United States Patent 6,812,339 (POLYMORPHISMS IN KNOWN GENES ASSOCIATED WITH HUMAN DISEASE, METHODS OF DETECTION AND USES THEREOF) - sequence listing, part 100

SEQ ID NO: 133010 - DNA, 601 bp, Human
tgtttatgaacatatgaatccgttgcattctgaggacccttctctttaagattttcttttgaagtaggcatatgcaacacaggaccatactcattacgaagcttgattgccatttttcgtttgtgactatttagaaattataaacataagaacgtatccataaatactttaaaacaaacacttagcttaagtttgcccattcacgtagaaaaagtttctagtatgattttaagtagtatttaaaagaatcaaaaatttccaagggcatttccccaccatatctgttcttttgcttacattsgaccacacagcattcattaaacctacgtaatattttagtttgttacctaataaatagaaaaccttttatgataaattgtcaagggtctgactgaaagatatacagaaactaacataccctttaagaaacctcaaagtcaatatactttccttcaaaatataaatatagtaaaaactctatagcaacctttactagatgtatccaaacaggttagttagaactaatcaaagtacttaattggttcaatatcttaaaaagaaatgcatttatattacttttaaaaatagtctactttataaa

SEQ ID NO: 133011 - DNA, 601 bp, Human
tcatctctttaaatgtatcaagtaatattaagttttcaactggatctatcaaattttctcaactaaagtcaagcctcagaaataagggaagttgatcacttttgctttgatctctgtaaaccatgtccttgaccatttgctatatagcaatggtatacaaagaagccctcctatcaagtgacaatccactctggtatttcttccaagcaaatggtttcctgtggaatcttgaattctctttacttattaagatttcagtatttaatttcatctttctgaattacagacaagatagatggtrtcctcacaggttaagaatattctccaattttttcctttaatctctactgtgaccttctccacactctaagaatctctgccatcattatactaccatttttatttcctataagaaaaaagtcatcaacagtattcccatgaggatcaaaacttccattataatacaggtacggccattaaatactgtacgaccacaataagtcctgccaggaggggcaaaaataacatattttatttttctgtttttaaaattcacatataagtctgacatttctgataataccatactcaccttgattgg

SEQ ID NO: 133012 - DNA, 601 bp, Human
tagctcaggctgctatttatcttaataattccaaagaagagggaaatatggcaacatgttccaaaagttagaaacctgctatttgatgcagaaaaacttactgaattcatcgctgtaggctgtggacggtcagaagccccaggatgtcggtattcacttccactaggggcagtacgatttgcatcagccctggggcaaaagaaataatattttcaaagtaattaatgcctccagtcatgtattctgcaaaactaaccctttattttaaattgttataaagtcctgataaaggaaaatgtcrtataatagttataaagaaattttaaaaagaaaaaatgtgaacagtgaaatatgcttttaagatctttgtaattataatatttcatacttggtctgcaaaggtaatgccaccgctaaggactgtgcagctgattcacttggcattctctggatcttagtatctgctgtcaaagcaacccctattaaaatgaaaaatcaacttcttttagtagctgtgtattattcatttacatgcacttaaaataaaatgatgaaggaaaacatacaccaaatgtttattatctccaggcagtgatattat

SEQ ID NO: 133013 - DNA, 601 bp, Human
actgcctgatataccatctgttgttagcagtcatctagtcatccaaaacataaataagcccataaagttcctgccctcaagaagcttaaattataccctcataaggagggtagagagcctggacagaagacgtgctctgaatggaataaaggaggaaaggagatgtggcagttacacattcattcacttcataaagtcaaatcaattgcataatgagctgagaagcaaaaccagcacttatttcaagtggcagcatattttattatgctgcagataaatcaataaaataactatagaaaaatcaacaactatttctaccatactaataccagttgccatttacttacaaacagataaacttatttctaaatgctcatttataagactagttgtatagcccatgaatagtacaacactaacagcactcaagataactgtacacaccaacttaaaatttaataaaaaaaaaaagactttcatattcaatacatactaacacaagtttcagaaaaactctccttgcatttttaatagtgggcaataaataccaacatcacattatctttatcaaaatatatattacacacaatgtacaagtaga

SEQ ID NO: 133014 - DNA, 601 bp, Human
gtaacaatcatgtaacctctatgtggctcacctgtaaaatgggaagaatagtgcctatttcatagggttactacaaagatttaataagtagtaaatgctccatgtaagctcccaatattaaagtcattttaagtgtattagtgccactgtctttcattgtcatattttaacattattggtttaatatagcaaagactgacagttccttctatttatcttctaatacaatatttaaatactattttaacaggtatactgcctgatataccatctgttgttagcagtcatctagtcatccaawacataaataagcccataaagttcctgccctcaagaagcttaaattataccctcataaggagggtagagagcctggacagaagacgtgctctgaatggaataaaggaggaaaggagatgtggcagttacacattcattcacttcataaagtcaaatcaattgcataatgagctgagaagcaaaaccagcacttatttcaagtggcagcatattttattatgctgcagataaatcaataaaataactatagaaaattcaacaactatttctaccatactaataccagttgccatttacttac

SEQ ID NO: 133015 - DNA, 601 bp, Human
agagcacacatcactgtgtacgggttcaaaacccagcttggccaattactagctgtttgacattaggtaacaatcatgtaacctctatgtggctcacctgtaaaatgggaagaatagtgcctatttcatagggttactacaaagatttaataagtagtaaatgctccatgtaagctcccaatattaaagtcattttaagtgtattagtgccactgtctttcattgtcatattttaacattattggtttaatatagcaaagactgacagttccttctatttatcttctaatacaatatttamatactattttaacaggtatactgcctgatataccatctgttgttagcagtcatctagtcatccaaaacataaataagcccataaagttcctgccctcaagaagcttaaattataccctcataaggagggtagagagcctggacagaagacgtgctctgaatggaataaaggaggaaaggagatgtggcagttacacattcattcacttcataaagtcaaatcaattgcataatgagctgagaagcaaaaccagcacttatttcaagtggcagcatattttattatgctgcagataaatca

SEQ ID NO: 133016 - DNA, 601 bp, Human
agtttggctagttagcttggtagcacaatagagtgactacagttaagagtaatttattgtatatttcaaaataactagaagagtaaaattggaatgttcctaatacaaagaaataatatcccaattaccgtgatttgatcattacacactgtatgtttttctttgttttttgttttgagatagggtgtcactctgtcgcccaggctggagtgcagtggcgtgatcttggctcactgcaacctccgcctcctgagcccaagtgatcctcccacttcagcctctggagtagctgggactacargtgtgctccactacacatagccaatttttgtatttttttgtagaggcggggttttgttgtgttgcccaggctggtactgaactcctaggctcaagagatgcgcttgcctaggcctcccaaagcactgggattataggcatgagccaccatgcctggcctacacactgtatgcttgtatcaaatttgatatgtagcccataaatatgcacatctattatgttagccataaaaattaaaaataaattagaactgaaattattgaaaaaaaataagacaactatagtgatagaaaacagatca

SEQ ID NO: 133017 - DNA, 601 bp, Human
taagatttagtgtttggtagcactagtttggttagctagtttggtagcactagtttggctagttagcttggtagcacaatagagtgactacagttaagagtaatttattgtatatttcaaaataactagaagagtaaaattggaatgttcctaatacaaagaaataatatcccaattaccgtgatttgatcattacacactgtatgtttttctttgttttttgttttgagatagggtgtcactctgtcgcccaggctggagtgcagtggcgtgatcttggctcactgcaacctccgcctcytgagcccaagtgatcctcccacttcagcctctggagtagctgggactacaggtgtgctccactacacatagccaatttttgtatttttttgtagaggcggggttttgttgtgttgcccaggctggtactgaactcctaggctcaagagatgcgcttgcctaggcctcccaaagcactgggattataggcatgagccaccatgcctggcctacacactgtatgcttgtatcaaatttgatatgtagcccataaatatgcacatctattatgttagccataaaaattaaaaataaattagaa

SEQ ID NO: 133018 - DNA, 601 bp, Human
taatgtgtgtacactggctttagttctcacatcccaaatctataaaaacacaatagacatattaggaaagagaataggtattcattatctcaagaagataactggatcaattcaaggctgaaaatttactacataactagtgcctgaatataataaagaaaatgcttaagtgaaagataatgatttacaaactggaggacgaatataaataggagacaacttgcaagaattctaaaaagctaaaagatcagggtactgaaaatctaagaatgagtatgatgggactactttttaagactaytgaatgaaagaactaatggacaatagttgttacagaatggaacgtgagaatatcacatttcaggggcagggcactaataacactaacatggtgaggccatacaactgaagactaaggtggaaaaaaatgcaagttaagaaacttagggactaggatattgatgactcaagacagctatctttaattctctatcaatcaattgaagacactgaaaccgaaagtgcaccctacaagatgcaatatatttacagataaatacacaactctatcccatttacccgtgcagttgaatctcgacta

SEQ ID NO: 133019 - DNA, 601 bp, Human
ctaaatgactgccaaaagcagtgctaacaccactagcatttcagcattatcttaagaactgaagaaaaacaagaagctaattaggaaaatacacttactgtcttggatgtaaaaccacagccctaactgattttttgtgatttgttaatgtcactcttgtttttccagccaccagatcccataatcgaattgtagtatcatggcttcctgtaatggaaacacatatatccctcaaaacatagaccaggaaaaataatgcaaaagttaaataaaatacaaagcattcttccaaaacacataygttctaaatgaaagtcatatcacacgcaaattagtcttggctaatttcttcatagttccaaatttttaggttgattttaattctttaaaaaaatgcaatacaacaattgattcactgtcaattgaacagctaaaacaaatgcaaataacaaataaatatataattgtataccctagtgaaaaggaaaaaacttcaatgatttttttaagttaataaaatacatcaggcaaaggaattattttgctagtattaaagatccattgttactaactttatttagagcaaagtaagattcaaatc

SEQ ID NO: 133020 - DNA, 601 bp, Human
ttcaaatgtcctaattatcggtttcatacattttttttaaaaaagggggttttctaataagactgtcaaaatattacatctagaatagttatgttcaataaacctgcatttacttgatatctgcatcttcctagtatcacaaattgttttagaaataaaaacacaggggtaggggacaggggacagtttattgtaaaatatgaagcagcaatgattgaagcaagtgaatttctcctttatattcccagccagagcacaaaatgactggatatcctcatgaacgccaagcttttttttttttaattaaaaagaaaaaaaaagagagagaaaaaattccacattcattaaaatctctttctcttgataatttctggtttccagctgactggatgagtttcttctgtctaaaaatagaaaagtgagttaaaataaagtattattagtttgcttcatgtctaataggcttcctttctaacaaaaataaggtatctaacattattcattggctttatacacttagttctttgacagttttaggaagagttgataaacttctggcattatccaagtctaataacagatggatggattcattatgttt

SEQ ID NO: 133021 - DNA, 601 bp, Human
tgtgctatttcctgaacagtatctagtgcagaactttgtagaacatacactcaaaaactgtttttggaataaacatacataaattaagacttcaaatcttttaatctcaaattattagtcacagatgttattttttaaaggactaaaaaaaaactactgctccttcaaatgtcctaattatcggtttcatacattttttttaaaaaagggggttttctaataagactgtcaaaatattacatctagaatagttatgttcaataaacctgcatttacttgatatctgcatcttcctagtatmacaaattgttttagaaataaaaacacaggggtaggggacaggggacagtttattgtaaaatatgaagcagcaatgattgaagcaagtgaatttctcctttatattcccagccagagcacaaaatgactggatatcctcatgaacgccaagcttttttttttttaattaaaaagaaaaaaaaagagagagaaaaaattccacattcattaaaatctctttctcttgataatttctggtttccagctgactggatgagtttcttctgtctaaaaatagaaaagtgagttaaaataaagtatt

SEQ ID NO: 133022 - DNA, 601 bp, Human
ttatatatagatgagactgtgaatagcaatatcccaactaaccttcgtgtgcttcgttcaatcctggaaaacctgagaagcaaaatacaaaagttagaatctgatgtctcagctcaaatggaatattgtcgcaccccatgcactgtcagttgcaatattcctgtggtgtctggcaaaggtaactgattcataaacatatttttagagagttccagaagaactcacacaccaaaaataagagaacaacaacaacaacaaaaatgctaagtggattttcccaacagatcataatgacattacrgtacatcataaaaatatccttagccagttgtgttttggactggcctggtgcatttgctggttttgatgagcaggatggggcacaggtagtcccaggggtggctgatgtgtgcatctgcgtactggcttgaacagatggcagaaccacagatagatgtagaagtttctccattttgtgtgttctgggagctcatggatattccaggacacaaaaggtggagaagagctttgttcatcctcttagcagataaacgtcctcaaaactgggttggacttactaaagtaaaatgaaaatctaata

SEQ ID NO: 133023 - DNA, 601 bp, Human; identical to SEQ ID NO: 33895

SEQ ID NO: 133024 - DNA, 601 bp, Human; identical to SEQ ID NO: 33896

SEQ ID NO: 133025 - DNA, 601 bp, Human; identical to SEQ ID NO: 33897

SEQ ID NO: 133026 - DNA, 601 bp, Human; identical to SEQ ID NO: 33898

SEQ ID NO: 133027 - DNA, 601 bp, Human; identical to SEQ ID NO: 33899

SEQ ID NO: 133028 - DNA, 601 bp, Human; identical to SEQ ID NO: 33900

SEQ ID NO: 133029 - DNA, 601 bp, Human; identical to SEQ ID NO: 33901

SEQ ID NO: 133030 - DNA, 601 bp, Human; identical to SEQ ID NO: 33902

SEQ ID NO: 133031 - DNA, 601 bp, Human; identical to SEQ ID NO: 33903

SEQ ID NO: 133032 - DNA, 601 bp, Human; identical to SEQ ID NO: 33904

SEQ ID NO: 133033 - DNA, 601 bp, Human; identical to SEQ ID NO: 33905

SEQ ID NO: 133034 - DNA, 601 bp, Human; identical to SEQ ID NO: 33906

SEQ ID NO: 133035 - DNA, 601 bp, Human; identical to SEQ ID NO: 33907

SEQ ID NO: 133036 - DNA, 601 bp, Human; identical to SEQ ID NO: 33908

SEQ ID NO: 133037 - DNA, 601 bp, Human; identical to SEQ ID NO: 33909

SEQ ID NO: 133038 - DNA, 601 bp, Human; identical to SEQ ID NO: 33910

SEQ ID NO: 133039 - DNA, 601 bp, Human; identical to SEQ ID NO: 33911

SEQ ID NO: 133040 - DNA, 601 bp, Human; identical to SEQ ID NO: 33912

SEQ ID NO: 133041 - DNA, 601 bp, Human; identical to SEQ ID NO: 33913

SEQ ID NO: 133042 - DNA, 601 bp, Human; identical to SEQ ID NO: 33914

SEQ ID NO: 133043 - DNA, 601 bp, Human; identical to SEQ ID NO: 33915

SEQ ID NO: 133044 - DNA, 601 bp, Human; identical to SEQ ID NO: 33916

SEQ ID NO: 133045 - DNA, 601 bp, Human; identical to SEQ ID NO: 33917

SEQ ID NO: 133046 - DNA, 601 bp, Human; identical to SEQ ID NO: 33918

SEQ ID NO: 133047 - DNA, 601 bp, Human; identical to SEQ ID NO: 33919

SEQ ID NO: 133048 - DNA, 601 bp, Human; identical to SEQ ID NO: 33920

SEQ ID NO: 133049 - DNA, 601 bp, Human; identical to SEQ ID NO: 33921

SEQ ID NO: 133050 - DNA, 601 bp, Human; identical to SEQ ID NO: 33922

SEQ ID NO: 133051 - DNA, 601 bp, Human; identical to SEQ ID NO: 33923

SEQ ID NO: 133052 - DNA, 601 bp, Human; identical to SEQ ID NO: 33924

SEQ ID NO: 133053 - DNA, 601 bp, Human; identical to SEQ ID NO: 33925

SEQ ID NO: 133054 - DNA, 601 bp, Human; identical to SEQ ID NO: 33926

SEQ ID NO: 133055 - DNA, 601 bp, Human; identical to SEQ ID NO: 33927

SEQ ID NO: 133056 - DNA, 601 bp, Human; identical to SEQ ID NO: 33928

SEQ ID NO: 133057 - DNA, 601 bp, Human; identical to SEQ ID NO: 33929

SEQ ID NO: 133058 - DNA, 601 bp, Human; identical to SEQ ID NO: 33930

SEQ ID NO: 133059 - DNA, 601 bp, Human; identical to SEQ ID NO: 33931

SEQ ID NO: 133060 - DNA, 601 bp, Human; identical to SEQ ID NO: 33932

SEQ ID NO: 133061 - DNA, 601 bp, Human; identical to SEQ ID NO: 33933

SEQ ID NO: 133062 - DNA, 601 bp, Human; identical to SEQ ID NO: 33934

SEQ ID NO: 133063 - DNA, 601 bp, Human; identical to SEQ ID NO: 33935

SEQ ID NO: 133064 - DNA, 601 bp, Human; identical to SEQ ID NO: 33936

SEQ ID NO: 133065 - DNA, 601 bp, Human; identical to SEQ ID NO: 33937

SEQ ID NO: 133066 - DNA, 601 bp, Human; identical to SEQ ID NO: 33938

SEQ ID NO: 133067 - DNA, 601 bp, Human; identical to SEQ ID NO: 33939

SEQ ID NO: 133068 - DNA, 601 bp, Human
aacatctgcagtgcaattgaagttaccagtcatctgcagtctaaaaagaaagtgattttgggaggtgcgtagaaaaaatcatcttattatttttcctctatattacttttttctttttttctcctgaagaaacttttttttttggtgataccttctttttctctagcacgtataattttggaagcatttttcatatgcagtgtatacttcagaaagagagagagagagaggaaaattgtcctgttcagcgtttgcatttccattattcctgctattagttaaaaacaacaacaacaacaamaaacaagcaggatacctagatctggaaaagggagaattgtgtagagctgtcttcctaaagttctgagttagggctgcctcagaccactttcataactatctccagtggctttgtgttttatatttattaagatagagaaaaaaagagtaattactaagggcagctgctgtagctttatggtgattactgaacattgacatgctgtcacgtttttggaactttgagtatttaatcactttgggatattctattttcccccatcttgagtgtggacagatgctggtgatgtagccttctggg

SEQ ID NO: 133069 - DNA, 601 bp, Human
aaaaatcatcttattatttttcctctatattacttttttctttttttctcctgaagaaacttttttttttggtgataccttctttttctctagcacgtataattttggaagcatttttcatatgcagtgtatacttcagaaagagagagagagagaggaaaattgtcctgttcagcgtttgcatttccattattcctgctattagttaaaaacaacaacaacaacaaaaaacaagcaggatacctagatctggaaaagggagaattgtgtagagctgtcttcctaaagttctgagttaggrctgcctcagaccactttcataactatctccagtggctttgtgttttatatttattaagatagagaaaaaaagagtaattactaagggcagctgctgtagctttatggtgattactgaacattgacatgctgtcacgtttttggaactttgagtatttaatcactttgggatattctattttcccccatcttgagtgtggacagatgctggtgatgtagccttctgggcacagagcaagcctccccctcagcctctgcaccagaaaggctcagcttcacacactccaagtatgttttctac

SEQ ID NO: 133070 - DNA, 601 bp, Human
gtgttttatatttattaagatagagaaaaaaagagtaattactaagggcagctgctgtagctttatggtgattactgaacattgacatgctgtcacgtttttggaactttgagtatttaatcactttgggatattctattttcccccatcttgagtgtggacagatgctggtgatgtagccttctgggcacagagcaagcctccccctcagcctctgcaccagaaaggctcagcttcacacactccaagtatgttttctacaagaactacactttgtggctttctgacccaaacatttttrtactaaattacacacaacaaagttgtagctcagagagggaacaaatggcttatttaggccaccattttcttgagccattatgatttcacacagggctcccttggccctgtaaattggcaaggattccattattcaacccgcatacatgtacagagaccctgctctggcccagatagtattctgggtacaggcggatagagcaggaaacaaaacagctacagtgatggacaggtcagcctgcagcaatgcctgcagtctctgcgaaggtagctgtatgggtgggcaggtggctagcactta

SEQ ID NO: 133071 - DNA, 601 bp, Human
agcaagcctccccctcagcctctgcaccagaaaggctcagcttcacacactccaagtatgttttctacaagaactacactttgtggctttctgacccaaacatttttatactaaattacacacaacaaagttgtagctcagagagggaacaaatggcttatttaggccaccattttcttgagccattatgatttcacacagggctcccttggccctgtaaattggcaaggattccattattcaacccgcatacatgtacagagaccctgctctggcccagatagtattctgggtacaggcrgatagagcaggaaacaaaacagctacagtgatggacaggtcagcctgcagcaatgcctgcagtctctgcgaaggtagctgtatgggtgggcaggtggctagcacttattcagctctggaaggatctcccctctggcctctcccctgacacccatcaataaaactgaggagcatcggtggacaggggaccttgtgccccctccctgcctgtgcagttggggctgaacccagctacgaagtttgagctcactctctccagctccctctcaattcagagctgaactgtgggaagcttcagagc

SEQ ID NO: 133072 - DNA, 601 bp, Human
gaactacactttgtggctttctgacccaaacatttttatactaaattacacacaacaaagttgtagctcagagagggaacaaatggcttatttaggccaccattttcttgagccattatgatttcacacagggctcccttggccctgtaaattggcaaggattccattattcaacccgcatacatgtacagagaccctgctctggcccagatagtattctgggtacaggcggatagagcaggaaacaaaacagctacagtgatggacaggtcagcctgcagcaatgcctgcagtctctgcraaggtagctgtatgggtgggcaggtggctagcacttattcagctctggaaggatctcccctctggcctctcccctgacacccatcaataaaactgaggagcatcggtggacaggggaccttgtgccccctccctgcctgtgcagttggggctgaacccagctacgaagtttgagctcactctctccagctccctctcaattcagagctgaactgtgggaagcttcagagctctctgtttcaaggacaggttctcctcacctctcctaatggaggtgcaccagggaactggccctgctctg

SEQ ID NO: 133073 - DNA, 601 bp, Human
cttgaagtcagtggcatggacagggtcaagatcacagttagaggatgcagccttagagaaaaggaaggggctcggttctctgagcaaggagggaaagaagagaggcagatgcagagaagtacggcacatcgtgctgctggttgtagaaataacctctgacttttaataaagtcatccctcggtatccctgggggattagttctatgacctccctcggatgccaaaattcgtggatgctcaagtccctgatataaaatggcatagtatttgcatttaacctacacacatcctccatatcctttttttttttttttttttttttgtgagatggagtcttgctctgtcgccctggctggagtacagtggctcgatcttggctcactgcaagctccgcctcccgggttcatgccattctcctgcctcagcctacaggtgcctgccaccacgcccagctaattttttttttgtattttttagtagagacagggtttcaccatgttagccaggatggtctcgacacatcctccatatactttaagtaacctctagataatctctagattacttgttttgtctttttttttttttttttctttttgag

SEQ ID NO: 133074 - DNA, 601 bp, Human
gagaagtacggcacatcgtgctgctggttgtagaaataacctctgacttttaataaagtcatccctcggtatccctgggggattagttctatgacctccctcggatgccaaaattcgtggatgctcaagtccctgatataaaatggcatagtatttgcatttaacctacacacatcctccatatcctttttttttttttttttttttttgtgagatggagtcttgctctgtcgccctggctggagtacagtggctcgatcttggctcactgcaagctccgcctcccgggttcatgccattytcctgcctcagcctacaggtgcctgccaccacgcccagctaattttttttttgtattttttagtagagacagggtttcaccatgttagccaggatggtctcgacacatcctccatatactttaagtaacctctagataatctctagattacttgttttgtctttttttttttttttttctttttgagatggagtttcactcttgtcacccaggctggagtgcaatggtgcaatctcagttcactgcaacctccgcctcctgggttcaagcaattctcctgtctcagcctcctgtgtagct

SEQ ID NO: 133075 - DNA, 601 bp, Human
aaattcgtggatgctcaagtccctgatataaaatggcatagtatttgcatttaacctacacacatcctccatatcctttttttttttttttttttttttgtgagatggagtcttgctctgtcgccctggctggagtacagtggctcgatcttggctcactgcaagctccgcctcccgggttcatgccattctcctgcctcagcctacaggtgcctgccaccacgcccagctaattttttttttgtattttttagtagagacagggtttcaccatgttagccaggatggtctcgacacatcytccatatactttaagtaacctctagataatctctagattacttgttttgtctttttttttttttttttctttttgagatggagtttcactcttgtcacccaggctggagtgcaatggtgcaatctcagttcactgcaacctccgcctcctgggttcaagcaattctcctgtctcagcctcctgtgtagctaggattacaggcccctccccaccccccccaacaactggctaatttttgtatttttagtagagatggggtgtcaccacgttggcctggctggtcttgaactcctgacctca

SEQ ID NO: 133076 - DNA, 601 bp, Human
acagggtggctttctgatgacaacattcctctgcttaaacctgtcagtaattccttgttgctctcagacggaactaagttctgaatttcttcacacggctctcagcaaggtcacagtcaccctgctaggccccaggggcaaatctcaatggtcatcttcttgaagacctggctcagttatttctttctcattgaggctcacgaccccaccttcttgcatgcctcaaacggccccttaccatgctcttctttcgcccatagctcagcacaccgtatcattttaatttatgtattttgcttartgtggatgatctgtctcctcctctgctgtcctcaccagagcatcagttcctcaaaccaaggctctttgttttgttcttggatgcaagctaaatgtctggcatgtggcaaatggtcatagatacatgtcattgaaagaatgattcatcacctccctctttggccttgtctgtggttctaccaaatcccattccctccccagtgccctccattccccctccttggctgaacattctgaaccacagacagttctttaccctgaacctttgcatattttgttctcttagcttagagcggcccct

SEQ ID NO: 133077 - DNA, 601 bp, Human
catattttgttctcttagcttagagcggcccctctccctccgtctgcttggctaatttctacttgttcttcagattttatcttagatgtcattccctcaaggaatccttctgtgactcaacatggaattaagttgcctcctttgaccctgaaagcaccatgtactcaatctcatcttggcatgactcactttgctgtgtggaatgtctgctttccttgtttgtctattcctttagactgtaagatcctagaaagtgggggccgtgccttgctcatgactgtgtttctaacaccaaacacartgttcagtagagagcagctgctgagtacgtttctgctaaatgacagttgatggaggacatttagggttgcttggaggtcaagtcaaggaggcatttaacattctagtaaaacaaggaagtaacaggctcctgaacatgcccacaatgaaccagatgcaaaccttttcccttggcaggattctttgcccataaagtggagcacgaaagcaggacccagaatgggaggagcttccagaggaccggaacacttgcctttgagcgggtctacactgccaagtgagtcctaaacctgatgttgct

SEQ ID NO: 133078 - DNA, 601 bp, Human
acaccaaacacaatgttcagtagagagcagctgctgagtacgtttctgctaaatgacagttgatggaggacatttagggttgcttggaggtcaagtcaaggaggcatttaacattctagtaaaacaaggaagtaacaggctcctgaacatgcccacaatgaaccagatgcaaaccttttcccttggcaggattctttgcccataaagtggagcacgaaagcaggacccagaatgggaggagcttccagaggaccggaacacttgcctttgagcgggtctacactgccaagtgagtcctaamcctgatgttgctaataagtgggggcatgggcaggggggcctccttctaggagtgatgaccacccttaataccacatgtctgtctgagccaagtttctgagcgccagggaggtgaggaaggttggacttcaccagagaggctttgtggacaccctttatcatcttagtgagtgctagtgtcaaaacaaagggagtggggatatggggcacattggtggagggaggtgtgatctctgcagcttcagaaagatctgaaagagtcatttggttagagaagttgacctatttcctgtggggttag

SEQ ID NO: 133079 - DNA, 601 bp, Human
gtgaggaaggttggacttcaccagagaggctttgtggacaccctttatcatcttagtgagtgctagtgtcaaaacaaagggagtggggatatggggcacattggtggagggaggtgtgatctctgcagcttcagaaagatctgaaagagtcatttggttagagaagttgacctatttcctgtggggttagaccagggttgctactgtgaacaccagccatgactcaccagtcaccttcagaagccacaggcaggacatgctgacgacagccttcaactcacccaccccttgctcccctgcrggtggaagtctggaggtgacaccactgcattttctaacacgggggctccttgagcaactagaacaagaacagaaagaatggggacattagcaggtgctttccccctctctcattcttttctttgaataaaaaggttgtttgaaaacacctgagcggctcctaaagatgggtgcaatctattcgggatgcaaatccgaatgaatgttattcaaatgctcctctcttctttatgcagagtgtatttcaaggctcagccagtggcaggcatgctggggactatggactacggactaggggcct

SEQ ID NO: 133080 - DNA, 601 bp, Human
gccacaggcaggacatgctgacgacagccttcaactcacccaccccttgctcccctgcgggtggaagtctggaggtgacaccactgcattttctaacacgggggctccttgagcaactagaacaagaacagaaagaatggggacattagcaggtgctttccccctctctcattcttttctttgaataaaaaggttgtttgaaaacacctgagcggctcctaaagatgggtgcaatctattcgggatgcaaatccgaatgaatgttattcaaatgctcctctcttctttatgcagagtgtatttcaaggctcagccagtggcaggcatgctggggactatggactacggactaggggcctgtcacagaggaaggcctcatgctagagagctaagggaggagctggccttcagttccatcccaggagcaactttgatgttcccagagatccttccaaagggggagtcatggtcacccaagaaaaatgtattcagaatgccaagaatggtgcaaactcaggacaaagattcacactgcagggttggagtccctgggcttgctgctggcaccatgggagggagggtccccttcaggggtaccgtt

SEQ ID NO: 133081 - DNA, 601 bp, Human
ggtaccgttggtttcctgtgaattaaactggcttcaagggatctcgactgaacaggcctatatcacactcactgatatactctctcttcagtccttctcctcatctaggtatttttaattgtttcagtgaggtgtaggcatgaggggattggagggggcatctcctccattgcagtttttcattggctgctttgctccctcagctccgaaatcgctgggccactctcgaacgcattagtacggtagtcacaggttgattgcctggccccttgccctctgtgggcattttccctctcagacwgcccctgagtactcacagtgctgctacagtgggccacctagatctccctctttctccatgctcccacgtgctctgggctccactcccttctcccaagcacttctgtccagggctattccagcagtctgacctcaaggaaatcctttgctaaactgattatagagaggtttctattttaacatttaggccttccatgtattaattctcagaatcaatttaagatgtttaaaggtgtgatttaagacattttaaaaccatttggaggagagtacagaaattatgtcacttgctgtcagcctc

SEQ ID NO: 133082 - DNA, 601 bp, Human
ttctgtccagggctattccagcagtctgacctcaaggaaatcctttgctaaactgattatagagaggtttctattttaacatttaggccttccatgtattaattctcagaatcaatttaagatgtttaaaggtgtgatttaagacattttaaaaccatttggaggagagtacagaaattatgtcacttgctgtcagcctctttgcaccatctgcagagaaagatactagagtcccgccttggacacatccacatgcaagaggtgcaaagaaggtgtctttgatgaggcaaggtcaaaactyctccccagacgaaatccaaagaaagcattcctactatgctatatcagtttggaaagaaaaacttctgccaggtgactgcattctcactggtcacattgtgttcctatggactcctcagctcaaccaatttggagaagttatggtgcaatttcaccatatctggctagaagttaagtttccaatttgctggcaatgaagaagaaatggagcaggccaggctgtgtagtttctgccacgtgcccccgggagtgaacagctctgtttgtaagaagccatggtgcttagacctgggcttgctag

SEQ ID NO: 133083 - DNA, 601 bp, Human
gagagtacagaaattatgtcacttgctgtcagcctctttgcaccatctgcagagaaagatactagagtcccgccttggacacatccacatgcaagaggtgcaaagaaggtgtctttgatgaggcaaggtcaaaactcctccccagacgaaatccaaagaaagcattcctactatgctatatcagtttggaaagaaaaacttctgccaggtgactgcattctcactggtcacattgtgttcctatggactcctcagctcaaccaatttggagaagttatggtgcaatttcaccatatctggytagaagttaagtttccaatttgctggcaatgaagaagaaatggagcaggccaggctgtgtagtttctgccacgtgcccccgggagtgaacagctctgtttgtaagaagccatggtgcttagacctgggcttgctagttgccagcctccaaattgcagaagtgccctttggttggtggctatgctgtgtcacttgggaaggtcgtttggaagttccacagtcgttgtggggtgccagagattaaaaagcgtaagaggagagtggaaagtgattgttgctgcttgggcatccccaccgtgtg

SEQ ID NO: 133084 - DNA, 601 bp, Human
aaactcctccccagacgaaatccaaagaaagcattcctactatgctatatcagtttggaaagaaaaacttctgccaggtgactgcattctcactggtcacattgtgttcctatggactcctcagctcaaccaatttggagaagttatggtgcaatttcaccatatctggctagaagttaagtttccaatttgctggcaatgaagaagaaatggagcaggccaggctgtgtagtttctgccacgtgcccccgggagtgaacagctctgtttgtaagaagccatggtgcttagacctgggctygctagttgccagcctccaaattgcagaagtgccctttggttggtggctatgctgtgtcacttgggaaggtcgtttggaagttccacagtcgttgtggggtgccagagattaaaaagcgtaagaggagagtggaaagtgattgttgctgcttgggcatccccaccgtgtgggtgctgcagcccagctctcaaaacccatgggtctgtacactcaacctccatgagagggaaggagaaggatgagggaggggagagatagccatggaaaggtaggaactaagcaggcagggtggaaagtttt

SEQ ID NO: 133085 - DNA, 601 bp, Human
tgggcttgctagttgccagcctccaaattgcagaagtgccctttggttggtggctatgctgtgtcacttgggaaggtcgtttggaagttccacagtcgttgtggggtgccagagattaaaaagcgtaagaggagagtggaaagtgattgttgctgcttgggcatccccaccgtgtgggtgctgcagcccagctctcaaaacccatgggtctgtacactcaacctccatgagagggaaggagaaggatgagggaggggagagatagccatggaaaggtaggaactaagcaggcagggtggaragttttctgtaagacaaaaactgtctggacactgctgcggttctgttacaaagaccacttcctccctgggccagcaacatatctgtgtgcctgtctgggttgtaaaaagggtcaaagatcaatgcagcaggcagctacatgctggcaaaagccagaggcagctggtctgtttgcctgtgccaggaaaccactgggaatggggttgtgtgttattctaggagaaagtcgtcccagcagcagcttctccaggggcatccaagagcactgaaaagggttgcaagatgacccatgaggctgcag

SEQ ID NO: 133086 - DNA, 601 bp, Human
tcgtcccagcagcagcttctccaggggcatccaagagcactgaaaagggttgcaagatgacccatgaggctgcaggaagaaaagaacatgcatttaatcttgctatctgaaaagtaagacatgaagctttcctcatttttaatatacacatggacagtagtatgtgtatatagtttatatgcaaatatacttgttataaggttgcatgctcaaaatttttggttcatggggtgtgggatcataaatgtttagggaccatggctatcaaggaaaaacagcatgaaggataaatgatactggyggattaaaaagacagatgcatgtatttttagcataaaacacaactgctgactgatacagatagctcaacattctggggcagctgctgaacagatacactagccagtgtggctcatcggctcagacttggccttaattaatgggctgtccctccacccatctcccatgagggcagagctgagccagggtttgagagctaaaaggaattggacctggactcagttcacgtgtatattttaattctaattaattcattcttttgaaagacagagtcacactctgttgcctaggctggagtgca

SEQ ID NO: 133087 - DNA, 601 bp, Human
ctgcaggaagaaaagaacatgcatttaatcttgctatctgaaaagtaagacatgaagctttcctcatttttaatatacacatggacagtagtatgtgtatatagtttatatgcaaatatacttgttataaggttgcatgctcaaaatttttggttcatggggtgtgggatcataaatgtttagggaccatggctatcaaggaaaaacagcatgaaggataaatgatactggcggattaaaaagacagatgcatgtatttttagcataaaacacaactgctgactgatacagatagctcaasattctggggcagctgctgaacagatacactagccagtgtggctcatcggctcagacttggccttaattaatgggctgtccctccacccatctcccatgagggcagagctgagccagggtttgagagctaaaaggaattggacctggactcagttcacgtgtatattttaattctaattaattcattcttttgaaagacagagtcacactctgttgcctaggctggagtgcagtggcacgatcttggctcactgcaacctcggcctcccaggttcaagttattctcctgcttcagcctcct

SEQ ID NO: 133088 - DNA, 601 bp, Human
ggttcatggggtgtgggatcataaatgtttagggaccatggctatcaaggaaaaacagcatgaaggataaatgatactggcggattaaaaagacagatgcatgtatttttagcataaaacacaactgctgactgatacagatagctcaacattctggggcagctgctgaacagatacactagccagtgtggctcatcggctcagacttggccttaattaatgggctgtccctccacccatctcccatgagggcagagctgagccagggtttgagagctaaaaggaattggacctggactcwgttcacgtgtatattttaattctaattaattcattcttttgaaagacagagtcacactctgttgcctaggctggagtgcagtggcacgatcttggctcactgcaacctcggcctcccaggttcaagttattctcctgcttcagcctcctgagtagctgggattataggcacatgcccccatgcctgactaatttttgtatttttagtagagacggggtttcaccatgtcaggctggtcttgaactcctgacctcaggttatccacccgccttggcccctcaaagtgttggaattacaggt

SEQ ID NO: 133089 - DNA, 601 bp, Human
gagtagctcctatttagacctcaaggaatgagactcaaaatgggttcatcagttctgttttgcagaaaaaatagcgcaaaatttctcaaaagaaaatccagaataataataatttgtcaataggaaagacatttccactgggggttaagaaggaagacattggaacaatgatagccaccacttattgaatgcttactgtgagccaggtggcacttcaccttgtttcattctcacaacagtctagggaagtaattactaatgtctccatccacctcttgtagatgagcaaattgaggctcaytgaggctaggaaatgcacccacactcacatagcccataagaggcagccatggcattgggcccagaccatgtgaacttcaaagactacacgagcagccactgggcagctgtcatggctaaagccacttgaattcagcccagcagcaaccccctctccaggaggggcacataagcttgcagctttgggtagaagctgcacttgaagtcctggatggcgagagggactggcttgagccagagccaggaacaaggctctgagaatattctggaaatccacaggaggaacccattttcttacagc

SEQ ID NO: 133090 - DNA, 601 bp, Human
accatcagaggaccacgaagattccattggtgaggcgcagataacctgatctctctgggttctctgcagggcacagatgaagggctggccattcccaagttctcagtggtaccactgaggcatgagaccctaatggtttgcatgagcagtttgaaaattgcatctttgtttttacctatataatcacatgaaacccgtggttctcaaacgtcagcaggcatcagcatcacatggagggcttgttaaaacagatttctgggccccaacacagagttttaaattctgaaggcctgaggtgggygtgaacatttgcatttctaacatgttctcgatgctgctgccgccgctggtcccgagagcatgcctggagaactgccaccttcgaccatggactgtgagaattcacatggacctcagaattataatcagtctctcagttttacagataaggaaactaaatccagagagattgttttgccaatggtgaacagctggttaaagtcaggatggagactttaatcctagtcaagtgacctttcctctgtatttatttccctccctttttatgcctctcaagtctagttacactgtttttcatgga

SEQ ID NO: 133091 - DNA, 601 bp, Human
ctgatctctctgggttctctgcagggcacagatgaagggctggccattcccaagttctcagtggtaccactgaggcatgagaccctaatggtttgcatgagcagtttgaaaattgcatctttgtttttacctatataatcacatgaaacccgtggttctcaaacgtcagcaggcatcagcatcacatggagggcttgttaaaacagatttctgggccccaacacagagttttaaattctgaaggcctgaggtgggcgtgaacatttgcatttctaacatgttctcgatgctgctgccgcckctggtcccgagagcatgcctggagaactgccaccttcgaccatggactgtgagaattcacatggacctcagaattataatcagtctctcagttttacagataaggaaactaaatccagagagattgttttgccaatggtgaacagctggttaaagtcaggatggagactttaatcctagtcaagtgacctttcctctgtatttatttccctccctttttatgcctctcaagtctagttacactgtttttcatggatgggcatatttattgtcctgatctggactgcagacttctcaggag

SEQ ID NO: 133092 - DNA, 601 bp, Human
gaagctggagaaggcaaggaaatggtttctcccctagaagttccagaaggattgcagccctgctaatatcttgactttatagccctttgagatttattttggatttctgacatcctgaaccatagtaaaagggtgttttttgtttttttgagacagagtcttgctctgttgcctgggctggagtgcagtggtgtgatcttggctcgctgcaacctccgcctcccaggttcaagtgattctcctgcctcagcctcctgagtagctgggattacaggtgcttgccaccacacctggctatttkttgtgtttttagtagagacagggtttcaccatgttggccaggctggtcttgaactcctgaccttgtgatctgcctgcctcagcctcccaaattgctgggattacaaggcgtgttgttttaagccactcagtttgtggccacttgttacagcagcaagaggaaactcatacagttatcatgtgaactcacaggaatatggtgagttaaaaagagaggaagggtgcaaaacatccacggtagagtgagaactctccagggagtgaggactgtgcacagcatacagtgatcaccctcttagta

SEQ ID NO: 133093 - DNA, 601 bp, Human
ggtgcttgccaccacacctggctattttttgtgtttttagtagagacagggtttcaccatgttggccaggctggtcttgaactcctgaccttgtgatctgcctgcctcagcctcccaaattgctgggattacaaggcgtgttgttttaagccactcagtttgtggccacttgttacagcagcaagaggaaactcatacagttatcatgtgaactcacaggaatatggtgagttaaaaagagaggaagggtgcaaaacatccacggtagagtgagaactctccagggagtgaggactgtgcmcagcatacagtgatcaccctcttagtaagctaagtttctgagcaccagcttttttgagttgactttgttgtctttaacatttgaagatcacccttctttgctcagcctggcttgcagacctgggctgatttgtggatctgatagaaaagtttccttagttgggctcttctccccgaccacccccatgccagtgtggccacatcctctgtctgcattgctcactcttcaattccaagaagcgcaggggcaccgccaggaacaggaaccctgccagaggaatacatcaagaaaccaagtctc

SEQ ID NO: 133094 - DNA, 601 bp, Human
ctgtcacttggctcttctgctaataagcttccagtgtggtggccctccttcaggcatgtttccactgagccacgggctggatgccacatccccggccttcccacagttatcagcagcccacaggcttgacttgagcaagttggaaagacaaatcaacttccagagttgatttaacattgagtggaaatcagtcatacttttggtcccctttcggggccacgcctggcactgtgcctggtggcagatcggcatgaactggccagcttctgtggccctggagggcacaggcagaaaggccacrctcagtcccatgatgaactgtttaagacttattgttgtctccccgctctgtaaagtagatagagtggattttatgtcccttattacctttcaggatactttgactcagggagataaagtaacttgggtacagctactcagctggtgaagaacacaggcagaatgagtgcctgggtcttttgacttaaaattctggatttttcacaaagatcctcttactttattcatttacataataaatatatattgaagagctactctgtgccaagccctgtgcctagatatacagtgataaataaag

SEQ ID NO: 133095 - DNA, 601 bp, Human
tggagactcaagttcccaaaacgccaggagcactgcggcaggtgaaaagtattccctcaatggcggaagtgtttaaattgcttttatatctgtagctctagataacactagttccagcttagttaactcccagctccaagccttcaggacttcatagagttattggggtgctgctcttggcagtttcccaaaaagctagaatgcagagggaatctccttcccaaaaagctagaatgcagagggaatctccttcccaaaaggctagaacgcagagggaatctccttcccaaaaggctagaaygcagagggaatctccttcccaaaaggctagaatgcagagggaatgtccttctcttctaaatggtagctgttagttcaagaaaggttaaacattgtgctgtggggaggctcaggggtgaagggtgtacttttaagagaaccagtttcagagctgggtttggggtttaagccctaccctctgcccccttttacgagctgacagccttatgcaagcctggttgaccacctgaacccacgtttccacatctggaaatagaaatgtgggtactagttatgttgaaaggactcaggttagatgata

SEQ ID NO: 133096 - DNA, 601 bp, Human
tgctagattttgtgaccaatgttgattgcctaattgggctaacagcatgttttggtggctacgaaactgacacaggtgttttcatttctccacttagttcctgctgcgtttgctggactgatgtacttgtttgtgaggcaaaagtactttgtcggttacctaggagagagaacgcagaggtaggtaactgggactactaaagaactgtggagcgattcctgatttttgagcaggaagagtgacaattcaaaacagtatttgactagattcacggctccgtagcatccccttgggtgggagsgggaaggctgactaggacctctgattcttctttccctgagctttgaaggctctgaaaatacagctggggggacttgcccagttttcttattaagcaattcctccgcatggtgctggctttcaaagggtgcttcagtgctgtttgctgcacgtgccttgcagccccacaccctgcactcccgccctgcagagtctggcgctggaatgacattttaggtctgggttcccaggcctcctgagagtgaaatgtttcattgtttgtctagagaaatgagaactaaagcttgcaccttgtgataag

SEQ ID NO: 133097 - DNA, 601 bp, Human
attgggctaacagcatgttttggtggctacgaaactgacacaggtgttttcatttctccacttagttcctgctgcgtttgctggactgatgtacttgtttgtgaggcaaaagtactttgtcggttacctaggagagagaacgcagaggtaggtaactgggactactaaagaactgtggagcgattcctgatttttgagcaggaagagtgacaattcaaaacagtatttgactagattcacggctccgtagcatccccttgggtgggagggggaaggctgactaggacctctgattcttctytccctgagctttgaaggctctgaaaatacagctggggggacttgcccagttttcttattaagcaattcctccgcatggtgctggctttcaaagggtgcttcagtgctgtttgctgcacgtgccttgcagccccacaccctgcactcccgccctgcagagtctggcgctggaatgacattttaggtctgggttcccaggcctcctgagagtgaaatgtttcattgtttgtctagagaaatgagaactaaagcttgcaccttgtgataagttgtcctgaggaacatatctttcagggaccag

SEQ ID NO: 133098 - DNA, 601 bp, Human
gtctggcgctggaatgacattttaggtctgggttcccaggcctcctgagagtgaaatgtttcattgtttgtctagagaaatgagaactaaagcttgcaccttgtgataagttgtcctgaggaacatatctttcagggaccagaagaaagaatgttgggaaaataagatgcagtaagatgcagacatgacagcagggtgcagcggctcacgcctataatcccagcactttgggaggctgaggtgggtggatcacctgaggtcaggagtttgagaccagcctggccaacatggtgaaaccccrtctctactaaaaaatatacaaaacattagccaggcatggtggtgggcgcctgtaatcccagctactccataggctgaggctggagaatcgcttgaacccaggaggcagaggttgcagtgagccgagattgcgccactgcactccagcctgggcaacaaaagcaaaactccatctcaaaaaaaaaaaaaaaaaaaaaaaaaaagatgcagacacgagactgtgaaactgactagcatcaccattgcattgtttatagatgttgccagacagaaagccccaaagcagcacagtaccttcctg

SEQ ID NO: 133099 - DNA, 601 bp, Human
tgatattctttattctcttttgccctggaaaacctctatcatgccttttcccatgtgattacctcgttaagagtgggggtggaatgtctagcaatgaaataagagggtcttctcttttgcctggctccctatgcagccctatcttaccccctgcaaagtcccagggatgtggctcagtcactgctcctctcttcatctgtcaccacttgcttgagatcctacagctgctttaattccgagaccatctgcagaacatgacaaaatttgtccacctacccacatgtccttttaactttaaagsctttactaactgattcctattagggaatgaacagaggtggcaaaaataaacaataggagattgatttacaagaaatctttaaaatagtagatttcttcggacctcattgaaatataaatggcctgccttcttgtgtccctccctggtctccctctttaggtgataagaagaagatcctgccagccccataacccgccatctgcgcgggttctagacccccttctcctcccctctggccgtggtaggcattactgatgaatcatggtgctctttcttccagagaccaaacctggcctcgga

SEQ ID NO: 133100 - DNA, 601 bp, Human
cacatgtccttttaactttaaaggctttactaactgattcctattagggaatgaacagaggtggcaaaaataaacaataggagattgatttacaagaaatctttaaaatagtagatttcttcggacctcattgaaatataaatggcctgccttcttgtgtccctccctggtctccctctttaggtgataagaagaagatcctgccagccccataacccgccatctgcgcgggttctagacccccttctcctcccctctggccgtggtaggcattactgatgaatcatggtgctctttcttmcagagaccaaacctggcctcggaatccttcttaacacagatactgcttaacacaaccactctgagcagctgtcataagtagaagtaatagatactagaagaaatgtctaagcctaatctagaccaaaatacggcctgatatagatgcaagccagaggggctttatggttaaatgcaaggagattttcaaccctgccgtctagaagctacttgctgagatcttcttcagttgggcccatctcctccccaggcctctcttctgttcctgggctatgtcacacttggactctgcagacaccta

SEQ ID NO: 133101 - DNA, 601 bp, Human
cctgccagccccataacccgccatctgcgcgggttctagacccccttctcctcccctctggccgtggtaggcattactgatgaatcatggtgctctttcttccagagaccaaacctggcctcggaatccttcttaacacagatactgcttaacacaaccactctgagcagctgtcataagtagaagtaatagatactagaagaaatgtctaagcctaatctagaccaaaatacggcctgatatagatgcaagccagaggggctttatggttaaatgcaaggagattttcaaccctgccgtytagaagctacttgctgagatcttcttcagttgggcccatctcctccccaggcctctcttctgttcctgggctatgtcacacttggactctgcagacacctaatgctcttgggacctgctttagttcttgacctcaccaaccgaggaggaattgctcgatgagatccttcccccggaatttctctcttgaaccccagatggtccgttgcccctttccagaagttgctccagccctgtccgcttaggaagttcagtgtcatccttgatccagtgggtagggaagacattccataatgtatgc

SEQ ID NO: 133102 - DNA, 601 bp, Human
aagtactgggagtataggcataagccacccatgatgcccagcctgaatcttggtttcttccccattcatttaagctattacctgggcctgaactcaatggcacctggcaccaactggcaactgactcttggtcttttattacctaccttccctagcaggcactgggttgctccctcttcctatcccatggagtcctgtcctctgttggggctcctactgatcctcttggcaatatgaagttctcagctcaatggtgggtgggcaatgactgccaactcttgaggccaatgaactcaggttwccccactcctcctcctcctgagttgctcactcactcctcattcactcaacattgattcagtagatatttgctacctgctctgtgccaggtaccaggtcagttgctgaaggagtaacagtgaacatgacggagtctttgtccccaaggagacccaaggtgtctcctagagccaggggcacattgcaagaccaaatatattcaacttaccaaaataatcatagacctagttctcaaaaagcaagaagactgattcctcgttgtcatttctcctcctcagcatcaatgttttagagtctgtgg

SEQ ID NO: 133103 - DNA, 601 bp, Human
tacctcgtattttgttcacattaagaacctggggtgggaagtggaggagggggggtgactggcggggggccacagagagctgagctggggtggtctcgaactcctgaactcaagcaatctgccagcctcagtctcccaaagtgctgggattataggcatgagccacccacgatgcctgggtggaactcagggctctggatgcctgggcgcccccatctcccacactacggcgcctcatcctagaagtggttagcacctttgagatgggaattatttagcaggatgcttttgtgttttcatrtaagttttatgctgcctgtggagggcacagctgtttcaaaactaataaccaaatcctggtctccgaagtctgaaggcatcctttgccctgcagtgcaaagcacgggattctggcctcacacaggcaggtctgaactcctgtgttgcctcttgctggctgtgggacctgaggcaaatcatgcaacctctcttttctgtttgcctagatggaaaataggtttacaatacgcccccataggatggctgtgagaattaaaggaagtcatgggtgtacaatacctggccccgaaagatgcttaat

SEQ ID NO: 133104 - DNA, 601 bp, Human
ggaggagggggggtgactggcggggggccacagagagctgagctggggtggtctcgaactcctgaactcaagcaatctgccagcctcagtctcccaaagtgctgggattataggcatgagccacccacgatgcctgggtggaactcagggctctggatgcctgggcgcccccatctcccacactacggcgcctcatcctagaagtggttagcacctttgagatgggaattatttagcaggatgcttttgtgttttcatgtaagttttatgctgcctgtggagggcacagctgtttcaaaamtaataaccaaatcctggtctccgaagtctgaaggcatcctttgccctgcagtgcaaagcacgggattctggcctcacacaggcaggtctgaactcctgtgttgcctcttgctggctgtgggacctgaggcaaatcatgcaacctctcttttctgtttgcctagatggaaaataggtttacaatacgcccccataggatggctgtgagaattaaaggaagtcatgggtgtacaatacctggccccgaaagatgcttaataatttaattctgaccttcctcactcatttaggattatgtacc

SEQ ID NO: 133105 - DNA, 601 bp, Human
gaagtcatgggtgtacaatacctggccccgaaagatgcttaataatttaattctgaccttcctcactcatttaggattatgtaccaacttttagaaacaatgaaagattagtgagtcttctgtggttggtataaaaaaaaaatagaaacatgaaagagatgtcctccttgttcaagggctaatgaccctggtgtgcgctgtctaggcccccaaggtcttccttccctgctcacagcatttcaggttctccgcagctttgctgagcctgggtcaggttcggtatctgcccaccatgctcacytgccacagctgtggccccatttccaaacttcagagacttaaaggtgcagctaatgatgtgcccggcctggggtcacattccctgagccctgcagacaagggagcaggaggctgagctcttatcttccacaccctgtgcacagcctgggaagagttaaagcaccctagtcctatgctgcgagggccacatgccctgagaccttggaaaaaatcctacctgaattgaagagcatcactatttcatcaggaggcgctgccatttcatttttcacttcggttttatcttgagtgtaaaacagct

SEQ ID NO: 133106 - DNA, 601 bp, Human
gcagcctggggggctcaaaccacagaatttattctctcacagtcctagaggctagaagtccaagatcaaagtgtgggcagggtcggtttctcctgcagcctctctccttggcttatagagtgccaccttctacctgtgtcttcacatcatcacctcactgagcatgtctgtgtccaaatctccccttcttataagaccccagtcatactggatgaggatccacccatatgagttcattttaccttaattatctctttaaacaccctgtctccaaatacagtcccattctgaggaactgagrgtaaagattcaacatatgaattttggaagggacctaattcagcccacaacaccctcttttgggatgtttattttcccccttaaggagctagttaggatgtcttatctcatgaacatgactgtgaacaggaaaacagggagagaatgaagctggccaaggaacagggctggtgtcagctagcagtgcttttctgatgtgagtgggtcccacagggagcttgttaaaatgcagattctgattcattaggttccagagggacctgagatttcccatttctgacaagtttccagtgtgggggct

SEQ ID NO: 133107 - DNA, 601 bp, Human
cctgtgtcttcacatcatcacctcactgagcatgtctgtgtccaaatctccccttcttataagaccccagtcatactggatgaggatccacccatatgagttcattttaccttaattatctctttaaacaccctgtctccaaatacagtcccattctgaggaactgagagtaaagattcaacatatgaattttggaagggacctaattcagcccacaacaccctcttttgggatgtttattttcccccttaaggagctagttaggatgtcttatctcatgaacatgactgtgaacaggaaracagggagagaatgaagctggccaaggaacagggctggtgtcagctagcagtgcttttctgatgtgagtgggtcccacagggagcttgttaaaatgcagattctgattcattaggttccagagggacctgagatttcccatttctgacaagtttccagtgtgggggctgatgctgctggtccacggaccatactttgagtagcaaggagcttgatacataatggctgagtgactttcagactcctgctgtagaaaaattatgagttggctgggcgtggtggctcacgcctgtaatcccag

SEQ ID NO: 133108 - DNA, 601 bp, Human
ccatggaggcagtcagaggagggctctgcagagggagggcagaaacagggtggcctctgcatgccattaggaggtcacatctcactgggggatgcagtttaggatttagtgccttggagagaaggatagagtgtattaaaacatgtctccgctaggcatggtggtttacgcctataatcccagcactttgggaggccgaggtgagtggattgcctgagctcaggagttcaagaccagcctggctaacatgacgaaacctcatctctactaaaatacaaaaagttagctgggagtggtggcrtgcgcctgtagttgcagctacttgggaggctgaggcatgagaatcacttaagcccagaagactgaggttgcagtgagccgagattgcaccactgcactccagcttgggctacagagtgagactctatctcaaaaacaaagaaacaaacaacaacaataacaacaaaaaccaagtctctccctccactcaaaaatgcaagggcctgtctcccattgctgggtgcccaggtctcatgaatgtagacatgaattattccagtcagcctcaggagaatagaatgagccctcagatgccgaagca

SEQ ID NO: 133109 - DNA, 601 bp, Human
aacatgacgaaacctcatctctactaaaatacaaaaagttagctgggagtggtggcgtgcgcctgtagttgcagctacttgggaggctgaggcatgagaatcacttaagcccagaagactgaggttgcagtgagccgagattgcaccactgcactccagcttgggctacagagtgagactctatctcaaaaacaaagaaacaaacaacaacaataacaacaaaaaccaagtctctccctccactcaaaaatgcaagggcctgtctcccattgctgggtgcccaggtctcatgaatgtagayatgaattattccagtcagcctcaggagaatagaatgagccctcagatgccgaagcacctttcagattccaccggttttatcggctcatttaaacttcacttctaacacagtcctgcattacacacgtgtctgtcgttatgggcagctgcagagagggtcttaatggtcctaatgctcagtgaggatgcccaatggtcaacagaacctgccatcttcaggccatcaaggagctctggagttaaggaaatcatgagagcacagaggggcgggtacagcagagccctcgtggtaatgggtttt

SEQ ID NO: 133110 - DNA, 601 bp, Human
cctcaggagaatagaatgagccctcagatgccgaagcacctttcagattccaccggttttatcggctcatttaaacttcacttctaacacagtcctgcattacacacgtgtctgtcgttatgggcagctgcagagagggtcttaatggtcctaatgctcagtgaggatgcccaatggtcaacagaacctgccatcttcaggccatcaaggagctctggagttaaggaaatcatgagagcacagaggggcgggtacagcagagccctcgtggtaatgggttttgaggtctaggctctcttcrcttgggtttgaaataagttcaatgactagtaatagctgagacacttctacccttcaaatgaagtaaatgggaaaatggagcattgttgagtccagggagctataatttaaaccccatatatctaaaaggggtaacatttttgtgtgtgtgaaattggtgtcattcgcactgcatctacagttttctttttccttctcttccagcacccctggctacatatttgggaaacgcatcatactcttcctgttcctcatgtccgttgctggcatattcaactattacctcatcttctttttcgga

SEQ ID NO: 133111 - DNA, 601 bp, Human
tgtaccaagtcttgccaaagcagtgaacattatgacacaactttttgtcacagctggctcctaataggacagtgccagccaattcaagcccagtcctttctgtgtttattcccatctctcccaaatatttggaaactgatgtcttgactcatgggtgtattcacaaattctgttacttcaagtctttttcttttaacggattgatcttttgctagatagagacaaaatatcagtgtgaattacagcaaacccctattccatgctgttatgggtgaaactctgggagattctcctattgacscagaaagcgattccttcactgatacactgtctgcaaacatatcacaaggtaaagttccttccagatacggctattggggacgtgggggcatttatgtaagggtaaaattgctcttgtagtttgtcttccaggttgtgtttgttttaatactatcatgtgtacactccagtattttaatgcttagctcgttgctatcgcgttcatttaaaaacatgttcagaaccttaaaaaaggaaacctaacctaatctattttatctctgtgcatggctcccatttcctgaattttaagcattaaagg

SEQ ID NO: 133112 - DNA, 601 bp, Human
aataggttaactgagaggcaagtactgtttgtggtaagggatggttatgtgattcaagttagttttcattctgtgctaatctctaattttatgctttgaatttactctgagtttaatttttttgagtctcaatttcctctaaaagaatgatccagtacttttcttcctaattaacatagtgcagaatgaaattattagcaattaaaacattatattttgtaccaataatttaacccttgtcttatagggtctctggctactacttcttcataagcactgtttctctgttaaaaatgtgagytcctaaaggcccaagacctatgattgttactcctattgcattttgtaaatgacctttaaataattactccacctcttccaaaacagacagacttaaaaataaattagctatatgatcatcattagccgaggccagcagagttgaacactgtggagttgaggtatttggcatgggtacagtagtcctcttaggtgctccttcttcctcatcataggcaaagtgaaattgggggtgttgcaaatggttgggtactgctatttaagaaaaagtggcacatttagtgtgaatgactcagatatc

SEQ ID NO: 133113 - DNA, 601 bp, Human
tggcaagattgaagggaagcttccacaagctcaagctgaatatgcctcctgcttttagtgccagacttagtcctgtgtgaattctacaattttaagtcgttgcaccagagccttgaaagatgatgacacacttgtcctttggagctgattgagcaatggaaatatgccttagagacatgataaatgctgcaatagacaatccttcaaaacgagtctctcctgagataggagtgagtgattgattgcatgccatttttattgagggatacttaatctgtggttacatatctccaggcaactrtatattcagaaacatttagataactgaccaaagttttcacctttccagaagtttaaagggacccatgtagtaccagggaatataaggaccagtcctttgttggccacatatttgctgtgtgaatttaagcacgccatttttcttctctggccttctgtttccacatatattaacagaatacacaggattaatgggaggattaaatgacacaatacttgtgcaagtagatctaaagccctatatggaatttattgctttagccttgtagcgttaatcacttgtggctagaatagaaggctc

SEQ ID NO: 133114 - DNA, 601 bp, Human
catttagataactgaccaaagttttcacctttccagaagtttaaagggacccatgtagtaccagggaatataaggaccagtcctttgttggccacatatttgctgtgtgaatttaagcacgccatttttcttctctggccttctgtttccacatatattaacagaatacacaggattaatgggaggattaaatgacacaatacttgtgcaagtagatctaaagccctatatggaatttattgctttagccttgtagcgttaatcacttgtggctagaatagaaggctccgtttaaaaaaaraaaaggctgggtacagtggctcacatctgtaatcccacaactttgggaggccgaggcgggcagatcacgaggtcaggaggtcaagaggtcaagaccatcctggctaacacgatgaaaccctgtctctactaaaaatacaaaaaattagccaggcgtggtggtgggcgcctgtagtcccagctactcaggaggctgaggtaggagaatggcgtgaacccaggaggcagaggttgcagtgaggctgagattgcgccactgcactccagcctgggcgacagagcgagactccatctcaaaaaa

SEQ ID NO: 133115 - DNA, 601 bp, Human
tttcttctcagagcattgagaaacttggattataatgtttttcgtacactgaagtagaagtccagaaaagatttgagttattgacacagatcttcttttttttttgagacagagcctcactctgtcacccaggctagagtgcagaggcctgatatcatatttcaccacagcctcaacctccctgggcttcggtgatcctcccacctcagcctcactagtagctgggactacaggcgtaccttaccacacccagcaaatttttgtaatttttatagagacaggatttcaccatgttgtccargctggtcttgaactcctgggctcaaggaattctcccgcctcgacctcccaaagtgctgggattacaggcgtgagccatcgcagcctgcccctgaattccataatttcacgtgtaattagaattcaagacctttttcttgaatattactcttgtccatattaatttttttctgagtatggctctagctttatcatttttttctgacttaactctgattaacctcttttttcatcaccagtacttggcagattttgtagatttctaaactctgaaaatcactgtttttctgaaaactgtcat

SEQ ID NO: 133116 - DNA, 601 bp, Human
agatttgagttattgacacagatcttcttttttttttgagacagagcctcactctgtcacccaggctagagtgcagaggcctgatatcatatttcaccacagcctcaacctccctgggcttcggtgatcctcccacctcagcctcactagtagctgggactacaggcgtaccttaccacacccagcaaatttttgtaatttttatagagacaggatttcaccatgttgtccaagctggtcttgaactcctgggctcaaggaattctcccgcctcgacctcccaaagtgctgggattacagrcgtgagccatcgcagcctgcccctgaattccataatttcacgtgtaattagaattcaagacctttttcttgaatattactcttgtccatattaatttttttctgagtatggctctagctttatcatttttttctgacttaactctgattaacctcttttttcatcaccagtacttggcagattttgtagatttctaaactctgaaaatcactgtttttctgaaaactgtcatttgtctcatactttcctccaaaattatgaattataggaaacaccccaaagaagtatcatttacattag

SEQ ID NO: 133117 - DNA, 601 bp, Human
agagcctcactctgtcacccaggctagagtgcagaggcctgatatcatatttcaccacagcctcaacctccctgggcttcggtgatcctcccacctcagcctcactagtagctgggactacaggcgtaccttaccacacccagcaaatttttgtaatttttatagagacaggatttcaccatgttgtccaagctggtcttgaactcctgggctcaaggaattctcccgcctcgacctcccaaagtgctgggattacaggcgtgagccatcgcagcctgcccctgaattccataatttcacrtgtaattagaattcaagacctttttcttgaatattactcttgtccatattaatttttttctgagtatggctctagctttatcatttttttctgacttaactctgattaacctcttttttcatcaccagtacttggcagattttgtagatttctaaactctgaaaatcactgtttttctgaaaactgtcatttgtctcatactttcctccaaaattatgaattataggaaacaccccaaagaagtatcatttacattagctgtttacaagaaaatacagggtttcatttttaattttattt

SEQ ID NO: 133118 - DNA, 601 bp, Human
agattttgtagatttctaaactctgaaaatcactgtttttctgaaaactgtcatttgtctcatactttcctccaaaattatgaattataggaaacaccccaaagaagtatcatttacattagctgtttacaagaaaatacagggtttcatttttaattttattttcccctactatctctaaggaatacaacttgtcttgaaagctccctgacagcagctatccatttaatctgccaattgcagtataaaaattggttattaaatgaaaaacaattgtatacctctcacagaggttgtcatrtattactatttttgtcagcattctcacttataactctgttaggataatcctgggaaaatttctaaaatcttcatagctctttcgttaggtacatattccttgagacagaggaaatctgagcaaagtaaatttcttcattatcttagatcaacaaaagtgatacagagcttctgtcctgttagctccctttggacgcttaaaataggcactagaggttgtccagtaaatgcttcatatccatctactagtgctgaatatttgtgaaaatataggtgataatgaattagactcgtttgaatg

SEQ ID NO: 133119 - DNA, 601 bp, Human
attctatgtattgcttactgtctgcttcacctccctggaatgttaaccgcatgaaggcagagatctttgtctagtttgttcacccactgatgtattccaaatacctgaatagtattgctcattaatacttgctaaatgaaagaatagaatcctctaacacttacggcttctatcacacaatttagccctgagttcaaactgtctggtattatttcctgttttatgtattccctaagccaaatcatatagtcactgaagaaaagatccatgttttattctatattccacaaatgccaaacayataataagtataatcaggtcttgttgacttattaataccaagctgatctcctaaggtcagagactggaatatatttagcaaataaatacaaaattttagtgtatgttaaatattattctaaaaccaatgctaatataaacaaaccaagtactggatatgctacaaaccaggcacaaatatgttttgaattatctgttagttaatttgcaccgtgtccctccattagtttgagtagcattcattgaatatcatttgaatattaatttaaacatcatttgtttgtgagttacccaaatccct

SEQ ID NO: 133120 - DNA, 601 bp, Human
aacacaagactcttgacgtaggcctcagaatttggggaaaaaaattcctgcattgtttaaaaatacagtgtccttgtaaagcagaataggccttatatacaagccaaatatatcagttctaaagcaaaaacaaaacttttcctacttactcttttatttcttttttttttttttttttgagacagagtctcactctgtcacccaggctgaagtgcagtggcgccgtctcagctcactgcaacctctgccccctgggttcacacaatcctcctgcctcagcctcccgagtaactgggattasaggcacccaccaccacgcctggctaattttgtatttttagtagagacggggtttcaccatgttggcagggtggtctcaaactcctgatctcaagtgatccgactgcctgcacttttcaaagtgctggattgcagatgtgagccactatgcccagcctgcttcactcttttagataaaatgtacaccctttgaatttttacttccgccatttacactgatttgaagtccttggttgaatatgtatttagccttcactgtgcaaggaagctggttacaaaaacagatagtttattaaaatac

SEQ ID NO: 133121 - DNA, 601 bp, Human
ctgcattgtttaaaaatacagtgtccttgtaaagcagaataggccttatatacaagccaaatatatcagttctaaagcaaaaacaaaacttttcctacttactcttttatttcttttttttttttttttttgagacagagtctcactctgtcacccaggctgaagtgcagtggcgccgtctcagctcactgcaacctctgccccctgggttcacacaatcctcctgcctcagcctcccgagtaactgggattagaggcacccaccaccacgcctggctaattttgtatttttagtagagayggggtttcaccatgttggcagggtggtctcaaactcctgatctcaagtgatccgactgcctgcacttttcaaagtgctggattgcagatgtgagccactatgcccagcctgcttcactcttttagataaaatgtacaccctttgaatttttacttccgccatttacactgatttgaagtccttggttgaatatgtatttagccttcactgtgcaaggaagctggttacaaaaacagatagtttattaaaatacttgtgttggtttttaaaaaagaataattttaatacagtttttctctt

SEQ ID NO: 133122 - DNA, 601 bp, Human
taaataaaattacacattgtttactcttttgtgtctggattcttttgcttagcatttattcgtgagattaatcacactattgaatgtaattgtacttcattctcattactgtatagtgtttcattgtataaatatatcacaacatatttatcctactgttgatgggcattcagatggttttcagtattgcaaatagtactgctatgaacattgtcctgtaggtctcttagtgaaggagcgtatgcatttctggtagctatatgcttcagccaataatagagtatgttgagcttcaggagaygttgccaacagttctgaacaggactctagaaatctatacttctactagaagtgcatgagtgttctagctcttctacaccatcactggtacttggcattctctgtctttttcacgttagccattctggtgggtgtgttggtatcatattctaattttaatctccccttttctgatgtctaaaaagttaaacactttaaaaagcgtttgttgtccatttggctatcctttcttgtaaagtacctgttcaagtctttcacccatttttatattgagtactttaggtaaacgttctaaagcata

SEQ ID NO: 133123 - DNA, 601 bp, Human
ataaatatatcacaacatatttatcctactgttgatgggcattcagatggttttcagtattgcaaatagtactgctatgaacattgtcctgtaggtctcttagtgaaggagcgtatgcatttctggtagctatatgcttcagccaataatagagtatgttgagcttcaggagatgttgccaacagttctgaacaggactctagaaatctatacttctactagaagtgcatgagtgttctagctcttctacaccatcactggtacttggcattctctgtctttttcacgttagccattctgrtgggtgtgttggtatcatattctaattttaatctccccttttctgatgtctaaaaagttaaacactttaaaaagcgtttgttgtccatttggctatcctttcttgtaaagtacctgttcaagtctttcacccatttttatattgagtactttaggtaaacgttctaaagcataccttgtcagatacatgtattgtaaatatctcctcttactctgtgtgctttttcgtttacttaataaacagatatttctaatcaatatagtctgatatactagatttttcttttacagtaagtgcttt

SEQ ID NO: 133124 - DNA, 601 bp, Human
cacatattttgttagattttttcccctgggtatttgattgttttaatgctgttgcaaaaataatttttaaatttcattttctacttgttgctggcttatagaaatataattggtttttgaatattgaccttgtacccagcaactttgctaaattattttattaactataatgagtttttttgtggatttttaaaaacacagtctgcctaacatggtggctcatgcctgtaatcccagaactttgggaggctgaggtgggtggatcactttgagctcaggagttcgagaccagcctggccarcatagtgaaaccctgtctctactaaaaatacgaaaaattagccaggcatggtggcatgcccctgtaatcccagctacttgggaggctgaggcaggagaattgccctaatgccagaggtggacgttggagtgagctaagataatgccactgtactccagcctgggcaacagagtgagacttcgtctcaaaaataaataaataaataaataaataaataaataaaacgaacaacaacaacaaaatacagtcatgtcatctgtaagtaatgttagttttagttttatttcttcttttccaatt

SEQ ID NO: 133125 - DNA, 601 bp, Human
tacagtggtgagtagaagtaatgatagtatcattaccttgttgctgatctcaagaggaaggctttaaatatttcaccatcaggtatgatggctactctaggatttttgtttgtttatttgtttgttttttatagattttctttagcagactaatgaagttccctttccttcctaagaggttttttatttaaaaaaaaaattatgagtgaatgttgaattatatcaaatgctttcatagtttgttgtggtggtggttgtttttgagacagggtctcactttgtctccaagctggatcatggygcattgcagcctcaacctcctgggctcaagtgatcctcccacctcagcctcttccagtagctgggaccacagcacatcaccacacccagctaatttttaaaaaattgttatagagacagggtctcactgtgttgtctaggctggtcttgaactcttaggctcaagtaatcctcccaccttggcctcccaaagtgctgggattacaggtgtgagccactgtatctagcctagaatattttttatagtgctcaggagaaagattaaaagtatgaaaagtgtctactatgtatactttaatat

SEQ ID NO: 133126 - DNA, 601 bp, Human
attcctttcatttttccttttcctctcctctcccctattttcattcccctatcactgcaaagccaaaaccaaaacgtggaaggggacctagccgaggaaaacattccagcttcttttttctgatctaaacaccgttcttcttcttttttattttttaattaataactttatttttagggcagttttagtttcagagcagaattgagtaggaagtacaaagagttcccatatacttcctgtcccccaccacgcacaatctcccccactatcaacatcctgcacccaagtggtacacttgttacagtcaataaacccccactgacacatcattatcactcaaagtccatagtctacattaagattcactcttcgtgttatattctctgggtttgtacaaatgtataaggacacatatccaccattgtagtgtcatacagaatattttcactgacctaaaaatcctctgggatccacctgttcattccgttctcccccaaacttctgactaccactgatctttttcctgttttgatagttttgcgcttcccagaatatcatatagttggaaccatacagtatgtggccttttcagtttgacttc

SEQ ID NO: 133127 - DNA, 601 bp, Human
agcattatgacttttgtatattaaccttgtatcctgcaaccttgctataatcacttactaggtccaggagattttttttttttctgttcttttggatttttttatgtagaagtcatgtcatttgcaaacaaagacagttttatttttaccttcccaatctgtatcccttttatttccttttcttgtcttgttacgttagctaagacttctagtatgatgttgaaaagcagtagtgagagaagatatccttgccttattcctaatcttagtgggaaagcttgagtttctcaccattacttaygatgttaactatatgttttgtttgtagatgttcctaagtttaggaagttttcttattttgtcaaattctttttctgcatttattgatatgatcatgtgatttttcttctttaggctatgggtgtgatggattacattaatttgttttctaatgttgaaccaaccccacataccttagctaaatctcacttggccatggtgtataattcttttcatacgttatcggattcaatttgctgatattttgttaaagatttctgcatgtctgtccatgagagattggtctatagggtttattttc

SEQ ID NO: 133128 - DNA, 601 bp, Human
gttgaaaagcagtagtgagagaagatatccttgccttattcctaatcttagtgggaaagcttgagtttctcaccattacttatgatgttaactatatgttttgtttgtagatgttcctaagtttaggaagttttcttattttgtcaaattctttttctgcatttattgatatgatcatgtgatttttcttctttaggctatgggtgtgatggattacattaatttgttttctaatgttgaaccaaccccacataccttagctaaatctcacttggccatggtgtataattcttttcatacrttatcggattcaatttgctgatattttgttaaagatttctgcatgtctgtccatgagagattggtctatagggtttattttccttgtaatgtctgttttgttttagtattagggtaattctagcctcattgaatgagttaggaagtattccctctgcttttatattctgaaagagatttcagagaattggtataatttcttccttaaatgtttggtagaattcaccagtgaacccagtccggtgccttctgtttcagaaggttattagttattgattcaatttcattaataaatgtaggc

SEQ ID NO: 133129 - DNA, 601 bp, Human
tatttctgctgatgggttccagagtcttttcctccttcactaaacaaaactcaggatactatgtgaaggaaaagaagtgagttggtagaatttattttttaaatgcttgagtcaaaaggagagccatttgtggctgaagcatcaaaaccattttctgattttctttcattctacttgaaactacattaaaattttctccaattttccagatgattgcatgataattccttttaagaggactttaacacatgtaagaaatagagttactccctctgttaggagaaatcatggaaagatattrtaattaaaagatagtgaattttagcttaatttttacctttatctaaataacactcgtacacagctacagctttcagtgaagaagagatactcattcccacagctaaatcccgctcctcataggcagtgattttacctctttcacatatttcttctggcatttaccttcctatctctagaataacatacttacattaatggccaggcatagtgactcacgcctgtaatcccaacactttggtaggtcaagatgggcacatcgcttgagcccaggagtttgagatcagcctgggcaacatgg

SEQ ID NO: 133130 - DNA, 601 bp, Human
ctttcacatatttcttctggcatttaccttcctatctctagaataacatacttacattaatggccaggcatagtgactcacgcctgtaatcccaacactttggtaggtcaagatgggcacatcgcttgagcccaggagtttgagatcagcctgggcaacatggtgaaacctcatcagtacagaaaatacaaaaattagccagcagtggtggtgcatgcctgtggtcccagctacttgggaggctgaagttggaggatttctcgagcccgggagtttgaggctacagtgagctgtgattgcrttacagcacgacagcctgggccacagagagagaccttgtctcaaaaataattataataataataacttatactattatttttaaaattgtattcttatccattgacttcttactgtgggagataataatttagtccttttactaccatattcccttttccaaaacacatacttctccctcccctccatcttcacaatgtagttacttgtaatttggggttaaatcagttgtctgtgcttacattgtagtaactgaaagtgctgcttaaggttgagccaagcagtgtgctatgattctgtt

SEQ ID NO: 133131 - DNA, 601 bp, Human
ctgtgattgcgttacagcacgacagcctgggccacagagagagaccttgtctcaaaaataattataataataataacttatactattatttttaaaattgtattcttatccattgacttcttactgtgggagataataatttagtccttttactaccatattcccttttccaaaacacatacttctccctcccctccatcttcacaatgtagttacttgtaatttggggttaaatcagttgtctgtgcttacattgtagtaactgaaagtgctgcttaaggttgagccaagcagtgtgctmtgattctgtttcctctcctgcttagctatttacttttctggagttaatttttgtcacttagtcattgctcattttgttgtcatttcttgctatgtactcatcactaattcatcctcaaactctctgacagagtaataaaaactcctctgaaagtggtcagacatatcgggcattctggtttctcaggtgatcccacctggccttcttcctcctgcattttctctaggctgctctgtatctgtagcctgggactaccttccacctctctcctgtctttcagatcctttgtttcctggtccc

SEQ ID NO: 133132 - DNA, 601 bp, Human
gtacttatgatcatctctatagaaggggtattaatcttgacagtgttcctttctgtgtggtttaagaaatcctttctctcttgggttttgttactgttttataaatccttgatcttagtcattctaaggttaaagaaaaactgaggaacaactcaggaatacgtttcaagtacatgtgataaaaggcaaatatgcagaggatgataactatatgtttaaaaaatgggaaaaaagagatagtcgcaaacttcaacataggttagatcatcatttctcaaaccatattccatcacatattaarctcctcaaatattgcacactgtgcttttttctctcttttgtgtattctcgtgaacattagcctgttagtttaagaagtctcacagtaaacctatttaaccttgcttaacctagcattgcctaaatttacttgatcaccagattttttttgttttgtttttaattatttttaaaggaacattattaacatatgtataacacagttggggaaatgccagataagacatagactttcctggctgctaaagagcaattaagcattggaatgagtaaccaagaggagctgtggactctccttttc

SEQ ID NO: 133133 - DNA, 601 bp, Human
tggttccttacatgagactttttccctcataaatttgatgacattcatatacattcactaaagacccccaaaaaataaatctggatctgtgaaaagtggcaaaggttaaaagtcccattttcagcatatttacatgtagtaacaacttgataacacagcgctgagaatgccaggctcagaggagccaagctgggctcccgtccagtcagcctctagctcaccaggaaaccctgagcaggtcactttgcctcattttctttatctgtcaaatgagaactcagatgatctcaaaacagccttktctgctgtagtgtttcaggatgattcttgtctctggatgtcgctgtcatgatgggagaggaattagtaaattcccaggtcagtttacactgcagagtgatcttgatctgcatgaatcagtaaggatgggctggataaacaagttggaaccacagttatgagtaccatgacattaactgaaacaaatgagaagggattgaaaaatcggcggttaagtgtcttttaaggtcatttccaacaaaactacaaaggacctatgaaaggcttttcaggcacgtactcttgttgcctagctgaacac

SEQ ID NO: 133134 - DNA, 601 bp, Human
agcacctactatgagacaagccctttgttagccagtggggatatgactgcaaacaagaaagatacgcctatgatttgatgaatcctggagtttatgagcagctcatctctgtctcccgtgtgagcagtcctaaatttacacagctctccactggtgtttttgaccacagagttaacatttaaaatacctatgactgcttttttggcaccactttgaataatgaactggtgtcaggtaaacagagtccaggtacctattgcagaaagttttccagtctgcaccctcggtggctcacaagttyacatgaagtgaaccaaaagagttttgttgcacttactgtgacaataaatcatgtttagaaaaatgcatgtggcatacatgatattgggcaaatgattcatgaaacttgctattctgtggccttagaatccatgtaagcatttttcctttgtcttttatgtgttttcttgtttctatctctgttttgttttgtttttgttttggggatggtttaaaattaatgctgggctagagtctgattttgacactctcgggtgtgatcaaatgtttccacatatctctctaacctttctattctcaa

SEQ ID NO: 133135 - DNA, 601 bp, Human
aatattttgggcttctaatttcaagagagtaaaattgtcctggaaccctgtgcacactttaaaaacaatcattaacagattgcatcaaactagaaacttcttcaccacaaaggaaataatcaataaagtgaaaagccagcctacagaataggggaatctgtacatctgatatgaagttatggattgcaaatcgtacatctgatatggaattaatattccaaaatatgtaagaaactcaacaaactcaattgcaagaaaacaaataacccagttaaaaaatgataaaggaatatccatttcyagaaagaagacatacaagtggccaacagatatatgaaaaggtactcaccatcactaatcatcagggaaatgcaaatcaaaaccacggtgagatatcatctcacacccattagaatggctgttatcaaaaacacagaagataagaagtgttggcaaggatgtggataagagggaacccttgtacactgttggcaggaatgtaaattggtatagtcattatggaaaacagaatggactgcctcaaaaaattaaaaatagaactagcatatgatctagcaatcctacttctgggtatatatcc

SEQ ID NO: 133136 - DNA, 601 bp, Human
ctgttcactctgatgatagtttcttttgctgtgcagaaactctttagtttaattagatcccatttgtcaattttggcttttgttgctattgcttttggtgttttagacatgaagtctttgcccatgcctatatcctgaatggtattgcctaggttttcttctagggtttttgtggtgttaggtcttacatttaagtctttaatccatcttgagttaatttttgtatatggtgtaaggaagggatcaataattctcttatcaaaaaaaccttcctctcctagccatgccaaataactgagcrctctgtgagccatccagctgtcagctagccaagtagcattttcacccactaatattagtctttaaaaagcaagaatcaaaagagaagtcaaggaatatcataaaatatctatgatcacaatggcaaacatcaggattttcaccaacatttatcaatgagaacagttctatacattagcattctgttcatctgtgaaaaaaaaactttttgatatctgaaggtcctcagaaccctttgagaattaaagagacttcaactgccagcaaattctacatcgggcatattctttaagacattgct

SEQ ID NO: 133137 - DNA, 601 bp, Human
acaagaggtagtgaaaactctccaaaacaacatcaatgaaacaaaatgaaacaaacataccctcagttccaagctgtgagctgcaggcacacttagcaggtcagggttttccccatgatagatgcccagagaggtacagtggtgagcattgccccaaaggcagatggctgtagcagttttctgagcaataagtgagaaggagctaagtgtagggcttctgaattaagccaggattctcaatagtgtctgaaatagtcataagtcagtaacacccctggctactgaattcctaattcagacyttgtaggagtcccccagtttaaggtcaagaaactagttccaaataatatcagcaagcatgtgagaagctaaccatcttgaatgacattcatcatcaacaagaaaactgatacagactccctgctcttcccctacctggggaaagcagaaattgggattgcctgatacagaatataaaaaagctattatgaattatttaaaggaagagggcataggcttgcaacaataaactattaggaataaccaggatgatttgaaaaccaagtgaaaaaaaggtgaagcttctaaaagttaaaagtat

SEQ ID NO: 133138 - DNA, 601 bp, Human
tgcctataatcccagctacccagaaggctgaggcccaagaatcgcttgaacctgagaggtgaaggttgcagtgagccgagatagcaccactgcactccagcctgagcaagagagcgagactctgtctcaaaacaaaaaacaaacaaaacaaaaagagtgaaatgaaatatctattggttgaataaacaaaaatactgaaaaagtacatttcaaggatagtaagccagagaagatatttgaacatctgtaacagacaacagattaatatctagcatattttttaaaaaagtctaaaattcarttttaaggaaaagacagttagaaactgggaagtgaaaagccagggacatacaaatcaagatttaaattcaattttatacatttcagattgtcaaaattaagaagtctgacagcaccaaatgtggaagagactacaattttcataaagcgcttgtggggagtgtacattggtagccactttggaaaacaatttggcattatcttgtaaaattttaatactcacacattgtacaacccagaaatgccacttaaacatatttacaggaatatttagagaaactcttctcataatagcaaaaaa

SEQ ID NO: 133139 - DNA, 601 bp, Human
tgaggaaagaaagaagtcaagagtgatttcaaggattttggcttgagaaactggaaggatggcgttgcgtctgctgagatggagaaagccgcaagtgaagtgagtttgtaggggagggtcaggacttcaatttggacaggctggcttagagatggctattaattatttaaatgaagctgtcaagtaatcagaacatactcatccagagttctaaatggacgtttggagaaagtcaaaatgcatgtcaatgaccaaagcaatactaatgcagtgctttttgcaccaaacagggccagatacmtttgaaagaattagcaattaagttttatgaagatgaacacaatagaaatgaataggaatatgatgaacccaaaaaatggagtcagaaaacacgtccagttcgatttttttcagctctttccaaagatgtaaatatagcagaatattcagttggcctcaaattgacatatttgccattttgagatagcagtcgattttgtgaggatttatctgattacttctcatgttattcccatagtctctttctgtctgtaagccacaacaatgatggggcacactttaaacaacataaataagtgaa

SEQ ID NO: 133140 - DNA, 601 bp, Human
gtggacactaaagccattgccaaaaatgtgtacagtttttccaccaaatgccagaatttagaatattgcatggcgataaaacatttctcttttaggtcagtgtttttaaagttttattatagaacctttctctctgtggttgggcatctgccatgaggagaaaagagacttgaaaaatctgggggattatgggaaaaactttagtgttagaacaaatataatgatcatcatgattaatttttatattgcctcatgcattaaaaacagaattaaaatttacttttgtgtatcagtagtgtcrttctgctttaaatgtaagaaaatcctgaagatgtctgggtctgaaactttaaatggcatatgagaatttagattcatttaattttttttttttttttttttttgctgtttattatgcaaagacgagtattcgtttccttcacttcaaggaacgtccatgagttgtggaaagggtaaaacaaattatttttatagttctgcaaaacttcaaagccatagaaacataagagaataaaactttctacttttgaaacctgtgtctaaagtcaagcttatgactttgggtgtcaacttaagggaa

SEQ ID NO: 133141 - DNA, 601 bp, Human
ttttaaagttttattatagaacctttctctctgtggttgggcatctgccatgaggagaaaagagacttgaaaaatctgggggattatgggaaaaactttagtgttagaacaaatataatgatcatcatgattaatttttatattgcctcatgcattaaaaacagaattaaaatttacttttgtgtatcagtagtgtcattctgctttaaatgtaagaaaatcctgaagatgtctgggtctgaaactttaaatggcatatgagaatttagattcatttaattttttttttttttttttttttgctgtttattatgcaaagacgagtattcgtttccttcacttcaaggaacgtccatgagttgtggaaagggtaaaacaaattatttttatagttctgcaaaacttcaaagccatagaaacataagagaataaaactttctacttttgaaacctgtgtctaaagtcaagcttatgactttgggtgtcaacttaagggaaatgatgtagaagacctgagaaaagacccatgttttcatgatctgtggaactaactcagtaaggtcctggaagacaaacgtgtttgaaaaaataattcttggtc

SEQ ID NO: 133142 - DNA, 601 bp, Human
tctcaaaactgatctagtaagaaggcagtcttcatctatatgtactctaaagcatctgagaaaattaaatttttgctctatcatgcagatacttggttttcacagtggaaaccatcaagatatttgagagtcactcattgattaataacctaccctttaaaaatagttcacaaaattctatctgtatgattactaatgggtcagttcctctaaaggcaagaatgtattttgaatagagctatcagcagtactgaacaggatggaaatttggtccaactttcctcaacaattgactacatctgctgtatacaactgtagtcatggattgcaaaataatttgctggttcagttccatcagtttcctttttatttcagacctcataaaacataagggcaagcttccaagtcaagggttgtattttaggtgatgcaatcaagttgcaataaacttatttcatcttcatgaagaaatcattgactttgaggtcattatcactgagacagcctaggaaagcatgccagttccgcttttaacactaatttttgcctattaaaaaattatcacttcacacattcatgtaaaatataattcctgttactt

SEQ ID NO: 133143 - DNA, 601 bp, Human
agcagaaatacagacccacttcctaggccactcagcggtgtatgtaacttaccaagtgatcattgcatcaactactctttgttagtgaagctggtgtctgcagaatcttgataaaaagactcatggataatgttgcttctttagtcaaatgggctcttgcatgcatttttatagattttcaaagtagtcatttttgttttaaaatcctgctgccaagtcctttatagtaattgcattttaaaaatatgtcttctttattttttattattatttttttttgagatggagtctcgctctgtcrcccagtctggagttaaatggtacaatcttggctcactgcaacctccgcctcccaggttcaagcaattctcctgccttagcctcctgagtagctgggattacaggtgcccgaaaccatacccagctgatttttgtatttttagtaaagatggggcttcaccatgttggccaagatggtctcgaactcctgacctcaggtgatccacccacctcagcctcccaaagtgctaggattacaggcgtgagctaccacactggccttgtcctctttatttttaataaaattatttagtcattaaga

SEQ ID NO: 133144 - DNA, 601 bp, Human
cccacttcctaggccactcagcggtgtatgtaacttaccaagtgatcattgcatcaactactctttgttagtgaagctggtgtctgcagaatcttgataaaaagactcatggataatgttgcttctttagtcaaatgggctcttgcatgcatttttatagattttcaaagtagtcatttttgttttaaaatcctgctgccaagtcctttatagtaattgcattttaaaaatatgtcttctttattttttattattatttttttttgagatggagtctcgctctgtcacccagtctggagtwaaatggtacaatcttggctcactgcaacctccgcctcccaggttcaagcaattctcctgccttagcctcctgagtagctgggattacaggtgcccgaaaccatacccagctgatttttgtatttttagtaaagatggggcttcaccatgttggccaagatggtctcgaactcctgacctcaggtgatccacccacctcagcctcccaaagtgctaggattacaggcgtgagctaccacactggccttgtcctctttatttttaataaaattatttagtcattaagaattttggcttgtgg

SEQ ID NO: 133145 - DNA, 601 bp, Human
ccacttcctaggccactcagcggtgtatgtaacttaccaagtgatcattgcatcaactactctttgttagtgaagctggtgtctgcagaatcttgataaaaagactcatggataatgttgcttctttagtcaaatgggctcttgcatgcatttttatagattttcaaagtagtcatttttgttttaaaatcctgctgccaagtcctttatagtaattgcattttaaaaatatgtcttctttattttttattattatttttttttgagatggagtctcgctctgtcacccagtctggagttmaatggtacaatcttggctcactgcaacctccgcctcccaggttcaagcaattctcctgccttagcctcctgagtagctgggattacaggtgcccgaaaccatacccagctgatttttgtatttttagtaaagatggggcttcaccatgttggccaagatggtctcgaactcctgacctcaggtgatccacccacctcagcctcccaaagtgctaggattacaggcgtgagctaccacactggccttgtcctctttatttttaataaaattatttagtcattaagaattttggcttgtggg

SEQ ID NO: 133146 - DNA, 601 bp, Human
gcaattctcctgccttagcctcctgagtagctgggattacaggtgcccgaaaccatacccagctgatttttgtatttttagtaaagatggggcttcaccatgttggccaagatggtctcgaactcctgacctcaggtgatccacccacctcagcctcccaaagtgctaggattacaggcgtgagctaccacactggccttgtcctctttatttttaataaaattatttagtcattaagaattttggcttgtgggccgggcatggtggctcatgcctataatcccagcactttgggaggccraggtcagaggaccacttgagctgaggagttcgagaccagcctgggaaacatgacaagactccatatctactaaaactacaaaaaattagtcgggcgtgatggcttgtgcctgtggtttcagctactcgggagtctggagtgggaagatcgctttagcccagggggtggaagttgcagtgagccatgattgcaccactgcactccagtctgggtaacagagcaagacccagtctcaaaaaaaaaaaaaaaaaaagaattgtgactagtgaataattcatattcagagctctttttaatgta

SEQ ID NO: 133147 - DNA, 601 bp, Human
gtctcgaactcctgacctcaggtgatccacccacctcagcctcccaaagtgctaggattacaggcgtgagctaccacactggccttgtcctctttatttttaataaaattatttagtcattaagaattttggcttgtgggccgggcatggtggctcatgcctataatcccagcactttgggaggccaaggtcagaggaccacttgagctgaggagttcgagaccagcctgggaaacatgacaagactccatatctactaaaactacaaaaaattagtcgggcgtgatggcttgtgcctgtrgtttcagctactcgggagtctggagtgggaagatcgctttagcccagggggtggaagttgcagtgagccatgattgcaccactgcactccagtctgggtaacagagcaagacccagtctcaaaaaaaaaaaaaaaaaaagaattgtgactagtgaataattcatattcagagctctttttaatgtatgaactaaataataaaatagtaagtttaggctaagtgccctttttatttttaaaattttctgtatttattattactatttttagagatggagtctccctgtgttgcttaggctg

SEQ ID NO: 133148 - DNA, 601 bp, Human
ctttgctgactaggatgtcttattatataaatgagagagagtttgtaattttttaaaaaaaactgacaactttcaaaatagtttctcagtggcttcataaaaatccagaaaaaaagatttcacaaatttttgtgacactcaacatttttaaggtagttctctcagtgccttgcaaacagcagctctagtgtatattgagaaaaggaaaaattctgaatggcaaatactagatttcaactttaacctattcctttttattattattattattattattattattattattattattattatagagacaaagtctcgctctgttgcccaggctggagtgcagtggcgcgatctaggctcactgcaagctccacctcccggattcacaccattctcctgcctcaccctcctgagtagctgggactacaggcgcctgccaccatgcccggctaattttttgtatttttagtagagacggggtttcaccgtgttagccaggatggtcgcgatctcctgacctcatgatctgcccacctcagcctctcaaagtgctgggattacaggcgtgagccaccgcgtctggctaacctattccttttttttc

SEQ ID NO: 133149 - DNA, 601 bp, Human
ttttagtagagacggggtttcaccgtgttagccaggatggtcgcgatctcctgacctcatgatctgcccacctcagcctctcaaagtgctgggattacaggcgtgagccaccgcgtctggctaacctattccttttttttctttagtcttcttggttgtgtaaagaaaaattacccaaatcttaactttcagaaaaggtaacaaactcctaatgcatgtggcagtacatgtttgctccagctgccctgtccctctaccctgcgtggactccagaaccgcccatgttggagcccacctcctytccccacccctgcccactttccactcacacctcaggcaaaccctgcattttgctgttcctggaaaatggcttatgcttggatacctctgggcctctgttgatgcgtctgtctgttccttgtggaaattcttcctgacattcaaggctgcattcaaatgccttccttcccatgagacttttctgattccctgctcttccttttctatgtgtttcataccttcctgtgatatcacattctgccttaaaaagcaagagagtgatcagatacatattaccaaaaaaaaaaaaataccgatagca

SEQ ID NO: 133150 - DNA, 601 bp, Human
caggaataagagccagtttggaggagaaaattttaaattcagttttatattgtgttagagatgcctatagagtatccagcaactacgtatagaggaatataggaggatgtgaaaaataaggctccaaatttcagtgaagagagagcaggaatcatcagcacccattgtaggttagagaggtcacactagggaccacagaatacaagctaagggagaggcaccatcagagagatctggagagcagctggcagaatgttagaggacccagaacagcaggaaccaggacaagaaattttggaartaagagggcggagatggtcaccagaattaaaggctgggagaatactgaagagctcaagtctattgagaacttagaagaggccattagttctggccgagagaaaagcattcaggatttttacaaagttttggtaaatcccagtgagcgcaaagctagactgcagtagatcgagaagtgaatagaaagtgacaaacacagacggagtgaaaacaactctttcagtaagttcagtggtggaggaaagatagcttaaagaggaggtaatagtagagtcagaaccttcaacctgggcagaaaggc

SEQ ID NO: 133151 - DNA, 601 bp, Human
aaagagaggtgagccaggtgtagtggctcatacctgcaattccagcactttgggagactgaggcaggaggatcacttgggccaggagttttggcgagatcccatgtctaccaaaaaaaaaaaaaaaaaaaaaattagctgggcatggtcatgtgtgcctgtgggcccagccacttgggaggctgaggcagaatgattgcttgagcccagaaggttgcagtgagctacgatcatgccactacactcccacctgcgtgatcgagaaagaccctgtctctaaaaaaaaaaaaaaaattttaaaragagatgggaaaacaacttattggcaatagcacatgttcttgtttgtatgcaacaaacatataaaaagtagaaaaattgaccataagacatagccttactatttttcaaaagcctgataatgattgcaaattcatcccttagatgtggaaagacaaaaataagacttgtcttatttcattctgttattttctattgatttattattttgaaaacctgctttaattaaccttagtaattaagtagcatttgtctttaatgcttctacaattaggtagatgttttaaaaacatgccgattaa

SEQ ID NO: 133152 - DNA, 601 bp, Human
tcctgactgcattcagtgcagtattcattcccttgctttccagagaggccaaaagttcttgctcagtgactcacagtaagacatgaagcattttccttttaagattaatcagcagtggtagaagatttggaaaaatacacttgtatatgagtacactcagcctttatagttctgacccccaatgcagaatgttcatcttctatttctaaggtctgacttcagtctttcaggaaacacctcccaacctccttcgctttcctcctcttggttgtcagattctccacatgaagggtagaacctraggctcaagaattacttaactaaaaaacaccatctcacaaacaatttaaagatggaaagatagaaatagagataggcagacagatggacacatagattagggtttcagattctgttctttctctgtgggagaggtcagcgtgccatgactaccagcctggtctagaacccacagcagccatagttaccaagaccacagcaataaaagctgtgtttgttaagcattgccatgcacctagcactgtgttaaacacttcctgtgcctcctctcatcacctcacgtgaggtagataggtacaat

SEQ ID NO: 133153 - DNA, 601 bp, Human
gattaatcagcagtggtagaagatttggaaaaatacacttgtatatgagtacactcagcctttatagttctgacccccaatgcagaatgttcatcttctatttctaaggtctgacttcagtctttcaggaaacacctcccaacctccttcgctttcctcctcttggttgtcagattctccacatgaagggtagaacctgaggctcaagaattacttaactaaaaaacaccatctcacaaacaatttaaagatggaaagatagaaatagagataggcagacagatggacacatagattaggktttcagattctgttctttctctgtgggagaggtcagcgtgccatgactaccagcctggtctagaacccacagcagccatagttaccaagaccacagcaataaaagctgtgtttgttaagcattgccatgcacctagcactgtgttaaacacttcctgtgcctcctctcatcacctcacgtgaggtagataggtacaattatgtgggactcaaaagcaacgaaataataaaactggcttttttcccccttaaaaaaggtatgcgtgcctcagctgaaagacagaaaaaaaaaaaaaagtag

SEQ ID NO: 133154 - DNA, 601 bp, Human
tagggtttcagattctgttctttctctgtgggagaggtcagcgtgccatgactaccagcctggtctagaacccacagcagccatagttaccaagaccacagcaataaaagctgtgtttgttaagcattgccatgcacctagcactgtgttaaacacttcctgtgcctcctctcatcacctcacgtgaggtagataggtacaattatgtgggactcaaaagcaacgaaataataaaactggcttttttcccccttaaaaaaggtatgcgtgcctcagctgaaagacagaaaaaaaaaaaaaagtaggcaaataaaaatccttgttttctgtacaatttcagatttgtgtatgttttatgggaatttagtctcaccaaatgggatcgatttttcattccttttatgaacttctggtgtataaaaatgttaaaatcacctatataattggttgcactggtagttaaatggaacctaatttgtagcatgggcatttaacaatacagataatttattcattagagttagcctttggggggaacttcaacttacaaaaatacgttttagtgagattatagcagagggatctcactttaatatatcct

SEQ ID NO: 133155 - DNA, 601 bp, Human
ttggggggaacttcaacttacaaaaatacgttttagtgagattatagcagagggatctcactttaatatatcctaattctaaaatggtttttcggggtattttttggttatatttgttaggtgatagaaaagcaagactagtaaatgtagtaagtggctatctttggctgtttgtccatttaaattaacttttttgattacccattaggaaaaaattgcttttctaggtgtgtaaagttttgcatatgattatagcctcttacctgtaaaaactgaatcagagcttagaaccatgcctggygcacaatagtcattcaacaattattccttgaataaagagacagtattgtgtggtctgtgaaataacaaaagttcaggagcaacagacacttggtgattctagtcacctctattttgttataggataactggttttctctgagttttacaccagaatgccttcttcttttaatacgccttcttacttagtgcttttctcatgatcattttcccaaacttcctaatggacatagtgtctcattttctgtctgtttttaaacctgatactttggagtttaatccatcaaacatttattgttaa

SEQ ID NO: 133156 - DNA, 601 bp, Human
tttctaggtgtgtaaagttttgcatatgattatagcctcttacctgtaaaaactgaatcagagcttagaaccatgcctggtgcacaatagtcattcaacaattattccttgaataaagagacagtattgtgtggtctgtgaaataacaaaagttcaggagcaacagacacttggtgattctagtcacctctattttgttataggataactggttttctctgagttttacaccagaatgccttcttcttttaatacgccttcttacttagtgcttttctcatgatcattttcccaaacttcstaatggacatagtgtctcattttctgtctgtttttaaacctgatactttggagtttaatccatcaaacatttattgttaacctactatgtgtattttgttacacctaggaacaaagatgagaaaacatgttactcatataatttatattcgagtagaataactgatataaaccaacatcatagtatagtaacagtttaatacatgagctaatgtatgcatacaacaggagcccagcatttaggaagctttttataaactgtcccaaaccccaggttttttatatactcctaattgagtgg

SEQ ID NO: 133157 - DNA, 601 bp, Human
ctcctaattgagtggatggatggcccatcaaaatgtcccgtggaagacatataatgtcagaagttaccgagtgactctgataggctctgcctcccctaccctccgcactcctcaattaggaactactggtgaacaagaaatgaatgtagtacagccatccctccttattccctgggattggctccaggacccactcagataccaaaattcctaaatgtgcaagtctctgatataaaatggcatagtatttgcatgtaacctacacataccctcctgtatactttagatcatctctagatgrcttataatatctaatacagtataaatactgtataaatagttcctatggccaggtgtcatggctcatgcctgtaatcccatctctttgggaggtggaggcaggaggatcccttgagcccaggagttcgagaccagcctgggcaacatggtgaaaccctgtctctacaaaaaaattaaaaattagccaggcgtggtggcacacacctgtagtcctagctactcaggaggctgaggtgggagaatcgattgagtctaggaggtcgaggctgcagtgagccatgattgtgccactgcactccag

SEQ ID NO: 133158 - DNA, 601 bp, Human
ttcactttggcctcccaaagttctgggattacaggtgtgagctaccacacccagcccatattattttttattggttcttttttccaaatattttcaatccacagttggttgaatctgcagatgtggaacctgcgggtatggagggccaactgcataaggaattctatctgagcaaagtggtcaggaggtcacagaggattttgaaggaatatgctatctggggttttctttccattgtatttcaaaatacagtagacaaggacttaatatgtgccagaaattgtactaagtgctgaggatmcaataatgaacaagattcctgcctttgtggagattatatggcaagggaggaaagaaaacattatagattaattcctgtgatcagtgctgtgagataaggtcatatcctgagggacccagacaagcctagcaccaggggctggggtcaccagtagataaaaatatgaacaaccataccccagccccatggaacaacacagaaagaaaatggggaagagtgagtagggaacaggatttttgaccaaaacctcctagtttaaaggtttctatatgaagaggccatgtaccaaggatatattca

SEQ ID NO: 133159 - DNA, 601 bp, Human
aagtatctaaatataggctaattcaatttaaaggaatcccaactgagaggtaagattttcttcccctctaacacccaagtctggtctctaaggaggcccctacaaaacaatagttgtattagtcagcgataaaatttatttagggtcaatggaaatgaatttatgaatttgagactcaagggtacatgtcagtttcttcttgggaaaatccaaggtaatattcacagagtactcagatgggaaagttgtcgtgtgctgtcatgtctcatggtagaaatgctacccttagcataataacatrtaaaataactatctctggctgggcacagtggctcatgcctgtaaccccaacactttgggaggctgaggtgggtgaatcacttgaggtcaggagtttgagacccacctggacaacgtggtaaaaccctgtctctactaaaaatacaaaactgagccaggcatggtggcccaccccttgtaatcccagctactcagaggctgaggcaggagaatcgcttgaacccaggaggtggaggttgcagtgagctgggattgtgccactgcactccagcctgggcgacagagcaagactccatctcaa

SEQ ID NO: 133160 - DNA, 601 bp, Human
tactcagaggctgaggcaggagaatcgcttgaacccaggaggtggaggttgcagtgagctgggattgtgccactgcactccagcctgggcgacagagcaagactccatctcaaaatataaaataaaataaaataaaaatctctttgttctgggattcagcagagacagagtcttgctagagacataaacaaatatgacagtctctgcgctcgaggagcatatagtctagtgaagccgatcaccataaaaacgcatggctgtgataccacatcgtgagtgtaagaacagagctatgtatgcrtggggaacagtggacatgatggccaggtacccttattatgggaaacatagaacccaaagtgtgttcccaaaggaacatgattcaaaataatattttgctgaacatattggtaagaaggaaagaaaacatatctgagttgaaaagttacagtttattttttccccaaactagtccccactaacccctcttacattttccttgttgcttttctttctttcattatcttctttgacacttcctcaccctacaggcagccagtttgtctttctgacaaacatcattaagtggtaactctggaga

SEQ ID NO: 133161 - DNA, 601 bp, Human
tgtacctcagtttgttgttgttgttgttgttgttgttttgagacagagtcttgctctgttgccaggctggaatgcagtggcgtgatctcggctcactgcaacctccacctccctggttcaagcaattctcctgcgtcagcctcccgagtagctgggattgcaggcgcatgccaccatgcccagctaatttttttgtatttttagtagagatgggttttcaccatgttggccaggatggtcttgatctcctgacctcgtgatctgcccgcctctgcctcccaaagtgctgggattacaggcrtgagccaccgcgcccggctttgtagctcagtttttaatgacagggtttggctttgattctgatgtctgcacaacgctcccagggctgtaagaactgcagaacacactgagaagacaccgtcccagccatggaaagcccttctatgcagtcatttattttcacatgaacacctcccagagagctatgcaatgacttgatagatatgtgtaacttttcccctattcagatatattgttaggaaaatctcattaacctttcatgtattttgatgactatctcaagatggtagttcttctgttt

SEQ ID NO: 133162 - DNA, 601 bp, Human
tctgttgccaggctggaatgcagtggcgtgatctcggctcactgcaacctccacctccctggttcaagcaattctcctgcgtcagcctcccgagtagctgggattgcaggcgcatgccaccatgcccagctaatttttttgtatttttagtagagatgggttttcaccatgttggccaggatggtcttgatctcctgacctcgtgatctgcccgcctctgcctcccaaagtgctgggattacaggcatgagccaccgcgcccggctttgtagctcagtttttaatgacagggtttggcttygattctgatgtctgcacaacgctcccagggctgtaagaactgcagaacacactgagaagacaccgtcccagccatggaaagcccttctatgcagtcatttattttcacatgaacacctcccagagagctatgcaatgacttgatagatatgtgtaacttttcccctattcagatatattgttaggaaaatctcattaacctttcatgtattttgatgactatctcaagatggtagttcttctgtttagctaaactagtaagagtagaatcagttaatagaaaaaggaaacttatggcata

SEQ ID NO: 133163 - DNA, 601 bp, Human
agttcttctgtttagctaaactagtaagagtagaatcagttaatagaaaaaggaaacttatggcataaagccatatggtaataaggacaatgagttttctgatttgaaaataggtctttgatacctcaacaataatatacctggattcaattctttacagtataaaaaaaaccttgcacatttgttaggttcgagccacatgcacctgactactgctattattatcctctttattttagagatgaggaaaataaagtccagagaggttaaacattttgccctaagaccccacagcaagtgkgtagaagacctgggactataatgcaggttttctggcctctagttcagagcattcgtagcatgctagcccctcagtagcatagtactttaggaagctagtctttcccacttgctggtagtaagccagggagacataatacactaagaaagcttcggtctgagaaaactttccatgattgttttttctcaatttttagaacagtaggaattcttcacctcatctgctatcccaacatattcacaattggaaaatttttgtgctgttctgttcttttcaaattacaaaagtccttgactagga

SEQ ID NO: 133164 - DNA, 601 bp, Human
tacagtataaaaaaaaccttgcacatttgttaggttcgagccacatgcacctgactactgctattattatcctctttattttagagatgaggaaaataaagtccagagaggttaaacattttgccctaagaccccacagcaagtgggtagaagacctgggactataatgcaggttttctggcctctagttcagagcattcgtagcatgctagcccctcagtagcatagtactttaggaagctagtctttcccacttgctggtagtaagccagggagacataatacactaagaaagcttcgstctgagaaaactttccatgattgttttttctcaatttttagaacagtaggaattcttcacctcatctgctatcccaacatattcacaattggaaaatttttgtgctgttctgttcttttcaaattacaaaagtccttgactaggactgctggcttttacatgcacaggactgcacaacactggtgtttataaagctcattcgttcaatgataaaattggccatagcaaatcaaaaataaatgaagacctctgcgtagctgattggactacagaaaataagccattcatatccaggaagaa

SEQ ID NO: 133165 - DNA, 601 bp, Human
aatacactaagaaagcttcggtctgagaaaactttccatgattgttttttctcaatttttagaacagtaggaattcttcacctcatctgctatcccaacatattcacaattggaaaatttttgtgctgttctgttcttttcaaattacaaaagtccttgactaggactgctggcttttacatgcacaggactgcacaacactggtgtttataaagctcattcgttcaatgataaaattggccatagcaaatcaaaaataaatgaagacctctgcgtagctgattggactacagaaaataarccattcatatccaggaagaaaaaattaaaaggattgctgaaaaggaaagagccctaaagcaaactatctacagttttggttagttttcttttcttttcttttctttttttttttttttttttgaggtggggtcttgctttgttgcccaggtgggagtgtcttcttatattggtcaggctggccttgaactcggggctcaagccgtcctcccacctcagcctcccaaagagctggtattacaggtgtgagccaccagccatggttagttttcatcaactgctttctcaccttcttttcatc

SEQ ID NO: 133166 - DNA, 601 bp, Human
gtgtttataaagctcattcgttcaatgataaaattggccatagcaaatcaaaaataaatgaagacctctgcgtagctgattggactacagaaaataagccattcatatccaggaagaaaaaattaaaaggattgctgaaaaggaaagagccctaaagcaaactatctacagttttggttagttttcttttcttttcttttctttttttttttttttttttgaggtggggtcttgctttgttgcccaggtgggagtgtcttcttatattggtcaggctggccttgaactcggggctcaagcmgtcctcccacctcagcctcccaaagagctggtattacaggtgtgagccaccagccatggttagttttcatcaactgctttctcaccttcttttcatcctctaattcatacctgcaatccttattagaaatcctgtcaacttaatagtaccagaaagtcaggcaaaagactgataaaaaaaaagcctcggtggtcaagaacttaaaattacactactggtgtgcaacgtgctcttatctgtgttactggaggacaccctcaagatacctcactccagttgactccttggctctaaatcttt

SEQ ID NO: 133167 - DNA, 601 bp, Human
tttcttttcttttcttttctttttttttttttttttttgaggtggggtcttgctttgttgcccaggtgggagtgtcttcttatattggtcaggctggccttgaactcggggctcaagccgtcctcccacctcagcctcccaaagagctggtattacaggtgtgagccaccagccatggttagttttcatcaactgctttctcaccttcttttcatcctctaattcatacctgcaatccttattagaaatcctgtcaacttaatagtaccagaaagtcaggcaaaagactgataaaaaaaaagcctcggtggtcaagaacttaaaattacactactggtgtgcaacgtgctcttatctgtgttactggaggacaccctcaagatacctcactccagttgactccttggctctaaatctttgagttaaaaaataaggaggttctttatggaataaacaggtattaagctatttaaaggagagggctgcgaaatgcttgattatgggcttttcaagttcagaggccaagcgtttgtcattttcttccagtaactaggactgtgtcttgcccctaatagttactcagactatatttgcttaattg

SEQ ID NO: 133168 - DNA, 601 bp, Human
ttcttttcttttctttttttttttttttttttgaggtggggtcttgctttgttgcccaggtgggagtgtcttcttatattggtcaggctggccttgaactcggggctcaagccgtcctcccacctcagcctcccaaagagctggtattacaggtgtgagccaccagccatggttagttttcatcaactgctttctcaccttcttttcatcctctaattcatacctgcaatccttattagaaatcctgtcaacttaatagtaccagaaagtcaggcaaaagactgataaaaaaaaagcctcrgtggtcaagaacttaaaattacactactggtgtgcaacgtgctcttatctgtgttactggaggacaccctcaagatacctcactccagttgactccttggctctaaatctttgagttaaaaaataaggaggttctttatggaataaacaggtattaagctatttaaaggagagggctgcgaaatgcttgattatgggcttttcaagttcagaggccaagcgtttgtcattttcttccagtaactaggactgtgtcttgcccctaatagttactcagactatatttgcttaattgaattaa

SEQ ID NO: 133169 - DNA, 601 bp, Human
actcatgaaagttaagatttgcattgataggaaaagttttgcagaaatatggactcttgagagggtgggaggtatataaaagtggctatggctgtgcagcagagcaatttgcatttcttatacaccctgcttgagactgatgtcattagtgttggttaggccaaggctgggggaggctactcagaatagtgggtgaccaattacccagaacctttggaaaaggaaatgacttgattgaagaggccattctttaaatgtatcttactgctcaatttcaccattgcctattgtagaatgcgcsctgcccgctcagcatttgcctctaggcagaccaggactccttcccctccccaactaatcttccttctcctgtatcttattccctagggccacttgcacctttcaaaatggataaattaaattcccctgctccccttctaccaactttaacatcatatccttggtgtatgatgccctacttttcattgttttgcctaaataagagtatgcttgggaattttaggcttagggctgggaaaagatgggatatggaatcgtcagctatagattgccggacaagaaattttaggagcagtagacc

SEQ ID NO: 133170 - DNA, 601 bp, Human
agcgttagtttaaaatctccagttcatcctagaacaatcattttaaaaggaaaaaaagaagtggggaagtcctatagaaagcaatggaaagggaaaagttctcaacccagaatcggggcttaggttctagttcctggtttgctataaatggcactttgactttggaatgtctctggcttccgtttatccattagtcagagaatgatgggacagattacttctgaagaccccttatgtcctataaatctcatagttctcaacaagagggaaacgggaacaacaggggcagaaaccaacgagcggctgaggaaaccaaaccaatgagttttggattgtagctaaccgaggagaaccaggtgtgtcaaaggtgatgaaagtcagatgtgtaaaaagcaagaaggaaacaaaatgaagaacatgagccctaagaattcagtgtctttccctggtaaaactaagaacatcaggaaagccacactcgatgaggcacacatttttccaagccagttttcactctgacagggttacctcaagtgattgtttgagagagggtagaggggttgactacactcattcaatctgccaaattagaaaagtcacc

SEQ ID NO: 133171 - DNA, 601 bp, Human
gctggccacgatcttctcactaggtttgagggtaaggaggtcccctgtgaaatatgaaagtgaactctctgctatctaagaattggtgaattggttgcaaagaaaggcagaccaggcccacccagggatcactcttgcagtttgacagatctacctggaggctgaaagaatctatgcagccttcggaaatgcagtgaaaacagtataatcagatatgactagggaaaaaataaaacaactggtgttcatttgcatgtcaacacccagaattctctgctagttcacctcttcttcagaatgyagaaaggattgaaaaagctggaatggggccgggcatggtggctcatgcctgtaatcccatcactttgtgaggcagaggtgggtggatcacctgaggccaggagttcaagaccagcctggccaacatggtgaaaccccgtctatactaaaaaataaaaaaatttaaaaaaaattgccgggcgtggtggtgggtgcctgtaatcccagctactctggaggctgaggagaatcacttgaacccaggaggtggaggttgcagtgagcctagattgcgccattgcactccagcctgggcaacagg

SEQ ID NO: 133172 - DNA, 601 bp, Human
ggaggtcccctgtgaaatatgaaagtgaactctctgctatctaagaattggtgaattggttgcaaagaaaggcagaccaggcccacccagggatcactcttgcagtttgacagatctacctggaggctgaaagaatctatgcagccttcggaaatgcagtgaaaacagtataatcagatatgactagggaaaaaataaaacaactggtgttcatttgcatgtcaacacccagaattctctgctagttcacctcttcttcagaatgcagaaaggattgaaaaagctggaatggggccgggcrtggtggctcatgcctgtaatcccatcactttgtgaggcagaggtgggtggatcacctgaggccaggagttcaagaccagcctggccaacatggtgaaaccccgtctatactaaaaaataaaaaaatttaaaaaaaattgccgggcgtggtggtgggtgcctgtaatcccagctactctggaggctgaggagaatcacttgaacccaggaggtggaggttgcagtgagcctagattgcgccattgcactccagcctgggcaacaggagcaaaactccatctcaaaaaaaaaaaaaaaaaaa

SEQ ID NO: 133173 - DNA, 601 bp, Human
ttcggaaatgcagtgaaaacagtataatcagatatgactagggaaaaaataaaacaactggtgttcatttgcatgtcaacacccagaattctctgctagttcacctcttcttcagaatgcagaaaggattgaaaaagctggaatggggccgggcatggtggctcatgcctgtaatcccatcactttgtgaggcagaggtgggtggatcacctgaggccaggagttcaagaccagcctggccaacatggtgaaaccccgtctatactaaaaaataaaaaaatttaaaaaaaattgccgggcrtggtggtgggtgcctgtaatcccagctactctggaggctgaggagaatcacttgaacccaggaggtggaggttgcagtgagcctagattgcgccattgcactccagcctgggcaacaggagcaaaactccatctcaaaaaaaaaaaaaaaaaaaaatgaaatggtttggcatgatggtggggtgctgattcctctctctgtccttgagtatttactgccaggaaatcctgaccaacatcaattgccaaggggttaaagtcacattgttgttaaattgggagagaaaattagcaggatttt

SEQ ID NO: 133174 - DNA, 601 bp, Human
agatatgaatagaatctccaaccagtgcatcttgaagccggctgccacggccactcatgcaccttctctcctttcaggagagaattgtcagcatctctgctcaaaacaatctttacttttagtccatcagagacttcatgtttgtcgtgcatgcacactcacacctctccacacatatgcccactccccacacacatcctgcttctgagaaatgcaactagaatttcctccggagaagagatggaaacccctgattgagaaatttaaggcctaggaaaggtaaatgacttttcttaagtcwcatggctcaccacagaaccaaagctggaacacacataccctcagctcttcttccagtgctttcaggtatacaagtatttgaacaggattcaaggtttaactccttatgtgtcattcagtgtatccagtgtaagtaaaatgttaccccttagtcagaacagccttgagaatttctcaatgactacaaaccttgcttagttctatacaagggaagtaaaagagagagaatgtcatgaccaaatgacttaacttttgaaggcagcctattgcaaacttgaataattggggcatgtattttatt

SEQ ID NO: 133175 - DNA, 601 bp, Human
ctagttctatcaggtcagtaacctggggtccctggggctcccccatgggtcataccagatagatagattttttaaaaatttgttggaattaaagtagaatcaaagcctagtgctagcccagaataagttattcaataaatgcttgttgagtgaataatcatccgaaatgattataatactgcctaccattcgttgaaagcttcagtatgtgggagaatctgtcctgggcactttatatacacccataatctgtttggatttcttggtaggaagactacatggctgcatacatggtctttcwttacctccattttatagatggagaaaatggaaatttaaagaggttaagcagtttgccgaaggtcacagagctactaatcggtgaggtcaaggttcagacccaggtctctcagactttaaaactggtgcacttaaccattagactctactttttgcgtattgagatgtggaagcatctcaattaattgcttcagtcttggagttctttggcggttatcaaaaactgcctatttccatattgcctccagatattgtaattaagaatttccaaggccaggcacagtggcttatatctgtaatc

SEQ ID NO: 133176 - DNA, 601 bp, Human
tattgcctccagatattgtaattaagaatttccaaggccaggcacagtggcttatatctgtaatcccaacattttgggaaaccaaagttggaagatcccttgagcccagaagtttgagaccagcctgggcaacatagggaggcttcgtctctacaaaaaatacaaaaattagccaggtgtggtggcgcatgcatgtgtagtccaagctactctggaggctgaggcaggaggattgcttaagcccaggaatttgaggctccagtgagctgtgattgtgccactgcactccagcctgggcaayagagtgagatcctgtctcaaaaaaaaaaagaaaagaaaaagaaaaaagaatctccagattatagttcagatattacgtattaatatccaaagccctccttaagacaccattttaatctgtctaacaaaattaacaccctaggttttgacaattgcttgaggagggagtagggcctggtgatagagctaaagactagtgttctggttctttaatttgttcagccagcaggtacctggaaataatgatactgtttgcagaactccccacaaaaatggacagtcaactttaaataactaagta

SEQ ID NO: 133177 - DNA, 601 bp, Human
aaacagaataaccctgatgcagctgtcacggcagaacactcattccagctcacagaacaccagtgttcaatcagcactgagtttgaggagcaccgggtttgggagtattcatctctcttccctgtcccatagctgcccttcaaactcttgagactgttcccagctctaaaatggaaagggtcgtcttctctctggaacaaaagacaggatgtacttgcttgaataggccagtgctttcctggaggaaactccggcttatggagcctctgcttctgcacagcccagtgccttccaccccctsttcatctgctagcatctacattactagttaactggagaggagaccaaacccaaaatattacaaaacatagatattaaaaatactgtgaacaacaatcagcccgctttctcccacctctcctgtaccagctaaatatttacctccctcatccgtagagggtttttggacaagacaggctggtgcctacatggtgaaagttgtttttctctcttttcttgtaatattgcaaataaacaaggatatctgctttctcttgagcaggacaacagccaaagagtattattgcatagttcctgtccc

SEQ ID NO: 133178 - DNA, 601 bp, Human
gactatggggtcgaatgctgagtcattcctgtccccacaccagcagtcctggaagaggctcagtcgatcagtcagtgggctgctttctggagcactttatcattttgggctctcacaatgtgtgtttaaactctgagtgaccccaggcagccttccagactggcacagttcaccaagacgttcagacagatcatctgcaagtgaggaagaatgaaaacccagcactggttcaaatcactcctagcagaggtagtgaaggcatcactcagtcctggagaaatcttcggagggctcaccagcrtcacaagtaggtagaccagaagaggcaggctggcccattgcaaagccctggaatcagagggacaggagttccaaatccccactctctctcttcctagatgtgtgcttgcggcaattatttatctctctgagccttaatttccttatcaggaccctgagcaaaccaaataacatgatgtgaagcctctggcacaatgcctgggacatgttcagcacacaataaatgctaattttcccttttgccctatatgatatgatttgaagcagcgccactcaatcctgccagtcacattgctggaaa

SEQ ID NO: 133179 - DNA, 601 bp, Human
ggggcctctaaccccagggtgcacagaggtagggacccaagggctttccggggtcggacagaaatctcgggttccattttcactctgagagacccagaaatgacagagcccatgctcagtttccactggtggtgctgttgagtggaggggctttgaacatggcacacaggaaagggttgcccaccctgtcaccagatgggcttgcactgttttgtggtttgggagttgcatattggaggtgggagtggagtgttgagatgaggcaagttgagatgtaatcgctatttaatgggcagatcaragaaaacattggctggtttgatttttattatggttatcccgctccaccatcctggcccagtcatatatattattgttatcaggcatagataggggaagcaattaaatgtgaaactgttatttaaaccggcaagtgtcagaatgttaacccacttcagagcgaaggctctaccagcaacatgtgtgttcactgcagaatgtgctggttacagatgatctttatctgtttgtcaaagcatttgcaagatctctattttatgtcatcccctttccctgaaagcagcagcagtaaacgacattg

SEQ ID NO: 133180 - DNA, 601 bp, Human
agagaggccagttccatgacactgcaccggagccaagtgtttccagcaagccctgatcagttgcatgttagtccttgtttgtatgataaacgggacctagtagattaacatcatctcctcagcccaagggctgaccccagtggtgctgctcaagaggaaggaggaggctgggagcggtggctcccgcttgtcatcccagcactttgaggggctgaggagggcaaatctcttgagcccagcattcaagagcagcctggaaaatgtagagattctgtctctaccaaaaaaaaaaaaaaaaaaraagaagcaggtggaggaaggaggagctgcagaaaggctccgggagccagtgtctagtaagcagaggcctagcccaggctgagtggtcccagcccaggagggcctctctcggcacctgtctttagatgcacgtctgcctctggcctttgagatgcacacattcatcaagcaggaggatctgtagtcattaaaccaaggtgccagtctggggcccagccttcaatgaagcatcagtggctttttcattcccatagagcaactgcgaggaagaccccatgctcccaggggcccaattctccag

SEQ ID NO: 133181 - DNA, 601 bp, Human
cttctcagaatctgagatcttttgctgatggttccaaaattgaatgctgaaatctaaaaagaaaattatacttactctggtcaatgggatatgttggagacctgagagtgaaaaaatcaaactgaagaccagtttccttctttaatggaagaaaagtaagaaagttaacttagaagaatatttagagttctgaaaatcccactctgagaccactctgccatctcacattgttctcttgagccttatctcaatggataaaggtcactagagtttattagacacaggaaaacatcgtttacaaacttcttcattgtgtagggattctgccttcaggcctgttcaccagccaggagaattgtgctttttgatccagggctcttggccagaacagccttctcgctcattaactcagtcaaccaaatgcttcctgtgtttccactggtggttcagaacgtagtctctgccctctgatacctcacggtctaacgggggagaaacaagaaagtcagaacttacaatacaagataataaggaataagagcagagcctttggaaccagacagacttagatccaaatgtcagctctgcatttactagcaag

SEQ ID NO: 133182 - DNA, 601 bp, Human
ttagaagaatatttagagttctgaaaatcccactctgagaccactctgccatctcacattgttctcttgagccttatctcaatggataaaggtcactagagtttattagacacaggaaaacatcgtttacagacttcttcattgtgtagggattctgccttcaggcctgttcaccagccaggagaattgtgctttttgatccagggctcttggccagaacagccttctcgctcattaactcagtcaaccaaatgcttcctgtgtttccactggtggttcagaacgtagtctctgccctctratacctcacggtctaacgggggagaaacaagaaagtcagaacttacaatacaagataataaggaataagagcagagcctttggaaccagacagacttagatccaaatgtcagctctgcatttactagcaagtggtctatcttggtaagatgcaactcttttctctaagtcttaatttctccctctgtaaagtatgacctcatggggttattgtgaagattaaatggcatatcgtatataaggcccttggcacgatctttggaaaataataaccattcagtgaatgtaatctactagtata

SEQ ID NO: 133183 - DNA, 601 bp, Human
tatttagagttctgaaaatcccactctgagaccactctgccatctcacattgttctcttgagccttatctcaatggataaaggtcactagagtttattagacacaggaaaacatcgtttacagacttcttcattgtgtagggattctgccttcaggcctgttcaccagccaggagaattgtgctttttgatccagggctcttggccagaacagccttctcgctcattaactcagtcaaccaaatgcttcctgtgtttccactggtggttcagaacgtagtctctgccctctgatacctcayggtctaacgggggagaaacaagaaagtcagaacttacaatacaagataataaggaataagagcagagcctttggaaccagacagacttagatccaaatgtcagctctgcatttactagcaagtggtctatcttggtaagatgcaactcttttctctaagtcttaatttctccctctgtaaagtatgacctcatggggttattgtgaagattaaatggcatatcgtatataaggcccttggcacgatctttggaaaataataaccattcagtgaatgtaatctactagtatagtagcgatt

SEQ ID NO: 133184 - DNA, 601 bp, Human
ccttcaggcctgttcaccagccaggagaattgtgctttttgatccagggctcttggccagaacagccttctcgctcattaactcagtcaaccaaatgcttcctgtgtttccactggtggttcagaacgtagtctctgccctctgatacctcacggtctaacgggggagaaacaagaaagtcagaacttacaatacaagataataaggaataagagcagagcctttggaaccagacagacttagatccaaatgtcagctctgcatttactagcaagtggtctatcttggtaagatgcaactyttttctctaagtcttaatttctccctctgtaaagtatgacctcatggggttattgtgaagattaaatggcatatcgtatataaggcccttggcacgatctttggaaaataataaccattcagtgaatgtaatctactagtatagtagcgattgaggtgtttatagggtgctatgagggcccagagaaaggagatgagatgaacaggagagaggaagggatactgttgaggaaggatttcaggatggaatcccaccacaggctgtattttgaagaaatggttgaagtcaataagaagagtg

SEQ ID NO: 133185 - DNA, 601 bp, Human
ggcactaagaagaaaatgtggaggcttcaatgcatttattagaatacaaagaataccaaatcaaatgaattaagcattcaactcaagaaaactagaaaaagagaagaaagtaaacctaaagaaagttttaaaaaggaattcaataaattaaaaacaaaacacacaatttttaaaaacagacttgattaataaaaccaaaagctatgtcttttttaaaaaagcaaaaaatagataaacctttgacaaatcagatttttttaatgagagaatgcacaaataaagagctctaagagctgggcayggtgactcatgcctatattcccagcactttgggaggctgaggcaggaggattggttgaggccaggagtttaagaccagcctgggctacgtagcaagaccccacctctacaaaaaatttcgaaattagttgggtgtggcggctcatgcctatagtcccagctacttgggaggctaaagcaggaggatcacctgaacccaggagttggaggctgcagtgagccatgatcatgccactgcactgggcaacagattaagactctgtcacaaaaaaaaaagcgttaagttaaggagcgtgaataa

SEQ ID NO: 133186 - DNA, 601 bp, Human
ttttttaaaaaagcaaaaaatagataaacctttgacaaatcagatttttttaatgagagaatgcacaaataaagagctctaagagctgggcatggtgactcatgcctatattcccagcactttgggaggctgaggcaggaggattggttgaggccaggagtttaagaccagcctgggctacgtagcaagaccccacctctacaaaaaatttcgaaattagttgggtgtggcggctcatgcctatagtcccagctacttgggaggctaaagcaggaggatcacctgaacccaggagttggargctgcagtgagccatgatcatgccactgcactgggcaacagattaagactctgtcacaaaaaaaaaagcgttaagttaaggagcgtgaataaaaataatacatttcatattctaagacaatatcatctacaactttattccaatataaattactaaaactttaccatataagtagtagaaagcctgaatagataaaagctatggaagaaaaattaaagatagtgatagatttatcaccaagctcagatggttctgcaaacaaattctaagaaaccgtcagggaacagatcattactgcgt

SEQ ID NO: 133187 - DNA, 601 bp, Human
aaagagctctaagagctgggcatggtgactcatgcctatattcccagcactttgggaggctgaggcaggaggattggttgaggccaggagtttaagaccagcctgggctacgtagcaagaccccacctctacaaaaaatttcgaaattagttgggtgtggcggctcatgcctatagtcccagctacttgggaggctaaagcaggaggatcacctgaacccaggagttggaggctgcagtgagccatgatcatgccactgcactgggcaacagattaagactctgtcacaaaaaaaaaagcrttaagttaaggagcgtgaataaaaataatacatttcatattctaagacaatatcatctacaactttattccaatataaattactaaaactttaccatataagtagtagaaagcctgaatagataaaagctatggaagaaaaattaaagatagtgatagatttatcaccaagctcagatggttctgcaaacaaattctaagaaaccgtcagggaacagatcattactgcgttgacacagaaggcaaacctctcaacttggtgtataaggctagttaacattgttactaaaacaggcaaaga

SEQ ID NO: 133188 - DNA, 601 bp, Human
gcgttgacacagaaggcaaacctctcaacttggtgtataaggctagttaacattgttactaaaacaggcaaagaatggcccccaaaataactctaaaccagtatcacctacaaatacaaaaactctatataaaatattagcaagtgagtacaagagtataaggaactctattaatgtaattcactgtgctaggttaagataaaaccataactcttcagatatcatagctctttagatagaaaaatgtaaaagtatttgataaaaattcaacaacattcctgactaaaacaaattaaaattktaaaacccctggaaagccaggagtaaaacatgttctccataatctatagcaaacatcatagttgctgataaaccattagaagcatttccttcaaagttaggaataaaacaagaattgctactattgctactattatttaatcccatattggaggttttagccaacacactatggcaagaagaggaaatgagaaaggttaatgctgcaaaagaagaaataaataaagctaccattgctgatataattatctatccaaaaaaagtagaaatccatgattaaaagctatttgaactgataaaa

SEQ ID NO: 133189 - DNA, 601 bp, Human
agaaataaataaagctaccattgctgatataattatctatccaaaaaaagtagaaatccatgattaaaagctatttgaactgataaaagttcagaaaattggaattgtttcaatatactaaaatcaattagttttctgcacatcagtggggatatattagatgtaatgaaaatgaagggtccattcacaatagaagctataaagtatttgagaataaatctaacaagatctacataaagaaaaaagtaaactgcttaaaagtaatttaagttcaccatttgcaaattgaactaaagaaaaatctaaagaagaactagtgaaaattgcttgcaatcttaccactgaaaagaaacctctgttaaaatgtatcagtattttaaaactgtgttttgtcctttggaaatatgccatattaagcaaacatagcataagcaaattaagcaaaaagacaaacctttttttaaaagcatatttgtgaaaaaagcatatttgaagctatgataagaaactgagtagaagctataaaacgtagattcatcaggaaggagcagaagttgaaaaggagatttctggctgggcacagtggctcatgcctgtaatc

SEQ ID NO: 133190 - DNA, 601 bp, Human
caaattaagcaaaaagacaaacctttttttaaaagcatatttgtgaaaaaagcatatttgaagctatgataagaaactgagtagaagctataaaacgtagattcatcaggaaggagcagaagttgaaaaggagatttctggctgggcacagtggctcatgcctgtaatcccagcactttgggaggccaaggcgggtggatcacttgaggtcaggagtttgagacaagcctggccaacatggtgaaaccctatctctactaaaaatacaaaaattagaaaggcgtggtggtgagcacctatsatcccagctactcaggaggctgaggcaggagaatagcttgatcccgggaggcataggttgtagtgagccgacgtcatgccactgcactccagcctggatgacagagcaagactccatctcaaaaaaaaaaaaaaagaaaagaaaagaaaaggagatttctgagtagaaacacgttagcagaggaaacttcatttggggaacaggattgttttgatgccatgctccctcagctgaccacacagattacatcctggccagaaaaaggccctgcaaagagctctgatcattttggttctgatt

SEQ ID NO: 133191 - DNA, 601 bp, Human
aagaaactgagtagaagctataaaacgtagattcatcaggaaggagcagaagttgaaaaggagatttctggctgggcacagtggctcatgcctgtaatcccagcactttgggaggccaaggcgggtggatcacttgaggtcaggagtttgagacaagcctggccaacatggtgaaaccctatctctactaaaaatacaaaaattagaaaggcgtggtggtgagcacctatcatcccagctactcaggaggctgaggcaggagaatagcttgatcccgggaggcataggttgtagtgagccracgtcatgccactgcactccagcctggatgacagagcaagactccatctcaaaaaaaaaaaaaaagaaaagaaaagaaaaggagatttctgagtagaaacacgttagcagaggaaacttcatttggggaacaggattgttttgatgccatgctccctcagctgaccacacagattacatcctggccagaaaaaggccctgcaaagagctctgatcattttggttctgattccatccttagttcttacccattatctgcttacccttcctccccacctatttaagatacaaagcaaaacaa

SEQ ID NO: 133192 - DNA, 601 bp, Human
ttctggctgggcacagtggctcatgcctgtaatcccagcactttgggaggccaaggcgggtggatcacttgaggtcaggagtttgagacaagcctggccaacatggtgaaaccctatctctactaaaaatacaaaaattagaaaggcgtggtggtgagcacctatcatcccagctactcaggaggctgaggcaggagaatagcttgatcccgggaggcataggttgtagtgagccgacgtcatgccactgcactccagcctggatgacagagcaagactccatctcaaaaaaaaaaaaaaagaaaagaaaagaaaaggagatttctgagtagaaacacgttagcagaggaaacttcatttggggaacaggattgttttgatgccatgctccctcagctgaccacacagattacatcctggccagaaaaaggccctgcaaagagctctgatcattttggttctgattccatccttagttcttacccattatctgcttacccttcctccccacctatttaagatacaaagcaaaacaaaccaaaaatacagatgagttgcttggtagagctgcctaggcctccaaggcggggcccagaggatt

SEQ ID NO: 133193 - DNA, 601 bp, Human
gcactttgggaggccaaggcgggtggatcacttgaggtcaggagtttgagacaagcctggccaacatggtgaaaccctatctctactaaaaatacaaaaattagaaaggcgtggtggtgagcacctatcatcccagctactcaggaggctgaggcaggagaatagcttgatcccgggaggcataggttgtagtgagccgacgtcatgccactgcactccagcctggatgacagagcaagactccatctcaaaaaaaaaaaaaaagaaaagaaaagaaaaggagatttctgagtagaaacaygttagcagaggaaacttcatttggggaacaggattgttttgatgccatgctccctcagctgaccacacagattacatcctggccagaaaaaggccctgcaaagagctctgatcattttggttctgattccatccttagttcttacccattatctgcttacccttcctccccacctatttaagatacaaagcaaaacaaaccaaaaatacagatgagttgcttggtagagctgcctaggcctccaaggcggggcccagaggattttttgactgaaccccctgttgtgttttccatatgtgc

SEQ ID NO: 133194 - DNA, 601 bp, Human; identical to SEQ ID NO: 133111

SEQ ID NO: 133195 - DNA, 601 bp, Human; identical to SEQ ID NO: 133112

SEQ ID NO: 133196 - DNA, 601 bp, Human; identical to SEQ ID NO: 133113

SEQ ID NO: 133197 - DNA, 601 bp, Human; identical to SEQ ID NO: 133114

SEQ ID NO: 133198 - DNA, 601 bp, Human; identical to SEQ ID NO: 133115

SEQ ID NO: 133199 - DNA, 601 bp, Human; identical to SEQ ID NO: 133116

SEQ ID NO: 133200 - DNA, 601 bp, Human; identical to SEQ ID NO: 133117

SEQ ID NO: 133201 - DNA, 601 bp, Human; identical to SEQ ID NO: 133118

SEQ ID NO: 133202 - DNA, 601 bp, Human; identical to SEQ ID NO: 133119

SEQ ID NO: 133203 - DNA, 601 bp, Human; identical to SEQ ID NO: 133120

SEQ ID NO: 133204 - DNA, 601 bp, Human; identical to SEQ ID NO: 133121

SEQ ID NO: 133205 - DNA, 601 bp, Human; identical to SEQ ID NO: 133122

SEQ ID NO: 133206 - DNA, 601 bp, Human; identical to SEQ ID NO: 133123

SEQ ID NO: 133207 - DNA, 601 bp, Human; identical to SEQ ID NO: 133124

SEQ ID NO: 133208 - DNA, 601 bp, Human; identical to SEQ ID NO: 133125

SEQ ID NO: 133209 - DNA, 601 bp, Human; identical to SEQ ID NO: 133126

SEQ ID NO: 133210 - DNA, 601 bp, Human; identical to SEQ ID NO: 133127

SEQ ID NO: 133211 - DNA, 601 bp, Human; identical to SEQ ID NO: 133128

SEQ ID NO: 133212 - DNA, 601 bp, Human; identical to SEQ ID NO: 133129

SEQ ID NO: 133213 - DNA, 601 bp, Human; identical to SEQ ID NO: 133130

SEQ ID NO: 133214 - DNA, 601 bp, Human; identical to SEQ ID NO: 133131

SEQ ID NO: 133215 - DNA, 601 bp, Human; identical to SEQ ID NO: 133132

SEQ ID NO: 133216 - DNA, 601 bp, Human; identical to SEQ ID NO: 133133

SEQ ID NO: 133217 - DNA, 601 bp, Human; identical to SEQ ID NO: 133134

SEQ ID NO: 133218 - DNA, 601 bp, Human; identical to SEQ ID NO: 133135

SEQ ID NO: 133219 - DNA, 601 bp, Human; identical to SEQ ID NO: 133136

SEQ ID NO: 133220 - DNA, 601 bp, Human; identical to SEQ ID NO: 133137

SEQ ID NO: 133221 - DNA, 601 bp, Human; identical to SEQ ID NO: 133138

SEQ ID NO: 133222 - DNA, 601 bp, Human; identical to SEQ ID NO: 133139

SEQ ID NO: 133223 - DNA, 601 bp, Human; identical to SEQ ID NO: 133140

SEQ ID NO: 133224 - DNA, 601 bp, Human; identical to SEQ ID NO: 133141

SEQ ID NO: 133225 - DNA, 601 bp, Human; identical to SEQ ID NO: 133142

SEQ ID NO: 133226 - DNA, 601 bp, Human; identical to SEQ ID NO: 133143

SEQ ID NO: 133227 - DNA, 601 bp, Human; identical to SEQ ID NO: 133144

SEQ ID NO: 133228 - DNA, 601 bp, Human; identical to SEQ ID NO: 133145

SEQ ID NO: 133229 - DNA, 601 bp, Human; identical to SEQ ID NO: 133146

SEQ ID NO: 133230 - DNA, 601 bp, Human; identical to SEQ ID NO: 133147

SEQ ID NO: 133231 - DNA, 601 bp, Human; identical to SEQ ID NO: 133148

SEQ ID NO: 133232 - DNA, 601 bp, Human; identical to SEQ ID NO: 133149

SEQ ID NO: 133233 - DNA, 601 bp, Human; identical to SEQ ID NO: 133150

SEQ ID NO: 133234 - DNA, 601 bp, Human; identical to SEQ ID NO: 133151

SEQ ID NO: 133235 - DNA, 601 bp, Human; identical to SEQ ID NO: 133152

SEQ ID NO: 133236 - DNA, 601 bp, Human; identical to SEQ ID NO: 133153

SEQ ID NO: 133237 - DNA, 601 bp, Human; identical to SEQ ID NO: 133154

SEQ ID NO: 133238 - DNA, 601 bp, Human; identical to SEQ ID NO: 133155

SEQ ID NO: 133239 - DNA, 601 bp, Human; identical to SEQ ID NO: 133156

SEQ ID NO: 133240 - DNA, 601 bp, Human; identical to SEQ ID NO: 133157

SEQ ID NO: 133241 - DNA, 601 bp, Human; identical to SEQ ID NO: 133158

SEQ ID NO: 133242 - DNA, 601 bp, Human; identical to SEQ ID NO: 133159

SEQ ID NO: 133243 - DNA, 601 bp, Human; identical to SEQ ID NO: 133160

SEQ ID NO: 133244 - DNA, 601 bp, Human; identical to SEQ ID NO: 133161

SEQ ID NO: 133245 - DNA, 601 bp, Human; identical to SEQ ID NO: 133162

SEQ ID NO: 133246 - DNA, 601 bp, Human; identical to SEQ ID NO: 133163

SEQ ID NO: 133247 - DNA, 601 bp, Human; identical to SEQ ID NO: 133164

SEQ ID NO: 133248 - DNA, 601 bp, Human; identical to SEQ ID NO: 133165

SEQ ID NO: 133249 - DNA, 601 bp, Human; identical to SEQ ID NO: 133166

SEQ ID NO: 133250 - DNA, 601 bp, Human; identical to SEQ ID NO: 133167

SEQ ID NO: 133251 - DNA, 601 bp, Human; identical to SEQ ID NO: 133168

SEQ ID NO: 133252 - DNA, 601 bp, Human; identical to SEQ ID NO: 133169

SEQ ID NO: 133253 - DNA, 601 bp, Human; identical to SEQ ID NO: 133170

SEQ ID NO: 133254 - DNA, 601 bp, Human; identical to SEQ ID NO: 133171

SEQ ID NO: 133255 - DNA, 601 bp, Human; identical to SEQ ID NO: 133172

SEQ ID NO: 133256 - DNA, 601 bp, Human; identical to SEQ ID NO: 133173

SEQ ID NO: 133257 - DNA, 601 bp, Human; identical to SEQ ID NO: 133174

SEQ ID NO: 133258 - DNA, 601 bp, Human; identical to SEQ ID NO: 133175

SEQ ID NO: 133259 - DNA, 601 bp, Human; identical to SEQ ID NO: 133176

SEQ ID NO: 133260 - DNA, 601 bp, Human; identical to SEQ ID NO: 133177

SEQ ID NO: 133261 - DNA, 601 bp, Human; identical to SEQ ID NO: 133178

SEQ ID NO: 133262 - DNA, 601 bp, Human; identical to SEQ ID NO: 133179

SEQ ID NO: 133263 - DNA, 601 bp, Human; identical to SEQ ID NO: 133180

SEQ ID NO: 133264 - DNA, 601 bp, Human; identical to SEQ ID NO: 133181

SEQ ID NO: 133265 - DNA, 601 bp, Human; identical to SEQ ID NO: 133182

SEQ ID NO: 133266 - DNA, 601 bp, Human; identical to SEQ ID NO: 133183

SEQ ID NO: 133267 - DNA, 601 bp, Human; identical to SEQ ID NO: 133184

SEQ ID NO: 133268 - DNA, 601 bp, Human; identical to SEQ ID NO: 133185

SEQ ID NO: 133269 - DNA, 601 bp, Human; identical to SEQ ID NO: 133186

SEQ ID NO: 133270 - DNA, 601 bp, Human; identical to SEQ ID NO: 133187

SEQ ID NO: 133271 - DNA, 601 bp, Human; identical to SEQ ID NO: 133188

SEQ ID NO: 133272 - DNA, 601 bp, Human; identical to SEQ ID NO: 133189

SEQ ID NO: 133273 - DNA, 601 bp, Human; identical to SEQ ID NO: 133190

SEQ ID NO: 133274 - DNA, 601 bp, Human; identical to SEQ ID NO: 133191

SEQ ID NO: 133275 - DNA, 601 bp, Human; identical to SEQ ID NO: 133192

SEQ ID NO: 133276 - DNA, 601 bp, Human; identical to SEQ ID NO: 133193

SEQ ID NO: 133277 - DNA, 601 bp, Human
taccagtcaagagatactgcttctggctgttggcttctagtttcacaccacagagggaagagtcaaaaggcgtatagatatactgaacatccttgactttctcaaaccctttgaacatctgacaggcaattacaaaaaaaggcaatattgggtcagtgagtgtactgtatatattaacagacaaaaacctctcacttctcagcctaaaaatgtaagcaaaagtctagttgaggattttgtgtcctcagatgtccctactgggttattttctctcttaaaacaaaacaacaacaaaaaaaamcacctaaaccttggtttattccagtaggtacctgtagtggcaccatacaccagcagctgtgggaccagatggatgctgaggccctccctggcaatatccctgggattctatgggctctgcctccaaatctcatccagttccacttcagtatctagacccaaggattactgagccaggccacctgaaagctaccagccctcccagaacacagactccactttctccatcagccttaggggctacacatcccagcctgcccccatgtacctttatctgtttgatttcataccggagcatttt

SEQ ID NO: 133278 - DNA, 601 bp, Human
ttaacttaccagtcaagagatactgcttctggctgttggcttctagtttcacaccacagagggaagagtcaaaaggcgtatagatatactgaacatccttgactttctcaaaccctttgaacatctgacaggcaattacaaaaaaaggcaatattgggtcagtgagtgtactgtatatattaacagacaaaaacctctcacttctcagcctaaaaatgtaagcaaaagtctagttgaggattttgtgtcctcagatgtccctactgggttattttctctcttaaaacaaaacaacaacaamaaaaaacacctaaaccttggtttattccagtaggtacctgtagtggcaccatacaccagcagctgtgggaccagatggatgctgaggccctccctggcaatatccctgggattctatgggctctgcctccaaatctcatccagttccacttcagtatctagacccaaggattactgagccaggccacctgaaagctaccagccctcccagaacacagactccactttctccatcagccttaggggctacacatcccagcctgcccccatgtacctttatctgtttgatttcataccggag

SEQ ID NO: 133279 - DNA, 601 bp, Human
acagctctgttttatgcccaagaaaatgccacctggctcagcctactgcccaaggaagaccctggctcctttctcactacctcccctagggcagaatctattatattaaggccagttgttggtcttttaacttaccagtcaagagatactgcttctggctgttggcttctagtttcacaccacagagggaagagtcaaaaggcgtatagatatactgaacatccttgactttctcaaaccctttgaacatctgacaggcaattacaaaaaaaggcaatattgggtcagtgagtgtactgtwtatattaacagacaaaaacctctcacttctcagcctaaaaatgtaagcaaaagtctagttgaggattttgtgtcctcagatgtccctactgggttattttctctcttaaaacaaaacaacaacaaaaaaaaacacctaaaccttggtttattccagtaggtacctgtagtggcaccatacaccagcagctgtgggaccagatggatgctgaggccctccctggcaatatccctgggattctatgggctctgcctccaaatctcatccagttccacttcagtatctagacccaaggattac

SEQ ID NO: 133280 - DNA, 601 bp, Human
gctcaatcatttactcactgagtgactgctgtgatctagtaccaggaatacagatataaaaatgacaggatctctgctcccaaggagcttagaaatgagtagggtagatggataagtagggaaaaattacactattgtgtggttctatacaaagtgcagtataagaacaaaggaacatacaattatttccatctatggaaggagtgtggggcaaagaaggtgtctcagagaagactgtgcttgcattgggccttgaagggatgagtgggagtctgcctaccaaacaggttgggggaagggyttcctgtcattgccactatcctgtgcagaggcagggagacacagcctggcagcataccttctgcaaccacaggtagctgagttcagttcttgggaaagtgaggggctgggaactgatattgacaaagctagagagggcagcagtgttctggtcacaaagagctttcaacaccaggcaaaggagcttgtgccttctcctgtaggacctgggcaccattgataacttttcttagactattttttgtcatttctccccaccctcagttagacttgacctccctgaaggcagggaacatgtttc

SEQ ID NO: 133281 - DNA, 601 bp, Human
gcatggggctcagtgaagggaccaataaataaaactactataatctttctagcaaaaagataagcagattatgtttgtacgaggcagagttgtgggatctggtgaaggccttttcgtttagcatggtacagagagaagaatgtggtctttaaagtcaaagtctgtgtgggatccccctttcttttctgtcatttactagctgaatgatcttaaggaagttgtataacctctcagctggaagatgaaaattataaagttgtcagattaaatgagagattgtctataaagttcccagcacagtgtggtcccacagaagatattcaataaataataggtcccttcccctttccagcccttcccagtatctgcacaggccaggctcctgctctagattggtgagtcttttaccttccccataggaaatttccccctttttacctatgaagctccttttcacctttcaaagaccctttcagtgccacctcaaagccatctctgaccacctagctagcccatgcctcttttagaacctcagtcgctcaatcatttactcactgagtgactgctgtgatctagtaccaggaatacagatataaaaatg

SEQ ID NO: 133282 - DNA, 601 bp, Human
gttccccatattcaatattgccacttagtggcatctctggagtcagacagctctgagggtccttactctaccactgaccttgagcacttcacttgccagagctttcatttcttcaccttaaaatggaaatcttaattcttcataaatatgttttggagactaaattaaacatttacagtaaatttactattacagtggctggcaaagaatagactctctttaaagggtagctgtgttacagttatctcggtctgcctcctgtgatggccaccttcccagccaaagtgtaagtactttgagrtcagggcctatagactgtattgctttctcatccccaacttcatacagtgcagatctcaagtatagtctagtaagtgaataaattcatgcatgaatgaaggctcagaacccttcccccatccctaaagactttggaaatggacattcccttacttggcagccacagttcagatggtagtgatgattcagactttccctctgcaccaaggacaggtcctcccagggctcgatgtagttgcacagatggatgaagacttttccatcactgaggacctgaccttcaaggggagatggaggagag

SEQ ID NO: 133283 - DNA, 601 bp, Human
ttatcaagcctttcccagtccccagtcttctcctggattctccttccccaaggttccccatattcaatattgccacttagtggcatctctggagtcagacagctctgagggtccttactctaccactgaccttgagcacttcacttgccagagctttcatttcttcaccttaaaatggaaatcttaattcttcataaatatgttttggagactaaattaaacatttacagtaaatttactattacagtggctggcaaagaatagactctctttaaagggtagctgtgttacagttatctcrgtctgcctcctgtgatggccaccttcccagccaaagtgtaagtactttgagatcagggcctatagactgtattgctttctcatccccaacttcatacagtgcagatctcaagtatagtctagtaagtgaataaattcatgcatgaatgaaggctcagaacccttcccccatccctaaagactttggaaatggacattcccttacttggcagccacagttcagatggtagtgatgattcagactttccctctgcaccaaggacaggtcctcccagggctcgatgtagttgcacagatggat

SEQ ID NO: 133284 - DNA, 601 bp, Human
tgattcagtatagcacaggtactcttgagtgtccagactgcagatataaggcaacagatatttatgaagcaccttctctgtataggggatatttactaagaaaaatgagacacagtatctgccatctaagagcttgctgtccagataggtagataagataaatacttttgaaaaaaaatttactaaaaagtagggcctttggatcaacagcattggcatcaaccaggagcattttgaactgcagaatctccagtcccacctcacacctactaagtcagaatttgcatttgaataagatccmcaggtgattcataatcacattaaattttagatgcacttagctgaaggatatgccattagtgctaagggtatggcaataacaccaactactgtcatttattgaacaacatatgccagatttactaagctttgtaccaatctcatttactctttacatagcagtgtaatactgcagaagtttagaagagttaagagatggatctgggctagagtgggaatggaaggtttctcggaacaagtgaggttttaactgagctcgaagaattggaatcaaaagagataggtttgtctcagtccagac

SEQ ID NO: 133285 - DNA, 601 bp, Human
tcctagcactttgggaggccgaggtaggcaggttgcctgagctcaggagttcaagaccagcaacacggtgaaaccccgtctctactaaaatacaaaaaattagttggttgttgcggtgtgtgcctgtagtcccagctattcgggagactgaggcaggagaatttcttgaacccgagagatagaggttatggtgagccgagatcgcaccactgcactgtagcctgggcgacagagcaagactccatctccaaaaaaataaataaaataaaatggttgaagaagactcttggagacctagtcrtcaaaatccagcaatctaataaagttagtaggactgtgccgtaatgctgaccttcccttcaggaacccatttttaagttagcgttcctatctacctaaggttgcttactgtctttctgtacccaagttcagatctgtaataaccttgttctttttaatatcttcctaaggaaaaaggaatggaggcctaaataggaagttttccagatgtgcatacctttccctcaaatttacaagggatataaggattaaacacaggccatgtctattggaatcgtccagtccaatgggagaggacagg

SEQ ID NO: 133286 - DNA, 601 bp, Human
gcctgggcgacagagcaagactccatctccaaaaaaataaataaaataaaatggttgaagaagactcttggagacctagtcgtcaaaatccagcaatctaataaagttagtaggactgtgccgtaatgctgaccttcccttcaggaacccatttttaagttagcgttcctatctacctaaggttgcttactgtctttctgtacccaagttcagatctgtaataaccttgttctttttaatatcttcctaaggaaaaaggaatggaggcctaaataggaagttttccagatgtgcatacctttccctcaaatttacaagggatataaggattaaacacaggccatgtctattggaatcgtccagtccaatgggagaggacaggcatttaaagaggattttaatattgtatggtaattagtatgcataggatgctatgggaacacagagataagttatcctggggaatgaagatcttgtacttagaaatgttccattaaaatgtgccaccatgtattcttagataaaccacttcgcatctttggactttgattttctaaaatttgtcaaatgagaggattgaaatatattctccaagatcctt

SEQ ID NO: 133287 - DNA, 601 bp, Human
catcaatgatgggaattgggacttgtggctaaatctatgtgggaatctaaaacaaaagatgacaatgccacctgataagcttgcagaagttcttacaagatttacaggtgtacacatagtgggagtgccactaaacacacagaaaaaccaagatacaactctgtcttgaggctactgcatttaaccatgacttcactctaggtggtggatatgatcctgaaaaagctgtgtatattgagtttttgtaaattgaataatttcaaaaacagtggggcactcactatttaaatgaattgtggamaatcttttgcaagagaaattgccttttttataagaaaaaaattgttacctaattttttttagcttcccacatagaagcaattgggtatcataaagctacaatatctctttagagaaaggagaggatgatctagaaggcttttctgttctgcagacactgcttcaatacagcaggaagacgtagtttttagtagggcagtgacctgtggagagaataaagtgagcagataccacaggtgcctgaactctaaggatgtccatgctgcatgactaagaataggaggatgtatatgggccttgg

SEQ ID NO: 133288 - DNA, 601 bp, Human
aggtggtggatatgatcctgaaaaagctgtgtatattgagtttttgtaaattgaataatttcaaaaacagtggggcactcactatttaaatgaattgtggaaaatcttttgcaagagaaattgccttttttataagaaaaaaattgttacctaattttttttagcttcccacatagaagcaattgggtatcataaagctacaatatctctttagagaaaggagaggatgatctagaaggcttttctgttctgcagacactgcttcaatacagcaggaagacgtagtttttagtagggcagkgacctgtggagagaataaagtgagcagataccacaggtgcctgaactctaaggatgtccatgctgcatgactaagaataggaggatgtatatgggccttggtgtttgttgcttgacagcaggcatttcagaaattttaaccagttcatgtaagattgtaaaatagattagattcagtcaccctgcccttctttccttttcagcagcatgaaacaatgtgagatacaggattgagggtcaaaagacttcgaattgagatctggctccactgttagccttatggccttatcaggtttacata

SEQ ID NO: 133289 - DNA, 601 bp, Human
ccaaacatgaaagataaatctcactcgttacttatccagttatttgcccttttccactgacactggccttctgccttctctgtaatattgatactgttcttgctagggaacctaattgctaaatccagaggaaggtgtcaaatgttcactgatgtgtttgacactgtatatcttccctttggaagtcgcttggcttcaggacactgcattctttgttcctttttaaaatttttaaatagttttgtaaagacaagatcttgctatgttgcctaggctagtcccgaagtcttggccccaagtkatcctcctgcctcagcctcccaaagtgtcaagattacaggcatgagccaccacccccagcctctttgttctcttcatacttgttttatcgaagtttcttttcactcttcttgttctttccctttgtctacctcattaaatgtagatgttcctccgggcccccttttcctgcccacttctttttttatactgcatattctccctggtccatctactctcaaggtgtcagttacctcttaagtacaatcagttccctaatcattacctttagtccaaaactttgtcctcatctttagacata

SEQ ID NO: 133290 - DNA, 601 bp, Human
ctcctgcctcagcctcccaaagtgtcaagattacaggcatgagccaccacccccagcctctttgttctcttcatacttgttttatcgaagtttcttttcactcttcttgttctttccctttgtctacctcattaaatgtagatgttcctccgggcccccttttcctgcccacttctttttttatactgcatattctccctggtccatctactctcaaggtgtcagttacctcttaagtacaatcagttccctaatcattacctttagtccaaaactttgtcctcatctttagacatatgtkcagctgcctgctggacatctccatctgggtggttaagagtcgtttgatccaatattgaaatccatgtttttccttcctattccagctcttctattctgtattttaagtgggacaccgatggtcacctatttcaagttctcattaactttcacctagaacttctgcaagtctcatcatgatttccatttagtaacctgaatgaactatttaaaatgcaaatttgacctttttactcctttgcttaaagtttttcaggagcttcttacatcctataggtagtttatggccctcctgtgattt

SEQ ID NO: 133291 - DNA, 601 bp, Human
aagtttttcaggagcttcttacatcctataggtagtttatggccctcctgtgatttgacccctgctttcttctcctgccgtctctaattatttccatgtccagacttccttttccagcaatactgaactgtttgcacttccatacacacattgttgcattcctcctccttgtctttactgtctgctactacagtttcccttcctcccctttccttttcttgattaaattcatattcatcttttgagactgagtatttccttttccagaaactcttctctaactctctagattgtattgagygtctatgccccctccatgccctctttcaatactgcaagtatctttatctctggacacaacacaatggtctgtttatgtgtctgcttccccactagatagtgggttctctgaggacagacaggctgaatgtttcattcctttttgcatccttagcatccagcatagggcttgacacatagattgaggacagtaaatctttgccatattgaattgagcagcaagagagtcaaaggatgagataagggatagaaggtaacaatgaagagagggaagtatcctaggattagaagtatatgttaa

SEQ ID NO: 133292 - DNA, 601 bp, Human
ttcaaccataccacatcataaatctttagagatttagctctgaatgagagagccatagcagcccacaatactggaaagtattatctagtccatggcagctctgagcagagcaaaggcaaatggaataaaattgaggaccaagtttctcttaccatatattgacacttggctctcaaggaaccatttttctgaaaattcggtcttcttttttcctcagtgtgaaactccaacctcaggccacccaagctgtgtgtttctttctctttagtgaaaaagttcctttgggctattgctttgtctrtacctttatgagttttgtgtgccttcttccacacagcttttttggcttcctgttttttcaactgcaaagtgggattgtgggaatggtttaacttccccattctaagggctcttcagaactatcacaaacaatatatttgttttcttgaaaacagctttaattgtaaacagtttactaatggtagaatagagatttggagaaccaaaacatcattgtgattggaaaatgttgaaagtacacagcaagcattcatgatctgactgcttacttctcctgccttgcctttctttgatttgccac

SEQ ID NO: 133293 - DNA, 601 bp, Human
acactacatagagttaattgaatgtgccgtgcccctgtgtctttatttgtactacttgtgcttcctgaaaggctttcttctcctgtgtctttacctggataatcttcaagactcaactcagttgttgcatcgtctagcatcaggacttaatccttccttaaattatttccatttgtgttagaaaccacaataccattgattacctgtcatagcagttagcccactgtattataatcagggtttgtctgtcttccccaacacctcactttcgacaacactgagatccccttgaaggcagtgwctataacttttatttcagtatctccaggacaaagaaagttttcagtacttatttgttgaacttatcagtgacttatgaaaaaaattatgaaaatatcaatgatgagcaaaagcaactcgttggttccctgtaaatataaacaaatgacagctgcattaaccgaagtaactagtcagcaagtagtggtatatataaaatctttttataaagtgtaaagtgctatagaagcattaattattgttactggattagaatttcctacaccttccgttacataaggctgattacgtacctgctcgc

SEQ ID NO: 133294 - DNA, 601 bp, Human
gacaaagaaagttttcagtacttatttgttgaacttatcagtgacttatgaaaaaaattatgaaaatatcaatgatgagcaaaagcaactcgttggttccctgtaaatataaacaaatgacagctgcattaaccgaagtaactagtcagcaagtagtggtatatataaaatctttttataaagtgtaaagtgctatagaagcattaattattgttactggattagaatttcctacaccttccgttacataaggctgattacgtacctgctcgcacctctccctcattcacccttgtctgaygtgcctaaacaccccatgcttgtttttttctgaagaacagctgttgtgctctctgcttctcctctctcagcctaggcattaaactgcctttgtttccttgagcttttctcaagttctagggtttgttcgttcttttcttctttctatctaggactgttcttccattcctgtcctcccaagcacaactataatcccttttccaggatatatacctcttatctctttctctgttcagggggcctgacaacttcgtacaataatttcagcctgatttaatcctgtacaaagaggcttgggctt

SEQ ID NO: 133295 - DNA, 601 bp, Human
aaagaaagttttcagtacttatttgttgaacttatcagtgacttatgaaaaaaattatgaaaatatcaatgatgagcaaaagcaactcgttggttccctgtaaatataaacaaatgacagctgcattaaccgaagtaactagtcagcaagtagtggtatatataaaatctttttataaagtgtaaagtgctatagaagcattaattattgttactggattagaatttcctacaccttccgttacataaggctgattacgtacctgctcgcacctctccctcattcacccttgtctgatgtkcctaaacaccccatgcttgtttttttctgaagaacagctgttgtgctctctgcttctcctctctcagcctaggcattaaactgcctttgtttccttgagcttttctcaagttctagggtttgttcgttcttttcttctttctatctaggactgttcttccattcctgtcctcccaagcacaactataatcccttttccaggatatatacctcttatctctttctctgttcagggggcctgacaacttcgtacaataatttcagcctgatttaatcctgtacaaagaggcttgggcttcgt

SEQ ID NO: 133296 - DNA, 601 bp, Human
atggaaagagcattgcaaacacttaaaacacctgggttcaagtctgtactctgccaactaactttttgtgtcaccataggcagtttaactgttcaagtctcaatttctgtttcaaaaattagggatgtaggccaggcgtggtggctcacgcctgtaatcccagctctttgggaagctgaggcgggcagatcacttaaggtcaggagtttgagaccagcctggccaatatggtgaaccccatctctactaaaaatacaaaaattagctgggtgtggtggtgggcacttgtaatcccagctaytcgggaggctgaggcaggagaattgcttgaacttggaaggtggtggttgctgtgagctgagatcgcgccactgcactccagcctgggtgacagagactccatctcaacaacaacaacaaaattatggatataggctaaatcatcgatcttcagaggcccttatgaaatcaagtgatctgtagaaatcaagtggtttctaaaggttggactgtttgactatataaagaactctttatatagtcaaacaatatcacagtctcagtggactgtagaagtcaaaatgtttcacagaagtcacag

SEQ ID NO: 133297 - DNA, 601 bp, Human
ttttggtgccttctctctccaatgatgcctcttattctctgtctgtggacatatatcttatgacctgggactcattccagatgtgaacgtgttttctgaatcaaaattgggacatgaagtcttatttgccagtgcaagaaatagtctgggagatttttagatgctgaaatgggggaatttggagggaattttggtggttggagactacaagactgaaaatgtgaaatcagcaggttcttgggacatttaaggcaaattgttgttggcatccctatttcctagcccttagtattcagtagastgagcccgtgagctaaccatgttagctcaactatgagttgctaatggttactggcaaccctttttcaggtttctgcattttcatagaaggagctgggaaatagaaaaacttctctgacactaagtcatgaatagtggaatttcagcactatgatcagaggaaaaggaaaagtattctttattgccacccacctacatgaaaagtctactctttgaaagaataaaacatcagttaacttggcaaaatgggatgagactaattttcctgtagcctccagataacttatgcagtcaggtttgt

SEQ ID NO: 133298 - DNA, 601 bp, Human
caaaattgggacatgaagtcttatttgccagtgcaagaaatagtctgggagatttttagatgctgaaatgggggaatttggagggaattttggtggttggagactacaagactgaaaatgtgaaatcagcaggttcttgggacatttaaggcaaattgttgttggcatccctatttcctagcccttagtattcagtagactgagcccgtgagctaaccatgttagctcaactatgagttgctaatggttactggcaaccctttttcaggtttctgcattttcatagaaggagctgggaaayagaaaaacttctctgacactaagtcatgaatagtggaatttcagcactatgatcagaggaaaaggaaaagtattctttattgccacccacctacatgaaaagtctactctttgaaagaataaaacatcagttaacttggcaaaatgggatgagactaattttcctgtagcctccagataacttatgcagtcaggtttgtttgaaaaaaatgcactcaacttaactgtgacccttggaaggaaattgtagtatttctgattccttattaaggtcatatatttaagtaaaactttacaattt

SEQ ID NO: 133299 - DNA, 601 bp, Human
ttctttgtacctggaaatttatttcttagccagaactcagagtggcatcagacttaaacttaagttcctactaaaaagactgttctctgctggtctgttttttttcctgtcctcttcccccccaccctggccccccacataattagtccctcttgcaacatcctcctcttcttctgtccccccagttgattccagctgtagtgatatggaaggttcctggagtagaagggcagtgggttttggagtagggaaaggatttgaagcacctggccctctgactcgggataccccctgaaagttytgggaggttccctgctgctatgcccacttcccaggatcctgtgctttcccccagacccttaggagaaagatctaggtagcagctttgaaggaagaaggactctccagagattcttcagtgctgatttagtttttcccctagatgtatcttagaaacaggcacctagatataaactttttgtttgactttaatgatttacctcctctccccttcttgggggtatttattttgaggtttcccatgtacttcatatattctttcatgaattattcagtaggaattggtgctgtaacgcgagca

SEQ ID NO: 133300 - DNA, 601 bp, Human
ggactctccagagattcttcagtgctgatttagtttttcccctagatgtatcttagaaacaggcacctagatataaactttttgtttgactttaatgatttacctcctctccccttcttgggggtatttattttgaggtttcccatgtacttcatatattctttcatgaattattcagtaggaattggtgctgtaacgcgagcacaagaaacattgccctgtcttcacaaagcctatagtttagtggaggagacaagctattaaacaagcaatgtaataaagtatgatttattatatcagyatgattaaaggatgttttaaatagaaaacatttatctcataattttaccatagcagtagaggagctgctttcacattttttgtattctcttctaatatttgttcatatacacacatttttacataattgtggttgtactctagctataacttcatatttttttcacttataaataattttgacatatgccagtcttaaaaattgtattttttcatggctaatgtaccatgatttcttcaatttataattctgttaaagaactgtattgacttccaatttttcaccattatgacatagtac

SEQ ID NO: 133301 - DNA, 601 bp, Human
aaattgtattttttcatggctaatgtaccatgatttcttcaatttataattctgttaaagaactgtattgacttccaatttttcaccattatgacatagtacaaccataggcattctcaattttcaggagaccaactacttgatcaaagattattatatctgtaactcttggtaatgttactatattgcaatatctgaaaagattctatgaaaggtttttttctattatatttgcagtctatcaaccatttttacctcactttgcagcacatggtattatcttttttagtgttaatatccrtaaagcagtatttgcccattttaacatgtatttctatgagtataccaggtaagattaaatgttttccccaatgtttgtttaaaaatatgtgaaatgtcatgctactttggaggctgaggtgggtggaccacttgagccctgtgaccagcctgggcagcatagcaacatcttgtttctacaaataaataaataaatttttaaaaatgtgaaacgtcagttcttgtcttttggcagtttgtttgtttacttggtggtttgattttaaatgggctattcactgttaaagatgaggaatgggta

SEQ ID NO: 133302 - DNA, 601 bp, Human
ccagcctgggcagcatagcaacatcttgtttctacaaataaataaataaatttttaaaaatgtgaaacgtcagttcttgtcttttggcagtttgtttgtttacttggtggtttgattttaaatgggctattcactgttaaagatgaggaatgggtagcagcagctagaatggcttcttgggtgttcgttccaacttggcagaaaacatcagtgattgtgaagataagaatcagattcttggctgggcgcggtggctcatgcctgtaatcccagcactttgggaggccgaggtgggcagatsacccaagctcaggagctcgagaccagcctggccagcgtaacgaaaccccgtctctattaaaaatatgaaaaacaaatcagctgagtgtggtggtgtgcacctgtaatctcagctactttggaggttgaggcacaagaatcccttgagcccaggaggaagaggttgcagtgagctgagatcacactgcctcactccagcctgggtgacagagtaagattgcaaggctctgtgtcaaaaaaaaaaaaaaaagaggttctttcagctaaaatcagtactacatacaggactgacacctgtggg

SEQ ID NO: 133303 - DNA, 601 bp, Human
gcagcagctagaatggcttcttgggtgttcgttccaacttggcagaaaacatcagtgattgtgaagataagaatcagattcttggctgggcgcggtggctcatgcctgtaatcccagcactttgggaggccgaggtgggcagatcacccaagctcaggagctcgagaccagcctggccagcgtaacgaaaccccgtctctattaaaaatatgaaaaacaaatcagctgagtgtggtggtgtgcacctgtaatctcagctactttggaggttgaggcacaagaatcccttgagcccaggagkaagaggttgcagtgagctgagatcacactgcctcactccagcctgggtgacagagtaagattgcaaggctctgtgtcaaaaaaaaaaaaaaaagaggttctttcagctaaaatcagtactacatacaggactgacacctgtggggtctatactaggctgtgagttccatcagggcaaaggccatgctttattctttgcctcagcctttagcagcctggctgatggtaggcctcaaaaaaaatgttgaagaaatttcaagttcttgggacactggatagtctcctccaaatatcacttccg

SEQ ID NO: 133304 - DNA, 601 bp, Human
ggctgctctcaaactcctggtctcaagcgatcctcctgccttagcctcccaaagtgctgggatgacaggtatgagccaccgtgcctggccaagaaaattattaatgcctataggaggatgaatatggtggtctcaggtaacatactggagattatagctgcaatatgagagcaacaacaccctgcagagatagaatgtagaatgcacacccggtggtggaggagtagagaaatgcttacaagagtagtaggaagttgtcagaaataacagctacatttattgaccagaatcccaggaataygagaactggcaagtaatcttagtgtttacctgagccttggtgtctttatatgttaaatgtggatgagaatgcctattttccagggttattgtgccacttaaagtgggttatgaaagtgctctgtaaattcaaaagtgctttataaataaaaaaaaaaatcattgtcatcaccatcatgtaggaagctagggaatacagggataaaatttctttttattattttttcaggagctagatttattcttcatatttttagctaatctttatcatttgaaggtgaaattgaagtttataaagtag

SEQ ID NO: 133305 - DNA, 601 bp, Human
ctcccaaagtgctgggatgacaggtatgagccaccgtgcctggccaagaaaattattaatgcctataggaggatgaatatggtggtctcaggtaacatactggagattatagctgcaatatgagagcaacaacaccctgcagagatagaatgtagaatgcacacccggtggtggaggagtagagaaatgcttacaagagtagtaggaagttgtcagaaataacagctacatttattgaccagaatcccaggaatatgagaactggcaagtaatcttagtgtttacctgagccttggtgtcyttatatgttaaatgtggatgagaatgcctattttccagggttattgtgccacttaaagtgggttatgaaagtgctctgtaaattcaaaagtgctttataaataaaaaaaaaaatcattgtcatcaccatcatgtaggaagctagggaatacagggataaaatttctttttattattttttcaggagctagatttattcttcatatttttagctaatctttatcatttgaaggtgaaattgaagtttataaagtagtattttccccccccacccccaaagaaacagtgaagaagtagagag

SEQ ID NO: 133306 - DNA, 601 bp, Human
tgcaatatgagagcaacaacaccctgcagagatagaatgtagaatgcacacccggtggtggaggagtagagaaatgcttacaagagtagtaggaagttgtcagaaataacagctacatttattgaccagaatcccaggaatatgagaactggcaagtaatcttagtgtttacctgagccttggtgtctttatatgttaaatgtggatgagaatgcctattttccagggttattgtgccacttaaagtgggttatgaaagtgctctgtaaattcaaaagtgctttataaataaaaaaaaaaatcattgtcatcaccatcatgtaggaagctagggaatacagggataaaatttctttttattattttttcaggagctagatttattcttcatatttttagctaatctttatcatttgaaggtgaaattgaagtttataaagtagtattttccccccccacccccaaagaaacagtgaagaagtagagaggatagggaggtagctttggggagtgtaagacttctttagcttttcatcatgttaaatgaatagcttctttctgcccaagtctttttctgagaggatggtgaaaagaggaaggc

SEQ ID NO: 133307 - DNA, 601 bp, Human
cttctttctgcccaagtctttttctgagaggatggtgaaaagaggaaggcacactgtggaccatgttcagagtcagtattttacttgattgaagcagtgggacaagatgaggaggaattatgagttaatctttgaatagtaggatggaatctgctaaggagaaccttgaatacaaagctcacatattttttctttatcttgtagtcagtagaaagttgtgaaggttttgatcaggggagtgagttgataagtgctgtacttaagaaggtttatctgaagacagtgtagaaaatgggctgtkgggggcatgggtggagaacttgtgcagtcctggagaccaactaggagcatgttttggttgtccgtctgtgaggtactggatgtttgaactagaaccgtagcagtggaaaagaaggagtggatacaggggtgtcttgagagtgtagtcctggggtaaaggagctttggggaccttatgaccctcaatctgttattgcttccaaaggtttgttttctctgtagacttttaaaaaatcaaagtataaaactgacatacataaacgtgcagaaatagtaagtttgtaactcattgagtttttag

SEQ ID NO: 133308 - DNA, 601 bp, Human
ttggccagactggtctccaactcctgacctcgtgatccgcccatctcggcctcccaaagtgcattacttctttcaatcttgacttcttctccctgaacagataaccactattttgcttccttcagcatatgttaattttgcctacttttgagctttatataaacgaaatcctacagtagaaactctttttgtgtctggtttcttttgtttaacataatattcatgagatgcatttgttttcttgtagatagcattagttcattctttgacattgctgatttgtatttcattctctgaatayatcacagtttatgcattctgctataatggatacttaagttgttcccagtttggggctactgtgaataatggtgataagaacaatttttgtacatgatgttggtgattataagctcttattcctgctgggtgtgtacccaggagtggcatttgctgggttatagggcatatgtatattcagcttttagtagttttacagttttacagaatgattgtaccagtttacactcccaccagcagtatatgagagttcctcaccaaaactgtgtcttgtcagctcaggctgctgtaacaaagacct

SEQ ID NO: 133309 - DNA, 601 bp, Human
agtggcaaaactgaaatgagcaaaatttctacccttaacctttaaaaaaatatatatacaaggccttcatgctaccctctgatcactatgagaaaatagaaggggctataattaatttgcctagaataggaggctggggaaggattaacaacaaaggcggcatctgagttggacttaaaggaagaatagaagttcactagatggagtaggagattaggggagtaaggcctctcaggtagaggagtgaggcagaagatatgaaaagacattgctctttaggaaacattgtgttcttggtgcrgatattgtgtgtgatgaaaagggcaagaatgaggaatgctaggagacgtggctgggaggatcactgagccactttgtaaagagacttgaatagtacagtggtggggactaatgaaaaatgttaaatattgtttgggttagcactgcatagttgctaatctgcaactgcatgttaagctcctctcaactcaggaccctgatccacacagcagtgtttggatgttaactaatgcagtggcagtgcccacaaactcagaagtgattccagttagagccttggtgacttggggtttacactaat

SEQ ID NO: 133310 - DNA, 601 bp, Human
cttggtgcggatattgtgtgtgatgaaaagggcaagaatgaggaatgctaggagacgtggctgggaggatcactgagccactttgtaaagagacttgaatagtacagtggtggggactaatgaaaaatgttaaatattgtttgggttagcactgcatagttgctaatctgcaactgcatgttaagctcctctcaactcaggaccctgatccacacagcagtgtttggatgttaactaatgcagtggcagtgcccacaaactcagaagtgattccagttagagccttggtgacttggggttyacactaatttcttcttcttaattgtctcagggtgttggatatacgcgtaatgcttgtataaaataaaagggtaggagagtggggggaggctctgctgataggcagcaagtctcagactgcaataaactcagtggtgtccttgccattctaaactcatcatcagaggtgaatgtggcaagattgtaattttgcctcctgtgtgaaaaattagagtcagcttcatggctcagccttcccagctcttctccataaaggatctcctcattctgtctccggaaacatatgtttatttgtaatgca

SEQ ID NO: 133311 - DNA, 601 bp, Human
tctgcgttgctcacgctgggagctgtagaccggagctgttcctattcggctggttataagtaattcttgtgctttctttactttgggaatgaaacagactgtgctgtgaccagtggtaagcttagataatttccaggtgtgaggcagactagggtacgagagactaatacaatatgtagctgggactctctttttcccaaattgagatattatttgcataccataaaattcacccctttaaaatatacaattcgttggttttagtatattcacaagattatataaccaccaccacttattycagaacatcttaatcaccccaaaaaccatatacatgttagcagtatttcccattcctcccttaagcagccccaggcaaccactaatttaccttctgtttccgtggacttgcttattataagcatttcatataaatggaaccatacaatatgtggccttttgtgtccagcttttttcatcttagcataatgttttcaggattcatccacattgtatcatgtgtcagtacttcattcctttttatggaattttattcctacacacaatatttcctttatagatatactgcattttacttgtc

SEQ ID NO: 133312 - DNA, 601 bp, Human
accataaaattcacccctttaaaatatacaattcgttggttttagtatattcacaagattatataaccaccaccacttattccagaacatcttaatcaccccaaaaaccatatacatgttagcagtatttcccattcctcccttaagcagccccaggcaaccactaatttaccttctgtttccgtggacttgcttattataagcatttcatataaatggaaccatacaatatgtggccttttgtgtccagcttttttcatcttagcataatgttttcaggattcatccacattgtatcatktgtcagtacttcattcctttttatggaattttattcctacacacaatatttcctttatagatatactgcattttacttgtctatttacttatcagttgatggacatttgggttgttttcacttctgtgtaattataaataaagctgttatgaatatttatgtacaagttgttgtgtgaacatacgctttcagttcttttaggtatatccctaggagtggaagtgctgggttatatagtaattttatttttaactttttgaggtactgccagactgttttccaaagtggttgcactatttt

SEQ ID NO: 133313 - DNA, 601 bp, Human
attcacccctttaaaatatacaattcgttggttttagtatattcacaagattatataaccaccaccacttattccagaacatcttaatcaccccaaaaaccatatacatgttagcagtatttcccattcctcccttaagcagccccaggcaaccactaatttaccttctgtttccgtggacttgcttattataagcatttcatataaatggaaccatacaatatgtggccttttgtgtccagcttttttcatcttagcataatgttttcaggattcatccacattgtatcatgtgtcagtrcttcattcctttttatggaattttattcctacacacaatatttcctttatagatatactgcattttacttgtctatttacttatcagttgatggacatttgggttgttttcacttctgtgtaattataaataaagctgttatgaatatttatgtacaagttgttgtgtgaacatacgctttcagttcttttaggtatatccctaggagtggaagtgctgggttatatagtaattttatttttaactttttgaggtactgccagactgttttccaaagtggttgcactattttatattacc

SEQ ID NO: 133314 - DNA, 601 bp, Human
cttttggctgcatcataacatgggggaaggcatgacatggcattacattgcacaagagtgagggttagagggccaaacttatccattatcaggaacctactactgcagcaactaactcactcccaggataacagcatttgtccattcacgaaggcagagctttcattaggcccacctcataacactgttgcattggggattaagtttccaacacatgaattttgggagacacactcaaaccacagcattccactccagcaccagcccccttctcacatgcaaaatatatttattcagtgcygatggccttcaaagttttaacttgttccacatcaactcaaaagtccaaagcccaaagtctcatctaaatcagatatgggtgagactcaaggcacaattcatcccgaggtaagtttcttccagccgtgagcctgtgaaatcgaaacaggttgtttatttccaaaatataatggtgggacaggcataggatagacgttcctattacaaaagggagaaataggcaagaaaaaggggtgacaggtcccaagtaagtccaaaacccaacatcatgaataacgttaaatcttaaagctccagaata

SEQ ID NO: 133315 - DNA, 601 bp, Human
ctactactgcagcaactaactcactcccaggataacagcatttgtccattcacgaaggcagagctttcattaggcccacctcataacactgttgcattggggattaagtttccaacacatgaattttgggagacacactcaaaccacagcattccactccagcaccagcccccttctcacatgcaaaatatatttattcagtgccgatggccttcaaagttttaacttgttccacatcaactcaaaagtccaaagcccaaagtctcatctaaatcagatatgggtgagactcaaggcacarttcatcccgaggtaagtttcttccagccgtgagcctgtgaaatcgaaacaggttgtttatttccaaaatataatggtgggacaggcataggatagacgttcctattacaaaagggagaaataggcaagaaaaaggggtgacaggtcccaagtaagtccaaaacccaacatcatgaataacgttaaatcttaaagctccagaataatcttccttgattccatgtccccatcttcggggcactctgggtcagggactgggcccacaaggcctcaagcagccctgcccccttggctttgctgg

SEQ ID NO: 133316 - DNA, 601 bp, Human
actgttgcattggggattaagtttccaacacatgaattttgggagacacactcaaaccacagcattccactccagcaccagcccccttctcacatgcaaaatatatttattcagtgccgatggccttcaaagttttaacttgttccacatcaactcaaaagtccaaagcccaaagtctcatctaaatcagatatgggtgagactcaaggcacaattcatcccgaggtaagtttcttccagccgtgagcctgtgaaatcgaaacaggttgtttatttccaaaatataatggtgggacaggcrtaggatagacgttcctattacaaaagggagaaataggcaagaaaaaggggtgacaggtcccaagtaagtccaaaacccaacatcatgaataacgttaaatcttaaagctccagaataatcttccttgattccatgtccccatcttcggggcactctgggtcagggactgggcccacaaggcctcaagcagccctgcccccttggctttgctgggctcagtccatgcagcagctctcacaggttggagtctcgtacctgcagctctctcaggccagagttgcacactggtagttctgcagt

SEQ ID NO: 133317 - DNA, 601 bp, Human
caactcaaaagtccaaagcccaaagtctcatctaaatcagatatgggtgagactcaaggcacaattcatcccgaggtaagtttcttccagccgtgagcctgtgaaatcgaaacaggttgtttatttccaaaatataatggtgggacaggcataggatagacgttcctattacaaaagggagaaataggcaagaaaaaggggtgacaggtcccaagtaagtccaaaacccaacatcatgaataacgttaaatcttaaagctccagaataatcttccttgattccatgtccccatcttcgggkcactctgggtcagggactgggcccacaaggcctcaagcagccctgcccccttggctttgctgggctcagtccatgcagcagctctcacaggttggagtctcgtacctgcagctctctcaggccagagttgcacactggtagttctgcagttctgtggtgttagggggcttattactgaaccaaacttgggtccatcaacctggcatagcaaagccaaacactggcattgagatttgcagcgagagaaggtgaggcatttattgcagggcaccaagcaatgagaattgacagctaatgcgt

SEQ ID NO: 133318 - DNA, 601 bp, Human
gggcactctgggtcagggactgggcccacaaggcctcaagcagccctgcccccttggctttgctgggctcagtccatgcagcagctctcacaggttggagtctcgtacctgcagctctctcaggccagagttgcacactggtagttctgcagttctgtggtgttagggggcttattactgaaccaaacttgggtccatcaacctggcatagcaaagccaaacactggcattgagatttgcagcgagagaaggtgaggcatttattgcagggcaccaagcaatgagaattgacagctaatgygtaatacctgaactccccaatggcttacatgtaagggtttttaaaggtgggaggcagaggttacaggcaaagccatacattgatatacggaggctatcataaattgatttgaccggaaaaggtggggcatctcaagagtgggggcctgcaagtcataggtagattcaaagatgttctagtttgtaatcggataagaaaataaagctttgtctgaaaacttggggtcagtagaaaggagtgctaatctctggtttgtgagtgtggacttcctccaggcctctcagcaagaaatttagaaca

SEQ ID NO: 133319 - DNA, 601 bp, Human
gcctgtgatgggagggtgaaaatctcaaagatctctgaaatgccttccgggtcattctctcattgtcttgatgaatagcacctggcttccttctagctgtactactctgtttaacaaactgtcaattggctacatccttagtattctctcctgaatacacttttttattctttgcctttccaggctgagagttttccacatctttccttctccttcccttttcattgtaaattatgtctaagtcatttctcttttccttcactttactataaggggccaaaggaagtaatgaagcatcttsaacactttgctgcttagatgttcctcctaccagatatcctagtttatcactgttaagttctgcattccacaaagtcctaggacatgaagacaattccactaagttctttgcaactgtgtaacgagaatagactttactccagtttctaataccttgttcctcatttccatctgagacctcatcatcagaattgcctttactgtccatatttctacctacattctgattatggccacttaagtaatccctaaaaagatttaggctcttcctacagctctcatctttttctgacccctcacc

SEQ ID NO: 133320 - DNA, 601 bp, Human
gggctgtatctggtgagggcctccttgctacatcataacatggagtaaaacatcacatggtgtgtgagagagagtgtgagcacaagagcaagtgagagcaagaactagagagtgagcaggctcaagtggaagggggttgaactcatccttttatcaagaacctactcctgaaataactaacctgctcccatgataacagcattaatccattcatgaggcctcacgacctaattgctgttaaaggtcccacctcataacactgttgcaatggggattaagtttccaacataagaactttggkggacacactcaaaccatagcaaataccttaccatatatatgatttgcaaatattttctcccattctgtggcttatcttttcactttggtagtgttctttggagcacatgtttttaattttgatgaagcccaatttttctgttttttcttttgttgcttgtgttttttgtgtatatctaaagaaactgttgcctaatccaagatcacaaagacttacacctatattttcttctaatagttttatagttttatctcttacacttagatctttgaatccattttgccttaatttttgtatatg

SEQ ID NO: 133321 - DNA, 601 bp, Human
taccttaccatatatatgatttgcaaatattttctcccattctgtggcttatcttttcactttggtagtgttctttggagcacatgtttttaattttgatgaagcccaatttttctgttttttcttttgttgcttgtgttttttgtgtatatctaaagaaactgttgcctaatccaagatcacaaagacttacacctatattttcttctaatagttttatagttttatctcttacacttagatctttgaatccattttgccttaatttttgtatatgctgtgaagagtccaaattcattcyttagcatgtggatacctatttttcccagcaccatttgttgaaaagactctttttcctctattgaattgtcttgacacccttgtcaaaatcaactcaccatagaattgtgggttcatttttgaattctaagttctattccattgatgcaatagattgcaatgatgcattatttgttcttatatcaatatcatattatcttcattactgtagctttgtagcaagttttgaaattggaaagtgtgagtcatctaactttgttgtttttttaaaaaaaacttttttttggctatactttgagtc

SEQ ID NO: 133322 - DNA, 601 bp, Human
tttgtatatgctgtgaagagtccaaattcattctttagcatgtggatacctatttttcccagcaccatttgttgaaaagactctttttcctctattgaattgtcttgacacccttgtcaaaatcaactcaccatagaattgtgggttcatttttgaattctaagttctattccattgatgcaatagattgcaatgatgcattatttgttcttatatcaatatcatattatcttcattactgtagctttgtagcaagttttgaaattggaaagtgtgagtcatctaactttgttgttttttwaaaaaaaacttttttttggctatactttgagtcctttgaattgccatatggattttaggatcaacttgtgaatttctgcaaaaaaggcagctgaaattttgatagggatttaattgatagattaatttggagatattggcatttattaaatattacaatccatgaacacagatttttttcatttattttgttcttcaatttctttcaacagtgttttctaatttttagtctataagtcttgtacttattttaaaattcttattcccaacaattttattctttttgatgctgttgtaaatt

SEQ ID NO: 133323 - DNA, 601 bp, Human
ctaagatgtagaattcttgtttaagaagtaagcagctttccagaaacttcagatttctctgccagtcatgattttagcaaccagtgaagatgagcatgttttggattagagccacagccttctagttcgtgtccttgcctttagtctccctcctgccagtctaaggtgtaaatgctgccaggcttttttccataaagccctgctttcatcatggcattctccattcagataacctctagttgccactcctgtgcatcaggtctaggcatactgtttagctttgaaatttgttatatccggygttatgtctgatattcctccccagcattcaccatctgcacctgacaggctggttttctctcagtcctccagatataatattcatttccacttatatccctcgctcaaaacgttcctttcttctctagctaaatcctgcctgtccttctaagacagctcatttcttcttccttcaatgctagcattggtcacagcctgctctgctctgccaacatatatagtagtttccaaataatttagtgacaagttgttttctattttttgtatattagcgttggtctgtaagccttttgaagtcttg

SEQ ID NO: 133324 - DNA, 601 bp, Human
gttgataactgctctagataggactagagcccaagcttcaggtctgttaaaaatgctgacttgccttgtgttttcttgaaatcccagttttctttaagggatttgtagatattgttgtttaatactatggaattatcctgggagctcaatggaaaggtaatgtcttcctgtgaactagacagttataggagacctgagaatgtttcagctgcaagtggatctaaagaaggagggtgtagtgggttgaatagtgttcctttctgcctggccctccccatcccccaattcaggtccacctcaraatgtgacttatttggaaacagtgtctttgcagctaaggatcttgagatgaaatcattccagatataaggtagatcctaaatccaatggctggtgtccttataagaagaagagaagatacagagagcagcacagagaggagaagcccatgtgaagatggaggcagagattgcagctaggcaactacaagctagggaatgacaaggattgcttgtaaccactagaggctggaagaggcaaggattggatgggccctacagccttcggagggaacatagcccggccaacacaccttgatttt

SEQ ID NO: 133325 - DNA, 601 bp, Human
tgtttcagctgcaagtggatctaaagaaggagggtgtagtgggttgaatagtgttcctttctgcctggccctccccatcccccaattcaggtccacctcagaatgtgacttatttggaaacagtgtctttgcagctaaggatcttgagatgaaatcattccagatataaggtagatcctaaatccaatggctggtgtccttataagaagaagagaagatacagagagcagcacagagaggagaagcccatgtgaagatggaggcagagattgcagctaggcaactacaagctagggaatgrcaaggattgcttgtaaccactagaggctggaagaggcaaggattggatgggccctacagccttcggagggaacatagcccggccaacacaccttgattttagacttctggcttctaaaaccgtgagaataaatccccccacaccttttttttccttctcttttctctcttttttttttttgtgagacagcatcttgctctgacacccaggctggagtgcgatggggtgatcacagctcattgcagccttaaattcctggactcaggcgatcctcccacctcggcctcccaagtaggtggg

SEQ ID NO: 133326 - DNA, 601 bp, Human
aggtagatcctaaatccaatggctggtgtccttataagaagaagagaagatacagagagcagcacagagaggagaagcccatgtgaagatggaggcagagattgcagctaggcaactacaagctagggaatgacaaggattgcttgtaaccactagaggctggaagaggcaaggattggatgggccctacagccttcggagggaacatagcccggccaacacaccttgattttagacttctggcttctaaaaccgtgagaataaatccccccacaccttttttttccttctcttttctctyttttttttttttgtgagacagcatcttgctctgacacccaggctggagtgcgatggggtgatcacagctcattgcagccttaaattcctggactcaggcgatcctcccacctcggcctcccaagtaggtgggactactagtgagcatcaccatgcccagctaatttttaaaaaatttcatagagatggagtctcactgtgttccccaggctggtctcgagcgcctgacctcaagcaatcctcctggaaaacaaacctctcaaagcactgggtttacaggtgtgaactactggtgcccagc

SEQ ID NO: 133327 - DNA, 601 bp, Human
ttttagacttctggcttctaaaaccgtgagaataaatccccccacaccttttttttccttctcttttctctcttttttttttttgtgagacagcatcttgctctgacacccaggctggagtgcgatggggtgatcacagctcattgcagccttaaattcctggactcaggcgatcctcccacctcggcctcccaagtaggtgggactactagtgagcatcaccatgcccagctaatttttaaaaaatttcatagagatggagtctcactgtgttccccaggctggtctcgagcgcctgacytcaagcaatcctcctggaaaacaaacctctcaaagcactgggtttacaggtgtgaactactggtgcccagctgcttttttttcctctcctaatttcacttttttaaagccaccaaattagtggtaatttgttatgacagccttaggatactaatctaaaagagaagaaaaataagcatttactgcagggtctcctatataacccggtatattttaggcactttaatgtgttattttatctcccaacaactttgtgtggtaggcattatttatccatattttacaaatcagaaaaataagg

SEQ ID NO: 133328 - DNA, 601 bp, Human
ttcacttttttaaagccaccaaattagtggtaatttgttatgacagccttaggatactaatctaaaagagaagaaaaataagcatttactgcagggtctcctatataacccggtatattttaggcactttaatgtgttattttatctcccaacaactttgtgtggtaggcattatttatccatattttacaaatcagaaaaataaggctcagaaagataagcttgtgttttaggaatattctgtcattttgttttcagctgtctactttcttctgttgattgcctgaggaatttattatgyggccctcagaatgactgggcataaaactgtgatgtccattctactgggttggttaaagaaatgcaccgtggattagtcaaaggagggccagacatatcatatgacctttcctatggaaaagtctcagcatctgtcttcccccacgtctgtacctatttctcacctactatatagtcaaatctccatcatgaaacttccctagatttctttacctaatattttatctgtttctctctctcaactgaacctccatagcagtttatctacttcaattttattgtacatactgcattctacctt

SEQ ID NO: 133329 - DNA, 601 bp, Human
tgatgcagtaaaaaggagtagataaaaagtgaaatggattgttctttgctgcaagcggagttttgtttgtaaaatgtagaaagagttaaaatgagatggtaagaatgaatgaggagaaatgcatttcagtttttttctgggttaaataagtaaatgtctctactgttttccaatttgaatagatgtttttccccctttggaggatgggggattccgttacttagagagactaccaccactattgctatcactaataacaatcatttgattagtgctttacattttacaaagtactttcactgtagcccgtagacaattaatcttcccatatcttgcattcccatagtcctttgcacataccctgcattgtactgaatccctttgcccctacaatctccacctcagtgctcatggcgaactgatttgtgtgccctgtggagtgggagtactgcaacattgagtagtggggggctcaggaatacctcccagaagcacaggagagtactatatagaatttgaatctggcggagttaagaagaaaaaagttaaaatcagttatgcttttaaaaaatgaggcttgaatttacagcatagtgtagtg

SEQ ID NO: 133330 - DNA, 601 bp, Human
gatgcagtaaaaaggagtagataaaaagtgaaatggattgttctttgctgcaagcggagttttgtttgtaaaatgtagaaagagttaaaatgagatggtaagaatgaatgaggagaaatgcatttcagtttttttctgggttaaataagtaaatgtctctactgttttccaatttgaatagatgtttttccccctttggaggatgggggattccgttacttagagagactaccaccactattgctatcactaataacaatcatttgattagtgctttacattttacaaagtactttcactctagcccgtagacaattaatcttcccatatcttgcattcccatagtcctttgcacataccctgcattgtactgaatccctttgcccctacaatctccacctcagtgctcatggcgaactgatttgtgtgccctgtggagtgggagtactgcaacattgagtagtggggggctcaggaatacctcccagaagcacaggagagtactatatagaatttgaatctggcggagttaagaagaaaaaagttaaaatcagttatgcttttaaaaaatgaggcttgaatttacagcatagtgtagtgg

SEQ ID NO: 133331 - DNA, 601 bp, Human
atgcagtaaaaaggagtagataaaaagtgaaatggattgttctttgctgcaagcggagttttgtttgtaaaatgtagaaagagttaaaatgagatggtaagaatgaatgaggagaaatgcatttcagtttttttctgggttaaataagtaaatgtctctactgttttccaatttgaatagatgtttttccccctttggaggatgggggattccgttacttagagagactaccaccactattgctatcactaataacaatcatttgattagtgctttacattttacaaagtactttcactggagcccgtagacaattaatcttcccatatcttgcattcccatagtcctttgcacataccctgcattgtactgaatccctttgcccctacaatctccacctcagtgctcatggcgaactgatttgtgtgccctgtggagtgggagtactgcaacattgagtagtggggggctcaggaatacctcccagaagcacaggagagtactatatagaatttgaatctggcggagttaagaagaaaaaagttaaaatcagttatgcttttaaaaaatgaggcttgaatttacagcatagtgtagtggg

SEQ ID NO: 133332 - DNA, 601 bp, Human
cacataccctgcattgtactgaatccctttgcccctacaatctccacctcagtgctcatggcgaactgatttgtgtgccctgtggagtgggagtactgcaacattgagtagtggggggctcaggaatacctcccagaagcacaggagagtactatatagaatttgaatctggcggagttaagaagaaaaaagttaaaatcagttatgcttttaaaaaatgaggcttgaatttacagcatagtgtagtgggtgagaagcatgggatttggagtcagcagaactgaatttgaataacttgctkctttcatttaccagacatttattcattctcaaaggaacccatatttctcctttatagtacttactacaactctaactaaatatttgtttaatgattatactttctactaggatataagtttaattaggaaagagactgtcagtattgttcagttttattctctgtacctagtacagctactagtgtggtttagttgttcagtcaacatttgttgactgaataaaatgaatgaatgtctggtaaattgggtgggtgaaactgaccaaatctgaggagttgggaaaggttttggtgagtata

SEQ ID NO: 133333 - DNA, 601 bp, Human
aatgactgctctggctgccatctagtggagactggattggaggaagggaagagtggatgttcggaaattattaaaaggctattgcaaaaaactaggtgagagaagatggtggcctggacaaaagtagcaaacgtggagatgaagagagttggaataatataagaaatatttaatagatcatcaagacttgatgattgattagataagaaatgaaggagaggtcaaagtatgacgactaggtttctgactgcacagctgggtggatggaggttgccatttactgatacgaggaacattgaargaacctgaaggacagattttagggggagatgatgaatgttgttttagatatgttgtaattgaagtgccgatgagacaataaagagaatgattatgggaagttgggtgtatgggtttgaacttcaggaaaacatattgtactccatgactgttccatatcaagatggaaagcactaccttgtttttttcatgactgaatggtatttcattgtatatattaatgttccaattatgtgccataattaagggaaaggcaaattgtatggaaagagaagaatacttaatagtgtgagtttccttt

SEQ ID NO: 133334 - DNA, 601 bp, Human
gtggcagcatgtgatgttctgtttaatttgaagaaagcatttaacctgttttttgctgtaaaccattcagatttaagatggttcaataaatcagcagttaactctgggtatgagagtactttggtttccttggtacctgattgtgagaccctctacaagttacgtacgttgtgtattccaaccttttacttctgacttacagataaaatgcccattgtttgtttctagggttttgagcattttctgtaaccctaagtgaaagatttagcctttttatgcctttttaagatgagacaattcrtgtttgctacattttactttcccaagggcttattatgagattttgttttattattttttgagacagggtcttgctctatcacccaggctggagtgcagtggtatgatcacggctcactgcagccatcggactcaagcgatcctcccacctcagcctcccgagtagctgggacgacgggtgtgcaccaccatgcccagctaatttttgtattttttgtagagacagggttttgccatgttggccaggctggtcttgaactcgtgagctcaagtgatccacctgctttggcctcccaaaggc

SEQ ID NO: 133335 - DNA, 601 bp, Human
attttcttttagttctgtgctaatctctaaacttcaagtagatctcaggtctctgaaactgaacatgcaggcttatttctggatcagcccacttggaaatagcttatcagagatcttctctggaccagaggaaatattccttaaatgggtcagttgtcaagaatgttctttggaacacattgtataacaacatctgcttcaaggccttgtgtatgcctgaggtgttaggatctcattccttcatatggaaggtttctcaggaatttattcagcttctccaagaaggaagcttttcagaggytagaaatcttactaaattcaccgtgtatttcccatgtgggctgttgcctcttagttggctccctgctggttttctttttcattcagtttattttgtattttttaatgataataattattcacctttgacaaatgttttggttttagagcatttttgacacatctttctttagccctagcagcaatcatatgggatcgatattcacattttagtatttatattcaggaaacatttattgaatgctagctacatgctaggcgttgtgctagactgtatgctatatatcattttaaaagtctc

SEQ ID NO: 133336 - DNA, 601 bp, Human
gtaatcccagcactttgggaggccgaggtgggtggatcacgaggttaggagttcgagactagcctcaccaacatggtgaaaccccgtctctactaaaaatgcaaaaattagccaggcatggtggtgggtgcctgtagtcccagctactcaggaggctgaggcaggagaattgcttgaacctgggaggcggaggttgcagtgagccgagatcacaccactgcactccagcctgggcaacagtgcgagactttgtctcaaaaaacaaaaaacaaaacaaaacaaaacaaaaaaatatatatakatatgattctgattgatccttctttctcattatctgataaatgtacacttaggtctcacagcccccctctacactccatctatcaaacataattattctgtaatttgtatttatatcagtgtttacattattctcatatatgtttctttctgcagagctaggtgacatacttactatgattacaatgtttaccatacaggacttttcccccctagagttaatagtattctcatgttttttacatgaaaatttttataactctcaaattgagaataatttttgtaaacctcaattaaaatt

SEQ ID NO: 133337 - DNA, 601 bp, Human
gtaggaggagccagagacttggggtgtatagccggttgacacagaaggtttaactacatgagtccatctagaatcactctggtggcccctgaaggcagagtgagtaaagccaagagaatctggggaggagcaaaagatttgtctgattcaaccaattacttacattatctgaaaaatctaccaattctcccctctctgatcccctgcccagaggtctccctttgtaaccctctatcctattttaatctggacaatttggtatctaggattattgcatcctgggacttttttttttttttttaacactactgtctcctggggagtagttccagtttcttggatcccactttttcttttttgcttagctttacttcctcattctacaggaacatcttttccaggagtttttaaagaaagggtgcctaagagatgaatcttctgagaaattagatattcaaaaatgaaattattaacccatacatttgatagtttagtagaatatagaattctgggtcaaaaataatttttcttcaaaatttagaaaagtactgcttttgttttctagcatcctttattagtgttgataaatttaatattgatt

SEQ ID NO: 133338 - DNA, 601 bp, Human
attgaacatcaacagctgttaatatcacagaaaggcagactttatgagctcctgataaaaggaatctaacaggagtctgatcaagcctctgcgtccagctgccaatttgtgggaaacacaaagaatggagaaagacgatcttcctggtgagagtgtaatcagcaaaactgctactatgggaaattctacatatggatcaagatgctccaggctcttgaacagatcaactctaaggaaaataaagggatgcacagggaaacctgtggattaaaagagatttggaagacaaagttgtgttttktttttttttttttaaataggcaactgtaaactgtagtgtttaagaatatacacttgaatacaagcataaggaagtaattccataaaagtcaagagagtggttacctttgcggggaaggagggggtcaagactgggactgggtattgaagttgctcctggggtggctgtcaaaattggtttattaacctggatggtggatacatgagtgtttgccttataacaactcattaaactcattaagcaatactctttttttttttaattttgatgtggctttctgtatctttgttttattttaca

SEQ ID NO: 133339 - DNA, 601 bp, Human
tcatcgtgtggtcctctatctgcatcaaaatcacctgggatgcctactttaaaaatatattctgtggtcccattccccaacccttctccatcagaatctacattttttaacaaatgcacatacctagaatttgatccctgtccttttcaaatgtccatatttatttcttcactttaagtttcttacctacaatgtctataaggacactgtagataagtaggccatctggaggttgatttggtagaccatttgcatgtttttgaaacaatagatttctgatgtaagttgattatcttaacartttagcataaatatgttttatttcccacaaattaatgatccctttaatgacagtagatgatttctgaatgattcccagctgtattgttaaagacattaaattaagatatgctattatgctgtgtgtatatataggactactaaaggaatcagaactcagaattttttttagaatgagttattccagtcattaacctttgtatgtttgtgtgatataagacaacagtaatttacttcttttcctgacaaatgattattctatctctgaagcaaactgttccttccagtgctggacaatttg

SEQ ID NO: 133340 - DNA, 601 bp, Human
tgcatcaaaatcacctgggatgcctactttaaaaatatattctgtggtcccattccccaacccttctccatcagaatctacattttttaacaaatgcacatacctagaatttgatccctgtccttttcaaatgtccatatttatttcttcactttaagtttcttacctacaatgtctataaggacactgtagataagtaggccatctggaggttgatttggtagaccatttgcatgtttttgaaacaatagatttctgatgtaagttgattatcttaacaatttagcataaatatgttttmtttcccacaaattaatgatccctttaatgacagtagatgatttctgaatgattcccagctgtattgttaaagacattaaattaagatatgctattatgctgtgtgtatatataggactactaaaggaatcagaactcagaattttttttagaatgagttattccagtcattaacctttgtatgtttgtgtgatataagacaacagtaatttacttcttttcctgacaaatgattattctatctctgaagcaaactgttccttccagtgctggacaatttgcctcaattatttccacttac

SEQ ID NO: 133341 - DNA, 601 bp, Human
aaatatattctgtggtcccattccccaacccttctccatcagaatctacattttttaacaaatgcacatacctagaatttgatccctgtccttttcaaatgtccatatttatttcttcactttaagtttcttacctacaatgtctataaggacactgtagataagtaggccatctggaggttgatttggtagaccatttgcatgtttttgaaacaatagatttctgatgtaagttgattatcttaacaatttagcataaatatgttttatttcccacaaattaatgatccctttaatgacrgtagatgatttctgaatgattcccagctgtattgttaaagacattaaattaagatatgctattatgctgtgtgtatatataggactactaaaggaatcagaactcagaattttttttagaatgagttattccagtcattaacctttgtatgtttgtgtgatataagacaacagtaatttacttcttttcctgacaaatgattattctatctctgaagcaaactgttccttccagtgctggacaatttgcctcaattatttccacttactctagtatcagctcttctgataataattaagc

SEQ ID NO: 133342 - DNA, 601 bp, Human
aatgaaaagcaaatgctataagtaaaaactgcaacaaaaatgaagaatgcctttgatgggctattctggacacagccaaggaaagaagcttgaaaatacatatgtcagtgaaacttctcagaaaggcaaagagaaaaatagagtttaaaacagcaacagaacatttaagaatgtgagatattttcaataggtataagatgtgcaattatatgagaaggcaaagaaagaacagaagaaatatatggtaagatatttgaaggctaggaattgatgcttaaaaagcctctgacaaaatgcaacrttgattcatgataaacattctcagcaaactaggcataaaggtgaatttcctcaacttattaaagaacatcttacaaaaaaagcctatattgtacttaatggtaagaaaccatactttctccctaagattgagaatgaggtaaagatgtcttctgtcaccactattagtcaacatcatattggataacttagtgaaataagacaagaaaaggaaattaaagctatatattttgtgaagtaagaaataaaactgtctttgttcacaggtgacatgattgtctatgtagaaaattgctaggaa

SEQ ID NO: 133343 - DNA, 601 bp, Human
agatctaaataaacagattctatatttatagattggaagactcaatattgttaagatgtcaagtcttcccaacttgatctgtagatgcagtggaatcccaatcaaaatcccagaaagcaatttttgtagagattaacaagttgattctgaagtttatatggaaagcctagaaacccagaatagccgacataatactgaagaggaataaagttgaaggattcacacaacttgatttcaagactttttattacattgtagttatccatgcagtatgatgatgatgatgatatgaaacaatagwtctatttcaatcaatggaacagagagcccagaaatagactcacacagataataatcaaatgatctttgacaaaggagcaaagaattaaatggggaaaggacagtcttttcaacaaatttacattcatatgcagggtagtgaacctagacacaaatcttatacttttgacaaaaattaaaatggaccataaaccgaaatctgaaatttaaaactagaaatcttctggaagaaaacacaggaggaactctaggtgaccttgggtttggctgtgagtttttagatacagcaccaaaaacataa

SEQ ID NO: 133344 - DNA, 601 bp, Human
taggtatttacccaaatgatttgaaaaccatatgccaagacaaaaacctgcatgcaaatgtttataacaactttattcataatcagcaaaaactggaagcaaccaagatgtccttcagtaggtgaatgggtaaactatggaacatccagacagtagaatattattcagtgataaaaataaatgagctatcaagctacaaaaagacatggatgaatcttaaatgcatattgctaaggtaaataagccaatttcaaaaggctacaggctacatgagtccaattatatgccattttggaaaagrcaaaactatagtaacagcaaaaggattggtgtttgccggggggaaggatgggaggggaggacttaaatacagtgaaacacaggagatttggggggtggtgaaactattctatatgatactgaaatggaggaatacatgacactatgcaaaatctatggaattcaacaacacaaaaggtgaaccataatgtttgcaaaattttaaaaaatcacttaggggattgggtgatcccaggatagaatgcagaatgtgataaaattacaaatgtgtaaaataactcactgaaatgaatgagggaaa

SEQ ID NO: 133345 - DNA, 601 bp, Human
ggaagatggagtcaaccaggtttctcactgtcggagtggaagttcacagataaacatgggaaaaggctagaataatccatgtaataatggattaaagttggagacatcattatgaactcatgtttagtttaatataggcacatacagtttcatatagaaatatttatggatatttttaaaaacacatggaagggggctgtgtcaaaagagcctgaagcccaattgaaagggttaccaatggctaaagctggaatagtttgagcaagaaaatacagtattgggttataatccaaaataataratatccataggtccatactgatgcaaataaatgattaaagggagaagaggaaaaaaaatctaccatgcaggataatttccaatttatgtagatattctgcatcaagaaggtggaatataacttcccaccccttaagtgtgagctgtgcatagtgccatcctttcaaagagtacagtagggaaagtaggaaaaaagattacattggagaacctgacaaacactccctcagtcaggtgatcaaagtcatcatcaacagtgataagtaatgttggtagtgtatacccttgacatgtgactaaa

SEQ ID NO: 133346 - DNA, 601 bp, Human
gcctgaagcccaattgaaagggttaccaatggctaaagctggaatagtttgagcaagaaaatacagtattgggttataatccaaaataatagatatccataggtccatactgatgcaaataaatgattaaagggagaagaggaaaaaaaatctaccatgcaggataatttccaatttatgtagatattctgcatcaagaaggtggaatataacttcccaccccttaagtgtgagctgtgcatagtgccatcctttcaaagagtacagtagggaaagtaggaaaaaagattacattggagaacctgacaaacactccctcagtcaggtgatcaaagtcatcatcaacagtgataagtaatgttggtagtgtatacccttgacatgtgactaaaatggtacttgatctctgtggtcttttttcctcaaacccataactctaactttgagaaaaacattagataaagaccagttgaggggcagtctacaaaacacttggccaatacttattaaaactgtcaaaattatcaaaaacatggaaagtctgagaaactgtcaagaggagaacttaaggagacatggtgattaatgtggtatcctgtat

SEQ ID NO: 133347 - DNA, 601 bp, Human
gggtgacggaatcaatcataaaccaaacctcagcatcatgcaatatactcatgtaacaaacctgcacatgtactccctgaatctaaaataaaagttgaaattatttaaaaagccagtaacaagagaccacatgttgtatgattccatttatatgaagagtccagaataggcaactctgtagagacagaaagcagattagtggttacctagggctacaagtggggatgaggcattaggaggtgactggtaatgggtacatggtttctgttttgggtaacaaaaatactctagaattagatartggtaaatatactaaaccctactgaattgcacactttaaaaggatgaattgtatggtatgtggatgatatccgggtaaagattaaaactaaggaaatctggataaagtatgcacttcagttaataataatgaatcaatattggcttgttaattataacaaatataccatactgatgtaaaatgatagtatggaaagctaggcttggggattgtgggaactctgggctatcttaatagtttttttggtaaatctaaaaccattctgaaaaataaaattaaaaaaatgaaagcagctgttgc

SEQ ID NO: 133348 - DNA, 601 bp, Human
agtggtaaatatactaaaccctactgaattgcacactttaaaaggatgaattgtatggtatgtggatgatatccgggtaaagattaaaactaaggaaatctggataaagtatgcacttcagttaataataatgaatcaatattggcttgttaattataacaaatataccatactgatgtaaaatgatagtatggaaagctaggcttggggattgtgggaactctgggctatcttaatagtttttttggtaaatctaaaaccattctgaaaaataaaattaaaaaaatgaaagcagctgttkcaatgtcagaagtgaaaacacacaaagtcctacttatgaaaacagaaggatatttggaggcagttgttttagaaaaaagactcaaggttggggggagtcttattaaattgtaaggcatgaattgaatatattcaccaaaactcttggcggcattggtagaaaatctggctggcttttatgcaaactgaatatttgcatggctactaagtttttcagcccaaataattcaccttccttacccttacatttgtgtacttatatcagaatatttatcatgtaggatatgaaaaaaaatatgct

SEQ ID NO: 133349 - DNA, 601 bp, Human
gcatgaattgaatatattcaccaaaactcttggcggcattggtagaaaatctggctggcttttatgcaaactgaatatttgcatggctactaagtttttcagcccaaataattcaccttccttacccttacatttgtgtacttatatcagaatatttatcatgtaggatatgaaaaaaaatatgctggagttccagcatcacagaaggtggcatggtactcacattcagaacatagagcagttctgttcaagaacctctttacaagtgtattagtccgttctcacactgctataaagaacyacccaagactgggtgatttataaaggaaagaagtttaattgttgcacaatttcacatggctggggggggtctcaggaagcttacaatgatggcagaagggtatcacttctcggccttttgactaagatcaagtgtagaatcatggcagaagtgaaagcaaacatgtccttcttcacatggtggcaggagagtgagttccaagcaaagggggaaaagccccttatataaactatcagatctcatgagaactcactctcacaagaacagcatgggggtaactgcccccatgatgcaagtacc

SEQ ID NO: 133350 - DNA, 601 bp, Human
ctgaatatttgcatggctactaagtttttcagcccaaataattcaccttccttacccttacatttgtgtacttatatcagaatatttatcatgtaggatatgaaaaaaaatatgctggagttccagcatcacagaaggtggcatggtactcacattcagaacatagagcagttctgttcaagaacctctttacaagtgtattagtccgttctcacactgctataaagaaccacccaagactgggtgatttataaaggaaagaagtttaattgttgcacaatttcacatggctggggggggyctcaggaagcttacaatgatggcagaagggtatcacttctcggccttttgactaagatcaagtgtagaatcatggcagaagtgaaagcaaacatgtccttcttcacatggtggcaggagagtgagttccaagcaaagggggaaaagccccttatataaactatcagatctcatgagaactcactctcacaagaacagcatgggggtaactgcccccatgatgcaagtacctttcactgggtccctcccacgacatgtggggattatgggaactacaagatgagatttgcgtggggataca

SEQ ID NO: 133351 - DNA, 601 bp, Human
cacatggtggcaggagagtgagttccaagcaaagggggaaaagccccttatataaactatcagatctcatgagaactcactctcacaagaacagcatgggggtaactgcccccatgatgcaagtacctttcactgggtccctcccacgacatgtggggattatgggaactacaagatgagatttgcgtggggatacagccaaaccatatcaacaagatttgttaaattatatttcacatctccctaggggagaaaagacaaatgcagattttagcatgggaaaagaaacagaatgagtcayatcaaggttttaatccaagtcattcagtgatttaaaaaaaaagaaaaaagggatgttttttcccttattgtttcaactctatatgagaggtaaacctttcctttccttgtaaaattcttttcagccttcaaggccaagtcttctatgaaacttcactttctccctggtccctactgtattcctttgttgaactcctctaattaatatgcatggcatcacaacatcaattcataaataagagactgttagaatgtttattaattggccgggtgtggtggctcatgccatgtgcagtttctc

SEQ ID NO: 133352 - DNA, 601 bp, Human
attcagtgatttaaaaaaaaagaaaaaagggatgttttttcccttattgtttcaactctatatgagaggtaaacctttcctttccttgtaaaattcttttcagccttcaaggccaagtcttctatgaaacttcactttctccctggtccctactgtattcctttgttgaactcctctaattaatatgcatggcatcacaacatcaattcataaataagagactgttagaatgtttattaattggccgggtgtggtggctcatgccatgtgcagtttctccttctctgttaaatcattttcrtctgcatattacaagctccagactctcttatcttaaccagaaaaaaaaaaaaaggaaagaaagaaagggaaagcttccttgacactttctgaactttcctggttcatttcctagaaatatttctcaaattctatctctctgtcttcaggtcttcacttcttaagcattctataaatttttaaaattaaaatttgaactcaggccaggcacggtgggcccatgcctgtaatggcagcactttggaaggctgagatgataggacaacttgagcctaggagtttgataccagcatgggcaatg

SEQ ID NO: 133353 - DNA, 601 bp, Human
aactctatatgagaggtaaacctttcctttccttgtaaaattcttttcagccttcaaggccaagtcttctatgaaacttcactttctccctggtccctactgtattcctttgttgaactcctctaattaatatgcatggcatcacaacatcaattcataaataagagactgttagaatgtttattaattggccgggtgtggtggctcatgccatgtgcagtttctccttctctgttaaatcattttcgtctgcatattacaagctccagactctcttatcttaaccagaaaaaaaaaaaaaggaaagaaagaaagggaaagcttccttgacactttctgaactttcctggttcatttcctagaaatatttctcaaattctatctctctgtcttcaggtcttcacttcttaagcattctataaatttttaaaattaaaatttgaactcaggccaggcacggtgggcccatgcctgtaatggcagcactttggaaggctgagatgataggacaacttgagcctaggagtttgataccagcatgggcaatgtggcaaaaccctgtctctacaaaaagaaaaattaggcaggtgtggtggtgcat

SEQ ID NO: 133354 - DNA, 601 bp, Human
aaatttgaactcaaatgtaataagtgtatttgatatatatctaccacttgatatcgctctttttttatagaaacatttaaagctcaaccttttatgtctgaaaaaagctcaacctttcatgtctgaaaatatctttatactatccttgtacttaattgatagtttgctggctttagaattttaggtcagaagtcatttttccttagaatgttgaaggcattgctcagttatcttccagcttccagtattgctcctgggaagtttgcagccactttgattcctaatcttttggatgttgatstgttcccaccctcttccctgaaagcatttggaattttctctttggcttgcttttccgaaatttatgatggtgaatcttggtgagaatctatttgcatttgttttgcttgactctctggagccctttcagtctgggtaacaagcctttcaattctgagatattttcttgaattccttcattgttgatttccaatccatatttttctatgctctctttttagaactattatttggttgttgaccttccgaatttatcagtagatttaaatttttttctcttctgtttttcatttctgagttt

SEQ ID NO: 133355 - DNA, 601 bp, Human
ccagcttccagtattgctcctgggaagtttgcagccactttgattcctaatcttttggatgttgatctgttcccaccctcttccctgaaagcatttggaattttctctttggcttgcttttccgaaatttatgatggtgaatcttggtgagaatctatttgcatttgttttgcttgactctctggagccctttcagtctgggtaacaagcctttcaattctgagatattttcttgaattccttcattgttgatttccaatccatatttttctatgctctctttttagaactattatttggwtgttgaccttccgaatttatcagtagatttaaatttttttctcttctgtttttcatttctgagtttttttttctgtatttttaggaagatttccttgacttttcttccagccttcctaatgagttttcttcctgtgatattgttttctctctttaaaaatatttcccacttaaagtgtgcaatccaatggtttttagtacatctgcagggttgtgcaactaccacacatcactatcaattttagaacattttcattaaccagaaataaagctctatacccattggtagtcacacccctat

SEQ ID NO: 133356 - DNA, 601 bp, Human
gtctgggtaacaagcctttcaattctgagatattttcttgaattccttcattgttgatttccaatccatatttttctatgctctctttttagaactattatttggttgttgaccttccgaatttatcagtagatttaaatttttttctcttctgtttttcatttctgagtttttttttctgtatttttaggaagatttccttgacttttcttccagccttcctaatgagttttcttcctgtgatattgttttctctctttaaaaatatttcccacttaaagtgtgcaatccaatggttttyagtacatctgcagggttgtgcaactaccacacatcactatcaattttagaacattttcattaaccagaaataaagctctatacccattggtagtcacacccctatttctccacaccttctcagccttaggtcaccacttatctgctttctgcctctacagagttgcctgttctgaacacttcatataaatggagtcatataatatatggtctcctgtcattggcttttttcacttagcgtaatgttttcaaggtccatccatgttgtagcatgtgtcagtacttcattccattttattgc

SEQ ID NO: 133357 - DNA, 601 bp, Human
ttctgaacacttcatataaatggagtcatataatatatggtctcctgtcattggcttttttcacttagcgtaatgttttcaaggtccatccatgttgtagcatgtgtcagtacttcattccattttattgctgactgacattccgtcatgtctgtaccacattttgtttattcatcagttgatggacatttgggttgtttccactttttggccgtatgaataacgctgccatgaacatttgtgtacaaattgtatgaccttttttttttttttggagacggagtctcgcccttgccctgtsacccaggctggagtgcagtggcacaatctcagctcactgcaacctccgcctcccgggttcaagctgttctcctgcctcagcctcctgagcagctgggattacaggcacatgccaccacgtgtggctaatttttgtatttttagtagagacggggtttcaccatgttggtcaggctggtctcaaattactgacctcgtgatctgcccgcctcagcctcccaaagtgctgggattacaggtgtgagccactgcgcccggccgtggacacatgtgttttaaactcctttgggtatacctaagg

SEQ ID NO: 133358 - DNA, 601 bp, Human
gcacatgccaccacgtgtggctaatttttgtatttttagtagagacggggtttcaccatgttggtcaggctggtctcaaattactgacctcgtgatctgcccgcctcagcctcccaaagtgctgggattacaggtgtgagccactgcgcccggccgtggacacatgtgttttaaactcctttgggtatacctaaggagtgaaattgctggctgctatgataattctctttaatgttttgaggaactgccaaactgtatttccaagtgtacccattttacatttccaccagcagtttgtgarggttccagtttctccacatcacatcctcatcaacatttattattgtccatcttgttaattatatttatcctactgggtgtgatttggtacctcggttttgtttatttgttttgttttgggttttttttttttgagacagagtctctttctgtctcccaggatggagtgtagtggcatggtcatagctcagtacagtctcaacctcccaggctcagtcaatcctcccacctcagcctcctgagtagctgggaccacaggcacacaccaccacgcctggctaatttttagtagatatgaggt

SEQ ID NO: 133359 - DNA, 601 bp, Human
atcacatcctcatcaacatttattattgtccatcttgttaattatatttatcctactgggtgtgatttggtacctcggttttgtttatttgttttgttttgggttttttttttttgagacagagtctctttctgtctcccaggatggagtgtagtggcatggtcatagctcagtacagtctcaacctcccaggctcagtcaatcctcccacctcagcctcctgagtagctgggaccacaggcacacaccaccacgcctggctaatttttagtagatatgaggtcttgcagtgttgcccagrttggtctcgaattcctcaaactcaagtgatcctcccgccttggcctcccaaagtgctgagatgataggcataagccactatgcctgtctggtactccagttttgatatgcattttcctgatggttaatgacgttgagtatcacacagtcgctgccgccagcccgtgcaccatgtcctcctactgctctgccgccctgctcctccgcctgtcacaatggaagaagagattgccatgctggtcattgacagtgtctccggcatgtacaaagctggatttgctggggacgacgccccctgagc

SEQ ID NO: 133360 - DNA, 601 bp, Human
catttaagcccttcatccattctgagttaatttctgtatgtagtatgaaatagtggtctaaattcattattttggatatcgatatatggttgtcccagcaccatttgatgaaaatattcttttttctccattgacttgtcttggtaccctcaccaaaagtaaattgaccataaatgtgaaggtctatttctgggtttctcctatttatgtttttagcttccaagagctctttgtttttctccaattgcttccatattcatcctgtttttctatcatgggtccattatctttgtgaagataytaataatggcttttaaagctttcatttctctgtatagtctctgtttctccaggttacctttttctctgcccacgggcttgatctctgtgttttattccatagtgtctattaaaatatgtattgttctcaattgtctgctcaagtttaaagacagagcactaaaggctagttgaaagctctgtgcgtttaagtagagcctaccagctgtgggcctcactgtcagatgatctagtagactttatcaatgtggcaatatctaaattgtttttcttaaacaacttagaaagctctctcttactc

SEQ ID NO: 133361 - DNA, 601 bp, Human
caagaggtgcagctttggagttctctgagatatccctgtatccttgcaataaattctcctgttttgttaaagtaatttatagtgggtttctttcttgttatcaaaggaacttgaaaatgccattctccttcccagaattactaattttaaattaattatatcattgcacatctgtttaatacttcatagcttactaaatatgtactgtcattaatctattctccttacaacaatgtgaatattaatggtttttcaactagataaatgaggaaactgaggcccagactcatgaaatgattgrcccaagttcttaaagatatggttgatcagcttatatgaaaacccaggtgttatttttagcccagtggcttcctatgcaccattgcattctaaattgtcctaaggttgtcacaaaggttgttttcataacatagagcttcattttctccaaagaaatagaattgagattacagggaaaagcttttatattaaatgcttagataatataatgagaaatctgttattctatttggaggaaaattactttgagtacaattgatatgatgtcaattgctatgatacatggtttttaataaccaac

SEQ ID NO: 133362 - DNA, 601 bp, Human
tttgagtacaattgatatgatgtcaattgctatgatacatggtttttaataaccaacacaggtggaggcttataataaaaggatgccttgctattatagtagaagaatgaaataacctgcagtccacatttatctgtgaatgctactcagttttctttcttcttagccttgcagttttctttaaattagaaaattaaatcttcagggtcattattttaaaagatattctattcctcttccctgataataaattccttatatattaagaattactggaacaatatttttatcctgtatatgrccagtgatttaaaggatgctttccatttctgaaattgcattaggagtacataaatgctttttaaaaattgttcagtaaagcaagtgtgatacctatttgcaacactaggccacatgtgggatttttaaaacaatgaattagtcactgtctttaaagagcatatagctgataatattaccagccaatattccttgaatgcttactatttgccagtcactgttgtaaatattttagatcatatgttaattcacttaatcttcacgacaatcctgtgaggtatatactattattatcaccatt

SEQ ID NO: 133363 - DNA, 601 bp, Human
agaatttgagagggagaagtgttggaagtggagttacagtttcctccctgattttttcctgattaactttactactcagtgcaggtttgcgatggggcaatcttgctacagtatctcctctgtgaactagtctccacacctagttaagttaatatggttagttaggttaatatgtaaagttaagcattgagcttggtatcagtgacccaattaagatggtttcactcccaagaaaattcatataagaataactctaagcatggccatagattttaatcaaaccttgcatagaatttttttyctttttttttaaaaaaaaattatttttcttttaagttccagggcacatgtgcaggatgtgcaggtttgttacataggtaaacatgtgccatggtagtttgccgcacctatcaacccatcacctaggtgataagcccagcatgcattagctatttttcctaatgatctcccttcccccacccaaatcctgataggccccagtgtggtgttcccctccctgtgtccatatgttctcattgttcagcttctacttacaagtgagaatatgcggtgtttggttttctgttcctgtgttagcttg

SEQ ID NO: 133364 - DNA, 601 bp, Human
agggagaagtgttggaagtggagttacagtttcctccctgattttttcctgattaactttactactcagtgcaggtttgcgatggggcaatcttgctacagtatctcctctgtgaactagtctccacacctagttaagttaatatggttagttaggttaatatgtaaagttaagcattgagcttggtatcagtgacccaattaagatggtttcactcccaagaaaattcatataagaataactctaagcatggccatagattttaatcaaaccttgcatagaattttttttcttttttttwaaaaaaaaattatttttcttttaagttccagggcacatgtgcaggatgtgcaggtttgttacataggtaaacatgtgccatggtagtttgccgcacctatcaacccatcacctaggtgataagcccagcatgcattagctatttttcctaatgatctcccttcccccacccaaatcctgataggccccagtgtggtgttcccctccctgtgtccatatgttctcattgttcagcttctacttacaagtgagaatatgcggtgtttggttttctgttcctgtgttagcttgctgaggataa

SEQ ID NO: 133365 - DNA, 601 bp, Human
gggagaagtgttggaagtggagttacagtttcctccctgattttttcctgattaactttactactcagtgcaggtttgcgatggggcaatcttgctacagtatctcctctgtgaactagtctccacacctagttaagttaatatggttagttaggttaatatgtaaagttaagcattgagcttggtatcagtgacccaattaagatggtttcactcccaagaaaattcatataagaataactctaagcatggccatagattttaatcaaaccttgcatagaattttttttctttttttttwaaaaaaaattatttttcttttaagttccagggcacatgtgcaggatgtgcaggtttgttacataggtaaacatgtgccatggtagtttgccgcacctatcaacccatcacctaggtgataagcccagcatgcattagctatttttcctaatgatctcccttcccccacccaaatcctgataggccccagtgtggtgttcccctccctgtgtccatatgttctcattgttcagcttctacttacaagtgagaatatgcggtgtttggttttctgttcctgtgttagcttgctgaggataat

SEQ ID NO: 133366 - DNA, 601 bp, Human
ttgctacagtatctcctctgtgaactagtctccacacctagttaagttaatatggttagttaggttaatatgtaaagttaagcattgagcttggtatcagtgacccaattaagatggtttcactcccaagaaaattcatataagaataactctaagcatggccatagattttaatcaaaccttgcatagaattttttttctttttttttaaaaaaaaattatttttcttttaagttccagggcacatgtgcaggatgtgcaggtttgttacataggtaaacatgtgccatggtagtttgcygcacctatcaacccatcacctaggtgataagcccagcatgcattagctatttttcctaatgatctcccttcccccacccaaatcctgataggccccagtgtggtgttcccctccctgtgtccatatgttctcattgttcagcttctacttacaagtgagaatatgcggtgtttggttttctgttcctgtgttagcttgctgaggataatggcttccagctccatccatgtccctgcaaaggacatgattttattcctttctatgcttgcatagtattccatggtgtatacgtaccacatt

SEQ ID NO: 133367 - DNA, 601 bp, Human
ctctgtgaactagtctccacacctagttaagttaatatggttagttaggttaatatgtaaagttaagcattgagcttggtatcagtgacccaattaagatggtttcactcccaagaaaattcatataagaataactctaagcatggccatagattttaatcaaaccttgcatagaattttttttctttttttttaaaaaaaaattatttttcttttaagttccagggcacatgtgcaggatgtgcaggtttgttacataggtaaacatgtgccatggtagtttgccgcacctatcaacccrtcacctaggtgataagcccagcatgcattagctatttttcctaatgatctcccttcccccacccaaatcctgataggccccagtgtggtgttcccctccctgtgtccatatgttctcattgttcagcttctacttacaagtgagaatatgcggtgtttggttttctgttcctgtgttagcttgctgaggataatggcttccagctccatccatgtccctgcaaaggacatgattttattcctttctatgcttgcatagtattccatggtgtatacgtaccacattttctttatctggtct

SEQ ID NO: 133368 - DNA, 601 bp, Human
ttctggatattaggcctttgtcagatggatagatcacaaaaattttctcccattctgtaggttgcctgttcacagtgattatagttttttgctgtgcagaagctctttagtttaattatatcccatttgtcaatttttgcttttgttgcaattgctttcatcatgacatctttgtctgtgcctatgtcctaaatggtattccctaaattttcttccagggattttatagttttggattttacatttaactgtttaatccatcttgagttaatttttgtataatgtgtaaggaaggggtccrgtttcaattttctgcatatggctagctagttcttccagcaccatttattaaataggaaatcctttccccattgcttgtttttgtgagctttgtcgaagatcaggtggttgtagatgtgcagtcttatttctgagttctctgttctgttccattggcctatgtgtctgtttttgtaccattaccatgctgttttggttactgtagccttttaatgtagcttgaagtccagtagtgtgatgcctccaactttgttctttttgcttaggattgtcttggctatacaagctcttgtttggtttc

SEQ ID NO: 133369 - DNA, 601 bp, Human
acctcaggtgatctgcccacctcagcctcccaaagtgttgggattacaggcgtgagccactgcgcccagcctgttgtttttaattagatcttttggagacagctctattttttacctaggatgtctgtgaataatagttctgtctctctctgtattggtggtaacaaatcttgcagactaaaatttgagtttagcttcctacctagggttggtggaactgcagtggtgaggaatgggaaaactcaaggagagagctagggacaataggaatgtttattccttcctcccaaagtttctcctwagacttggaaagtcttcagggttaggaaaatccttagaaaatactggaagtgctaatgttcctgaaattcctatgtcattataacttctgtttttgtggactgtcatgattctctgagtataaagagcctatgtgtgggctgctgctcccactgaagatggcacttcatcatctgttctacctagtggtctctggtgagaatgatggagcctaaccatctgctagttttaatctgtctggaaacaggagccctctgagattgaggaaaacctagtttctccatctacctagcagaattac

SEQ ID NO: 133370 - DNA, 601 bp, Human
agaaatccttagagaccatataatgtgtttcatgggttgggatagggagaggagaatgctggaatagtccccttgttcagacatgtctctccccattcttataatttagaaaccctgtttatggcatctctgttaggtagccatctaaggtttaattaaaactcttcattgatcaggaatttatttctgccccttgagttaagccatttaatcactttgaatgtattttttataatgttaagatgaaaactgcctccctataatatctaaccatttctaattttcttaattatgtcttttsatatcactcagactactccatttttttttcctgaggagcccttcaaaataatagagagttttattctctttttattaattggtattgtcttataccctgcagatgctcttgggaaatgtaatctattaaattaatattcaaattaattaaacagattctttcctcctggacagtggctcagataataatctagaaggaatattatgcccagaaatcttgttcttcaaaaatgaaggggagataaaaatctttctcagacaaaaactgagggaatttatcaccactagacttggcttatac

SEQ ID NO: 133371 - DNA, 601 bp, Human
tgcagatgctcttgggaaatgtaatctattaaattaatattcaaattaattaaacagattctttcctcctggacagtggctcagataataatctagaaggaatattatgcccagaaatcttgttcttcaaaaatgaaggggagataaaaatctttctcagacaaaaactgagggaatttatcaccactagacttggcttatacaaaatgctaaagggagtccttcaagctgaaggaaaatgttactaagcagtaacacaaaaacatgaaagtacaaaactcactggtaaaagtaatcacakagtaaaattcaaaatattctagtactgtgatgacagtggaaaatcaattacatctcttatatgaaggttgaaatattatatagctgcaataatctgttaagggatacacattataaaaagatgttagatgtgataccaaacacataaaatggaagaaggagtaaaagtttagagtttgtgtaagtgatcaaagctgttaccaacttaaaatagcctgttacaagatgttttatgtaagccttacggtaaccatgaggcaaaaacccctagtagatacacaaaagataaaaagaaaggatt

SEQ ID NO: 133372 - DNA, 601 bp, Human
aatagcctgttacaagatgttttatgtaagccttacggtaaccatgaggcaaaaacccctagtagatacacaaaagataaaaagaaaggattcaaagtataccactgcaggaaatcattaaatcacaacggaggacagcaagagaaaagaggaacaaagggtctacaaattaactaggaaaaaaaaaaatcagcaaattggctgtagtaagtccttacctaataataattattttgaatttaaatggattaaagtttctaatcaaacggcattgaatggctgactgggtaaaaaaaaaaaatatgttgcctacaagagactcacttcactgttaaggacacatttagactcaaaatgaagggatgggaaaagatatgccatgcaaaggagcaggaatagctatacttacatcagacaaaatagactttaattcaaaaactgtaaaaaaagacaaagaaggtcattatgtaaagaggtcaactcatcaagaagacataataatcatatatatatatgattgttatggaatatacacacacacacacacgcacgcacgcacgcacgcacgcactcgatgtcagagcacctaaatatatgtggt

SEQ ID NO: 133373 - DNA, 601 bp, Human
atgcaaataaacccagaaatggaagagtggacattatacctgataccacagaaatacaaagtagcacaagagacttctatgtaacaaattgcataagcagaagaaataaattcctaaaaacctagaacctattaagatgaatcaagaagaaatagaaaatctgaacaggcaataatgagtaaggagattgaataagtaataaaaagtctcccatcaatgaaaacccaagacctgatggtttcactgctgattctaccagatatttaaagaactaataccaatccttctcaaactcttccaraaaatggaagaggagggaatacttccaaactcgttttacaagaccagcattaccctgatgccaaatacagacaaggacactacaaagaaacaaaactacaggacaatatctttgatgaacatagacgcaaaaatcctcaacaaaatactagcagaccaaactcaacaacatatttaaaagatcattcaccgtgatcaagtgagatttatccctgggatcctaggatgttttgacatatgtagatcaataaatgtgatacagcatattaacaaaatgagggacaaaacccacatcatcatc

SEQ ID NO: 133374 - DNA, 601 bp, Human
gagacaaccacggattgggagaaaatatttgcaaaccgtacatctgataagcggttaatatccaaaatatataaggaactcaaacaactcaataacaagaaaacaacccaatttttttaaatgggcaaaggacttgaacagacatttttagaaagaatgcatatgaatggccaatagatatatgaataaatgctcaatatctctaatcatcagggaaacgcaaataaaaaccacagtgagataacatctcataccttttagaatcactattaccaaaaagacaaaagataagtattggggsggttgtgaagaaaaagggtgcactattggtgggaaggtaaattagtatagccattttggaaaacgctatggaggttcctcaaaaaatataattactgtacaatccagctgtcccacttctggatatatatccaaaggatttgcaatcagtatgtcgaagagatatttgcactatggtcatttcagcattacagtaaccaagatatggaaacaatctaagtgtttgttaaccaatggacggatacaaaaatgtagtatatatacacaatggaatactatacagcatttacaaagaaggaat

SEQ ID NO: 133375 - DNA, 601 bp, Human
ttagtcttgtccttgttcccagagttctgtaattctggacagtcacttgtagtgcttcattttcttatctacaacaagaaggagttagattagagaattcaatgagcactaggtagccctgaaagcactctaggctgtgattaccaagaaatagactaaaagcattttaagagaatttctgcctagatatctgacttggcctccaggagacacatttctctgagactagcaaatttaattttgaacttttttttcttttgatagctaattggcccttatgaattattaaatcagcagctcyttaagaaatccacacccagagctgatgaagagaggaagtctctggggctgtggtcttcagaaagcttaagccattttctgcaaatattttatttataaatgactatgaggaaactctagcctgtctctgactttatgaatgtataaacgaaacaggtcatacctaggatcccatgggagcatcaaacacaaacacttaagttaatgtaacttagagtagcccccataaagagatgacacaatgtagtggaaggaatgctaagctgaagagtctgaagacccaagtttaaatttctggctc

SEQ ID NO: 133376 - DNA, 601 bp, Human
agaggaagtctctggggctgtggtcttcagaaagcttaagccattttctgcaaatattttatttataaatgactatgaggaaactctagcctgtctctgactttatgaatgtataaacgaaacaggtcatacctaggatcccatgggagcatcaaacacaaacacttaagttaatgtaacttagagtagcccccataaagagatgacacaatgtagtggaaggaatgctaagctgaagagtctgaagacccaagtttaaatttctggctctgccactttcttgccagtaagaccttgagctaatgagttcactcctctgtgcttcagggtcttcagctataaaataagacagttggactaactttcaacttttagtaactgaggcttggcaacttagaagtaagagaatggagctagaagcccatgaacaggaagtcatctgtaatgacatcaaggatagcaggttattcctggccaagagcttgatgtgaaactctacttcctattgttccttggcctaattgatgtcgtgatgctttatctgattgtgtcactgacagactggctagggagtgattttctaacttttcctccacagtta

SEQ ID NO: 133377 - DNA, 601 bp, Human
cattactaccctcactgggggttctctgtgacttctcccagggcctgttagccatcctgattacttttcctctcccacagggtgcctttgaccttaaagttattatttttcctctttgggcatctgttttctcatcagtaaaataacatgaaagtaatctttaagtttctttctagctccaatattctgtgatgccattgtccagaatctctactgaatgggggagcaaattatgtatcacattttttgttataaaaatcaaattggtttattgaacagattctggagaataaaaccttcrttcaagcctcagccttagtggtcatattagtattgtggtctctgtgggtttttaatcaaagaaaactgtggacataggaatggtatcatttgtcagtgtaagctgcaatgaagaaatgcaaggtagaaaaagatgactgacatcattagacccactttgacaagtgtgatattattctcaaagtactcccgggcatctgagttatttttgtctcctgtgggtcagagtctggggcttgttctcctcccctggtaagatagctagtttaatgatggctctgccatcactgaagtacatttg

SEQ ID NO: 133378 - DNA, 601 bp, Human
ggcctacgtgtggtgactgatgttcttagatagaagagagagaaaaggcaaagtaagatggcctaagttctgaagaacttcaacaccagcagacaggttgaagaaccaggaaactagtttgacgaaagccaaaggaagaaaacatttcaagacagaatcatctacacatgatgtcactttgttctcaccttccacttactcttcagctcactacagtctggcttccgtaccattcccctcaattacactaaaatagctcttttttaaaggaccgtcaggctgggagcagtgactaaagccygtaatcctagcacattgggaggccgaggcaggtggatcacaaggtcaggagatcatcgagaccatcctggctaacacagtgaaacctcgtctctactaaaaaatacaaaaaattagcggggcatggtggcgggcacctgtagtcctagctactcgggagactgaggggcaggagaatggtgtgaacccgggagtcagagctttcagtgagctgagatggcgccactgcactccagcctgggcgacaaagcgagactctgtctccaaaaaaaaaaaaaaaaaaaaaaaaaaaaaaaaaaaa

SEQ ID NO: 133379 - DNA, 601 bp, Human
gattatctagacagaatatcaacaaggaaatagaggatttgaacaacaccaaagccaactagacctaagaaatatctatagaacacccaacaatagtagaatgcctattcttctcaagggcacatggaacattctttaagatggatcatatgttggtccataaagcaaatctcaatagattttaaaggattgaaatcatacaaaatatgttctccaactgcaataggatgaaattagaaatgagtaacagaaggaaatttgagaaattcacaaatatatggaaattaaacaacactcttasacaaccaatgagtcaaagcagggaagtttgaaaatactctgaaattaatgaaaacaaacataccatattgaaatctgtgctataggtaaaagcattgcctagagggaaatttatagctatacttgcctatattgaaaaagaaggaagatttgaaaattaataacctaactctccatcttaaaaaaaaataagagaaaactaaattcaaagcaatcaatgaaaaaaggtaggctgggcgcaatggctcacgcctgtaatcccagcactttgggaggccgaaatgggcggatcacgaggtca

SEQ ID NO: 133380 - DNA, 601 bp, Human
aaaagaaggaagatttgaaaattaataacctaactctccatcttaaaaaaaaataagagaaaactaaattcaaagcaatcaatgaaaaaaggtaggctgggcgcaatggctcacgcctgtaatcccagcactttgggaggccgaaatgggcggatcacgaggtcaggagatcgagaccatcctggctaacacggtgaaaccccatctctactaaaaatacaaaaaacttagccgggcgtagtggcgggcgcctgtagtcccagctacttgggaggctgaggcaggagaatggcgtgaaccygggaggcggagcttgcagtgagccgagatcgcaccactgcactccagactgagcgacagagtgagactctgtctcaaaaaaaaaagaaaaaaaaaaaaaaaaaagaagtgcctacagtggaaactacaaaattgttgaaagaataagatctaaataagtggaaagacattgttaagatagcaatctatgtcaaagtggatttgatatggattacattgaacctgtgcagttttttattgcagaaattgacaagctaattttaaaatcatatggaaatcctagggatccagaatagccaga

SEQ ID NO: 133381 - DNA, 601 bp, Human
atagtggtgacaattacacaacttgtgaatatccaaacactgattctcacattttaaaaaggttaattttatagtatgtgaattctatcttaatgtctttaaaaaagggatacaaggaagaaaagtatagagatctgagaagaaaatggaggtaaattacttctatggcccttaagcatgttagactatagtgtaaacatccctcatagaggaatatttacagaggtgagactgaattggaggtgttattgggacagtatatttgtggagatgtatccagttccttttaggatgttggcamaatcactaggaaggcatttaacagcaatgtccagttgcctgggggatacagggattagtcagacacagtctctgcaatttagcctagcaactagttgttaagatagaatgctacaaggcagagtgtgatcagagttatcgaatgatgcaagtgataagaggtaaaggaaaaatgagaaatcatgtatgattggacagtcagagaaagtgttttaaaggaggacatgaggattctattttaaccttgaaggatagagcagaatttggtgcatgaaatttggtgcattttggtacatgaaaa

SEQ ID NO: 133382 - DNA, 601 bp, Human
agcaatagatgtcagtctaaagggggatgattgcagtaaagtattccaaagccttgcatctcagtagcattgtattacttgagacttagtgatgcaaaatgtcaggatcgccccattacttactaattgaaatctgcatttgaacacatttcccaggtgattcatatttacattaaagattgagaaacccgcttccaaggtcctggaattgtttgggatgggaattgtgatatcagttaacttcaagcttggtcacagtcaacaatataatttcaagaataacccctgaaagaaaagaaayagcatgtataaaacttccaaatcagtccaaggcaaaactggactcaaaatattaacaaataaaaaaagaagtggccaggaaaagaaagaagttcagggcaaatgaaaaaagcacagtcgagttcaggcataacaaaattccaataagtgtgagtagccaaaatttgccagttaaaagagattgtcaaatagaattttaaaataatccaattatatgatttttagaaataacatataaaacacagagcatgaaagtgaaaatatcaaaacaagatatatcaggcaaacactaaacataagg

SEQ ID NO: 133383 - DNA, 601 bp, Human
tagatgtcagtctaaagggggatgattgcagtaaagtattccaaagccttgcatctcagtagcattgtattacttgagacttagtgatgcaaaatgtcaggatcgccccattacttactaattgaaatctgcatttgaacacatttcccaggtgattcatatttacattaaagattgagaaacccgcttccaaggtcctggaattgtttgggatgggaattgtgatatcagttaacttcaagcttggtcacagtcaacaatataatttcaagaataacccctgaaagaaaagaaacagcakgtataaaacttccaaatcagtccaaggcaaaactggactcaaaatattaacaaataaaaaaagaagtggccaggaaaagaaagaagttcagggcaaatgaaaaaagcacagtcgagttcaggcataacaaaattccaataagtgtgagtagccaaaatttgccagttaaaagagattgtcaaatagaattttaaaataatccaattatatgatttttagaaataacatataaaacacagagcatgaaagtgaaaatatcaaaacaagatatatcaggcaaacactaaacataaggatgtt

SEQ ID NO: 133384 - DNA, 601 bp, Human
ccccattacttactaattgaaatctgcatttgaacacatttcccaggtgattcatatttacattaaagattgagaaacccgcttccaaggtcctggaattgtttgggatgggaattgtgatatcagttaacttcaagcttggtcacagtcaacaatataatttcaagaataacccctgaaagaaaagaaacagcatgtataaaacttccaaatcagtccaaggcaaaactggactcaaaatattaacaaataaaaaaagaagtggccaggaaaagaaagaagttcagggcaaatgaaaaargcacagtcgagttcaggcataacaaaattccaataagtgtgagtagccaaaatttgccagttaaaagagattgtcaaatagaattttaaaataatccaattatatgatttttagaaataacatataaaacacagagcatgaaagtgaaaatatcaaaacaagatatatcaggcaaacactaaacataaggatgttggggtaacaataatacttaaataaagcttggaaaaaagaatgctagagtagttacattaatgtcagactacagataattttttaaattttatttatttatgtttt

SEQ ID NO: 133385 - DNA, 601 bp, Human
cccaggtgattcatatttacattaaagattgagaaacccgcttccaaggtcctggaattgtttgggatgggaattgtgatatcagttaacttcaagcttggtcacagtcaacaatataatttcaagaataacccctgaaagaaaagaaacagcatgtataaaacttccaaatcagtccaaggcaaaactggactcaaaatattaacaaataaaaaaagaagtggccaggaaaagaaagaagttcagggcaaatgaaaaaagcacagtcgagttcaggcataacaaaattccaataagtgtgagtagccaaaatttgccagttaaaagagattgtcaaatagaattttaaaataatccaattatatgatttttagaaataacatataaaacacagagcatgaaagtgaaaatatcaaaacaagatatatcaggcaaacactaaacataaggatgttggggtaacaataatacttaaataaagcttggaaaaaagaatgctagagtagttacattaatgtcagactacagataattttttaaattttatttatttatgttttagagacagagtcttacaccatcacccaagctggagtacagt

SEQ ID NO: 133386 - DNA, 601 bp, Human
gttcagggcaaatgaaaaaagcacagtcgagttcaggcataacaaaattccaataagtgtgagtagccaaaatttgccagttaaaagagattgtcaaatagaattttaaaataatccaattatatgatttttagaaataacatataaaacacagagcatgaaagtgaaaatatcaaaacaagatatatcaggcaaacactaaacataaggatgttggggtaacaataatacttaaataaagcttggaaaaaagaatgctagagtagttacattaatgtcagactacagataattttttaamttttatttatttatgttttagagacagagtcttacaccatcacccaagctggagtacagtggcatgatcatagatcactgcagcctcaaaatcctgggctcaggcaatgcccctgactcagctgcctagctgggactcagacaaaatatgtgtaaggcaaaaaggttaaacttaggcttaattttaaaatagcctcaaaataaataaagcaaaattgataggcctacagggagaaatttgcaaatgctatatatttgctagatgtcagtacattctttcttatttgaaggccaagcatca

SEQ ID NO: 133387 - DNA, 544 bp, Human
caatgtataatattctcaaagacccttagctgcagcaattcatatggtgtcacttgaagatttttctctcttaagatttcaggagaacacaggcagttccaggagacacaggcagttccgtctcaattcacggcaaggtctgcaggagaacacatagactctgttgtacttgagggaagatttttctagcctagcctgaagggaggccacatgttatcccagacccaccttgccaccttagtagacactataaactcatacaactcctagagtgtaacactggaaatgatttgttgtattagttttctattgctacataacaacacctatttattaactcacagttccataggtcagtagtctacacagggatcttcttagaatctcacaagggtaggaatcaaggtgtcagctgggctgagttcttatctggagacactggggaaaaaaatctgtttccaagctcattcttgttggcagaattgggtttcttgtggttataggactaagatccctgtttccgtgatagcttttagccaggggc

SEQ ID NO: 133388 - DNA, 601 bp, Human
agagaacaaaaagaagtaagaccaactcttaggagcatcagagtgtttttattagaagtagcttatgacaattggagaatctgaggcccttggggattgaagagttgcccagtatagtgagttggtggcaaagcgtggatgaaaataacgcagatatccctcacttctgtgcttttctcactataatacggttcttaacaaactgataaaaaatctcctagctgctataagccataaacccttttttgtagaaggtggctgtaactttgacattgactaggtttcagttcggagataggaktgggaagagggctttgacttaaggtatatgctggttctttgtttaatgaatgtcacaagatagttgctttttccacctccggttccattctttttaaatacagagtccctcttttttgtaaaggccttttaattctttaccctcaggagtacagctgttactaagtcatcagattccacggtgaactaattcaaccatcttcttttctaaaatctgtactataggaatgggcattgcagtggggtcctaaatctttcataaattatttagtctctttgtttgttggttgggtttaaaaaa

SEQ ID NO: 133389 - DNA, 601 bp, Human
taggattgggaagagggctttgacttaaggtatatgctggttctttgtttaatgaatgtcacaagatagttgctttttccacctccggttccattctttttaaatacagagtccctcttttttgtaaaggccttttaattctttaccctcaggagtacagctgttactaagtcatcagattccacggtgaactaattcaaccatcttcttttctaaaatctgtactataggaatgggcattgcagtggggtcctaaatctttcataaattatttagtctctttgtttgttggttgggtttaaaaaaaaaaaacatataatcagtttaggagccagtttttttttttttccagtttttcttgaccatcatctgcttaaaagagagggaaggaaatagatgaaaaactcaaatatccattctgaatgtccaattttttaaaaatgtggtcataaagactgaagtttgcagttgccctggctgacaccctctaatttcattcctaaataactgttcctttacattttgaagttttttcattcttgctttctcttaccagaaagtaccattatcatgaatcattttaagggagtattttatagaa

SEQ ID NO: 133390 - DNA, 601 bp, Human
agacaagtttttaaataaaacctctgtattttcttttttaaaatagtgatatactgggcacagtggctcatgcctgtaatcccaactctccaaggccaagatgggaggatcgcttgagcctgggagtttgagaccaacctaggcaacatagcaagaccccatctctacaaaaaatttaaaagattagctgggtgtagtgatgtgtacctgtagtcccagctactggggaggctgagacaagagggttgcttgagcccagggttcaagtgtacagtgagctgtgattgtgccactgtattcmatcctgggcaacagagggagaccctgtctaaaaacataaaatggtaataattgtaatacttactcttaaaactccaaaatgatcctttgactccatgtctcacatccggatcacatggaggcaaaaggtgggttcccatggtcttgggcagctctgtacctgtgactttgcaggggtatagccttcttcctggttgctttcactggctggcattgagtgcctgaagcttttccgggcacttggtgcaagctgttggtggatctgccattatggggtcggaggacagtggccctcttctca

SEQ ID NO: 133391 - DNA, 601 bp, Human
gaggacatgaggtttgggaggagccaggggtggaatgatatggtttggctgtgtccccaccccaatctcatcttcccatgtgttgtgggagggacccagtaggaaataattgaatcaggggggcagatctttcctgtgctgttctcatgatagtgaataagtctcatgagatctgatgggtttaaaaaggagagttcccctgcagaagttctttgcctgctgccatccatgtaagacatgacttgctcctccttgccttctgccatgattgtgaggcctccccagccacttggagctgtargtccattaagcctttctcctgtatgaattacccagtctcgggtatgtctttattagcagtgtgtaaatggactaatacacttacctaatggggttgtggtctgtatatacttagcatggtatctgtcattttgaccctcaataaaggttgttattattttcatcatcaggattatcataatctcatcctattcagatccttttcaggtccttcggcaaccctaaagaactagaaattcctaagcactcctatttgatggtttggaggaagcgttttcatcttttagcagatcttactttt

SEQ ID NO: 133392 - DNA, 601 bp, Human
agcaggcttctgggaaggcaactttcagaaacttcttaggacattggcagaaactctgaggtgagacccctgggtgaattggtatggtttgtttccctagaatctctgctaagagggggagcagtgtttgtcactgaaaaacatgagtgtggtgtaacctaaggagaggcttatcagaagtgctctgagtctagaagagccttctgcttgggatctgaaagcaaagcactggtgtacaagtaaaatatcatgctacagtttgactgtctgctatcccctgccccattgttccacttctttsatcagctctattttctttgagggtattcctggcaacttcacagtcagattcaatgaattaattttattttttaattcagcattgattaattgcccctgtcaaatgaacggtgacatgggccacttaggtttggttcactatttggggtgcctatcctgtactcaaacccagcttatagctgtggaagacaaagacctccacagctatagggtatgctttcaaaaattttgcagtggagttacaagtctgttaacccattaaaatataaaagtactaagaatctctcacattatgtagtat

SEQ ID NO: 133393 - DNA, 601 bp, Human
aaaatattgcacataattctctaggttatcacagtgacccctataaaccttgttaattattatatagattttctagatgagggctctaaaaccaaaagaggagaaagtattcaaccaaggtcatagcaaattaatagtgattggcagactaaaacataaacctatttcttctgcctccacgtgaaagttcattatactataccacagctgcttccatggatatcttgcagtgcacttttaaaaaaaataaataccccaggagttaagtcatatccggttagcatatggtatataattgtgrtacaagtagtaaattctatgatagtccagagaggaatgatcatcatgggctgtaaagaccagggaatgctttgtagagtaggtaagacttgagttgaaccttacatgaatgaaggaactgtcaagaaggtatttagtgcctgttcttttgagtgacagagctttcttgtgcagagggctttgtgcacgttctaggccccgtggtggtcttagtctgtctgttatcatcctaaagaagcatttcattctcttctctgttctgtgctctagggatatttgtggtccagatcagcatcctagt

SEQ ID NO: 133394 - DNA, 601 bp, Human
gtggtggtcttagtctgtctgttatcatcctaaagaagcatttcattctcttctctgttctgtgctctagggatatttgtggtccagatcagcatcctagttcttgtaccaatatcttcatgcaatatttttttccaccaaagtattcctaaggagaagagtgtacgtatgtaacccaatagttgctgcccttcacttgaaatattttgaaatcttgttttgattctaatatgttatatatgatttacattttctccataatatttgtaattatttaatgtaaaagcccttaaaaaaggaggggaaaaaactctgagtaaaagttatgcttcgagaaaattagctatatttacccctccccatttaaaaaattgaggtactattcacaaaatataagattcatcattttaaccattttaaggtgtacaatccggtgccattaagtgcattcacagtgttgtacaatcctcaccactatctaatccagaaatttctcatcgccccaaaaggaaaccctgtgcccattcttcatttccctttccctcaaccctggtaaccactaatctactttctgttttatggattaacttattctaatatt

SEQ ID NO: 133395 - DNA, 601 bp, Human
cacttgttggcaatagacaatagtccatctttttttttttttattgtagctatactagtggtgtgaagtgatatctcattgtggttttgatttgcattcccttaatgacgaatgatgttgagcatctttttatgtgcttcttggctagttggatgtgttctttggagaactatctattcaagtcctttgcccaatttttaattctgtcatcttttattgttgagttgtaagggctgtttatatattctgggtaaataaactgttatgagatatatgatttgcaaatattttctcccattaygtaaattattttcattttcttggtagtgtcccttgatgcccagagtttttactcttgatgaaagccaatttgttttttctttggttacttgtgcttttggtgtatatcttaaaaatcttgcttactctaagatcatgaagatttatctctatgttttcttctaacagttttatagttttatcctttggactttgacccatttgagttaatttttgtgtagtgttataatgttaatggtagaatctaggtggggggttctctgtaaaatcccttcaactctcaacttcaccatatgtttga

SEQ ID NO: 133396 - DNA, 601 bp, Human
taagatcatgaagatttatctctatgttttcttctaacagttttatagttttatcctttggactttgacccatttgagttaatttttgtgtagtgttataatgttaatggtagaatctaggtggggggttctctgtaaaatcccttcaactctcaacttcaccatatgtttgaaatttttcataaaaaaatattgaagggagaaggaaaccaaatttagaaacttattatttagaaatgtactatttcttctttgagcatcccctcttccccaccttctccacagcttcagaagagaaccrtaatgtaggttaaaggcagttgctggacaaggagaacgtagcagtgcactcaccaggctccaagctaacatgagagctttctattaaccacaactcctctgttagcctgtaactttctgttctgtcaccccgaatctttcctccacaatatgcccccaagaaacttgcctttccatccccaatgttatccccagttgctgtttctgttagataaatgccttattaccctgaaatgacttcacctttgtcatttcaaagaatgatctaattttcatctgaacaaaggcatttttgcagaaa

SEQ ID NO: 133397 - DNA, 601 bp, Human
aaacttattatttagaaatgtactatttcttctttgagcatcccctcttccccaccttctccacagcttcagaagagaaccgtaatgtaggttaaaggcagttgctggacaaggagaacgtagcagtgcactcaccaggctccaagctaacatgagagctttctattaaccacaactcctctgttagcctgtaactttctgttctgtcaccccgaatctttcctccacaatatgcccccaagaaacttgcctttccatccccaatgttatccccagttgctgtttctgttagataaatgcmttattaccctgaaatgacttcacctttgtcatttcaaagaatgatctaattttcatctgaacaaaggcatttttgcagaaagaaaactccattgagaatcagcaaacatgtgttctagagtagactcagtcaggtaagtgacttgtgcaaggtcaaataattgataaatggtagaaacagagtttgggtccagaacaccttattccggtttatcattagtactgctctttaggacctaaaggaatgcatggtggagtttcagaaagcaaggatatatttcatcactcagattctgctgca

SEQ ID NO: 133398 - DNA, 601 bp, Human
agacagatttagtccctaattgtaccttaccaatgtacaatccttagaagaaatatcctatcttatttaaatctgttctctaaatcaagtgctggaaattacttcagatatattgctctgaattttgtgcctgtgtaagagctcatcattcattgtttagagaggaaccaggagacagagaactaactctatcccaactcaccctcccaaataacatcaggaactggaaccaacagcattctggatggtatgagtgggaagtgccagaatctgttacataacctgtgaaaaattctgcctyggggttgcagttagagttgtcaagttttaaatcttctcctctgtgtctgctgtctgcttttgcccttctgggaaaggatagagcttcctgccctgaagttagcagcatcttccccatagacaggagtcagccttcctggagcaaatttggaaacagattcccatatcttcctatcttggccctctgtgccacactccacttagtcttgagtctgagttcctactacctggagggtgttagatgatatgacagttacagagatgcatgtgataggcatgttgcactcagaatttagtgagg

SEQ ID NO: 133399 - DNA, 601 bp, Human
gttaatgaactattttacattcttttttcataccaaatcttagaaattgggcacgtgtttcccctcacatctcacatctcatttgcacttgtggttgatgccactgtattggaaagtgcagcctttcacaaactccatttttcctgcttttcagttctggctttctaaccttcattcctgtcctcactatattattttaatagatctgcctatcttctttttctttggtccttagagaagcaggcttcttttctgcctaagtgtcagctatccttccttggttaggttaaaaaaaaaacartaacaactcttctggccactatttgaaatcagctagtgctgcctgaactatgcctttccttccctgtgaacattcagctcttttgaactgagcttcccatctcactttatttatgtgtctgcctcttctgctaaattttgtgctccttgaggacaaggatagtgttttattcatttctgcaatcgtagcaacctaacacagcttttggcccctagtagaaatttgttaaattgttaataagtgaagagagaggcttctcctgaataccttgccagctcctttttcccccctaacagctgt

SEQ ID NO: 133400 - DNA, 601 bp, Human
tttgtggtgccaagaaggatagggagagagcggattcaggcaggtcatggtggcacagatgtttcctgtcccttagccagtctggctgtgtctttcagagaaagccaaatgccatggccaggtgtggttttggggccttccaagcccttggaggtggtagttgtttataaccgcaatttcctcattagcttctgtttttcacaggcctctagccactacctgagggaatacatctcaacctctatcctaggagtcatcaatcattcagagctctttgtggtctggccatgacctacctctrtattttatttcccagtgtctccttcatgtgtcctatattttctcccagaatgctgtgaatttctcccccttccttctcatcttcgcctgttaaaattttacttatctttccagatcaagcttaaatgacaccttcttcaagaagcctttctgaatttccaaccttgcgcaatccccctctgttatagtatcataactttttagtctcatcggccatcattccttgccttatattttaggtacagtaactttacacataccatagtgtttctcactttcatgcctttgcttatgctatttg

SEQ ID NO: 133401 - DNA, 601 bp, Human
tttgtatattaccatgaatacatgtcagaaatataacaccgagtgggaaaaatgcaggtcgtaggcagatagatataaaatagcatcacttatattaagccccaaacaagcaaaacagtactatattcagtctacggatatatacacatgtagtaaaactatataaaaacacatacaggaataatgaatgttaattcagagtagttatccctggggaagggatgtagaggaataggattggggaggaatatgcaagcgatttcaacagtgtatattaatatagaaaaatattaagatcaaktagcaaataaacaagtatgttatattctttaaatatagctgtatgacaaataatgaaattaagtttggagaaatgtatacagctgctgaggatttttcttttttttttgagatggagtctcaccctgtcgcccaggctggagtgcaatggcacaatcttggctcactgcaacctccgcctcccgggttcaagtgattctcctgcctcagcctcccaagtagctgggattacaggcgtgtgccaccatgcttggctaattttttgtatctttttcaccatgttggccagggtggtctcaaa

SEQ ID NO: 133402 - DNA, 601 bp, Human
cacttggaccaggaaaagaggatcaagtctcctttgctaacaaaagcagaatgtgaggagatctcttttatttccttgcagcaatttgctctacgaactgtgtactgatgatgtggtattacaaacagaatcaatgcatcagcaaaatgataaaaataaaactcccttgtgcttctataatactaagctgtttacattttttttttcagacagcatctcactctgttgcccaggctggagtgcagtggtgtgaacatggctcactgcagcctcaacatcccaggctgaagcgatcctcccacctcagctcctaagtagctgggaccacagacactagccaccatgccagactaattttttatttttttgtagagacagaatctcattatgttgcccaggctggtttcgaactcctggactcaagtaatcctcccgcctcagtctccacaagtgctgggattacaggtgtgagctaccacgcccagccaattatttacattctttatgatacttgatctcacaagcgctctgagtggaaatcgggtcctcagtttctacatcctgttatatcacttagggatttctatgtgttgaattccag

SEQ ID NO: 133403 - DNA, 601 bp, Human
ttgatcttgaacttgtcaaatttcccttcttcaggcttctgtttcttcacaagtaaaataagtaaaagatctctaagcaaaattttccctctcagaaggctgagggaatattatcttgttaatttttcatattatcatgtgaataaaatgtataaatacttcagtaattgttgacttatacctaaaatagaacattaaggtggaagatggtcccatcatacgttggaaaaaacatgtatttgtctatatttataaatgcctgaccagcattaaaagaatgaattcattttgttgaaatgcyctccatttcaaagaactcacgcaggaaagttttttttaacccagtggtttttacataaaaagaggaggaaaaaaacccctgaaatgtgtggctgtggtgcacttgatactttacattctcatttactcattcaacaaacattagagcactaacatgtaccaggcattgtaacagagctgggcatgagattgatacagtggctaccaccacaaggtcgctattctcatggagcttacattttggttgggcagatggataataagtagttgaaaaaatttcaaaatagaaataacgaagaat

SEQ ID NO: 133404 - DNA, 601 bp, Human
tgccctcaccaggaactgaatctgctggcaccttgatctggactttctagcctccagatctgtgagaaataaatgttgtttaagccagccagtctatggcattttgatatagcagcccaagtgtgtgtgtgtgtgtgtacatatatatatgtgtgtgtgagtatacataggtatatgtgtgtctgtacatatatacacagagagatgtgtatgcatctctgtgtgcgtgtgtgtgtgtgtgtgcatgtgtgtgtgttataaagaattggctttcacagttatgaggctgagaagtcccaaratctgcagtgggcaaatgggaaacccaggagagctaatgatagttccagtccaagtctgaaggtctgagaactgggagagccaatggtataagtttcaatctgagtccaaaggcaggagaaaagctatgtccttgcttgaagacagggagaaagagcaaattctcctgtactccacatttttgttctaatcagaccttcagtgggttaaatgatgtccatcctcagtggggagggcaatctgcttgactcagtctactcattcaaatgttaatctcatccagcaacaccctcacaaacac

SEQ ID NO: 133405 - DNA, 601 bp, Human
gtgtgattcgtgaccgtacagtggaggtagacctgcagtattcaagatgctaggagccttacatatctggcataaaataaagccaaatcttcaaaattatatttgcctgctcttcaaagcaaacttgataactgacccactttgctccaatatcaaatcagcctgatttaattttataagtcagtcatggaaagaaaatctgtcccatgactccaaagcattctgttctgtagctccactataattacagacaaatgcatctaatcttcccgtcatgtgttctcctgagttacaggattctttttttttttcctgtatttgataatcttgttatcttgtgatactgcatcatttaattattccccaaaatagagatcttcagaaaatctattcagaaaaagtgatttgctgttcccaactgaaatcacagctgggatgtttacacagaaattagttattttcagatctttgggattgctgcttttcttaagagatctcatctgccacataaggctgttgaagcctcccacagatcacctgatgaaatttcataaactccagagaaggcattcacagaggtcttcaagcctaggactctgta

SEQ ID NO: 133406 - DNA, 601 bp, Human
ccacataaggctgttgaagcctcccacagatcacctgatgaaatttcataaactccagagaaggcattcacagaggtcttcaagcctaggactctgtattagattgagcctggttgctctctctgatttttttctttttctttttcttttttttcctttcttttctttttcttttttttctttttttttctttttttttttgagacagggtttcaccatgttggccaggctgcactcgaactcctgggctcaagtgatcctccagcctcagcctcccaggtagtttggactgcaggcacaygccatagcactcagctgtcctctgatattaaccttcagatatctagctgtgttcagtaactctataaacatttcatgtgtcaaacagtaggacaggctttggtaacacaaaatgagtagagcagagtcctcacctaaggaagtatatggtctctaaacttgatcatcaaaagagttggaatttaatttgactagctctgccaccttctaactgctacctttaagcaagtcagttaattcatctgagcctcatttttctataaaaccagtaacattaagatgacattcttgtaagaggcat

SEQ ID NO: 133407 - DNA, 601 bp, Human
actaagtcacagctctgtgaaggatttggaaatttatggatataatgattatatttgtacaggcctagagcatataatcaaacaataagacataatcagtatttaaaatcaaaaattttctgaaaaatccaagactcacatatggatcatccctgctctgaagcattgttacataatctagtggtctgaggcgtaggtgggggagcagtgtctgattattagacaaccgactttgaaaggtggtatcagatgatgatgctgtgagccaaatatcatgagcagacaataaatgtgatgaaakttcagaaaaggaagaagccatgttggctgtagtcatattaaaatagcataaatgtttgctgctttttgctaacagtgcttcatatttgcataaatttcagcatttccaaaactttcatgtcatctgatttcattaaatcttcacaaccacctgtgagccaaacattattaaatgaggtaaaatacataaaacacttagaatagtgcctagtacatcacaggtgttcactattaagatcaccattagccctattttataaatgacacaactaagactcagagacgcattatttgcccaaag

SEQ ID NO: 133408 - DNA, 601 bp, Human
aggatttggaaatttatggatataatgattatatttgtacaggcctagagcatataatcaaacaataagacataatcagtatttaaaatcaaaaattttctgaaaaatccaagactcacatatggatcatccctgctctgaagcattgttacataatctagtggtctgaggcgtaggtgggggagcagtgtctgattattagacaaccgactttgaaaggtggtatcagatgatgatgctgtgagccaaatatcatgagcagacaataaatgtgatgaaatttcagaaaaggaagaagccrtgttggctgtagtcatattaaaatagcataaatgtttgctgctttttgctaacagtgcttcatatttgcataaatttcagcatttccaaaactttcatgtcatctgatttcattaaatcttcacaaccacctgtgagccaaacattattaaatgaggtaaaatacataaaacacttagaatagtgcctagtacatcacaggtgttcactattaagatcaccattagccctattttataaatgacacaactaagactcagagacgcattatttgcccaaagtcacacagctgaaaagtggt

SEQ ID NO: 133409 - DNA, 601 bp, Human
gggaaaaaagaacattttactttttgttttatccttttatataattttaaagatagattgattgattggtttaaccacatgatatactatttttaaaaaatttaagcctccctaaggtcatacaaccaggaaagggtacagctagaattcacaccccagattgtgattccagagcccatcctctggattctagcacactgccctgtactagtgttctcttagtatcaggaaagacttctatcatttgctagcaagttacacaatttttcatgaaaatacctagaatcaaaatgtccaagakcctggagctgcaagaatgtgctcattctccagaagagggctctgtgccccatctgccggccatcttggctccttttctataaggttgtggctcagccaagacaggtcagtgaccctgggccaggaaacacacactaagatttccaacaggacaaattaccttaaggaaaaggcattaggatagctagagaggtgggggtggagggaaggcatgaaaacagttcattagccaacttggtcaatgggcaggtgcaggaagtggcagataaacccagccagagtctataaatatatttcaata

SEQ ID NO: 133410 - DNA, 601 bp, Human
tcgctgagctgtgaatgttgatcagggtcctggaaacaagctggtgtgaagcttaataagaaattggggcagaggtggggggtggacttaagtggtccagctccaggatggctgagtgcctcagaggagcaatttgagggtggccagggacttggataggacaaatgacaacttcctagaacggggtgttccagaacccatagagaaaaggaaacagcctggcctcgtcccgggtagttgacaggaaccagggtaggaagtatttgtagtgggactaatgctcacatcattaagtcccttrtgagtggaagaaggaaaatgggaataaatgcaatgcggcacacacagggcaagtccgtttttgtagtggtgtgagcagagatggagagaatagatcaccagggggagacagtgcctgcagtgtgaagggcagtggtctcagagtgccacagacttagatgtgaatactggctctgccactaacttgctatagggccttgaatacaccattttcaattctgaatcttggtttccttgtctctgaaatgaagccctttctctgtatcttatacgttgttaggactaaatgagatgttcttga

SEQ ID NO: 133411 - DNA, 601 bp, Human
tgaggttcctctagatctgtgacaaactgggaagatactatgtactgtgtaactcaccttgacccattttcttgactgctcagaaatgtgggctaagttttgtgttcaaatgcaatggcttccctcagtcttttcccgctaccttctattttggtctaattaatttcctctcattcattgattgttctttaatccttattttgttggttatatttttaaattactaattgcctcaggtcctctttgtatgggtatgaagaagtaaagtgataataacagtttctttaaaaactaaaaatcsaagggtggataccaaatagaaaaccatagtaaaacgaaggatcaaggaaaataaggaaactgcagagatgtataaagctgatctagcctttatgaagaataaaactggggaaattcctatttctagatgcgttttatagccaaaagaccagagatgttataacaaaacctgataatgaagggatgttttggattattttatagatgggtaaattgaggttaaaagagaggaaatggtttgtcttgtggtgatctcatagcagaatgtggatcagaacccaggtctcttgaccctcattct

SEQ ID NO: 133412 - DNA, 601 bp, Human
agtttctttaaaaactaaaaatccaagggtggataccaaatagaaaaccatagtaaaacgaaggatcaaggaaaataaggaaactgcagagatgtataaagctgatctagcctttatgaagaataaaactggggaaattcctatttctagatgcgttttatagccaaaagaccagagatgttataacaaaacctgataatgaagggatgttttggattattttatagatgggtaaattgaggttaaaagagaggaaatggtttgtcttgtggtgatctcatagcagaatgtggatcagaayccaggtctcttgaccctcattctggagatctgtctgctgtggtcctcttctttgtaatagtaaatgtctgactttaaatacttgcacaaaactaatttgtgtgggtttattcttttctccagggccaagtgctttcggggcaaaaaagtccttggagattatgatatcaaggtggaacaggtaatcagcctgaagcccagagctgcatccccgtcatcacagtttcctcttgacatgccagagtgaaccatctcgttctgctgagtggaatactgtgtccatcattgggttctggactct

SEQ ID NO: 133413 - DNA, 601 bp, Human
tcaggttttcagacatcagtcttgttccaagaagagtcttcacctcactctcttctccacctcaatctacagtaacctgacaggcttccagtgtccaacaggaactggattggtgacaggaaaggccagactggaggtgtctgggacctaacaacaggaaatacgagcttgtccattctgaagatcaagaaagaagacagaaaaagagatgtccatccgggtggggagtgagcttaggtagcccctacaagagaaaatggatgggctcctccagctgtaggtagagagggtaatggggatrcatgaacgcaagcaggtggtgacagagaggcccaaaagcagggcaagaataaaggcaggcccttctgggtaccagggtaggaactcaggggctggccacagtgtacagctcaattcctgtaactggggtgcaggattggagttgtatttcaggcatacagctggtgccagcttcccagaactgggacacaagaaggtcagagcagctctaacagatgccatatttctgtttgtttgtttaatagattgaggggattcatgtacagatttgttacacgaattatgtacattatgtaatggt

SEQ ID NO: 133414 - DNA, 601 bp, Human
agtttggggttctagtgttccatcgccaaaataatgagcatcatatccaataggtaatttttcagccctcatccccctctcatcctcccctcttttggagtctccagtgtctattgtttccatctttatgtctatgtgtacccattatttggctcccacttataagtgacaaatgcagtatttgattttctgtttctgagttacttcagttaggataatggcctccagctccatctttgttgctgcaaaagacatgattttatttttttaatgactgcgttgtattccatggtgtatgctrtatatattttcttcatccagtcatccactgatggatacttaggttgattccatgactttgctactctgagtagtgctgcaataaacatatgagtacgggtgtcttttaatatgatgatttattttcctttgagtagatactcagtaatggtattgctgggtcatatggtagttctacttttagttctttgagaaatctttatattgttttctgtagaagttgtactaatttacattcccaccaacgatgtaaaagcttaagtcctcgagtggccaaggaaggctccttcaaccctcactt

SEQ ID NO: 133415 - DNA, 601 bp, Human
agttttccaggacttgctttgagctccaactcgaaagccacaaggagcttcaggctcttatacagcctcatgaagtcaaggaaaaatatttttcacttaagatgtgagagtctaaaagtgtttcttccctcctaagggtatttgtaccttagaaaaaggtagtgcttagcccagaggagagaggaaatgtcagaattctgttcctcaaatctcctttggaaagtaccataatattggccaggcgtggtggctcgcacctgtaatcccagcactttgggaggccaaggcgggcagatcactkgaggccaggagttcaagaccagcttgtccaacatggcgaacatggcaaaaccccatctctactaaaactacaaaaaattatctgagcatattggtgtgtgcctgtaattccagctacttaggaggctgaggcacaagaatctcttgaacctgggaggcggaggttgcaatgagctgagatcgcgccactgcactctagcctgggcaacggagcaagacttgtctcaaaaaaacaaaaaatacaaaaaccaaacaaacaaaaaaggagagtaccataatatcccatttcccagtccagaaa

SEQ ID NO: 133416 - DNA, 601 bp, Human
ttcccccaagtaaaagggtaggattcaggccctacatctcccaggtccctagcagggactcaagatgcagtaggccccagccccaggagggtccctacatcttccaggcccctaggagggtcctcaagatgcagttggccccagctaagaggatgtgagaggagcttcccctgggacatgggggagggctggccatcagaatagcacagcatcacctgtcacaggctcagcacctttgctgcggagtggacctttggcctcacaacaaagtcgcacaaagataccgtgaagaagcccttayaggtctgtaggctctgcccttggccataggctgcaatgataaaaatgtctgtttcttgcctcctagaatgattaaacttttggaaaggcctgagcccagtgacaaccaagggaatagtccaactcaggtagtgacagagtcctaccaagtggttcagcaacctgaaaatgaaatttatcctcatgcatgtgaatcaaatacttatgagctagaagtgtcttggagatcatcaaagcctaaccctaattctgaccttaacctttcatgatagagatatgaaaattaaagaaggaaagtaag

SEQ ID NO: 133417 - DNA, 601 bp, Human
gaaagtaaggtgtagaaaactacttactataggatgccagtttctgagatttttctgttaatttcatttaatcctcaccttacaaggaagatatcattattgtcactttttacagagaaacaaaacccaaaaaggattaagtaacttgccaaagttacagtgccaggatttctctacatcccactgcctctcccatagattgaggctcctatataaggaggaaactgttctggttttctcttccttggccaatttggaaatctaggagggcagtggaaacttttaggcagatagaaaaagyggggctaggagggagagtgacttatgatggctttgggggcactctggcttcccctccgaccactgaggggacccagctcctctgctggctctgctacttcaggctggccctctcagaaggtaacacctacccctaatcacatcctcattggcttgcagtatgcaggcctcccctgcatcaactcactggaatccatttataacttctgtgacaagccatgggtggaaagtgaggcccccttcccccaggtaaaaggctaggatccagaccctgcatcttccaggcccctaggagggactt

SEQ ID NO: 133418 - DNA, 601 bp, Human
tttggaaatctaggagggcagtggaaacttttaggcagatagaaaaagtggggctaggagggagagtgacttatgatggctttgggggcactctggcttcccctccgaccactgaggggacccagctcctctgctggctctgctacttcaggctggccctctcagaaggtaacacctacccctaatcacatcctcattggcttgcagtatgcaggcctcccctgcatcaactcactggaatccatttataacttctgtgacaagccatgggtggaaagtgaggcccccttcccccaggtaraaggctaggatccagaccctgcatcttccaggcccctaggagggacttctggaccccaagatgcagtaagcccttcttgttttgtaaaaatgaaatttcagctgtcacacgccctggattgccaaggttcctggcacttgtgtctaattgtgaagtttccacacctttacaccactcagagagctgaagaggggtgtgtgtgtgtgtgtatgtgtgtgtgtatgtgtgtgtgttaaccaaacagatctgtcacttctgatcttgatcttttttttcaccctggaactaacagctttcttt

SEQ ID NO: 133419 - DNA, 601 bp, Human
tatgatggctttgggggcactctggcttcccctccgaccactgaggggacccagctcctctgctggctctgctacttcaggctggccctctcagaaggtaacacctacccctaatcacatcctcattggcttgcagtatgcaggcctcccctgcatcaactcactggaatccatttataacttctgtgacaagccatgggtggaaagtgaggcccccttcccccaggtaaaaggctaggatccagaccctgcatcttccaggcccctaggagggacttctggaccccaagatgcagtaagmccttcttgttttgtaaaaatgaaatttcagctgtcacacgccctggattgccaaggttcctggcacttgtgtctaattgtgaagtttccacacctttacaccactcagagagctgaagaggggtgtgtgtgtgtgtgtatgtgtgtgtgtatgtgtgtgtgttaaccaaacagatctgtcacttctgatcttgatcttttttttcaccctggaactaacagctttctttttccttttgaagccagggagagcttggagtgtaagaaaaagatcaatggacaagtagtcaggagggctggg

SEQ ID NO: 133420 - DNA, 601 bp, Human
tgatcctgctattagcagctttttctgggtgatttcactgcttatcaactctctgaccgaacctgtgccccagtttcttcatctacaaactgggaataatagtagcacctgccaccactttgacagcctggttgttacaggctcctagtatatgggttctcttaaagaaatttgtggccagacgtggtggctcacgcctgtaatcccagcactttgggaggctgaggcaggcacatcacgaggtcaggagatcaagaccatcctaactaacacagagaaacccgtctctactaaaaatacaaaaaaaattagccgggtgtggtggcaggtgcctgtagtcccagcaacttaggaggctgaggcgggagaatggcgtgaacccgggaggcggagcttgcaatgagccaagatcgcaccactgtactccagcctgggcgacagagcgagactctgtctcaaaaaaaaaaaagaaatgtgttccctgttttcttttcctaaactgtgccagaggccagggcaggaagaatggggagagcctgtggctagggctttgctcctcccgggatctgggatctggtgaggggtcacactctcacccatt

SEQ ID NO: 133421 - DNA, 601 bp, Human
gtttctcatatgtaggcaaagggtccagtaagttcagtccctcgttaggtagtaagtcccagaaagactgggcctgtctatcccacataccatgaccattctaatcttcctgaagaacagcttcattttatgatgcctcctgctcaaattcttggtgattccatactgcttactggaaaaatccatcattcctttgcctgacgtttgaacttccaagacttggcccatgtcacctatccagcttcatgccttgcgatcactcagagatgcaggtgtggaaagtcagagacccaatttttgrtcccagcttcaccttgcagttctgtgactataggcaagttttgtaacctctctgggccccatatgtaaaatgaatatgataaaatactagttcatcaatttgatttgaaacatcattacaattgagaaaggtaattgaattttagctcactctctttcccttccccaactaatgcgtatcatatccttggaaataggaattgtacacttcttttatatcctcacaatgcttagcataaagtcctccacagagcaaatgctcaataaatatttgatgagttgatgtttcatctgtttcaga

SEQ ID NO: 133422 - DNA, 601 bp, Human
gatgcctcctgctcaaattcttggtgattccatactgcttactggaaaaatccatcattcctttgcctgacgtttgaacttccaagacttggcccatgtcacctatccagcttcatgccttgcgatcactcagagatgcaggtgtggaaagtcagagacccaatttttgatcccagcttcaccttgcagttctgtgactataggcaagttttgtaacctctctgggccccatatgtaaaatgaatatgataaaatactagttcatcaatttgatttgaaacatcattacaattgagaaagstaattgaattttagctcactctctttcccttccccaactaatgcgtatcatatccttggaaataggaattgtacacttcttttatatcctcacaatgcttagcataaagtcctccacagagcaaatgctcaataaatatttgatgagttgatgtttcatctgtttcagaagttatctaagataagctgtaacatttgcttttcttttgcagtttgcccagctggtcgctatctataagacactgggaggagaaaagttccctctcattgaacagacatactaccccaaccacaaagagat

SEQ ID NO: 133423 - DNA, 601 bp, Human; identical to SEQ ID NO: 133283

SEQ ID NO: 133424 - DNA, 601 bp, Human; identical to SEQ ID NO: 133282

SEQ ID NO: 133425 - DNA, 601 bp, Human; identical to SEQ ID NO: 133281

SEQ ID NO: 133426 - DNA, 601 bp, Human; identical to SEQ ID NO: 133280

SEQ ID NO: 133427 - DNA, 601 bp, Human; identical to SEQ ID NO: 133279

SEQ ID NO: 133428 - DNA, 601 bp, Human; identical to SEQ ID NO: 133278

SEQ ID NO: 133429 - DNA, 601 bp, Human; identical to SEQ ID NO: 133277

SEQ ID NO: 133430 - DNA, 601 bp, Human
gaagcgatctggaagcagaggggaagcactgggagaggggatggtgtcaagggcagaaagacggaaagagccacaaagacaaatgcatgaggacagaaaaactgagggctgtgattcaggcagaaagaacaagagtgaggagaggcacagacagaaagagtgagacaggcagagtcccagagaggcagacagaattacaacaggcaaaagagacagtgacagagaaggacggaccccttgctgagctgcacgctgggaatgagacgagctactcagggcttctttcagctgcaggaagtgytttcaatgccctatttatgaggctccaaagcaacagcaaacagtaatagaacaggacagagaaagttggggtgtgtgtgtcttggctctgttgcctggggggtggggagagatgtcaaagaagcagccagtgctttagaaaccctttctcactcccagagcctcagactctccagatagctggagacagcgctcttggtgtacaaaacacaaagtgtcccatcacttagggcaaaccttggacctcaaagccctctcgaggccctagactacattgatttttattgcatgtcccttctca

SEQ ID NO: 133431 - DNA, 601 bp, Human
ccctagactacattgatttttattgcatgtcccttctcactggagactctgtcatgttctagaaggtgggacagcttagaaaacaaagaagcaggctgggcgtggtggctcacgcctgtaatctcagcactttgggaagccaaggcgggttgatcacctgaggtcaggagttcgagatcaccctagccatcatgatgaaactccgtccctactaaaaatacaaaagttagccgggcgtggtggcctacacctgtagtcccaggtactcaggaggctgaggcaagagaatggcttgaacccmggaggcggaggttgaagtgagctgagactgtgccactgcactccagtctgggcgacagagtgagactccgtctcaaaaaaaaaaaaaaaaaaaaaaaagtaaaagaaaaaacaaagaagcaggggacttgggggtgactgtgaccagagccttgtctgctgtttgggcacagtgttgcaagcctccaaatcccaaatctccatgggattattgctgtgggatgtttccacatggtgctggactggatagtgggaggctgggttccaattctgactgtcactgtagctttgtgacttttgc

SEQ ID NO: 133432 - DNA, 601 bp, Human
agcctttcattgactccaagtatgacatccgggtccagaagattggcaacaactacaaggcttacatgtgagtaagagtggggtatgttttctcctcagtgatgatggaaaagctgagcctccacattgcagccaactctcagataacagagagggtgccacttaagtcagagatttttttacctgggttccttttaagtcagaggaggggtctgtggactaagatgagaaaatatattaatattcattttcacttgcctctaagggaaatttagctttctcttcattttgaacagagacracagactacattagttacctgtacataggagtttgtcactaaaggtgattactgattttcttagatcttagatcttatagttgagacacatatctctatggattattctcattcctactttaaaataatggtacttgttaggcttgccactacctcctgttacttagaaacacatattttactaatcacagatttgtttaatatttttgataactctaattgggtagctctgggatcccatgtactctatcttatacagttacacatcttatatattgtgttcattggaaggaatccata

SEQ ID NO: 133433 - DNA, 601 bp, Human
caacaactacaaggcttacatgtgagtaagagtggggtatgttttctcctcagtgatgatggaaaagctgagcctccacattgcagccaactctcagataacagagagggtgccacttaagtcagagatttttttacctgggttccttttaagtcagaggaggggtctgtggactaagatgagaaaatatattaatattcattttcacttgcctctaagggaaatttagctttctcttcattttgaacagagacgacagactacattagttacctgtacataggagtttgtcactaaaggkgattactgattttcttagatcttagatcttatagttgagacacatatctctatggattattctcattcctactttaaaataatggtacttgttaggcttgccactacctcctgttacttagaaacacatattttactaatcacagatttgtttaatatttttgataactctaattgggtagctctgggatcccatgtactctatcttatacagttacacatcttatatattgtgttcattggaaggaatccataggcttccccagactgccacagcacaaagttaaaaagttcctggtat

SEQ ID NO: 133434 - DNA, 601 bp, Human
cgcataaaatgcaggtggcttataattccaattttggaaatattaatcccccacttaaagtttacagtgggccaggcgcggtggctcatgcctgtaatcccagcactttgggaggccgaggcgggcggatcacgaggtcaggagatcaagaccatcctggctaacatggtgaaaccccatctctactaaaaaatacaaagaaattagccagacgtggtggtgggcgcctctagtcccagctactcaggaggctgaggcaggagaatggcatgaacccggaaggcagagcttgcaatgagcygagatcgcgccactgcactccagcctgggcgacagtgcaagactctgtctcaaaaaaaaaaaaaaaaaagagaaaaagtttacagtggtgttttctttacaaagaaagaacattattaatatatagatttgatcttggtcactcaggacttcagcagacttcaaggttgagcagccttccctttctcttccccacctgtgtctgtttttcttctcttacccccccttttcactacttacactccccaccccttgagtgagttaggccccctccctgcactcctgtcccataccacccttc

SEQ ID NO: 133435 - DNA, 601 bp, Human
ggccgaggcgggcggatcacgaggtcaggagatcaagaccatcctggctaacatggtgaaaccccatctctactaaaaaatacaaagaaattagccagacgtggtggtgggcgcctctagtcccagctactcaggaggctgaggcaggagaatggcatgaacccggaaggcagagcttgcaatgagccgagatcgcgccactgcactccagcctgggcgacagtgcaagactctgtctcaaaaaaaaaaaaaaaaaagagaaaaagtttacagtggtgttttctttacaaagaaagaacattattaatatatagatttgatcttggtcactcaggacttcagcagacttcaaggttgagcagccttccctttctcttccccacctgtgtctgtttttcttctcttacccccccttttcactacttacactccccaccccttgagtgagttaggccccctccctgcactcctgtcccataccacccttcacacacctcttggttagcacttgccacacatgtgttttgtgtcaccctcctcctccagactctgagttccttgtgaacaagaatgatggaatcatctctgcatctccattacc

SEQ ID NO: 133436 - DNA, 601 bp, Human
cagtaggcaataatgtgggtcagctgtggaggtcatatgatttttgggtctagagaatggcctctcagtgtcccctttgctcccacatgccccaggtagcctgtatggatctatgccctgcatcccattgttagagaatggtgtgaagtgttggggagctttgcaaactttaaagtgccatgaaaatgtaaggatgatgttattttccactcaaaaaggattttaacctataaatcaacagggttatataatattttttctaatatcttaaatattgaaaaagtcatagaggtcatagagkttatgggactggcttgaaaccaattatatgaggttcagtttcttcctttttttcttttctttttttttttttttttttttgagacagagtctcgctctgccaccaggctggaatgcagtggtgcaatctcagctcactgcaacctccgcctccctggttcaagcaattcccctctctcagcctcctgagtagctgggactacaggcacccaccaccatgcctggctaattttttgtattttagtagagacgaggtttcaccatgttgaccaggatggtctcgatctcccgacctcgtgat

SEQ ID NO: 133437 - DNA, 601 bp, Human
tcagtgtcccctttgctcccacatgccccaggtagcctgtatggatctatgccctgcatcccattgttagagaatggtgtgaagtgttggggagctttgcaaactttaaagtgccatgaaaatgtaaggatgatgttattttccactcaaaaaggattttaacctataaatcaacagggttatataatattttttctaatatcttaaatattgaaaaagtcatagaggtcatagaggttatgggactggcttgaaaccaattatatgaggttcagtttcttcctttttttcttttcttttyttttttttttttttttgagacagagtctcgctctgccaccaggctggaatgcagtggtgcaatctcagctcactgcaacctccgcctccctggttcaagcaattcccctctctcagcctcctgagtagctgggactacaggcacccaccaccatgcctggctaattttttgtattttagtagagacgaggtttcaccatgttgaccaggatggtctcgatctcccgacctcgtgatccacctgccttggcctcccaaagtgctgggattacaggcgtgagcctccggccctaacttcccg

SEQ ID NO: 133438 - DNA, 601 bp, Human
tcgacagtgtaagcaggactcttctgtcccctaggctatctccttcctcttgactgtgtctggatgaaggctgataattaaaaagacatattttgggtgtttatagttaatttaaacctgtatcaattggtctttctgacagccctgtgttaacagataacaggctcagaggggtgaaatgactctctgaaggtcacccagcccatcaagagcaaatccagaaccagaaaccaagtaatccacctcctatttagtctaagactagttgacaccaacacatattcatggatggagggtgccrtgggcacagcagagaagaagctgatggcttgatgccatcggctccatttgacagacaaggcaacttaaccctgaagagttaattgacttccccagagtcacattgctaatattatagtggccttcagaagttaataatgaatgagtgagtgagccagtaaagaagatattggaagatattcataaagaaccctgcgggagtttcaggattgatggaattcagtttgtatgtatcaagtcagtatagatactgaatgggtaggcgtctgggaacacaagacacgatatgtaccttcaagtg

SEQ ID NO: 133439 - DNA, 601 bp, Human
tctaagcttaagactcagatcaaataactaaaataaaaagtagatttaagattgaaaatcaggcagaagcaaagtcctgtagaagttctaaggacagtgaaaggtcatccggttgagagatcagggcaggctctgtggagccagagctgtctgggcaagacccttgtagagaggaggagggcattgcaggtggggatttggcagaggcacccaggctctaggctcagcagacagacccctgggctacttgtgggagaagcaggtgtggaaagcaacagtgagctaaaattctggaaagttkcatgccctcctcttgctggtgtggctcactgcctgtcctatcctggtgggatcttgttgcaggaggacatcgatctcagggaactggaagacgaacactggctctgcgatgctggagcagattgccatgtcagacaggtgagttgagagaaggagtccagtttccagcccagtgagagggaggcttccttagatgaagaagtttaggaattaagctctgtccaaagggagtcatggagcaaaccggacagataaaacacaaaaggcccaagtagcccatttagcaagatcaggcaggact

SEQ ID NO: 133440 - DNA, 601 bp, Human
gctcactgcctgtcctatcctggtgggatcttgttgcaggaggacatcgatctcagggaactggaagacgaacactggctctgcgatgctggagcagattgccatgtcagacaggtgagttgagagaaggagtccagtttccagcccagtgagagggaggcttccttagatgaagaagtttaggaattaagctctgtccaaagggagtcatggagcaaaccggacagataaaacacaaaaggcccaagtagcccatttagcaagatcaggcaggactgatgatagagaaagatgatagagwtaaagactgcacataccataggtaaaagcttcctgaggcctcaccagaagcagatgctggcaccatgctttttgtacagtctgcagaaccatgagccaaaataaaccttttttttttttataattacctagcctcaagtattcctttatagcaacacaaaacagactaatcaaggagtgaggtgttgctataaagatagttgaaaatgtggaattggctttggaactgggtaagaggcagaggttagaagagtttgaagggctcagaagaagacaggaagccaagggaaagttcagaact

SEQ ID NO: 133441 - DNA, 601 bp, Human
gagcgaattgccccagcttcaggacaccttcccatcacctccaggtacaaactgtgggtggacacctgctctgagatgtttggcggcctggacatctgtgctgtcaaagctgtacatggcaaagatgggaaagactacatttttgaggtaagtctggaccaagcagtaagaggtaactcctaaggcttaagaactatgtgggcagctcagactgcctttaatttggagtctcctgaaccatggaaatgttccagcaagatcagtgggtagctattgtttctaacctgctaggctgacccaygccatgggtaaaagatgttgaatacgggttgatgggatcctagccattcctctgggaagactgtggtgatgttaccattctctgtctcagaaagccacccttgggagtcattctgtccaacctgctcattttacaggtgaggaaactgaggcctaacaccatgagcatgtgcccaagaccacagggtgaatcagtgtctcagctgggcaccagatgcaggagattcttcttagtgtctctctgagccttggagacactactcagcctggtcctctaacacaactttgctgactccctttt

SEQ ID NO: 133442 - DNA, 601 bp, Human
ggacaccttcccatcacctccaggtacaaactgtgggtggacacctgctctgagatgtttggcggcctggacatctgtgctgtcaaagctgtacatggcaaagatgggaaagactacatttttgaggtaagtctggaccaagcagtaagaggtaactcctaaggcttaagaactatgtgggcagctcagactgcctttaatttggagtctcctgaaccatggaaatgttccagcaagatcagtgggtagctattgtttctaacctgctaggctgacccacgccatgggtaaaagatgttgratacgggttgatgggatcctagccattcctctgggaagactgtggtgatgttaccattctctgtctcagaaagccacccttgggagtcattctgtccaacctgctcattttacaggtgaggaaactgaggcctaacaccatgagcatgtgcccaagaccacagggtgaatcagtgtctcagctgggcaccagatgcaggagattcttcttagtgtctctctgagccttggagacactactcagcctggtcctctaacacaactttgctgactcccttttacctgttgtaaaggaaagcca

SEQ ID NO: 133443 - DNA, 601 bp, Human
caaaactaagccaaaggaagatgtgtagagcagaatttgggagggtttcaaacacaaaacttcgattagttaggactcatgactcattcccctcctggctttgatatgtgacaatatgcatagaggattaacaacgaggaaagctcctctgagcttcagtgttcacagtttttattggggcttcatgatgtaggcatgactggttgatcacctggttgaactcagcctctggcttctccctccttggaggtcagaataataccatgtggcctgaggggcccactgtgagtgacaaagacastcctatcactccagaaactccaagagtgtagtggttacttctgaggagccaaagatgaaggccagaattctcttagggaaaagccaaattctttactatacacatgattaagttaatatagtaaatgtttctcaaatactttcagcccatgtgggcaaggactgtgccttattgatctgcatttccattgactaacatggaaatgcagagtgtgtgcttaaaattagttaatagccttaggacttaaagttgctgtccaaaagatttatattctaaattgaaataatgattgaattcaca

SEQ ID NO: 133444 - DNA, 601 bp, Human
gtgagccgagatcgtaccactgcacctgggtgacagagcaggactgtgtctcaaaaagaaaaagtcatctccatgtcactgagtccagtggtcacttttgttcttatcttacagacttttcagtagcatttgacacagctgactactccctcctctaaacactattttctaggcccctgaggcccccccgcccatcgcttggttttcattctacatcattggcttccccttcttggcctcctttgctgattcttccacttctgctgagtgtctaaacatcagtgccccagaacttggtcarcgtacatttgttggtggtcttggccagcctgtatctatctcctgccctgaccaccccttcaaactccagactcacatttctaactcttgcttgacatccttacttgcatatcttaaaggcaccctaaatataacacagccaaagcagaactctagtttttccccttagtcctgtccccccaacattgtttttccctagcaatttatgtaggcccctacctgcctctttcccttgtactatcctaactgttgctcactgtgccctagccacactggtaagggcctttgtattaggctgtgc

SEQ ID NO: 133445 - DNA, 601 bp, Human
gagtaaaagttaaaggaattgcagttgaatagcagacatctcaatgagtgcattaattaatatctttagctctctgatgccgccatggagtagaactgattccaaaaggcaaatctgttagcagacaggttttgacccagtgtagggagtaaactctctaacactcagaaacggcatgcggctgccacattgttgctgatgttcaagcaggagcaggatgagcagcttgtaaggcacatggtgaaaggggagggctggggactggggctgttggagcaggtaacttataaaatctccttcyaagcctgacatgctgagatccagactgtgtgcagccatgggacctggaaaaggctgtgatgagaattcagaattgaaggactgaggctgaataacctctggtgtctggtgggacattctaccagtccttttttgtactggttctctggtatgaagagaaacagaacacatttccagctaggtttttccagccacaaaggctctgaaacaagcttgtctaacctgcagcccaggatggctttgaatgcgtcccaacacaaattcataaacttccttaaaacattatgagatattttgcaat

SEQ ID NO: 133446 - DNA, 601 bp, Human
caagtggtggacctaccaacctggaggagtcttgagcttcaccagctctctccttcctccctggcttctctgatcactaagcccagtagattcagcgtagcaggataccagcccaattagctttgatggaagcggcacactctccttgccaagctcctgaaagcctatacctgcaagacatctctgcacaggtccaataaccctagggtcttgctgagtttaagactctgtagctggtccaggctggtctggaactctgtagctaagaagggattgtctcagttctcacacaccggaagawctgaaagaaaaaaaaaaaaaaaaaaaaaagcataaacgaattcatggaagcctagagccagaagggcctgtagaagtcatgtgcctgcagctacatgagcccccctaaccaaagtttgtccaagcactgctgaaatacctctcatgccaggaagctcactactacccaagccagcccttgacactattcagatttatatttgactaatttcaatcttctactaagccctaggtgcttccatggttacctcatttataccatttgggaaactgtgactcaggataagtaacttgcccaaag

SEQ ID NO: 133447 - DNA, 601 bp, Human
taccatttgggaaactgtgactcaggataagtaacttgcccaaagtcacatgtgtaaagttgtcatttcgagacttctaaccatcctatttgctccatgtacccatgtttttctgctagcatcacccttaagaggtggccagaactggttgcagtgctctctcatgaggcttgatcagccaaaagaacagtggtcctatcacttccccttgtcaagacatagacatacctccagctgcatccaatttttggcagcatcattacagactgacaccctttgagcctgtcgtcactctgtaaayccaaggttggttggggtttattatttatttatatatttttttgagacggggtctcactctgttgcctaggctggaatgcagtggcgtgatcctggctcactgcagcatccacctcccaggctcaagctatcctcttgccacagccctctgggtagctgggactataagcacatgccaccatgcccacctaatttttgtattttttgtagagacagcgtttcatcatgttatccaggctggtctcaaactcctgggctcaagtgatccacgcacctcggcctcccacagtgttgggattac

SEQ ID NO: 133448 - DNA, 601 bp, Human
ttatttatatatttttttgagacggggtctcactctgttgcctaggctggaatgcagtggcgtgatcctggctcactgcagcatccacctcccaggctcaagctatcctcttgccacagccctctgggtagctgggactataagcacatgccaccatgcccacctaatttttgtattttttgtagagacagcgtttcatcatgttatccaggctggtctcaaactcctgggctcaagtgatccacgcacctcggcctcccacagtgttgggattacaggcgtgagccgcacccagctgggtttttttttttttatgctactataaggtcatttattccccttccgttttgtgtacagctaggcacaagcactgcacttcacattcttacctgtttgaatcaatccaacttcctgaggaaagctctgcctctcagtctggccatgagttcctgctgtgggctggctccaggccagcctttggcagtgacgccagagtggccagacttctgtggaattcggcatcccaggatgctctgggtgactggaaacagatcccatggtagccaagccccacagggaataggcccggagcccctagtag

SEQ ID NO: 133449 - DNA, 601 bp, Human
gatttaaaacgttttcttggaatcatagtttcactggattggaaggaaccttagcattcatccagtcaatctcatgtttaaaaaaggaatattatctatgatgtctttgtcaggtcattcactacccactatgtgaacacatacgtctacctcccaaaacagcctatctcactatttttacaaaagaaagttctacttgtaggtgaaagtctgcccagagcttttgtgcccactggccctggttctgctcttatgccacatagtcttctgtaaccctctctgggaataccaattctctggraggagaacatcgtaagctgctcttggccaacatttgagatgatgcattgggacccttcagtggtactgggcatgaggccctgggggagagaccagcgagagccagtccggtagcttcacaaactgggactttttctgtccttcacctaagtatctgtctctgaccatgagaggctgtggtgttgaaggcatgggccagactagagaatgaacagtagaggatcaggcctggactgagcagctgtttatgacataaaggagggagaaggctagaaagggcaagcccagccatgctgaagca

SEQ ID NO: 133450 - DNA, 601 bp, Human
gatggagtggtttccagctggcttcccgggtatgggtattgcagtgtcaggctcagactgtgccttatggatcccaagaaggtccccagaggaagggaaaggaagtagtgttctcactgtgacttgtgggggttgagggttatggtagaatgggcactctgatgtggtggcactgaggacatttcaaaggcccccctcccagctgctctcccaaatcctctcagtagaacagttccgagtaatgaggttaaaagactgtgatactgagaaggtaacacttcctggcagtggagctgaaaayaggccataatgggcagggagataaatggccagaatgggatgtccaagggaaatggggagcaggaggagaagcagctttatgtgggagtagggctgaggggcacatcaagaggggagaggagcactgatggtgaagcgagtgctcactgaggacatgcttgtttttagccaccgccttgccttggaagcccctcattgacatcaccgttggcacacttggcagactttaggcttcacagaacatttcccttgtgctgaactcagactccaaacgttcactgcctctaatacaagcattaga

SEQ ID NO: 133451 - DNA, 601 bp, Human
cgttggcacacttggcagactttaggcttcacagaacatttcccttgtgctgaactcagactccaaacgttcactgcctctaatacaagcattagacaaactaagtcgcacaggtctttaatcccgtcagggcataatcagaatcacggctgggagagggagcatgggatcggagccatgctgttgggttaagtgtagtcatgctgtttgggagggaaaagcagcctggccttgagcgctgttacaaacattaatgtcttactctttccctctaaggtaaggagggttctgagaaacaaaygacgacccctttctttaagtccctccctttgggagttcccagccgagtccaaagagtggatctgatctcctgagtcaggcctagaactgatcccactccggagttaactccagatgagaagtgagccaagcctaggctagtcactaggtccggctgggcgcaggcatgcgcacacatacactcctcccctgccctcctgctcacctgcccctagagccacctatagtccaaccctgtctctggggtttggcgttggccctccctttcctttagacagccaggcctgtacgtagaagtggg

SEQ ID NO: 133452 - DNA, 601 bp, Human
atgctgactggactgtgtttttcctatgcagtgtcagctcctctgtctggttgtttacctgttcctgttcgtgcttgtaatgctcacttatgttttctctgtataacttgtgattccagggctgtttgtcaacagtatacaaaagaattgtgcctctcccaagtccagtgtgactttatcttctgggtggtttgatagtgtttttaaaagtaatatataatgtggggtgaaatgggagtaggggggtggacaggggagaaacgaaaaccacaaaaagaaaacccaactcctctcctccccscaagctcagttaaatcccccacctccaactttccctccaccagtgtgcttgggatcttcaatgaactgtgcttttcgctttctttctgcatgactattgtaactagatagaacattaagagattttcaagatcaaacttccatagcttcatccactgaatttgaaggcatccacctttttctccatttgctaaaatttggtgcagtttgagtttatgtgaataggctggctgtgcctgtagagctcttgtgtttttagtgatgacatgaaatacaaagaacaagctatttccaggaatgt

SEQ ID NO: 133453 - DNA, 601 bp, Human; identical to SEQ ID NO: 19522

SEQ ID NO: 133454 - DNA, 601 bp, Human; identical to SEQ ID NO: 19523

SEQ ID NO: 133455 - DNA, 601 bp, Human
tcattccccagatgtgcgggtcagagaggtatgtctaccgttctgttgactggctcttattgtcacttctggcagaggtgacagggcagtgaaagagataaggtcctttccctttcggaactcattatatctttatttctttttctttctcactgcaaatgaccccactgaggttagagacattttaatcagtcagtcaatagagacagaaatgtgtggttaggagcatagatgccgcagccagactgcatgtgttcaaatcctgactctgacagacactggctgtgtgcccgaagactgytaacttaacttctttgagctttagtttcttccatctataagatggacggagtaatatgtatatcttagagttttggtgaggattaagtgagacagatttaaacacgtaggaggctgcctgacacaaattatggtcattattactggcaaactccatgcctagctttaaaaaaatgcacaatcaaaacaatttttaaattataggtttctgaaatgcagggggtagaaattcttttgaagtggaaattaaattttttgttttgaaactgattatgttccaattcaaatatttattgagtcc

SEQ ID NO: 133456 - DNA, 601 bp, Human
ccagatgtgcgggtcagagaggtatgtctaccgttctgttgactggctcttattgtcacttctggcagaggtgacagggcagtgaaagagataaggtcctttccctttcggaactcattatatctttatttctttttctttctcactgcaaatgaccccactgaggttagagacattttaatcagtcagtcaatagagacagaaatgtgtggttaggagcatagatgccgcagccagactgcatgtgttcaaatcctgactctgacagacactggctgtgtgcccgaagactgctaacttracttctttgagctttagtttcttccatctataagatggacggagtaatatgtatatcttagagttttggtgaggattaagtgagacagatttaaacacgtaggaggctgcctgacacaaattatggtcattattactggcaaactccatgcctagctttaaaaaaatgcacaatcaaaacaatttttaaattataggtttctgaaatgcagggggtagaaattcttttgaagtggaaattaaattttttgttttgaaactgattatgttccaattcaaatatttattgagtcctgttaga

SEQ ID NO: 133457 - DNA, 601 bp, Human
gcagtgaaagagataaggtcctttccctttcggaactcattatatctttatttctttttctttctcactgcaaatgaccccactgaggttagagacattttaatcagtcagtcaatagagacagaaatgtgtggttaggagcatagatgccgcagccagactgcatgtgttcaaatcctgactctgacagacactggctgtgtgcccgaagactgctaacttaacttctttgagctttagtttcttccatctataagatggacggagtaatatgtatatcttagagttttggtgaggattragtgagacagatttaaacacgtaggaggctgcctgacacaaattatggtcattattactggcaaactccatgcctagctttaaaaaaatgcacaatcaaaacaatttttaaattataggtttctgaaatgcagggggtagaaattcttttgaagtggaaattaaattttttgttttgaaactgattatgttccaattcaaatatttattgagtcctgttagataatcaattgcagataataggttaaatataaccctacacaaagataaaaaaaaatgttattcctaaagtgcaagaact

SEQ ID NO: 133458 - DNA, 601 bp, Human
ttaaaaaaatgcacaatcaaaacaatttttaaattataggtttctgaaatgcagggggtagaaattcttttgaagtggaaattaaattttttgttttgaaactgattatgttccaattcaaatatttattgagtcctgttagataatcaattgcagataataggttaaatataaccctacacaaagataaaaaaaaatgttattcctaaagtgcaagaactcatgcccaactcacttataaatgcaactgccacctattttattccactttcactagggctcccagctggtggacgggccygctctgtcattgctaactctgaacccccagcctacaccagccccagtatcccctgctgagtcactgatttttattctgaaagccattttgatatcgatgcaagcttccattctaaaagatgcttcatatctaaatagcaggccattctctgtccccctccctcttctagctgttttgcaccctaaattgtatccacctgggaaagaaggtcctttatctaaggcagtgcttctgaagccttaatgtgcgtaagaatcacctagagaactttaatattaaagtgcagattctgaatcattc

SEQ ID NO: 133459 - DNA, 601 bp, Human
acaatcaaaacaatttttaaattataggtttctgaaatgcagggggtagaaattcttttgaagtggaaattaaattttttgttttgaaactgattatgttccaattcaaatatttattgagtcctgttagataatcaattgcagataataggttaaatataaccctacacaaagataaaaaaaaatgttattcctaaagtgcaagaactcatgcccaactcacttataaatgcaactgccacctattttattccactttcactagggctcccagctggtggacgggcctgctctgtcattsctaactctgaacccccagcctacaccagccccagtatcccctgctgagtcactgatttttattctgaaagccattttgatatcgatgcaagcttccattctaaaagatgcttcatatctaaatagcaggccattctctgtccccctccctcttctagctgttttgcaccctaaattgtatccacctgggaaagaaggtcctttatctaaggcagtgcttctgaagccttaatgtgcgtaagaatcacctagagaactttaatattaaagtgcagattctgaatcattccaggaaagactg

SEQ ID NO: 133460 - DNA, 601 bp, Human
tattgagtcctgttagataatcaattgcagataataggttaaatataaccctacacaaagataaaaaaaaatgttattcctaaagtgcaagaactcatgcccaactcacttataaatgcaactgccacctattttattccactttcactagggctcccagctggtggacgggcctgctctgtcattgctaactctgaacccccagcctacaccagccccagtatcccctgctgagtcactgatttttattctgaaagccattttgatatcgatgcaagcttccattctaaaagatgcttcrtatctaaatagcaggccattctctgtccccctccctcttctagctgttttgcaccctaaattgtatccacctgggaaagaaggtcctttatctaaggcagtgcttctgaagccttaatgtgcgtaagaatcacctagagaactttaatattaaagtgcagattctgaatcattccaggaaagactgagattctgcataaagaactccaagtgcttgcagtgttgctagttagcagacctttttcaggcgtctggttctgatttaattggtcccacctggttgtgaatttgggctctttct

SEQ ID NO: 133461 - DNA, 601 bp, Human
agggctcccagctggtggacgggcctgctctgtcattgctaactctgaacccccagcctacaccagccccagtatcccctgctgagtcactgatttttattctgaaagccattttgatatcgatgcaagcttccattctaaaagatgcttcatatctaaatagcaggccattctctgtccccctccctcttctagctgttttgcaccctaaattgtatccacctgggaaagaaggtcctttatctaaggcagtgcttctgaagccttaatgtgcgtaagaatcacctagagaactttaatattaaagtgcagattctgaatcattccaggaaagactgagattctgcataaagaactccaagtgcttgcagtgttgctagttagcagacctttttcaggcgtctggttctgatttaattggtcccacctggttgtgaatttgggctctttcttctgctaatttgatgcactgggctctgggactgcaggctcttctcgtctgcactcctcacagtcagaatgccttctctcagcccgtccacactgctctggagacttggcctcagttggaaactggcagcctcccatatctcccttgggc

SEQ ID NO: 133462 - DNA, 601 bp, Human
cctccctcttctagctgttttgcaccctaaattgtatccacctgggaaagaaggtcctttatctaaggcagtgcttctgaagccttaatgtgcgtaagaatcacctagagaactttaatattaaagtgcagattctgaatcattccaggaaagactgagattctgcataaagaactccaagtgcttgcagtgttgctagttagcagacctttttcaggcgtctggttctgatttaattggtcccacctggttgtgaatttgggctctttcttctgctaatttgatgcactgggctctgggmctgcaggctcttctcgtctgcactcctcacagtcagaatgccttctctcagcccgtccacactgctctggagacttggcctcagttggaaactggcagcctcccatatctcccttgggctgcacttagctgcagtgggcagtcagggcttgctggtgtgtgggcaagggtcacctatgctaactgtatgctcccctccttcacaatttctttcccaagcctcagctttgacaagagacctcaactcttacaaatcttttttctgctcaagaatttttctctgtctaaagagagtattaga

SEQ ID NO: 133463 - DNA, 601 bp, Human
tattagatgaatatctacagcgcatattagataggaaaaagacatataatgaactagaaatagaatgaagccacatatgtaatgttacatactcaagtagcctcattaaaaataagcgggtgaaattaattttaatacatttcatttaacccaatacatgcaaaatacaattaggacatgtgatcaacataaaaaaattaataagatcctttaacttttttaaactaaatcttcaaaatccaatgtgtattttgtacctaaagcaacccatttctgagtagccacacttcaaatgctcaakagccatatctggctacatgtttgacaacacagttccattatgcttagaagatcagaaaccaagcttttaatttttcttgtatttttttgtttctgtcagtttattgagttctatctagtaagttacaaattgtaagcatacagttctgtgaattttcacagttgcagtcagctgtgtaaccaccaccatgatcatgatacataaagggcatttccctttatgtattcacccttcaaatttccttatgccctttgcagttcaaacttttctcccactcctgggccctggcttccactgatg

SEQ ID NO: 133464 - DNA, 601 bp, Human
gtacaatttacagggccttgtgttgaggcccacacggactatgttttttacatcagtgtacatttacttttgctgggaaaccagccaaagacaagttagagaattctgcctgctccctacgcactgtggcctgttcagaacagcgaggtcacgcctggaaccagggccagagcttcacataggcagtgttagctggctcttctttggtggcccaaacacaactccaggtagacaagcagaacaaatggctcccagtgaaaataactcagtgctggaaacagttttaaaaattttctaaagmgtattctcagtgtgattttaaacaatggtaacgtaatttatcaacaactcttccaagaaaaatagacaataaaggtcatatttctcaatgaagatataaggtctcaactgccttaccggccacctctccttacatatggacccccttaggatcctgctgaagtttaagacaggccctggcaaaatcccatcatcaaataggatctctctcatttccatacttcgaaagcacttggtccatgcctgactttcacagcctttaccactgactgtctttggtcaaagttatgagtttgaggac

SEQ ID NO: 133465 - DNA, 601 bp, Human
tacgcactgtggcctgttcagaacagcgaggtcacgcctggaaccagggccagagcttcacataggcagtgttagctggctcttctttggtggcccaaacacaactccaggtagacaagcagaacaaatggctcccagtgaaaataactcagtgctggaaacagttttaaaaattttctaaagcgtattctcagtgtgattttaaacaatggtaacgtaatttatcaacaactcttccaagaaaaatagacaataaaggtcatatttctcaatgaagatataaggtctcaactgccttacyggccacctctccttacatatggacccccttaggatcctgctgaagtttaagacaggccctggcaaaatcccatcatcaaataggatctctctcatttccatacttcgaaagcacttggtccatgcctgactttcacagcctttaccactgactgtctttggtcaaagttatgagtttgaggacgaagctttgaactagcaccctggaaaggttaggttatgccaattctacaacttacaaggtgcatgattgtgtaaagtcacttaatgtctcttcttattaaagaatggagaatactct

SEQ ID NO: 133466 - DNA, 601 bp, Human
caaaatcccatcatcaaataggatctctctcatttccatacttcgaaagcacttggtccatgcctgactttcacagcctttaccactgactgtctttggtcaaagttatgagtttgaggacgaagctttgaactagcaccctggaaaggttaggttatgccaattctacaacttacaaggtgcatgattgtgtaaagtcacttaatgtctcttcttattaaagaatggagaatactcttatttatgcagagttgtccatgagggataaagaaagcaagagaatgtgatttctaaatcacarctggttacagaatcatgagttgtaaaaatattacctccccaggctgggcgcagtggctcacgcttgtaatcccagcactttgggaggccaaggcaggcagatcacttgaggtcaggagttcgagaccagcctggccaacatggtaaaaccctgtctctactaaaaatacaaaaattagctgggcatggtggcgctcacctgtaatcccagctactcaggaggctgaggcacgagaatcgcttgaacccgggaggcagaggttgcagtgagccgagatagtgccactgccctccagcctgg

SEQ ID NO: 133467 - DNA, 601 bp, Human
agaagtggaagtgttttcacagtcttagagatcagataccagagagtgatgcaaaggtgatggcagagaggtgaaagagctcatggaaaggtcacagatgatcactgtagaggatgagggggttctgaccccctcattcatccaaagttgaggacctatatgtcaggctctatgctagctgccgaagatacaaccatgaacaaaaagtctcagatctcatggagcttacatttcactgcgaggattcaaacaagtaaagatctgtattaagtggtgtaagaagtaaaatagaccgggtgcrgtggctcatgcctgtagtcccaaccctttgggaggccgaggtgggcggatcacgaggtcaggagatcaagaccatcctggctaacacagtgaaacctcatctctactaaaaatacaaaaaaaattagccggacatagtggcaggcacctgtaatcccagctactcgggaggctgaggcaggagaatggcttgaacccaggaggcggagcttgcagtgagtcgagatcacgccactgcactccagcctgggcgacagagcaagaccccctaatgaggtgaatatgtggagagtgattgtat

SEQ ID NO: 133468 - DNA, 601 bp, Human
ccagagagtgatgcaaaggtgatggcagagaggtgaaagagctcatggaaaggtcacagatgatcactgtagaggatgagggggttctgaccccctcattcatccaaagttgaggacctatatgtcaggctctatgctagctgccgaagatacaaccatgaacaaaaagtctcagatctcatggagcttacatttcactgcgaggattcaaacaagtaaagatctgtattaagtggtgtaagaagtaaaatagaccgggtgcagtggctcatgcctgtagtcccaaccctttgggaggccraggtgggcggatcacgaggtcaggagatcaagaccatcctggctaacacagtgaaacctcatctctactaaaaatacaaaaaaaattagccggacatagtggcaggcacctgtaatcccagctactcgggaggctgaggcaggagaatggcttgaacccaggaggcggagcttgcagtgagtcgagatcacgccactgcactccagcctgggcgacagagcaagaccccctaatgaggtgaatatgtggagagtgattgtatggtggctgtgctctaaatagactagtcagagcagaccc

SEQ ID NO: 133469 - DNA, 601 bp, Human
agagtgatgcaaaggtgatggcagagaggtgaaagagctcatggaaaggtcacagatgatcactgtagaggatgagggggttctgaccccctcattcatccaaagttgaggacctatatgtcaggctctatgctagctgccgaagatacaaccatgaacaaaaagtctcagatctcatggagcttacatttcactgcgaggattcaaacaagtaaagatctgtattaagtggtgtaagaagtaaaatagaccgggtgcagtggctcatgcctgtagtcccaaccctttgggaggccgaggygggcggatcacgaggtcaggagatcaagaccatcctggctaacacagtgaaacctcatctctactaaaaatacaaaaaaaattagccggacatagtggcaggcacctgtaatcccagctactcgggaggctgaggcaggagaatggcttgaacccaggaggcggagcttgcagtgagtcgagatcacgccactgcactccagcctgggcgacagagcaagaccccctaatgaggtgaatatgtggagagtgattgtatggtggctgtgctctaaatagactagtcagagcagacccttct

SEQ ID NO: 133470 - DNA, 601 bp, Human
tgatgcaaaggtgatggcagagaggtgaaagagctcatggaaaggtcacagatgatcactgtagaggatgagggggttctgaccccctcattcatccaaagttgaggacctatatgtcaggctctatgctagctgccgaagatacaaccatgaacaaaaagtctcagatctcatggagcttacatttcactgcgaggattcaaacaagtaaagatctgtattaagtggtgtaagaagtaaaatagaccgggtgcagtggctcatgcctgtagtcccaaccctttgggaggccgaggtgggyggatcacgaggtcaggagatcaagaccatcctggctaacacagtgaaacctcatctctactaaaaatacaaaaaaaattagccggacatagtggcaggcacctgtaatcccagctactcgggaggctgaggcaggagaatggcttgaacccaggaggcggagcttgcagtgagtcgagatcacgccactgcactccagcctgggcgacagagcaagaccccctaatgaggtgaatatgtggagagtgattgtatggtggctgtgctctaaatagactagtcagagcagacccttctgata

SEQ ID NO: 133471 - DNA, 601 bp, Human
aggtcacagatgatcactgtagaggatgagggggttctgaccccctcattcatccaaagttgaggacctatatgtcaggctctatgctagctgccgaagatacaaccatgaacaaaaagtctcagatctcatggagcttacatttcactgcgaggattcaaacaagtaaagatctgtattaagtggtgtaagaagtaaaatagaccgggtgcagtggctcatgcctgtagtcccaaccctttgggaggccgaggtgggcggatcacgaggtcaggagatcaagaccatcctggctaacacrgtgaaacctcatctctactaaaaatacaaaaaaaattagccggacatagtggcaggcacctgtaatcccagctactcgggaggctgaggcaggagaatggcttgaacccaggaggcggagcttgcagtgagtcgagatcacgccactgcactccagcctgggcgacagagcaagaccccctaatgaggtgaatatgtggagagtgattgtatggtggctgtgctctaaatagactagtcagagcagacccttctgataagggaataggtaggaagctagtaagtcatgcagatagcagag

SEQ ID NO: 133472 - DNA, 601 bp, Human
agaggatgagggggttctgaccccctcattcatccaaagttgaggacctatatgtcaggctctatgctagctgccgaagatacaaccatgaacaaaaagtctcagatctcatggagcttacatttcactgcgaggattcaaacaagtaaagatctgtattaagtggtgtaagaagtaaaatagaccgggtgcagtggctcatgcctgtagtcccaaccctttgggaggccgaggtgggcggatcacgaggtcaggagatcaagaccatcctggctaacacagtgaaacctcatctctactaaaaatacaaaaaaaattagccggacatagtggcaggcacctgtaatcccagctactcgggaggctgaggcaggagaatggcttgaacccaggaggcggagcttgcagtgagtcgagatcacgccactgcactccagcctgggcgacagagcaagaccccctaatgaggtgaatatgtggagagtgattgtatggtggctgtgctctaaatagactagtcagagcagacccttctgataagggaataggtaggaagctagtaagtcatgcagatagcagagtaaagggtcatctttacatc

SEQ ID NO: 133473 - DNA, 601 bp, Human
agtgtgttttaggtgcttttaacattgaggatatgttttgggtgagaaaaggtcacacagtctccaggtgcggtggctcatgcctgtaattccagcactgtgagaggccaaggcaggagcatcacttaaggtcaggagttcaagaccaccctggctaacatggtgaaactccatctctactaaaaatacaaaaactagccaggtgttgtggcacgtgcctgtaatcccagctactcaggaggctgaggcaggagaattgcttgaacctgggaggcggagattgcagtgagctgagattgtrccactgcattccagcctgggtgacagagtgagtctccatctcaaaaaagaaaaaaaagaaaagatcacacagacagtgactcacacaggcccctcctttccagggcctcagtttgtctctattcaataggagcaagaggaaattatcactgctttaatatggggagaaattggtgccttgtatgagccgggataaagaacgtattggatatgagaatgagaagcccttgttaccccaggtgtctgacctctttatccaggactgggcagtcagtattcccttattctccctcctttctta

SEQ ID NO: 133474 - DNA, 601 bp, Human
atctggagcgtcgatgtcaggggtcaacaatggagctgctgcaggtaaggcttgtgaaggagcccagatctgagagtcaaggaaaagagaaactaactttccttcctttctgggacatcagactaccatcgttgcagggacaagagaaaacattcctttggcgctatagtgcctatcccctattaaactgtttagaggtatggagtaaagcgtaagataattcagagtacaaatgcaagggaaagtcccatttttatttataaagggttgtctaaaagtttatttgatgctgtggagaagwtctgttgtatccagtgatgttgttctttctttctcagtcttggcactatttacatttctggctggataattctttgctgcgtggggttctcctgtacattgtaggatgcttagcagcgtctctggcctctgctcactagatgtcagcagcaccaccccagatgtgacaaccccaaatttcttcagacattgccacgatagccccagggtgaacacagtgctctcccagttgagaaccactgttcattaggcacctctcgtctctgatgctgtgttgggaatttgccaagtgcttcttacc

SEQ ID NO: 133475 - DNA, 601 bp, Human
catttctggctggataattctttgctgcgtggggttctcctgtacattgtaggatgcttagcagcgtctctggcctctgctcactagatgtcagcagcaccaccccagatgtgacaaccccaaatttcttcagacattgccacgatagccccagggtgaacacagtgctctcccagttgagaaccactgttcattaggcacctctcgtctctgatgctgtgttgggaatttgccaagtgcttcttacccagcttagtcacaggcacacttacgccaagctaaattcttagagatgatgtaytaccagcccttctttgttttcactctcttctctagagcagaatcatttaacatactgtagcaattgatatttgaactggttttgggggtctgggctctggtctgtatgtgtgtaggtcgcagattacaaggtatcaagcctagagagatttgatggagggacttgaactgaggttgaaattctagcagctattttctgcatagaatgaatagtgtggttgtgaatttgaggcatgatgtagcttgtgatattctgtaaccttcagagtgtaagatattctttatattttgtttgtcttcg

SEQ ID NO: 133476 - DNA, 601 bp, Human
aagattttatagccaaggccgagcgcggtggctcacgcctgtaatcccagcactttgggaggccgaggcaggcggatcatgaggtcaggagattgagaccatcctggctaacacggtgaaaccccgtctctactaaaaacacaaaaaaattagccgggtgcggtggtgggcgcctgtagtcccagctactcgggaggctgaggcaggagaatggcgcgaacccaggaggcggagcgtgcagtgagccgagatcgcaccactgcactccagcctgggcgacagagcaagactccatctcaamaaaaaaaaatattttatagccaagataaaagcttcaaaatatggacataaagccaacataagagaagtagccacatgaaatagcacatcgatttgatcatttcagttcctcagtacagccacaatgtaagattgatacaatcctggatatttactgcaaattgacacacacagcacctctaccacattctatgttcaagccagtttgagttgtgcctctatgaaatgccaccataaacagccctaatacagagaaaatagttaatcctgtattatgtggaccaaacttaagcttttcttc

SEQ ID NO: 133477 - DNA, 601 bp, Human
cgacagagcaagactccatctcaaaaaaaaaaaatattttatagccaagataaaagcttcaaaatatggacataaagccaacataagagaagtagccacatgaaatagcacatcgatttgatcatttcagttcctcagtacagccacaatgtaagattgatacaatcctggatatttactgcaaattgacacacacagcacctctaccacattctatgttcaagccagtttgagttgtgcctctatgaaatgccaccataaacagccctaatacagagaaaatagttaatcctgtattatrtggaccaaacttaagcttttcttcggggtcattgagatgtatggagcacaagataaaaagaccaaatagaaaggaataggccaattccacagaaatgagactagcagtggcagtgataaaggtgaacaactggtgaccaaatgaaattgaggatgtgaagtggactgacttgggcaaagataggatgccagggtgaatatatggtagttatttcctattttgtttaaatttggtgacttaagtggttgctagtgtgattcagtaggatggaagggagacaagagttgccgaactaagttc

SEQ ID NO: 133478 - DNA, 601 bp, Human
gttgtgcctctatgaaatgccaccataaacagccctaatacagagaaaatagttaatcctgtattatgtggaccaaacttaagcttttcttcggggtcattgagatgtatggagcacaagataaaaagaccaaatagaaaggaataggccaattccacagaaatgagactagcagtggcagtgataaaggtgaacaactggtgaccaaatgaaattgaggatgtgaagtggactgacttgggcaaagataggatgccagggtgaatatatggtagttatttcctattttgtttaaatttgstgacttaagtggttgctagtgtgattcagtaggatggaagggagacaagagttgccgaactaagttcttttaaacatcttgcatttgaggtacctgtgacatatctgctggtgtatatattaatcaaaatcataaggaaagggggctgagcagaagtacagatttgagaatcatcaacatgtgtacattaaaatgaaggaaatggatgaagtcagcaaaggtagggtagaaggttagagaaggtgaagtttgagaaacaaccatatataaagtccatgagcctgtatcttcagcaaccag

SEQ ID NO: 133479 - DNA, 601 bp, Human
tgtatggagcacaagataaaaagaccaaatagaaaggaataggccaattccacagaaatgagactagcagtggcagtgataaaggtgaacaactggtgaccaaatgaaattgaggatgtgaagtggactgacttgggcaaagataggatgccagggtgaatatatggtagttatttcctattttgtttaaatttggtgacttaagtggttgctagtgtgattcagtaggatggaagggagacaagagttgccgaactaagttcttttaaacatcttgcatttgaggtacctgtgacatatytgctggtgtatatattaatcaaaatcataaggaaagggggctgagcagaagtacagatttgagaatcatcaacatgtgtacattaaaatgaaggaaatggatgaagtcagcaaaggtagggtagaaggttagagaaggtgaagtttgagaaacaaccatatataaagtccatgagcctgtatcttcagcaaccagaacaggatgtaagctactcaaggatagaaattatgacttcatcatctgaggttctctaggccaggcacaatgcctgacaaataatacatgctatacatacataac

SEQ ID NO: 133480 - DNA, 601 bp, Human
gtgaatatatggtagttatttcctattttgtttaaatttggtgacttaagtggttgctagtgtgattcagtaggatggaagggagacaagagttgccgaactaagttcttttaaacatcttgcatttgaggtacctgtgacatatctgctggtgtatatattaatcaaaatcataaggaaagggggctgagcagaagtacagatttgagaatcatcaacatgtgtacattaaaatgaaggaaatggatgaagtcagcaaaggtagggtagaaggttagagaaggtgaagtttgagaaacarccatatataaagtccatgagcctgtatcttcagcaaccagaacaggatgtaagctactcaaggatagaaattatgacttcatcatctgaggttctctaggccaggcacaatgcctgacaaataatacatgctatacatacataacattacacacacatatgcacacacacaatgttgtgaaaatcaagacactgatgagtcaattgagttattttttgatgtcttcacatgggttcttagggacagtctgccctgagttttttctctactttgtggcctccacattaggattatctttat

SEQ ID NO: 133481 - DNA, 601 bp, Human
tttaaacatcttgcatttgaggtacctgtgacatatctgctggtgtatatattaatcaaaatcataaggaaagggggctgagcagaagtacagatttgagaatcatcaacatgtgtacattaaaatgaaggaaatggatgaagtcagcaaaggtagggtagaaggttagagaaggtgaagtttgagaaacaaccatatataaagtccatgagcctgtatcttcagcaaccagaacaggatgtaagctactcaaggatagaaattatgacttcatcatctgaggttctctaggccaggcacmatgcctgacaaataatacatgctatacatacataacattacacacacatatgcacacacacaatgttgtgaaaatcaagacactgatgagtcaattgagttattttttgatgtcttcacatgggttcttagggacagtctgccctgagttttttctctactttgtggcctccacattaggattatctttatttgtatcatatcatggggtaggggacatggaaggagaaatgtggataagggcatgacctgttactccttgacttaacctgtctttttccttcctaggatgtgagtgatg

SEQ ID NO: 133482 - DNA, 601 bp, Human
caggcacaatgcctgacaaataatacatgctatacatacataacattacacacacatatgcacacacacaatgttgtgaaaatcaagacactgatgagtcaattgagttattttttgatgtcttcacatgggttcttagggacagtctgccctgagttttttctctactttgtggcctccacattaggattatctttatttgtatcatatcatggggtaggggacatggaaggagaaatgtggataagggcatgacctgttactccttgacttaacctgtctttttccttcctaggatgtragtgatgtcacagaaaggtatgtgtaaggagaacatgaggtagttcccctggactgacaaatgattcctttacccatgatcagtgggaaagggaagaagaatcagagtggggaagattcaagagagtagtcttgaatcgcgcatcacatggagttttggcatccccaaataaaggggatgaactggcctctctggtaggaaaatgtgggtgatgggaggtcagtaggtggggacagtactgttatttagaataaagagttgcagtattgcgccactgcactccagcctgggagacaaagg

SEQ ID NO: 133483 - DNA, 601 bp, Human
actctgtcgcccaggctggagtgcagtggtgtgatctcggctcactgcaccttcctgcccgtgaattttatcagagtgacattcccatctgcattatttctcaaggtctaagaatttggtcttggcacatctgccttaagtttttctttctcccaggccttgctccctagtagattttcttttgtctcaattccagtaaaaacgtaaacccgagctctggaggataataatttagcccgggaatcaaacatgttctctatcacatactccagagtctcatccaacaaggtgacatgtcaarctgcttgcacacttggttcctccatgctcctcacagacacacgaaatgggaaccctatcgtcccttctgaaatctgtactctccgtttggaggtgaggacatcttttctccagctagtggcataacattcccagagacggcaaatcctaaaatgctgttttgaaggttttctgagaaatcccagggcctaagcccacagactcttctgaagaaaccccttcacttgatactttcaaagccccagcaataggcccctggtgttctgcctgtcaacccagacatcttcaacccctctgattt

SEQ ID NO: 133484 - DNA, 601 bp, Human
ataataatttagcccgggaatcaaacatgttctctatcacatactccagagtctcatccaacaaggtgacatgtcaaactgcttgcacacttggttcctccatgctcctcacagacacacgaaatgggaaccctatcgtcccttctgaaatctgtactctccgtttggaggtgaggacatcttttctccagctagtggcataacattcccagagacggcaaatcctaaaatgctgttttgaaggttttctgagaaatcccagggcctaagcccacagactcttctgaagaaaccccttcayttgatactttcaaagccccagcaataggcccctggtgttctgcctgtcaacccagacatcttcaacccctctgattttaaatattttatatctttttttagaggtagcaaaagatttccaagccattattttactgaactgcataacatctctaggacacagaaaaaggaaaattatagtattttctaaaaacaacaacagaaaaacaaaatgagactttaagaagttaaatcttggacaggcgcagtgactcacacctgtaatcccagcactttgggaggctgaggagggcagatcacg

SEQ ID NO: 133485 - DNA, 601 bp, Human
aaaatgagactttaagaagttaaatcttggacaggcgcagtgactcacacctgtaatcccagcactttgggaggctgaggagggcagatcacgaggtcaggagatcaaaaccatcctggctaacatgatgaaaccctatctctactaaatatacaagaaaattagccaggcgtggtggcacgcgcctgtagtcccagctactcagaaggctgaggcaggagaatcgcttgaacctgggaggtggaggttgcagtgagccgagatcgtgccactgcactccagcctgggtgacagagcgagmctccttctcaaaaaaaaaagttaaatcttacacaagtttatgtagatggtgagatgatagtttctagtctagctcttctggctccagtgccagggctgtttgcagaatgatgctaagtgtattcagaaaggaggattggaattcatcagtaggcttgggaggtaagggagatgggtggtggaggaacccacagtcagcagtgtgggaactcagaagtcctgtcctttctaggagtgagttctggaccctgaggaagccagaagctctccctacaaagctgagaagtatgttccgagcccc

SEQ ID NO: 133486 - DNA, 601 bp, Human
gtttatgtagatggtgagatgatagtttctagtctagctcttctggctccagtgccagggctgtttgcagaatgatgctaagtgtattcagaaaggaggattggaattcatcagtaggcttgggaggtaagggagatgggtggtggaggaacccacagtcagcagtgtgggaactcagaagtcctgtcctttctaggagtgagttctggaccctgaggaagccagaagctctccctacaaagctgagaagtatgttccgagccccagatctgaaaaggatgctgcgagtgtgtagaggtamggagattcaggggaaagagtttggatgtgaaattactgtcgtgggaagaaataaacgggatagaggctatagtcggtatttgagcatagtggcaaagagggaggtcccagagggagggacatagtgtgctgaagaagatgcgttttgtatttaaggggagatgaaatggccaggtgacatcctcacaggattcctcaccattcccctcaatgtagtaaggagagagataccagacatgagacagttggtcctattcaacattattgactcttttcatcattacagagctgacagatgtcc

SEQ ID NO: 133487 - DNA, 601 bp, Human
ccagttcctccaaccacttcctgtgtttcctcttctcagcataacgagacccatgtccccgttctcatctgctgatgttgtaccttttcctacagttgacgtgaccctgaatccacacacagctaatttaaatcttgtcctggctaaaaaccggagacaagtgaggtttgtgggagctaaagtatctggaccttcctgtctggaaaagcattatgactgtagtgtcctgggctcccagcacttctcctctggtaagcattactgggaggtagatgtggccaagaagactgcctggatcctrggggtatgcagcaattcactgggacctacattctctttcaaccattttgctcaaaatcacagtgcttactccaggtatcagcctcagagtggatactgggtgattgggttacagcataaccatgaatatagggcctatgaggattcttccccttccctgcttctctccatgacagtgccccctcgccgtgttggggttttcttagattatgaggctggtactgtctccttttataatgtcacaaaccatggcttccccatctacactttctctaaatattactttcccactactctttgt

SEQ ID NO: 133488 - DNA, 601 bp, Human
tcttgaatattcttctgttcccacccacttctgataagtaccctgaggcttatcagcatgtgattctcccttctgatcttctgtttttctgtgttctcaattcttttgttgttttttggtttttgaatcttttttgagatggaatctcgctctgtcgcccaggctggagtgcactggcgcaatctcggctcactgcaacctctgcctcctgggttcaagcgaacctcctgcctcagcatcccaagtagctgggattacaggcacccaccaccatgcccaactaatttttgtatttttataragatagggtttcaccgtgttggccaggctgatctcgaactcctgaccgcaagtgatccacccgcctcggtctcccaaagtgctgggattacagatgtgagccgccgcgcccagacagttctttcgttttaaacagttactcagtactaggatgcacccagtggtgagagtaagcatctttgactgatgacaggtcttgaggtggatagggggcgctttcagtattttgccattaagcatagtatttgatgcaggttttttttgattgatgcaggggatcaaatttaggaagttctgatct

SEQ ID NO: 133489 - DNA, 601 bp, Human
tcccacccacttctgataagtaccctgaggcttatcagcatgtgattctcccttctgatcttctgtttttctgtgttctcaattcttttgttgttttttggtttttgaatcttttttgagatggaatctcgctctgtcgcccaggctggagtgcactggcgcaatctcggctcactgcaacctctgcctcctgggttcaagcgaacctcctgcctcagcatcccaagtagctgggattacaggcacccaccaccatgcccaactaatttttgtatttttatagagatagggtttcaccgtkttggccaggctgatctcgaactcctgaccgcaagtgatccacccgcctcggtctcccaaagtgctgggattacagatgtgagccgccgcgcccagacagttctttcgttttaaacagttactcagtactaggatgcacccagtggtgagagtaagcatctttgactgatgacaggtcttgaggtggatagggggcgctttcagtattttgccattaagcatagtatttgatgcaggttttttttgattgatgcaggggatcaaatttaggaagttctgatctgttaatttactacaagtt

SEQ ID NO: 133490 - DNA, 601 bp, Human
atggcactggctgtcccatatggtatccaggagccaccaatgtctgttgagtacttcatacatgcctagtctgaattgagatgtgctcaatgtataaaatatataccagatttcaaatacctacttcaaaaaataatgtaaaatatctcactaataacttttcctttgtgtattgcaatgataatatgttggctctattggattaaataaagtatgttattcattttacctgtttcattttacttttttaatgtggatactagaaaccttaaaattacatatgtggcttacattgtatttytattggacaactctggagtagatcctataatgaaatttctgtccctaagtgagccctagtgtaaaagcctatggactcaggatacagaggaggtttcaaggcacatatgtttatctctacagaacctgcaccttcccagctgccctgaggcatttttatggaaggtaatgacagagaaaagaagatctcaacatatctagaagtgtagaaatttggaagatcatagaaagggctcatgaccagagaatgattctgcagactctggcccctgccgttagtcctcagtctgttgggcacttg

SEQ ID NO: 133491 - DNA, 601 bp, Human
taaaattatattttttcccaaatctatgaggatgttcatatatctttttgttattggtttataatttaattttaaatggtccagatacagactttatatgacttgaatcctttttaattgtattgagacttgttttacggtaaaggatatgatctatattggtaaatgtttcatttgcacttgaaagaaatgtgtattctgtggtcctggggtacagtgttcaattaacatcatgttagttgatattattcaaatcttctgtatctttactgcttttctatgagagaggggtgttgaaatwtacaactatatttgtggatttgcctatttctcctgcaattctatgagattttgctttctgatttttgaagctcttttgtaaggagcatacacatttaggaatgttacatcctgttgatgaactgacacccctttctcattatggaatgaccctctatctctactaatatctttttctccaaattctactttgttaggtattaatttagccactccagctttcttgttttttgttttttttttgttgttgttgttgtttgtttgtttgagatggagtctcgttctgtcatccaggctggag

SEQ ID NO: 133492 - DNA, 601 bp, Human
ttagttgatattattcaaatcttctgtatctttactgcttttctatgagagaggggtgttgaaatttacaactatatttgtggatttgcctatttctcctgcaattctatgagattttgctttctgatttttgaagctcttttgtaaggagcatacacatttaggaatgttacatcctgttgatgaactgacacccctttctcattatggaatgaccctctatctctactaatatctttttctccaaattctactttgttaggtattaatttagccactccagctttcttgttttttgttktttttttgttgttgttgttgtttgtttgtttgagatggagtctcgttctgtcatccaggctggagtgcagtggcgtgatcttggctaactgcaacctctgcctcctgggtttaagtgattctcctgcctcagcctcccgagtagctgggattacaggcacctgccaccacgtccggctaatattgtatttttagtagagacggggtttcaccatgttggtcatattggtctcgaactcctgacctcaggtgatccacccgcctcggcctcccaaagtgctggaattaccggcgtgagcca

SEQ ID NO: 133493 - DNA, 601 bp, Human
tattattcaaatcttctgtatctttactgcttttctatgagagaggggtgttgaaatttacaactatatttgtggatttgcctatttctcctgcaattctatgagattttgctttctgatttttgaagctcttttgtaaggagcatacacatttaggaatgttacatcctgttgatgaactgacacccctttctcattatggaatgaccctctatctctactaatatctttttctccaaattctactttgttaggtattaatttagccactccagctttcttgttttttgttttttttttkttgttgttgttgtttgtttgtttgagatggagtctcgttctgtcatccaggctggagtgcagtggcgtgatcttggctaactgcaacctctgcctcctgggtttaagtgattctcctgcctcagcctcccgagtagctgggattacaggcacctgccaccacgtccggctaatattgtatttttagtagagacggggtttcaccatgttggtcatattggtctcgaactcctgacctcaggtgatccacccgcctcggcctcccaaagtgctggaattaccggcgtgagccaccgtgccc

SEQ ID NO: 133494 - DNA, 601 bp, Human
atttctcctgcaattctatgagattttgctttctgatttttgaagctcttttgtaaggagcatacacatttaggaatgttacatcctgttgatgaactgacacccctttctcattatggaatgaccctctatctctactaatatctttttctccaaattctactttgttaggtattaatttagccactccagctttcttgttttttgttttttttttgttgttgttgttgtttgtttgtttgagatggagtctcgttctgtcatccaggctggagtgcagtggcgtgatcttggctaactkcaacctctgcctcctgggtttaagtgattctcctgcctcagcctcccgagtagctgggattacaggcacctgccaccacgtccggctaatattgtatttttagtagagacggggtttcaccatgttggtcatattggtctcgaactcctgacctcaggtgatccacccgcctcggcctcccaaagtgctggaattaccggcgtgagccaccgtgcccagcccagctttcttttgattattgttttcataacatatcttttcatttttttttttttttttgagacggagtctcgctctgtc

SEQ ID NO: 133495 - DNA, 601 bp, Human
ttgctttctgatttttgaagctcttttgtaaggagcatacacatttaggaatgttacatcctgttgatgaactgacacccctttctcattatggaatgaccctctatctctactaatatctttttctccaaattctactttgttaggtattaatttagccactccagctttcttgttttttgttttttttttgttgttgttgttgtttgtttgtttgagatggagtctcgttctgtcatccaggctggagtgcagtggcgtgatcttggctaactgcaacctctgcctcctgggtttaagygattctcctgcctcagcctcccgagtagctgggattacaggcacctgccaccacgtccggctaatattgtatttttagtagagacggggtttcaccatgttggtcatattggtctcgaactcctgacctcaggtgatccacccgcctcggcctcccaaagtgctggaattaccggcgtgagccaccgtgcccagcccagctttcttttgattattgttttcataacatatcttttcatttttttttttttttttgagacggagtctcgctctgtctcccaggctggagtgacatggcgca

SEQ ID NO: 133496 - DNA, 601 bp, Human
ggctaactgcaacctctgcctcctgggtttaagtgattctcctgcctcagcctcccgagtagctgggattacaggcacctgccaccacgtccggctaatattgtatttttagtagagacggggtttcaccatgttggtcatattggtctcgaactcctgacctcaggtgatccacccgcctcggcctcccaaagtgctggaattaccggcgtgagccaccgtgcccagcccagctttcttttgattattgttttcataacatatcttttcatttttttttttttttttgagacggagtctygctctgtctcccaggctggagtgacatggcgcagttgagtgacgtggcgcgatctcggctcactgcaagctccgcctcccgggttcacgccattctcctgcctcagcctcccgagtagctgggactacaggcgcccaccaccacgcccggctaatttttttgtatttttagtagaggcggggtttcaccgtgttggccaggatggtctcgatctcctgacctcgtgatccacccgcctcgcctcccaaagtgctgggattacaggcgtgagccaccgcgcccggcctcatctttttactt

SEQ ID NO: 133497 - DNA, 601 bp, Human
cgaactcctgacctcaggtgatccacccgcctcggcctcccaaagtgctggaattaccggcgtgagccaccgtgcccagcccagctttcttttgattattgttttcataacatatcttttcatttttttttttttttttgagacggagtctcgctctgtctcccaggctggagtgacatggcgcagttgagtgacgtggcgcgatctcggctcactgcaagctccgcctcccgggttcacgccattctcctgcctcagcctcccgagtagctgggactacaggcgcccaccaccacgcccrgctaatttttttgtatttttagtagaggcggggtttcaccgtgttggccaggatggtctcgatctcctgacctcgtgatccacccgcctcgcctcccaaagtgctgggattacaggcgtgagccaccgcgcccggcctcatctttttacttttaaactatttgtgtcttcgtactccagcctgggcaacaagagcgaaacgctgtctcaaaaaaaagaaaagtatttaagtggcatgtagttgctctaggtaaataatatagttatcttcatttttcccaacaagttactgcttgagttg

SEQ ID NO: 133498 - DNA, 601 bp, Human
gcctcggcctcccaaagtgctggaattaccggcgtgagccaccgtgcccagcccagctttcttttgattattgttttcataacatatcttttcatttttttttttttttttgagacggagtctcgctctgtctcccaggctggagtgacatggcgcagttgagtgacgtggcgcgatctcggctcactgcaagctccgcctcccgggttcacgccattctcctgcctcagcctcccgagtagctgggactacaggcgcccaccaccacgcccggctaatttttttgtatttttagtagagrcggggtttcaccgtgttggccaggatggtctcgatctcctgacctcgtgatccacccgcctcgcctcccaaagtgctgggattacaggcgtgagccaccgcgcccggcctcatctttttacttttaaactatttgtgtcttcgtactccagcctgggcaacaagagcgaaacgctgtctcaaaaaaaagaaaagtatttaagtggcatgtagttgctctaggtaaataatatagttatcttcatttttcccaacaagttactgcttgagttggcattttaacttagttttaattaaaatt

SEQ ID NO: 133499 - DNA, 601 bp, Human
ttgattattgttttcataacatatcttttcatttttttttttttttttgagacggagtctcgctctgtctcccaggctggagtgacatggcgcagttgagtgacgtggcgcgatctcggctcactgcaagctccgcctcccgggttcacgccattctcctgcctcagcctcccgagtagctgggactacaggcgcccaccaccacgcccggctaatttttttgtatttttagtagaggcggggtttcaccgtgttggccaggatggtctcgatctcctgacctcgtgatccacccgcctcgcctcccaaagtgctgggattacaggcgtgagccaccgcgcccggcctcatctttttacttttaaactatttgtgtcttcgtactccagcctgggcaacaagagcgaaacgctgtctcaaaaaaaagaaaagtatttaagtggcatgtagttgctctaggtaaataatatagttatcttcatttttcccaacaagttactgcttgagttggcattttaacttagttttaattaaaatttaaatattttgctactttatattttgtcagaaatgatcttgattccatgggactctcagtttt

SEQ ID NO: 133500 - DNA, 601 bp, Human
ttttgagacggagtctcgctctgtctcccaggctggagtgacatggcgcagttgagtgacgtggcgcgatctcggctcactgcaagctccgcctcccgggttcacgccattctcctgcctcagcctcccgagtagctgggactacaggcgcccaccaccacgcccggctaatttttttgtatttttagtagaggcggggtttcaccgtgttggccaggatggtctcgatctcctgacctcgtgatccacccgcctcgcctcccaaagtgctgggattacaggcgtgagccaccgcgcccgrcctcatctttttacttttaaactatttgtgtcttcgtactccagcctgggcaacaagagcgaaacgctgtctcaaaaaaaagaaaagtatttaagtggcatgtagttgctctaggtaaataatatagttatcttcatttttcccaacaagttactgcttgagttggcattttaacttagttttaattaaaatttaaatattttgctactttatattttgtcagaaatgatcttgattccatgggactctcagttttttaaacatttgctgtataactgctttgtgcatacagtctagccc

SEQ ID NO: 133501 - DNA, 601 bp, Human
cgatctcggctcactgcaagctccgcctcccgggttcacgccattctcctgcctcagcctcccgagtagctgggactacaggcgcccaccaccacgcccggctaatttttttgtatttttagtagaggcggggtttcaccgtgttggccaggatggtctcgatctcctgacctcgtgatccacccgcctcgcctcccaaagtgctgggattacaggcgtgagccaccgcgcccggcctcatctttttacttttaaactatttgtgtcttcgtactccagcctgggcaacaagagcgaaacrctgtctcaaaaaaaagaaaagtatttaagtggcatgtagttgctctaggtaaataatatagttatcttcatttttcccaacaagttactgcttgagttggcattttaacttagttttaattaaaatttaaatattttgctactttatattttgtcagaaatgatcttgattccatgggactctcagttttttaaacatttgctgtataactgctttgtgcatacagtctagcccttgccttcacagagactcagtcagttaggggataaaacaaaggcatattctgtgcaaggtttattt

SEQ ID NO: 133502 - DNA, 601 bp, Human
cttttagaagataaatttggggttttagggttccaagatttgaaacattacatttgattggtgaagggctagttctcaggttctcatggggttgatgtttgaggccgagaataaccttttttttttttttccttgagatggagtctccctcctgttgcccatgctggagtgcagtggcacgatctcggctcactgcaacctctgcctcctgggttcaagcgattctcctgcctcagcctcccaagtacctgggatgaaaggtgcctgccaccttcggctaatttttgtatttttagtagakacagtgtttcactatgttggccaggctgatctcaaactctcagcctcaggtgatccacctgcctcggcctctcaaagtgctgggattacaggcataagccaccacgcccagcttttttttttttttttaaataaatgcaagcttaggtacaggctcttgtcaaataaggaatcaacaaagaaataaaatattgattcatttttatccatcttgaaaacatactagtatttgaagggcaaataattaaaatatgaaaaacaattagggaaatggagtctattttggaatctttgaaaaagc

SEQ ID NO: 133503 - DNA, 601 bp, Human
aatttggggttttagggttccaagatttgaaacattacatttgattggtgaagggctagttctcaggttctcatggggttgatgtttgaggccgagaataaccttttttttttttttccttgagatggagtctccctcctgttgcccatgctggagtgcagtggcacgatctcggctcactgcaacctctgcctcctgggttcaagcgattctcctgcctcagcctcccaagtacctgggatgaaaggtgcctgccaccttcggctaatttttgtatttttagtagagacagtgtttcacyatgttggccaggctgatctcaaactctcagcctcaggtgatccacctgcctcggcctctcaaagtgctgggattacaggcataagccaccacgcccagcttttttttttttttttaaataaatgcaagcttaggtacaggctcttgtcaaataaggaatcaacaaagaaataaaatattgattcatttttatccatcttgaaaacatactagtatttgaagggcaaataattaaaatatgaaaaacaattagggaaatggagtctattttggaatctttgaaaaagcagaggagaaatgt

SEQ ID NO: 133504 - DNA, 601 bp, Human
accttttttttttttttccttgagatggagtctccctcctgttgcccatgctggagtgcagtggcacgatctcggctcactgcaacctctgcctcctgggttcaagcgattctcctgcctcagcctcccaagtacctgggatgaaaggtgcctgccaccttcggctaatttttgtatttttagtagagacagtgtttcactatgttggccaggctgatctcaaactctcagcctcaggtgatccacctgcctcggcctctcaaagtgctgggattacaggcataagccaccacgcccagcttttttttttttttttaaataaatgcaagcttaggtacaggctcttgtcaaataaggaatcaacaaagaaataaaatattgattcatttttatccatcttgaaaacatactagtatttgaagggcaaataattaaaatatgaaaaacaattagggaaatggagtctattttggaatctttgaaaaagcagaggagaaatgttaggagagaaatcaagatagaactgcaagtttaaggcattattgcctatctcagctaagcattggcctttatttcaagagatcgaaggaaaccctcacat

SEQ ID NO: 133505 - DNA, 601 bp, Human
gattctcctgcctcagcctcccaagtacctgggatgaaaggtgcctgccaccttcggctaatttttgtatttttagtagagacagtgtttcactatgttggccaggctgatctcaaactctcagcctcaggtgatccacctgcctcggcctctcaaagtgctgggattacaggcataagccaccacgcccagcttttttttttttttttaaataaatgcaagcttaggtacaggctcttgtcaaataaggaatcaacaaagaaataaaatattgattcatttttatccatcttgaaaacayactagtatttgaagggcaaataattaaaatatgaaaaacaattagggaaatggagtctattttggaatctttgaaaaagcagaggagaaatgttaggagagaaatcaagatagaactgcaagtttaaggcattattgcctatctcagctaagcattggcctttatttcaagagatcgaaggaaaccctcacatttttgaactgaaagtcaacacatacatttgaatcacacacatttccacctgaccactgagggtacttgtatgaagacagcaactgagttttctatatcgcttcctct

SEQ ID NO: 133506 - DNA, 601 bp, Human
cctcccaagtacctgggatgaaaggtgcctgccaccttcggctaatttttgtatttttagtagagacagtgtttcactatgttggccaggctgatctcaaactctcagcctcaggtgatccacctgcctcggcctctcaaagtgctgggattacaggcataagccaccacgcccagcttttttttttttttttaaataaatgcaagcttaggtacaggctcttgtcaaataaggaatcaacaaagaaataaaatattgattcatttttatccatcttgaaaacatactagtatttgaaggrcaaataattaaaatatgaaaaacaattagggaaatggagtctattttggaatctttgaaaaagcagaggagaaatgttaggagagaaatcaagatagaactgcaagtttaaggcattattgcctatctcagctaagcattggcctttatttcaagagatcgaaggaaaccctcacatttttgaactgaaagtcaacacatacatttgaatcacacacatttccacctgaccactgagggtacttgtatgaagacagcaactgagttttctatatcgcttcctctgtgtcaatcacgtttc

SEQ ID NO: 133507 - DNA, 601 bp, Human
aagatagaactgcaagtttaaggcattattgcctatctcagctaagcattggcctttatttcaagagatcgaaggaaaccctcacatttttgaactgaaagtcaacacatacatttgaatcacacacatttccacctgaccactgagggtacttgtatgaagacagcaactgagttttctatatcgcttcctctgtgtcaatcacgtttctatacattatatatatggactcaatctttttttttttttttttttcaggcagagttttgctcttgttgcccaggctggagtgcaatggcaygatctcggctcactgcaaccttcgcctcccaggttcaagcgattcaccagcctcggcctcccgagtagctgggattacaggcatcaaccaccacgcctgtctaatttttgtgttttttagtagagacggggtttcgccatgttagccaggctggtctcaaactcctgacctcaggtgatccacctgcctcagcctcccaaagtgctggaattacaggcttgggccaccgcgcatggcctgggctcaatctttatagtggtcctatgaaaataggtactgtcattatcctttttttaaaaa

SEQ ID NO: 133508 - DNA, 601 bp, Human
gctaagcattggcctttatttcaagagatcgaaggaaaccctcacatttttgaactgaaagtcaacacatacatttgaatcacacacatttccacctgaccactgagggtacttgtatgaagacagcaactgagttttctatatcgcttcctctgtgtcaatcacgtttctatacattatatatatggactcaatctttttttttttttttttttcaggcagagttttgctcttgttgcccaggctggagtgcaatggcacgatctcggctcactgcaaccttcgcctcccaggttcaagygattcaccagcctcggcctcccgagtagctgggattacaggcatcaaccaccacgcctgtctaatttttgtgttttttagtagagacggggtttcgccatgttagccaggctggtctcaaactcctgacctcaggtgatccacctgcctcagcctcccaaagtgctggaattacaggcttgggccaccgcgcatggcctgggctcaatctttatagtggtcctatgaaaataggtactgtcattatcctttttttaaaaaaaatgagaaaatggaggtacagtgagatgaaagaatttgc

SEQ ID NO: 133509 - DNA, 601 bp, Human
atatggactcaatctttttttttttttttttttcaggcagagttttgctcttgttgcccaggctggagtgcaatggcacgatctcggctcactgcaaccttcgcctcccaggttcaagcgattcaccagcctcggcctcccgagtagctgggattacaggcatcaaccaccacgcctgtctaatttttgtgttttttagtagagacggggtttcgccatgttagccaggctggtctcaaactcctgacctcaggtgatccacctgcctcagcctcccaaagtgctggaattacaggcttgrgccaccgcgcatggcctgggctcaatctttatagtggtcctatgaaaataggtactgtcattatcctttttttaaaaaaaatgagaaaatggaggtacagtgagatgaaagaatttgctcaaagttggacacatatgaagtggcagaattgacctacaaaacagggcagcaaaattcagaggcaacatttttattcatttctgtctgttagaaatctgaaaaggtcagtgtgtgagtcaaatcctactttgatacctatttttgtaaatgtactttattggaatatcaccatgcttattt

SEQ ID NO: 133510 - DNA, 601 bp, Human
ctgggcaacagagtgagactccatctcaaaaacaaacaaacaaacaaacaaatagtcaaagtaatgtataatgctcaaaatgtaatcttaggcctaatgaaggaatagactcctatattactcataaatgatataagtaatattaaacttggggtctagcttacgtgaccaagataatgatgaaaactttaagttgaaagcttatgttgaaaaacaaaataaaatcatttcatatgcaaattttaacaccacagtcaggaatgtcaatggatatacagggtaaaagaagagagaaaattarcctagatgataaactgtatacattgcatattgattaatctactataaaacaatggcacaagtacatgattgttttgattcttgaaccttgattgattatagatagcatcaaatgtagtatactctgggggagaaaagattggactatgagaggaaattctattttaagctttgtacaattataagacataaggaggacacaaatctcattaagggcagatttgggagagaaacagtgacaaagctaaaaccgtgacttatttgggaaacatcagtgtagcatgataaggacaagccattt

SEQ ID NO: 133511 - DNA, 601 bp, Human
tggggtctagcttacgtgaccaagataatgatgaaaactttaagttgaaagcttatgttgaaaaacaaaataaaatcatttcatatgcaaattttaacaccacagtcaggaatgtcaatggatatacagggtaaaagaagagagaaaattaacctagatgataaactgtatacattgcatattgattaatctactataaaacaatggcacaagtacatgattgttttgattcttgaaccttgattgattatagatagcatcaaatgtagtatactctgggggagaaaagattggactatgrgaggaaattctattttaagctttgtacaattataagacataaggaggacacaaatctcattaagggcagatttgggagagaaacagtgacaaagctaaaaccgtgacttatttgggaaacatcagtgtagcatgataaggacaagccattttatatcactcacatgagcaggcttcatgtcattgggtaaaaattcacagtaatcctggagaaaatgaagaatgtgtgaatcaatgtattgtgtgcaaacggtgatatgagggtagcctgagtcatatgaactccctgggaaaaacgacc

SEQ ID NO: 133512 - DNA, 601 bp, Human
tcatgtcattgggtaaaaattcacagtaatcctggagaaaatgaagaatgtgtgaatcaatgtattgtgtgcaaacggtgatatgagggtagcctgagtcatatgaactccctgggaaaaacgaccagctttgtgtatgtagcaagtggacttggtactcctattacctaaaaagagcctctgcaagtacttattgacaaaagttgacatctactctgcatatggaatagctgtccctgcctctcaggcattttgtaccataaaggccaacagattgccattatcaatattttgatgtccycaaaacagtttcagtggtaaccacatgatcgtacaagaatacgcctccttcattctgttgccagagaagtacaggaatcttcagttctttgtcttatttggagaaagcattctgctttccagtcttttccagtggagagtaggcctttgttatgggggatgctctgaacatatttcagaatggttcttttactctctctctgccagaaaagaaaggatctttttcttggctttccactatgggaactcactttggtttttggaggtaaattccaagcaagtggggcgggggcggggccct

SEQ ID NO: 133513 - DNA, 601 bp, Human
aagaaaggatctttttcttggctttccactatgggaactcactttggtttttggaggtaaattccaagcaagtggggcgggggcggggccctaagtctaggtgctaggagtttctctctctcaagctagtccataatcagcctccggcaatttgtcagaactactatttaagtgttcctaccagtatatgactcaggcaactcctgttttaaattttttttttttttttttttttttttttttttttgagactgagcctcactctgttgcccaggctagagtagtggtgtgatctcggctyactgcaacctctgtctcctgggttcaagcgatcctcctgtctcagcctcccgagtaactgggattacaggcgcccaccaccatgcccggctaatttttgtatttttgtagacagggtttcgacatgttggccaggctggtctcaaactcctgacctcaagtgatccacccgcctcagcctcccaaagtgctgggattacaggtgtgagccactgcgcccgtcctgactcatgcaacttctgcttcaggtaagcagatttaggctgtttattctgtgtttacctgtctctacattttgggg

SEQ ID NO: 133514 - DNA, 601 bp, Human
atgggaactcactttggtttttggaggtaaattccaagcaagtggggcgggggcggggccctaagtctaggtgctaggagtttctctctctcaagctagtccataatcagcctccggcaatttgtcagaactactatttaagtgttcctaccagtatatgactcaggcaactcctgttttaaattttttttttttttttttttttttttttttttttgagactgagcctcactctgttgcccaggctagagtagtggtgtgatctcggctcactgcaacctctgtctcctgggttcaagckatcctcctgtctcagcctcccgagtaactgggattacaggcgcccaccaccatgcccggctaatttttgtatttttgtagacagggtttcgacatgttggccaggctggtctcaaactcctgacctcaagtgatccacccgcctcagcctcccaaagtgctgggattacaggtgtgagccactgcgcccgtcctgactcatgcaacttctgcttcaggtaagcagatttaggctgtttattctgtgtttacctgtctctacattttggggtggcagtttttttcctgtgactttatctga

SEQ ID NO: 133515 - DNA, 601 bp, Human
gttggccagattggtctcgaattccttggccagactggactctaactcctgaactcgtgatccgcccgcctcagcctcctatagtgctgggattacaggagtgagccactgcgtccagccaagctttttttctcttgtgagggttgcagtaatgagtctcaagctctttacatgttggaactaaaactggaagttcctggtattcttttctacttctgtagtaattctctttctttggaaatcactttctctgtctgcccagctaagtctccatttttcaggttatgggtgcacattatgmcttacggtgggaggggcagaagtactgtcatgggctccctctgcaatggtgtttgtcagtgttctcttcctccagattagcttcttctttccattaagtgagaggctctggtagacctcaggaatgaagcaaagcctgttctgctcctacagtgagatagcaaggcaaaagctgctgtgcagtgttcacatagtatatatggtagagtccctgtgtcttttggcatttttgttgccaactatcctttctctgcttctaaactagtaaagcagttactgttctggtcccagctttactaga

SEQ ID NO: 133516 - DNA, 601 bp, Human
cagattggtctcgaattccttggccagactggactctaactcctgaactcgtgatccgcccgcctcagcctcctatagtgctgggattacaggagtgagccactgcgtccagccaagctttttttctcttgtgagggttgcagtaatgagtctcaagctctttacatgttggaactaaaactggaagttcctggtattcttttctacttctgtagtaattctctttctttggaaatcactttctctgtctgcccagctaagtctccatttttcaggttatgggtgcacattatgccttacrgtgggaggggcagaagtactgtcatgggctccctctgcaatggtgtttgtcagtgttctcttcctccagattagcttcttctttccattaagtgagaggctctggtagacctcaggaatgaagcaaagcctgttctgctcctacagtgagatagcaaggcaaaagctgctgtgcagtgttcacatagtatatatggtagagtccctgtgtcttttggcatttttgttgccaactatcctttctctgcttctaaactagtaaagcagttactgttctggtcccagctttactagaatattt

SEQ ID NO: 133517 - DNA, 601 bp, Human
gattacaggagtgagccactgcgtccagccaagctttttttctcttgtgagggttgcagtaatgagtctcaagctctttacatgttggaactaaaactggaagttcctggtattcttttctacttctgtagtaattctctttctttggaaatcactttctctgtctgcccagctaagtctccatttttcaggttatgggtgcacattatgccttacggtgggaggggcagaagtactgtcatgggctccctctgcaatggtgtttgtcagtgttctcttcctccagattagcttcttcttyccattaagtgagaggctctggtagacctcaggaatgaagcaaagcctgttctgctcctacagtgagatagcaaggcaaaagctgctgtgcagtgttcacatagtatatatggtagagtccctgtgtcttttggcatttttgttgccaactatcctttctctgcttctaaactagtaaagcagttactgttctggtcccagctttactagaatatttttagtccccatatcttggtgacctttggtgggggaagcgattccaagttagatacaggcagtttctctatgtgtagacacacat

SEQ ID NO: 133518 - DNA, 601 bp, Human
cagccaagctttttttctcttgtgagggttgcagtaatgagtctcaagctctttacatgttggaactaaaactggaagttcctggtattcttttctacttctgtagtaattctctttctttggaaatcactttctctgtctgcccagctaagtctccatttttcaggttatgggtgcacattatgccttacggtgggaggggcagaagtactgtcatgggctccctctgcaatggtgtttgtcagtgttctcttcctccagattagcttcttctttccattaagtgagaggctctggtagwcctcaggaatgaagcaaagcctgttctgctcctacagtgagatagcaaggcaaaagctgctgtgcagtgttcacatagtatatatggtagagtccctgtgtcttttggcatttttgttgccaactatcctttctctgcttctaaactagtaaagcagttactgttctggtcccagctttactagaatatttttagtccccatatcttggtgacctttggtgggggaagcgattccaagttagatacaggcagtttctctatgtgtagacacacattcctatctccagcactcatccatag

SEQ ID NO: 133519 - DNA, 601 bp, Human
tttatgactttcattttcagggctttgggacctgggagaatggtgtgagtaaagccagagggatctgagaagacagatactttactcctgcactggtgtctctagataatttcccagctggctctctctgcctgtgtaaacaagccttgaggatatgacccttgccaactcttgttagccactcctgtttacatagagctctaagtacatgcccatggaaatagctgcatattcttgaatgactaaacttgctcatttttctgtccaggtcatttctgctatccagaagcacagctcagckgagagtgaggcaccagaagaatgcctaagagtttccaaaagtgatgatttttctaccattaatatattatatgttggtagtatgaaaggaaaataaatcttggagcttcaaaatcactaggccaaatagaaaagtcaagctgggaactgcttagggcaaacctgcctcccattctattcaaagtcatccctctgctcactgacataaatgcctatctgattgactcctttgaaaaggctaatcagaaactcaaaagaatgcaacaggttgtccttcaccaacctgtgacctggaagcccc

SEQ ID NO: 133520 - DNA, 601 bp, Human
ttctcctgcctcagcctcctgagtagctgggattacaggcgcatgccaccatgcccggctaattttttttttttttttttgtaattttagtagagacgggggtttcaccatgttagccagggtggtctcgaactcctgaccttgtgatccgcccgcctcaacctcccaaagttctgggattacaggtgtgagccaccacagttggctttataatacttttaatttcaaaagccgcaattacttttgcactaacctgatagtaattgactcccttaaaagtagtcaaagcatattcccaagstattggatgtggatacatttttgtgggaaagttgttaaacttccaacaagtttataattgtccttgatcaccatgcatgagtcagatggagagggcaaaaatgaaaattgtaccttgtcaggtggtttccaaaggtggcaccttttattatgtaatgtgctctacaggaggtagactaggattgttttgatgcatacagcacagaaaatgaatctatcaacttatattcctcatgaaaatggagcatgctgtttgtggaggcacaatgtggggtcatcctgtgaccaaacgagtggcaac

SEQ ID NO: 133521 - DNA, 601 bp, Human
aattctctctctctctttctctctctcaaagagatgaacagaagatctcttattttccacctcctactccctcctcaaaagagaagttggtgaaaggaggtctctgttttccaagtgtgtgcagggcttagctcctagtatgtggcgtcagatagaatggagccatgggagcacggccaggggttgaagtgggttcttttgctgccctcctggcaaccactaaggggctttctgtggccatcctcacgtattcttagtccttggcctccctgacaatagcaggttgagtgatgtgactgcygcacaccgctctgttccctctgttcctatgtctttctgcaggtcgtctcagggctctccttgcacatccctgaacatacctgtttacttttacttcagtaacccatgtgctaccagcgtcttcacctgtctcagaacttgctcctcatcattcttcctcttagacacaccttggcattgatttgtaacctcaatttgttattgcttttctttgctcacaattacttaacagaagttgttcattgtgggctcagaaggagcccacggatttaatcttcttgttaagaatttgatatagagt

SEQ ID NO: 133522 - DNA, 601 bp, Human
ctccctgacaatagcaggttgagtgatgtgactgctgcacaccgctctgttccctctgttcctatgtctttctgcaggtcgtctcagggctctccttgcacatccctgaacatacctgtttacttttacttcagtaacccatgtgctaccagcgtcttcacctgtctcagaacttgctcctcatcattcttcctcttagacacaccttggcattgatttgtaacctcaatttgttattgcttttctttgctcacaattacttaacagaagttgttcattgtgggctcagaaggagcccacrgatttaatcttcttgttaagaatttgatatagagtatgtcctatcttaagctcacttgtgagcaatttgcaccttgattgatatgttacagatattctgacacatgccattctggcctctgctctcacccttcagagttcactgtaactgccatcctgtgtctctgccttactcctgggtagaatccatgtctgcctacatactgactgtctcccagaggcgtctagtcaggcacaagacccaacatatgggataaaattgattataaagcaggctgctaatgtaaaaacgtgcaattag

SEQ ID NO: 133523 - DNA, 601 bp, Human
ataaaattgattataaagcaggctgctaatgtaaaaacgtgcaattagcatccatttaacattcaataaatatgaaatatacgtggaagcctacatccaaatagaaagtgatcatagaccatatcgatgaatgttagagtacacaagaagatgactaatactatggagtaacatcttcaagaagttacattagggtaatgactctgtaaagacctcatgaaggccttgcaactttaaatagtttttatgaaagttttaaatagttttcattgtaagaacacatttgagtagaatcttaagratgcgaggaaattaaaggctttaatggtttttcccacgggcttaaaaggagaacagtgtggaagattaagatgggagtgtgcctggagaggcataaaaggtgagttcttaccaggcgcggtggttcacgcttgtaatcccagcacttagggaggacaaggcaggaagatcaccagagatcaggagttcaagaccagcctggccaatgtggtgaaactgtgtctctactaaaaaaatgcaaaaattagccgggtgtggtggcggatgcctgtagtcccagctactcgggaggctgaggcag

SEQ ID NO: 133524 - DNA, 601 bp, Human
ttccaaaataaacacatgaataattggcattcaattagtggatgtggatttaacacagacagaacttcatcgctcctaaatgtggtctccctttatgtattgggacatctctctcatggccaacagccatctccttggtatttctattcctcgatgatctgacattggtatgaatctgtgatctgtgtgtaattcagctggttacacccctcccccaacgaatacacacctttgggttcctatcaacctctgtaacatccttcaggccaagaagaaatcctaccatctacaaacacaagacccccccagaaattcccaacttatgtggtttcctccatttctacactctcataaccctggatcccaatctacttctttcaggctttacctcggcttttctttgtttaaataagtggagtagcatggagacctctgaaagagaactctgaggttattatgttcactccaattctaccatcgaattgggtgatctttgtaaatcatttaattttatttattcatctgaagaaagggagtactcttatttctcaagaattttggaaggaggaacaaacaggccaaagtgatttttaaattgtaa

SEQ ID NO: 133525 - DNA, 601 bp, Human
tagatgtgttaggaggcgagcacttcttcactggaaaccacatctggggttctaaagttcagctattgaagaatttccaaataatggaaggaagataatgaaacaatgataaagttttagtcatctatggagagacagggaagttttttttatatgtttatcaaacattgtgcttctctgtgttctaaacactgaggctatagcagtaaaaagacaaaagtgcctaatctacatgtagattatgttttagaaagaagaggtggacatttaaaaatagataatgataataaaagaaagatgscaaatgtacactgaatgatgagtttgtggttgtgctgtacttaagtttgtcttagcagcccttctgatgaagggacatgtaaggagaaagttgaaaaaagtataaacgaaagtcatgcaaatagcaacaggatggtaattctaggctgagtaatgaacaagtgcaaaagccttgaggcattaacagctcgcccagaccactttcagccatttttggtttctcttcctcatcttctttgttctttgatattgcagtctcggccagtctttgatgtctgtgcaattagaatgctttttattt

SEQ ID NO: 133526 - DNA, 601 bp, Human; identical to SEQ ID NO: 40439

SEQ ID NO: 133527 - DNA, 601 bp, Human; identical to SEQ ID NO: 40440

SEQ ID NO: 133528 - DNA, 601 bp, Human; identical to SEQ ID NO: 40441

SEQ ID NO: 133529 - DNA, 601 bp, Human; identical to SEQ ID NO: 40442

SEQ ID NO: 133530 - DNA, 601 bp, Human
atgaaagagttaaagccaaatatattggtacatcttgctcaaaacaaattaacccacagtggtgatgatgggggaatgcagatgactaacagaagttaaggatggactggcttgataaaatgttttagtgtctgggacagggactgagtgaatattgataccagtttgacaatacggcataagaaaggaaacaatatggctggagaacagcttatgttttagatattcttagttactggtgccgttttttcttctttgtggaatgtagtattgtacctgtacagaatgaagtctagctgcyttttttcacagtccaatgagatgcagacagacttggaaaagaagggagtttatttttgcaactggttacagggagaaggtcagagtaactatcagaccaactcagagttacaaagttttttttttctggtgcttatatacattttaagctctatgccttcacgtgggagtgcacctacatgcaggagtgtttcaatctatatctatctttaactagggtctggggtctagaaagctttctctagagtcttggaaagtttcttaatcttaaatgggccctggtacaagttgtatgtctaag

SEQ ID NO: 133531 - DNA, 601 bp, Human
taacacagtgaaaccccgtctctactaaaaatattaaaaattagccgggcatggtggcacgtacctgtagtcccaggtacttgggaggctgaggcagaagaatcgcttgaaccggggaggtggaggttgcagcgagccaagttcgcaccactgcactccagcctgggtgacagagtgagactctatttcaaaaaaaaaaaaaaaaaaaaaaaaaaaagattggaagaggttgcctataggcggtggatagaacaggacttttctgactgtacataagactatgtcatctgtaaaaagagakagatttactattttctttccaatagagaagcttttttaaaaattagtttttattggtacttaataagtatacatatttatagggtacatagattttggcacaggtatacaatgcataataattacatcagtacatcagagtaaatgatgtatccatcacctcaagcatttatcatttgtttgtgttgccaacattcagattatactattttaattattttaaatgcataataaattattgttgactatagtcacactgttgtggtatcaaatactaaatcttattcattctatctaactg

SEQ ID NO: 133532 - DNA, 601 bp, Human
taaaaatattaaaaattagccgggcatggtggcacgtacctgtagtcccaggtacttgggaggctgaggcagaagaatcgcttgaaccggggaggtggaggttgcagcgagccaagttcgcaccactgcactccagcctgggtgacagagtgagactctatttcaaaaaaaaaaaaaaaaaaaaaaaaaaaagattggaagaggttgcctataggcggtggatagaacaggacttttctgactgtacataagactatgtcatctgtaaaaagagagagatttactattttctttccaatakagaagcttttttaaaaattagtttttattggtacttaataagtatacatatttatagggtacatagattttggcacaggtatacaatgcataataattacatcagtacatcagagtaaatgatgtatccatcacctcaagcatttatcatttgtttgtgttgccaacattcagattatactattttaattattttaaatgcataataaattattgttgactatagtcacactgttgtggtatcaaatactaaatcttattcattctatctaactgccaacatagagccttttatttgttt

SEQ ID NO: 133533 - DNA, 601 bp, Human
gccaacattcagattatactattttaattattttaaatgcataataaattattgttgactatagtcacactgttgtggtatcaaatactaaatcttattcattctatctaactgccaacatagagccttttatttgttttctgtgactaactgccctgactagaacctccaataccatgttaaatagaagtagtgagagcaaacatccttgtcttttctgatcttcgggaaaaagcattcagtttttcaccacaaagtatgatgttagctgtaggtttttcatagatgtgttttatcaggytgagggacctctcttctattccaagtttgttaccattcctgttttgttttgttttttttatgaaagtgtgctgaattttgctgaatgctttttttcatgtctattgagatcatcatgtggttttcatcctttattttattaatatggtatattacatcaattgatttttttttatgttgaaccaaccttgcatttctgggataaattctacttggccatcaggtataatctttttgctggattgccagatttgattttcttgtatttttgttgaagaattttgtatttatatttataaga

SEQ ID NO: 133534 - DNA, 601 bp, Human
cctcatgtaatcaattaggaagtgttccctgctcttctttatttttgaaataacttatgaagttttgatattatttctttttaaacctttagcagaattagccagtgaagccatctgggtgaggccttttctctgtaggaagtctttgaattccaacttaatctcttaacatgttttaggcctattcatattttctatgcgttctttaatgtgtattgatagtttctgtatttctaggaatttgtctgtttcattaagattatctaatttgttggcatacagttgctcatcattttataawccttttaatttccttaaggtcagtagtaatatcccatctttcattcctgattttttttcttggtgtgtctagctaaatgtttgccaattttgttgacattttcatataactcacttctgatttttccatttttttttctactgttcttctttctttcattagtcttacaccagtctttatacactttgactcatgttttctcttttctttctaggacatgagtggaatcatgaaatggtgcgtatgggtggccaggagtggtgcttgtgagttataaagaagtgtttgtagctattagag

SEQ ID NO: 133535 - DNA, 601 bp, Human; identical to SEQ ID NO: 40443

SEQ ID NO: 133536 - DNA, 601 bp, Human; identical to SEQ ID NO: 40444

SEQ ID NO: 133537 - DNA, 601 bp, Human; identical to SEQ ID NO: 40445

SEQ ID NO: 133538 - DNA, 601 bp, Human; identical to SEQ ID NO: 40446

SEQ ID NO: 133539 - DNA, 601 bp, Human; identical to SEQ ID NO: 40447

SEQ ID NO: 133540 - DNA, 601 bp, Human; identical to SEQ ID NO: 40448

SEQ ID NO: 133541 - DNA, 601 bp, Human; identical to SEQ ID NO: 40449

SEQ ID NO: 133542 - DNA, 601 bp, Human; identical to SEQ ID NO: 40450

SEQ ID NO: 133543 - DNA, 601 bp, Human
gtgactcacattggcctcagaaatctaaacttttcactttgttttccagatcactacagatctgaggcagcgttgcacggacaaccacactgggacgtcagcctcagcccccatggctgcaggcatcattgcgctggccctggaagccaagtaagccttgatctctatatgtcttcaatggtgacaacccctgatctcagggaaaacgtaccccttcccttgtataggacccctagcatgacaacctagaatataatcttcccaatcccacctttaaaacttcaaaggtttgggctttttwaaaaaaattcccctatattaagaagaagattaggtttttggttttacatgcttaaaaaatcaaactgtgtaattactttattatggagtcatagcacatgcatgccagttggctccaactctcttgccttgttgaggtttttattctagtctgggaatgttcctgagcgtcccagagaggttaggtctgcccatttctggtctgtttctctgaagcatgactaggcagctccgattccacgacaatagcacagtcacagactggctctgcagaatagaatatgccagggacgaggacaac

SEQ ID NO: 133544 - DNA, 601 bp, Human
tgactaggcagctccgattccacgacaatagcacagtcacagactggctctgcagaatagaatatgccagggacgaggacaacccatttatatcaaatcctgttcagtatagtcaaattctatgtcaaaaagattactgtgaaagacccctttaggctatttgtaaataaataggtcctcatctcttttttctctaagaacaaataggttaatttgccttaacgttttgaaaacctaataatacagatctaatatctcttgtcctcaattttaaaatcctaaatgccaggaaaactgaacrttcttttgcaaatttaacactagaattcattttttggcaaagtttgccataaactcatttgaggctatttacagtattatttataacatttattgtgaaatattcatgtatttgattgtgaagtgctggctcagaccccgctggagattttgtatcatgtatgttataggcatcatctctgaaaaaattttgaattccaaacatgtcttgtccaattttagaatagggattgaaggcctgttctctgaggttctccctgcaggaggatcataagaaaaaggaactgaactaatgatataa

SEQ ID NO: 133545 - DNA, 601 bp, Human
acacaggtagtttcccagcattcacagctgcccctctgtaagacggagagcctatgttaaggcagctggacctgaatataacgtggatacagcaaattgctaagtcatgtgttggactgaaaccgggggaaggacatgggctctggatatggtgccctgtctctgggtggcctcttgcccaagcctggagattgagagatatccaagctcccatgaatatttggatttctttctttttgacgaggttaaatatgaagtcattttcaacaaattacatcttttaaggtgttaaaagtttggktttagcaaggaactggcacttatcctattaaattctcactttacaacttttcactaaagtgttctggcagcggaagtctcaattaagtgtctgtgtttttaatttggtgaactctacccaggatttttgaaaaatatattgtttttattctgaaattctaggttgtttctctggaatatgtttctgtccacaaaatattaaaagaaaaaacattaggaattcctctaccatgctccccctcaaaggctatctcaaactaaaacttagcaacctgatactataactattgcttcgtagaat

SEQ ID NO: 133546 - DNA, 601 bp, Human
ttcactaaagtgttctggcagcggaagtctcaattaagtgtctgtgtttttaatttggtgaactctacccaggatttttgaaaaatatattgtttttattctgaaattctaggttgtttctctggaatatgtttctgtccacaaaatattaaaagaaaaaacattaggaattcctctaccatgctccccctcaaaggctatctcaaactaaaacttagcaacctgatactataactattgcttcgtagaattaggtgatactcagctctttgagatattactgtaacactattattttttwaaaaaaaaaacagttcttttaatcacgatttaagctgaaatgcaaaaatcttgctttatgcctcaaataacctaagataaggtcactttggactgcataacacattgaaagactacaattgttttttttttttttttctcttttgcgttttgagcatttttaaagatctatttttgacacaactgtgatgagtagaaggaggttcctaagatacaggctacctggaaaatgcactgtgttttaagatgttaacagtccactctaattgtggggccaaaatggatgatgaactatctgata

SEQ ID NO: 133547 - DNA, 601 bp, Human
ggaagtctcaattaagtgtctgtgtttttaatttggtgaactctacccaggatttttgaaaaatatattgtttttattctgaaattctaggttgtttctctggaatatgtttctgtccacaaaatattaaaagaaaaaacattaggaattcctctaccatgctccccctcaaaggctatctcaaactaaaacttagcaacctgatactataactattgcttcgtagaattaggtgatactcagctctttgagatattactgtaacactattatttttttaaaaaaaaaacagttcttttartcacgatttaagctgaaatgcaaaaatcttgctttatgcctcaaataacctaagataaggtcactttggactgcataacacattgaaagactacaattgttttttttttttttttctcttttgcgttttgagcatttttaaagatctatttttgacacaactgtgatgagtagaaggaggttcctaagatacaggctacctggaaaatgcactgtgttttaagatgttaacagtccactctaattgtggggccaaaatggatgatgaactatctgataaactcagaaaaaacaaaccttt

SEQ ID NO: 133548 - DNA, 601 bp, Human
tctaggcagagttatgactcaggacactgccctactcgctgggtatgcatggcctgccagggttcattcagtaactggatatgctgagcctttgaatgaaaagctgcaagagtctgccagtccctatttgaactgcatgtcctagctatccctgtactgtcaggagaaatttattgtttctctgaatatcaccagattactgtatttactcagtcataggaacattagagaaaactaggtcctgagcttttcgccagcctctcttccttacattccagatgtctgcctgcatgggtaggaytgtggttcattctgtgatgctgcttctaccattggcctctctgccattcaaaaaccttcccaggaaactaagggaaaagaaaacaaatacatccggtagtcctagctactcagggggctgaggcaggaggatcccttgagcccaggagttcaaggctgcagtgagctatgatcacaccattgcactacagcccaggcaacagaatgagaccttatctcaaaaaaaaaggttgtgggggagaaagaaaaagaagtggaatgaaatacaaaacatagaaacagataaacttaaaagtatcca

SEQ ID NO: 133549 - DNA, 601 bp, Human
aacaaatacatccggtagtcctagctactcagggggctgaggcaggaggatcccttgagcccaggagttcaaggctgcagtgagctatgatcacaccattgcactacagcccaggcaacagaatgagaccttatctcaaaaaaaaaggttgtgggggagaaagaaaaagaagtggaatgaaatacaaaacatagaaacagataaacttaaaagtatccagatatcttttccaaacataacaagtttgatcatgaaataactttgctatggccaggaacagtggctcacgcctataatcccrgcactttgggagactgaggcaggaggatcacctgaggtcaggagtttgagaccagcctgccgacttggcaaaacccatctctactaaacatataaaaattagccaggcgtggtagcatgcgcccatagtcccagctacttaggaagttgaggcaagagaattgttcgaacccaggaggcagaggttgcactgaactgagatcatgctgctataccccagactgggtgacagagcaagtctctgtctcaaaacaaaaaaaaaagtaaagaaaagaaaaaagagaaataactttgctgtaac

SEQ ID NO: 133550 - DNA, 601 bp, Human
gtcaggagtttgagaccagcctgccgacttggcaaaacccatctctactaaacatataaaaattagccaggcgtggtagcatgcgcccatagtcccagctacttaggaagttgaggcaagagaattgttcgaacccaggaggcagaggttgcactgaactgagatcatgctgctataccccagactgggtgacagagcaagtctctgtctcaaaacaaaaaaaaaagtaaagaaaagaaaaaagagaaataactttgctgtaacagctagtacgactcccaggccatcctttttctacagratgtataagaatatgtgttgcaacaaattccactctaatatgctcgcagatacttgaatgaaattgttctgctcccaagactagaagaattctcagttcctctgaaaatctttctcctttacctttttttcctgggttggagcctctttggtttgggttgtgttaagctctacagccacctttgacagtctcatcatgagtcttgcctttctgctaaagtgagagatttcctccttgttctcaaagatgcttctaaaaattatggacgattttagaataagaaaaaatactttaatctta

SEQ ID NO: 133551 - DNA, 601 bp, Human
ctataccccagactgggtgacagagcaagtctctgtctcaaaacaaaaaaaaaagtaaagaaaagaaaaaagagaaataactttgctgtaacagctagtacgactcccaggccatcctttttctacagaatgtataagaatatgtgttgcaacaaattccactctaatatgctcgcagatacttgaatgaaattgttctgctcccaagactagaagaattctcagttcctctgaaaatctttctcctttacctttttttcctgggttggagcctctttggtttgggttgtgttaagctctrcagccacctttgacagtctcatcatgagtcttgcctttctgctaaagtgagagatttcctccttgttctcaaagatgcttctaaaaattatggacgattttagaataagaaaaaatactttaatcttaaaagagaggggagaaacaattttttgtgatgtggtaccctcagaacatttttattggttcagaatgtttaatagtatgattttttttctggattttttttggtaactttctggtgtttcagctaaatgaatagggaacatgtaaccagtgattataggatatcatttgggcg

SEQ ID NO: 133552 - DNA, 601 bp, Human
aaatgaatagggaacatgtaaccagtgattataggatatcatttgggcgattgctgcttaaaatgatgtctttttacatagcctaactcaaaaagttcaaataaaatgagtatgcaaggaagcaggtttattaaatgaaaaaccaaaatgaaagatggctgtactaattttagcttagcaacctggcagaacaccttatgtttgaaaagtgttttgcatctaggtcctagtatatgttcccagtgctatagatctatcagggggaaaaaaataaaagagcttgctgttaaatgatgttttstataaaattgtttataaaataaagtcaaaataactaacattcatgaaagtacagagtgctcagaataataagttgtactgaaagttttcctcacccatctgcaattattagcaatgaaaagcttattttagtggaatatttcatatgtaacaatatcagcatcaactcagaaaatacaaaaattaagttcatcaaagaaacctttctgcttctaattgcaaagggtctttcattggaaaattgaagaatatatgttcagtaatcaagaaatgttacactatacagtgaatggtaaataaa

SEQ ID NO: 133553 - DNA, 601 bp, Human
ttatattctcattagggaagcaaatgtacactaacagatatatgcaaattatttaaggaagtcaatgaaatcgttctgggggaagggttgtagggggtgcaggacttggatgaaaataaaaatgcccagctttgatgattcaaattggaacattggttccatagaaatttgtatcctccacgacacctaagcataatgttttgaacaaggtccattctcaacaaatattaaattaattcgtctagtccaaccttaccttttgtacaatggaactgagtcctagagaagttcaattgctcarttagttacttttaccgtccatatcctttagttgatattcattagtgacttctttctcccatactgcctcaactcgtctctcatcctgttgatttatcatttgctagaagtggacctcacctggctaaaataaagacatgaatgttattccctctctcaccttccaagggaatcccctctaccttttgtctttggaggaagggatcattcgagacaaggaaaggtcaaagtgtgagaagttaaaggagtgttgagccaaaggatgattcacaccgtatgctgttgatttcacaaatcacat

SEQ ID NO: 133554 - DNA, 601 bp, Human
gaagcaaatgtacactaacagatatatgcaaattatttaaggaagtcaatgaaatcgttctgggggaagggttgtagggggtgcaggacttggatgaaaataaaaatgcccagctttgatgattcaaattggaacattggttccatagaaatttgtatcctccacgacacctaagcataatgttttgaacaaggtccattctcaacaaatattaaattaattcgtctagtccaaccttaccttttgtacaatggaactgagtcctagagaagttcaattgctcaattagttacttttaccktccatatcctttagttgatattcattagtgacttctttctcccatactgcctcaactcgtctctcatcctgttgatttatcatttgctagaagtggacctcacctggctaaaataaagacatgaatgttattccctctctcaccttccaagggaatcccctctaccttttgtctttggaggaagggatcattcgagacaaggaaaggtcaaagtgtgagaagttaaaggagtgttgagccaaaggatgattcacaccgtatgctgttgatttcacaaatcacatcttgaaaattttctca

SEQ ID NO: 133555 - DNA, 601 bp, Human
tagaaagtacttgcacagagagaaatacaagcatatgtgccctgattccacacagttacaagggtaaagaagcaggtattccacacacccttcctttcatatactcttagagtttttttgtgtattggagtgttgtatgttgggcttaaaattttgctgaaatttctggtatgaatgcttggggtatacagcctgaagagggtgaagagaattaaaagaaaacaagggaggagagctgaaaaggtttataaggtaaaaacaatgcacatttcgacttgaggcctagcggacagagaagggwtgtactgtcctgaactattccctatagtgaaataattgtaaccagacccaaagagcagttaccacgggccttctgccaggactgtgcatgaaaatagctttgttatgtctacatatacacagacaatacactctgtcctctagtccttctcaagttcaaattatgtagaagccaacttttcctggactcaactttgtaccttaactaatggtttcaaaaactacagcttccagagatgtctattataactggaaaagccctggtcaacaggctcattcaccttggattatcttgaaatgt

SEQ ID NO: 133556 - DNA, 601 bp, Human
tgccctgattccacacagttacaagggtaaagaagcaggtattccacacacccttcctttcatatactcttagagtttttttgtgtattggagtgttgtatgttgggcttaaaattttgctgaaatttctggtatgaatgcttggggtatacagcctgaagagggtgaagagaattaaaagaaaacaagggaggagagctgaaaaggtttataaggtaaaaacaatgcacatttcgacttgaggcctagcggacagagaagggatgtactgtcctgaactattccctatagtgaaataatygtaaccagacccaaagagcagttaccacgggccttctgccaggactgtgcatgaaaatagctttgttatgtctacatatacacagacaatacactctgtcctctagtccttctcaagttcaaattatgtagaagccaacttttcctggactcaactttgtaccttaactaatggtttcaaaaactacagcttccagagatgtctattataactggaaaagccctggtcaacaggctcattcaccttggattatcttgaaatgtagccagtgtgttccaactccttccctatgtgagaaaa

SEQ ID NO: 133557 - DNA, 601 bp, Human
gtagtagtgcaggagagattagggtagcctggtcaaggtgatgggaatggggacagagagaagtgggtagatttgatgtatattttgtaggtatagccaacaggtaatgaattacatatgtgcctttgggaaaagcaaaaaaatcaagatctagtttctttgctaaactcaggtaaattgtgatatcatctatggaaatagataccctttattctccccatgggattctggagattagaagctgcataaaaatccagttgtacaagaaagtctctgggcctacagattttgcaccaagacmtgtagcaaatttctctggcaattattgactgtccttgggtacaccagcctccccatcagctaattaatctgcaaaaagtgcctacccggagatcatgattgctataagtgactgagacagttcccattttaaaaaagtaaaagaaaacagagaatattatttacattataaattgctcatctgcttctgtgtcttttaatttaaacagagtgttagcaaattaacctttatgcagttacccgataagattgcttagaaactccactgatgtatattagtgagtttacaagaaatatgtga

SEQ ID NO: 133558 - DNA, 601 bp, Human
tgcataaaaatccagttgtacaagaaagtctctgggcctacagattttgcaccaagacctgtagcaaatttctctggcaattattgactgtccttgggtacaccagcctccccatcagctaattaatctgcaaaaagtgcctacccggagatcatgattgctataagtgactgagacagttcccattttaaaaaagtaaaagaaaacagagaatattatttacattataaattgctcatctgcttctgtgtcttttaatttaaacagagtgttagcaaattaacctttatgcagttacccrataagattgcttagaaactccactgatgtatattagtgagtttacaagaaatatgtgagatttagtattaaatttagtctcttgagggtttgtggattttactcaatgccagggaatttttgttctgatagtgcctatggtaacaccccaaataccatcaaatatgatttttcttgctaagaaaaagagaagatgacttttttagggtccattagtttcacatcatagcctgctacttaatcactttagtcaaagcgtattaaaagactcattgcataatatatcattggatggcttcat

SEQ ID NO: 133559 - DNA, 601 bp, Human
aatccagttgtacaagaaagtctctgggcctacagattttgcaccaagacctgtagcaaatttctctggcaattattgactgtccttgggtacaccagcctccccatcagctaattaatctgcaaaaagtgcctacccggagatcatgattgctataagtgactgagacagttcccattttaaaaaagtaaaagaaaacagagaatattatttacattataaattgctcatctgcttctgtgtcttttaatttaaacagagtgttagcaaattaacctttatgcagttacccgataagatwgcttagaaactccactgatgtatattagtgagtttacaagaaatatgtgagatttagtattaaatttagtctcttgagggtttgtggattttactcaatgccagggaatttttgttctgatagtgcctatggtaacaccccaaataccatcaaatatgatttttcttgctaagaaaaagagaagatgacttttttagggtccattagtttcacatcatagcctgctacttaatcactttagtcaaagcgtattaaaagactcattgcataatatatcattggatggcttcatcaaatatt

SEQ ID NO: 133560 - DNA, 601 bp, Human
gtttgtggattttactcaatgccagggaatttttgttctgatagtgcctatggtaacaccccaaataccatcaaatatgatttttcttgctaagaaaaagagaagatgacttttttagggtccattagtttcacatcatagcctgctacttaatcactttagtcaaagcgtattaaaagactcattgcataatatatcattggatggcttcatcaaatattgctgtttttgtatttgaaaattctcagattatattcctctactctatatttaaacatagttcaaacttaatctgtttatrtgccaagttttcttgggctgagttttgaattgatctagcctatggctacattgtcttgccctataattttttacttccaggacatttttgtcacataaaagttaaaattgtttggtgtcatttgttcagaagagcctaattgttcctagtgacactggaatctagtttttgtattaactgataccaacattctttttttcctctgtttaaaaatttataatcataatgcattttgccatcaataggagagaaaagtaaataaggaaaataaaaatgacagattgaaagcatgtcatttta

SEQ ID NO: 133561 - DNA, 601 bp, Human
gagatttaaaatagggaggtgaggtctctcaagggctctcagcagagtctgcttgtcatttagctattggaaacctttgcgaacaacttggaagaatgtcgtagcgagcttcctggagagagtatgatacaggagtgatcgtattagtcatgctgaatttttattcattgctctgaatttaggtgccattggaattgacatctgatagcctcattttccatagcagatgtattcaattctataattttcattgtgctaaaattctcaagcatttgggatcccatacctggaatataaagcrattgttatcagtttgtctgaggaatcgtaacattggaaggttgcccagaaaccatctggcctgtagagatgctattcagtgagagtgttcaggggtcaccaggcaaaggtgaataacaatggcaatgtaggttatttttaaaacaaaggtatattttttaattttaaaaaataattttaaagtgactcattctgattatatatactgtttttgcatgacattttcttacttgtatgaaatgatgctatccttacttagcaatgaaagtgatgaatctcactttgattcccaagttgaaaa

SEQ ID NO: 133562 - DNA, 601 bp, Human
cgtaacattggaaggttgcccagaaaccatctggcctgtagagatgctattcagtgagagtgttcaggggtcaccaggcaaaggtgaataacaatggcaatgtaggttatttttaaaacaaaggtatattttttaattttaaaaaataattttaaagtgactcattctgattatatatactgtttttgcatgacattttcttacttgtatgaaatgatgctatccttacttagcaatgaaagtgatgaatctcactttgattcccaagttgaaaaacaatattccagtctttgaaatccaraagattgagagcctttttcatcacagtggtgcttgcaagcattctactgatttcatttgccactagtatcttagaagcaaataagtatttatttaatactgacagataccaggaagagcaatcccatgaccattataatctattattagcaatagaaccatttttaaaatgtaggtgtttatttatatgatgtattattttgataatatcttcaaattaattaatataaatttaaattatattatcatcaaaataacacattttacaaaacatatatataaatcatgcagacatgtaaat

SEQ ID NO: 133563 - DNA, 601 bp, Human
caccctgctgtgccatcatttagtaggtcttattcattctttctaactattatttttgacctctcctaaccatttctacctccccccagcacttcccatcaccacccttcccagcctctggtaacctttcttctactttctatattcataaattcactggttttgatttttagataccataaatcagtgacaatatgcgatgctgttttcttgttttatttttcatcattaaagttgaaccaactagagtttattttgttgtccagtatgaggatgtaaattgagtttttatagggatccwatttgcccaatgtcatttgttaagtaatctatctcctccaaaagcagtttgttttgtattcttttaagttgttgcatttatgaggatctcctttagcattttctgttttatcttctaccaaatctttaaacattacagaatcacttcatattttaaacattttcttaagcattcttatttgttcatattcccagataaaatttagaaccagtcttttgtgttccaaaaacaatcccagtggcaatttataacaattgtgtaaatcttggcttctttacaagttttcccaatcaaaaaaat

SEQ ID NO: 133564 - DNA, 601 bp, Human
tgggtagtaaacggagagtcaagcttttaacccacgttggtttgaccttgaaactggcctgtctctgcaagtttttggtatcagatgatgttaaattcacaaaataaattatggaattttgcaatttgtattttctctccagagacccttgggatcagagttctcgcatgtttgaaggaaaccatctggcctcaaagccatttttagaagaaatcccagtattttctaatactataaacatctcttgtattggttttttttttttttttttttttttttgagacggagtctcgctctgtckcccaggctggagtgcagtggcgggatctcggctcactgcaagctccgcctcccgggttcacgccattctcctgcctcagcctcccaagtagcagggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccttggtttttatgactgccttaatatttagaatttattagtg

SEQ ID NO: 133565 - DNA, 601 bp, Human
tctgtatttgttgatggtcagttttctcaatcctgcaaatatatcttctgtattcactcatgaaggacgacaagtctagtgtaaaattctcaggtttatttcttttaaatcagttcaactgttttattatcttctaaaattagctttgcagagaaagtctttaactagaagtcctgttttgcttagttttaggatttttttttcatttgtattgtaatgaaaacgtatatattttaggacaagtctaggggatgcaactcttttcattaatatgtcctggaaaacattaagtatttttagyccaccttgaacatttttaatcagatgtgactttgattagtggcgaagatcaccacagagcttcagagcctgggccctgaagtatatgagaaacctgccttcaaattcctgttctgcttcttactagttacacggctttgagaaaggaagtgaacctttctaagccttagtttccacacctgtaaaaggggaataataatgctgtttatttcatggggttgtgtgttcattaagtgaagttatatacataaagcacccagtaaagcatctggtaaataggaaagactcagtaatttttagt

SEQ ID NO: 133566 - DNA, 601 bp, Human
tctaaaattagctttgcagagaaagtctttaactagaagtcctgttttgcttagttttaggatttttttttcatttgtattgtaatgaaaacgtatatattttaggacaagtctaggggatgcaactcttttcattaatatgtcctggaaaacattaagtatttttagtccaccttgaacatttttaatcagatgtgactttgattagtggcgaagatcaccacagagcttcagagcctgggccctgaagtatatgagaaacctgccttcaaattcctgttctgcttcttactagttacayggctttgagaaaggaagtgaacctttctaagccttagtttccacacctgtaaaaggggaataataatgctgtttatttcatggggttgtgtgttcattaagtgaagttatatacataaagcacccagtaaagcatctggtaaataggaaagactcagtaatttttagtcctcagagcaaggtaaagctaatattctgaagccaggtttgtttcctgtcctccaaatccatcggcttgtcttccttgtcatctctttccttaaaaatatgcaagaagtggccgggtgcagtggctcacacc

SEQ ID NO: 133567 - DNA, 601 bp, Human
ttctttcctttgtttaaaaaaattattcattctcaatttaaaaaaaaaactggctacagaaaggctgtggctatgtccttgctctgcttagcctccaagcacagacttactcaaatctgccattgaaggatgggatgagggataaacctccctgtccgattctgagattctagcagagatccctctgaagtgagaagatcatttcctcccccttctgacaaaactagaggctgaacgtccagtccctacaaacaccattaacctgactctttccatcacgcacccctccagtccaagacaktgcaggtggcgagggtcagagctgaggctctagaatcaggctgcctgggccattctcaactgtggctaattgtatgactttgaggaagatcgttaaactttccctgctttgatgttcttattttggaaatgaaagtaataacagtatttgtctcacaggactgtcatgaagaatagatgaaataatgaatatagaatacttttgatagtatgtatgcctggcacacagtaagccttcaatacatgccatctactactctgtacttttggaggtacatcttttaggaaatttcttctgtag

SEQ ID NO: 133568 - DNA, 601 bp, Human
ctacagaaaggctgtggctatgtccttgctctgcttagcctccaagcacagacttactcaaatctgccattgaaggatgggatgagggataaacctccctgtccgattctgagattctagcagagatccctctgaagtgagaagatcatttcctcccccttctgacaaaactagaggctgaacgtccagtccctacaaacaccattaacctgactctttccatcacgcacccctccagtccaagacattgcaggtggcgagggtcagagctgaggctctagaatcaggctgcctgggccaktctcaactgtggctaattgtatgactttgaggaagatcgttaaactttccctgctttgatgttcttattttggaaatgaaagtaataacagtatttgtctcacaggactgtcatgaagaatagatgaaataatgaatatagaatacttttgatagtatgtatgcctggcacacagtaagccttcaatacatgccatctactactctgtacttttggaggtacatcttttaggaaatttcttctgtagtaagaaagagggttgtacaagaaaaaaatccacaagttagcagtcaagatgtt

SEQ ID NO: 133569 - DNA, 601 bp, Human
ctccaagcacagacttactcaaatctgccattgaaggatgggatgagggataaacctccctgtccgattctgagattctagcagagatccctctgaagtgagaagatcatttcctcccccttctgacaaaactagaggctgaacgtccagtccctacaaacaccattaacctgactctttccatcacgcacccctccagtccaagacattgcaggtggcgagggtcagagctgaggctctagaatcaggctgcctgggccattctcaactgtggctaattgtatgactttgaggaagatcrttaaactttccctgctttgatgttcttattttggaaatgaaagtaataacagtatttgtctcacaggactgtcatgaagaatagatgaaataatgaatatagaatacttttgatagtatgtatgcctggcacacagtaagccttcaatacatgccatctactactctgtacttttggaggtacatcttttaggaaatttcttctgtagtaagaaagagggttgtacaagaaaaaaatccacaagttagcagtcaagatgttgactcaaggctaccaagctcaagctaccaagtccaaaga

SEQ ID NO: 133570 - DNA, 601 bp, Human
ccattaacctgactctttccatcacgcacccctccagtccaagacattgcaggtggcgagggtcagagctgaggctctagaatcaggctgcctgggccattctcaactgtggctaattgtatgactttgaggaagatcgttaaactttccctgctttgatgttcttattttggaaatgaaagtaataacagtatttgtctcacaggactgtcatgaagaatagatgaaataatgaatatagaatacttttgatagtatgtatgcctggcacacagtaagccttcaatacatgccatctacwactctgtacttttggaggtacatcttttaggaaatttcttctgtagtaagaaagagggttgtacaagaaaaaaatccacaagttagcagtcaagatgttgactcaaggctaccaagctcaagctaccaagtccaaagaagctcaaggcttccaaggccaaggtctatgtggggttttttgttgttcttttccgaatggttgctgcagctccaatcatcatatccacattccaaataaaaggagaaaggacaaaatgatgcaggactagcaatctttatagcaggaaagcaaagttttctc

SEQ ID NO: 133571 - DNA, 601 bp, Human
gacattgcaggtggcgagggtcagagctgaggctctagaatcaggctgcctgggccattctcaactgtggctaattgtatgactttgaggaagatcgttaaactttccctgctttgatgttcttattttggaaatgaaagtaataacagtatttgtctcacaggactgtcatgaagaatagatgaaataatgaatatagaatacttttgatagtatgtatgcctggcacacagtaagccttcaatacatgccatctactactctgtacttttggaggtacatcttttaggaaatttcttcwgtagtaagaaagagggttgtacaagaaaaaaatccacaagttagcagtcaagatgttgactcaaggctaccaagctcaagctaccaagtccaaagaagctcaaggcttccaaggccaaggtctatgtggggttttttgttgttcttttccgaatggttgctgcagctccaatcatcatatccacattccaaataaaaggagaaaggacaaaatgatgcaggactagcaatctttatagcaggaaagcaaagttttctcagaaatgcccagtagactttattagtcagaactctgtctcct

SEQ ID NO: 133572 - DNA, 601 bp, Human
aaatgaaagtaataacagtatttgtctcacaggactgtcatgaagaatagatgaaataatgaatatagaatacttttgatagtatgtatgcctggcacacagtaagccttcaatacatgccatctactactctgtacttttggaggtacatcttttaggaaatttcttctgtagtaagaaagagggttgtacaagaaaaaaatccacaagttagcagtcaagatgttgactcaaggctaccaagctcaagctaccaagtccaaagaagctcaaggcttccaaggccaaggtctatgtgggkttttttgttgttcttttccgaatggttgctgcagctccaatcatcatatccacattccaaataaaaggagaaaggacaaaatgatgcaggactagcaatctttatagcaggaaagcaaagttttctcagaaatgcccagtagactttattagtcagaactctgtctcctgtgtacccctcattatcagggattctggaaagatagcattttggcatcccaagatatataatagagggagacaatgaaaaagaaagttaaaaattattttcctcatagtcacattagctcataagtttttt

SEQ ID NO: 133573 - DNA, 601 bp, Human
gttttttgttgttcttttccgaatggttgctgcagctccaatcatcatatccacattccaaataaaaggagaaaggacaaaatgatgcaggactagcaatctttatagcaggaaagcaaagttttctcagaaatgcccagtagactttattagtcagaactctgtctcctgtgtacccctcattatcagggattctggaaagatagcattttggcatcccaagatatataatagagggagacaatgaaaaagaaagttaaaaattattttcctcatagtcacattagctcataagtttttytgaaatacatcaaaatttttgtaatagatttctgttagtctttgttgattttttcctgcgtgtgtgtgtatgtgtgtgtgtgtgtgtgtggtgtaatttttaaagtattttttgttcctatcgatgatgtctaacaattagaaagactgccaggaattgatacactaaaccaggagtttctaaaataggcataataattcagccataaaaaaatgaaatcagctgggcgaggtggctcacgcctacaatcccagcactttgggaggctgaggcatgtggatcacctgaggtcaggagttc

SEQ ID NO: 133574 - DNA, 601 bp, Human
gaaaggacaaaatgatgcaggactagcaatctttatagcaggaaagcaaagttttctcagaaatgcccagtagactttattagtcagaactctgtctcctgtgtacccctcattatcagggattctggaaagatagcattttggcatcccaagatatataatagagggagacaatgaaaaagaaagttaaaaattattttcctcatagtcacattagctcataagtttttttgaaatacatcaaaatttttgtaatagatttctgttagtctttgttgattttttcctgcgtgtgtgtgtrtgtgtgtgtgtgtgtgtgtggtgtaatttttaaagtattttttgttcctatcgatgatgtctaacaattagaaagactgccaggaattgatacactaaaccaggagtttctaaaataggcataataattcagccataaaaaaatgaaatcagctgggcgaggtggctcacgcctacaatcccagcactttgggaggctgaggcatgtggatcacctgaggtcaggagttcgagaccagcctgaccaacgtggagaaatcccgtctctactaaaaatacaaaattagctaggcgtgatggc

SEQ ID NO: 133575 - DNA, 601 bp, Human
tactcaacaggaaaaaaatgggagaaaacggctataaagtaatttagaatcataataataatggcgatgcagtcaatgatttctgttgcctctccaggggtttaactactggcttttgaggtgagaactctgcaaatctctgaactatgtagaaaagtatcaaaagcacttcagtctggcaatttggctaggcaaataagtatacttgtagtcctcattctaacattcgattctctaaagcactctgatatcaaaccaaagaacatctcactatcctccacaattacatcaatggctaacyatcaagagagaagatctcccacatgtagagtagatttattaacaatcctagtgggtccaaaaatttcactccccagccaattaaattgccatctacactatggggttgtgaaaaccagatctttttgacaaatcttagtagcattgttgtttcactaagcagaaatataccaaggtgttaaaaatgctgttttgttcatctgttagtgaaactaaaaaacatattactaaagtttaggaacattgcagaaaacttagcctaattaaatacagattcatcaaatgctggtgtaaactcagc

SEQ ID NO: 133576 - DNA, 601 bp, Human
atttagaatcataataataatggcgatgcagtcaatgatttctgttgcctctccaggggtttaactactggcttttgaggtgagaactctgcaaatctctgaactatgtagaaaagtatcaaaagcacttcagtctggcaatttggctaggcaaataagtatacttgtagtcctcattctaacattcgattctctaaagcactctgatatcaaaccaaagaacatctcactatcctccacaattacatcaatggctaactatcaagagagaagatctcccacatgtagagtagatttattracaatcctagtgggtccaaaaatttcactccccagccaattaaattgccatctacactatggggttgtgaaaaccagatctttttgacaaatcttagtagcattgttgtttcactaagcagaaatataccaaggtgttaaaaatgctgttttgttcatctgttagtgaaactaaaaaacatattactaaagtttaggaacattgcagaaaacttagcctaattaaatacagattcatcaaatgctggtgtaaactcagcaaaagtagtccttctgagttataatggtacagtaggttcct

SEQ ID NO: 133577 - DNA, 601 bp, Human
aattgccatctacactatggggttgtgaaaaccagatctttttgacaaatcttagtagcattgttgtttcactaagcagaaatataccaaggtgttaaaaatgctgttttgttcatctgttagtgaaactaaaaaacatattactaaagtttaggaacattgcagaaaacttagcctaattaaatacagattcatcaaatgctggtgtaaactcagcaaaagtagtccttctgagttataatggtacagtaggttcctaatctcaataaatcatcatgacgcttgtctttggtagcctatsatatgccaagctctttatttccattacctcaaattcttgcagccatcttgtggagtcagcgttattttctccacattgcggctgaggaaacagagacttcaagaggttcagtaaattgtccagtgttacagaactatcaggtaggagatcatgattcaccctaggtcttcctgactctgaagcgtaatttacaccattctcgtgtgattaagaggctgtagaatgcaaaacaaaatttattattattttgaatgagaaatagaaatgaggggggtaaccatgtcttcctgcaggacttag

SEQ ID NO: 133578 - DNA, 601 bp, Human
ttttgacaaatcttagtagcattgttgtttcactaagcagaaatataccaaggtgttaaaaatgctgttttgttcatctgttagtgaaactaaaaaacatattactaaagtttaggaacattgcagaaaacttagcctaattaaatacagattcatcaaatgctggtgtaaactcagcaaaagtagtccttctgagttataatggtacagtaggttcctaatctcaataaatcatcatgacgcttgtctttggtagcctatcatatgccaagctctttatttccattacctcaaattcttkcagccatcttgtggagtcagcgttattttctccacattgcggctgaggaaacagagacttcaagaggttcagtaaattgtccagtgttacagaactatcaggtaggagatcatgattcaccctaggtcttcctgactctgaagcgtaatttacaccattctcgtgtgattaagaggctgtagaatgcaaaacaaaatttattattattttgaatgagaaatagaaatgaggggggtaaccatgtcttcctgcaggacttagtctgtgggcctagaactgcataatttatacatgctaagt

SEQ ID NO: 133579 - DNA, 601 bp, Human
aaaatgtctctcttaggagatgtcctgcttcttctaaaccttgtgttgggcctgtgaaatactctgaactgctcagagtaaaaatgtaatgcaaatactgggtagtgatagtgtcattaattatgctgtttttgcagctgaaaactagaaaactagaagtgtttaaggtgaggttcagctgagattcactgaacggagaagagtcacgtagcctggctgcgaaccacatccaagtgtggccatggcaggggagatgacaagttcataacaataatggtatgcaataatacactgatgttaygacatacagtatacgtgtaaactattataaaaatcatatgattttcctggtgtgttatttttctgtttacctttgaaagaatgggtaaaaggcctttggaacctgcataacaaattaagactcaggaatcctctgaatgctatggtaaacaaaaatcaacagagtcaagaaagagagtgtgtgtacaaagtgtgtgtaaccatgaggacgcgacgtgccatacttggctttttgatccatttgtcaaagaacttcctgacaaatagatgtgtgtctctgcttcacctttgtggatccgtt

SEQ ID NO: 133580 - DNA, 601 bp, Human
tctcttaggagatgtcctgcttcttctaaaccttgtgttgggcctgtgaaatactctgaactgctcagagtaaaaatgtaatgcaaatactgggtagtgatagtgtcattaattatgctgtttttgcagctgaaaactagaaaactagaagtgtttaaggtgaggttcagctgagattcactgaacggagaagagtcacgtagcctggctgcgaaccacatccaagtgtggccatggcaggggagatgacaagttcataacaataatggtatgcaataatacactgatgttacgacatacrgtatacgtgtaaactattataaaaatcatatgattttcctggtgtgttatttttctgtttacctttgaaagaatgggtaaaaggcctttggaacctgcataacaaattaagactcaggaatcctctgaatgctatggtaaacaaaaatcaacagagtcaagaaagagagtgtgtgtacaaagtgtgtgtaaccatgaggacgcgacgtgccatacttggctttttgatccatttgtcaaagaacttcctgacaaatagatgtgtgtctctgcttcacctttgtggatccgtttggaaata

SEQ ID NO: 133581 - DNA, 601 bp, Human
ggagatgtcctgcttcttctaaaccttgtgttgggcctgtgaaatactctgaactgctcagagtaaaaatgtaatgcaaatactgggtagtgatagtgtcattaattatgctgtttttgcagctgaaaactagaaaactagaagtgtttaaggtgaggttcagctgagattcactgaacggagaagagtcacgtagcctggctgcgaaccacatccaagtgtggccatggcaggggagatgacaagttcataacaataatggtatgcaataatacactgatgttacgacatacagtatacrtgtaaactattataaaaatcatatgattttcctggtgtgttatttttctgtttacctttgaaagaatgggtaaaaggcctttggaacctgcataacaaattaagactcaggaatcctctgaatgctatggtaaacaaaaatcaacagagtcaagaaagagagtgtgtgtacaaagtgtgtgtaaccatgaggacgcgacgtgccatacttggctttttgatccatttgtcaaagaacttcctgacaaatagatgtgtgtctctgcttcacctttgtggatccgtttggaaatagtgttat

SEQ ID NO: 133582 - DNA, 601 bp, Human
attcactgaacggagaagagtcacgtagcctggctgcgaaccacatccaagtgtggccatggcaggggagatgacaagttcataacaataatggtatgcaataatacactgatgttacgacatacagtatacgtgtaaactattataaaaatcatatgattttcctggtgtgttatttttctgtttacctttgaaagaatgggtaaaaggcctttggaacctgcataacaaattaagactcaggaatcctctgaatgctatggtaaacaaaaatcaacagagtcaagaaagagagtgtgtrtacaaagtgtgtgtaaccatgaggacgcgacgtgccatacttggctttttgatccatttgtcaaagaacttcctgacaaatagatgtgtgtctctgcttcacctttgtggatccgtttggaaatagtgttatatggtgattgatagcataaggtatacagccaagtccagctggcttgaattctagttctacttactacctgtgtatttgagttactgtgtgtaactcaaagcctcagttttgtcgtctgtgaaacaggaataagaatgttacccacgtcatatgattttcaatatcatg

SEQ ID NO: 133583 - DNA, 601 bp, Human
atatgattttcctggtgtgttatttttctgtttacctttgaaagaatgggtaaaaggcctttggaacctgcataacaaattaagactcaggaatcctctgaatgctatggtaaacaaaaatcaacagagtcaagaaagagagtgtgtgtacaaagtgtgtgtaaccatgaggacgcgacgtgccatacttggctttttgatccatttgtcaaagaacttcctgacaaatagatgtgtgtctctgcttcacctttgtggatccgtttggaaatagtgttatatggtgattgatagcataagktatacagccaagtccagctggcttgaattctagttctacttactacctgtgtatttgagttactgtgtgtaactcaaagcctcagttttgtcgtctgtgaaacaggaataagaatgttacccacgtcatatgattttcaatatcatgcaacaatcatgcacataaaagatacactgcctggccctggccaagtgctcactagatgttggttattactatgagttcagcaaaggatgcaaaactataaatgattacatatacagaactcccgagaaagtcatgttcatttccttggtttga

SEQ ID NO: 133584 - DNA, 601 bp, Human
caagaaagagagtgtgtgtacaaagtgtgtgtaaccatgaggacgcgacgtgccatacttggctttttgatccatttgtcaaagaacttcctgacaaatagatgtgtgtctctgcttcacctttgtggatccgtttggaaatagtgttatatggtgattgatagcataaggtatacagccaagtccagctggcttgaattctagttctacttactacctgtgtatttgagttactgtgtgtaactcaaagcctcagttttgtcgtctgtgaaacaggaataagaatgttacccacgtcatrtgattttcaatatcatgcaacaatcatgcacataaaagatacactgcctggccctggccaagtgctcactagatgttggttattactatgagttcagcaaaggatgcaaaactataaatgattacatatacagaactcccgagaaagtcatgttcatttccttggtttgaaaggtcatagatggctacccatatcttgtaggtgtttataaatgtgactctcttcatatatatttttgtttaagggcatttgttaattccaggaagaaatttgaggggtgtgtagcataactacatgtga

SEQ ID NO: 133585 - DNA, 601 bp, Human
gaggacgcgacgtgccatacttggctttttgatccatttgtcaaagaacttcctgacaaatagatgtgtgtctctgcttcacctttgtggatccgtttggaaatagtgttatatggtgattgatagcataaggtatacagccaagtccagctggcttgaattctagttctacttactacctgtgtatttgagttactgtgtgtaactcaaagcctcagttttgtcgtctgtgaaacaggaataagaatgttacccacgtcatatgattttcaatatcatgcaacaatcatgcacataaaasatacactgcctggccctggccaagtgctcactagatgttggttattactatgagttcagcaaaggatgcaaaactataaatgattacatatacagaactcccgagaaagtcatgttcatttccttggtttgaaaggtcatagatggctacccatatcttgtaggtgtttataaatgtgactctcttcatatatatttttgtttaagggcatttgttaattccaggaagaaatttgaggggtgtgtagcataactacatgtgatttattatagggcggtggtcacgagactcaggattggg

SEQ ID NO: 133586 - DNA, 601 bp, Human
ttactacctgtgtatttgagttactgtgtgtaactcaaagcctcagttttgtcgtctgtgaaacaggaataagaatgttacccacgtcatatgattttcaatatcatgcaacaatcatgcacataaaagatacactgcctggccctggccaagtgctcactagatgttggttattactatgagttcagcaaaggatgcaaaactataaatgattacatatacagaactcccgagaaagtcatgttcatttccttggtttgaaaggtcatagatggctacccatatcttgtaggtgtttatwaatgtgactctcttcatatatatttttgtttaagggcatttgttaattccaggaagaaatttgaggggtgtgtagcataactacatgtgatttattatagggcggtggtcacgagactcaggattgggagatgttgttcttttctccaggtgggttagacttttgatctctcaatagttgcttgcttcaaagctcttgttgcacaagtttgtctattcttggagatcagagaggtctcagttttcagaggccactggagtgtgggtccaagatacttggcagagagaaataggtattagg

SEQ ID NO: 133587 - DNA, 601 bp, Human
ctttactttattttggtgaaattcaggaaattttcaaattagatcatttctgaagttgtgcattaccaaatatcagagtaaaaccatccaaacaccttctttttccatgtgtaggtccaatttcctgaagctaatttcttccttctaattacaagcactccaagaactaggttttgctactcagcatgaaaacaagtaactcttatttcttcagtctgagtttgaatgcaggaggcttcctgaatctgccagaatacaggtgcttaaggtataagatcaatgtaaatgttccctgttctgytttgaaaattaaatttttagtgctaaggttcactagggaaaatgtggatctcccaatgatcagaatttcttgcttaatatttctgaagaaatcttgccctggtgacaggtaacatgagacattgacttcttttctttttttctcctccctaaaggagagttaaatttaaggagttaaaacgtggaagttctgtgtgtcaaatgttatttttaaattactaggttgatttagatattttcgtcaaatctaagtgtattctttggtatctcactgtttactcatgacaaaataaaaacattc

SEQ ID NO: 133588 - DNA, 601 bp, Human
ttactttattttggtgaaattcaggaaattttcaaattagatcatttctgaagttgtgcattaccaaatatcagagtaaaaccatccaaacaccttctttttccatgtgtaggtccaatttcctgaagctaatttcttccttctaattacaagcactccaagaactaggttttgctactcagcatgaaaacaagtaactcttatttcttcagtctgagtttgaatgcaggaggcttcctgaatctgccagaatacaggtgcttaaggtataagatcaatgtaaatgttccctgttctgctwtgaaaattaaatttttagtgctaaggttcactagggaaaatgtggatctcccaatgatcagaatttcttgcttaatatttctgaagaaatcttgccctggtgacaggtaacatgagacattgacttcttttctttttttctcctccctaaaggagagttaaatttaaggagttaaaacgtggaagttctgtgtgtcaaatgttatttttaaattactaggttgatttagatattttcgtcaaatctaagtgtattctttggtatctcactgtttactcatgacaaaataaaaacattcat

SEQ ID NO: 133589 - DNA, 601 bp, Human
aattttcaaattagatcatttctgaagttgtgcattaccaaatatcagagtaaaaccatccaaacaccttctttttccatgtgtaggtccaatttcctgaagctaatttcttccttctaattacaagcactccaagaactaggttttgctactcagcatgaaaacaagtaactcttatttcttcagtctgagtttgaatgcaggaggcttcctgaatctgccagaatacaggtgcttaaggtataagatcaatgtaaatgttccctgttctgctttgaaaattaaatttttagtgctaagkttcactagggaaaatgtggatctcccaatgatcagaatttcttgcttaatatttctgaagaaatcttgccctggtgacaggtaacatgagacattgacttcttttctttttttctcctccctaaaggagagttaaatttaaggagttaaaacgtggaagttctgtgtgtcaaatgttatttttaaattactaggttgatttagatattttcgtcaaatctaagtgtattctttggtatctcactgtttactcatgacaaaataaaaacattcatgttcatttgggaggattctgctttac

SEQ ID NO: 133590 - DNA, 601 bp, Human
gtcatttttgtcattcactctaataactaggacataccatcttaggcagagctagaacatcttatgttgagactggcattcaggattatcccttgacttactttctaatttccgtgacagtagtgcattgagtctactgaatgatcatgtgaatgaatttagtgtttgtcagcaaaggctcaaatcatgctatttgttttagaagcaaaacatcctgctcctggattccaccaaacagcctgcctccctttcttgaaagttttttgctttatcaggttctataattgattcctaacaagtsctgtatcctaagaaaacaagaataattctgttttcatcgttctcatatttttaaagtttatgtagttggggtttaatttccacaattcaagttcttttgttgatataactttaccaagtagtctagatccagtcttaacccgctctggaaactttaaaaaatggcaggactcagtctccttttatttttaatctgagaccataacagaaaaagtgtcagaactcaatagtacttttctttccccatttctttcatactgaagccaccaaataagagctgtggatgcaaattttagcaaaa

SEQ ID NO: 133591 - DNA, 601 bp, Human
ttctaatttccgtgacagtagtgcattgagtctactgaatgatcatgtgaatgaatttagtgtttgtcagcaaaggctcaaatcatgctatttgttttagaagcaaaacatcctgctcctggattccaccaaacagcctgcctccctttcttgaaagttttttgctttatcaggttctataattgattcctaacaagtgctgtatcctaagaaaacaagaataattctgttttcatcgttctcatatttttaaagtttatgtagttggggtttaatttccacaattcaagttcttttgttratataactttaccaagtagtctagatccagtcttaacccgctctggaaactttaaaaaatggcaggactcagtctccttttatttttaatctgagaccataacagaaaaagtgtcagaactcaatagtacttttctttccccatttctttcatactgaagccaccaaataagagctgtggatgcaaattttagcaaaatgctttgctatctaccacttcttaatagcttcttatgcaccaggcacaaggttaagtacttggcattattttaactgattcaatcagtacaacgacataaag

SEQ ID NO: 133592 - DNA, 601 bp, Human
agaactcaatagtacttttctttccccatttctttcatactgaagccaccaaataagagctgtggatgcaaattttagcaaaatgctttgctatctaccacttcttaatagcttcttatgcaccaggcacaaggttaagtacttggcattattttaactgattcaatcagtacaacgacataaagcagatactagcatccatgttctaagtaggaatactaagactttgagaggttaatttcacatggaaaatgaaggagccagaatctgatcactagaccccttcttactagaaggccgycctgaccaccctaaaaaacatagatgtggtgagtatgattgggaaaaaaatgtagtataaagtgaagaaacatacaggccctatcatgaaaaattaggtacaattaagataccaagttctccctctgcctgaaagacctcagtgtccatacacctacaaaagagagtgcagaaagactaccccaagccccatcacacctcaaggcaggtagtgagtaattttctcctcttccctaaatcttctctcccatcctttgcaaatattgttgctgaagtgaaggtagctggtgagaaacaaata

SEQ ID NO: 133593 - DNA, 601 bp, Human
agctaatggttagaaaaggttcctacaacaagagctcaacaagggcttgtatttaaatgaggtcagccggcttttgcaggtcttgcttagcaggaatccatagtcacgtatttctccttagactgggaaaacggaagttgcctgcctacagaagtgtgtggtcctgggtgcccttctttgtcccacccaactcagccctaacactgagtaaaatatatgtatgaaatgaatctgaaaactcctgttcttccttgggcttacttttgttttcccagtgttgagtaatttattaataacttgytggaaaagtagtttaaaaaaaaataggagaacaatttcacaaattgctcaataggtacctgccagtaatagggacatcagcgtcacccatcagaatttctttctcatcacgtaaagcagaagccacttagagtagcaaacaactcagttttggagttcagacatcactagacttgatagtctttgttatcactgataacttcagtaaagccaacaccccaatgaatagtctctaccaaaaccctaccaaatccattttatccaacctccttacatttcttcagacatacccccatgtcct

SEQ ID NO: 133594 - DNA, 601 bp, Human
ctgtaatgagatgacctcacagagagggaagacacatgtaaacattcttatgttaatggcaccttaattttcaacaattttaatcaaactaagattattctatcctgctgtttcttaaataataataacaatctcatagtataattaaaatatcttttctggtagattagtttttcagaataaacataatctgatgaatacatacctatggaaactgactaaacattgtttggccttgttcatcttgtgaataatcctagctaagtttcagacaacagcttttgactttaaacctcctccrgagatagtttttttaattaaatggtataaatatcatgtacctatcagagaatctactttagattgcccatgagaatagggaattatttgccttagaccagatgaacagatgtgatattctgctaccagagaactgaaatccaaattccagtattttgcttctgaccaatatttgcaatgccagaaggtgactttggcattcagctgtttggggttttgttagtattatttctttcctccccttgatcccttccctttctgcttaggaaaagtcttttctgttttgttttgttttctattc

SEQ ID NO: 133595 - DNA, 601 bp, Human
atttttcataacctacggcttgtatcatttcaggaagaagttagctctttcttgtgatctcctcccttttagtgctataatctgaggaaactgtaaatccactgacctctcccaccagtgcctgggctgtgcaggctgattcttggcccgagtccttatctttggtttgggtgtgaagttataattataattgaatgcatgcaacatcagtgatctagttttctttttttcaaagtgtttatattggattatatgactgtatacagttaaactctcttaaatctaggaacaggaatagacrtcagataataaattaggaccttctgtcatctttactaggcgaaagaatgaaaaaaatgtcattgaaaatcaaaaaatgacaactaagtgagagaggttaccacgccttccatttcactgccctcccagactatgtaagtctctttttttctaccagcatgttgctgaaacctcccccatccccactgactctttctttgaccacaactaaactactagattttttttttttaatttctaactgattaccaaccgtggggaaaacaattgacagtctaacatgacttcttagcctccgagg

SEQ ID NO: 133596 - DNA, 601 bp, Human
aaagtgtttatattggattatatgactgtatacagttaaactctcttaaatctaggaacaggaatagacgtcagataataaattaggaccttctgtcatctttactaggcgaaagaatgaaaaaaatgtcattgaaaatcaaaaaatgacaactaagtgagagaggttaccacgccttccatttcactgccctcccagactatgtaagtctctttttttctaccagcatgttgctgaaacctcccccatccccactgactctttctttgaccacaactaaactactagattttttttttttaatttctaactgattaccaaccgtggggaaaacaattgacagtctaacatgacttcttagcctccgaggccttaacttttaataacctgtattacttttaattgccatcattttatttccactggtagggttgataattttaagatgtccaatatatttttaatacctacctgtcttgctttcagtttgtaacacttattaaaaagaattcaaagtgctgaaaccattaagcatgctgtgtgttcaatcaaaatgaaaggttttgaaatgtgcttttgagttgtgttttgagtataaagt

SEQ ID NO: 133597 - DNA, 601 bp, Human
atatgactgtatacagttaaactctcttaaatctaggaacaggaatagacgtcagataataaattaggaccttctgtcatctttactaggcgaaagaatgaaaaaaatgtcattgaaaatcaaaaaatgacaactaagtgagagaggttaccacgccttccatttcactgccctcccagactatgtaagtctctttttttctaccagcatgttgctgaaacctcccccatccccactgactctttctttgaccacaactaaactactagattttttttttttaatttctaactgattaccmaccgtggggaaaacaattgacagtctaacatgacttcttagcctccgaggccttaacttttaataacctgtattacttttaattgccatcattttatttccactggtagggttgataattttaagatgtccaatatatttttaatacctacctgtcttgctttcagtttgtaacacttattaaaaagaattcaaagtgctgaaaccattaagcatgctgtgtgttcaatcaaaatgaaaggttttgaaatgtgcttttgagttgtgttttgagtataaagtgatttctgatgtgttacca

SEQ ID NO: 133598 - DNA, 601 bp, Human
gactgtatacagttaaactctcttaaatctaggaacaggaatagacgtcagataataaattaggaccttctgtcatctttactaggcgaaagaatgaaaaaaatgtcattgaaaatcaaaaaatgacaactaagtgagagaggttaccacgccttccatttcactgccctcccagactatgtaagtctctttttttctaccagcatgttgctgaaacctcccccatccccactgactctttctttgaccacaactaaactactagattttttttttttaatttctaactgattaccaaccrtggggaaaacaattgacagtctaacatgacttcttagcctccgaggccttaacttttaataacctgtattacttttaattgccatcattttatttccactggtagggttgataattttaagatgtccaatatatttttaatacctacctgtcttgctttcagtttgtaacacttattaaaaagaattcaaagtgctgaaaccattaagcatgctgtgtgttcaatcaaaatgaaaggttttgaaatgtgcttttgagttgtgttttgagtataaagtgatttctgatgtgttaccatttg

SEQ ID NO: 133599 - DNA, 601 bp, Human
tctccatgggaatatagaagccctgatagcaaactctgcttggtcatggcttaatccagagtctttcatccaaaatgcccacttgtctcatcagaatgttcaactcatgcctaccaaatatgtgacgctcaaaaatattttctacaaatgaaaagtggtgttttctctgtgcctgtccttgactgaatggtggtattaggtttgttaggcttttgggggtttcattttgttttgccctttcatccctgtaagttttaaatgcatgcggtttcacacttaaaacccattctcaaaatagaaktaaaatgatggttgcactatttacctgttatctctatacaagatgtaattagttaatgaagagaactatgtttggagtggttttgtgattttgccaaaatcttaagagcctttaaattctagaagaaagtctattaatgatattttctgtggcctttgaggaagccaattagagtttttgtaccttggtttttgaggaatgtggatagctaatactaaacataatgagaagaatgaattgaatgaaaagtgctttgaaaatggaaaataccaaacaaaaagagtcttaaaagtatatctt

SEQ ID NO: 133600 - DNA, 601 bp, Human
cttaatccagagtctttcatccaaaatgcccacttgtctcatcagaatgttcaactcatgcctaccaaatatgtgacgctcaaaaatattttctacaaatgaaaagtggtgttttctctgtgcctgtccttgactgaatggtggtattaggtttgttaggcttttgggggtttcattttgttttgccctttcatccctgtaagttttaaatgcatgcggtttcacacttaaaacccattctcaaaatagaattaaaatgatggttgcactatttacctgttatctctatacaagatgtaaytagttaatgaagagaactatgtttggagtggttttgtgattttgccaaaatcttaagagcctttaaattctagaagaaagtctattaatgatattttctgtggcctttgaggaagccaattagagtttttgtaccttggtttttgaggaatgtggatagctaatactaaacataatgagaagaatgaattgaatgaaaagtgctttgaaaatggaaaataccaaacaaaaagagtcttaaaagtatatcttcatacatgaagctttctactccctgaaatgagaataaagatgcggaact

SEQ ID NO: 133601 - DNA, 601 bp, Human
ttagcaaactaactcaggaacagaaaaccaaatactacatgttctcacttgtaagtgggagctaaatgatgagaactcgtgaacacaaagaaggaacaacacacactggggcctacttgagcggggagcgtgggaggagaaagaggagcaggaaaaataactattggatactgggcttaatacctgggggatgaaataatctgtacaacacagccccatgacatgagtttacctatataacaaacctgcatatgtactcctaaacctaaaataaaagttaaaaaaagtaatgttttaaatktttaaaagtatatcaggcattcattctcttttattgctatctagtattccactgtatgaatataccacaatttccatactcattcacttttccatggaacattttattgtttctggttccgagttagtatgagtacaactgctccaaatagttatgtaaaaatctttatgtggacaaattataattttaaaatattagtcagaaaagtcctctttaatttgaacagaaaccctgaagaataagggagcattctaagtggctaactaggtatagagcatttcaggcaagatgaatagcatg

SEQ ID NO: 133602 - DNA, 601 bp, Human
gttaactgcacaagggagccaaactaaagggttgagtgggtggggacagaaatctggccttggatccagtcaccaaggaatgtgccctgcagtgggatgatgtccaccttaaggaaagaggtacctttctctaatcgacagaagtcccacatgggcatccctgttgcatggaattctgttgtgatttcttccagagctaacaaaggcacaggtatcttttaagaagtatgcatccagagatggttctgttcattttaatctgcagccattgcttcagtcttgatacccacagaacctgttwcttcattggcaaaataactcagtgttactagagtcaaataaaattttgcaatagctggccaggagtggtggcttatgcctctaatcccagcactttgggaggccgaagtgggcggatcacgaggtcagaagttcaagaccagcctggccaacatggtgaaaccccatctctactaaaaataaaaaattagctgggtgtggtggtgggtgcctgtaatcccagctactcaggaagctgaggcaggagaatcgcttgaacctgggaggcagaggttgcagtgagccaagattgtgccgctgc

SEQ ID NO: 133603 - DNA, 601 bp, Human
atcactgctggatgttaacaaatgggaagttgctctttgatactcaatgtcattcttccatctataagtgcctggttagctctaataaaaaaaaatagccaaagcgtgaatataaaataaagtatcttttccatattaatatcttcacactcacagaaaatccctgatagaaatgactgaagaaggtcatttctcagcaagaatatgggaaagtgttagggaccagatgttaaactttccttccaagtccaacatataaataaataaatatgtatatatacatgtatgtatatatatataagtgtatatatatattgcacatgatgttttaatgagttctgaagttttgaagatgagagcagtactttgtgtggttgacttggaaaagataagttatgtagatgatttcctcatatgttttccccctttattaccttgcaggattattctgaggattatgattgatttgagtaccttagtggaaagaaatactgtatgtcttgtagaccacagtaatcaatggataaatatatagtagaaagaaattctgaagacttgagcttgagtttctatgactttgcacaacttcttttcatgttca

SEQ ID NO: 133604 - DNA, 601 bp, Human
gtgaagattttattagctactgtgtaataaaatacatatgtaagatatgaattttgcctcccctataaaatttcccctcagcctctcattttgtgaagcatgctcaatgcattaaatgtgcttcagttgtaggggcagtaggattcagaaatagacaagtcagtgcattttctgttttcacctttgtacactgagcatgatttttcatctcaactcagtcaaaccctgattctttcctaacaatgccatatgtacttaacgccttaagtaatgtgcattcaaagaaggaagtatctagacyaatctgtccctgaagtgtgagtgataatgcaagtctaggttaattaagggaacttttatcttctcaaaatgtttctgtaagagaagcagaaatatttgggataaccatataaaaagatactgacatcatatactgtgcagtcaactctcatttcttttgctcctggcatgagggaaagggtatttgagaatcatgcctatagagtctcaggacctatgctggagaggttagcctaattaatcagactttgccaggagatgccatccctaataacctaagtgttctcaaagtgtggtcccc

SEQ ID NO: 133605 - DNA, 601 bp, Human
cactgggactgagaaatgtgtgctttagcaagtcctgggtgattccgatacacatgcaagtttgaggactactgtcccaagtcgccccccatatgtaatgaattatcttctctcctgtgcatctggaagtgccatccttagaagaataaagtgccatccctggaagaaacaaaaaaatagtctctcaaattgtgtttttcctgctgtttcaataaggaagttgtgaaaggttttccccaaacatctcttgtcagttgctgagccatttgctcccagccacatctgttcttttttctgtcarttggaccatgaccctatgttttcaaactttgtatcactcgtaaagggggagaaaagaaaaagaaaaccttttccattctactgcctttgttccctccctcctttcacagctaaaaattccctgcaagtagtctgaattagctgcgtccatttccttagttcattcagtccttctgtaattctttgcaatcttgtttctacttttattgtttctacttccacctttgaagggaaattattctacaactttgacccatctcctgcttgccaaatcggaagacctattgtcttcctctaggat

SEQ ID NO: 133606 - DNA, 601 bp, Human
taggttccctgccttagtccttctgcctctgatatcccgtataacaaatcccagattaatctttccagaatatcaattcaattatgtcatttccttgatcgttggccctcattgcctccagagtaaatccagccgtgcattccaggaccacacagcttccttgaaaatgtcaccattccaaatattctggtctcattaccttctctccatgaatccaaatcttactgaaggatttaagagccatctcaagtcttatttcttctaaaagaacatccagttctcagtaatggcttacttttcwtaaattttacagaaatttccctactgacatccattaagcttaaaaatcatttgagttttatgaaaataaaagggaatgctcctgagaagcctacatagtggcagaaactgagaaggatatgtggtagctttcttcccagtgaaatagtgacattcccagtgacaaggaataatttttctttgtttgccatcatcacctccaacagtgggtgaagaaggctccttgtgaggtcagctgatggatgtgtagctggatgaaataaccaaatctttgtaattactattaaccactgagtaaaca

SEQ ID NO: 133607 - DNA, 601 bp, Human
atgctgcataacactgtgttttagcagaaaggtcctctttcactttaggaagctcaaactgttttcaaccagtcaattccttatagagtgatttactaataatcgtgttagtgtcatcatgaaatatccattcagtgtaatttttaaaaaatgttaaatagctggctccagtaaggacagtccactaaaagagatgaacatatacccaattttcctgcttacagcttcttatgcccagaaacttctattttttttcctgctgagctttctagcttatctttagaatagagtcttttaggcytcttagccaaagctgttacgtatattaactgaatctgctttcaaactatgcaattacctacttgtgcgcctaacaattatcttctctcagcacttccggtctcatcagaaaataagaatatacctgccagagaatattaactgttttcctgtgttctcttgtccatctgactattccaagcagggaagcctttggatagctttgaataaaaactagctgtacttctggtgcaagatgaaacggctttcctgagcttatgtgcataaatgagcctatttgtgagacctcaactgatatctt

SEQ ID NO: 133608 - DNA, 601 bp, Human
gtaaacgctttatgacacttggtgaattaaataacatttctcttctaggcaccattcattcatttcacaaatatttatgaaagccctgctccaagccaggcatttcacagcccctggagagaatcatattctgaacccttgggagcccctcagggtaacagtagatgtgcaagacagacttgactcaaatggtcaccaaaaacgtcaatgtttctctctttacaggtcattttgagtatgaaaattgtatataaaaaattgttagtgcttccaaactgcataatggctctttcccgtattsacaccagattttgagggagttcctctgcccaacacatttattatgcaatttcccttattgacttagtgaccttcattgatctactcagcaaccagttttcttgttcattaatattatattagtatgaagtttttttcggttgaccagtctgcagtttaactgtagctagtcagcctctcttccgagcatctactttgagtgtttcatgaacagacattgtctctggagggtagaaattgaattggaaaaggaaacaaatttatggccttcataaagtctcaaggtgcttttctacttaag

SEQ ID NO: 133609 - DNA, 601 bp, Human
ctgaacccttgggagcccctcagggtaacagtagatgtgcaagacagacttgactcaaatggtcaccaaaaacgtcaatgtttctctctttacaggtcattttgagtatgaaaattgtatataaaaaattgttagtgcttccaaactgcataatggctctttcccgtattcacaccagattttgagggagttcctctgcccaacacatttattatgcaatttcccttattgacttagtgaccttcattgatctactcagcaaccagttttcttgttcattaatattatattagtatgaagwttttttcggttgaccagtctgcagtttaactgtagctagtcagcctctcttccgagcatctactttgagtgtttcatgaacagacattgtctctggagggtagaaattgaattggaaaaggaaacaaatttatggccttcataaagtctcaaggtgcttttctacttaagtggttaacaggcatgaagtgtttgctgtatctgattgttcatgttaatttatgtcctcatggttgttaggtggacagttctggaggaggggagagtgaaaacaggagccagagcagctgagtgcaagcat

SEQ ID NO: 133610 - DNA, 601 bp, Human
tctactcagcaaccagttttcttgttcattaatattatattagtatgaagtttttttcggttgaccagtctgcagtttaactgtagctagtcagcctctcttccgagcatctactttgagtgtttcatgaacagacattgtctctggagggtagaaattgaattggaaaaggaaacaaatttatggccttcataaagtctcaaggtgcttttctacttaagtggttaacaggcatgaagtgtttgctgtatctgattgttcatgttaatttatgtcctcatggttgttaggtggacagttmtggaggaggggagagtgaaaacaggagccagagcagctgagtgcaagcatgggcgctcaggtggggcacgtacctggtattgcagtgacagctcaaagccctggccctgtccaagtccccacctcccttctccacgcccccaacatgccaatcgaatctttcatcttatttccctaaactgaaataaaatgatgagttgtgctagtttaaaaccacttgacactagcatggggtatatttaaggactgatcggaggtagagctcctgacataacatctttggtaaaaatttcaatttccc

SEQ ID NO: 133611 - DNA, 601 bp, Human
ttttacaaaagatctccacagtttagttccttaagcccaaatttgacatttcttctgtatcatgtgagtacctctgtccctttttaattacccctcatgatgttacggaactaaaactaaatattcagaattgttcataaaacttatcaacttgtgatcaggtttttgataattttcattttgtttattttctggataagatgttttaaaatgaatatgcttactttttaatttaaaaaaataataaaaattgcagaagtacctgtataaaactcccacatttatccgtgccatagcaaartaggtttactttttttatttaatatgtcctatctggctaagtacctgatattaaagtaaggagaccttacattcatatgtttctttacacagattttctcacatagagctcagtgaacttaataatgtagatgagatagatcataacatccccaaacaaggaaattgtgtattattttctggtttgctaagaattatgtgattagcaaatcgcataattaaggcagtaattttttcaacctagcacagtgttcgtttttatatactatagtttatttgtcctctatgtgcatcaagttct

SEQ ID NO: 133612 - DNA, 601 bp, Human
attttctggtttgctaagaattatgtgattagcaaatcgcataattaaggcagtaattttttcaacctagcacagtgttcgtttttatatactatagtttatttgtcctctatgtgcatcaagttctgttaacatagaacatataaagaaacaagacccagttgctgtcatcaagcagtttataatgcagctggagtaaaaagacatatgctgacagagagagttaattggcaatgcaattgatggcacagataaaagtgcagtgcctgataacagtgtgtggtacatcaaaggcattcargaaatgatggatggatggagggatggatgatgaatggatgaatggatggatggatggacagaagggcagatggattgacaaattaattagttaccagagtagaaaggagaaaagttcactggtcacagatagtcaaatttcagtaaatgtcttttgactatttcattggtcagagagtacttcaagaaggaaaagatagactagccaggccttcaggaacttataagagtagggcttaactctgcagagagaaagaaagaggggttgtcaggccaagttctcagcctggacaaaggcagt

SEQ ID NO: 133613 - DNA, 601 bp, Human
gggtctctaagaggggccttcctaaagcaaaggtttggtgatgaggttgttttgcaagtagaatggaactacatctgagcacatcgcgacaatcaagctgatgtatttaagtaatccataagtatgggcagctacataaatgtttgcataaagtcattcatgtgatgataataaaaaatgttttagacaaaaactggaaatatgacatagtgttgaatgtaaagttataagagacagttcaataagaagtggagattttaagtgccaactggaattttaaagtatttttagaaagatctgacatgtatatattactgtatcagtcaagtattcctatatctaattgaagtttctgagacagttatgtcaaattcagctttagatcaataggtttgctaactgagaaccaaaagattcaaagacctgaagctggcataaaagtctagaggcctccaaatatttcctggataaagtttaataaattttgtatatgctagaagaaaggtaataatttatgtcttctaaggtagtcaacctaattactagatatgtcagaacgttagcatctcttgtatgtaagttcttcttgcactatgagaag

SEQ ID NO: 133614 - DNA, 601 bp, Human
agctacataaatgtttgcataaagtcattcatgtgatgataataaaaaatgttttagacaaaaactggaaatatgacatagtgttgaatgtaaagttataagagacagttcaataagaagtggagattttaagtgccaactggaattttaaagtatttttagaaagatctgccatgtatatattactgtatcagtcaagtattcctatatctaattgaagtttctgagacagttatgtcaaattcagctttagatcaataggtttgctaactgagaaccaaaagattcaaagacctgaagstggcataaaagtctagaggcctccaaatatttcctggataaagtttaataaattttgtatatgctagaagaaaggtaataatttatgtcttctaaggtagtcaacctaattactagatatgtcagaacgttagcatctcttgtatgtaagttcttcttgcactatgagaagtcatatacattgttacttctctttaaacctattaattattttatcttatgaaagcagtgatgtcatcacttaaatgcaagtgattaaacagtggggccctggagaaaaactacgtgcattaaaatctag

SEQ ID NO: 133615 - DNA, 601 bp, Human
aaaaaataagagataggggacatattttcacctgtggctcgatgaaggtctcagggaggggaaatttaagctttgaccttgaaggaagaagcgttagccgtagggacatcagcaacaacaacaaaagtacttcaggcagagtagtgtgtgcaaagtccccaaggtgggaaacttgaattatcccagaggttgaacctgatgccattgtggctgcagcctagtgttcaaggggaactgtggcacaggaggaagctagagaggaagatgagaacctatagacaagagggaagaatgtgctggwgggttatagagcaagggatgtgaaccccctttatgctaatccccaagcctccactgtaccacagtaagtggttctcacagtgtattccatagatcagctacgtcactatcacctgggaacttgttagaaatgcaaattcttgagatccatcccagacctactcaatcatacactctggggccagcaatctgtgttttaacaagctgacatcaatgcatactcagtttgagatctattaccttcatgaagatgaaagaaccttgttcctttttcacctctcccttgcatctttcccactaa

SEQ ID NO: 133616 - DNA, 601 bp, Human
aagagataggggacatattttcacctgtggctcgatgaaggtctcagggaggggaaatttaagctttgaccttgaaggaagaagcgttagccgtagggacatcagcaacaacaacaaaagtacttcaggcagagtagtgtgtgcaaagtccccaaggtgggaaacttgaattatcccagaggttgaacctgatgccattgtggctgcagcctagtgttcaaggggaactgtggcacaggaggaagctagagaggaagatgagaacctatagacaagagggaagaatgtgctggagggttayagagcaagggatgtgaaccccctttatgctaatccccaagcctccactgtaccacagtaagtggttctcacagtgtattccatagatcagctacgtcactatcacctgggaacttgttagaaatgcaaattcttgagatccatcccagacctactcaatcatacactctggggccagcaatctgtgttttaacaagctgacatcaatgcatactcagtttgagatctattaccttcatgaagatgaaagaaccttgttcctttttcacctctcccttgcatctttcccactaactggtaa

SEQ ID NO: 133617 - DNA, 601 bp, Human
tcggctcactgcatcctccacctcctgggttcaagcaattctcctgcctgagcctctccagtagttgggattacaggcacacgccaccacagccagctaatttttgtatttttagtagagacggggtttcaccatgttggccaggctggtcttgaactcccaacctcaagtgatcctcttgccttggcctcccaaagtgctgggattacaggcatgagccactgcgtgcagcccggaatctgaaatcttcatgtgcattttatttctgtgcttagacttgctgtgttctttcaaatctgaygtcttccattagtgtatgggaaacctgggtttagtactttaaatgtgatgtgcagctttgccacaataagtgtatgcaggtgcaaggaacataaggattcctcagcataggatcgctgggcacttcctcatgtcctcctcccactgcagacaaagagccctcagcaggccgcctgcagggtaattgcaggtacctgcctgaggtttctttccagcaagcaaaacttcagatacacaattacgtgattaatgaaagtctctccagctgtggttaccgaagctagggaaggcctttatttct

SEQ ID NO: 133618 - DNA, 601 bp, Human
agctctgcagaattattgctctgagcagctgaccctttccatgtgaaacagctgcacccagtcccaaaaccatgaatggccaccttccaaggcctggctcccccgttcctgctgtgcttgacactggtagcgtccctcctaccgaggcagctaaagaaagacagtttcttttggcactctatccatctggagtattctgaagctttcatttcattagaggaaacttctcctcaaaacctctcagtctctgacctagtggcaaggaggcctcatgccctctcaccttggccccatttcaaarcacattcccagaatggagagctgggaacaagggcatagaaaggggtggagaggaggtgaagcaaaggcctgctttggtcctggtgtccttcatgttggtatgcaaggcagtccgtctctgtggtggggaaaaaaaatgaagaggtcaggttttagaaggaatttgccagagatgattggtaagagcaataaatatttcccctgccagacccttgtctttttttcagagaagtcaagatttctcaggaggaccatgtaaagcaaagaacaaagattttttttttaaataagaattctgaaa

SEQ ID NO: 133619 - DNA, 601 bp, Human
aaaacaatgtttccctagcagaggtggtttgagatgcagatgttggcttcttgtggcagacttttcctcattttatctgtcctacccctctgggggtaggggtgattcttttcatcccgaattagaatttccaacactgcacacttaactagcctggcagccaacgtggaaaactccccaaggcctttgaagcagctcctctgctccatggcttactcacagcaggctgcgtgttggctcctgggagaaggaaccagaatctggaggctcacttggcatcacctctcctttgcaatgaaaraaccagagaccagacaatgaggatgaagcagagggggagagtccagaggacagtgctctccttttcagtattgacaaaatatacgtcctatctggggacctgaaactatggtcactatttatggttggctttccagaagtcctcatttacttagacatttcagtgaggaatttcttcagaattgtttatctcctcaccacaggaattccttgaaagtctgttttctgagaagtgctgaacacgttgatgtagtctgtgtgggccgtctggagcccctcagtggctccctgtcctggctga

SEQ ID NO: 133620 - DNA, 601 bp, Human
tgaactcctgtgaagaacagctgttggaggaggaacagtttccccaagcatctgcaggtgctaagcgctggaaggcactcagcagcattcagaactccagtccagcttgagctctgtgccccattagcccggcgtgcatgctcccctggcaagccccgtggatcattcagtgggtgtgtgccgtgggtcaatggagaagtcctagaatggactttcctttgctcttcccctgccctcccaccctcttggttctccccttggcctgtataccctgcctaacaaaaaggcaaattgaatattyacagcaagtgatttacttccataaagagcatggaggtcgagtgtgtagggagaagccaggtgggcttgggtcctttgaaaatgtttttagatgagagcaactttagatataagcctatatactatgacacattcaaagtctgcctgtgtcaaaatttttcaaacaaaagcttatcccagcagattctttcttcagctgcatctgttagaattataaaaagctgtctttttttttttttttttttttctgaatctcccttattgagttttagatttagcttagatgtactggccctctgtt

SEQ ID NO: 133621 - DNA, 601 bp, Human
tcccaccctcttggttctccccttggcctgtataccctgcctaacaaaaaggcaaattgaatattcacagcaagtgatttacttccataaagagcatggaggtcgagtgtgtagggagaagccaggtgggcttgggtcctttgaaaatgtttttagatgagagcaactttagatataagcctatatactatgacacattcaaagtctgcctgtgtcaaaatttttcaaacaaaagcttatcccagcagattctttcttcagctgcatctgttagaattataaaaagctgtctttttttttktttttttttttctgaatctcccttattgagttttagatttagcttagatgtactggccctctgttccaaattttggcctcgattgaaaggtgaaactttgcctccctttctaaatttaattacagatgaatatctctgcttctaattatggccttaaatggagagaaggtatactttctaatctgcaaaacctatggagtcctataattaaatatattttaaatgtagtgtttatgcttcagtcatttctgtcacttccctacccaaatgttcaatgacagactattgacatttgtaagg

SEQ ID NO: 133622 - DNA, 601 bp, Human
ccctcttggttctccccttggcctgtataccctgcctaacaaaaaggcaaattgaatattcacagcaagtgatttacttccataaagagcatggaggtcgagtgtgtagggagaagccaggtgggcttgggtcctttgaaaatgtttttagatgagagcaactttagatataagcctatatactatgacacattcaaagtctgcctgtgtcaaaatttttcaaacaaaagcttatcccagcagattctttcttcagctgcatctgttagaattataaaaagctgtcttttttttttttttkttttttctgaatctcccttattgagttttagatttagcttagatgtactggccctctgttccaaattttggcctcgattgaaaggtgaaactttgcctccctttctaaatttaattacagatgaatatctctgcttctaattatggccttaaatggagagaaggtatactttctaatctgcaaaacctatggagtcctataattaaatatattttaaatgtagtgtttatgcttcagtcatttctgtcacttccctacccaaatgttcaatgacagactattgacatttgtaaggcatca

SEQ ID NO: 133623 - DNA, 601 bp, Human
gcctccctttctaaatttaattacagatgaatatctctgcttctaattatggccttaaatggagagaaggtatactttctaatctgcaaaacctatggagtcctataattaaatatattttaaatgtagtgtttatgcttcagtcatttctgtcacttccctacccaaatgttcaatgacagactattgacatttgtaaggcatcatggtatataaatgcatctgtgggttgcagtaaaaattacacttttgcagtgaatgttttacattccagtaacacccaaccacgtgaaccttcttycttcattcaaaagaaggtacagcctttggagttagacagagctgggtttttcttgacttcactgatatctgtgtttcaatttagaaagcctaatttcctcatttataaaatagatgtaatagtatatacctcacagggttggttggtacacgtattaagatcacgtacagttacatacttagcacagtgcctagcatagtaagcacttaataagtggtaactcttatttacacagtgcttctccaagcacctggtacatgactctatcaaatgcagttggctgggtccctctcccaaaaa

SEQ ID NO: 133624 - DNA, 601 bp, Human
ttctgtagtggacataaataccatttgaatagtagtggatgattctgaaattaagatccatttacaattttagaaataattatatgataacacatagctgtcagtatttataaaacatcttgttatttagttgccataacatcacagaagaatgctgtggccttgatacattcactagactctttaagaggaagggaaataaagcttacagtaattatgtaagttatttcctgagttaattcctcaaaaggatatactacacttgatggtcatcttttctaccaggcttcatccaaagtartttatttggaaaccacttgcagggatagggctgtggggcaccattttaataactggatgcataatttgtgccatcgcatgcatatatcatttcatcgagcacgtgattatgaagtcaactttgacaggacagaatttcactgcaagagaagtggataaaggcatggagttaatgtacttaggctttcagcacactggctctgctttattgacattttacccacactaataatgttggcatgtgtctgatctcttcactgttggcacagcgtggatgttcacgctgggcattaagcttttt

SEQ ID NO: 133625 - DNA, 601 bp, Human
tgtaaagcccagttaggtgatacaacaaccattggtgcctgtttttttttccccatcaactctttcagcaaaatgtgatggttgtgtttggctgcattttcattcctctcctcaactcttatattcacatgaaattaatgaacattccaactctgaataatgtgaagagaccagggggtggaaaactgcttagccacatagacagagctcatttatgtttgggctttgaaacatttacttgaattctgatttgtggatatttcttcttggcagtcagtttatatttaatttttgtgcccgrtgtgatttgaaagtgattggtagcaatgaaatgactttcaaaggtggacaggaaagggtggaagggaagaaacgtagggtctgctaatccagcagtcaaatcattgacccatgagtgattaaaagttggctgaggttgtggaaacaagactgcccctcatgtgatggcagcttcaagtctcctttgtagtttttggatgtgaggcaatgagccaagtgttctgtctaaactgtttgggaactgcttttaagttcggcactcttggagaggtattatgtgacaagttattgcttcagtgcc

SEQ ID NO: 133626 - DNA, 601 bp, Human
gagtgattaaaagttggctgaggttgtggaaacaagactgcccctcatgtgatggcagcttcaagtctcctttgtagtttttggatgtgaggcaatgagccaagtgttctgtctaaactgtttgggaactgcttttaagttcggcactcttggagaggtattatgtgacaagttattgcttcagtgccctcaaatggcaccatggcctcaacgaattagagcttaagctggagctgtgggacttaaggaaggaagtggttctaaactgcttttctgcctctagccatttctatatcaacatattccctttaacaacatctctctgttagaaagggcagtttgaaaaagctcctcttccccttctctgttgtcttcttgcccaacatacacatgttgtgggtttttagtgagggattcaatggatgtaagttaagtatataatgacacagccatttcttcttgtccaagtctagtcttaagccataaacttgtgaaatgagctgattgtggttgttcagtggattgtagaatctccataaagtgcaccatcctttctctattgaggacccattccagtgggaaaatattcatgtaaaaagct

SEQ ID NO: 133627 - DNA, 601 bp, Human
aagagttctactcatctgtgtttgattcagcctttcccaaattttttgaccatgggagacctgagaatgctgcctaataattttcatttttctgtctttcaagggttcaggaacatatagcaggtgattttcctgtttattgcttttctctagggaatattgcaaagtgttagccatttacctatcacaatccaaaattgtgtttctgaaccctttagctttagaatcctgctggcattttagaaagagcctcagacacactgataaaatacgtttttaaaaaatcagagttctaatataytgttataagaagactgaactagttacttttatgtttagaagggcacattttctctcaatgggaagaggtacagagaaggtcaaattataaccaccagtttgtctggtaaacatgagattaaagcaaagagagttgatttgtgtgttctgaatagccatcaaactttagttaccataacgtttgttaccatttgtccccattgaaggagagaaatatcccagtaactggacatgattgcccctaagaaaattttagagatatttttcctctctgtttgcctcgctcacttgcaatatttta

SEQ ID NO: 133628 - DNA, 601 bp, Human
ctagttacttttatgtttagaagggcacattttctctcaatgggaagaggtacagagaaggtcaaattataaccaccagtttgtctggtaaacatgagattaaagcaaagagagttgatttgtgtgttctgaatagccatcaaactttagttaccataacgtttgttaccatttgtccccattgaaggagagaaatatcccagtaactggacatgattgcccctaagaaaattttagagatatttttcctctctgtttgcctcgctcacttgcaatattttactctttttttatttttttcagtgaaataatagatgaacatcattttttaaagttctatacaaaaaggacttgccccgtctttcactttccactatgtaggtttcatctttacagaaaatgtcttctgtatctttgggatatttatttgggtagtcaagtctatgctatatacctgcataagtgatgtgtttatttatttgagacagagtctcgctctgtcatccaggctggagtgcagtggcatgatctaggctcactgcaacctctgcttcctgggttcaagggattctcctgcctcagccccctgagtagtgggact

SEQ ID NO: 133629 - DNA, 601 bp, Human
aatgggaagaggtacagagaaggtcaaattataaccaccagtttgtctggtaaacatgagattaaagcaaagagagttgatttgtgtgttctgaatagccatcaaactttagttaccataacgtttgttaccatttgtccccattgaaggagagaaatatcccagtaactggacatgattgcccctaagaaaattttagagatatttttcctctctgtttgcctcgctcacttgcaatattttactctttttttatttttttcagtgaaataatagatgaacatcattttttaaagttctrtacaaaaaggacttgccccgtctttcactttccactatgtaggtttcatctttacagaaaatgtcttctgtatctttgggatatttatttgggtagtcaagtctatgctatatacctgcataagtgatgtgtttatttatttgagacagagtctcgctctgtcatccaggctggagtgcagtggcatgatctaggctcactgcaacctctgcttcctgggttcaagggattctcctgcctcagccccctgagtagtgggactacaggtacaccaccatacccggctaatttttgtatttt

SEQ ID NO: 133630 - DNA, 601 bp, Human
aatttttgtatttttagtagagacggggtttcaccatgttggccagactggtctgaactcctgacctcaggtgatctgcccacctcagcctctcaaagtgctgggattacaggcatgaaccgctgcacccacttatttcttaatatgttaattttatacattattaatgtctctttattcttgaaagggaatctgtttgttttctttcccttcatacttcatatctttcaggattccattgcaggaaacagaataattctagctatttcaagcaggaagagattttaaactgcaaattcgragctttggaaatccctggaaggactgaaagagcaggatctaggctgggatttcaggcataactccctgaactggataagattagtgggcagtctttttattgaagcataatttacctacaatgtaaattcagttttttatgtgaataattcagtgagttttgacaaatctgtgttgctgtatagccacacgccattactttcaacatataaaacaattctatcaccctcaaaaattccccatgcctcttttcctctctcctccccagcccctggcaaccactgatctgtttctttacgta

SEQ ID NO: 133631 - DNA, 601 bp, Human
tagtagagacggggtttcaccatgttggccagactggtctgaactcctgacctcaggtgatctgcccacctcagcctctcaaagtgctgggattacaggcatgaaccgctgcacccacttatttcttaatatgttaattttatacattattaatgtctctttattcttgaaagggaatctgtttgttttctttcccttcatacttcatatctttcaggattccattgcaggaaacagaataattctagctatttcaagcaggaagagattttaaactgcaaattcggagctttggaaatcmctggaaggactgaaagagcaggatctaggctgggatttcaggcataactccctgaactggataagattagtgggcagtctttttattgaagcataatttacctacaatgtaaattcagttttttatgtgaataattcagtgagttttgacaaatctgtgttgctgtatagccacacgccattactttcaacatataaaacaattctatcaccctcaaaaattccccatgcctcttttcctctctcctccccagcccctggcaaccactgatctgtttctttacgtataattttgcctttt

SEQ ID NO: 133632 - DNA, 601 bp, Human
ttgaattcacacatgcagaatccacagatacagagggccgactgtaccataatttgtttacacatttaccagttgatggacacttgagttgtttacagttttggggaattatgaacattcatatgaagtttttcgtgtgaacatatgtcttcatttatcttgtttaaataggtaggaggaggattgttgagttttatggtgagtgtgtgtgtaactttataggaactgtcaaactgttttccagagcctcgtatcattttgcactcctatcagcagtataagagagccctagctcctccaygtcttcaatactctgctgtcagtcttgtaggtagagtcttaacctggttttcctgatccccagtgggttctcccttccagatttgctattacatagccagccccaattctgtttctctgtggtaaaacaatgatttatatatatatgtatatatatatatctgcaaattggtgacatccaggatgcagaccagctctagtgcccagctgaacttgctaatggatacaaaaaacagtgtcgattgtggtattaactagaccctcattggatttgaaatatcgcacataacaatgttttgtt

SEQ ID NO: 133633 - DNA, 601 bp, Human
aaacatgacagcttttgattgatgtttcagaatacatgatccacatctctaaccagcttcccagactttctatgtctgtaaacaagccagcctgtccaccggcactgagttcaattgcatgatctcacaagaagagacaggcttccttagttatctatttctttttagttttccctaaatttacttttcagtttaggcaagacattgagctcggcccatgccagctaatctgggtaccaccaaagaaaatgatgatgatattcttccctgcatgagcccaagagccaaggaaaaagaaacscttcttgacatgtaaaacagaaattatgatgttaacaaaggtcttttcaggtaggctcagtctgtttctgcacacagcctattcccgtcttcatgctaacctgtaaagcttgtttataatataaaataagggaaagtacaaggcaacatggggtgagagactgtgttgcccattacagagccctacagagtggctcagcagtgaatgatctgtttgataactaattagcttcccacccatccatgaacacatctttagccatcagataaagtcctccttctcagtgctctgtccagtcct

SEQ ID NO: 133634 - DNA, 601 bp, Human
tcatctttgtttgccacagtggtcccataatcagggaggtcaaagccagaatggtggccaggtcacaatgaatcaggataaacgttttgttaaagagtatctgtgcccagctcacctccagaatgcagcctgaatatagtggtaaccaagtttttatcaagaaagcaaatgtttgtcaataaggcaggattgatagagaaaacatgcagattatagcccagagtttctagaccctttcacctcttcataatctacattagttcccaggatcttcctctctcctttcttcctctttgcagcrcatgcttattgccctgccatgaggttgcacagggtcatggcacataggtgaaacggaagcatggtgactgggctgtgatccattagcaggcatcactgctggactcttacaggacaagagaccccggagaaataaacactgtcaaatgtggcagttgtgtaccaaggaaggtgcagacataaagagtatgtttttgagcattttaaagttataaaactaactaaacgtgactctgttctttattaccaccagacaccagaaattctactctccatgataagcccaggctgctcctaaggg

SEQ ID NO: 133635 - DNA, 601 bp, Human
tcttcctctctgattaataagggttacatcagtaagcgaatagaaattcagttggatctgtagaattttctagcccaattaaatggtagactcatcccctaatatagaacttcctggctccaaactgaatttatatttatttattgtctcttgtcatttatttattattacaatacatattaagagcatttgagggtgttgttttgatttttggcacattgaacctatatacgcagattgcatttatgtgttagcaaggaagatggatttttctccttctgtatttacacagctatttcayaataacaggtttcaatattaattgcaaaatcatctataaaatttagcaaacagaaaaaggggtagaggagaaaaaaaaatgatggcccaaatatggcagttatttgaagtgaatcatagtagaggttctaaggaaataaaattacataataagtgaaatataaagagatgaattacacaggaaggatatccctagtgggcttatgatgtccttcagaaatggcacaaagggaaataatcaattttgagacagcactcttcaaagcacttagagggtaaacttttgcatccaaaatgatct

SEQ ID NO: 133636 - DNA, 601 bp, Human
attttgagacagcactcttcaaagcacttagagggtaaacttttgcatccaaaatgatcttaaataaaatgaactaaattttaaggtgactaatgattaggatgacctatagtgtccttgtattatatgcttcatttgtacacttgagagatgccataaggaaaatgcgttctcttttgcactgctacctaaaggcaatcagataggtcatcaatttccagcagtcattcacttcttatcactccctaatgcgtgttacttagaattctgggcctgaataataccctgattgtgaaaagcytggtcattaacaaatgagtccaaagaaaagctggcagagggcaaaccatacataaaccgattgtactggtccaatgtaaaagtcagaaaaaaatgcatgcatcacagaatgtgttcatttttaaatgtcaggctcctaaactcctagaaatgaataggagataattttgtatatggtttaaaaacacaggatttggaattggagtatgttttaataccaatctgtcctcttattgcctttgaggaagttaccaacctctgtagctctgtttcctcctctatatattgggactgttagtac

SEQ ID NO: 133637 - DNA, 601 bp, Human
tgatggtaggtgctcatagatgaaggaagctgacaagctgaaatccgtcactttctgagctagcccctgaccttgtctggattctatgcattcagccaaggtgagaggggttctgaggggcattctaccttcctaccagcatatgcctatgtttgtaatggttttgtcttaatcacttctgcttacggttgattccttttgagatcagttttactaactttaatgaaatggaggcacgtttcctttttttttttttttttttttttttttttttttactttttgcattgaacacaattttrtgaagctaagaaataagttaacaaataagaactaaactaaagcaaaatgttccttgtaagtgatccagactcatagaaggtgaaacacttgcctcaggtctcaaggcgttcctgcccagaaaatgctgttttgggccaagtgtggtggctcacgtctgtaatcccagcacttagggaggctaaggcgggtggatcacctgaggtcaggagttcaagaccagcctgaccaacatggtgaaaccctgtctctactaaaaaatacaaaaattagctgagtgtggtgggggccacctgtaatcc

SEQ ID NO: 133638 - DNA, 601 bp, Human
aagatgttacagagctaaagagggaaaatttggtcatgctgtgatttcattattatttctcaaggtaaattgaaagaatggtctttggtcctctacggcacctccgtgcagccatattcaccaaccaatgaatttccgaaagtggaacggttccgctatagccgagttgaagaccccacagacgactatggcacagaggattatgcaggtgagctggcttccagtgggacacaggctaaaaagaggcagctcatgcatcatcccaccacatgggagaacagaatggaatggaatggaatgraatggaatggaatggaatggaatggaatggaatggaatggaatggaatggaatcgaatcgaatcgaatcgaatagaatagaatagaatagaacagaacagaatagaatagaacagaacaatctactacccatattctgacatattttcttccccttaaatatttgtgtgtgtatatcagtgcactcatatattcaaatatccatatgtgttatctgcaaagctaatagtccatattgcgattgtaccataatatagttaatctgtaatctgggacatattgttcgcttacagaattttac

SEQ ID NO: 133639 - DNA, 601 bp, Human
catgctgtgatttcattattatttctcaaggtaaattgaaagaatggtctttggtcctctacggcacctccgtgcagccatattcaccaaccaatgaatttccgaaagtggaacggttccgctatagccgagttgaagaccccacagacgactatggcacagaggattatgcaggtgagctggcttccagtgggacacaggctaaaaagaggcagctcatgcatcatcccaccacatgggagaacagaatggaatggaatggaatgaaatggaatggaatggaatggaatggaatggaatsgaatggaatggaatggaatcgaatcgaatcgaatcgaatagaatagaatagaatagaacagaacagaatagaatagaacagaacaatctactacccatattctgacatattttcttccccttaaatatttgtgtgtgtatatcagtgcactcatatattcaaatatccatatgtgttatctgcaaagctaatagtccatattgcgattgtaccataatatagttaatctgtaatctgggacatattgttcgcttacagaattttacactattttaaacacggtttggataaacatcatta

SEQ ID NO: 133640 - DNA, 601 bp, Human
tgtgatttcattattatttctcaaggtaaattgaaagaatggtctttggtcctctacggcacctccgtgcagccatattcaccaaccaatgaatttccgaaagtggaacggttccgctatagccgagttgaagaccccacagacgactatggcacagaggattatgcaggtgagctggcttccagtgggacacaggctaaaaagaggcagctcatgcatcatcccaccacatgggagaacagaatggaatggaatggaatgaaatggaatggaatggaatggaatggaatggaatggaatsgaatggaatggaatcgaatcgaatcgaatcgaatagaatagaatagaatagaacagaacagaatagaatagaacagaacaatctactacccatattctgacatattttcttccccttaaatatttgtgtgtgtatatcagtgcactcatatattcaaatatccatatgtgttatctgcaaagctaatagtccatattgcgattgtaccataatatagttaatctgtaatctgggacatattgttcgcttacagaattttacactattttaaacacggtttggataaacatcattatttat

SEQ ID NO: 133641 - DNA, 601 bp, Human
aagaatggtctttggtcctctacggcacctccgtgcagccatattcaccaaccaatgaatttccgaaagtggaacggttccgctatagccgagttgaagaccccacagacgactatggcacagaggattatgcaggtgagctggcttccagtgggacacaggctaaaaagaggcagctcatgcatcatcccaccacatgggagaacagaatggaatggaatggaatgaaatggaatggaatggaatggaatggaatggaatggaatggaatggaatggaatcgaatcgaatcgaatcgaaaagaatagaatagaatagaacagaacagaatagaatagaacagaacaatctactacccatattctgacatattttcttccccttaaatatttgtgtgtgtatatcagtgcactcatatattcaaatatccatatgtgttatctgcaaagctaatagtccatattgcgattgtaccataatatagttaatctgtaatctgggacatattgttcgcttacagaattttacactattttaaacacggtttggataaacatcattatttatcaatctttgtctatatcttcattatttctttaga

SEQ ID NO: 133642 - DNA, 601 bp, Human
aaaagaggcagctcatgcatcatcccaccacatgggagaacagaatggaatggaatggaatgaaatggaatggaatggaatggaatggaatggaatggaatggaatggaatggaatcgaatcgaatcgaatcgaatagaatagaatagaatagaacagaacagaatagaatagaacagaacaatctactacccatattctgacatattttcttccccttaaatatttgtgtgtgtatatcagtgcactcatatattcaaatatccatatgtgttatctgcaaagctaatagtccatattgygattgtaccataatatagttaatctgtaatctgggacatattgttcgcttacagaattttacactattttaaacacggtttggataaacatcattatttatcaatctttgtctatatcttcattatttctttagaatagagttctgttttgagacttactgcatcaaagaggataatcagctttagggcttggaaacattttgtcacttgctatccagacaagatgtaccagtcttcactgtgaccagctatgtgattgtttattacactcattcctgccaacagaaaaaaataaagaga

SEQ ID NO: 133643 - DNA, 601 bp, Human
attcctgccaacagaaaaaaataaagagaaaaaaaagtaaaaaaaagaaagaggtgaacgttttaaaagtgttatagctttgattgcctgtaaatctaaacatttcttcctctgtagttctctgaattaaatacaactgtcttatccatttttctattcgaagtacagtaatcctcttatctccttgtgaacactctgtatgttattgtctctcacattgtttcgtctttgctgaaaacatattctcacttatcactgttaagttttgttttggtttgtgttgttttgacaaaaaaaaaaactattagaggctggggtttatggtctcagatataacactgatattttgcagaagttttatcctttaatgtctactgaatattcacatgctttgcttggtaatctcttattttttacatttggccattaattcatctggaactcattttggtttatgatatacagtgtcaattgaagctctgtctttagttattttccaaacagactaacatcattggccaagtaactatcccttctttttttattagtttaggatgcttcctttgtaacaatatagtaagttcttataccagcatctttt

SEQ ID NO: 133644 - DNA, 601 bp, Human
aggctggggtttatggtctcagatataacactgatattttgcagaagttttatcctttaatgtctactgaatattcacatgctttgcttggtaatctcttattttttacatttggccattaattcatctggaactcattttggtttatgatatacagtgtcaattgaagctctgtctttagttattttccaaacagactaacatcattggccaagtaactatcccttctttttttattagtttaggatgcttcctttgtaacaatatagtaagttcttataccagcatcttttctggttcygccttttctgattcatcaatctaataattctcaaaccaataccacccacactgttttgttttcatttcatgatgttatttttatatttgtagaacatctgcttcccatttccatagcaattattgccttattattcttccagatgaattttagaatgatttttaagtctccctttaaaagtctcattggaatttaatttgaatttatatgcagtcttatgggaagaattgtttttgcaacatacaatctttccatttaaaacatagatcatgtcccactttactgcaatcttttaatttt

SEQ ID NO: 133645 - DNA, 601 bp, Human
ttaatgtctactgaatattcacatgctttgcttggtaatctcttattttttacatttggccattaattcatctggaactcattttggtttatgatatacagtgtcaattgaagctctgtctttagttattttccaaacagactaacatcattggccaagtaactatcccttctttttttattagtttaggatgcttcctttgtaacaatatagtaagttcttataccagcatcttttctggttccgccttttctgattcatcaatctaataattctcaaaccaataccacccacactgttytgttttcatttcatgatgttatttttatatttgtagaacatctgcttcccatttccatagcaattattgccttattattcttccagatgaattttagaatgatttttaagtctccctttaaaagtctcattggaatttaatttgaatttatatgcagtcttatgggaagaattgtttttgcaacatacaatctttccatttaaaacatagatcatgtcccactttactgcaatcttttaattttatgtagttttcttcttgttagcgttacacctaagtatttttgggccttggtgctct

SEQ ID NO: 133646 - DNA, 601 bp, Human
atccttctaagatatgacatgtaacgcataatggacaaagcttctcctaatgaagaactgtttataggccaggtgcggtggcccacgcctgtaatcccagcactttgggaggccgaggagggtggattgcctgagctcaggagtttgagactagcctgggcaacatggtgaaaccccatctctactaaaaatacaaaaagaaattagccgggtgtggtggcacgcacctgtaatcccagctactggagaggctgaggcacaagaatcacttgaactcaggaggcggaggttgtagtgagcygggatcgtgccacttcactccagcctgggaacagagtgagactcagtctcaaaaaaaaagaaaagaaaagaaaaaaaagaactataaatacaagtttaatgtatctttagatgagaaatattttttcttgcagttctgaggttttcctctaaatactaaaaataaaagtacttcattaaccacctgaacagagtatcttaaatacacatgtagttacttttattctaaacagatagcatcctagaatcaataaacatgcttgaaattaagaccaattgagcttatcagagctggattgta

SEQ ID NO: 133647 - DNA, 601 bp, Human
aggcggaggttgtagtgagccgggatcgtgccacttcactccagcctgggaacagagtgagactcagtctcaaaaaaaaagaaaagaaaagaaaaaaaagaactataaatacaagtttaatgtatctttagatgagaaatattttttcttgcagttctgaggttttcctctaaatactaaaaataaaagtacttcattaaccacctgaacagagtatcttaaatacacatgtagttacttttattctaaacagatagcatcctagaatcaataaacatgcttgaaattaagaccaattgarcttatcagagctggattgtattagattttgtgatgttttgctttgagcctatagcattgctatttatattttaactagcaaactattttgtcttctcggataggagaaagtagatccaaaaaacataaatagagtataatagtaagctgttactctttattcatattttggtaatgtttcccattcaaattttggaatgttgagattcagaacagttatatatctttgtggtttttctgattatatctctaaaacatcaatattggcacttgtgagagaaccaagactattattgcatta

SEQ ID NO: 133648 - DNA, 601 bp, Human
cgggatcgtgccacttcactccagcctgggaacagagtgagactcagtctcaaaaaaaaagaaaagaaaagaaaaaaaagaactataaatacaagtttaatgtatctttagatgagaaatattttttcttgcagttctgaggttttcctctaaatactaaaaataaaagtacttcattaaccacctgaacagagtatcttaaatacacatgtagttacttttattctaaacagatagcatcctagaatcaataaacatgcttgaaattaagaccaattgagcttatcagagctggattgtrttagattttgtgatgttttgctttgagcctatagcattgctatttatattttaactagcaaactattttgtcttctcggataggagaaagtagatccaaaaaacataaatagagtataatagtaagctgttactctttattcatattttggtaatgtttcccattcaaattttggaatgttgagattcagaacagttatatatctttgtggtttttctgattatatctctaaaacatcaatattggcacttgtgagagaaccaagactattattgcattattatcctgcaacctacaatg

SEQ ID NO: 133649 - DNA, 601 bp, Human
tagagacacagatggcgttatcataaccagattcccgtactgtgtcattggatccaagggactgtgagatcacagctggctgaacttcagtccatagacagcagagacaccactcccctggtgtacgatggcagatggctaaaatgtcccaagttgcagtagctatggaatttggagatcgatttgaagctttggggaaaatagaaataagcagtgctgtcaaatgactcttgcagttaatcagaagtatattcgagtctgcagcattttgaaatgacttatttccattcagatggagaartcatccctagtacgtgatttgctacatctaagcaggaatttttacctaagtatcagggcctatgttgatcccctctcctcaccatgtgatactgggcaagccactgaaattcttggaaaatcagtttcttcatcagtaaaatgagggtatttgactaccagatttttctctaagtcattccacccgagttctaacatttttttatgtttctgtgattcagttaattatgaaacatagtcccataatgactcaaagaaaccaaggtgtaacagtaagtcctttgggttacaataagtagat

SEQ ID NO: 133650 - DNA, 601 bp, Human
ctatttgtacatttcattcaatatatttattgctagttaaaatcatatgaattttcagtgggaaagagtttgcagattatgagaccaaatgttccagaatatggagaacaaagaagagaattaaaaacttctataactagcccatgtcattagaaagtttttcatcaatcacaaaatagctccatctttctggcatttttttttcttactgttcattatcttcagttctataccaaagaatatgtagtaagagagattgggaactttcatcccaggtctggaatcctttaagcttgcttgygttttttttaaatttatatgtcattttcttttgttgaattgcccattggcctttgtgtaggatgcaattttaaatctattatctgtgtctgagactggatgctgataagcttgtgccaggtgctgtaatggtgtttcttcctggccacagtatttcagaggtattcagtagctttaatgagacaggtcatttggtccaggcgttaaataataatgcttttttcttttttgtcaacaacttctctcttttctacaaatccaatctttttactattacacatacttaattgcagttggtttt

SEQ ID NO: 133651 - DNA, 601 bp, Human
tgagctcagccatttgctcagcacctccaagagaatgctggggactggtttgctcatgacgctgccttctttcttattgtttcacaatgcaggatctgtgtctccagctgcccccctggccactaccacgccgacaagaagcgctgcaggaagtgtgcccccaactgtgagtcctgctttgggagccatggtgaccaatgcatgtcctgcaaatatggatactttctgaatgaagaaaccaacagctgtgttactcactgccctgatgggtcatatcaggataccagtaagctcacttcaratacttgggttttagagaagaaatgtggtgttttcatttgagtgacctcaggagggatagcctctttgtgaaatctggaattgtgcttcatatcaaacaggatctagttcattcattttaagagaaccctttagaagcttcatgtaaaaatgcttataactttgtcagagtatcctcaagaccacccccagattcagtgatttgctgggaatattcacaaggcctggggtatagtcgtgctcatgaactcacagataggagatattacagcaacaaatcatcaaagggaaaaggcatatg

SEQ ID NO: 133652 - DNA, 601 bp, Human
tcattcattttaagagaaccctttagaagcttcatgtaaaaatgcttataactttgtcagagtatcctcaagaccacccccagattcagtgatttgctgggaatattcacaaggcctggggtatagtcgtgctcatgaactcacagataggagatattacagcaacaaatcatcaaagggaaaaggcatatggaacaaggttcagccacacagggcatattcacttccccgtgcaacaatgcgtgacgacgtgcatgaaatgttgtctaccagggaacctcattagagactcagggcccasggttgtcactgggggctggtcagacctgacacataccaaaattccagagtcttcaaaggaaaataggtgttcaccataaaccatattgtttatacaaacagtttagacaaagtgagccactcttttcagggtagtgggaaccctcccaaaattcaagttcccagatgtgccagccatgggccaaccttacaagcagatttgctaaggacaacattcaggctgctcttttctgcacactgaccaaatagacaccaggcctgtatgatatcaaaatatactttttaaaaagttcaaaaaata

SEQ ID NO: 133653 - DNA, 601 bp, Human
ccctttagggcagtgggtaaggactctgcctttcttgcttgccccaaaatttagaacatgaaatttgacttgagggagaaaggagaaattgggagacagaagggggcataaagaatccacagaaatatgcagtattccttgtgaggaaaaaagtcaaaattctatcaggaaggttgagccttgaaaaagaaatttgattctggaatgttgtatgacagaaccaaggtaattgagagtccgttgtttccagagcctagaaggtagataattaaggtgttcaaactatgacttcagctaccasgaagtgttgatccaagtggtttgtatatctctctctttctatgtaattgccttatgttatagttttcctctctaatgagtccatttatgtacaacatgatgatcacatatgataatgactagtaataattactgccaacacatttacagtgcttaatagttcatatcgttcccttgaataattaattttatttaacttctcaagacaaccagagaggtgggtaacattgtaatctcattttaatgaataaaagaacagagaccctgaatttgcccactggaggtgcttaaagcagaatgc

SEQ ID NO: 133654 - DNA, 601 bp, Human
agtcaaaattctatcaggaaggttgagccttgaaaaagaaatttgattctggaatgttgtatgacagaaccaaggtaattgagagtccgttgtttccagagcctagaaggtagataattaaggtgttcaaactatgacttcagctaccaggaagtgttgatccaagtggtttgtatatctctctctttctatgtaattgccttatgttatagttttcctctctaatgagtccatttatgtacaacatgatgatcacatatgataatgactagtaataattactgccaacacatttacagtrcttaatagttcatatcgttcccttgaataattaattttatttaacttctcaagacaaccagagaggtgggtaacattgtaatctcattttaatgaataaaagaacagagaccctgaatttgcccactggaggtgcttaaagcagaatgcaaatctaggtcatctgagttaagattctatgcatgtgcagtgttctcaatgagacagtgagagagaccgtatgatgactactgttaagattgtaaggggcttcgtatttcatgctcagaggctcagacttgatccagcaggcccttgcagg

SEQ ID NO: 133655 - DNA, 601 bp, Human
gtcaaggattactttgcaggtaataccaatgaattatatttaatcccccgattcattccttggatggtcggaaattattcccttatctttattatttctctccacatacccaatcattctcttatcttaagtatctcaggcttggttccattatgctatggtatgcacatagatttaacaccaggagatgttttccttgaatggatgacttgctcattgctaaagctcaatagttggtcaactctctaagagaacaatgtacagctcaaattaactaggtagcctcttgatctcagtaggraaggtgagaccattctgcatttagtgaagagttggactgaggctgtacgtagaattagaactctgctgcactggatttcttttaagtattgatcatatctttatttccacctgtgattggaggtaaactaggcagggtccaggcagtttccaggcaggtacattcttcaccattaaccagtattggagcatcattttcatttagattaattatctatggcttcatttctttttccccccatgaatgcattcagtattagcttacttggcaattttcatctcaagacttcagtactgagaa

SEQ ID NO: 133656 - DNA, 601 bp, Human
tttggggcaagtcacttaactactccgagccttcattttctcctctataaaatgatgataataataatccctgttttgctggattatgataaaggttaactgtgataacatttacaaaatacctattctaccatctggcacatacttggttcatgagaaataaaagatgatttaaattattttatttcttagggaacattgtatagagtatgttaaaccagtgcatgccggtagaaacatgagagccatatatgtaattttaaatatgccagtaaccacattaagagaagtaaaaagatayaggggaaatgagtttaataaaatattttatttcacctcatatatctaaaatattatcatttcaacaatataaaaacttatcagatgtctttcattctttttcattgttgtactgtcttcaaaatctgatatatattttacccttagaacacatctcaattcagacaaaattgtttttatgagaaatatttgatctttatttaggtttcacagttgaaaaagaaaattttacatagccaagttgttccaaacgtacccaaatttttgccagtaatggaatcaagtgccaatttttcacatt

SEQ ID NO: 133657 - DNA, 601 bp, Human
tctcctctataaaatgatgataataataatccctgttttgctggattatgataaaggttaactgtgataacatttacaaaatacctattctaccatctggcacatacttggttcatgagaaataaaagatgatttaaattattttatttcttagggaacattgtatagagtatgttaaaccagtgcatgccggtagaaacatgagagccatatatgtaattttaaatatgccagtaaccacattaagagaagtaaaaagatacaggggaaatgagtttaataaaatattttatttcacctmatatatctaaaatattatcatttcaacaatataaaaacttatcagatgtctttcattctttttcattgttgtactgtcttcaaaatctgatatatattttacccttagaacacatctcaattcagacaaaattgtttttatgagaaatatttgatctttatttaggtttcacagttgaaaaagaaaattttacatagccaagttgttccaaacgtacccaaatttttgccagtaatggaatcaagtgccaatttttcacatttagacttaaattagttaaaattaaattaaataaaatgt

SEQ ID NO: 133658 - DNA, 601 bp, Human
tagcctttgtagagatggcgtctgactgtgttgcccaggctagtctcaaactcctggcttcgagtgatccacccaccttggcctcccgaagttctgggattacaggtgtgagccaccatgcccagccaaatatagtaaaaattttttatttgctttcaattttaagaattagcctgtagactgtgaaaaatatgatagctgacagaaattagaagggagagaaaaatatgcatttctcatttgacattctgacaactcattaaatactatctcatattgctaggtaaatagaaatttaaaaaggttatttaatatagtttagataactcccagaaacactaaataataatataacaacaaagaaaagtcaagatgattggggaaatagcagtacagttagttttgataaatttttcattagagtgtttaaaatgaataaatcaagaaatagaggcaaaagtattttaaatcttgttgttttgatgagaacctatagaagactaaaatcagaaacacttaaaatcagaatggctactccggagaatttgagctgtgggttggacaggatggtcgtacacttttactcagtcataattcattg

SEQ ID NO: 133659 - DNA, 601 bp, Human
ggattacaggtgtgagccaccatgcccagccaaatatagtaaaaattttttatttgctttcaattttaagaattagcctgtagactgtgaaaaatatgatagctgacagaaattagaagggagagaaaaatatgcatttctcatttgacattctgacaactcattaaatactatctcatattgctaggtaaatagaaatttaaataggttatttaatatagtttagataactcccagaaacactaaataataatataacaacaaagaaaagtcaagatgattggggaaatagcagtacagytagttttgataaatttttcattagagtgtttaaaatgaataaatcaagaaatagaggcaaaagtattttaaatcttgttgttttgatgagaacctatagaagactaaaatcagaaacacttaaaatcagaatggctactccggagaatttgagctgtgggttggacaggatggtcgtacacttttactcagtcataattcattgtaccatgtgttcctactgcatttataatcatgaaataactgttgaatttattatgtagtaagtctggatattaagaaattgttgggcttattgcta

SEQ ID NO: 133660 - DNA, 601 bp, Human
catattgctaggtaaatagaaatttaaataggttatttaatatagtttagataactcccagaaacactaaataataatataacaacaaagaaaagtcaagatgattggggaaatagcagtacagttagttttgataaatttttcattagagtgtttaaaatgaataaatcaagaaatagaggcaaaagtattttaaatcttgttgttttgatgagaacctatagaagactaaaatcagaaacacttaaaatcagaatggctactccggagaatttgagctgtgggttggacaggatggtcrtacacttttactcagtcataattcattgtaccatgtgttcctactgcatttataatcatgaaataactgttgaatttattatgtagtaagtctggatattaagaaattgttgggcttattgctagacaatgtgattgttttgtcaatcaaatactttttaaaacctctgggttgtaagatgttgcgcaaagtaggagtgtgcccatcagtctaacaaattaaggaggctgtccccgaagcctagcagcgtgtgtgtatgctacagatatcattgtaggcacagagaagcattataagcat

SEQ ID NO: 133661 - DNA, 601 bp, Human
tttaaatcttgttgttttgatgagaacctatagaagactaaaatcagaaacacttaaaatcagaatggctactccggagaatttgagctgtgggttggacaggatggtcgtacacttttactcagtcataattcattgtaccatgtgttcctactgcatttataatcatgaaataactgttgaatttattatgtagtaagtctggatattaagaaattgttgggcttattgctagacaatgtgattgttttgtcaatcaaatactttttaaaacctctgggttgtaagatgttgcgcaaaataggagtgtgcccatcagtctaacaaattaaggaggctgtccccgaagcctagcagcgtgtgtgtatgctacagatatcattgtaggcacagagaagcattataagcattgagaggagaaaaaaaagggtacacgggctatttccccggctttgaagctttgccaaatccactggcctctgagggaaactgtatctgttacatatggagtttggggagtcattacgttttggcctcatcacaacagtctgcttgaagctccctttatacttcttccagcctgcagggatcccggtgctct

SEQ ID NO: 133662 - DNA, 601 bp, Human
gtcaatcaaatactttttaaaacctctgggttgtaagatgttgcgcaaagtaggagtgtgcccatcagtctaacaaattaaggaggctgtccccgaagcctagcagcgtgtgtgtatgctacagatatcattgtaggcacagagaagcattataagcattgagaggagaaaaaaaagggtacacgggctatttccccggctttgaagctttgccaaatccactggcctctgagggaaactgtatctgttacatatggagtttggggagtcattacgttttggcctcatcacaacagtctgyttgaagctccctttatacttcttccagcctgcagggatcccggtgctctgtctcctgtgaagatggacggtatttcaacggccaggactgccagccctgccaccgcttctgcgccacttgtgctggtaccttccctagttcttttgtttattctcccggttctggttttgcttttctttctggtttgggccatcactcatgcaacccacttgatacttttaaagtaatgctggaaaagtttatttctcgtttgataattgtgtgtgtattctcattgaaagtcaagcagtcatcagcatc

SEQ ID NO: 133663 - DNA, 601 bp, Human
tttttccacttaaaaaagaaactcacagcatgcatcagatatgacatgctcaatattttggtggcattcattcatcttgaacttatgcccttaatggatttgtttgaattgcaaaaagaaataaatcagctacagtggcactggccaatatggctcaagttaatttttttaattaataaactttattttttgagagcagttttagattcataagcaaaattgagcagaaagttcagaaatttcccatataccccgttttccccacacaggcatagcttcccccactatcaacatcaagcaytagaggaatacatttgttacagttgataaacctacagtgacacatcattatcacccaaagtccacaatttacattagggctcactcttggttatatattctgtgggtttggacaaatgtataacaacatgtatgcaacattatagcgccatgcaaagtagttttactgccctgaaactcctctgtgaattacctactcatctctcccacccactactgattttttttttttttttacagtctccatagatttgccttttccagaatctgtataattggaattatacaatatgtagccttt

SEQ ID NO: 133664 - DNA, 601 bp, Human
ggcatttcaagagttgtaatgctttaactactttccctaaaccatggtgagcactggataagttatgtcaaatggcactttgctaaaagcggagtgtcaggcttgtgggctgaagtgggaaaagaagaatcatatctgcagtgagcccattttcaggtcagttacaaaatgagaatattgatggctcaccaggcttttgaaatcacatggcagctgcacttaaggatgtgttatttattctctttcaactgtcatatttctgtgattctaagacatatattttttacattttatcatctcrgaaatcagatgcatcttataatttgtggcagtttacaactgcttttgaccagaaaactgatgtgatatcagtgttactgcccagatatgagagttggatgcagagacatctgttcaaccgagttaggcacatgactacttcttcttgtgttgaatttaattcttcttcttgtgttgaatttaattgccgttctaaagaggtttgaaaattaaactattgttcaatattcgaaggaaagattcttgcataagcatggaaacaaacaaacagaatgttacataagtataacaaatactttta

SEQ ID NO: 133665 - DNA, 601 bp, Human
taagacatatattttttacattttatcatctcggaaatcagatgcatcttataatttgtggcagtttacaactgcttttgaccagaaaactgatgtgatatcagtgttactgcccagatatgagagttggatgcagagacatctgttcaaccgagttaggcacatgactacttcttcttgtgttgaatttaattcttcttcttgtgttgaatttaattgccgttctaaagaggtttgaaaattaaactattgttcaatattcgaaggaaagattcttgcataagcatggaaacaaacaaaaagaatgttacataagtataacaaatacttttaataagtctaaaattaaaattctaattgataagacaatattgtgtcacagtttaatatgaagcatcttttcctttgtgttacttaaaatgatggtgcatcttaaatcttgtgtcttagattcaatgaaatatggtataaatgactgtatactctctgctctaggtatctcaaagaagacaaatttcttgcttgtgttattaattgatttctaatttattctttttctaatctttttttttttttcacaaatggataccaattacattta

SEQ ID NO: 133666 - DNA, 601 bp, Human
aaaaagaacaatctgtgccaacggaaggttcttcaacaactttgctgcaaaacatgtacatttcaaggctgagcagccatcttagatttctttgttcctgtagacttatagattattccatattattaaaaagaaaaaaaaaagccaaaaagaaaaaaaaaaaaagcaagccacctctctctttcttttcttgctctctttttctttctctctctctcaagtttgtgcagggagatggtgaactgttttgtcagaacttaaatggaaaaaaaaataaaactacaacaagcctaccttttayaactgggtgtttagtgctaaacagccagaaccacagagacagtattgtatgaccaaagcatttgatgccaaaatttgacgttaaagtaatgatttgatttcctgccctggttttgaaggtccatttttttcccttttgcattgacttgcttgtttcccctttgaaacacctaaaaatacctttccaaaacatcgcgagagcatacatagacaaaaatgaaatagaaagctcttgcatgcttgagtccaccattgggggaaatgacagaaaactggacctgagggcattaggaacatccta

SEQ ID NO: 133667 - DNA, 601 bp, Human
tagaagaagttttttcatcttgtcattttaagaaaataaaactggaaattgaatatgggtggcatgattgtacccttttagttctcttatttttctactcctctgtccctctataactatgccatactattatatgctggtccactgaatgctgagatgatctgttttttggggttttttttttttaagaaatattttcactggttttctgtgactctctaaacacttcatcgaaactagaagactgaattatgaggaaactatttggattagtggccagaaacgatgaaatcttatagaycttttgacagtttctctgtttaggggagcctagactgatatcaagtttcttcatatcaaagcttcattggtgacctcatttgctttacaagtgaccagccatcttgcaggcttcatgcttctgagagccttacttagaagatgctgctggagtcacagctgaggagaggaatactatcaacatggactatcctgggaaagagctaggaagtagatgctgaggtccccatccaaacagcaagctaggaaaaagcctgccttgaaaatatttctagacatcaaagataacttacaacccaaa

SEQ ID NO: 133668 - DNA, 601 bp, Human
ttttttttttaagaaatattttcactggttttctgtgactctctaaacacttcatcgaaactagaagactgaattatgaggaaactatttggattagtggccagaaacgatgaaatcttatagatcttttgacagtttctctgtttaggggagcctagactgatatcaagtttcttcatatcaaagcttcattggtgacctcatttgctttacaagtgaccagccatcttgcaggcttcatgcttctgagagccttacttagaagatgctgctggagtcacagctgaggagaggaatactrtcaacatggactatcctgggaaagagctaggaagtagatgctgaggtccccatccaaacagcaagctaggaaaaagcctgccttgaaaatatttctagacatcaaagataacttacaacccaaagtgaataataagtaaatagtctgatgaccctcttaatagcattgcaattgtattgaatcacataatgattcataagtaactagggaaccaactgattttgctaagcagtcttccccttataacaccacaggcccttctgacacacaaaaaaatgaaagttaatcctgggtacagca

SEQ ID NO: 133669 - DNA, 601 bp, Human
atactatcaacatggactatcctgggaaagagctaggaagtagatgctgaggtccccatccaaacagcaagctaggaaaaagcctgccttgaaaatatttctagacatcaaagataacttacaacccaaagtgaataataagtaaatagtctgatgaccctcttaatagcattgcaattgtattgaatcacataatgattcataagtaactagggaaccaactgattttgctaagcagtcttccccttataacaccacaggcccttctgacacacaaaaaaatgaaagttaatcctgggtwcagcatacagttttacatttaaacgcacagtcttacgtggacaaatgcaagcacaagcctaaagcaaggtcaagcagatggcaaaaccgaatttgcctgcaaagaaatctatttaactgaatcagcccataatatttgaggcacgaggttactgtgattgataggaaagataaaaatgatgtctgtttttgtagacgaataaccatcaacatgacaacaaaattcattggggtctaccagcgtgcattccatttcccactgaccatgcaggtgcacgtcgcggaaatactggtttaacta

SEQ ID NO: 133670 - DNA, 601 bp, Human
tagatgctgaggtccccatccaaacagcaagctaggaaaaagcctgccttgaaaatatttctagacatcaaagataacttacaacccaaagtgaataataagtaaatagtctgatgaccctcttaatagcattgcaattgtattgaatcacataatgattcataagtaactagggaaccaactgattttgctaagcagtcttccccttataacaccacaggcccttctgacacacaaaaaaatgaaagttaatcctgggtacagcatacagttttacatttaaacgcacagtcttacgtgsacaaatgcaagcacaagcctaaagcaaggtcaagcagatggcaaaaccgaatttgcctgcaaagaaatctatttaactgaatcagcccataatatttgaggcacgaggttactgtgattgataggaaagataaaaatgatgtctgtttttgtagacgaataaccatcaacatgacaacaaaattcattggggtctaccagcgtgcattccatttcccactgaccatgcaggtgcacgtcgcggaaatactggtttaactactagtgtgttactgcctcatttatctacataacattatta

SEQ ID NO: 133671 - DNA, 601 bp, Human
ttgctaagcagtcttccccttataacaccacaggcccttctgacacacaaaaaaatgaaagttaatcctgggtacagcatacagttttacatttaaacgcacagtcttacgtggacaaatgcaagcacaagcctaaagcaaggtcaagcagatggcaaaaccgaatttgcctgcaaagaaatctatttaactgaatcagcccataatatttgaggcacgaggttactgtgattgataggaaagataaaaatgatgtctgtttttgtagacgaataaccatcaacatgacaacaaaattcaytggggtctaccagcgtgcattccatttcccactgaccatgcaggtgcacgtcgcggaaatactggtttaactactagtgtgttactgcctcatttatctacataacattattaactagaacataatgctttcaaagtttaagttaatgttatatattatgtataaatatatatattcataatgagatatatgtaatggatagtacaaagtttggagactcaacaaatgctctaaccttctagagacaaaagtcctatttctgttttcttttgtctttttattttcaattagtgacccatt

SEQ ID NO: 133672 - DNA, 601 bp, Human
agacaaaagtcctatttctgttttcttttgtctttttattttcaattagtgacccattgttaaatccaaatccacttttactgaaaaatactgtacatgtgtaaaatgttcagttgtttttttgtaaaatatagtagaacggttgtaactgatactggccaaaatcaatgttattccatattttattttttctattaaattaacctaagttcctgtttatttgatctgttcatacccacgtataaacttctctgaaagggtaaggtcatgagaaacttccctgtttctacatagaagctgmatatgaaggaaagggtggaggtgcatgaaacatctaaataaagttggaaaagaaagagtgagcagaggagggaattgagaaggagtgagaaacagcaatgtaagaaaggaatgggttagatttggtcatgaatatatattaaataccatctttagaaagcaaggctgtgaaaaaaaatccataaaggcttggtattgtttctatcagattgtacagatgctggaccccagaacagggcccacctggtcccattcttcctctagtgcgcagcacacccactagtatgtgtctgtagggtta

SEQ ID NO: 133673 - DNA, 601 bp, Human
gtgcatgaaacatctaaataaagttggaaaagaaagagtgagcagaggagggaattgagaaggagtgagaaacagcaatgtaagaaaggaatgggttagatttggtcatgaatatatattaaataccatctttagaaagcaaggctgtgaaaaaaaatccataaaggcttggtattgtttctatcagattgtacagatgctggaccccagaacagggcccacctggtcccattcttcctctagtgcgcagcacacccactagtatgtgtctgtagggttaggagccatggctgggggcaargaggtaggcagtgtaaaagctgttaaagaggaaggtggctttgttcaatttgctgacatcttgcgtaaagtcggcattggctggatgtctagaagatgatttttgtctaaaataaatctccggtacataccagggggtgggactgaacgagctagctaaaaacagcagtggagtatagatctttctgaaccgtgcctgagatgcaattactagtcttaaaggttcagtgctctgccttttggggaaaagaaattgtaaaccagccaaagccacaaacaaattgagctccaactaggttta

SEQ ID NO: 133674 - DNA, 601 bp, Human
gcactacaagcttcccaaggacttccaaaaatagcatgaaaccttaaaaatggagttgactctaaaatgtacaaataaaactgcaaagatcaaaatcaaatgatatctttattaaatatctacaaagtggatcatgtcaaactagtccactgcaactaagaaagtatacttacagccattgtcacttgacagcagggatatgtctgagaaacgcatccttaggtgattttgtcatcatgcaaacatcatagaacacacttacacaaacctagatggcatagcctaccacccacctaagctrtatgggatggcttattgcttctaggccacaaagctgtacagcatgttaccgtactgaatactgcatgcagttgtaacaaaatggtaagtatttgtgtgtctaaacatagaaaaggtatggtaaatatatggtataatcttatgggaccactgtcatatatacagtctgttattgaccaaaacgtcattatatggtacatgactataattaatgttaatgtagaataaaggtgaattttaatatgcttgatatgatgtgagacctgcagagattggagaatctaggatcttgagaatcttc

SEQ ID NO: 133675 - DNA, 601 bp, Human
acaaatggaaaatcagatttcatctctgtttactgagcataaaatctgaactccttacctgagatctttgtgctgtcacctcacaccaccatcccccatgccctcacatgttctagtcatgccaactttcttttcatccttcaaacaaaaccagcttgtttgggacccaggacccttgcccttcacatggctggcttcttctcatcccacaggtctcagttcaaaaataacttcctctgagcagttccttccaccactgaccccacacctgcccacctcgttttgactttccatagcactyaccacatgacattttatggttcgttacttgttgtcagccagccccgtgagagctggtgcttcatctgtcttgttcacagctgtatcttacatgtccagcacatgccttgcttaagaaatatttgtggaatgaatgaataagaaaacatccgagagaagtgacatttgacctgggccttgaaggataagcaagaaattaaaaatcaaagaaggttatgatgtttaagaaggatattcgagagagagaacctgagcaaaggcacaaagccattgaaagggtcctgtggacggcgatcacttg

SEQ ID NO: 133676 - DNA, 601 bp, Human
atcagatccaacaccaagtcaagacagttctacctcccaaatctcccagatccactttctgttcttcatctcttctgcccctatcctagtctaacactttggatcaagctacttctcacctgggatattgcagtatctcctcattagcctccctgaacacaccccatctgtccacagtcatgtgtcttcatcttcatctcctattccattttccacaacagccagaatgctctttttaaaaattcaaagctcagcatgagactccactcccctgtgacttcccagttccctaggataaaaytgaaattcctttccacggccttgaaggccagggtcaatctgacccacctctcctctctaaacttagctcacaacattctcttcttccccaagtattttcctgccacatttactttccctgattcttccattctgccctgcaccctagaacacccccacacatcactccccctcctttaatgttatctcacccgaatcatctatcgtctgggcctcagtttaaatgtcacctctttgattcctgatccttaacagagaaggttagatctccttagtgtaagctttctaggaagcctctaca

SEQ ID NO: 133677 - DNA, 601 bp, Human
tggatcaagctacttctcacctgggatattgcagtatctcctcattagcctccctgaacacaccccatctgtccacagtcatgtgtcttcatcttcatctcctattccattttccacaacagccagaatgctctttttaaaaattcaaagctcagcatgagactccactcccctgtgacttcccagttccctaggataaaactgaaattcctttccacggccttgaaggccagggtcaatctgacccacctctcctctctaaacttagctcacaacattctcttcttccccaagtattttsctgccacatttactttccctgattcttccattctgccctgcaccctagaacacccccacacatcactccccctcctttaatgttatctcacccgaatcatctatcgtctgggcctcagtttaaatgtcacctctttgattcctgatccttaacagagaaggttagatctccttagtgtaagctttctaggaagcctctacatttcttttatattaattttatgataaatatctagttacttgtaggaatatttgtctaatatatgtaattctcactacatagtttgtttgatgggggcaa

SEQ ID NO: 133678 - DNA, 601 bp, Human
atctgtcctcttccctctatccccaccatgaccgtcctaggttggctatcatcatcacttcccagaagcactctgtgaatcttctctagttccgcaaagaagctaaagtgacttttcaaaatgcaaatctaatcacaatgctctcctgctaaaacctgtggctactggggtaaatacaggatccattaacatgtcctgcgaagtctgatacccctacacccatctcaatttcatttttctttctttttctttctttcttctctcttccctctcctctcttctcctctcttctctctctctktctctcctctactctctccccccttctctggccttcctttagcctgtcccggtggccaagcctccccgcactggaccctttgcagacatggttccctaaggctagagtgctggaatcacaggtccacaattgtgtttgttcttatttgttggatgtctgagtcccactccagactctaagcatgagggcaggagtgcatttgctttttctcatcgttgcataccccataattagcacagttgctggcacaaatactagctcagtaaacagttttttaatgaacaaatgaatgaataaaaa

SEQ ID NO: 133679 - DNA, 601 bp, Human
ccaccatgaccgtcctaggttggctatcatcatcacttcccagaagcactctgtgaatcttctctagttccgcaaagaagctaaagtgacttttcaaaatgcaaatctaatcacaatgctctcctgctaaaacctgtggctactggggtaaatacaggatccattaacatgtcctgcgaagtctgatacccctacacccatctcaatttcatttttctttctttttctttctttcttctctcttccctctcctctcttctcctctcttctctctctctttctctcctctactctctccccscttctctggccttcctttagcctgtcccggtggccaagcctccccgcactggaccctttgcagacatggttccctaaggctagagtgctggaatcacaggtccacaattgtgtttgttcttatttgttggatgtctgagtcccactccagactctaagcatgagggcaggagtgcatttgctttttctcatcgttgcataccccataattagcacagttgctggcacaaatactagctcagtaaacagttttttaatgaacaaatgaatgaataaaaataccgtggcacagttgaagagg

SEQ ID NO: 133680 - DNA, 601 bp, Human
ataccgtggcacagttgaagaggcaggacaaataagatgttggtgcttcttttggtttgactcctacttgggggcagggagggcaagaattaaattatgtcagatggaaaacataaattcactggctggatcactgttgagttactgcaacctttgtgagtgtgtcacagactatgttggaagtagctgagcacaggaggagaaatcagaaattggttcagcaaaggggtcatctcaaaatatgctacaagtctaaggggttatataactaccaaaagctgaaaaattgtctttccacacyctcaccatatctatcatttctttaggtttgctgcctagaaagatctcattgtcaggtattttttcccccaccaaaatatataaacctcagtttgcagctatctcactactaggttagccctcactgtccctttccgtattcaaccctccacctcccgcttccagctctgtaggtgtaaaacacgatgatccagagctggagaatgaagacccgcctatgctgttcccacacagaacacagcgtgaggaggtggcgagacattcgcagaccatagagggccctcgtatggggctggggcaa

SEQ ID NO: 133681 - DNA, 601 bp, Human
gttgaagaggcaggacaaataagatgttggtgcttcttttggtttgactcctacttgggggcagggagggcaagaattaaattatgtcagatggaaaacataaattcactggctggatcactgttgagttactgcaacctttgtgagtgtgtcacagactatgttggaagtagctgagcacaggaggagaaatcagaaattggttcagcaaaggggtcatctcaaaatatgctacaagtctaaggggttatataactaccaaaagctgaaaaattgtctttccacactctcaccatatctrtcatttctttaggtttgctgcctagaaagatctcattgtcaggtattttttcccccaccaaaatatataaacctcagtttgcagctatctcactactaggttagccctcactgtccctttccgtattcaaccctccacctcccgcttccagctctgtaggtgtaaaacacgatgatccagagctggagaatgaagacccgcctatgctgttcccacacagaacacagcgtgaggaggtggcgagacattcgcagaccatagagggccctcgtatggggctggggcaacttgacctcagat

SEQ ID NO: 133682 - DNA, 601 bp, Human
tggttcagcaaaggggtcatctcaaaatatgctacaagtctaaggggttatataactaccaaaagctgaaaaattgtctttccacactctcaccatatctatcatttctttaggtttgctgcctagaaagatctcattgtcaggtattttttcccccaccaaaatatataaacctcagtttgcagctatctcactactaggttagccctcactgtccctttccgtattcaaccctccacctcccgcttccagctctgtaggtgtaaaacacgatgatccagagctggagaatgaagacccrcctatgctgttcccacacagaacacagcgtgaggaggtggcgagacattcgcagaccatagagggccctcgtatggggctggggcaacttgacctcagatgtctgtgccagaaaaaaaactgatgaacaggtacatcattcaggaatgtccaagctcacaaattctttatgaggccagcagaacttggaggcctgaaaccctcctccagaatctaactcataccccaccattctgtaatatgtattctctgggcttccatcactgaagttccgtctccctgtcttataagctccaaggaa

SEQ ID NO: 133683 - DNA, 601 bp, Human
actaccaaaagctgaaaaattgtctttccacactctcaccatatctatcatttctttaggtttgctgcctagaaagatctcattgtcaggtattttttcccccaccaaaatatataaacctcagtttgcagctatctcactactaggttagccctcactgtccctttccgtattcaaccctccacctcccgcttccagctctgtaggtgtaaaacacgatgatccagagctggagaatgaagacccgcctatgctgttcccacacagaacacagcgtgaggaggtggcgagacattcgcasaccatagagggccctcgtatggggctggggcaacttgacctcagatgtctgtgccagaaaaaaaactgatgaacaggtacatcattcaggaatgtccaagctcacaaattctttatgaggccagcagaacttggaggcctgaaaccctcctccagaatctaactcataccccaccattctgtaatatgtattctctgggcttccatcactgaagttccgtctccctgtcttataagctccaaggaatgtagggaccatgtctaacattgagaattccagatacaggcaggtgctttaaac

SEQ ID NO: 133684 - DNA, 601 bp, Human
caaaagctgaaaaattgtctttccacactctcaccatatctatcatttctttaggtttgctgcctagaaagatctcattgtcaggtattttttcccccaccaaaatatataaacctcagtttgcagctatctcactactaggttagccctcactgtccctttccgtattcaaccctccacctcccgcttccagctctgtaggtgtaaaacacgatgatccagagctggagaatgaagacccgcctatgctgttcccacacagaacacagcgtgaggaggtggcgagacattcgcagaccayagagggccctcgtatggggctggggcaacttgacctcagatgtctgtgccagaaaaaaaactgatgaacaggtacatcattcaggaatgtccaagctcacaaattctttatgaggccagcagaacttggaggcctgaaaccctcctccagaatctaactcataccccaccattctgtaatatgtattctctgggcttccatcactgaagttccgtctccctgtcttataagctccaaggaatgtagggaccatgtctaacattgagaattccagatacaggcaggtgctttaaacctgta

SEQ ID NO: 133685 - DNA, 601 bp, Human
taattattagacaattcagaaataaaatacagatgatgtttagccatgtcttactgaatgattcaaatcaaactcactctccaggtaatcggcagaatttctgactctgtgctggatccctccttcacctccctcctaaaccctctaccaagaggacatacaccatacccacccttccggatggcaagtttggaaatatgcttgcactgtgcacattggccactttctactactggtgctaagcaataacccagagtagcaagcagcctaagcctgggttgagatggcgacagtctttccraaggactctaaggcaatgagcatagagcaatggctgtcagacttgagtggccatcagaatcaccgggacagcctgttcaaacacagattcctatctgccacccccacctcagaatttgtaattcagtagatccgaggtggaatctgagaatttatatttctaataaattcccagttgatgctgatgctgctggtcctaccttgagaaccaccaacactggtgttaactacatagtcttagtaatgatactagaaagatgtgggttcaagtcccagctcagccacttagcatgtaactttg

SEQ ID NO: 133686 - DNA, 601 bp, Human
ttcccagttgatgctgatgctgctggtcctaccttgagaaccaccaacactggtgttaactacatagtcttagtaatgatactagaaagatgtgggttcaagtcccagctcagccacttagcatgtaactttggataaagtattaaatctctcaaattctcactttcctcatctataaaaagaaagtattaacagcagcaatgctgaggattaaatgggtgatgcatctggaagcatacgaaacatccccaccccagaagacagagcccctttccctgcaccacacccagtccctgctctscccaggctgccggtgcaactctccttaacagggctgctataggaacatttgagcagtgggcagggcacagctaattgtctccacttgcctctgtccagtggtgtcctgtccacaagggcaatgctaagatgagcatcagcccacctcacagagcgcaaacaaggctattgcctgatgcttctggaagaatggtgtttcacatagctttttgccctgagactaagagataaagtaattcatccaaaaccacacagctaataatggcagagctccagagttaggacaatgcacctgctgact

SEQ ID NO: 133687 - DNA, 601 bp, Human
tcagcttctagagctgcattcctggcattcttttgctcatgaccccttcctccatcttcaaagccagcagtagcctcgttaaatctctcactctacagtgagagagattagatcaccttcttctgtagtaaattctccttctgttttcctcttctaagaacacttgtgattatattggtgccaccctgataatccaggataatctccccatttcaagatctttaacttaatcacatctgggaaatcccttttgctgtacaaggtaatactcacaggtcccagacatgaggacttggatatmtttggaggccattttacggcctcccacacttggattttttgtctaattctctgagccaccatttttacttcagtgaagtggaaataataatatgtcctcatgagaacattaccatgtggtacacactaactcactgaataaatgtccgctggattgttgaatgcttcctgcaatactcttttgtgtgtatcttgcattaattcgttaactatttactcatctaacttttattaaacacttactatgtgttaagtactgagctgggcatagggaatataatataagggtatataaggatat

SEQ ID NO: 133688 - DNA, 601 bp, Human
attcctggcattcttttgctcatgaccccttcctccatcttcaaagccagcagtagcctcgttaaatctctcactctacagtgagagagattagatcaccttcttctgtagtaaattctccttctgttttcctcttctaagaacacttgtgattatattggtgccaccctgataatccaggataatctccccatttcaagatctttaacttaatcacatctgggaaatcccttttgctgtacaaggtaatactcacaggtcccagacatgaggacttggatatctttggaggccattttayggcctcccacacttggattttttgtctaattctctgagccaccatttttacttcagtgaagtggaaataataatatgtcctcatgagaacattaccatgtggtacacactaactcactgaataaatgtccgctggattgttgaatgcttcctgcaatactcttttgtgtgtatcttgcattaattcgttaactatttactcatctaacttttattaaacacttactatgtgttaagtactgagctgggcatagggaatataatataagggtatataaggatataatagaatacatttcct

SEQ ID NO: 133689 - DNA, 601 bp, Human
attcttttgctcatgaccccttcctccatcttcaaagccagcagtagcctcgttaaatctctcactctacagtgagagagattagatcaccttcttctgtagtaaattctccttctgttttcctcttctaagaacacttgtgattatattggtgccaccctgataatccaggataatctccccatttcaagatctttaacttaatcacatctgggaaatcccttttgctgtacaaggtaatactcacaggtcccagacatgaggacttggatatctttggaggccattttacggcctcccrcacttggattttttgtctaattctctgagccaccatttttacttcagtgaagtggaaataataatatgtcctcatgagaacattaccatgtggtacacactaactcactgaataaatgtccgctggattgttgaatgcttcctgcaatactcttttgtgtgtatcttgcattaattcgttaactatttactcatctaacttttattaaacacttactatgtgttaagtactgagctgggcatagggaatataatataagggtatataaggatataatagaatacatttcctccctttaca

SEQ ID NO: 133690 - DNA, 601 bp, Human
ctgcaatactcttttgtgtgtatcttgcattaattcgttaactatttactcatctaacttttattaaacacttactatgtgttaagtactgagctgggcatagggaatataatataagggtatataaggatataatagaatacatttcctccctttacagattttatactgtaataaagggatctaaatgagggagcaaatgccctgatgtgttaacacgtgttatgaaaaggaattagagaggatatgctctaccgaatgggttgtcagtcccctgggcaggaggtaggagtggaaggayagagctggagataggaggctggaaagggacagggaggtgtgagcacctggaaagtgccaggaatttttccctgatggagccttggggctgtcttagtctgcttcctgctgctataacagaataccacaaactgggtagtttataaaaaataggactttatttggctcatggtcctggaggctggaaagtctaagatcaagcagctgcatttggtgagagccttcttgctatatcataacatggtagaaggcatgacatggcaagaaagcgtacatgtgtcagagagaaatgggagccaaa

SEQ ID NO: 133691 - DNA, 601 bp, Human
tgtgaagtggtagtggtttccttaagtgcctcttgcctttgcctttcttcctcattgagaccttttatgatttatagtttcagaattttatttttagagcctcccattacagtgagccatcatctcccttgaacctctgtcaatctaatttataagtcatctgttcttaaaaatattcttatacctctggatcccatttaactctctaatctttgcagttcttttcatatgagaatgttcaaaaggtaaattcaccaaattaactattaggcagagaagaataattctgattgctcatgcrgtattttttttccaacctggatggttttgctgagaagtggattgatggtaactgtgatgtgaatttatttgaaaatgtttgctttcctggatgcatagtccttggtctattttatcccttcactttacctcctgaaacttagcacccctctctaatatatttttgtcaactgatatcattctctccatgaacttcaataaattggcagtgaacttctgtgctggaaagacattttgcattaaaaactggattcacagcaggcaatctgcctggggaccacatgtctaagaaagcagtcat

SEQ ID NO: 133692 - DNA, 601 bp, Human
gcgtggggggtggagaatatcgagtccaggagaccaattaggaagataaatccaccatatggtatagaaatgattgagctaaaagacatgggctggtgctggagatggggatgagcagatggaatggagagctgttcaggagatagaacagactgaaattgtgagggattagatgtgaggagggatcggggatgactccctggcgcaggctcccctgattggatgatggtggcactcacctagattggaagcacaggaggggtatcagtgctgggctaaagtggtaaggcttgttgaacayggtaagttggagatacctgtaaagtatccaggtggagaatccagtgggcaatagatgcaggattattgaactcaggagaaagatctggactgagaagaattgtttagaaaccactactttatggaagagatttaagggcagagaagcagaagaaattccaggatacataactgaaagtttgccatgtgggatgagttaattgaatgttactatcaacatccattcgtatgaagtcctttgctaagctagagatgacctggcacctatcatccctgggtattgctttgcctttatttctct

SEQ ID NO: 133693 - DNA, 601 bp, Human
ggggtggagaatatcgagtccaggagaccaattaggaagataaatccaccatatggtatagaaatgattgagctaaaagacatgggctggtgctggagatggggatgagcagatggaatggagagctgttcaggagatagaacagactgaaattgtgagggattagatgtgaggagggatcggggatgactccctggcgcaggctcccctgattggatgatggtggcactcacctagattggaagcacaggaggggtatcagtgctgggctaaagtggtaaggcttgttgaacatggtaakttggagatacctgtaaagtatccaggtggagaatccagtgggcaatagatgcaggattattgaactcaggagaaagatctggactgagaagaattgtttagaaaccactactttatggaagagatttaagggcagagaagcagaagaaattccaggatacataactgaaagtttgccatgtgggatgagttaattgaatgttactatcaacatccattcgtatgaagtcctttgctaagctagagatgacctggcacctatcatccctgggtattgctttgcctttatttctctctgcat

SEQ ID NO: 133694 - DNA, 601 bp, Human
tcaagtttaagtccatcaactcgactcctttttctccactcatttcctatatgcaggttgtcatcatttatcagtcataatgacatttattcaccatttgttatattccagacaaaccctgtgctaagtgcctttaaatactttatcaaatttagtcattacaacaactttctgaggtagggttatttttatatttttttgcacctatggaaacgagggttagaaaagttaagtagcaagcctaaaacaccacacagctagaaagtggcagagctggaatatggatctggctttcccagcyacttatgtaccatagtccctcctgcagagcattaaggatcttatctgcccctcctatatgtgacactttgaagtttccaaagcattgtcacaaagctatcatttgatcctccaagtggagcagagaactaggcaggacatgtatcattgtcatttccacagaagtgactaagccccacggggtttcaccgacctactcaaaaccatgcgtccatgccttggactcagatcttctctcttttcattattcccataaatatcattctttttgttcagagaagctgattcttctgtaatgacc

SEQ ID NO: 133695 - DNA, 601 bp, Human
cacttaaccacatcctccattctttcatgcccaaggcaatctgatttgcagttcaacaaacaaaaaaatggaatgaattcctcacacttaggaacaatcttccactcatacagtgaggccacggagaccccagaataagcaagagatggccctgtcctcggggaagagtataatcagaaccagctgctctggacaagacttagatttgaacacttgattctacattggctagttttcttgatagttgatgtgagctgattctatcccacaaagggtagaaagtgagccttcttccaacacyccacgccccatgcaagaaaatggtaggcaagcaaatagttccagattacatgattgaggagtctaggattgcatgtttgactttttccccacattcactcacacacacacacgtgcacacacacacacatatgtgtgtgtgcacgcagcccaccagtgatttgaatttctaggatattggaaggggggtgccatttaaacatgaaatctcatctctactactttcttgaaaaagggtatgtatagcaaaactctggttaaaagaggagagtttggagtctgacttcttggtttaagtccc

SEQ ID NO: 133696 - DNA, 601 bp, Human
tccactcatacagtgaggccacggagaccccagaataagcaagagatggccctgtcctcggggaagagtataatcagaaccagctgctctggacaagacttagatttgaacacttgattctacattggctagttttcttgatagttgatgtgagctgattctatcccacaaagggtagaaagtgagccttcttccaacaccccacgccccatgcaagaaaatggtaggcaagcaaatagttccagattacatgattgaggagtctaggattgcatgtttgactttttccccacattcactaacacacacacacgtgcacacacacacacatatgtgtgtgtgcacgcagcccaccagtgatttgaatttctaggatattggaaggggggtgccatttaaacatgaaatctcatctctactactttcttgaaaaagggtatgtatagcaaaactctggttaaaagaggagagtttggagtctgacttcttggtttaagtcccagctctggcaacagctaggtgaccttaacagaccactaatgtctcattgcctcaactttctcaacaacaacaacaaaaagcaggccttggggatgattta

SEQ ID NO: 133697 - DNA, 601 bp, Human
atagttccagattacatgattgaggagtctaggattgcatgtttgactttttccccacattcactcacacacacacacgtgcacacacacacacatatgtgtgtgtgcacgcagcccaccagtgatttgaatttctaggatattggaaggggggtgccatttaaacatgaaatctcatctctactactttcttgaaaaagggtatgtatagcaaaactctggttaaaagaggagagtttggagtctgacttcttggtttaagtcccagctctggcaacagctaggtgaccttaacagaccrctaatgtctcattgcctcaactttctcaacaacaacaacaaaaagcaggccttggggatgatttaaaaaacaagcagtatacaatgcctttctcccaacagggtcaagttattgtaaggatcaagtaagttagtatttgtggagcactccgaacaattcctagcatatggtaatcatgaaataagtgttagctgttcttattattactaattcagtgaccttggacagactgcttacatttcctgagccttggtttcctcatctgtaagaggagagcaatgctcacctccataaactggc

SEQ ID NO: 133698 - DNA, 601 bp, Human
ccctgcccattttggcaaactgtgaacagcagagagaggaattggccttccccaggaaaatttggggccccaggcacatcataccatgtaaaatctggttaagataaatatcaagagcagccttgaaagcaaaaagaagtcacagcaggtcagacagcagccagagggagtttgggaaggggaggagggcctgagtcaccagctctgcctgagatgatcactagaatcgagtttccagggaaaggcaggcttcctgagctgtggatgctaagcctgcctggtagctgcagacctaagccaggggctaggctttgaaggcccaggacccccgatatggggcccagacttgtttcactggttgcttgttccctagagatgctgctaaagaggccaccaaggggaaagttacttaactaattcaggaaggtgtggtggcctccaagggagacgctgagggcctgcttggggtgggcttgataataatggagagtggaggccaggtgtggtggctcatgcctgtaatcccagcactttgggagaccaaggcaggcaggcgatccttctctgtaaggatcacctggggtcaggagtgcaagaccac

SEQ ID NO: 133699 - DNA, 601 bp, Human
gaaagataaataagttattctgtcaaattatgctcacttatttctgtcaacatgtattaaaacttagatatcgcctcaccgtgaatgcatcagacactgtactgttctcaccactagggtgggccctctgcagccacaaatagaggagacagttggggataaaatcataactgatgaatagagagactgagtgcactagcaaacctgtagaaattctaggctcacaggaatagcaaaagacagcccactaaataaagagactgtcaagaagcatttcacacctaacatgagcaataaatgrattcccatccaccaacaacgtttttcatgattttcctcatccacaggttcaatgagaagctttgtaaatttattttgtttaactgcagacaataatcactctcagggctgggcatggtggctcatgcctgtaataccagcactttgggaggctgaggcgggcggatcacctgaggtcaggagttcaagaccagcctggccaacatggtgaaaccctgtctctactaaaaatacaaaaatcagctgggcgtggtggtgggcgcctgtagtcccagctactcggaaggctgaggaaggagaa

SEQ ID NO: 133700 - DNA, 601 bp, Human
cctgagcctcagtttcttgtttataaaagaggtttttgtctggattaaatattacatagaacagcacttgtaatacagtaggcatccatgaataggagcttgtatgattgctacatcactactacattcaggtgcgtcagccaagacttcactttggatgtacttttttaactgcctgactgtggtcaagggccaaacgacggtggaaactagaaagatcaactcttaattctgccctttgaacaacgtgtaggctgaaggaaactaaatatttgtgtgtgtgtgttggatccacaatttrcgatccatcctttttgcaggagtgccaacccatgaggttgccagagtagcatttcagagcatctgcacaaaccccacagatcaatgtcagtgcctgcctgagaatgaaaaagcaatgggaccaggaaggataagtcttgtcaatcaaaaacagaatatgcaggaaggacaagggcaagttgtccttgagagaatgggatagagaagagatttcctccagacacctccagggtagggatgtagaaccctctttctagctgcctaatgttcattctgtctttagtgcatccttgaggaaagg

SEQ ID NO: 133701 - DNA, 601 bp, Human
tgttggatccacaatttacgatccatcctttttgcaggagtgccaacccatgaggttgccagagtagcatttcagagcatctgcacaaaccccacagatcaatgtcagtgcctgcctgagaatgaaaaagcaatgggaccaggaaggataagtcttgtcaatcaaaaacagaatatgcaggaaggacaagggcaagttgtccttgagagaatgggatagagaagagatttcctccagacacctccagggtagggatgtagaaccctctttctagctgcctaatgttcattctgtctttagygcatccttgaggaaaggaagaagacagagttttccatctgccagatgtctcccttatcccaagttttattcatatatcaatttatttccattatcacaggaggtctcccaagcctcacttcaacagactggcttcccaagatggtggattggttgataccctttggacccatccccaaagacaggcaatactgattttgttttttggctaaaatgaagtattggcctgctaagacacaaactctttgtgtagatatttttttaaaaaaatattgtaaaatattcataatatatatttacc

SEQ ID NO: 133702 - DNA, 601 bp, Human
cctgcctgagaatgaaaaagcaatgggaccaggaaggataagtcttgtcaatcaaaaacagaatatgcaggaaggacaagggcaagttgtccttgagagaatgggatagagaagagatttcctccagacacctccagggtagggatgtagaaccctctttctagctgcctaatgttcattctgtctttagtgcatccttgaggaaaggaagaagacagagttttccatctgccagatgtctcccttatcccaagttttattcatatatcaatttatttccattatcacaggaggtctccccagcctcacttcaacagactggcttcccaagatggtggattggttgataccctttggacccatccccaaagacaggcaatactgattttgttttttggctaaaatgaagtattggcctgctaagacacaaactctttgtgtagatatttttttaaaaaaatattgtaaaatattcataatatatatttaccattttaactatttttagtgtgtagttctgtggcattaaatacattcacactgctctgcaaccattaccaccatccatctccagaccttcatcatcttcttccactgaaac

SEQ ID NO: 133703 - DNA, 601 bp, Human
acacaaactctttgtgtagatatttttttaaaaaaatattgtaaaatattcataatatatatttaccattttaactatttttagtgtgtagttctgtggcattaaatacattcacactgctctgcaaccattaccaccatccatctccagaccttcatcatcttcttccactgaaactctgtacccattaaataaccctttccccctacccttaggccctggaaactacaattctactttgtctctatcacttttactactccagttacctcatataagtaaaataatacaatattcgtgyttttgtgactggcttatttcatttagcatagtgtcttcaaggttcatccatgttgtagagtttgtcggaatttcctttctttttaaggctgaatgattgtgttgacttaaagatgttgcagtctcagttgatggcctcatagtttgagccttgctataaaactttatgcttaacaaagctttgaaaaacaactgatttcattagtacataagtagctgaaagtgttgctgagtatttattatagctggcgaaaaaaacatatagatgtttttaataaaaattatcttcacagaatggtat

SEQ ID NO: 133704 - DNA, 601 bp, Human
aaagggcttgggaaggtttaagttagcagaaaacttttgtagatcagacaaggattggagatgtgaggaagagattaaacacagaggaactggtggagaaatattctgaggaaagaagattataacagtagatggggaattgacaatagccaggaagagtggcagacctttcttttggagacagaagataagtaaaaagccaaagagaagacagagatgacttttgacattgagaaaaaaaaaagccaagggaactcagacatcttattgcaaatgaggaggtgatgtctccttttgcagragaatgggtggaacttgggctttgggatggcttggcctaccccaggtgggggatgcaagctagagattggaagagatgaatgaagggataatcgcacagtgacagggagtcacctaggatgatgtagacttatagtatggcataagaagctgtgtctggaggatgtatttaaaatcttggagatggggtaatcttttggggtcattatatctaaggcagcacattgtgagtgccaacagaggccattatagttgagtagattgaagacatgcaaagccagagtattaaagccacctactg

SEQ ID NO: 133705 - DNA, 601 bp, Human
gatgtgaggaagagattaaacacagaggaactggtggagaaatattctgaggaaagaagattataacagtagatggggaattgacaatagccaggaagagtggcagacctttcttttggagacagaagataagtaaaaagccaaagagaagacagagatgacttttgacattgagaaaaaaaaaagccaagggaactcagacatcttattgcaaatgaggaggtgatgtctccttttgcagaagaatgggtggaacttgggctttgggatggcttggcctaccccaggtgggggatgcaarctagagattggaagagatgaatgaagggataatcgcacagtgacagggagtcacctaggatgatgtagacttatagtatggcataagaagctgtgtctggaggatgtatttaaaatcttggagatggggtaatcttttggggtcattatatctaaggcagcacattgtgagtgccaacagaggccattatagttgagtagattgaagacatgcaaagccagagtattaaagccacctactggtttatgaaagccaatgagaaggcaaacaagagatacagaagaaaatttaaaattttca

SEQ ID NO: 133706 - DNA, 601 bp, Human
ataaagaaggctgcataactatgatgatgcctgtagtcagtgacacagtctcagcttgaaatcaccactcctgctagatggaggtcacagcttttttctgtctcagggctactggttaccaagaatgtaaccagtccagtcaacacctttgtatgagttaataaaaggtgtccctctacagaggcaggcgcagcctacaccagagtgcctggcatggtgaagcaaatgggctggatgtcagcctccactggaccattcgggtgggtaggcaccttgtgcagtgaacaacctgcatacctgytggtatgcctttgcccctgctggttatgcactcttttgggcctaggtctcctgggaagtttcctagtcagtcctgaagtaagaatcacagtcccattcccattctaaaaattgtatataagtttcccagtccaaactgtaccttggtaacaatgaggagacatagaggaacagagcccggggtgtgcagggtgtgctgtgattagatgtttgcatcactctgaacatgcacttttcccttctgttaacaaaatgaatagaataaccctacatgaaaggctttttctgctacataaaggca

SEQ ID NO: 133707 - DNA, 601 bp, Human
taccaagaatgtaaccagtccagtcaacacctttgtatgagttaataaaaggtgtccctctacagaggcaggcgcagcctacaccagagtgcctggcatggtgaagcaaatgggctggatgtcagcctccactggaccattcgggtgggtaggcaccttgtgcagtgaacaacctgcatacctgctggtatgcctttgcccctgctggttatgcactcttttgggcctaggtctcctgggaagtttcctagtcagtcctgaagtaagaatcacagtcccattcccattctaaaaattgtayataagtttcccagtccaaactgtaccttggtaacaatgaggagacatagaggaacagagcccggggtgtgcagggtgtgctgtgattagatgtttgcatcactctgaacatgcacttttcccttctgttaacaaaatgaatagaataaccctacatgaaaggctttttctgctacataaaggcaaactctagttgtctcttcacagtcatctttggggtttagtgctagcaagtgtaaaatttacatatataagatttacttacatgctagctgtaccagtccagtaaagcgatggggga

SEQ ID NO: 133708 - DNA, 601 bp, Human
aaattgtatataagtttcccagtccaaactgtaccttggtaacaatgaggagacatagaggaacagagcccggggtgtgcagggtgtgctgtgattagatgtttgcatcactctgaacatgcacttttcccttctgttaacaaaatgaatagaataaccctacatgaaaggctttttctgctacataaaggcaaactctagttgtctcttcacagtcatctttggggtttagtgctagcaagtgtaaaatttacatatataagatttacttacatgctagctgtaccagtccagtaaagcratgggggaaagagggatgaatttccctcatttcctcaccagtcaagtctaggtttccagggttcttttcaatgcaactatgctaaatcaggcagtgaatcttggagttgcagtaagacaacgtgattaaaccctgggcgggtcctgctatctcaccccaccagctggatctcagattgacagtgttcagacatggcttatgggggctgtcagagttggagggggttgaggtccagtggaggttgtgtctctgccaaaatctgaaaccatattttctgggcatgaccagtctctaaaccag

SEQ ID NO: 133709 - DNA, 601 bp, Human
acttttcccttctgttaacaaaatgaatagaataaccctacatgaaaggctttttctgctacataaaggcaaactctagttgtctcttcacagtcatctttggggtttagtgctagcaagtgtaaaatttacatatataagatttacttacatgctagctgtaccagtccagtaaagcgatgggggaaagagggatgaatttccctcatttcctcaccagtcaagtctaggtttccagggttcttttcaatgcaactatgctaaatcaggcagtgaatcttggagttgcagtaagacaacktgattaaaccctgggcgggtcctgctatctcaccccaccagctggatctcagattgacagtgttcagacatggcttatgggggctgtcagagttggagggggttgaggtccagtggaggttgtgtctctgccaaaatctgaaaccatattttctgggcatgaccagtctctaaaccagaaaaagtggctctgtggatctgaccaaagaagcctgtcaattttttttaagacaatagcaggttaggatgagtgcaatgagggttggattcagtgagtagaggcccatctttgagtctatga

SEQ ID NO: 133710 - DNA, 601 bp, Human
gcaaactctagttgtctcttcacagtcatctttggggtttagtgctagcaagtgtaaaatttacatatataagatttacttacatgctagctgtaccagtccagtaaagcgatgggggaaagagggatgaatttccctcatttcctcaccagtcaagtctaggtttccagggttcttttcaatgcaactatgctaaatcaggcagtgaatcttggagttgcagtaagacaacgtgattaaaccctgggcgggtcctgctatctcaccccaccagctggatctcagattgacagtgttcagwcatggcttatgggggctgtcagagttggagggggttgaggtccagtggaggttgtgtctctgccaaaatctgaaaccatattttctgggcatgaccagtctctaaaccagaaaaagtggctctgtggatctgaccaaagaagcctgtcaattttttttaagacaatagcaggttaggatgagtgcaatgagggttggattcagtgagtagaggcccatctttgagtctatgagatttactttccatgagattggcctccctctgccacctttgctgtgggagtaatttcttaaaatgttt

SEQ ID NO: 133711 - DNA, 601 bp, Human
ccatgagattggcctccctctgccacctttgctgtgggagtaatttcttaaaatgtttccaagaaacttgtgaggctggatttgcttctgttgcagggccccatatgtgtttttccttgggaaagataaaatttccaattaaaggaagaattccctggctatttcttcactattactctttcagagtgagatgtagcttacaatcacccaatgtcagccaagactcagcacccattcttgaccagtaaccatgattaccacacctctaccccatggggtggtaagaaaagatctaggtggktcctgctcattgcttgacttgaaccaagactatacggccctctgtggaccaggagacctcagcttttaatggaaaagtcagcaggagttcagtaaaggggtctggtgggaagccccgcttggccttccctacttataaaatctgtaacacatgttgactagattcagaaatatgtcattgcctcataactttttgaggttccaacttctggagcccccgggagaggagcagttgttatgataaggtcaggatttgggactagcagctgaagccattcagggcctctcctctctgtgttgt

SEQ ID NO: 133712 - DNA, 601 bp, Human
gtgtgagctcatggattgcagggtggagagaggaggtgctcaccatcttagcagcacctcatgggcctgcagtgaaaaagaagcaaactctttcccactccacagatattctccttggtctgggcacagcccagctctgtagtatcctctccccatgacgcccagtccccaccacaaggaccagttccctggacatggaacagatttcctcatcaatcaatagggtgcctttgatgcctgaaatctcatccttttctgcatacccgtccctcaatcatcatttccatctgctggtcaagtrtctacttatttctagagtcagttcaaaagtgaactgttcttttttttttttttgagacagagtcttgctctgtcacccaagttggagtgcagtggcgcgatctctgctcacggcaacctccgcctcccgggttcaagcaattctcctgcctgagcctccctagaagctgggattataggcgcccaccaccacgcctggctaacttttgtgtcatttagtagagatggggtttcaccatgttggccatggtgggttctatgtctgcttcctctcctatttctgaatggtcttgacctcctg

SEQ ID NO: 133713 - DNA, 601 bp, Human
tcatttacaaagctatctcttcattagactgtaagccacttgagatactcatctttgatctctagtacctaccacagttcggggataatagcaggcactcagtaatgtttgctaactgagttaatgagggaatagcaagtatgcaaatggaatgagcatctttgctaatacactgggaatttctaataaagaaagctggaggcctgttttattttcagtcaatgctcctctgagcctagcactgaatattttttggctaccgagtatttcagtgaatggcctcatcactgccctgcccaaygcaaaggaagcaggtctcttgcaggcaagggtgatgaggctgctccagtggcaggcgctttgcatctctgggatggacatgccctctgctttgcattatggtcattttgtcctacttctgcaagactataatattcttgcaagcgggtgctgtggtgtgttttttcctttattccccacagtgatcaacacataattcaataaatgtgctttattgaacttgatgaagtgtggaatcaatatcataggtttggctctccaaatagctccctcagaaagaggaaggaagaaaggaaagaat

SEQ ID NO: 133714 - DNA, 601 bp, Human
gatctctagtacctaccacagttcggggataatagcaggcactcagtaatgtttgctaactgagttaatgagggaatagcaagtatgcaaatggaatgagcatctttgctaatacactgggaatttctaataaagaaagctggaggcctgttttattttcagtcaatgctcctctgagcctagcactgaatattttttggctaccgagtatttcagtgaatggcctcatcactgccctgcccaatgcaaaggaagcaggtctcttgcaggcaagggtgatgaggctgctccagtggcaggmgctttgcatctctgggatggacatgccctctgctttgcattatggtcattttgtcctacttctgcaagactataatattcttgcaagcgggtgctgtggtgtgttttttcctttattccccacagtgatcaacacataattcaataaatgtgctttattgaacttgatgaagtgtggaatcaatatcataggtttggctctccaaatagctccctcagaaagaggaaggaagaaaggaaagaatgaataagagaaggaaaagaggaaagaaggaaggagaaaggaccgaagaagacacaa

SEQ ID NO: 133715 - DNA, 601 bp, Human
ccacagtgatcaacacataattcaataaatgtgctttattgaacttgatgaagtgtggaatcaatatcataggtttggctctccaaatagctccctcagaaagaggaaggaagaaaggaaagaatgaataagagaaggaaaagaggaaagaaggaaggagaaaggaccgaagaagacacaaaggaacagttttaagaatttttaatgctaaccatgagcatatttttccaagtgtctctttaaaataactatgcctctaaatattgaatttgctttaaagaagcatcaggacttactctamgatacagatagcattctcaaaatgaggttctgttttttctccaattccccaccataccaacaatcaaatgccaatgcatgtttggacgtcttttgaactaggggaatattttaacatttgtttaataaggcagctaccacccttcttttacaattttataaaccactgggtttagctccttaaagacaattaaaaacctggagaaagcaagtgacctctttgccactgtatttaacatgcaaagctctgtgatgccaggatcctcattgcccaacctaatttccctgcccagtcctgaag

SEQ ID NO: 133716 - DNA, 601 bp, Human
tgttaagatcatctctgcccagctgcttagcacttggttccactgcattctccctttctttcagccctgtttggtctggaatggttcacttcctatgaaaaggtcaagagctggcatgagttggggaaagaagctcttcccctgcagagatgagcttgcctgggcatctcaggaatccatgaattggatgactggtggtcccagagatgccttgagttggctttaaggaacattttcatcagacccattttctacttttatagagaaaaatatctattctcttccactagggaaaatttgytggtgtctgttgaaaactgtggccatttgaaatgggatttttcttcaagtttcttagcaatattttggggggaggttggagaatgtggggtgggtcgtggtgacataactcagtgccttcacttaagcataactgtcttccctatctttctatctttagaaataatcatcctcttacaaaaactggagatctcacctatgcttttgttagggtggacatggagggaatggtttaaagcataattatgtgattgatatgttcctcaaatcaagtcaaaaagacagcccctttcctacataa

SEQ ID NO: 133717 - DNA, 601 bp, Human
gaacatgagggcctaggaatccaagagagaggtggacttctctcttaggttgtcggcttgaatcccattctgcctccaaacagatgcaaatgacacagactttcagggtatgggaatgaatgagatggaagactgcaagtgacatactattcaggatgccttgtcccacccaaccttcttccaaacctgggattgaaatggcccaccccccagttcagggttggttctagctctggaaacagtgaagtttaaacaagccagtgccaatacaggaacaaggtgcttgaggcctacatctgayctttcgtgtggtgtccagcataagtggagaggagtagtagagagaaaaagacatccttccctttcttcgcaggcccactcagatgtcccaggcctggatggcagcattatgcccacgggagcttgcgtatgctatgtgctcagtgaacctcacaattgatacaataacttattctaagggagctgtaagagatgccaatttgatgtcacctgtattacataggaatcatttagcgaattccacagtaatccagactgtcactgagcagcggatctcaaagagtgctcaccagaccagcag

SEQ ID NO: 133718 - DNA, 601 bp, Human
gagggcctaggaatccaagagagaggtggacttctctcttaggttgtcggcttgaatcccattctgcctccaaacagatgcaaatgacacagactttcagggtatgggaatgaatgagatggaagactgcaagtgacatactattcaggatgccttgtcccacccaaccttcttccaaacctgggattgaaatggcccaccccccagttcagggttggttctagctctggaaacagtgaagtttaaacaagccagtgccaatacaggaacaaggtgcttgaggcctacatctgatctttcrtgtggtgtccagcataagtggagaggagtagtagagagaaaaagacatccttccctttcttcgcaggcccactcagatgtcccaggcctggatggcagcattatgcccacgggagcttgcgtatgctatgtgctcagtgaacctcacaattgatacaataacttattctaagggagctgtaagagatgccaatttgatgtcacctgtattacataggaatcatttagcgaattccacagtaatccagactgtcactgagcagcggatctcaaagagtgctcaccagaccagcagcactgg

SEQ ID NO: 133719 - DNA, 601 bp, Human
tcccaggcatcccccttgtttctggaacaatgaagtcaaatctgtccagcaaacatgaataccacatgttctgatacttagggccactctggaaagtcaccctgatgaattctaaaagtctgcttttcctctaggatttttgatgatggccgctgtgtttcgaactgcccctcatggaaatttgaatttgagaaccaatgccatccatgccaccacacctgccagagatgccaaggaagtggccctacccactgcacctcctgtggagcaggtgagagactgctgctcctccgtcttctgsaccccaaacctgttcctcttctgatggccatcatttggtttgacccaaaagccttgtgtctggggctgagggttaagatcagacagctgttcactggagagcgtgtacaaccttgaactttctgcttgctgtcagtacacaaaaagcttgttcaccttattcgggtgtagactcggtgccctggaaaagatgagaaagcagctaagagatgcctttccagagaaggagagagaaggacgtagaagcatgaggtcagacatgagatagacagtgaagttaagatttgtggaggtaaaagtg

SEQ ID NO: 133720 - DNA, 601 bp, Human
cccttgtttctggaacaatgaagtcaaatctgtccagcaaacatgaataccacatgttctgatacttagggccactctggaaagtcaccctgatgaattctaaaagtctgcttttcctctaggatttttgatgatggccgctgtgtttcgaactgcccctcatggaaatttgaatttgagaaccaatgccatccatgccaccacacctgccagagatgccaaggaagtggccctacccactgcacctcctgtggagcaggtgagagactgctgctcctccgtcttctgcaccccaaacctsttcctcttctgatggccatcatttggtttgacccaaaagccttgtgtctggggctgagggttaagatcagacagctgttcactggagagcgtgtacaaccttgaactttctgcttgctgtcagtacacaaaaagcttgttcaccttattcgggtgtagactcggtgccctggaaaagatgagaaagcagctaagagatgcctttccagagaaggagagagaaggacgtagaagcatgaggtcagacatgagatagacagtgaagttaagatttgtggaggtaaaagtgaagacctgggga

SEQ ID NO: 133721 - DNA, 601 bp, Human
tcaatggaaggaatgttaagaccagcagtcagaaaatgtgggttcaagtcccgcctttgttactgacgagaaggtactaaaccagtcacttcacctctttatgcctcttcttatttgcaacaaaaaaaaagaagaagaagaagaagagaaagtacaagatggcatccaaaatcacttttacatctccatatatagcacaaaattagaaagaagtttagataccaaacaaatgtctagtcttctaagcatcctacaactacttggaccaatctacctataaatgcactgacatttcttctatttttttttctatttgaaattgtgtttaatccattatcttaaacatttattgcatcccttctatttacaagttactatgccctgaatgccagagaaaatgagataaatgatagcatgatactcatgttcaaggaattacagtctaacaaggaggtttgtcctcatatgttacaaaacaagaaaataatagatgaagaccaaatgcatggtagaaatcctatcccagatcagagaagcagcatcacttccagctgtaatgagcagagaaggcttcctcgaggtggggtgttgtttaccaagc

SEQ ID NO: 133722 - DNA, 601 bp, Human
acttggaccaatctacctataaatgcactgacatttcttctatttttttttctatttgaaattgtgtttaatccattatcttaaacatttattgcatcccttctatttacaagttactatgccctgaatgccagagaaaatgagataaatgatagcatgatactcatgttcaaggaattacagtctaacaaggaggtttgtcctcatatgttacaaaacaagaaaataatagatgaagaccaaatgcatggtagaaatcctatcccagatcagagaagcagcatcacttccagctgtaatragcagagaaggcttcctcgaggtggggtgttgtttaccaagccctgaggtagctctgcctccttgagagtgtgatgtccttaagaagcattagtgaagcaagtgtagcagagaccttgataacacagtgctgaagaagatggatgacttaattgaagaagttccatatccataaatggaagctttaataaaaggctaaaaatcctccagccggggtgtcccatcaaccttcataagcccctcctaccaatttgtagagattgcatcccttgtttaattgtgacttcattaaggtttaggt

SEQ ID NO: 133723 - DNA, 601 bp, Human
tgcactgacatttcttctatttttttttctatttgaaattgtgtttaatccattatcttaaacatttattgcatcccttctatttacaagttactatgccctgaatgccagagaaaatgagataaatgatagcatgatactcatgttcaaggaattacagtctaacaaggaggtttgtcctcatatgttacaaaacaagaaaataatagatgaagaccaaatgcatggtagaaatcctatcccagatcagagaagcagcatcacttccagctgtaatgagcagagaaggcttcctcgaggyggggtgttgtttaccaagccctgaggtagctctgcctccttgagagtgtgatgtccttaagaagcattagtgaagcaagtgtagcagagaccttgataacacagtgctgaagaagatggatgacttaattgaagaagttccatatccataaatggaagctttaataaaaggctaaaaatcctccagccggggtgtcccatcaaccttcataagcccctcctaccaatttgtagagattgcatcccttgtttaattgtgacttcattaaggtttaggtatgatgcctcttggaagtgtaca

SEQ ID NO: 133724 - DNA, 601 bp, Human
aagttactatgccctgaatgccagagaaaatgagataaatgatagcatgatactcatgttcaaggaattacagtctaacaaggaggtttgtcctcatatgttacaaaacaagaaaataatagatgaagaccaaatgcatggtagaaatcctatcccagatcagagaagcagcatcacttccagctgtaatgagcagagaaggcttcctcgaggtggggtgttgtttaccaagccctgaggtagctctgcctccttgagagtgtgatgtccttaagaagcattagtgaagcaagtgtagcasagaccttgataacacagtgctgaagaagatggatgacttaattgaagaagttccatatccataaatggaagctttaataaaaggctaaaaatcctccagccggggtgtcccatcaaccttcataagcccctcctaccaatttgtagagattgcatcccttgtttaattgtgacttcattaaggtttaggtatgatgcctcttggaagtgtacatctccagctatattgctgaggattcactccaattctcttccagatttattcactaccaaactacccaaagctaaattccatcaatca

SEQ ID NO: 133725 - DNA, 601 bp, Human
gatcagagaagcagcatcacttccagctgtaatgagcagagaaggcttcctcgaggtggggtgttgtttaccaagccctgaggtagctctgcctccttgagagtgtgatgtccttaagaagcattagtgaagcaagtgtagcagagaccttgataacacagtgctgaagaagatggatgacttaattgaagaagttccatatccataaatggaagctttaataaaaggctaaaaatcctccagccggggtgtcccatcaaccttcataagcccctcctaccaatttgtagagattgcatcycttgtttaattgtgacttcattaaggtttaggtatgatgcctcttggaagtgtacatctccagctatattgctgaggattcactccaattctcttccagatttattcactaccaaactacccaaagctaaattccatcaatcacacaacagctacagtaagcaaaatgtggtagtcaacttcatcaagtttattttcagaatccctgcacctttcttttatcctttccagcagtccttttcgcctcatgccttcaaccctcaccctttcttttcttctatggacatccaatatcatcatg

SEQ ID NO: 133726 - DNA, 601 bp, Human
acttcattaaggtttaggtatgatgcctcttggaagtgtacatctccagctatattgctgaggattcactccaattctcttccagatttattcactaccaaactacccaaagctaaattccatcaatcacacaacagctacagtaagcaaaatgtggtagtcaacttcatcaagtttattttcagaatccctgcacctttcttttatcctttccagcagtccttttcgcctcatgccttcaaccctcaccctttcttttcttctatggacatccaatatcatcatgctggtccactttctyacctaacagaatcagctgccaagaaatgctctggtaaaagtgaattactctccagaataaacaaaagccaatccaaactcttgtcccctattatcccatttgaactcttgtcgcctgttttcccaggaaagtttttggtgcctaacaaaagtatcagcccttctaccgctggaaatagcttcgtctacatactattataataatttaaagtcgaagaccctgggcaagtagccaaaaatttatgcatggtatttaaatttctgagctatccaaattatcatccataactaattgagcagg

SEQ ID NO: 133727 - DNA, 601 bp, Human
atcaagtttattttcagaatccctgcacctttcttttatcctttccagcagtccttttcgcctcatgccttcaaccctcaccctttcttttcttctatggacatccaatatcatcatgctggtccactttctcacctaacagaatcagctgccaagaaatgctctggtaaaagtgaattactctccagaataaacaaaagccaatccaaactcttgtcccctattatcccatttgaactcttgtcgcctgttttcccaggaaagtttttggtgcctaacaaaagtatcagcccttctaccrctggaaatagcttcgtctacatactattataataatttaaagtcgaagaccctgggcaagtagccaaaaatttatgcatggtatttaaatttctgagctatccaaattatcatccataactaattgagcagggctactcaaaatctgaccgaatcttgacatagtcctggaccaaacctgtcggaaaagctggtcatggccaaggcatctaagtgacctccctttgtaggtctatgtattttaaacactgagaccccctgaaatctctgttctttaaacccaaattataacacccaaaga

SEQ ID NO: 133728 - DNA, 601 bp, Human
ccaccagatcagagtcttgtgctccacaatgttgatcgatagctatagaatcaccaaatgcacattagtccttccaaaccctcttctttccttagaggataatctcttctatgtctaatttagaaacagcagaatattttcttccaccacctctgtggaagccctttttattttcttagtcctatgggaaccagtagccttctagtagaaaatcacaattagcaaaataggtagcttgagagcccataatccaaaagcatgttttaaaaattgcatttcaggcgaggcacagtggctcacrcctgtaatcccagaactttgggaggccaagccaggcagatcacttgagtccaggagttcaagaccagcctgggcaacatggtgaaaccctatctctacaaaacatacaaaaaaaaaaaaaatggttgggcatggtggcacgcacctgtggttctagctacttgaaaggctgaggtgggaggatcacttgagcccaggagaggaggttgcagtaagctgagatcatgccactgcattccagcctggacaacagagtgagaccctgtctcaaaaaaaagaaaatgtatttcaactattgctt

SEQ ID NO: 133729 - DNA, 601 bp, Human
ttagtcctatgggaaccagtagccttctagtagaaaatcacaattagcaaaataggtagcttgagagcccataatccaaaagcatgttttaaaaattgcatttcaggcgaggcacagtggctcacgcctgtaatcccagaactttgggaggccaagccaggcagatcacttgagtccaggagttcaagaccagcctgggcaacatggtgaaaccctatctctacaaaacatacaaaaaaaaaaaaaatggttgggcatggtggcacgcacctgtggttctagctacttgaaaggctgaggygggaggatcacttgagcccaggagaggaggttgcagtaagctgagatcatgccactgcattccagcctggacaacagagtgagaccctgtctcaaaaaaaagaaaatgtatttcaactattgcttttaataaataagaaatattatgataaatgatgtgaaagtgccatgctcacaggtaaaaaatagttaaatatcagcaatttcacgtgggtcaatttaacattatactgactctcagtttctgcacttgcaacatggggttagtgctatctttatccacaaattcagcagccttgca

SEQ ID NO: 133730 - DNA, 601 bp, Human
tcacgcctgtaatcccagaactttgggaggccaagccaggcagatcacttgagtccaggagttcaagaccagcctgggcaacatggtgaaaccctatctctacaaaacatacaaaaaaaaaaaaaatggttgggcatggtggcacgcacctgtggttctagctacttgaaaggctgaggtgggaggatcacttgagcccaggagaggaggttgcagtaagctgagatcatgccactgcattccagcctggacaacagagtgagaccctgtctcaaaaaaaagaaaatgtatttcaactatkgcttttaataaataagaaatattatgataaatgatgtgaaagtgccatgctcacaggtaaaaaatagttaaatatcagcaatttcacgtgggtcaatttaacattatactgactctcagtttctgcacttgcaacatggggttagtgctatctttatccacaaattcagcagccttgcatcttgaaggtcaatgattctggatctccatgtggtagatcacatgacgaatgaaccctagaccccggttattctgagtaacacagatcagctgctcttcagaggcagggacatgtgggaaa

SEQ ID NO: 133731 - DNA, 601 bp, Human
ctgtaatcccagaactttgggaggccaagccaggcagatcacttgagtccaggagttcaagaccagcctgggcaacatggtgaaaccctatctctacaaaacatacaaaaaaaaaaaaaatggttgggcatggtggcacgcacctgtggttctagctacttgaaaggctgaggtgggaggatcacttgagcccaggagaggaggttgcagtaagctgagatcatgccactgcattccagcctggacaacagagtgagaccctgtctcaaaaaaaagaaaatgtatttcaactattgctttkaataaataagaaatattatgataaatgatgtgaaagtgccatgctcacaggtaaaaaatagttaaatatcagcaatttcacgtgggtcaatttaacattatactgactctcagtttctgcacttgcaacatggggttagtgctatctttatccacaaattcagcagccttgcatcttgaaggtcaatgattctggatctccatgtggtagatcacatgacgaatgaaccctagaccccggttattctgagtaacacagatcagctgctcttcagaggcagggacatgtgggaaatctgat

SEQ ID NO: 133732 - DNA, 601 bp, Human
gcaacatggtgaaaccctatctctacaaaacatacaaaaaaaaaaaaaatggttgggcatggtggcacgcacctgtggttctagctacttgaaaggctgaggtgggaggatcacttgagcccaggagaggaggttgcagtaagctgagatcatgccactgcattccagcctggacaacagagtgagaccctgtctcaaaaaaaagaaaatgtatttcaactattgcttttaataaataagaaatattatgataaatgatgtgaaagtgccatgctcacaggtaaaaaatagttaaatatcrgcaatttcacgtgggtcaatttaacattatactgactctcagtttctgcacttgcaacatggggttagtgctatctttatccacaaattcagcagccttgcatcttgaaggtcaatgattctggatctccatgtggtagatcacatgacgaatgaaccctagaccccggttattctgagtaacacagatcagctgctcttcagaggcagggacatgtgggaaatctgattcagagaagatggataccccgagcacactcagcacaaaaactccgggagggtgggagtaggagacctctag

SEQ ID NO: 133733 - DNA, 601 bp, Human
aagaattatgcccggtctggtgctgaagagagctccaagacatttttagcataattaagacactcaattctgtttctccttaatgtttatgaatgtagtaaaagattttaaacttttttaaaaagtgtttagtagcacagatagaaagagaaaaagaacctgttcatttacatacccaattccattttcccagaagcagagctggcttctttaataaataaaatcaatgagcttgacttcaaaatgagctgcatggcatatggtccaacctggttctctttgtacccaatcaagctgattmaatctattcaattaatagaaggagattaaaaagtagaaaccacatatatcctcgaggacggttttgggcttcataattgctctatgatttactttaaaataagctacacacgaacatatttttgtagcaattaacgtgtctccactcaatggaaatgagttgtgtttttcacttctctgtctgtgtaggtgaagtccaagacccagactatgaagaatgtgtcccttgtgaagaaggatgtctgggatgcagcttgggtatgtcctcttcctttgtcacctaaagagttgaaatagctaa

SEQ ID NO: 133734 - DNA, 601 bp, Human
tctttatgaaactcaagtttagaaaaggaggccatggcaccttttcctctggttgtcaatgagttgttggggcttactgaccagcaaccgcatttcaggtgcctgagactcagcctctccttagcttctcaaggtgacacatttggaagattaacagtgaatgaactcaagcaaagaaatgcctaattcctctaactcacttgatgtgtaaaacacagaagtttgtgggtagagggagggggggtttcctttataaaaatgactctgttgggctgggcacagtggctcatgcctgtaatcmcagcactttgggaggccaaggtgggtggatcacctgaggtcaggagttcgagaccagcctgtccaacatggtgaaaacccatctctactaaaaatacaaaaattagctggatgtggtagcaggcacctgtaatcccagctattcgggaggctgaggcaggagaattgcttgaacccaggagtcagaggttgcagtgagccaagatcgtgccattgcactccagcctgggcgacagagccagactccatcttaaaacaataaaaatgaaaataaaaatgactctgttgcttggagcctaag

SEQ ID NO: 133735 - DNA, 601 bp, Human
tgggcacaaatcacctggggaatttgttgaaatgcagattctgattcactgatctaaggtgggcctgaggatttgtgtttctgacaagttgcccagtgaggctaatgctgttctatagaacactcatgaagttactaggggtaagattgtgccagaataaagcagactttttatttgccttacccaatggattttcttaatttttttcttactaatacataatagttttacatatttaggggatacatgtgatactttgatatttgcatatgatgtgtgatgatcaagtcagggtaactgktatatcatcacctcacacatttatcatttcgttgtgctaggaatattctaaatcttctctttgagctaatttgaaattaatacttaaatattatatatgaattataatttatattgtggctatcaccaccactctttgccttaaatggaaaagatacattttctataatatctgtaactagaaaatacagtttctggaagcttaaataccattgccccattatcttccactataaaatgatgcttatattactggataataaaatctcataataaagttaataaacacttaagaagaaga

SEQ ID NO: 133736 - DNA, 601 bp, Human
ataaacacttaagaagaagataaaatttagagtcagatatttaagggtaaaatgctaattacctgggaagcaaaaaataaacctaggcataaataataaaagtactgaagtaaaaaactataagcaaattccagtgtctgtctcatgtgaagtgatagaagatgagtttgcacagagcaatgatgaatgttttgattatcttgatttcactgtttgcccatttcagatgtattttcccattaagtttcacaccccagctaatttctgtggtcttctctggcatctttgctgttgtgtgttktgtgcccatactagcatctttgtgcatcttggaggcgggttgtgtgtaatctaaaatctgaggtttgggctctcttggctctgctcagtgatgagagtggggcaagtctacccagcaagatacacatagagaaaagaagatcttccttccatagcttcaagacaccttgacaggaatgtatgaatgtgtgtgaactccttcaggttcagtgaggatcttatcatggaggtgggaacagtgacaagaaaaccatggtcactaggtgttcgcattggcctcattctccacttagctgaccca

SEQ ID NO: 133737 - DNA, 601 bp, Human
ctcttagaagacaacctgccagagtagagacaggtataaagtgcagtgacaccaccagaaagggtgacaagaccattctaaatacctctaatttctcattttaaattctaaaatgcccttaatttataatatctgtatgtattgggcctcatttattcttggatagacttggctgaacccaattgtcaccttatttctgaaccctttgttgatctctccaatagaataaattctcccttttctagtttccctttgttaggccagcgagaataccttttagaggtgactagtgtaatatttsctatgtatacacctttctgcctggacactaaactacctgagaacaagctctttgacttatatgctctgaactagcagagtgcccaggacataataaatatgaattaatgcatgaatgtttgttgaattgaatttgagaattgcccaaattcaaagcagagatgaatggcttaggatacccagggtcttagatttgctgttttctctaatcaaactttgtttatgaaccaagaagaagaaaaaataaaccatacaatacaaaaataaatgattttggccaagtgcaatggctcacgcctat

SEQ ID NO: 133738 - DNA, 601 bp, Human
aagataaatctaagttttaaattatatttcttcactagctgaggatagaagtaaatggagtaacttttacctaatgttttgaggcacattttttgtttgtttgtttgttttaatttagggaatgtagcaatagctatgactcttaactataacctgagatccagacatcttagattatataccattgacttgatgattgattttaatcaaattacataagttgttcttacttttctacctcatcaataaatatagtggttaatgtgcccttgttttaacttagaaagagatcatgaaaatrtatcggtatttgcagattgaaatggctgtctccactcttgggataaaacatatccaaatttaaaaattgtaaggaattgcaaaaaaaagagaaaggctatataaattcactgccaaataaggggacaaatatatgcaccaaaaggattttttaaaaaaagagaacctctgggcactgaagtgttcaaggaaggcttttaagaagatgggagttgaggtgaacattagtgtttacatagaatttagacagataagagagaagagctgtactatagggggtctttatatttggacaatagca

SEQ ID NO: 133739 - DNA, 601 bp, Human
caggtctgtgacagcggcaaacagcagtggtggacgcgagcgaaacttcagcttgagccgtaacaaacatggaccagaagagtgcagttgcaagatttaatagagtgaaatagagtggaaacagagctcccatataaagggaggggacccaaagagtgtagccgttgctggctggaatgcctgggtttatatcctgatcattgtccctccctctgtgctctcaggggatagatgattggctatttctttaactcctgtctttgcctaattagcattttagtgagctctctgattggtccgstgtgagctaagttgcaagccccatgtttaaaggtggatgaagtcaccttcccagctaggcttagggattcttagtcagcctaggaaatccagctagtcctgtctctcactacctttgtggtaagaaaatggtgagataaaatgtatgagtgtatttacatttttatttactttggcaaagagaaaaaagataactaagaaactaatgaaagtggttacctatagagaaaggtaaaggagatgggcaggacttcactagctatatctttttattttttaatctttttttttttgagacaga

SEQ ID NO: 133740 - DNA, 601 bp, Human
tccagctagtcctgtctctcactacctttgtggtaagaaaatggtgagataaaatgtatgagtgtatttacatttttatttactttggcaaagagaaaaaagataactaagaaactaatgaaagtggttacctatagagaaaggtaaaggagatgggcaggacttcactagctatatctttttattttttaatctttttttttttgagacagagtctcgccctgttgcccaggctggagtgcaacggcgtgatcttggctcactgcaacctccgcctcccaggttcaagcaattctcctgyctcagcctcccaagtagctgggattacaggcacctgccaccacacctgactaattttttgtatttttagtagagatggagtttcaccatgttggccaggctggtcttgaactcctgacctcgtggtccgccagcctcagcctcccaaattgctgggattacaggcatgagccaccgctcccgaccttaatcttttttaaaaaaatttttttttaagagatggggtcgcactatacttaccaggctggtcttgaactcctggcctcaagcaatcctcccatttcggcctcacaaagtgcta

SEQ ID NO: 133741 - DNA, 601 bp, Human
tttttttttgagacagagtctcgccctgttgcccaggctggagtgcaacggcgtgatcttggctcactgcaacctccgcctcccaggttcaagcaattctcctgcctcagcctcccaagtagctgggattacaggcacctgccaccacacctgactaattttttgtatttttagtagagatggagtttcaccatgttggccaggctggtcttgaactcctgacctcgtggtccgccagcctcagcctcccaaattgctgggattacaggcatgagccaccgctcccgaccttaatcttttwtaaaaaaatttttttttaagagatggggtcgcactatacttaccaggctggtcttgaactcctggcctcaagcaatcctcccatttcggcctcacaaagtgctaggattacaggcatgatctaccgcacccaacctttagctgtatctttctagttatgatttgaaccagataaatattttacatattcataacaaatgacatagtaagtagtgtgaatggactcccactagccaaatgtaggacaattagagcatttttttttaaatgggtgataattccaactcaattaatattttaa

SEQ ID NO: 133742 - DNA, 601 bp, Human
ttttttttgagacagagtctcgccctgttgcccaggctggagtgcaacggcgtgatcttggctcactgcaacctccgcctcccaggttcaagcaattctcctgcctcagcctcccaagtagctgggattacaggcacctgccaccacacctgactaattttttgtatttttagtagagatggagtttcaccatgttggccaggctggtcttgaactcctgacctcgtggtccgccagcctcagcctcccaaattgctgggattacaggcatgagccaccgctcccgaccttaatctttttwaaaaaaatttttttttaagagatggggtcgcactatacttaccaggctggtcttgaactcctggcctcaagcaatcctcccatttcggcctcacaaagtgctaggattacaggcatgatctaccgcacccaacctttagctgtatctttctagttatgatttgaaccagataaatattttacatattcataacaaatgacatagtaagtagtgtgaatggactcccactagccaaatgtaggacaattagagcatttttttttaaatgggtgataattccaactcaattaatattttaaa

SEQ ID NO: 133743 - DNA, 601 bp, Human
ctttctgccaaaaaaccatgaccccagtctagtagtgaagaaaatatcagacaaatcccaacggagggacattttgtaaaatacccaattaatactcaaaactgtccagttcattaaacaagtcaagtctgagaaactgtcacagccgaaaggagcctaaggagatatgatgagtaaatgtaatgtggcatctcaggtgggattctgaaacagagaaaagacactaggtaaaaactaaagaaagctgaataaattacggactttacgttagtaataaccacattataataaaaataaaggrcctgatagagctatttggggttttagaaatgtcctatatcttgattgttggagtgattgcatgactataagcatttgccaaaatttatagaactgtacacataaaaagggcaaatgttactctatgaaaattgtatttcaatcaatctggcttgaaaagtagtccaagcatggtagctcagacctgtaatcccaacactttgggaggccaagacaggaggatggcttcaggccaggagttcgagaccagcctgggcaacatagccagataccatttgtacacaaaatttaaaaattgtca

SEQ ID NO: 133744 - DNA, 601 bp, Human
tctgtgggaaagtgggttctattataagtatgtgattggcagaagacaccctaacccttttcatctcaacccacattaaattcaagcttcaaacctaggacttagagaaccaacctcatttactcttactactccatctttccataggaaatgagaccctagttcatagaaaaagtattggcgatatggaagacatgaagttcactctttaatttgctattgcagcagatatgcaaggttttcaagttaaatactgtggacattgactgctatttatttcacttttactcagatctctcaytggaacatttccacatactttcagaggcacaagaacggtgtcaaaccattttggtaccttccaaaccaaatatattgcagaataaaatatatgccagcagtttgtctcctttaaattggaaggaagtggctgattgtaaaaccgctgctcagcattcataaagcatcgtcttttcagggacctagtgcatcatccactgtgtagccaaccttagtgcatgacccagggagttactgaccatcgtctccatgggcagatggggaagggacattcaggatgcctcttcttcttcttcttttt

SEQ ID NO: 133745 - DNA, 601 bp, Human
cctaggacttagagaaccaacctcatttactcttactactccatctttccataggaaatgagaccctagttcatagaaaaagtattggcgatatggaagacatgaagttcactctttaatttgctattgcagcagatatgcaaggttttcaagttaaatactgtggacattgactgctatttatttcacttttactcagatctctcattggaacatttccacatactttcagaggcacaagaacggtgtcaaaccattttggtaccttccaaaccaaatatattgcagaataaaatatatrccagcagtttgtctcctttaaattggaaggaagtggctgattgtaaaaccgctgctcagcattcataaagcatcgtcttttcagggacctagtgcatcatccactgtgtagccaaccttagtgcatgacccagggagttactgaccatcgtctccatgggcagatggggaagggacattcaggatgcctcttcttcttcttctttttttttttttaaggccaaactcagagccagcttcagaggaaggtttagaatataaatgcaatgtcaatagtcttctgaagataagagaaacaagc

SEQ ID NO: 133746 - DNA, 601 bp, Human
gctttctgctttcctatcacttgttccgtttattccacatataataggactgtatagcctaatatttatcaagcatcaccaggctacacgcttaatgtacgtgatgtgttttcacatctgcaacccaacaatttttacatatggggaaactgagggttagagaaatgttgaaatgtgaccaattttatgcatatgggaaatgacagagtaattcagaagcagtttgtttggagcaaccttgtgcataactttgctccctgtcttcacaaaggaagtagttggcttagaagctctttgttayaagtaaacactaggatacacagggttgtatttcccaaatctcggtgacttcaaacaacacaggtttatttctctctcatgctacatcttcatcatgggtgagctgagaactctgctctgtgtgatccttaattcaggaccaggttgatagagcagccactaccttgccatggcagacacaaagcagacactggctcttagaggtttctccaggatgtggcacttgtacctcctgcttacgtatttttggctaaagcaagttacatgattacgcctgggatcagagagtggggaggtgcaa

SEQ ID NO: 133747 - DNA, 601 bp, Human
gatgctgtgtgtggataagacaggagcatctgcatgttgatacccagctgctcaacaggctggtctccaactgagagttgggccaacgatgagtgtcagtaaattgcctctgcacctctagagcctgaaattcctgctttccaaaagtcaacaggagggtaatttggtaggcatccagactcatcctttccacaaagtctctctgcacctcccaccagggaaaatttggctccagtcctccccgcagcctccagttcagcttccagcacagtgggccagccggggccgtcagaagcagaayggggactaaacgctgcggcaagctggagaaggaccagttccaggggcaggatctggacagggccatgcctcactgatcaccctttggccaagtaccccaaattgaagcagtggaaggcaaggggtatccaggctgacctctccaaaccttagtcatgttctcatggatgatgtgactgggtcaatcaaaacttttttcctcgcagctgtgcctgtgactatctgtagcaaccaactttcctttatgtatatatgttttcctatatgtatatgttttccataaagacagtgtgttctgact

SEQ ID NO: 133748 - DNA, 601 bp, Human
ggccgtcagaagcagaacggggactaaacgctgcggcaagctggagaaggaccagttccaggggcaggatctggacagggccatgcctcactgatcaccctttggccaagtaccccaaattgaagcagtggaaggcaaggggtatccaggctgacctctccaaaccttagtcatgttctcatggatgatgtgactgggtcaatcaaaacttttttcctcgcagctgtgcctgtgactatctgtagcaaccaactttcctttatgtatatatgttttcctatatgtatatgttttccataargacagtgtgttctgactagctataaactatccattattaggtgagacaagtgaatattgttttgtatgaaccaggcaggtaacccaaggatgtctacctctcagctcccttttccacagctcccaggtacagggagggccctggggacactgggagaacagtccccactcaatcagatcaccagggcaagagcacagacatggcattatctccagaggggtaggtggtagaacattagaatagaaaagtttatcagtctctccaacctctgatatggaccagaaagagctgacagcctaa

SEQ ID NO: 133749 - DNA, 601 bp, Human
agcctcagactcctcatgtaaatggaggataatttccatatctgtctcacagtattggtgggagtattaaatgagataatccatctgtagtaggcagaataataggcccccaaaagatgtccatgctcaaatcctcagagcctatgaatatgtaaccctacacagcaagaggactttgaagatgagattaaggttaaagattttgagatggggagattattctgaattagctaagtggactcaatctgagctcatgaatctttaaagtggagaacctttccagctgcagtcagaaagacasacgagacaggagagaaaccatcactgatagccgtgaagctggcagaagagatgccccaagccaaaaaatgcaggtggcatctaaaagccaaatacaaccctcagctgatagctagcaaggaaatgaataaatggatatctcaggcctacaactgcaaagaaccgaattctgtcaacagcccaactgaatgaggaaacagatcctttcccagagccttcagaaggaacccagccctgctgccactctgcttttagcccattgagatctctaccagacttctaacctacaggactgtgacat

SEQ ID NO: 133750 - DNA, 601 bp, Human
aagaggtacagatggacactgggtgcttcctgaggtgatgtcttaagaaaggcacatgacccatgtagtagtttggctgcagatgctaaacttgagtttacacatgaggaaacatcaggacaatcccaaatgagaaactttattaaaaataaaccgttgcctttctccaaataggaaaagaagtcaaagtatctctccttgcggatgatatgattctatacctagaaaaccctaaagacactgccaaaaggctctaagaactgaaaaatgactctggtaaagctgcaggatagaaaatcartgtacaaaaatcagtagcatttttacacagcaataatgttcaagctgagggccaaatcaagaatggaatcccattcacaataacccccttcctgccctcacaaatatgtaggaatatatctaaccaaggagataaaaaatctctatgagaactacaaaacgctgtcaaaagaaatcagattcttcctacccatgagtatggaatgttcttccatttgtttgtttcctcttttatttcactgagcagtggtttgtagttctccttgaagaggtccttcacgtcccttgtaagttggattcc

SEQ ID NO: 133751 - DNA, 601 bp, Human
aaagcagagtatctcccagctgagcaagacataatatctcagtggtggcctgccccattggcaggtgctaagcttttatttttattattataatggctttgtttccccatgaaccatttagatgaagtatgaccacagtctgagtcttcacttatggccaacttcttctcttaatttactgtggcatcaaaacaataaggatttatttataaatttttgttctctttaagaatggatacaaggagaaaagtctcccaaagttgaagagcattgcctttttattcagtaatgcactgcctaycctcccaaaatgcacacacatgcttatgggtatacacacacacacacacacacacacacacacatttgtgggtctgccttccttcaaaatgttctaacgtgggactggtgaggtggataggctgacttgtgccacagactaagacatctgccattaattggtgggacagcaaataatgtaaaaatatgttttctctttcactagcttctctagacaaatcagctttgtgttcctagtgctgcttctaagtttctttcctcttgttcataattcctagctctcagattgcctttgaaaagc

SEQ ID NO: 133752 - DNA, 601 bp, Human
gttctagaacacacaagtaacatgaattatgactataaacctatgtgatatctagcttagggttacacattctcaaaggggtttttttgttgttttattttattgtatctacctgtcttagtccatttgtattgctataaaagaatacctgaggccaggaaatgtagaaagaatagaggtttatctggctcatgcttctgcaggctgtacaagagcatggctccagcatctgcttctagcgagggctccaggctgcttccactcatggtggaagggggagaaagcaaggggaggggaggcrccaggctcttttgaacaagcagccctcataggaactctcacgggaattagtaaagcaagaactcactcattcccaagaggacagcaccaccccatgcatgaaggatccacccatatgacccaaacacctctcattaggtcctgcctctaacattggagataaaaaaaaaatttatcctttttttaaaaatattgtttttatacctatttgaatgggaggagataaaattttaacatgaggtttggatggtcaaatagcactactcaatgctaaggatgagaccaagataattttttcctg

SEQ ID NO: 133753 - DNA, 601 bp, Human
tttttaaaaatattgtttttatacctatttgaatgggaggagataaaattttaacatgaggtttggatggtcaaatagcactactcaatgctaaggatgagaccaagataattttttcctgtctcttcctcctgaaaagtttatttttcatccatccttcactaagactgcaatccatgtgttcctatcccagccctgcattttatctgacaaccctaactataataagaatgctctgaatttgcccattaagcaagattttaaaaaagctattttttgtttgtttgcttctttggttttytgggggttttttgtttgtttgtttttcagatgcagtctctttctgtcacccaggctggagtccagtggcatgatcttggcttactgcaacctccgcctctcggattcaagtgattctcctgcctcagcctcctaagtagctaggattacaggcatgcaccaccacacctggctaatttttgtatttttagtagagacagggtttcaccatgttggccaggctggcctcaaactcctgatctcaagtgatccacctgcctcggcctcccaaaatgttgggattccaggcattagccactgt

SEQ ID NO: 133754 - DNA, 601 bp, Human
aaatattgtttttatacctatttgaatgggaggagataaaattttaacatgaggtttggatggtcaaatagcactactcaatgctaaggatgagaccaagataattttttcctgtctcttcctcctgaaaagtttatttttcatccatccttcactaagactgcaatccatgtgttcctatcccagccctgcattttatctgacaaccctaactataataagaatgctctgaatttgcccattaagcaagattttaaaaaagctattttttgtttgtttgcttctttggttttttgggggytttttgtttgtttgtttttcagatgcagtctctttctgtcacccaggctggagtccagtggcatgatcttggcttactgcaacctccgcctctcggattcaagtgattctcctgcctcagcctcctaagtagctaggattacaggcatgcaccaccacacctggctaatttttgtatttttagtagagacagggtttcaccatgttggccaggctggcctcaaactcctgatctcaagtgatccacctgcctcggcctcccaaaatgttgggattccaggcattagccactgtgcctggc

SEQ ID NO: 133755 - DNA, 601 bp, Human
tattttttgtttgtttgcttctttggttttttgggggttttttgtttgtttgtttttcagatgcagtctctttctgtcacccaggctggagtccagtggcatgatcttggcttactgcaacctccgcctctcggattcaagtgattctcctgcctcagcctcctaagtagctaggattacaggcatgcaccaccacacctggctaatttttgtatttttagtagagacagggtttcaccatgttggccaggctggcctcaaactcctgatctcaagtgatccacctgcctcggcctcccaraatgttgggattccaggcattagccactgtgcctggctgatgaaatactaattatgtgggaagacagaagagagagaatcataacttggcttctttcagcctgaaaaaatatttctgtggtacactacattagaggtttctccattctatcattcgccacactgtgatttctctctaattagctttgttaattactgtcccttcgccaatttgcaaattccttgaggtagggactgcctttctcatctatactcgttacagtatccaaagcagtggatggactgtagtgtgggatcaatt

SEQ ID NO: 133756 - DNA, 601 bp, Human
cataggtcatttttactgaagcttctcatgccctcccattactcttcgattagaatgtaaacctcctatcctggcctataagatcctatatgatcttgtcctgcctatgaccctggcatcacctcctgactctctccctttctctccatctcttccagccccactggccttcttgatgttccttgaaggggacaagctttccctggcctctgtctggaacacctgccctcagaacctcccatgctagctctttgttatcattcgaatctctactcagatgtcaattcttgcaagacacggyctcactagcccatctaaattagggcctctcctctccaccccagtctcatcactctctaaccctttatctgaatttacgtacttacttatgtgttttcttcacccaatgcatatttctggagcatctgctatataccagcagttcttggcactggagatacaggaaaacaaaacagaacaacctgtcttcatgaagcttgcgttttactgtttgcttcatgcatttattgaacaaaaatttatgctttgttttcattctaataattatctaggctgggtgcagtggctcactcctataatc

SEQ ID NO: 133757 - DNA, 601 bp, Human
atgaccctggcatcacctcctgactctctccctttctctccatctcttccagccccactggccttcttgatgttccttgaaggggacaagctttccctggcctctgtctggaacacctgccctcagaacctcccatgctagctctttgttatcattcgaatctctactcagatgtcaattcttgcaagacacggcctcactagcccatctaaattagggcctctcctctccaccccagtctcatcactctctaaccctttatctgaatttacgtacttacttatgtgttttcttcacccartgcatatttctggagcatctgctatataccagcagttcttggcactggagatacaggaaaacaaaacagaacaacctgtcttcatgaagcttgcgttttactgtttgcttcatgcatttattgaacaaaaatttatgctttgttttcattctaataattatctaggctgggtgcagtggctcactcctataatcccagcattgtgggaggccaaggcgggtggatcacctgaggtcaagagttcgagaccaacctggccaacatggtgaaaccctgtctctacaaaaaatacaaaaaaaa

SEQ ID NO: 133758 - DNA, 601 bp, Human
ccatccatccatccatccacacaggtaggtatctacctaccatatacatagagatggattatcatcattttttacatagcctatcatgaaatgtttctgtgtcattaaatactcttgagaaacaaaatttcaatgtctattagcccatcttatataagtgaacaggcatatctcattttactgcattttgctttattgtacattgcacatgttgcattttttttattatactttaagttttagggtacatgtgcacattgtgcaggttagttacatatgtatacatgtgccatgctggtgygctgcacccactaactcgtcatctagcattaggcatgtctcccaatgctatccctcccccctccccccaccccaccacagtccccagagtgtgatgttccccttcctgtgtccatgtgatctcattgttcaattcccacctatgagtgagaatatgcggtgtttggttttttgttcttgcgatagtttactgagaatgatgatttccaatttcatccatgtccctacataggacatgaactcatcattttttatggctgcatagtattccatggtgtacatgtgccacattttcttaatc

SEQ ID NO: 133759 - DNA, 601 bp, Human
cacgttgcccaggctggtcttgaactcctgagctcaactaatccaatcacctcaacctcccaaagtgctggtattacaggcttgtgccgttgcacctggcctaagtcttactgagaaagacactgtgtatggcaatagctgccgtagagattcctctgatgtatctgggcaatgtaaattgaaacttcctggaaaggatgcaccatttttttctttctttttttttttccccactctgttgcccaggctggagtgcaccattcttttctttgctttttttttttttttttttttttttttwcgctctgttgcccaggctggagcacagtggtgtgatcatagctcactgcagcctcaaactcctgggctcaagtgatcctcccacctcatcctcctgactagctaggactacaggtgtgtgccactgtgcctggccaattttttattttatttccaattttttctttctttctttttctttctttctttcttccttttcttctgtctttttttttttttcgagacagggtttttgcaatcttgactcactgcagccttgacctccgaggctaacgcaatcctcccacctcagcctcctgag

SEQ ID NO: 133760 - DNA, 601 bp, Human
ttcattcacatctatatttccacttatctcctgaccccaaaatgctaggtaaacaagttaattagaatcaaatagtccgtctataaagaagggcttgaagccaagtgcaggagattccttatgtacatgcgagtcagagagccatttcttctggttacaatcttaaggaaccaaactcaacatgttttgacaaggttaaatatgaatttattagctcagatgtagcatttggttaggtgtggcctgggtcactggtctccagaaagaggtaggaaaaataatttatttaggctgcaaaagaaaaaaaaaaaagaacttatgttcatgatttttatgttaacctcttcaatcttaaatgttctactctagcacatctctttaatgtatgtgaaatattcattgatatggtttggctgtgtcctcacccaaatctcatcttgaattgtagctcccataatccccacatgtcaagggagggacccggtggggggtaactgaatcatgggggcaggtttttcccatgctgttctcatgatagtgaataagtttcatgagatctgatggttttataaaggacagataccccgcacacactctcttg

SEQ ID NO: 133761 - DNA, 601 bp, Human
aggtaaacaagttaattagaatcaaatagtccgtctataaagaagggcttgaagccaagtgcaggagattccttatgtacatgcgagtcagagagccatttcttctggttacaatcttaaggaaccaaactcaacatgttttgacaaggttaaatatgaatttattagctcagatgtagcatttggttaggtgtggcctgggtcactggtctccagaaagaggtaggaaaaataatttatttaggctgcaaaagaaaaaaaaaaaagaacttatgttcatgatttttatgttaacctcttmaatcttaaatgttctactctagcacatctctttaatgtatgtgaaatattcattgatatggtttggctgtgtcctcacccaaatctcatcttgaattgtagctcccataatccccacatgtcaagggagggacccggtggggggtaactgaatcatgggggcaggtttttcccatgctgttctcatgatagtgaataagtttcatgagatctgatggttttataaaggacagataccccgcacacactctcttgcctgccaccatgtaagacatgtctttgcttctccttcaccttccac

SEQ ID NO: 133762 - DNA, 601 bp, Human
atacacacacatatattagcatgcaagtggagggtgagcataacgtgtataaatgttatattttctaacatactaattttttaagccaatgagtgattaatcaaaacagtatggagcttagaactttagatttctgttgttgattgagattggagagtggctgatgctggaagttctatgaagtatggctggagcatgactttggtctaatacttggcctaagtgtgggagatattggccaagctgaatcctgggaagtgaatggagcccctagtttggtagagcataagatatagatgaktagaccagagaaggtgactgggccaaaaggttgagattgtctgggagaagcaagtatccagggtatgctaaactacaatcaaatgggtaatgttttatggaacatttgcagatgtagcctaagagagtcaaagtggaaggaacctaaggagtctagaacacttgagaagagagtgagagaggtgagagcctaggagtctcccaagagcacatatttgccatgcccattcgtctgtcatcctagccagtaacctagtaggttcttgcagtaacaggacacaggacagataggtttcaatag

SEQ ID NO: 133763 - DNA, 601 bp, Human
gcaagtggagggtgagcataacgtgtataaatgttatattttctaacatactaattttttaagccaatgagtgattaatcaaaacagtatggagcttagaactttagatttctgttgttgattgagattggagagtggctgatgctggaagttctatgaagtatggctggagcatgactttggtctaatacttggcctaagtgtgggagatattggccaagctgaatcctgggaagtgaatggagcccctagtttggtagagcataagatatagatgagtagaccagagaaggtgactggrccaaaaggttgagattgtctgggagaagcaagtatccagggtatgctaaactacaatcaaatgggtaatgttttatggaacatttgcagatgtagcctaagagagtcaaagtggaaggaacctaaggagtctagaacacttgagaagagagtgagagaggtgagagcctaggagtctcccaagagcacatatttgccatgcccattcgtctgtcatcctagccagtaacctagtaggttcttgcagtaacaggacacaggacagataggtttcaatagcaagtggtagggggggagtctg

SEQ ID NO: 133764 - DNA, 601 bp, Human
tcgtcttttttagatagtgaactattaaatttctttggtaataaatgagaaaaaaagaggaaagaaaagatctgggctgcgatgattactgggttctatttgtctttctgataatgtgaatttaaaacagttaaatcacacttacaccactacaaaaattagtactagtaaccttttggagattataaaatacaatatacccagtggacataaatgtgttcaaaaggtttttttcctgcaggtcatttttccccccataaacagagacaaagtgaacatatgattgggttggtaattctgytgtatattgcaattcacccagcttcttgtcattcacagaaatgaagaagacaggcattagattttacttgtcatgtgatattagtagccagatgttttaatggcagcttatctgaggtccatcaatcctttgaatatgtgtagaaaagcatggccattgtttctcacctgcccacatctgaacacattcagataccatggaaaccacaaaggaagaaaaaaaatacttattccaagattcattgattgggatatttaagtgtcctttctttcatacagccaggggtgtgataatgtgcta

SEQ ID NO: 133765 - DNA, 601 bp, Human
gagctccatctctgagggtcctgagaaagacagtggatggatcctggagtcctcttgaaaggggaaggtggtcctattgagtggaacatgtgtgtctcaaatcctggaggtaggggcagagcaatagcaggggtggggacagggcaatagcagttgaacatggcaaggcaatgttcaccacagctgtaggagcacttggaggtaggttgaagtcattggcagatgcatctgctgctgcagaaggaggaagagctcccggcagtactggaatcagctctagctggatccccgggtctggggytctgtcattttcctttcctctggctgcctgggatcttccccattttacacttagtctgcagccattggtgattaacttattaaaggacttctctacagccacttgtgcagcctgccctgtggaaacctggatgaaagcacaccgctgtctctgcacaacagggattgtccagatctctctaaataggtagagattatttcttaagatctgtctcagtaatggtatcacccggatcaccggtgtctagtgtggggatagtcttatcctctgggagttccagatgaggcgtggctgaagcct

SEQ ID NO: 133766 - DNA, 601 bp, Human
ctcaaatcctggaggtaggggcagagcaatagcaggggtggggacagggcaatagcagttgaacatggcaaggcaatgttcaccacagctgtaggagcacttggaggtaggttgaagtcattggcagatgcatctgctgctgcagaaggaggaagagctcccggcagtactggaatcagctctagctggatccccgggtctggggttctgtcattttcctttcctctggctgcctgggatcttccccattttacacttagtctgcagccattggtgattaacttattaaaggacttctctrcagccacttgtgcagcctgccctgtggaaacctggatgaaagcacaccgctgtctctgcacaacagggattgtccagatctctctaaataggtagagattatttcttaagatctgtctcagtaatggtatcacccggatcaccggtgtctagtgtggggatagtcttatcctctgggagttccagatgaggcgtggctgaagcctactatagaagcttatctgctacagggtcgttgactatataatatcagtttttaatatctgatcagcaagggaatcatgtggacctgtaggcttct

SEQ ID NO: 133767 - DNA, 601 bp, Human
ctgctgcagaaggaggaagagctcccggcagtactggaatcagctctagctggatccccgggtctggggttctgtcattttcctttcctctggctgcctgggatcttccccattttacacttagtctgcagccattggtgattaacttattaaaggacttctctacagccacttgtgcagcctgccctgtggaaacctggatgaaagcacaccgctgtctctgcacaacagggattgtccagatctctctaaataggtagagattatttcttaagatctgtctcagtaatggtatcacccrgatcaccggtgtctagtgtggggatagtcttatcctctgggagttccagatgaggcgtggctgaagcctactatagaagcttatctgctacagggtcgttgactatataatatcagtttttaatatctgatcagcaagggaatcatgtggacctgtaggcttctcatgtctctatcgaaactcctctcctctcttaccctctcccttcacccagaaggagcaaatgtggggcttattctttaggtaatagggtatggtccaggccagtttgtctagcatgtcactggtggatgtggcttt

SEQ ID NO: 133768 - DNA, 601 bp, Human
ctgcctgggatcttccccattttacacttagtctgcagccattggtgattaacttattaaaggacttctctacagccacttgtgcagcctgccctgtggaaacctggatgaaagcacaccgctgtctctgcacaacagggattgtccagatctctctaaataggtagagattatttcttaagatctgtctcagtaatggtatcacccggatcaccggtgtctagtgtggggatagtcttatcctctgggagttccagatgaggcgtggctgaagcctactatagaagcttatctgctacasggtcgttgactatataatatcagtttttaatatctgatcagcaagggaatcatgtggacctgtaggcttctcatgtctctatcgaaactcctctcctctcttaccctctcccttcacccagaaggagcaaatgtggggcttattctttaggtaatagggtatggtccaggccagtttgtctagcatgtcactggtggatgtggctttccccagcaggccaactggctgtcttccattcgagttagaaatccctctctccacattctgcgtgtagtactcttctcttctctgacatctgac

SEQ ID NO: 133769 - DNA, 601 bp, Human
tgtctctatcgaaactcctctcctctcttaccctctcccttcacccagaaggagcaaatgtggggcttattctttaggtaatagggtatggtccaggccagtttgtctagcatgtcactggtggatgtggctttccccagcaggccaactggctgtcttccattcgagttagaaatccctctctccacattctgcgtgtagtactcttctcttctctgacatctgactttggcatgtcatcttttttttgttgtttttttgagatggagtctcactctgtcgcccaggctggagtgcagtracacagtctcagctcactgcaagctctacctcccgggtacatgccattctcctgcctcagcctcctgagtagctgggactacaggcacctaccaccacacccggctaatgttttgtatttttagtagagacggggtttcatcatgttagccaggctggtctcgatctcctgaccttttgatctgcccgcctcagcctcccaaagtgctgggattacaggcatgagccaccgcgcccggccagcatgtcctcttttaaagacaacgcagcatcacaaacctaggtgggcaggccatgctcc

SEQ ID NO: 133770 - DNA, 601 bp, Human
acccagaaggagcaaatgtggggcttattctttaggtaatagggtatggtccaggccagtttgtctagcatgtcactggtggatgtggctttccccagcaggccaactggctgtcttccattcgagttagaaatccctctctccacattctgcgtgtagtactcttctcttctctgacatctgactttggcatgtcatcttttttttgttgtttttttgagatggagtctcactctgtcgcccaggctggagtgcagtgacacagtctcagctcactgcaagctctacctcccgggtacaygccattctcctgcctcagcctcctgagtagctgggactacaggcacctaccaccacacccggctaatgttttgtatttttagtagagacggggtttcatcatgttagccaggctggtctcgatctcctgaccttttgatctgcccgcctcagcctcccaaagtgctgggattacaggcatgagccaccgcgcccggccagcatgtcctcttttaaagacaacgcagcatcacaaacctaggtgggcaggccatgctccaggtctaagaggcaggtctgacagacatacttcaggcttctg

SEQ ID NO: 133771 - DNA, 601 bp, Human
gtccaggccagtttgtctagcatgtcactggtggatgtggctttccccagcaggccaactggctgtcttccattcgagttagaaatccctctctccacattctgcgtgtagtactcttctcttctctgacatctgactttggcatgtcatcttttttttgttgtttttttgagatggagtctcactctgtcgcccaggctggagtgcagtgacacagtctcagctcactgcaagctctacctcccgggtacatgccattctcctgcctcagcctcctgagtagctgggactacaggcaccyaccaccacacccggctaatgttttgtatttttagtagagacggggtttcatcatgttagccaggctggtctcgatctcctgaccttttgatctgcccgcctcagcctcccaaagtgctgggattacaggcatgagccaccgcgcccggccagcatgtcctcttttaaagacaacgcagcatcacaaacctaggtgggcaggccatgctccaggtctaagaggcaggtctgacagacatacttcaggcttctgcaggttcgacatactttatttttcttgaaatgcatgtgggccccaggg

SEQ ID NO: 133772 - DNA, 601 bp, Human
acaggcatgagccaccgcgcccggccagcatgtcctcttttaaagacaacgcagcatcacaaacctaggtgggcaggccatgctccaggtctaagaggcaggtctgacagacatacttcaggcttctgcaggttcgacatactttatttttcttgaaatgcatgtgggccccagggcaccagcaaaacattgtgaatggcctggcacagatttctcatttttctcatacttttctttggtcattcagatataatgggtttcctctaagacatgtctgatacagaatggagaagtatgcatyttcccagtgtttcctgtttaaggtgttgaaaccaagacaggtcaccatctcgagggggtcttgaagtagtggtaggttttaggtgggagagagacaccatgatcctgtcaagcccagctcttctttgttcccctgttcttgatgctccggacaattgctttgacagtatgtgattctcctttcttgattcaaggtgaaacttacttctcaggaatccccattcttggagaaaactctggatttcctggtctctccaaggactggcctgtaataccagggctttggtagcctgaggcagga

SEQ ID NO: 133773 - DNA, 601 bp, Human
taggtgggcaggccatgctccaggtctaagaggcaggtctgacagacatacttcaggcttctgcaggttcgacatactttatttttcttgaaatgcatgtgggccccagggcaccagcaaaacattgtgaatggcctggcacagatttctcatttttctcatacttttctttggtcattcagatataatgggtttcctctaagacatgtctgatacagaatggagaagtatgcattttcccagtgtttcctgtttaaggtgttgaaaccaagacaggtcaccatctcgagggggtcttgargtagtggtaggttttaggtgggagagagacaccatgatcctgtcaagcccagctcttctttgttcccctgttcttgatgctccggacaattgctttgacagtatgtgattctcctttcttgattcaaggtgaaacttacttctcaggaatccccattcttggagaaaactctggatttcctggtctctccaaggactggcctgtaataccagggctttggtagcctgaggcaggaggattgcttgaggtcaggagttcaaaaccaccagggcaacacagggagaccccatcttaaattca

SEQ ID NO: 133774 - DNA, 601 bp, Human
ggcacagatttctcatttttctcatacttttctttggtcattcagatataatgggtttcctctaagacatgtctgatacagaatggagaagtatgcattttcccagtgtttcctgtttaaggtgttgaaaccaagacaggtcaccatctcgagggggtcttgaagtagtggtaggttttaggtgggagagagacaccatgatcctgtcaagcccagctcttctttgttcccctgttcttgatgctccggacaattgctttgacagtatgtgattctcctttcttgattcaaggtgaaactyacttctcaggaatccccattcttggagaaaactctggatttcctggtctctccaaggactggcctgtaataccagggctttggtagcctgaggcaggaggattgcttgaggtcaggagttcaaaaccaccagggcaacacagggagaccccatcttaaattcatgcttttctgctagaatactgagatacataacctggaagctggaagtccagtttcttcacaagtatctttttccagtgacaaagtaacttccctgtaatctcagcactttgggaagccaaggcagaaggatcacttg

SEQ ID NO: 133775 - DNA, 601 bp, Human
cctggtctcttcagacagccagcatggccagggcagccagtctcaccctgtaattgtgacattttgtcttcatgaaatgccagcttgctgacttgtgccgacattttatttctcacagagcagtaagaggccaggaccctttcacagtctgcatggggttgccatggttatgctcaccctccacttgtatgtatcctgaattatgggacaccgagtttatgtaaaccataaaaataaattcttcttctctagacgttcaagtttaaaatatctcctttccaatacatcttataggtatgakgtgcacagctcccactgtggccctcatccatccaaattcaatggtgaaggtgatcgttattactgagaacaaaataaaatggcatagaatgtaaattggctgctgaaggcgatgttgaagcaggaggcaatgtctccatgggacagtgagttcgtgatgagtgacagtacagatgatccccaaagacacagtgggaaggtgacacaggggatcatgaagagctctcaagagagagcggactttgtagtccggcccaccccaccccatacaaatgagacaataaaaatgacttttctcaag

SEQ ID NO: 133776 - DNA, 601 bp, Human
tgctcaccctccacttgtatgtatcctgaattatgggacaccgagtttatgtaaaccataaaaataaattcttcttctctagacgttcaagtttaaaatatctcctttccaatacatcttataggtatgatgtgcacagctcccactgtggccctcatccatccaaattcaatggtgaaggtgatcgttattactgagaacaaaataaaatggcatagaatgtaaattggctgctgaaggcgatgttgaagcaggaggcaatgtctccatgggacagtgagttcgtgatgagtgacagtayagatgatccccaaagacacagtgggaaggtgacacaggggatcatgaagagctctcaagagagagcggactttgtagtccggcccaccccaccccatacaaatgagacaataaaaatgacttttctcaagacagaaagacggcatccccgtcctgacgaggcatctgctcgcatgttctccttaggaaagatatgagcagctggaagccagccactgtttctgaagacttttttccaaatgtgtgaggctctctctgaattctgactgaactttccccatctctccccaaaatatgctct

SEQ ID NO: 133777 - DNA, 601 bp, Human
gctcaccctccacttgtatgtatcctgaattatgggacaccgagtttatgtaaaccataaaaataaattcttcttctctagacgttcaagtttaaaatatctcctttccaatacatcttataggtatgatgtgcacagctcccactgtggccctcatccatccaaattcaatggtgaaggtgatcgttattactgagaacaaaataaaatggcatagaatgtaaattggctgctgaaggcgatgttgaagcaggaggcaatgtctccatgggacagtgagttcgtgatgagtgacagtacrgatgatccccaaagacacagtgggaaggtgacacaggggatcatgaagagctctcaagagagagcggactttgtagtccggcccaccccaccccatacaaatgagacaataaaaatgacttttctcaagacagaaagacggcatccccgtcctgacgaggcatctgctcgcatgttctccttaggaaagatatgagcagctggaagccagccactgtttctgaagacttttttccaaatgtgtgaggctctctctgaattctgactgaactttccccatctctccccaaaatatgctctc

SEQ ID NO: 133778 - DNA, 601 bp, Human
caaatgagacaataaaaatgacttttctcaagacagaaagacggcatccccgtcctgacgaggcatctgctcgcatgttctccttaggaaagatatgagcagctggaagccagccactgtttctgaagacttttttccaaatgtgtgaggctctctctgaattctgactgaactttccccatctctccccaaaatatgctctctcagctcagaagtttgacaaaatcaaatcacccgagctatttaaacatccttctttggataacaccttccaagacagctaacaattgtagcttgtttagactcccttcccattcccctcaccacacacacacacacacacacacacacacacacacatgcaacatacacacacacacacacactagaagccaggaaaattcatctttctccttaagccacccctcctcaccatctaaatgccaagctgacttagagtcaacttctagatttgggattgttaccttcttccttaatctcataacagcagcctctcagtggtcaagctaaatccatttagcttatgtctgacttgtggatcttctggggtggaaacaattttttaaataattctcattct

SEQ ID NO: 133779 - DNA, 601 bp, Human
ttctcaagacagaaagacggcatccccgtcctgacgaggcatctgctcgcatgttctccttaggaaagatatgagcagctggaagccagccactgtttctgaagacttttttccaaatgtgtgaggctctctctgaattctgactgaactttccccatctctccccaaaatatgctctctcagctcagaagtttgacaaaatcaaatcacccgagctatttaaacatccttctttggataacaccttccaagacagctaacaattgtagcttgtttagactcccttcccattcccctcaccacacacacacacacacacacacacacacacacacatgcaacatacacacacacacacacactagaagccaggaaaattcatctttctccttaagccacccctcctcaccatctaaatgccaagctgacttagagtcaacttctagatttgggattgttaccttcttccttaatctcataacagcagcctctcagtggtcaagctaaatccatttagcttatgtctgacttgtggatcttctggggtggaaacaattttttaaataattctcattcttcagaacaactgctaataatgaga

SEQ ID NO: 133780 - DNA, 601 bp, Human
aggcatctgctcgcatgttctccttaggaaagatatgagcagctggaagccagccactgtttctgaagacttttttccaaatgtgtgaggctctctctgaattctgactgaactttccccatctctccccaaaatatgctctctcagctcagaagtttgacaaaatcaaatcacccgagctatttaaacatccttctttggataacaccttccaagacagctaacaattgtagcttgtttagactcccttcccattcccctcaccacacacacacacacacacacacacacacacacacaygcaacatacacacacacacacacactagaagccaggaaaattcatctttctccttaagccacccctcctcaccatctaaatgccaagctgacttagagtcaacttctagatttgggattgttaccttcttccttaatctcataacagcagcctctcagtggtcaagctaaatccatttagcttatgtctgacttgtggatcttctggggtggaaacaattttttaaataattctcattcttcagaacaactgctaataatgagaaaaactaatgagcattcataagctgttataaggcac

SEQ ID NO: 133781 - DNA, 601 bp, Human
ttttttccaaatgtgtgaggctctctctgaattctgactgaactttccccatctctccccaaaatatgctctctcagctcagaagtttgacaaaatcaaatcacccgagctatttaaacatccttctttggataacaccttccaagacagctaacaattgtagcttgtttagactcccttcccattcccctcaccacacacacacacacacacacacacacacacacacatgcaacatacacacacacacacacactagaagccaggaaaattcatctttctccttaagccacccctcctmaccatctaaatgccaagctgacttagagtcaacttctagatttgggattgttaccttcttccttaatctcataacagcagcctctcagtggtcaagctaaatccatttagcttatgtctgacttgtggatcttctggggtggaaacaattttttaaataattctcattcttcagaacaactgctaataatgagaaaaactaatgagcattcataagctgttataaggcacagttcctgttctatgcattattcatttatgcaaactgttgtaaaggtaccaaattcactgtgcaactggg

SEQ ID NO: 133782 - DNA, 601 bp, Human
cacacacacatgcaacatacacacacacacacacactagaagccaggaaaattcatctttctccttaagccacccctcctcaccatctaaatgccaagctgacttagagtcaacttctagatttgggattgttaccttcttccttaatctcataacagcagcctctcagtggtcaagctaaatccatttagcttatgtctgacttgtggatcttctggggtggaaacaattttttaaataattctcattcttcagaacaactgctaataatgagaaaaactaatgagcattcataagctgttataaggcacagttcctgttctatgcattattcatttatgcaaactgttgtaaaggtaccaaattcactgtgcaactgggctggaaaagtccctgaactcaagatggcattggtatgcacaattctgaggcttggttctgtttaacattttcatcagtgacctgcttaaaggagcagagagcaagctcattaagttcctagatgggagggatgaccagaacattaaagaacaggattagaatttccccagcccttgccaaattagcaaaactgttagagtcaaatatgttcattagggag

SEQ ID NO: 133783 - DNA, 601 bp, Human
cattattcatttatgcaaactgttgtaaaggtaccaaattcactgtgcaactgggctggaaaagtccctgaactcaagatggcattggtatgcacaattctgaggcttggttctgtttaacattttcatcagtgacctgcttaaaggagcagagagcaagctcattaagttcctagatgggagggatgaccagaacattaaagaacaggattagaatttccccagcccttgccaaattagcaaaactgttagagtcaaatatgttcattagggaggcagagtaaagtaagctgcccaaatrtaagctgagtggttggaggttatttagaaactgaaaagaatatggatgcaaaaatagacacgtaatggaaaatgaactagtccaggggaaccactggtgttcactggggcctctgctggcccttacaatgggttcagatccccagcctatgaattggtctttcccaagatttctaagaatgccagggagcttttctttcccatggtcacctctagcttcacttcctggttccacctaattagcctggtttttggttcatttcactgtcctgtcttagtcaccgtattacaaaccatgttg

SEQ ID NO: 133784 - DNA, 601 bp, Human
attattcatttatgcaaactgttgtaaaggtaccaaattcactgtgcaactgggctggaaaagtccctgaactcaagatggcattggtatgcacaattctgaggcttggttctgtttaacattttcatcagtgacctgcttaaaggagcagagagcaagctcattaagttcctagatgggagggatgaccagaacattaaagaacaggattagaatttccccagcccttgccaaattagcaaaactgttagagtcaaatatgttcattagggaggcagagtaaagtaagctgcccaaatayaagctgagtggttggaggttatttagaaactgaaaagaatatggatgcaaaaatagacacgtaatggaaaatgaactagtccaggggaaccactggtgttcactggggcctctgctggcccttacaatgggttcagatccccagcctatgaattggtctttcccaagatttctaagaatgccagggagcttttctttcccatggtcacctctagcttcacttcctggttccacctaattagcctggtttttggttcatttcactgtcctgtcttagtcaccgtattacaaaccatgttga

SEQ ID NO: 133785 - DNA, 601 bp, Human
gagcagagagcaagctcattaagttcctagatgggagggatgaccagaacattaaagaacaggattagaatttccccagcccttgccaaattagcaaaactgttagagtcaaatatgttcattagggaggcagagtaaagtaagctgcccaaatataagctgagtggttggaggttatttagaaactgaaaagaatatggatgcaaaaatagacacgtaatggaaaatgaactagtccaggggaaccactggtgttcactggggcctctgctggcccttacaatgggttcagatccccagyctatgaattggtctttcccaagatttctaagaatgccagggagcttttctttcccatggtcacctctagcttcacttcctggttccacctaattagcctggtttttggttcatttcactgtcctgtcttagtcaccgtattacaaaccatgttgacccagacattaaaaaccatttccctcccatgagcagataacagcttcctgcagaagggcccttctatctctttggctgtcttggctcttgttcaactcttccaattaaacctctaccccaaggagcttaacaaggtagtttccta

SEQ ID NO: 133786 - DNA, 601 bp, Human
tttctttcccatggtcacctctagcttcacttcctggttccacctaattagcctggtttttggttcatttcactgtcctgtcttagtcaccgtattacaaaccatgttgacccagacattaaaaaccatttccctcccatgagcagataacagcttcctgcagaagggcccttctatctctttggctgtcttggctcttgttcaactcttccaattaaacctctaccccaaggagcttaacaaggtagtttcctaaatatagacagttcttttcctaagaggaactctgaaaccagctgtwaagacaattacagacacctgtgtcccctagcaaagatgagcatgaccaagtcatgagctaatagtgctatagtcaggggacggcaaattctgtgaagtggcagggagtaaatatctttggtctcttgcaattactcaactctggttatatagcatgaaagcattcttacacaatacatacaaatagatggcaaggtcaaggtcctggagtgggccatagttgccaactcctgctaggctcaacttcagaatctgtgactttccagaagtcttaacaaccatcttgtccaaccagctcatt

SEQ ID NO: 133787 - DNA, 601 bp, Human
ggccatagttgccaactcctgctaggctcaacttcagaatctgtgactttccagaagtcttaacaaccatcttgtccaaccagctcattttacacccgcagaaaccaggacccagaaagtaggtgacatttgtgcaagttcacaagataattaagcctgagttgaaacttcaaacaggaagctcaacttccaggccagcactgtttctactgcaccatcatcaagctatttccagaaggttctgcagatccctgctttaattagcagagcctttgctagaaattttcccacttaacatttrgtgcaatgcattagttgtattatgtgtagtacacaggaatatcatttggtagcctccctaggacccaagatgaacgtgtgactaaagatttgagtgaggttgtgtctacctcctaagggcagtctgaaaaaaccagaagagggcagaatagattagaaaggaaagctatgcacaaagttcaaatgatatagttttattttgttaattaaaggtgacataaaattttcacataccaagaggaacgttttaaggaggaacagttgtctttcatctcctattaaaataagaagagcaagactg

SEQ ID NO: 133788 - DNA, 601 bp, Human
ccaaccagctcattttacacccgcagaaaccaggacccagaaagtaggtgacatttgtgcaagttcacaagataattaagcctgagttgaaacttcaaacaggaagctcaacttccaggccagcactgtttctactgcaccatcatcaagctatttccagaaggttctgcagatccctgctttaattagcagagcctttgctagaaattttcccacttaacatttagtgcaatgcattagttgtattatgtgtagtacacaggaatatcatttggtagcctccctaggacccaagatgaaygtgtgactaaagatttgagtgaggttgtgtctacctcctaagggcagtctgaaaaaaccagaagagggcagaatagattagaaaggaaagctatgcacaaagttcaaatgatatagttttattttgttaattaaaggtgacataaaattttcacataccaagaggaacgttttaaggaggaacagttgtctttcatctcctattaaaataagaagagcaagactggaaggtaggttagatcacagaaagaacctgccagaggtagctctgttatgtgcaagaactgcaggccagaggaag

SEQ ID NO: 133789 - DNA, 601 bp, Human
acccgcagaaaccaggacccagaaagtaggtgacatttgtgcaagttcacaagataattaagcctgagttgaaacttcaaacaggaagctcaacttccaggccagcactgtttctactgcaccatcatcaagctatttccagaaggttctgcagatccctgctttaattagcagagcctttgctagaaattttcccacttaacatttagtgcaatgcattagttgtattatgtgtagtacacaggaatatcatttggtagcctccctaggacccaagatgaacgtgtgactaaagatttgrgtgaggttgtgtctacctcctaagggcagtctgaaaaaaccagaagagggcagaatagattagaaaggaaagctatgcacaaagttcaaatgatatagttttattttgttaattaaaggtgacataaaattttcacataccaagaggaacgttttaaggaggaacagttgtctttcatctcctattaaaataagaagagcaagactggaaggtaggttagatcacagaaagaacctgccagaggtagctctgttatgtgcaagaactgcaggccagaggaagtcaccgaattctcttaat

SEQ ID NO: 133790 - DNA, 601 bp, Human
gcttgtagccccttccaaatatttgtgtgtggacttggttgatccctctatctcagtaaaggccagggggttcttaatgtggatggtcgttgatctttaattcgaagacccagtagcttgaacctattcctccttgaaagtcagggccaagtgtttatgagaattcttactacctttgataaagataaatcctagtgtacatcttgttgctaattaaaaacagtacaatctgttcaaatattatttctggacagtacatttcatgaaactatcccacaggattgtttatctcaagctacarctttcagaccctatttttccaaatgacgaattcctcatgattattactttttattattttttttttccagatgatccaggaacatgtacatcttgcgctatggggtattacaggtaagtctggtcttccttttcatggcactaacttttctgcagtttaagcattactgacataatcctcaatccagcgattaaagcaaagtggccctgcagcccgaagcaactctgtcctgtcaggctattaatgagcaattcttggatttagcaataagagcccagctgtttccttgcctcgaaagga

SEQ ID NO: 133791 - DNA, 601 bp, Human
ctatctcagtaaaggccagggggttcttaatgtggatggtcgttgatctttaattcgaagacccagtagcttgaacctattcctccttgaaagtcagggccaagtgtttatgagaattcttactacctttgataaagataaatcctagtgtacatcttgttgctaattaaaaacagtacaatctgttcaaatattatttctggacagtacatttcatgaaactatcccacaggattgtttatctcaagctacagctttcagaccctatttttccaaatgacgaattcctcatgattattaytttttattattttttttttccagatgatccaggaacatgtacatcttgcgctatggggtattacaggtaagtctggtcttccttttcatggcactaacttttctgcagtttaagcattactgacataatcctcaatccagcgattaaagcaaagtggccctgcagcccgaagcaactctgtcctgtcaggctattaatgagcaattcttggatttagcaataagagcccagctgtttccttgcctcgaaaggaggccatctctttcttgatcctggaagtcatccagcctgacactggtg

SEQ ID NO: 133792 - DNA, 601 bp, Human
aaaggccagggggttcttaatgtggatggtcgttgatctttaattcgaagacccagtagcttgaacctattcctccttgaaagtcagggccaagtgtttatgagaattcttactacctttgataaagataaatcctagtgtacatcttgttgctaattaaaaacagtacaatctgttcaaatattatttctggacagtacatttcatgaaactatcccacaggattgtttatctcaagctacagctttcagaccctatttttccaaatgacgaattcctcatgattattactttttattattttttttttccagatgatccaggaacatgtacatcttgcgctatggggtattacaggtaagtctggtcttccttttcatggcactaacttttctgcagtttaagcattactgacataatcctcaatccagcgattaaagcaaagtggccctgcagcccgaagcaactctgtcctgtcaggctattaatgagcaattcttggatttagcaataagagcccagctgtttccttgcctcgaaaggaggccatctctttcttgatcctggaagtcatccagcctgacactggtgtctaggaatc

SEQ ID NO: 133793 - DNA, 601 bp, Human
gaagcaactctgtcctgtcaggctattaatgagcaattcttggatttagcaataagagcccagctgtttccttgcctcgaaaggaggccatctctttcttgatcctggaagtcatccagcctgacactggtgtctaggaatcctgccatgggttaccaagattcagatcttgctgttcttgggcagaccttaataatatacctggtcctaagtaagctgtttgcaaacgtctgcatggatactgcgtccttaaccagagcgaaggctccagggtgaagccaggtgctatatcagctcttartcatcccctaggtaacaagagacacagaccactaggttaaatgaaacagaggtaaccatcactcccaatgtactctaaaaacaatccacaaaatcaaaaatggcatgtttcaatatcgccccctcttcctagtctagcttcccttccagcacacactgttgactgtcctagaaggaaaatgaaagagaaaggagctgcaaaggaaaggaagtccgtgggtgatgcatgggctgcataatccctccctgtcctcctaagaactcaggagttttgtgatatacaaactctcacgactatttc

SEQ ID NO: 133794 - DNA, 601 bp, Human
aatggcatgtttcaatatcgccccctcttcctagtctagcttcccttccagcacacactgttgactgtcctagaaggaaaatgaaagagaaaggagctgcaaaggaaaggaagtccgtgggtgatgcatgggctgcataatccctccctgtcctcctaagaactcaggagttttgtgatatacaaactctcacgactatttcatctctcgatcattttattgagattgtcagagacacaggaggatgttaatctcctgaagagaaaactgaagctcagagaggggcaaggttttactccarttgcaccacagctactgacaggtctacatttgcgacatttggcctttggcgggtcacctcctcttgtcacattgccttttccctccatccatagaattggacaaagcaatgtggtgacaagagaaggcgacccacctgtccaaaaacaaatacacttgaaatgtggtaataggtaagaaaaagtaaaaggagtgtggaggatgggagagaaagggaagcccaacaagctgaaacatactaaaaatgatcagttaaccttatcagttcttagccttacggttttaatctaacttttccaga

SEQ ID NO: 133795 - DNA, 601 bp, Human
gagctgcaaaggaaaggaagtccgtgggtgatgcatgggctgcataatccctccctgtcctcctaagaactcaggagttttgtgatatacaaactctcacgactatttcatctctcgatcattttattgagattgtcagagacacaggaggatgttaatctcctgaagagaaaactgaagctcagagaggggcaaggttttactccagttgcaccacagctactgacaggtctacatttgcgacatttggcctttggcgggtcacctcctcttgtcacattgccttttccctccatccatrgaattggacaaagcaatgtggtgacaagagaaggcgacccacctgtccaaaaacaaatacacttgaaatgtggtaataggtaagaaaaagtaaaaggagtgtggaggatgggagagaaagggaagcccaacaagctgaaacatactaaaaatgatcagttaaccttatcagttcttagccttacggttttaatctaacttttccagaatagcctgccattctctacattgactatgtctcacatcactgcactcctgacccactttgtttttttgggttttttttgtttgtttgttttta

SEQ ID NO: 133796 - DNA, 601 bp, Human
attgccttttccctccatccatagaattggacaaagcaatgtggtgacaagagaaggcgacccacctgtccaaaaacaaatacacttgaaatgtggtaataggtaagaaaaagtaaaaggagtgtggaggatgggagagaaagggaagcccaacaagctgaaacatactaaaaatgatcagttaaccttatcagttcttagccttacggttttaatctaacttttccagaatagcctgccattctctacattgactatgtctcacatcactgcactcctgacccactttgtttttttgggktttttttgtttgtttgtttttaagacagtctcactctgtggcccaggctggagtgcagtggcacgatgtcagctcactgcaacctctgcctcccaagttcaagtgattcttgtgcctcagcctccctagtagctgggattataggtgcacaccaccacgcccagctagtttttgtatttttagcagagacagggtttcgccatgttggccaggctctgttaaactttgtcaaacatcctctgttaaacgttggagccaaacctggccgcctcttcagctctccactactcgctaatgagc

SEQ ID NO: 133797 - DNA, 601 bp, Human
cccactttgtttttttgggttttttttgtttgtttgtttttaagacagtctcactctgtggcccaggctggagtgcagtggcacgatgtcagctcactgcaacctctgcctcccaagttcaagtgattcttgtgcctcagcctccctagtagctgggattataggtgcacaccaccacgcccagctagtttttgtatttttagcagagacagggtttcgccatgttggccaggctctgttaaactttgtcaaacatcctctgttaaacgttggagccaaacctggccgcctcttcagctcwccactactcgctaatgagcatgtttcataaaaccctctgaaaaacaaataccctggaagaacatgctccaatatcactaagggtacaacatgagatatttatttcaagaaacaaacatatataatctttgaaaacattcagcaactttgaatacagcgagtgaaatgccttacaatagacgttgttgctgggcgtgttggctcacgcctgtaatcccaacactttgggaggccaaggtgggtggatcacctgaggtcaggagtttgggaccagcctagccaacctggggaaaccccgtct

SEQ ID NO: 133798 - DNA, 601 bp, Human
cagctagtttttgtatttttagcagagacagggtttcgccatgttggccaggctctgttaaactttgtcaaacatcctctgttaaacgttggagccaaacctggccgcctcttcagctctccactactcgctaatgagcatgtttcataaaaccctctgaaaaacaaataccctggaagaacatgctccaatatcactaagggtacaacatgagatatttatttcaagaaacaaacatatataatctttgaaaacattcagcaactttgaatacagcgagtgaaatgccttacaatagacrttgttgctgggcgtgttggctcacgcctgtaatcccaacactttgggaggccaaggtgggtggatcacctgaggtcaggagtttgggaccagcctagccaacctggggaaaccccgtctctactaaaaatacaaaaattagccgagtgtggtggcatgcatctgtagttccagctactcaggaagctgaggcaagagaatcacttgaacccaggaggtggaggtggcagtgagccaagatcatgccattgcactccagcctcagtgacagggagatttagtctcaaaaaaaaaaaaaaaa

SEQ ID NO: 133799 - DNA, 601 bp, Human
ataccctggaagaacatgctccaatatcactaagggtacaacatgagatatttatttcaagaaacaaacatatataatctttgaaaacattcagcaactttgaatacagcgagtgaaatgccttacaatagacgttgttgctgggcgtgttggctcacgcctgtaatcccaacactttgggaggccaaggtgggtggatcacctgaggtcaggagtttgggaccagcctagccaacctggggaaaccccgtctctactaaaaatacaaaaattagccgagtgtggtggcatgcatctgtarttccagctactcaggaagctgaggcaagagaatcacttgaacccaggaggtggaggtggcagtgagccaagatcatgccattgcactccagcctcagtgacagggagatttagtctcaaaaaaaaaaaaaaaaacagttgttaaggaagatatgcaaaggtttcccctgatatcatgctgatgctctgaaattcatcaaaggcaggggtcaatttcactccactcctccttcaggtaagcctgcaattcagtggagtctgaattacaacattttactgtagaatgagaataacagataac

SEQ ID NO: 133800 - DNA, 601 bp, Human
tgccttacaatagacgttgttgctgggcgtgttggctcacgcctgtaatcccaacactttgggaggccaaggtgggtggatcacctgaggtcaggagtttgggaccagcctagccaacctggggaaaccccgtctctactaaaaatacaaaaattagccgagtgtggtggcatgcatctgtagttccagctactcaggaagctgaggcaagagaatcacttgaacccaggaggtggaggtggcagtgagccaagatcatgccattgcactccagcctcagtgacagggagatttagtctcaaaaaaaaaaaaaaaaacagttgttaaggaagatatgcaaaggtttcccctgatatcatgctgatgctctgaaattcatcaaaggcaggggtcaatttcactccactcctccttcaggtaagcctgcaattcagtggagtctgaattacaacattttactgtagaatgagaataacagataacgtacataaaaatatttataaataaaagctaagctacttcgctactattgttaataatctggttacagacattttagtaagctgcctggactcgacaccaagctatttcaggcctcagt

SEQ ID NO: 133801 - DNA, 601 bp, Human
gtggtggcatgcatctgtagttccagctactcaggaagctgaggcaagagaatcacttgaacccaggaggtggaggtggcagtgagccaagatcatgccattgcactccagcctcagtgacagggagatttagtctcaaaaaaaaaaaaaaaaacagttgttaaggaagatatgcaaaggtttcccctgatatcatgctgatgctctgaaattcatcaaaggcaggggtcaatttcactccactcctccttcaggtaagcctgcaattcagtggagtctgaattacaacattttactgtakaatgagaataacagataacgtacataaaaatatttataaataaaagctaagctacttcgctactattgttaataatctggttacagacattttagtaagctgcctggactcgacaccaagctatttcaggcctcagtgccagttgctatgtgataaatcacacaagcaaccttttcacacagactttggttaaaatcccagtcccaccgttagctagctgtgtgatttttgagcacttaaccctgagctccagttcccttatctagaaattaaagttacatgatatctaccatacgagat

SEQ ID NO: 133802 - DNA, 601 bp, Human
tcaggaagctgaggcaagagaatcacttgaacccaggaggtggaggtggcagtgagccaagatcatgccattgcactccagcctcagtgacagggagatttagtctcaaaaaaaaaaaaaaaaacagttgttaaggaagatatgcaaaggtttcccctgatatcatgctgatgctctgaaattcatcaaaggcaggggtcaatttcactccactcctccttcaggtaagcctgcaattcagtggagtctgaattacaacattttactgtagaatgagaataacagataacgtacataaaamtatttataaataaaagctaagctacttcgctactattgttaataatctggttacagacattttagtaagctgcctggactcgacaccaagctatttcaggcctcagtgccagttgctatgtgataaatcacacaagcaaccttttcacacagactttggttaaaatcccagtcccaccgttagctagctgtgtgatttttgagcacttaaccctgagctccagttcccttatctagaaattaaagttacatgatatctaccatacgagatttgtggagatttagatgagctaatacttga

SEQ ID NO: 133803 - DNA, 601 bp, Human
ggcaggggtcaatttcactccactcctccttcaggtaagcctgcaattcagtggagtctgaattacaacattttactgtagaatgagaataacagataacgtacataaaaatatttataaataaaagctaagctacttcgctactattgttaataatctggttacagacattttagtaagctgcctggactcgacaccaagctatttcaggcctcagtgccagttgctatgtgataaatcacacaagcaaccttttcacacagactttggttaaaatcccagtcccaccgttagctagctstgtgatttttgagcacttaaccctgagctccagttcccttatctagaaattaaagttacatgatatctaccatacgagatttgtggagatttagatgagctaatacttgacacataatcagtactctataaataagtatcagtaccccttctttctccccagccttctcccagctgccctgataaagagtccttggaggtccagaaggaggtggttagtgacttgggttgaggggtgcataacagaccaagcctgaaattcaattatccactcctgttgaaaatgctgcacaggctgggc

SEQ ID NO: 133804 - DNA, 601 bp, Human
tctgaattacaacattttactgtagaatgagaataacagataacgtacataaaaatatttataaataaaagctaagctacttcgctactattgttaataatctggttacagacattttagtaagctgcctggactcgacaccaagctatttcaggcctcagtgccagttgctatgtgataaatcacacaagcaaccttttcacacagactttggttaaaatcccagtcccaccgttagctagctgtgtgatttttgagcacttaaccctgagctccagttcccttatctagaaattaaagwtacatgatatctaccatacgagatttgtggagatttagatgagctaatacttgacacataatcagtactctataaataagtatcagtaccccttctttctccccagccttctcccagctgccctgataaagagtccttggaggtccagaaggaggtggttagtgacttgggttgaggggtgcataacagaccaagcctgaaattcaattatccactcctgttgaaaatgctgcacaggctgggcgtggtggctcatgcctgtaattccaacactttgggaggcagaggtgggcagatccc

SEQ ID NO: 133805 - DNA, 601 bp, Human
ctgtagaatgagaataacagataacgtacataaaaatatttataaataaaagctaagctacttcgctactattgttaataatctggttacagacattttagtaagctgcctggactcgacaccaagctatttcaggcctcagtgccagttgctatgtgataaatcacacaagcaaccttttcacacagactttggttaaaatcccagtcccaccgttagctagctgtgtgatttttgagcacttaaccctgagctccagttcccttatctagaaattaaagttacatgatatctaccataygagatttgtggagatttagatgagctaatacttgacacataatcagtactctataaataagtatcagtaccccttctttctccccagccttctcccagctgccctgataaagagtccttggaggtccagaaggaggtggttagtgacttgggttgaggggtgcataacagaccaagcctgaaattcaattatccactcctgttgaaaatgctgcacaggctgggcgtggtggctcatgcctgtaattccaacactttgggaggcagaggtgggcagatcccctgaggccaggagtttgag

SEQ ID NO: 133806 - DNA, 601 bp, Human
cctggactcgacaccaagctatttcaggcctcagtgccagttgctatgtgataaatcacacaagcaaccttttcacacagactttggttaaaatcccagtcccaccgttagctagctgtgtgatttttgagcacttaaccctgagctccagttcccttatctagaaattaaagttacatgatatctaccatacgagatttgtggagatttagatgagctaatacttgacacataatcagtactctataaataagtatcagtaccccttctttctccccagccttctcccagctgccctgakaaagagtccttggaggtccagaaggaggtggttagtgacttgggttgaggggtgcataacagaccaagcctgaaattcaattatccactcctgttgaaaatgctgcacaggctgggcgtggtggctcatgcctgtaattccaacactttgggaggcagaggtgggcagatcccctgaggccaggagtttgagaccagcctgggcaacatggcaaaaccccgtctctggaaaaaaatacaaaaattagccaggcatggtggtgtgcacctgtaatcccagctactcgggaggctgaggcaa

SEQ ID NO: 133807 - DNA, 601 bp, Human
tgtgatttttgagcacttaaccctgagctccagttcccttatctagaaattaaagttacatgatatctaccatacgagatttgtggagatttagatgagctaatacttgacacataatcagtactctataaataagtatcagtaccccttctttctccccagccttctcccagctgccctgataaagagtccttggaggtccagaaggaggtggttagtgacttgggttgaggggtgcataacagaccaagcctgaaattcaattatccactcctgttgaaaatgctgcacaggctgggcrtggtggctcatgcctgtaattccaacactttgggaggcagaggtgggcagatcccctgaggccaggagtttgagaccagcctgggcaacatggcaaaaccccgtctctggaaaaaaatacaaaaattagccaggcatggtggtgtgcacctgtaatcccagctactcgggaggctgaggcaagagaatcacttgagcccgggagacagaagttgcagtgagccgagattgaccactgcactccagcctgggcgacaagagcaaaactccatctcaaacaaaacaaaacaaaacaaaacaa

SEQ ID NO: 133808 - DNA, 601 bp, Human
tacttgacacataatcagtactctataaataagtatcagtaccccttctttctccccagccttctcccagctgccctgataaagagtccttggaggtccagaaggaggtggttagtgacttgggttgaggggtgcataacagaccaagcctgaaattcaattatccactcctgttgaaaatgctgcacaggctgggcgtggtggctcatgcctgtaattccaacactttgggaggcagaggtgggcagatcccctgaggccaggagtttgagaccagcctgggcaacatggcaaaaccccstctctggaaaaaaatacaaaaattagccaggcatggtggtgtgcacctgtaatcccagctactcgggaggctgaggcaagagaatcacttgagcccgggagacagaagttgcagtgagccgagattgaccactgcactccagcctgggcgacaagagcaaaactccatctcaaacaaaacaaaacaaaacaaaacaaaaaattctgcatggacatacataaggagattaaattatggtgaggagaaatacatcaacataagtcatgaaagaaatgatgtcttcttcctctaggtttgatc

SEQ ID NO: 133809 - DNA, 601 bp, Human
gaggggtgcataacagaccaagcctgaaattcaattatccactcctgttgaaaatgctgcacaggctgggcgtggtggctcatgcctgtaattccaacactttgggaggcagaggtgggcagatcccctgaggccaggagtttgagaccagcctgggcaacatggcaaaaccccgtctctggaaaaaaatacaaaaattagccaggcatggtggtgtgcacctgtaatcccagctactcgggaggctgaggcaagagaatcacttgagcccgggagacagaagttgcagtgagccgagatygaccactgcactccagcctgggcgacaagagcaaaactccatctcaaacaaaacaaaacaaaacaaaacaaaaaattctgcatggacatacataaggagattaaattatggtgaggagaaatacatcaacataagtcatgaaagaaatgatgtcttcttcctctaggtttgatcaccattgttataaaacctgtcctgagaagacctacagtgaggcagtggaatgcaaggcgtgtgatagtaactgtagcagctgtgaccagaatgggtgttactggtgtgaagagggcttctttctct

SEQ ID NO: 133810 - DNA, 601 bp, Human
acaaaacaaaaaattctgcatggacatacataaggagattaaattatggtgaggagaaatacatcaacataagtcatgaaagaaatgatgtcttcttcctctaggtttgatcaccattgttataaaacctgtcctgagaagacctacagtgaggcagtggaatgcaaggcgtgtgatagtaactgtagcagctgtgaccagaatgggtgttactggtgtgaagagggcttctttctcttaggtaagttagaaaatggcaccatccaagctaagaaccaggcactggagctccacacagtcrgggccacaggagcgcacatgtgattggtttcagagtctgtgcgtgtgggcacctctggcccaaggagaaattttaatttggtttagaaataaacattagccaaaccacctccttctgcttttattactgaagcatggttcctgttccactaattaatctcaaatatctccaagctgatggaaacaaggctgaattggatggagatagagagtggggacctgaagatgaatgttttggcattgaagtcacctggcatattgagagctctgacccttgtcttgagacttaatccatcttata

SEQ ID NO: 133811 - DNA, 601 bp, Human
acaaaaaattctgcatggacatacataaggagattaaattatggtgaggagaaatacatcaacataagtcatgaaagaaatgatgtcttcttcctctaggtttgatcaccattgttataaaacctgtcctgagaagacctacagtgaggcagtggaatgcaaggcgtgtgatagtaactgtagcagctgtgaccagaatgggtgttactggtgtgaagagggcttctttctcttaggtaagttagaaaatggcaccatccaagctaagaaccaggcactggagctccacacagtcggggcmacaggagcgcacatgtgattggtttcagagtctgtgcgtgtgggcacctctggcccaaggagaaattttaatttggtttagaaataaacattagccaaaccacctccttctgcttttattactgaagcatggttcctgttccactaattaatctcaaatatctccaagctgatggaaacaaggctgaattggatggagatagagagtggggacctgaagatgaatgttttggcattgaagtcacctggcatattgagagctctgacccttgtcttgagacttaatccatcttatatatcc

SEQ ID NO: 133812 - DNA, 601 bp, Human
tctgcatggacatacataaggagattaaattatggtgaggagaaatacatcaacataagtcatgaaagaaatgatgtcttcttcctctaggtttgatcaccattgttataaaacctgtcctgagaagacctacagtgaggcagtggaatgcaaggcgtgtgatagtaactgtagcagctgtgaccagaatgggtgttactggtgtgaagagggcttctttctcttaggtaagttagaaaatggcaccatccaagctaagaaccaggcactggagctccacacagtcggggccacaggagcrcacatgtgattggtttcagagtctgtgcgtgtgggcacctctggcccaaggagaaattttaatttggtttagaaataaacattagccaaaccacctccttctgcttttattactgaagcatggttcctgttccactaattaatctcaaatatctccaagctgatggaaacaaggctgaattggatggagatagagagtggggacctgaagatgaatgttttggcattgaagtcacctggcatattgagagctctgacccttgtcttgagacttaatccatcttatatatccccatgcact

SEQ ID NO: 133813 - DNA, 601 bp, Human
tgaaaaaggacttaggtaaagtgttggatttttctagatggagtctcactcttgtcacccaggttggagtgcagtggcgcaatctcagctcactgcaacctctgttggccaggctggcctcgaacacctgacctcaggtgatccacccacctcagcctcccaaagtgctgggattacaagcatgagccacctcgcccgacctggatttattaaaacacatttcttggttgacataagctaaagccatcttggtttctttgaaaacaaatgcaaaggctggacacagtggcctggccaacayggtgaaaccccatctctactaaaaatatataagccgtgcgtggtgacacatacctgtagtcccggtcactcaagaggctgaggcaggagaattgcttgaacccgggaggtggaggatgcagtgagccgagatcatgccactgcactttagcctgggcaacagagagagactccatctcaaaaataataataaaaacaaatgcaaagaaaaatgtccctaaaatttcctccagcctctttagaacttggccttgcaaagatcactaaagccttcatgctttctctctgtgttctcacatag

SEQ ID NO: 133814 - DNA, 601 bp, Human
atttggggatttttcactaataggggattggggacagagatgagagtgtttctcatggctggacaaaagcaatcaagtcaacgacagagctgtactttcccattcccatgacctatgaaataagacatgcagaccattaacacagagaaatagccatttattcactaagcaaggtaaagctgtagctcagcttcccccagcatagtgtaagcactgaaatggatagtaaatgggaaatgcattccataaagtcctgggagtatttgagccaatgcctacaaccttctcctgacttcttttkcttaaaaaaaaacaggatcgagagtgtaataggagaggagaggcttccagagaacaagcactaattagccacacctttcagatgatggaaagcagattgcagtcatcctgggtcaattcagaggaaacccaggcaaattacagagtgtttttgagaggatatagctgcctaggtggtaccagaacgtttttctgtttcattttgggttttgttttattttgtttttcaaacacagattcagattcaggtaggaaaggtaagatgacacacacttcaatccattccttcacccatgctgct

SEQ ID NO: 133815 - DNA, 601 bp, Human
ggggatttttcactaataggggattggggacagagatgagagtgtttctcatggctggacaaaagcaatcaagtcaacgacagagctgtactttcccattcccatgacctatgaaataagacatgcagaccattaacacagagaaatagccatttattcactaagcaaggtaaagctgtagctcagcttcccccagcatagtgtaagcactgaaatggatagtaaatgggaaatgcattccataaagtcctgggagtatttgagccaatgcctacaaccttctcctgacttctttttcttaaaaaaaaacaggatcgagagtgtaataggagaggagaggcttccagagaacaagcactaattagccacacctttcagatgatggaaagcagattgcagtcatcctgggtcaattcagaggaaacccaggcaaattacagagtgtttttgagaggatatagctgcctaggtggtaccagaacgtttttctgtttcattttgggttttgttttattttgtttttcaaacacagattcagattcaggtaggaaaggtaagatgacacacacttcaatccattccttcacccatgctgctcccc

SEQ ID NO: 133816 - DNA, 601 bp, Human
atagctgcctaggtggtaccagaacgtttttctgtttcattttgggttttgttttattttgtttttcaaacacagattcagattcaggtaggaaaggtaagatgacacacacttcaatccattccttcacccatgctgctccccagtggaaacaataagatcctgtttgcgtctgaagactacaaccaaccccatgagcatctatcagcacaggctgggaaaacacccttgaaataaaagtccagctagagttccctgaactcctcttttaataaggtggctaatcagaatgagaatgacwacagtgagagagccaccattctttgccaactgccaacaaagtgggaatacctcctacctagtctaaggatgcagattcctccacctatcagacaatgcctgacaaatcctccagctaagactaagtaatcaaagattgtgctcgactctctgttttttcagccaccaaaaagtcactgcacaaatgtatagatcatccccagaccctctctcctggtcactagtatattgtgacaattatttagtgtccctaaatggcaggaataaaaccaatattcaaggccggacgtggtagctcatg

SEQ ID NO: 133817 - DNA, 601 bp, Human
agattcctccacctatcagacaatgcctgacaaatcctccagctaagactaagtaatcaaagattgtgctcgactctctgttttttcagccaccaaaaagtcactgcacaaatgtatagatcatccccagaccctctctcctggtcactagtatattgtgacaattatttagtgtccctaaatggcaggaataaaaccaatattcaaggccggacgtggtagctcatgcctataatcccagcactttgggaggccgaggcgggtggatctcttgaggtcaggagttcgagaccaacctggycaacatggtgaaacctcatctctactaaaaatacaaaaaaaattagccgggcgtggtggtcagtacctgtaatcccagctactcaggaggctgaggtgcaagaatcacttgaacccaggaggcagaggttgcagtgagctgagattgtgccacagcactccagcctgggcaacagagagactccatctaaaacaacaacaacaacaaacgaacaaacaaaaatatataatattcgacaggctgcaaatggcttcagcagtgactcaagcatcacacaaccttggtggaaaggttcaggta

SEQ ID NO: 133818 - DNA, 601 bp, Human
caacaacaaacgaacaaacaaaaatatataatattcgacaggctgcaaatggcttcagcagtgactcaagcatcacacaaccttggtggaaaggttcaggtatggcagaccacgggctttgaaggaagatgatggcttcggctggtttcctgaagccacttttgggaatggaagcactttcctctgctactgttaaaccatttggattttcttaagtggtttcccccggtagtgctggagagtcctaggagtaatttctgcacatttatcttacctcatatttccatcattgattaaaacmatgttatagcaggttctaattacatattctgctgatagtctaatctacagaacacagacatggtgaattagctttgtgtttgtgaccacatcctaacaatttatcactagcctgtctcttgatcttaattctaatccttggggaaagactgaaatcccagagttagtcacaaacactgaaagtcactcacatgtgaaaaaaaataaatcgacttcagtagtgggaagatacgttgcctaatagtcactgaactttagaaaacttcaaagatgccatggaaatctgatttttagagagact

SEQ ID NO: 133819 - DNA, 601 bp, Human
cttaagtggtttcccccggtagtgctggagagtcctaggagtaatttctgcacatttatcttacctcatatttccatcattgattaaaaccatgttatagcaggttctaattacatattctgctgatagtctaatctacagaacacagacatggtgaattagctttgtgtttgtgaccacatcctaacaatttatcactagcctgtctcttgatcttaattctaatccttggggaaagactgaaatcccagagttagtcacaaacactgaaagtcactcacatgtgaaaaaaaataaatcracttcagtagtgggaagatacgttgcctaatagtcactgaactttagaaaacttcaaagatgccatggaaatctgatttttagagagactttatagatgtgtacagctgtctcacttagaaatgagtacaccatttttagttatttaacctaccagaacacagagtgcaaaaaaacacatggcactgggtaagtaattaactgtttggccagtaggacaaaggaagcatctgtatcagcttgcccagatcgttatatactcaggagttctggaagtggattgtgaaaccattgacagctt

SEQ ID NO: 133820 - DNA, 601 bp, Human
aaacttcaaagatgccatggaaatctgatttttagagagactttatagatgtgtacagctgtctcacttagaaatgagtacaccatttttagttatttaacctaccagaacacagagtgcaaaaaaacacatggcactgggtaagtaattaactgtttggccagtaggacaaaggaagcatctgtatcagcttgcccagatcgttatatactcaggagttctggaagtggattgtgaaaccattgacagcttgaaattagctatggtgggagtatttacaccacagaaattggaaacactrcaaatcaggtttttggtttttcatttttctagagacctgtcttaccagcacaccattattttggcttctatcaaattacttcagaattcaaatttattgctgaaaaattctaaagcctatgtctacaccctctagcagatgcaggctttagggcacagcacacatgaattcaaatcccagctctgtgttttgctagctgtgtgaccttcagtgagttactcatcctctctgagcctgtgtccttctctgtaaagtgaaaacatgaaactgcctcacacaaagtcattttaagaatgaaat

SEQ ID NO: 133821 - DNA, 601 bp, Human
agcacaccattattttggcttctatcaaattacttcagaattcaaatttattgctgaaaaattctaaagcctatgtctacaccctctagcagatgcaggctttagggcacagcacacatgaattcaaatcccagctctgtgttttgctagctgtgtgaccttcagtgagttactcatcctctctgagcctgtgtccttctctgtaaagtgaaaacatgaaactgcctcacacaaagtcattttaagaatgaaatgagaaaatgtatataaagctctcaggacacatataacacaataaagyctcgtctactccctaactatttgactcggtccagttttaacacttgaaacaccagtttgctttgaaagcagcattccctgggtcacaaaagaaagcaatatttggggccatgcgcagtggctcacacatgtaatcccaggactttgggaagctgaggtgggcagatcacttgaggccaggattcaagaccaacctggccaacatggtgaaaccctgtctctactaaaaatacaaaaattagccaggtgtggtggcacgcatctgtagtctcagctacttgggaggctgaggcattagaat

SEQ ID NO: 133822 - DNA, 601 bp, Human
caggactttgggaagctgaggtgggcagatcacttgaggccaggattcaagaccaacctggccaacatggtgaaaccctgtctctactaaaaatacaaaaattagccaggtgtggtggcacgcatctgtagtctcagctacttgggaggctgaggcattagaatcacttgaacctggaaggtggaggttgcagtgagccgagatcacaccactgcactccagcctgggcaacagagcgcgactctctcaaaaaaaaaaaaaaagaaagaaaagaaagaaagccatttgagagggtatagasataaacagggctctaagggaaatggccctggaaaaaaaggcaccagataatggtaagtcgggatacctaataggcagaatcctgacttagccaagaatgtatactcacaaagatgttgagagcagctttacgattttaaaaagagaagggaacaatctcaaaaatataacaaaagaaaaaagctaaatgaattaccatccatacaaataaatatgcaaaccattgaaaatgatgtttacagctgggcacggtggctcatgcctgtaatcccagcactttgggaggccaaggcaggcagat

SEQ ID NO: 133823 - DNA, 601 bp, Human
ctaaaaatacaaaatactagccaggcatggcggtgcttgcctatagtcccagctacttgggaggctgaggcaggagaatcgcttgaacctgggagccagaggctgcaacaagctgagatggcgccaccgcactctggcctgggaaacagagcaagactcctcgtggaaaaaaaaaatgatgtttacaaggaatgctaatgacaagagaaaatacctacgagatttatagtgttaaatgcagtgttcagggtcagtcttatgtgtacagaagctataaatgatgacacatctatacatagactgtaattatactcacacactcaatatgaagatgagacatccatgtaccacagtatacacagcagacatttctgggtggtgggtttataggtgaagtttatcttctttatcctttttgcattaaaaaaaaaactaaacacttttttttttaataaaaaagaagctgtgtccactgcaaacctatctgtggtgaagagcctgctgcaggagcgacgaaggtggaaagttcaaatcaaaagaggtaacagggaaatagggaggcaacaatcacagcagcagagactatctctggagatggtct

SEQ ID NO: 133824 - DNA, 601 bp, Human
gccaccgcactctggcctgggaaacagagcaagactcctcgtggaaaaaaaaaatgatgtttacaaggaatgctaatgacaagagaaaatacctacgagatttatagtgttaaatgcagtgttcagggtcagtcttatgtgtacagaagctataaatgatgacacatctatacatagactgtaattatactcacacactcaatatgaagatgagacatccatgtaccacagtatacacagcagacatttctgggtggtgggtttataggtgaagtttatcttctttatcctttttgcattaaaaaaaaaactaaacacttttttttttaataaaaaagaagctgtgtccactgcaaacctatctgtggtgaagagcctgctgcaggagcgacgaaggtggaaagttcaaatcaaaagaggtaacagggaaatagggaggcaacaatcacagcagcagagactatctctggagatggtctccgtggagaaatcaccccaagaagctgggaggccagaagcaaatggggtgcagagatgcagaggtcattagaaaaagttggagacaggaggggcaataaacacaacatatcagtgggcactc

SEQ ID NO: 133825 - DNA, 601 bp, Human
tttaataaaaaagaagctgtgtccactgcaaacctatctgtggtgaagagcctgctgcaggagcgacgaaggtggaaagttcaaatcaaaagaggtaacagggaaatagggaggcaacaatcacagcagcagagactatctctggagatggtctccgtggagaaatcaccccaagaagctgggaggccagaagcaaatggggtgcagagatgcagaggtcattagaaaaagttggagacaggaggggcaataaacacaacatatcagtgggcactcagagggaagactgtgagaagttccrcagtggagatttctgtaacagataaggatattcgtgacgagctaaatggtcatggctggcagaggctatcaagaaaagcctctgtccttgcagaactttaataggctaaggaagcacctctgccttcccagtcaccgcagcattgtttgaaatcacaaagactggaaaaaactaagtggttaccagtaggagatgagagaaataaagtcgatgtattcatacaatagaatactatggaggcaccaaaaggaagaggttctttctgtactgataaagaatgatttccaaatatattgcttg

SEQ ID NO: 133826 - DNA, 601 bp, Human
tgtggtgaagagcctgctgcaggagcgacgaaggtggaaagttcaaatcaaaagaggtaacagggaaatagggaggcaacaatcacagcagcagagactatctctggagatggtctccgtggagaaatcaccccaagaagctgggaggccagaagcaaatggggtgcagagatgcagaggtcattagaaaaagttggagacaggaggggcaataaacacaacatatcagtgggcactcagagggaagactgtgagaagttccacagtggagatttctgtaacagataaggatattcgtgaygagctaaatggtcatggctggcagaggctatcaagaaaagcctctgtccttgcagaactttaataggctaaggaagcacctctgccttcccagtcaccgcagcattgtttgaaatcacaaagactggaaaaaactaagtggttaccagtaggagatgagagaaataaagtcgatgtattcatacaatagaatactatggaggcaccaaaaggaagaggttctttctgtactgataaagaatgatttccaaatatattgcttgtttactttacaggcaaggtgataaaccgtgtgaataga

SEQ ID NO: 133827 - DNA, 601 bp, Human
caaaaaataaaagaaagccagggtaaatttttatctccaagctaggaaaaaaccaactacccagcctggcagcctaatcatttatatctccatctccacctgtatttgcatctatccgcatatctgtgtctatccatcctatctatgtatgtacctttctatcatctgtatttgaatctagtttcatctatggcaaggctcatcagctttgtatccatgattgtcatcacagaagctgagcaggccacccaggtatgaaaccagagggaaggaagaggggagtaaaacaagcctcagaaakggagtggaatggtggcaggagagaatcaacaggaagctgaaggaactacaatttactgcgcccctatgttaagcacttgacacgtattgtctcatttagtcttcacaacaatcctataagggcagaattattttctctcattttagagacaaggaaagtaggattctgagagtttaattactgtatccatgtgcccctatgttaagcacttgacacgtattatctcatttagtcttcacaacaatcctataagggcagaattattttctctcattttagagacaaggaaagtaggattct

SEQ ID NO: 133828 - DNA, 601 bp, Human
cctgggacaacctacttatagcccgaccaacaagaaagcctgtgagtaggggataattttgatgtttaacaatgatttgggacaaacttaagatgagataaatttaggttgcatagcacagtagctactctaaagaacacagtgacccaaacattgaccaataataaaatctgattttcaaagaacaaaaacagaaaaaaaaaagaaaagaagttcctccacgagaggtacaatgaattgtcaattatcatcttggagtgaagagaaatggtcatccggccgggcgcggtggctcacaccygtaatcccagcagtttgggaggctgaggcgggtggatcacctgaggtcaagagttcaagaccagctggtcaacatggcaaaaccccgtctctactaaaaatacaaaaattagctgggcatggtagtgggcacctgtaatcccagctacttgggagattgaggcaggagaatcacttgagcccaggaggcagaggcggcagtgagccaagatcacaccaccacactccagcctgggctacagagcgagactctgtctcaaaaaagaaaagaaaagaaaagaaaaggtcatccaacaatctt

SEQ ID NO: 133829 - DNA, 601 bp, Human
tctaaagaacacagtgacccaaacattgaccaataataaaatctgattttcaaagaacaaaaacagaaaaaaaaaagaaaagaagttcctccacgagaggtacaatgaattgtcaattatcatcttggagtgaagagaaatggtcatccggccgggcgcggtggctcacacccgtaatcccagcagtttgggaggctgaggcgggtggatcacctgaggtcaagagttcaagaccagctggtcaacatggcaaaaccccgtctctactaaaaatacaaaaattagctgggcatggtagtgsgcacctgtaatcccagctacttgggagattgaggcaggagaatcacttgagcccaggaggcagaggcggcagtgagccaagatcacaccaccacactccagcctgggctacagagcgagactctgtctcaaaaaagaaaagaaaagaaaagaaaaggtcatccaacaatcttggcaatagaagtgattacctttgactcataaactcattcacaagtgcatacacacaaatacaaactcactcccatttttaacacacaaaagaagtaattatgtgttcaaatatccccacagtatttga

SEQ ID NO: 133830 - DNA, 601 bp, Human
ttatcatcttggagtgaagagaaatggtcatccggccgggcgcggtggctcacacccgtaatcccagcagtttgggaggctgaggcgggtggatcacctgaggtcaagagttcaagaccagctggtcaacatggcaaaaccccgtctctactaaaaatacaaaaattagctgggcatggtagtgggcacctgtaatcccagctacttgggagattgaggcaggagaatcacttgagcccaggaggcagaggcggcagtgagccaagatcacaccaccacactccagcctgggctacagagygagactctgtctcaaaaaagaaaagaaaagaaaagaaaaggtcatccaacaatcttggcaatagaagtgattacctttgactcataaactcattcacaagtgcatacacacaaatacaaactcactcccatttttaacacacaaaagaagtaattatgtgttcaaatatccccacagtatttgaggctatcttgtagaataccacattccttgtggtaccacacattcgtgtggtatctttcttgataatcaattgcaaatgaaggagtaagagaaaaaaaaataaatgaagtctacaca

SEQ ID NO: 133831 - DNA, 601 bp, Human
tttcagaacattgtcatcaacctagaaagaaaccctatacccttttagctgttattcctactttttccatttcccccagccctaagcaaccactaatctactttctatccctgtagatttgctattcttggacatttcctataaatgggattatataaaatgtggtctttgagccaagcatggtggccatggtgcacacctctagtcccagctatcaggagcccaaggctggagaattgcttgagcccaggagttcaaggtcagcctgagcaacatagcaagaccctgtctctgaaaacaraaacaaaacacataaaacaaaaaagacaaaacatgtttttttctgacagactttttgacttagcataatgttttccagcttcatccccagctgggtatttgagaaaaggcttgatggtccctagctcttgaaggattttgtcaagcagagagtggagaaagggtagcaaagggtcagagtaagagaacccaggtgagaagtcaggtttggaaactcccagtcctcctcccctatcaaccgagctccaccccagcaaactcagccaagtgttacaataaagcaaaggtgaaagagatttgc

SEQ ID NO: 133832 - DNA, 601 bp, Human
gagaagtcaggtttggaaactcccagtcctcctcccctatcaaccgagctccaccccagcaaactcagccaagtgttacaataaagcaaaggtgaaagagatttgcttaccagagtcagtcattgcttcctcagtggtaggattgaactggttgtcattattattgccttatttatttaatcattacctttttcaactctctcttggattctttgagtgttccaggaattgacaacacattaaaacaaggaagaaagagatgcattttgctttactcaagttagttgaccgcttaatgtaytttacctcagagtctgggttgaaccattttcatggagcaatgggacactacgcagacatgcagcagtcaagatagtctgtatttcttgagcagtaggaaagctaccagcatggcctaggaatattgcagactatagaattgcaagcatatgccctcctgttatgggtagggtgatctgattatagcggaatccctcatctttgtgtttaaacacacaaaaaaaagaaaactaacaacagaagacacagagtctgaggaacacataatatccagtttatcttgggaagctttattgctgtt

SEQ ID NO: 133833 - DNA, 601 bp, Human
ccagtaccaactctcaggtgtggcaagagagacccatcatgaataacaaagacacccctaactcttaggaaattccaaaggttttgaggttagccgaagagaaagaccagacctctctttgggtgaggtcaaattctttactatgcttacaggaacaatgaatccatcaaattttcattcgattagaagatgtgattggtaaggtacacctgtaatcccagcactttgggatgccatggtgggcgcactgcttgaggccaggagtttgagaccagcttgggtaacatagtaagacccccayctctacaaaaaaaaaaagataaaaatttaaaaattagcccagtgtggcggcacacacctgtagtcctagctactcaggaggccaaagtgggaggatcacttgagcccagcaagtcgaggctgcagtgagccatgatcacaccactgcactctagcctgggcaacagagccagaccttgtctcaccaaaaaaaaaaaaaaaaaaaaaaagaatgtgatctatttaagaatgcactaaatttccttaatttcaaatttctcaaatctgatcaaactgctggtgggcatataacacattgcct

SEQ ID NO: 133834 - DNA, 601 bp, Human
aggctgcagtgagccatgatcacaccactgcactctagcctgggcaacagagccagaccttgtctcaccaaaaaaaaaaaaaaaaaaaaaaagaatgtgatctatttaagaatgcactaaatttccttaatttcaaatttctcaaatctgatcaaactgctggtgggcatataacacattgcctgtcttgttcaattcatttttaagagatagactttgtttgagcaaagtagctgagtctttcttcttcaagtgttctctgtcatggtcaaaaaaaagctaagggtactactgtgtgagraagctcaatcttagcttttatctggatgctatttctttctctctcttctacctagactgctttcttctccaatttttcttacctgaaactatatcagaaatatgactttttggctgggcacagtggctcacacatgtaactgggaggccaaggcaggcagatcacttgaggtcaggagtttgagaccagcctggccaacatggtaaagccccatctttactaaaaaaatacaaaaattagccaggcatggtggtgcatgcctgtagtcccagctactcaggaggctgaggcaggagaatc

SEQ ID NO: 133835 - DNA, 601 bp, Human
tggtgcatgcctgtagtcccagctactcaggaggctgaggcaggagaatcacttcaacccaggaggtagaggttgcagtgagttgagatcacgccactgcacttcagcctgggtgacagggcaagaccctgtctcagacaaaacaaaacaaagaaatgtgacttctgttcacccctgccctatttcttcctggaacactcaatatatttttgtttactgaatgcatacagtaaataaatgactgaaagaatgattaaacgtgtgagtgctgattaattaaaacaccaagtaaaaatgctgsgtagcagcggatcccttcctggcttgtgatttaaagaggtctctggtagattgggttatttgttgcagttcttcgccactcctcgtattcatgcccactgcctgcaactttgcaccaactccactagaggtgaaatggacttccttgtcccttgactttggctgggttatgtgatttgttttggccaatgacatgttagcagaagaaaggtggaggcataaaatgtgcccgattgaacttgcccttctgcgcgtttgtcatggctgtgagaagaacgtcccctggtagtcccggtagcca

SEQ ID NO: 133836 - DNA, 601 bp, Human
atgattaaacgtgtgagtgctgattaattaaaacaccaagtaaaaatgctgggtagcagcggatcccttcctggcttgtgatttaaagaggtctctggtagattgggttatttgttgcagttcttcgccactcctcgtattcatgcccactgcctgcaactttgcaccaactccactagaggtgaaatggacttccttgtcccttgactttggctgggttatgtgatttgttttggccaatgacatgttagcagaagaaaggtggaggcataaaatgtgcccgattgaacttgcccttctrcgcgtttgtcatggctgtgagaagaacgtcccctggtagtcccggtagccagggaaaatagaggaatgtgaaggcatggacccagtgtgtagcctggagtcaagcctgccaagcccagcctagatctgcttccccacacacatgagtgagagtaaatgattgttgttttaagccactgagttttgggttgggatggtttgtggcacagcaatattatggcgctaactcactaattgatcatgatagaaagcaattggaataggtacctatgacatcagaagtccattttctctaagccgg

SEQ ID NO: 133837 - DNA, 601 bp, Human
gccaatgacatgttagcagaagaaaggtggaggcataaaatgtgcccgattgaacttgcccttctgcgcgtttgtcatggctgtgagaagaacgtcccctggtagtcccggtagccagggaaaatagaggaatgtgaaggcatggacccagtgtgtagcctggagtcaagcctgccaagcccagcctagatctgcttccccacacacatgagtgagagtaaatgattgttgttttaagccactgagttttgggttgggatggtttgtggcacagcaatattatggcgctaactcactaatkgatcatgatagaaagcaattggaataggtacctatgacatcagaagtccattttctctaagccggcttatggttcttcctcttccgcgagttccagctcttccattcagcttttcccaccaaagaaacctcatctaagttcatgtcttttgcagggacatggacgaagctggaaaccttcattctcagcaaactaacacaggaacagaaaatcaaacactgcatgttctcactcataagtgggagttgaacaatgagaacacatggacacagggaggggaacatcacacaccagggcctg

SEQ ID NO: 133838 - DNA, 601 bp, Human
ccttcattctcagcaaactaacacaggaacagaaaatcaaacactgcatgttctcactcataagtgggagttgaacaatgagaacacatggacacagggaggggaacatcacacaccagggcctgtcggagggtagggggcaaggggagggagagcattaggagaaatacctaatgtagatagatgatgagttgatgggtgcagcaaaccaccatggcacatgtatacctatgtaacaaacctgcacattctgcacatgtaccgcagaatttaaagtataaaaaaaaaagaaaaaagaaaraaaagaaacctcatctatccatccctcatctcccaaatatatttgagaggattggggttgtatattttactgtgttcccccaccagtgagtgatttctacaatgggatagtttaatcactggggttctatatacacagacataagattccgcctggaagaaggtgatttgcacaaacacgctggtactcaaaatatgtttagtgctgtgtgcaaatgttcatatgtatgcatttgaaaaaagtcatcagaggttggttgacagcatccagtggttccaatcttacagggcattaaccctt

SEQ ID NO: 133839 - DNA, 601 bp, Human
gaggattggggttgtatattttactgtgttcccccaccagtgagtgatttctacaatgggatagtttaatcactggggttctatatacacagacataagattccgcctggaagaaggtgatttgcacaaacacgctggtactcaaaatatgtttagtgctgtgtgcaaatgttcatatgtatgcatttgaaaaaagtcatcagaggttggttgacagcatccagtggttccaatcttacagggcattaacccttttgagtcttttggaaatttttattgtttattaaatgtttttaaaatktattaattgaataaaaaatattttccactttaaagttaggctctaacaaaaagaaaaaaataataaaacttgggtcacatagggaaaagagaagatgactaaactatacacaaattaacaacaattgttctcaaaccaatcaaattcacaagaatatgaaccccaaatatctgaggcaggtctcagtcaatttaggaagtttattttgccacagttgaggacacatgcccatgacagcctcaggagttcctgatgacatgtgcccaaggtggccagggcacagcttagttttatactttt

SEQ ID NO: 133840 - DNA, 601 bp, Human
attttttagtagagacagtgtttcaccatgttggccagaatggtctcgatctcctgacctgatgacctgcccacctcggcctcccaaagtgctgggattacaagcgtgagccaccacacccggccagttagctatctttttaaggaatagcgtgggaggcaggtttaccctaagcagttcccagcttgatttttccctttggcttagtaatactggggtcccaagatttattttcctttcacaagaataatgcttgtccttttccttccatttttctgaatgttcttttcacttccttatraatcccatggatgcctctcagctgacgacagcagcagcccttttgtttttagacctaattccttttccccaggaatgagtcacttctccagcaggtcagcttctccagttgcactctgtcttccttccacaggggctcttatgcagaagacggcatatgtgaacgctgtagctctccttgcagaacatgtgaaggaaacgccaccaactgccattcttgtgaaggaggccacgtcctgcaccacggagtgtgccaggaaaactgccccgagaggcacgtggctgtgaagggggtatgcaa

SEQ ID NO: 133841 - DNA, 601 bp, Human
gggaggcaggtttaccctaagcagttcccagcttgatttttccctttggcttagtaatactggggtcccaagatttattttcctttcacaagaataatgcttgtccttttccttccatttttctgaatgttcttttcacttccttatgaatcccatggatgcctctcagctgacgacagcagcagcccttttgtttttagacctaattccttttccccaggaatgagtcacttctccagcaggtcagcttctccagttgcactctgtcttccttccacaggggctcttatgcagaagacgrcatatgtgaacgctgtagctctccttgcagaacatgtgaaggaaacgccaccaactgccattcttgtgaaggaggccacgtcctgcaccacggagtgtgccaggaaaactgccccgagaggcacgtggctgtgaagggggtatgcaagcattgcccagagatgtgtcaggactgcatccatgagaaaacatgcaaaggtacctaggagcttcccacaggagagcaaggctctgctgagccaccagttgggggccgattatctgagggtggatggcaaagagctgtgggaaccagtctccc

SEQ ID NO: 133842 - DNA, 601 bp, Human
ttcacttccttatgaatcccatggatgcctctcagctgacgacagcagcagcccttttgtttttagacctaattccttttccccaggaatgagtcacttctccagcaggtcagcttctccagttgcactctgtcttccttccacaggggctcttatgcagaagacggcatatgtgaacgctgtagctctccttgcagaacatgtgaaggaaacgccaccaactgccattcttgtgaaggaggccacgtcctgcaccacggagtgtgccaggaaaactgccccgagaggcacgtggctgtgragggggtatgcaagcattgcccagagatgtgtcaggactgcatccatgagaaaacatgcaaaggtacctaggagcttcccacaggagagcaaggctctgctgagccaccagttgggggccgattatctgagggtggatggcaaagagctgtgggaaccagtctccctaccattcctgaaaggtatgtctctgtgcctgtcatcagagaaactgagggtgagatacacccttttcattatggatgctgcaagttaagacaagcaagagcccctttttgcatgatctcttacactcaccccc

SEQ ID NO: 133843 - DNA, 601 bp, Human
gaggcacgtggctgtgaagggggtatgcaagcattgcccagagatgtgtcaggactgcatccatgagaaaacatgcaaaggtacctaggagcttcccacaggagagcaaggctctgctgagccaccagttgggggccgattatctgagggtggatggcaaagagctgtgggaaccagtctccctaccattcctgaaaggtatgtctctgtgcctgtcatcagagaaactgagggtgagatacacccttttcattatggatgctgcaagttaagacaagcaagagcccctttttgcatgatytcttacactcacccccatatgtacacacacagcagatgtgcaagtgctatcctaggtgctagaggtacagagaagaacccaatgttctcatcttttttttttccttgagatggagtttcactcttgttgcccaggctggagtgcaatggctcaatctcagctcactgcaacttctgccccccatgtttaagcgattctcctgcctcagcctccagagtagctgggattacaggcacgctccaccacgccgggctaattttaacatttttagtagagatgaggtttctccatgttggtcag

SEQ ID NO: 133844 - DNA, 601 bp, Human
aagcattgcccagagatgtgtcaggactgcatccatgagaaaacatgcaaaggtacctaggagcttcccacaggagagcaaggctctgctgagccaccagttgggggccgattatctgagggtggatggcaaagagctgtgggaaccagtctccctaccattcctgaaaggtatgtctctgtgcctgtcatcagagaaactgagggtgagatacacccttttcattatggatgctgcaagttaagacaagcaagagcccctttttgcatgatctcttacactcacccccatatgtacacayacagcagatgtgcaagtgctatcctaggtgctagaggtacagagaagaacccaatgttctcatcttttttttttccttgagatggagtttcactcttgttgcccaggctggagtgcaatggctcaatctcagctcactgcaacttctgccccccatgtttaagcgattctcctgcctcagcctccagagtagctgggattacaggcacgctccaccacgccgggctaattttaacatttttagtagagatgaggtttctccatgttggtcaggctggtctcaaactcctgacctcaggtg

SEQ ID NO: 133845 - DNA, 601 bp, Human
tccctaccattcctgaaaggtatgtctctgtgcctgtcatcagagaaactgagggtgagatacacccttttcattatggatgctgcaagttaagacaagcaagagcccctttttgcatgatctcttacactcacccccatatgtacacacacagcagatgtgcaagtgctatcctaggtgctagaggtacagagaagaacccaatgttctcatcttttttttttccttgagatggagtttcactcttgttgcccaggctggagtgcaatggctcaatctcagctcactgcaacttctgccycccatgtttaagcgattctcctgcctcagcctccagagtagctgggattacaggcacgctccaccacgccgggctaattttaacatttttagtagagatgaggtttctccatgttggtcaggctggtctcaaactcctgacctcaggtgatccaccatcctcagcctcccaaagtgctgggattacaagcgtgaggcaccacgcccagctgttcccatcttttggaacacaaaatcttacagactgatagtaagccacaaaacacagaggtagctagaaaactgcagttgttaaaaagga

SEQ ID NO: 133846 - DNA, 601 bp, Human
tgtttttttccctcaggaattatctcccccaaaaagctgttcaattttctctccagaataagacagactcatttaactggtgctgtcctatccaaagtattctcttggtgtgacctcaagtgtttcccaggattccccccaaagtaagaaaatgaacacaaaaaaaataaacccgcaatgtattcttcacactgatcaatcctgtattcattgttgtacctgatcaatgaatgaaaagttaactaatccaaccattcctaaactgctttctgtgttgaaaacagtgtgaggttctcaatayaattttttaaatctgttaatgctcttcgggtttttcaaacaataccgccagcctctcagccatccctgtcttttgcagcattgcaaatttttgcactgcacctccaaagggcagaccatttcattgtgtaagtccagcaccatctaatacggtcaccatgtgtggcctccttgtcccaaggcagggcttgttagacatcaagtctatgccctggcagggtgggtaaagggcaagcatactctcaggtcaaatcaaccaaagtgctgagggaggagctagcctactgcagacaatgaattc

SEQ ID NO: 133847 - DNA, 601 bp, Human
ctccctctattgcccaggctcaagttcagtagcacgaacatggctcactgaagcctccgcctcctgggctcaagtgatcctcccacctcagcctccagagttgctgggaacatagagatgaggtctcagaatgttgcctaggctggtcttgaactcctggcttcaagcaatcctctgccttgggctcccaaagtgctgggattacaggtgtgagtcaccatgaccagtccatctcatcctttaccatctcactcaaggaggcatattttgaaccggttgtaaataatctttaaatgaatcrctcataagctttgtataggtaacttttattagtgacaaatcacgtggaccttcctcacaacagtggctatgaactgctggtcaaaagaagttatcatataaagatttacagcagagaggaggagccttcaaaagctacctgagacttttcttgataacacaagcaaattgtgacaccataagggactttcttggtgcctcttgtctcccttcttgggtgatttttttttttttttttttgagacagagtctcactctgttggctagagtgcggtggcacgatcttggcttactataacct

SEQ ID NO: 133848 - DNA, 601 bp, Human
ggctcaagttcagtagcacgaacatggctcactgaagcctccgcctcctgggctcaagtgatcctcccacctcagcctccagagttgctgggaacatagagatgaggtctcagaatgttgcctaggctggtcttgaactcctggcttcaagcaatcctctgccttgggctcccaaagtgctgggattacaggtgtgagtcaccatgaccagtccatctcatcctttaccatctcactcaaggaggcatattttgaaccggttgtaaataatctttaaatgaatcgctcataagctttgtayaggtaacttttattagtgacaaatcacgtggaccttcctcacaacagtggctatgaactgctggtcaaaagaagttatcatataaagatttacagcagagaggaggagccttcaaaagctacctgagacttttcttgataacacaagcaaattgtgacaccataagggactttcttggtgcctcttgtctcccttcttgggtgatttttttttttttttttttgagacagagtctcactctgttggctagagtgcggtggcacgatcttggcttactataacctctgcctcctgggttca

SEQ ID NO: 133849 - DNA, 601 bp, Human
ctagctaatttttgcatttttagtagagacagggtttcaccatgttggccaggctggtcctgaatgcctgatctcaagtgatccgcccaccctggcctcccaaagtgctgggattacaggtgtgagccaccgcgcccagcctcccttcatggtttgctccctggaagctccccaccttcctcttcatatccttcaattcctgctccaaggtccccatttccactcccactcagtccctgcatgttcaagaaaggatctgctattatttatacctccttatgttttaactcggcatgaatcrtttgcctcttattcattatcaaggaacagaaaaataaaataagttatgcactctagaattctctagcaagtgagagaaatgttgtggggcgggggcttttctagagcccaggattcactctgttgaggcagcctgaggtccttcacccccacatgtcgcccccaagcaaacacgacaagatagatgtccagaggcaattcccctaacaaccgcgagagcctgagagtgaccttccactgagaaaccctgggacacccacaccctaggacatactgaggggaaggtttttagtaggacacg

SEQ ID NO: 133850 - DNA, 601 bp, Human
ccaggctggtcctgaatgcctgatctcaagtgatccgcccaccctggcctcccaaagtgctgggattacaggtgtgagccaccgcgcccagcctcccttcatggtttgctccctggaagctccccaccttcctcttcatatccttcaattcctgctccaaggtccccatttccactcccactcagtccctgcatgttcaagaaaggatctgctattatttatacctccttatgttttaactcggcatgaatcatttgcctcttattcattatcaaggaacagaaaaataaaataagttatkcactctagaattctctagcaagtgagagaaatgttgtggggcgggggcttttctagagcccaggattcactctgttgaggcagcctgaggtccttcacccccacatgtcgcccccaagcaaacacgacaagatagatgtccagaggcaattcccctaacaaccgcgagagcctgagagtgaccttccactgagaaaccctgggacacccacaccctaggacatactgaggggaaggtttttagtaggacacgaagatgtgtctcggtcctgaaggctttctgctccagccttgtgctgtg

SEQ ID NO: 133851 - DNA, 601 bp, Human
cctcccaaagtgctgggattacaggtgtgagccaccgcgcccagcctcccttcatggtttgctccctggaagctccccaccttcctcttcatatccttcaattcctgctccaaggtccccatttccactcccactcagtccctgcatgttcaagaaaggatctgctattatttatacctccttatgttttaactcggcatgaatcatttgcctcttattcattatcaaggaacagaaaaataaaataagttatgcactctagaattctctagcaagtgagagaaatgttgtggggcggggscttttctagagcccaggattcactctgttgaggcagcctgaggtccttcacccccacatgtcgcccccaagcaaacacgacaagatagatgtccagaggcaattcccctaacaaccgcgagagcctgagagtgaccttccactgagaaaccctgggacacccacaccctaggacatactgaggggaaggtttttagtaggacacgaagatgtgtctcggtcctgaaggctttctgctccagccttgtgctgtggatatgtctttttgtgtgttttatataaagcactatttagtgttaat

SEQ ID NO: 133852 - DNA, 601 bp, Human
gtgagccaccgcgcccagcctcccttcatggtttgctccctggaagctccccaccttcctcttcatatccttcaattcctgctccaaggtccccatttccactcccactcagtccctgcatgttcaagaaaggatctgctattatttatacctccttatgttttaactcggcatgaatcatttgcctcttattcattatcaaggaacagaaaaataaaataagttatgcactctagaattctctagcaagtgagagaaatgttgtggggcgggggcttttctagagcccaggattcactcygttgaggcagcctgaggtccttcacccccacatgtcgcccccaagcaaacacgacaagatagatgtccagaggcaattcccctaacaaccgcgagagcctgagagtgaccttccactgagaaaccctgggacacccacaccctaggacatactgaggggaaggtttttagtaggacacgaagatgtgtctcggtcctgaaggctttctgctccagccttgtgctgtggatatgtctttttgtgtgttttatataaagcactatttagtgttaatgtcctacctgcccatatgtgaaaagg

SEQ ID NO: 133853 - DNA, 601 bp, Human
gattacaggcatgtgccaccacacccagctaattttgtatttttagtagagacggagtttctccatattggtcagggtggtctcgaactcctgaccttaggtgatctgcccgtctctgcctcccaaagtgctgggattacaggcgtgagccaccatgcccggccgccattgcactttctaccagaccaaagggaggggaaggaatgtggtattggaagaaacagtgacaacctgactttccagagagataatacaaagaacctgatctgaaaattaagatttggggaagtgtagagaagcrtttagaatggagcaatctcagccggacacggtggctcacatctgtaatctcaacaacactttgggaggccaaggcaggaggatctcttgagtccaggaatttgagaccagcctgggcaacatagcaagaccctatttctaaaacaaaaataattatacaaaaattagccagatgtagtggtgtgtgcctgtagtcccagctactcaagaggctgagatggggggatcactttagcctgggaggtcaatgtttcagtgagccatgatcacaccactgcactctagcctgggtgacagagca

SEQ ID NO: 133854 - DNA, 601 bp, Human
cccagctaattttgtatttttagtagagacggagtttctccatattggtcagggtggtctcgaactcctgaccttaggtgatctgcccgtctctgcctcccaaagtgctgggattacaggcgtgagccaccatgcccggccgccattgcactttctaccagaccaaagggaggggaaggaatgtggtattggaagaaacagtgacaacctgactttccagagagataatacaaagaacctgatctgaaaattaagatttggggaagtgtagagaagcgtttagaatggagcaatctcagcyggacacggtggctcacatctgtaatctcaacaacactttgggaggccaaggcaggaggatctcttgagtccaggaatttgagaccagcctgggcaacatagcaagaccctatttctaaaacaaaaataattatacaaaaattagccagatgtagtggtgtgtgcctgtagtcccagctactcaagaggctgagatggggggatcactttagcctgggaggtcaatgtttcagtgagccatgatcacaccactgcactctagcctgggtgacagagcaagaacctatagcaaaaaaaagaa

SEQ ID NO: 133855 - DNA, 601 bp, Human
cagagagataatacaaagaacctgatctgaaaattaagatttggggaagtgtagagaagcgtttagaatggagcaatctcagccggacacggtggctcacatctgtaatctcaacaacactttgggaggccaaggcaggaggatctcttgagtccaggaatttgagaccagcctgggcaacatagcaagaccctatttctaaaacaaaaataattatacaaaaattagccagatgtagtggtgtgtgcctgtagtcccagctactcaagaggctgagatggggggatcactttagcctggraggtcaatgtttcagtgagccatgatcacaccactgcactctagcctgggtgacagagcaagaacctatagcaaaaaaaagaaaaaaaaaatctgtaagcaggatcttctctaagaaacacaaggactttggatccattccaatcacccagattatcctgtaatagatagtacagacacctctaaaagtcccatacctttcctgaagcactggagcagaagcagcaaggcagttgctaaggtcctgggctcaactcctgatactaattagcgtaagtgacttagcatctccagcctcaat

SEQ ID NO: 133856 - DNA, 601 bp, Human
agtacagacacctctaaaagtcccatacctttcctgaagcactggagcagaagcagcaaggcagttgctaaggtcctgggctcaactcctgatactaattagcgtaagtgacttagcatctccagcctcaatttcctgatttagataaaatgagaggataatataaacaataataataccatgcatgtatccacccagggaatgcttacaggggggcctgctatgtgccgtgtgctctttcaggtctggggaacagcagggagtgagacagagtccctgccctcatggagctcacattctrttagggaagacaggtactaacgaccataagccaagagcaaaaataaggcagaggggcaggacagggagataggcaggatggagataaaacttgagagatgtcttagatttcattgagaaaggcaggaagcaaaccatgcatgcctctgggagaagagaattgcaggcagacagaatggcaactactaaatcccagagatggtcggcctggtgcagtggctcatgcctgtaatcccagccctttgggaggccaaggcaggaaaatcacttgaggccaggagttcaagaccagcctgggcag

SEQ ID NO: 133857 - DNA, 601 bp, Human
cctctaaaagtcccatacctttcctgaagcactggagcagaagcagcaaggcagttgctaaggtcctgggctcaactcctgatactaattagcgtaagtgacttagcatctccagcctcaatttcctgatttagataaaatgagaggataatataaacaataataataccatgcatgtatccacccagggaatgcttacaggggggcctgctatgtgccgtgtgctctttcaggtctggggaacagcagggagtgagacagagtccctgccctcatggagctcacattctgttagggaagrcaggtactaacgaccataagccaagagcaaaaataaggcagaggggcaggacagggagataggcaggatggagataaaacttgagagatgtcttagatttcattgagaaaggcaggaagcaaaccatgcatgcctctgggagaagagaattgcaggcagacagaatggcaactactaaatcccagagatggtcggcctggtgcagtggctcatgcctgtaatcccagccctttgggaggccaaggcaggaaaatcacttgaggccaggagttcaagaccagcctgggcagcaaagtgaag

SEQ ID NO: 133858 - DNA, 601 bp, Human
gcaaggcagttgctaaggtcctgggctcaactcctgatactaattagcgtaagtgacttagcatctccagcctcaatttcctgatttagataaaatgagaggataatataaacaataataataccatgcatgtatccacccagggaatgcttacaggggggcctgctatgtgccgtgtgctctttcaggtctggggaacagcagggagtgagacagagtccctgccctcatggagctcacattctgttagggaagacaggtactaacgaccataagccaagagcaaaaataaggcagaggkgcaggacagggagataggcaggatggagataaaacttgagagatgtcttagatttcattgagaaaggcaggaagcaaaccatgcatgcctctgggagaagagaattgcaggcagacagaatggcaactactaaatcccagagatggtcggcctggtgcagtggctcatgcctgtaatcccagccctttgggaggccaaggcaggaaaatcacttgaggccaggagttcaagaccagcctgggcagcaaagtgaaggcccatctctattttttttttttttttttttcctgagacagggtc

SEQ ID NO: 133859 - DNA, 601 bp, Human
aatcacagctcactgcagccttgacctcctgggctcaggagatccttccaccttagcctcctgagtagctgggactacaggcacccgccaccatgcccagctaatttttgtgttttttctagagacagtgtcttgccatgttgctcaggctggtctcgaactcctgggctcaagcaatccatccaccttggcctcccaaagtgctaggattacaggcgtaagccactgcacccagcccccgtctctagttaaatacagaaaaagaaaacctagaggtggaagataattgttattttctttytttaacaaatacttatcgattcctattacatgccaggccctctcataggcactatgtattcaaaaataaatgcaaaagggacctttatttgtcaacagacaattaaatacattccaacaattgctgtattcgtgataagctcaaggtactccggaggtgagtggaggaccataacagtaggtgttgtgacggtggaaaattcgatgccattacagaatggcttgttattattttgttgcagtttgggtaattatagtgagccttactaatatttctgagatggctattgcaggaaagccc

SEQ ID NO: 133860 - DNA, 601 bp, Human
cttggcctcccaaagtgctaggattacaggcgtaagccactgcacccagcccccgtctctagttaaatacagaaaaagaaaacctagaggtggaagataattgttattttctttttttaacaaatacttatcgattcctattacatgccaggccctctcataggcactatgtattcaaaaataaatgcaaaagggacctttatttgtcaacagacaattaaatacattccaacaattgctgtattcgtgataagctcaaggtactccggaggtgagtggaggaccataacagtaggtgttrtgacggtggaaaattcgatgccattacagaatggcttgttattattttgttgcagtttgggtaattatagtgagccttactaatatttctgagatggctattgcaggaaagccctctctggatacaacagagaaaataaaataataattttctctcattttgcaaaagaatggtccaccccagagctcaagggctgtactcaactcatggccccacaccattggcccagagctctggaaatctccggaagaaatgtgaaaggaatgtgaagaccctttcccaggggaagccattcccacg

SEQ ID NO: 133861 - DNA, 601 bp, Human
tatttctgagatggctattgcaggaaagccctctctggatacaacagagaaaataaaataataattttctctcattttgcaaaagaatggtccaccccagagctcaagggctgtactcaactcatggccccacaccattggcccagagctctggaaatctccggaagaaatgtgaaaggaatgtgaagaccctttcccaggggaagccattcccacgagggccaccctggctctcgctcactctgtctgctgcccctccacgcccacagattgccacaagtcctgcttgacctgctcatcrtctgggacctgcaccacctgtcagaaaggcctgatcatgaaccctcgtgggagctgcatggccaacgagaagtgctcaccctccgagtactgggatgaggatgctcccgggtgcaagccctgccatgttaagtgcttccactgcatggggccggcggaggaccagtgtcaaacatgccccatgaacagccttcttctcagtgagttacttctccgaggacagctttgtgtttccatctctctgggaaactgccttgcacactgccttgtccagtagatactggcttctttctttttgatt

SEQ ID NO: 133862 - DNA, 601 bp, Human
tggtggctcacgcctgtaatcccagcactttgggaggccgaggtgggcggatcacaaggtcaggagatcgagaccatcctggctaaaacggtgaaaccccgtctctactaaaaatacaaaaaattagctgggtgtggtggcaggtgcctgtagtcccagctactcgggaggcttaggcaggagaatggtgtgaacccggaaggtggagcttgcagtgagccaagattgtgccactgcactccagcctgggcgacagagtgagactccatctcaaaaaaaaaaaaaaagagagatgccaggrgatcagagtcagtaatagaaggtgatgtgatcagaagcagagggacagagagaagctactgcactgctgcctttgaagacagaggaaggggccatgagccaaggcatgcaggtggactctagcaagtggaaaaggaaaggaaacagattccctcctagagcctctaaaaggaacagagccctgtggatctattttggacttctgacctccagaacagtaagataataaattgttgtttcaaggccccaagttggggatacttcataggaacagcaataagagactaatacggcggtgttt

SEQ ID NO: 133863 - DNA, 601 bp, Human
ggaaaaggaaaggaaacagattccctcctagagcctctaaaaggaacagagccctgtggatctattttggacttctgacctccagaacagtaagataataaattgttgtttcaaggccccaagttggggatacttcataggaacagcaataagagactaatacggcggtgtttttccttcaggaagctggggcttccccctagttaaccagatacatgagctggacaatgagccattgccaacatccacaggcgccggactgtagtttctgttctacccaccacagctaatccactgagaratttgggtgggacacagatgagatttggatctctgatgagatgagatgggatcactgatgagatttgggtgggacacagagccaaaccatatcactgacttctgttttccttgtattcctcatggccttagggcaattctgtttcttggacactaatcttatttcccaaacatatccatcagctcacaggatcatcccattcctcctgcagccctctcctccctcccgccatggtacacaagagggaaaatacaggggagacatgtgtcatgctcgatgtccaaatagacattttttctc

SEQ ID NO: 133864 - DNA, 601 bp, Human
acggcggtgtttttccttcaggaagctggggcttccccctagttaaccagatacatgagctggacaatgagccattgccaacatccacaggcgccggactgtagtttctgttctacccaccacagctaatccactgagaaatttgggtgggacacagatgagatttggatctctgatgagatgagatgggatcactgatgagatttgggtgggacacagagccaaaccatatcactgacttctgttttccttgtattcctcatggccttagggcaattctgtttcttggacactaatcttrtttcccaaacatatccatcagctcacaggatcatcccattcctcctgcagccctctcctccctcccgccatggtacacaagagggaaaatacaggggagacatgtgtcatgctcgatgtccaaatagacattttttctcccatgacagacacaacctgtgtgaaggactgcccagagggctattatgccgatgaggacagcaaccggtgtgcccactgccacagctcttgcaggacatgtgaagggagacacagcaggcagtgccactcctgccgaccgggctggttccagctaggaaaa

SEQ ID NO: 133865 - DNA, 601 bp, Human
tcacgcctataatcccagcactttgggaggccgaggtgggtgggaggtgaggttaggagtttgagaccagcctggccaacagggtgaaaccccatctctactaaaaatacaaaaactagccaggcatggtggcacgtgcctgtcatcccagctacttgggaggctgagggaggagaattgcttgaacccaggaggccaaggttgcagtgagccaagatcacaccactgcactccaacctggagcaagattctgtctcagaaaagaagaaaaacaccagtcatatagatcaaggaagaaagrgccctgccagacaagaacagagatggatggccaggtgtggtggctcatgcctgtaattccagcactttcaaaggctgaggcgggcagatcacttgaggccaggagttcacgaccagccttgccaacatggtgagaccctgtctctattaacaatacaaaaattagcagggtgtgcaggcaggcacctgtgatcccagctactggggaatctgtggcatgagaattgcttgaaccttggaggtgaaggtttcagtgagccaagatcgcaccactgcactccagcctgggcaacagaacaag

SEQ ID NO: 133866 - DNA, 601 bp, Human
ttccagcactttcaaaggctgaggcgggcagatcacttgaggccaggagttcacgaccagccttgccaacatggtgagaccctgtctctattaacaatacaaaaattagcagggtgtgcaggcaggcacctgtgatcccagctactggggaatctgtggcatgagaattgcttgaaccttggaggtgaaggtttcagtgagccaagatcgcaccactgcactccagcctgggcaacagaacaagaccctgtcttaaaaacaaacaaacaaacaaacaaaaacaggaatgaagctacctggyttagcccttctgcatcaccctagtaagtgtctgaaaagatctggatcccatcttcctcaaatcaagtcagtaaacactctcaaacacaaaaagggtgcttgatcatcctgtgatctaagtagaatgcagaccatggaattaagaagacaattgttccacagcatgtaaagttccccagggctggtggggggaggcacaggttgccatagatctctttaataaagaagaaatggaatattcatgaggtataagagaactcttcctttagtaaaatcagtgttccacatgcttggcataacc

SEQ ID NO: 133867 - DNA, 601 bp, Human
agaattgcttgaaccttggaggtgaaggtttcagtgagccaagatcgcaccactgcactccagcctgggcaacagaacaagaccctgtcttaaaaacaaacaaacaaacaaacaaaaacaggaatgaagctacctggtttagcccttctgcatcaccctagtaagtgtctgaaaagatctggatcccatcttcctcaaatcaagtcagtaaacactctcaaacacaaaaagggtgcttgatcatcctgtgatctaagtagaatgcagaccatggaattaagaagacaattgttccacagcrtgtaaagttccccagggctggtggggggaggcacaggttgccatagatctctttaataaagaagaaatggaatattcatgaggtataagagaactcttcctttagtaaaatcagtgttccacatgcttggcataacccttgtatgttaaatctctggcttggaaaagtaggcatacacttctctgcaccctatcccaacccacgtaattattttggtgtttaactcagagaagtttctttaaagcctaggttactgcttgtgcttatgctcttcaaggctgggaggctcaaaagatgagt

SEQ ID NO: 133868 - DNA, 601 bp, Human
cttaaaaacaaacaaacaaacaaacaaaaacaggaatgaagctacctggtttagcccttctgcatcaccctagtaagtgtctgaaaagatctggatcccatcttcctcaaatcaagtcagtaaacactctcaaacacaaaaagggtgcttgatcatcctgtgatctaagtagaatgcagaccatggaattaagaagacaattgttccacagcatgtaaagttccccagggctggtggggggaggcacaggttgccatagatctctttaataaagaagaaatggaatattcatgaggtatawgagaactcttcctttagtaaaatcagtgttccacatgcttggcataacccttgtatgttaaatctctggcttggaaaagtaggcatacacttctctgcaccctatcccaacccacgtaattattttggtgtttaactcagagaagtttctttaaagcctaggttactgcttgtgcttatgctcttcaaggctgggaggctcaaaagatgagtcctcaaagcaagcagtggtgttgtactcttttaatctgttccaataaactcttcattgtctcttttagcattactccttgataatttt

SEQ ID NO: 133869 - DNA, 601 bp, Human
ttcacttttccctgatggtttcttttcttgagtcttatgtgggctttgtcaaccattcagctcatcatcgccttgtctcttagatacctcagtcttacagattgacacatagtagtcattgttcttcacataactgcaaaaagtgaaggaagtctcaagttaccacaagctgggccactgaggttcaagtgtgctcactcagatcagtgacaggtggctaaacagaccaagcctcaacataacctaggcatggtgtgagttttcagcaagttcatggagctgaattagtctacaaaaaaaagcctattgggacctgtagtgttgcaccagagaaaacaaagatgaacctttaggtttctaggataggtttagtggtgctgatgtctagaaatacagagatgaatcagatgacctttagaagttcatccttagcaagaattttgttaccctcttttatcttgcttgcaaacctttgtttaccttcaattaatgcactattttgttgtagcgtttaacagttaagctcaaatcatattgtctcatttcactaactgactttaagcaagttgtctaaattctctaagcttcaatgtttgcttct

SEQ ID NO: 133870 - DNA, 601 bp, Human
tggtttcttttcttgagtcttatgtgggctttgtcaaccattcagctcatcatcgccttgtctcttagatacctcagtcttacagattgacacatagtagtcattgttcttcacataactgcaaaaagtgaaggaagtctcaagttaccacaagctgggccactgaggttcaagtgtgctcactcagatcagtgacaggtggctaaacagaccaagcctcaacataacctaggcatggtgtgagttttcagcaagttcatggagctgaattagtctacaaaaaaaagcctattgggacctrtagtgttgcaccagagaaaacaaagatgaacctttaggtttctaggataggtttagtggtgctgatgtctagaaatacagagatgaatcagatgacctttagaagttcatccttagcaagaattttgttaccctcttttatcttgcttgcaaacctttgtttaccttcaattaatgcactattttgttgtagcgtttaacagttaagctcaaatcatattgtctcatttcactaactgactttaagcaagttgtctaaattctctaagcttcaatgtttgcttctgtaaaataaggataa

SEQ ID NO: 133871 - DNA, 601 bp, Human
tacattaattatttataatgtgcccatcatggtccccacccctttctcagtaattacatgtttaattgtaggtactaacattagtcccatcttatagatgagaaacctgaggcacagagatgttgagtgactggcccaaggtcatacagcttgtaagtggtatgactgggatttaaaactgtagtcttgttccagagggcaagtgctaactaccacactctagtgtctcatttgtaggttcaataaggtgaaataatgtttatgaagtccctggaatactatcaggcatattagtagaaayttaatgaatagtggttatagttatcatatttaacttccaaaaatcttttcaaacaaggttatatctattatgtaaatgtcgatatcacacttgtcacctcctatttcaaaatttcttctttaattggcaaattagaagaataattcagaggtacatttatttattttatgttatcttttattgtattttatttatgacagtctcactctgtcacccaggctagagtgcagtggtgtgctctcagctcactctcctgggttcaaacaattctcatgcctcagccacccaagtagctgggac

SEQ ID NO: 133872 - DNA, 601 bp, Human
ggctcaccatctaccaaggagtccaggctgatactttgaagttctccttgactcttctccttcccctgttgcctgcccaacccacccacctccaacaaagctaaacttcaagatctgttggtactctttcccaaatagttatctaatgagatctttttcattctcactaccctcatcttccattctcagtatctagtatcacaccttttgaagcagccagcaggtcaccccaactctcaatcttgcccccacaccaggtcatctggtatactaatgccagagtgattgccttaaaattcaratttctcatttttctctacatcttgccataaatatatgagcaccatgaatgcttctcaatatttaagaatgaaatacttctatattttaattgttaaaactttctagaaaaatattattagctggtaggatacatacctgttcttttcaaaattatcttggctatttttagttcttttatataaatatgtaaccagtcaggtttaattttttaaaaatctttcatttttaaaaagtatttggatattgagtagcattgcattgaatttattttggagaaaaccccatctttatgatcctg

SEQ ID NO: 133873 - DNA, 601 bp, Human
ccacccacctccaacaaagctaaacttcaagatctgttggtactctttcccaaatagttatctaatgagatctttttcattctcactaccctcatcttccattctcagtatctagtatcacaccttttgaagcagccagcaggtcaccccaactctcaatcttgcccccacaccaggtcatctggtatactaatgccagagtgattgccttaaaattcaaatttctcatttttctctacatcttgccataaatatatgagcaccatgaatgcttctcaatatttaagaatgaaatacttcyatattttaattgttaaaactttctagaaaaatattattagctggtaggatacatacctgttcttttcaaaattatcttggctatttttagttcttttatataaatatgtaaccagtcaggtttaattttttaaaaatctttcatttttaaaaagtatttggatattgagtagcattgcattgaatttattttggagaaaaccccatctttatgatcctgagttatcatatttatgaatatgatataatggtatatctctccattctatgcatttacttactacacttcaataaactttta

SEQ ID NO: 133874 - DNA, 601 bp, Human
attatactacattcattgtgtatcccttgtttctactctggagtgtaaaacataagttttcattcagtgtttgttcactgaatgaatgactgtataggtaacaaattcctaatgtctttttgcaaattaaaaaatgttcagctataagatcttcaaatagccaggcgcggtggctcacacctgtaatcccagcactttgggaggctgaggtgggcggatcacctgaggtcaggagttcgagaccagcctgaccaacatggtgaaaccccatctctactaaaatactaaaattagccaggcrtagtggcgggtgcctgtaatctcaactacttgggaggttgaggtgggagaatcgcttgaaacctggaggcagaggttgcagtgagccgagattgcgccattgcactccagcctggcaacagaacgagactgtcaaaaaaaaaaaaaaaaaaaaacttcaaatattgtttctccactctcccctccaatctcgttttatggaatttctattaaatgcaatttagagtttattgatctttcctttgtatcctacctactcttttatattttgcctctttgactctatgtgagttatactagg

SEQ ID NO: 133875 - DNA, 601 bp, Human
tgtctttttgcaaattaaaaaatgttcagctataagatcttcaaatagccaggcgcggtggctcacacctgtaatcccagcactttgggaggctgaggtgggcggatcacctgaggtcaggagttcgagaccagcctgaccaacatggtgaaaccccatctctactaaaatactaaaattagccaggcgtagtggcgggtgcctgtaatctcaactacttgggaggttgaggtgggagaatcgcttgaaacctggaggcagaggttgcagtgagccgagattgcgccattgcactccagcstggcaacagaacgagactgtcaaaaaaaaaaaaaaaaaaaaacttcaaatattgtttctccactctcccctccaatctcgttttatggaatttctattaaatgcaatttagagtttattgatctttcctttgtatcctacctactcttttatattttgcctctttgactctatgtgagttatactaggttaattcttcagcactccatttcattccctgacttgttttagactgtgttcagtctaaaatccaacccatctattttttttgttttcaatttaagtgactatatttttactt

SEQ ID NO: 133876 - DNA, 601 bp, Human
gatcttcaaatagccaggcgcggtggctcacacctgtaatcccagcactttgggaggctgaggtgggcggatcacctgaggtcaggagttcgagaccagcctgaccaacatggtgaaaccccatctctactaaaatactaaaattagccaggcgtagtggcgggtgcctgtaatctcaactacttgggaggttgaggtgggagaatcgcttgaaacctggaggcagaggttgcagtgagccgagattgcgccattgcactccagcctggcaacagaacgagactgtcaaaaaaaaaaaaacaaaaaaacttcaaatattgtttctccactctcccctccaatctcgttttatggaatttctattaaatgcaatttagagtttattgatctttcctttgtatcctacctactcttttatattttgcctctttgactctatgtgagttatactaggttaattcttcagcactccatttcattccctgacttgttttagactgtgttcagtctaaaatccaacccatctattttttttgttttcaatttaagtgactatatttttacttttgagagttctaattggccaggtgcagtggctaat

SEQ ID NO: 133877 - DNA, 601 bp, Human
cttcaaatagccaggcgcggtggctcacacctgtaatcccagcactttgggaggctgaggtgggcggatcacctgaggtcaggagttcgagaccagcctgaccaacatggtgaaaccccatctctactaaaatactaaaattagccaggcgtagtggcgggtgcctgtaatctcaactacttgggaggttgaggtgggagaatcgcttgaaacctggaggcagaggttgcagtgagccgagattgcgccattgcactccagcctggcaacagaacgagactgtcaaaaaaaaaaaaaaaacaaaacttcaaatattgtttctccactctcccctccaatctcgttttatggaatttctattaaatgcaatttagagtttattgatctttcctttgtatcctacctactcttttatattttgcctctttgactctatgtgagttatactaggttaattcttcagcactccatttcattccctgacttgttttagactgtgttcagtctaaaatccaacccatctattttttttgttttcaatttaagtgactatatttttacttttgagagttctaattggccaggtgcagtggctaatacc

SEQ ID NO: 133878 - DNA, 601 bp, Human
tgtcatcctttttttaaactttattttataattaatagagacgatgtctcgccatgttgcccaggctgatcttgaactcctgggctcaagcaatcctcccatcttggccacccaaagtgctggggttacaggcgtgagccactgcactggcctgtcatctttcttagcattcattttatctatatactttggaatgctggtcttaagctcactgtaaatgaaatattttggttttggttctttactccctctctctcttatctttacttctcacagtctagaaatttttccattaactctwtccctgtcttcaacctgaaactcagtccagaacaagatgttccagtattcctggaagtgatattgatgacagcatagatcccatcagcaattcaatcagcagcttaggagagatcttgtcaggaggtgatgtctatgaaggcagagtcccaacatgactcctgatttaagcgctaagcctggattttggctctggtcttatgtaaaacacttttagttcctattttggtagaaaaggtgagctcacagtcaccattgcctacttctagtcctggagcagagaaggtggatggcttgaacc

SEQ ID NO: 133879 - DNA, 601 bp, Human
gtcatcctttttttaaactttattttataattaatagagacgatgtctcgccatgttgcccaggctgatcttgaactcctgggctcaagcaatcctcccatcttggccacccaaagtgctggggttacaggcgtgagccactgcactggcctgtcatctttcttagcattcattttatctatatactttggaatgctggtcttaagctcactgtaaatgaaatattttggttttggttctttactccctctctctcttatctttacttctcacagtctagaaatttttccattaactcttwccctgtcttcaacctgaaactcagtccagaacaagatgttccagtattcctggaagtgatattgatgacagcatagatcccatcagcaattcaatcagcagcttaggagagatcttgtcaggaggtgatgtctatgaaggcagagtcccaacatgactcctgatttaagcgctaagcctggattttggctctggtcttatgtaaaacacttttagttcctattttggtagaaaaggtgagctcacagtcaccattgcctacttctagtcctggagcagagaaggtggatggcttgaacct

SEQ ID NO: 133880 - DNA, 601 bp, Human
gatttaagcgctaagcctggattttggctctggtcttatgtaaaacacttttagttcctattttggtagaaaaggtgagctcacagtcaccattgcctacttctagtcctggagcagagaaggtggatggcttgaacctgactaccattttgcatttatatttcctttatgttccaaagagatttcattttctttgtaaggccatctatctttattttgttttcctctctttatatttattctataatttcattatgtttaaagtaaatgggatgtcagaacctgagcttataaaatattwttttaatgcatatgtgtcactaatggataatcagattcttagaagaggattgtaccctaaattattgcccagcctcactctactaatccaaatgcctggtgggatggcaggagggatacttaagacttgtggatgaaataagcaaaggccaacctgttagagcctgcctctaatcctctttttttttccccttccaaaatgattcatcttgaggcaatatgttgatgatatagaaacaccaagaattagggaaaacaagatgagaaatcaggtattcccccacactgggagaagaccatc

SEQ ID NO: 133881 - DNA, 601 bp, Human
ctggattttggctctggtcttatgtaaaacacttttagttcctattttggtagaaaaggtgagctcacagtcaccattgcctacttctagtcctggagcagagaaggtggatggcttgaacctgactaccattttgcatttatatttcctttatgttccaaagagatttcattttctttgtaaggccatctatctttattttgttttcctctctttatatttattctataatttcattatgtttaaagtaaatgggatgtcagaacctgagcttataaaatatttttttaatgcatatgtrtcactaatggataatcagattcttagaagaggattgtaccctaaattattgcccagcctcactctactaatccaaatgcctggtgggatggcaggagggatacttaagacttgtggatgaaataagcaaaggccaacctgttagagcctgcctctaatcctctttttttttccccttccaaaatgattcatcttgaggcaatatgttgatgatatagaaacaccaagaattagggaaaacaagatgagaaatcaggtattcccccacactgggagaagaccatcagcacgtttgctgtct

SEQ ID NO: 133882 - DNA, 601 bp, Human
ctaatggataatcagattcttagaagaggattgtaccctaaattattgcccagcctcactctactaatccaaatgcctggtgggatggcaggagggatacttaagacttgtggatgaaataagcaaaggccaacctgttagagcctgcctctaatcctctttttttttccccttccaaaatgattcatcttgaggcaatatgttgatgatatagaaacaccaagaattagggaaaacaagatgagaaatcaggtattcccccacactgggagaagaccatcagcacgtttgctgtctagcyactgagctgaaattcctgaaaagtatcttgatgacattatattttaaaataacttcttcccaagtacatgtgaatatagccatctccaagtttaaggtggcttccaatattacctatgccttggtgtctccaaatctgcttcttttcccaaatggttttcctgagctccggttccatacatccagttgctgactgagtatctctgattggatgctcaacagacacctccaactcctcaccccactcccaaactacttgttctgtgctccctatctggataaatggccccaccattcaccc

SEQ ID NO: 133883 - DNA, 601 bp, Human
gaccatcagcacgtttgctgtctagctactgagctgaaattcctgaaaagtatcttgatgacattatattttaaaataacttcttcccaagtacatgtgaatatagccatctccaagtttaaggtggcttccaatattacctatgccttggtgtctccaaatctgcttcttttcccaaatggttttcctgagctccggttccatacatccagttgctgactgagtatctctgattggatgctcaacagacacctccaactcctcaccccactcccaaactacttgttctgtgctccctatctggataaatggccccaccattcacccagttgcctgagacagtaacctggccattaccctctgctcctccccctctctcaatccccacattcaatttgttcccaaatcctgccaaacctaccccttaaatatctcctaattccatctcccctctcttggtattctagtgtcactgtcttagttcagactcatcattcattgtctgaattgtttaccaattatttatttaattggtcttcctacctttagcattagtcaccctgtaataaaccagtcttccatatgctcttagactgatctc

SEQ ID NO: 133884 - DNA, 601 bp, Human
catcagcacgtttgctgtctagctactgagctgaaattcctgaaaagtatcttgatgacattatattttaaaataacttcttcccaagtacatgtgaatatagccatctccaagtttaaggtggcttccaatattacctatgccttggtgtctccaaatctgcttcttttcccaaatggttttcctgagctccggttccatacatccagttgctgactgagtatctctgattggatgctcaacagacacctccaactcctcaccccactcccaaactacttgttctgtgctccctatctggataaatggccccaccattcacccagttgcctgagacagtaacctggccattaccctctgctcctccccctctctcaatccccacattcaatttgttcccaaatcctgccaaacctaccccttaaatatctcctaattccatctcccctctcttggtattctagtgtcactgtcttagttcagactcatcattcattgtctgaattgtttaccaattatttatttaattggtcttcctacctttagcattagtcaccctgtaataaaccagtcttccatatgctcttagactgatctcttt

SEQ ID NO: 133885 - DNA, 601 bp, Human
cattcacccagttgcctgagacagtaacctggccattaccctctgctcctccccctctctcaatccccacattcaatttgttcccaaatcctgccaaacctaccccttaaatatctcctaattccatctcccctctcttggtattctagtgtcactgtcttagttcagactcatcattcattgtctgaattgtttaccaattatttatttaattggtcttcctacctttagcattagtcaccctgtaataaaccagtcttccatatgctcttagactgatctctttatacaacaaatatartgatacatctccacttaaaaaacaactctctactgaccttaggatagaattttttttttttttttgagacagagcctcgctgtgtcacctaggctggcatgcggtggcatgatcttggctcactacaacctctgcttcctgggttcaaatgattatcctgaaccagcctcccaagtaactgggattacaggcacacaccaccgcacctgggtaatgtgtgtgtgtgtgtgtgtgtgtgtgtgtgtgtgtgtgtgtgtattttgagtagagatggggtttcaccatgttggccaggctgat

SEQ ID NO: 133886 - DNA, 601 bp, Human
tcttcctacctttagcattagtcaccctgtaataaaccagtcttccatatgctcttagactgatctctttatacaacaaatataatgatacatctccacttaaaaaacaactctctactgaccttaggatagaattttttttttttttttgagacagagcctcgctgtgtcacctaggctggcatgcggtggcatgatcttggctcactacaacctctgcttcctgggttcaaatgattatcctgaaccagcctcccaagtaactgggattacaggcacacaccaccgcacctgggtaatktgtgtgtgtgtgtgtgtgtgtgtgtgtgtgtgtgtgtgtgtattttgagtagagatggggtttcaccatgttggccaggctgatcttgaactcctgacctcaagtgatctgcctgcctcagcctcccaaagtgctgggattacaggtgtgagccaccaggcctggccaggatagaattttaatttagtatgtttgcgtatgaggcccttcagcatagagctcttctcatattcagcctcatctcttaccatctcttctcccatcctctaatcagggcataattagtaactataaacctga

SEQ ID NO: 133887 - DNA, 601 bp, Human
ctctctctggaatagtttctccagcctgctttgcatggctacctctttctgatccattagagtcatcacttcctccagaaaacctccccagacccttcattctatgttcccttagtactctgtgtcttcattcatccatttacttaaggcacaatgttctacaactgtgaacaagacagccaaggtccccgcagaccaggctagtttaatttgtgtaattgtacttagtggtgtagcagcactgtccagtagaaataaaatgtgattgaaaatttttagtagtcatgtttaaaaaaaaaaagtataattaattttaatcatacacttcatttatccaaaatattatcatttgaacatgtaatctacataaaattactgagatgttttacatgtgttgtactgtctttgaaagtccaatgtttattttacatgtacagcacaactcaagttgcactagccatatttcaactgctcagtggctacctgtggctagtggctgctgtattggacaccacagtaataacctagagcaatggtttcaaatgatattttagcagtggccaccttcctcagataaaatctgaggctgaatcctattagg

SEQ ID NO: 133888 - DNA, 601 bp, Human
tggtttcaaatgatattttagcagtggccaccttcctcagataaaatctgaggctgaatcctattaggtaaaccaatccaggcagagctgctcaggtgggagcagaggagccaccccagaaccccatctgatgcctctccatgctcccctcaccacctttcccaggaagcccctaaagcaactccataaaaactctaccatatcatggttcccagtctgtgcccattcacaattgactccagcacatgaaagaattagccttccaaacaaactgcattaactactcattaatctgttatcrctttttcattccagagacatatatggttaccacttaaaacttctaactggaattagataacagatgagaaaatacactgaattgggggtgggatgggagtggtggaaagctgatattatcattggccatatggtggtaaatattggctttctatttggttttttgaaaagttgaacttacctctgttaccatcattactggatgtgtgggacctttattccaactagggttgtctgataaaatactgtatttgatttgcgaaatctgacaaccctaattccagcccactagtgttgtgca

SEQ ID NO: 133889 - DNA, 601 bp, Human
tttttcatataattctttgcagtgagcagtcctttctttactatggcacatatgtcccttgctggttaggaaaatgttgtgctatcatctggttttgcaacatacagatacaaaatctggagacaggtttttctcacgggatataaactaggtagaaaaaaagatgaattccttcctttttaagtcattagctctcatagtaagaaatgaggaggcatgaaagaatcagaaaaaatttagcaacctacataagaaattaccagctaaattatatttcgttcactttggactgcccaataaktttaggatgttaaaaaagaaaaatatgtaaaagcatggaaggaggggtggagcaggaaaacatagcatactcaggcttaatatgtacctttctctgtaactgacacctccataattagctcattccttgccttcacacacctaactttttacttatcctctgcataaaattttattttttctatttttttttttcatttttgttttttgattttgtgttattgtttcttctcctcataaaatggtttggaatcaaaacccaggctgagtaaccaaagcctcttaactctcccaagctgca

SEQ ID NO: 133890 - DNA, 601 bp, Human
tcatagtaagaaatgaggaggcatgaaagaatcagaaaaaatttagcaacctacataagaaattaccagctaaattatatttcgttcactttggactgcccaataattttaggatgttaaaaaagaaaaatatgtaaaagcatggaaggaggggtggagcaggaaaacatagcatactcaggcttaatatgtacctttctctgtaactgacacctccataattagctcattccttgccttcacacacctaactttttacttatcctctgcataaaattttattttttctatttttttttttcatttttgttttttgattttgtgttattgtttcttctcctcataaaatggtttggaatcaaaacccaggctgagtaaccaaagcctcttaactctcccaagctgcatctttctgtgtagactgaggcccatgaagagaccccagaagttgctctgcatttgttgaattcatcccatggggttcagtctgaaggagagcagatggtgaactgctctgagttttaaagaaatgacaaaatgcctatcttttaggtcccagagctcctgcagaaccttagaagcaatgatagatgtagggtgt

SEQ ID NO: 133891 - DNA, 601 bp, Human
ataagaaattaccagctaaattatatttcgttcactttggactgcccaataattttaggatgttaaaaaagaaaaatatgtaaaagcatggaaggaggggtggagcaggaaaacatagcatactcaggcttaatatgtacctttctctgtaactgacacctccataattagctcattccttgccttcacacacctaactttttacttatcctctgcataaaattttattttttctatttttttttttcatttttgttttttgattttgtgttattgtttcttctcctcataaaatggtttrgaatcaaaacccaggctgagtaaccaaagcctcttaactctcccaagctgcatctttctgtgtagactgaggcccatgaagagaccccagaagttgctctgcatttgttgaattcatcccatggggttcagtctgaaggagagcagatggtgaactgctctgagttttaaagaaatgacaaaatgcctatcttttaggtcccagagctcctgcagaaccttagaagcaatgatagatgtagggtgttaaactttaaaataatagaaagccttctggaaatcaacaaactgccttttgcta

SEQ ID NO: 133892 - DNA, 601 bp, Human
caattaattggtgtaggagatgtaaatgaaggctgatttgtcacccaaagctgacatacagtgcccttgggtattgcctgggatctgggcctcagacaatttattgttggtcttctagaaaatgtaaccaaacttggccaggtgcagtggctcacgactgtaatcccagcactttgggaggccaaggtgggcagataacctgaggtcaggagatcaagaccagcctggccaacatggtgaaaccccatctctactaacaagagtaaaactccgtctccaaaaataaaaagaaaaaaaaaamcaaaagaaagaaaatgtaaccaaccttatggtaggaattttgtgacctaacctagttatggactgttccccctcttttagtgttttctactcttaatttattttattgtaaattgacaaattataattatatatatttatagggtacaaagggatgtcatgatatatgtatacaatgtggaataattaaatcaagctaattaacatgtccatcaggccaggcacagtggctcacacctgtaatcccagcactttgggaggccaaggtgggcagatcacttgaggtcaggaatttgagacc

SEQ ID NO: 133893 - DNA, 601 bp, Human
atatttatagggtacaaagggatgtcatgatatatgtatacaatgtggaataattaaatcaagctaattaacatgtccatcaggccaggcacagtggctcacacctgtaatcccagcactttgggaggccaaggtgggcagatcacttgaggtcaggaatttgagaccagcctaggcaacataatgagacctcatctctacaaaaaaataaacaaaatttggtcgggtgcagtggctcatgcctgtaatcccagcactttgggaggctaagacaggtggatcacttgaggttaggtgttcragaccagcctagccaacatggtgaaacctcatgtctattgaaaatacaaaaaaattaggcaagtgtggtggtgcacacctgtagtcccagctactcaggaggctgaggtaggagaattgcttgaacctgggaggcgaagtttgcagtgagctgagattgcgccactgcactccagcctgggtgacaaagcaagactctgtctaaaaacaaaactaaagaatatatattagttgggtatggggtgtgtgcctgtaatcccagctactcaggaggctaaggtaggaggatcacctgagccca

SEQ ID NO: 133894 - DNA, 601 bp, Human
gcctagccaacatggtgaaacctcatgtctattgaaaatacaaaaaaattaggcaagtgtggtggtgcacacctgtagtcccagctactcaggaggctgaggtaggagaattgcttgaacctgggaggcgaagtttgcagtgagctgagattgcgccactgcactccagcctgggtgacaaagcaagactctgtctaaaaacaaaactaaagaatatatattagttgggtatggggtgtgtgcctgtaatcccagctactcaggaggctaaggtaggaggatcacctgagcccaggaggtsgaggctgcagtgagccataattacaccaagccatgattgcaccgttgcaatatagcctgggcaacagagcaagattccacctcaaaaaaaaaagaaatccatcacttcaaatacttaatcctttttgtggtaagaacatctgaaatttactctcttaccaattttgaaagtacaatacattattgttaattatagtcaccatgagatataatagatctcaaaaacatgttcttcctgtctaactagaactttataccctttgaccagcatctccccagtcccctcagccccccagccccc

SEQ ID NO: 133895 - DNA, 601 bp, Human
gtgtggtggtgcacacctgtagtcccagctactcaggaggctgaggtaggagaattgcttgaacctgggaggcgaagtttgcagtgagctgagattgcgccactgcactccagcctgggtgacaaagcaagactctgtctaaaaacaaaactaaagaatatatattagttgggtatggggtgtgtgcctgtaatcccagctactcaggaggctaaggtaggaggatcacctgagcccaggaggtcgaggctgcagtgagccataattacaccaagccatgattgcaccgttgcaatatagyctgggcaacagagcaagattccacctcaaaaaaaaaagaaatccatcacttcaaatacttaatcctttttgtggtaagaacatctgaaatttactctcttaccaattttgaaagtacaatacattattgttaattatagtcaccatgagatataatagatctcaaaaacatgttcttcctgtctaactagaactttataccctttgaccagcatctccccagtcccctcagccccccagcccccagcctctggtaaccaccattctactctttacttctatgagttcaattgttttagat

SEQ ID NO: 133896 - DNA, 601 bp, Human
caccatgagatataatagatctcaaaaacatgttcttcctgtctaactagaactttataccctttgaccagcatctccccagtcccctcagccccccagcccccagcctctggtaaccaccattctactctttacttctatgagttcaattgttttagattccacattaaagtgagaacatgtatctacccttaatttctcttcatttaaaaaaaactctcttgtatgttaaaaattgaagtaagacatctaagctgtattttagaaaaatgtagaatgggctgggtgtggtggctcacgsctgtaatcccagcactttgggaggctgaggtgggaggatcaccaggtgatgagatcgagaccatcctggctaacacagtgaaaccccgtctctactaaaaacataaaaaaaaaattagctgggcgtggtggcgggctcctgtagtcccagctactcaggaggctaaggcaggagaatggcgtcaacccaggaggcggagtttgcagtgagccgagatcgcgccattgcactccagcctgggcgacagagccagactctgtctcaaaaaaaaaaaaaaaaaaagaaaaaagaaaaagaaaa

SEQ ID NO: 133897 - DNA, 601 bp, Human
ggtggctcacgcctgtaatcccagcactttgggaggctgaggtgggaggatcaccaggtgatgagatcgagaccatcctggctaacacagtgaaaccccgtctctactaaaaacataaaaaaaaaattagctgggcgtggtggcgggctcctgtagtcccagctactcaggaggctaaggcaggagaatggcgtcaacccaggaggcggagtttgcagtgagccgagatcgcgccattgcactccagcctgggcgacagagccagactctgtctcaaaaaaaaaaaaaaaaaaagaaaaaagaaaaagaaaaatgtagaatgggaaaaaggaagaatggaaataggagaagattgattcttccatcagagaccacaataacgttccagaacatgtgggaaattctgtatgaagctagagctaagataaaaataaagtggttttgaatttatatcactacaggcagcttccaacctaagaagcagttcagtactaaaggtgtttattctctaagctgttgtttgaaactcagaatttatttttccacagaaacattataagtgattgagctcacagttcagccatgaaacgtcaatttaact

SEQ ID NO: 133898 - DNA, 601 bp, Human
gactctgtctcaaaaaaaaaaaaaaaaaaagaaaaaagaaaaagaaaaatgtagaatgggaaaaaggaagaatggaaataggagaagattgattcttccatcagagaccacaataacgttccagaacatgtgggaaattctgtatgaagctagagctaagataaaaataaagtggttttgaatttatatcactacaggcagcttccaacctaagaagcagttcagtactaaaggtgtttattctctaagctgttgtttgaaactcagaatttatttttccacagaaacattataagtgatkgagctcacagttcagccatgaaacgtcaatttaactatgtgaatgtaaatgacagatccatcgttctatttcaagttcaaaaaccaccctttacaggattgttctgatgggaagacctataccaagttccaacttacaataccaggcacattctatgtccattaatcttatgctcccatttaaaaattatcagcaaaaatgtccaggacttcctaacagaatgagatagatttaggtctcctgtccccaaactttccagaagttattccttgatacctgcatagaataaatgtttggatc

SEQ ID NO: 133899 - DNA, 601 bp, Human
ttaaaaattatcagcaaaaatgtccaggacttcctaacagaatgagatagatttaggtctcctgtccccaaactttccagaagttattccttgatacctgcatagaataaatgtttggatcagtcctttttggggtgtctgaattaggagataagagtactgtctccacaggaaacaggctgcagattcagacttcttctatttggtggctcatgtgctaaggcagatatgtggtggaaagagcacctcagcaaggtgcaattgaccttgcatgcctctataatcccagctacttggagggtgagacaagaggatcccttgagtccaggaatttgagatcagcctggacaacatagcaagaccccatctgaaaaaaaaaaaaagaaagaaagacagatcaacggattatgagtcaacaaacttgaatttgaatcttgaccatcactatgtaaccctggataggtgacattacatgtctgggccttagttttcatttatcaatatttttaaaatgagaaataaataagatgtcaaatttctgagaagagaacttacagctttcaagagaatttcaaagaaatgtatcaccatcatcaccacc

SEQ ID NO: 133900 - DNA, 601 bp, Human
gttattccttgatacctgcatagaataaatgtttggatcagtcctttttggggtgtctgaattaggagataagagtactgtctccacaggaaacaggctgcagattcagacttcttctatttggtggctcatgtgctaaggcagatatgtggtggaaagagcacctcagcaaggtgcaattgaccttgcatgcctctataatcccagctacttggaggctgagacaagaggatcccttgagtccaggaatttgagatcagcctggacaacatagcaagaccccatctgaaaaaaaaaaaaagaaagaaagacagatcaacggattatgagtcaacaaacttgaatttgaatcttgaccatcactatgtaaccctggataggtgacattacatgtctgggccttagttttcatttatcaatatttttaaaatgagaaataaataagatgtcaaatttctgagaagagaacttacagctttcaagagaatttcaaagaaatgtatcaccatcatcaccaccccaaaattaagaaccaccaaacaaaatgatctgctgagtccttttagccctagcattttaagtgccaagtttagtgccgttt

SEQ ID NO: 133901 - DNA, 601 bp, Human
atcccagctacttggaggctgagacaagaggatcccttgagtccaggaatttgagatcagcctggacaacatagcaagaccccatctgaaaaaaaaaaaaagaaagaaagacagatcaacggattatgagtcaacaaacttgaatttgaatcttgaccatcactatgtaaccctggataggtgacattacatgtctgggccttagttttcatttatcaatatttttaaaatgagaaataaataagatgtcaaatttctgagaagagaacttacagctttcaagagaatttcaaagaaatgtatcaccatcatcaccaccccaaaattaagaaccaccaaacaaaatgatctgctgagtccttttagccctagcattttaagtgccaagtttagtgccgtttctcagttagaaactgtctattcatgatttatgcactgagtattgcagtcctccaaacacttggtaacatcctccacactagttaaacaataagcagaatagcgaataaaggttttataaactttctacatgatttctcattctctgaaaatctttcctcttgctgtaataaaagatctgtcatccccaaatcctcaattt

SEQ ID NO: 133902 - DNA, 601 bp, Human
cctcgcccgcgccggccgcgccccgcctcgcaagccaaggcggcggctcggggcatccccggtctgggcgtccaccctcggtcccccgcccccggcttggtgcgcgctgccttcccgcgggtccccggcgtcctgcctggtagcgctgctcgccgcccccgcatcatctcgcgcccgtgctgcaggaaggggaccgcggctgcactgctgccgcggcgcgcaggtgccttggcggcgcggtgggagattatgtaaagtcgcctcttcacgggtgaccttgcggagtcggtgcacccggctktcccgggatgtgttggcatgagcggtggccgcactgggggtggcggggcggaggccggcggtttgcgctcttctcccttaccctgttgtcagaaccctccttccccgccgcccgcaggctccaggggaatggaaggctggggtcttcctttagggacccgcatacattaacttttacctggagaactcggtcgtgaaactcctttgaggccagggcatgacaaacagtctgcgggtcttaaatatttccctaaaacaaccaaattgttgaagacttaaaatcatcatgtattttaaattg

SEQ ID NO: 133903 - DNA, 601 bp, Human
ccaccctcggtcccccgcccccggcttggtgcgcgctgccttcccgcgggtccccggcgtcctgcctggtagcgctgctcgccgcccccgcatcatctcgcgcccgtgctgcaggaaggggaccgcggctgcactgctgccgcggcgcgcaggtgccttggcggcgcggtgggagattatgtaaagtcgcctcttcacgggtgaccttgcggagtcggtgcacccggctgtcccgggatgtgttggcatgagcggtggccgcactgggggtggcggggcggaggccggcggtttgcgctcytctcccttaccctgttgtcagaaccctccttccccgccgcccgcaggctccaggggaatggaaggctggggtcttcctttagggacccgcatacattaacttttacctggagaactcggtcgtgaaactcctttgaggccagggcatgacaaacagtctgcgggtcttaaatatttccctaaaacaaccaaattgttgaagacttaaaatcatcatgtattttaaattgtttttaataaatctttggcatcttggatgtgcccatttttctttatggggttaataagctgtgactgtaat

SEQ ID NO: 133904 - DNA, 601 bp, Human
accctcggtcccccgcccccggcttggtgcgcgctgccttcccgcgggtccccggcgtcctgcctggtagcgctgctcgccgcccccgcatcatctcgcgcccgtgctgcaggaaggggaccgcggctgcactgctgccgcggcgcgcaggtgccttggcggcgcggtgggagattatgtaaagtcgcctcttcacgggtgaccttgcggagtcggtgcacccggctgtcccgggatgtgttggcatgagcggtggccgcactgggggtggcggggcggaggccggcggtttgcgctcttstcccttaccctgttgtcagaaccctccttccccgccgcccgcaggctccaggggaatggaaggctggggtcttcctttagggacccgcatacattaacttttacctggagaactcggtcgtgaaactcctttgaggccagggcatgacaaacagtctgcgggtcttaaatatttccctaaaacaaccaaattgttgaagacttaaaatcatcatgtattttaaattgtttttaataaatctttggcatcttggatgtgcccatttttctttatggggttaataagctgtgactgtaataa

SEQ ID NO: 133905 - DNA, 601 bp, Human
gctgcccaggaattctgtggcaggacttcttcgatattactaacctttttgattgctctactggtcacttctctatagcatatctcagcactgcgtttaccaacacatcttttttccacttggattctaaagatttcttttgcaaagcttagtgccctcaaaggcaattaagagtcttggctttggagtgggaaaggctaaggtttgaatcctgcctctgctgcttctgaccttgagagagtatttaacttctgaacctgtccatgctgaagtgatgataatttccgttgtctcttcaggrttgaggtgaagagaaacgagtgtgtagaacacacgtataaagtgttcaataaattatagttattgacataaaggatatttttattagtataaaatactatcccttatgctatgaagaagttacccaaggtagaccttttagtttttccaacttaaaaaatagagcgctccatttccgctaaatcttgaagttctgtgtcgccctataaagtgtagaaaaaataatttaaactgcgttaggaaagaacttaaaaggttggagaaggtcggcatgtgatgcgatacggttaatgtttatcac

SEQ ID NO: 133906 - DNA, 601 bp, Human
aagatttcttttgcaaagcttagtgccctcaaaggcaattaagagtcttggctttggagtgggaaaggctaaggtttgaatcctgcctctgctgcttctgaccttgagagagtatttaacttctgaacctgtccatgctgaagtgatgataatttccgttgtctcttcagggttgaggtgaagagaaacgagtgtgtagaacacacgtataaagtgttcaataaattatagttattgacataaaggatatttttattagtataaaatactatcccttatgctatgaagaagttacccaagstagaccttttagtttttccaacttaaaaaatagagcgctccatttccgctaaatcttgaagttctgtgtcgccctataaagtgtagaaaaaataatttaaactgcgttaggaaagaacttaaaaggttggagaaggtcggcatgtgatgcgatacggttaatgtttatcacaccgaatccaaatgcagaatcactgcgtcattgtcttccttttactgaaaagccttttatttgaaaggtgaagcagcacgtagtctcttatccataatttagtgtagcacactcttagaaagtctaagg

SEQ ID NO: 133907 - DNA, 601 bp, Human
tgcgtcattgtcttccttttactgaaaagccttttatttgaaaggtgaagcagcacgtagtctcttatccataatttagtgtagcacactcttagaaagtctaaggcacaggtgactgttctgtgcatatgtatatttaggagagtatgtaaagcccatgttaatgtttgcatgtgacaaaaaaattagagaaatagtcctgtcctacttttgtagccatttttttccatcaggtccgtgaacctgatgttatctacagagaagctttagacctagaattacttccttttgagaactgatrtgctggataatatagcctgggtttgtttgtttgtttatttatttattcatttgagacaaagtttgactcttgtcgcccaggcaggagtgcaatggcgtgatctcagcatactgcaacctctgcctcctgtgttcaggcgattctcctgcctcagcctcctgagtagctgggattataggcatgcactaccacgctcagctaatttttgtatttttagtagagacagggtttagccatgttaaccaggctggtctcgaactcctgacctcaggtgatctgcccgcctcgattacaggctga

SEQ ID NO: 133908 - DNA, 601 bp, Human
tgattttatcttaaataattaccatctgtaatgcccctatttccaaataaagttgcattctgagctattgtaattaggactttaatatgaattttgggaggggcacagttcaatccataacagtcgttatttgcataaaaggattaaccacagtattctatatttgattcaacatctaagaggacagttcagcctataaataacatataactttctattgcatcaaaaagatatactttctccttttttaatgagttggttagtatattgctaagttctgaatgtgtccctctaaaatacrtatgttgaagcttgactgccaatgtgacagtattaagaaatggggcctttaggaggtgactaagtcatgagggcactcatgattaagtcatgaatgggattagtgctctcttaaaagaagttgaaggggtcaccctgtccccttccaccgtgtgagggtttagcaacaaggcaccatctttgaagcaaagggtgggccctagccaggcacaaatctgttagtgccttcatcttggactgctagcctcccaaactgtgagaaataaattctattatttataaattaccccgtctaagatat

SEQ ID NO: 133909 - DNA, 601 bp, Human
catctgtaatgcccctatttccaaataaagttgcattctgagctattgtaattaggactttaatatgaattttgggaggggcacagttcaatccataacagtcgttatttgcataaaaggattaaccacagtattctatatttgattcaacatctaagaggacagttcagcctataaataacatataactttctattgcatcaaaaagatatactttctccttttttaatgagttggttagtatattgctaagttctgaatgtgtccctctaaaatacgtatgttgaagcttgactgccartgtgacagtattaagaaatggggcctttaggaggtgactaagtcatgagggcactcatgattaagtcatgaatgggattagtgctctcttaaaagaagttgaaggggtcaccctgtccccttccaccgtgtgagggtttagcaacaaggcaccatctttgaagcaaagggtgggccctagccaggcacaaatctgttagtgccttcatcttggactgctagcctcccaaactgtgagaaataaattctattatttataaattaccccgtctaagatattttgttagtagcctgaacagac

SEQ ID NO: 133910 - DNA, 601 bp, Human
tttatctcagtgagattttcagtttcttaattgcctctaagcagtcaactctctgctgcctttaaaatcttggctgtggcttgttgcttgacccaggatttctacacctgtaccctttcacattcttagccagtagtctctaataggctgcaaggggcctatatattttataaaattataagtaacattttatacatgcatttttctgagggagaatgcccttagcctgttaccagattcttaaataaattcctaattgctgccccttcctcccctcgaaaagtaaaaatagggtggggcrtggtggctcactcctgtaatcccaacactttgggaggccaaggcgggcggatcacttgaggtcaggagttcaaaaccggctttgccagtgcagtgaaacctcgtctctactaaaaatacaaaaagattagctgggcgaggtggcaggtgcctgtaatcccacctacccaggaggctgaggcaggagaattgcctgaacccaggaggccgaggttgcagtgagtcaagatggcgccactgcactccagcctgggcaacagagtgagattctgtttcaaataaataaataaataaattcatc

SEQ ID NO: 133911 - DNA, 601 bp, Human
tctctgctgcctttaaaatcttggctgtggcttgttgcttgacccaggatttctacacctgtaccctttcacattcttagccagtagtctctaataggctgcaaggggcctatatattttataaaattataagtaacattttatacatgcatttttctgagggagaatgcccttagcctgttaccagattcttaaataaattcctaattgctgccccttcctcccctcgaaaagtaaaaatagggtggggcgtggtggctcactcctgtaatcccaacactttgggaggccaaggcgggcrgatcacttgaggtcaggagttcaaaaccggctttgccagtgcagtgaaacctcgtctctactaaaaatacaaaaagattagctgggcgaggtggcaggtgcctgtaatcccacctacccaggaggctgaggcaggagaattgcctgaacccaggaggccgaggttgcagtgagtcaagatggcgccactgcactccagcctgggcaacagagtgagattctgtttcaaataaataaataaataaattcatcatgtcatcaggagaaagtggatgtttcttacaataatcactccaacagt

SEQ ID NO: 133912 - DNA, 601 bp, Human
cctgggtggggtgttcacagttagcgtatgtgggaatgaatgttgaggcagcaagaggcagcaggagacaacatgtgaagttttgaaactttgtaatacaacccttctcagtgtttttagtttagaatttattgtttccataatcacttaaggagcctaaaagcttaagaatgatgtacatggtatccgatggataataaagactaaagagagctataactatacttattaaaatgccatgattgtgagaccctgccaagtcttttgcattctaccaacaaaatattttcatgctatactraatcattagctgatgacaaatgcttcaggaaataatttcactatttataaaggttttacatttagtacaacttctaaatgccaaatatgatgttgtagttgctctaccctaatctccctccgccatcccctgggtcaaattgtatatagtagtaatgaatatggagaagctgtctgtaatactcgtgaagaacccacagctccatggaggtttacttggatacttaggacactgaaggacctctaggcagtgttttctgcctttttttgaattatgatatatataaaaaatagaaatatc

SEQ ID NO: 133913 - DNA, 601 bp, Human
atctccctccgccatcccctgggtcaaattgtatatagtagtaatgaatatggagaagctgtctgtaatactcgtgaagaacccacagctccatggaggtttacttggatacttaggacactgaaggacctctaggcagtgttttctgcctttttttgaattatgatatatataaaaaatagaaatatcttttttataattcaaactaacctttccccatagatactaatggaagcagttttataatgctgagaaacatctcaatatcaagctatgtattagtctgttctcatgttgctartaaaggcatacccgagactgggtaatttataaaggaaagaggtgtaattgactcacagttctgcatggctagggagggctcaggaaacttacagtcatggcagaagggggatcaaaaatgtccttcacatgacggcagcaaggagaagtacagagcaaagtggggtaaaagccccttataaaaccgtcagatctcgtgagaattcactcactatcacgagaacagtgtggcggtaaccacccctatgattcaattacctcccaccaggtccctcccatgacacatggggattgtgggaac

SEQ ID NO: 133914 - DNA, 601 bp, Human
agacacagacatgtaaagcattttgatacattttcaccaaaaaaatcaccttacataaaaggacgtgtcttaaacagaaagcttatcataaaatctctatatcaattgttttcctaaattgatgactgttacgtcttccccttttgtgaaacagtgagttatactgatattttgtgatatgtactggcttgccctttataatatctaaattacctaaattcttagtgttgtcacccctccagtgccccccaaaaaaggtcaacaggtcagagttaaattagcatttactcaggaatggggkttgcaacctggctagcagtcagagattgtaccacccgagaagggcaagggggctatttaaaagaacttatttagattacataaattgcttgtcacattatttcattggtgtattaaacaagtctttaatcagtagtagaagggtacatttgtatcagttattcaggaaaaacctatatacagagtgtttgtaaagattaggaccagttttacttgtattgtgtagtgctgagagcacggttgtttgtgaaggaatgtttttcacagttccttttcgggtctcaaagttcatcagcagttt

SEQ ID NO: 133915 - DNA, 601 bp, Human
tttaatcagtagtagaagggtacatttgtatcagttattcaggaaaaacctatatacagagtgtttgtaaagattaggaccagttttacttgtattgtgtagtgctgagagcacggttgtttgtgaaggaatgtttttcacagttccttttcgggtctcaaagttcatcagcagtttaatatggagtagtagcccaagatggagttactgatataaagcctggaacattgctaagctcatagtgtccagtaaaactgtgtctactggttgctgctgtgaatgattcaggtgaacgtaggcrttttctgtaggcgctttccacatgattatggtagaataatttgattgtttcctaagcgtatcattcagttgtatcttcatgacattttgtcaatctgtattcatgtttactgactatataagggttcaccagcaaaacagaaccaacatgatatgtagatacatgagagggatttattatgggaattggctcatgtgattatggagactaaatcctgcaatatgctttctgcaagctggagaatcaggaaacccggtggtgtaatacagtccaagtccaaaggcctgaggccccggggag

SEQ ID NO: 133916 - DNA, 601 bp, Human
ggtgaaggttaagtggatcaccaaaggccggtgatttaatcagtcatgcctatgtaatgaagcctccataaaaacccaacatcacagggtttgggaggattttcagacagctgaacatgtggtggttcctgaaagaggatgtgcctggagagggtatggaagctccaggctgcttctcccatacctcgacctatgtgtctcttccatctggctgttcatctgtatccttttaatacctttctaataaatggctaaacataagtaagtgtttccctgagttccgtgtgctgctctggcaaaktagttgaatcacaggagggagttgtgggaaccctgatttatagctggtaggttagaagcacaggactgtgcttgtgactggcatctgaagccagttgtgggaccgagccctcaacctgtgggatctgacgctatctccaggtagtgtcagaattgaattgaattagaggacacccagctggtgtccagtggagaatcatctgcagaatgggttgctggtagggagaaatccccacacattttggtaaccagaggtcacagaaatagtctgtgctgggtattttgaggtatatatataata

SEQ ID NO: 133917 - DNA, 601 bp, Human
gcctatgtaatgaagcctccataaaaacccaacatcacagggtttgggaggattttcagacagctgaacatgtggtggttcctgaaagaggatgtgcctggagagggtatggaagctccaggctgcttctcccatacctcgacctatgtgtctcttccatctggctgttcatctgtatccttttaatacctttctaataaatggctaaacataagtaagtgtttccctgagttccgtgtgctgctctggcaaattagttgaatcacaggagggagttgtgggaaccctgatttatagctgrtaggttagaagcacaggactgtgcttgtgactggcatctgaagccagttgtgggaccgagccctcaacctgtgggatctgacgctatctccaggtagtgtcagaattgaattgaattagaggacacccagctggtgtccagtggagaatcatctgcagaatgggttgctggtagggagaaatccccacacattttggtaaccagaggtcacagaaatagtctgtgctgggtattttgaggtatatatataataggagaaactgtgtttgtttttttcctacatccttacaaggacacaag

SEQ ID NO: 133918 - DNA, 601 bp, Human
caccacctggtttcaaagccagtaactgccagtagtttttaaccatgagtcctattgtcaccttatatatcaaaccaagacatacctaaaagctcttagtggtcaccaagaagacgcgaacactttagtagaaaaataagacaacaatatgaaaggcagtatttgaaagagcaagtggccaagatacgaatgcaaaaatcaaggaaatcagacagcaatatctgacatttttcattgtttagattggcagagatgaaaaggatagtaacattctgggttagcaagagtataagaacatggrtccccgtttatggtgggagtgtaaactgttaaaacacttctggagatcagtagttctcttccctgtaattctgtttttaggaaactattcacagaatataaatgtataagtatgtacaacttaggtacaagattgttcactgtagtagttattgtggtgaaaaattgtaaacaacctcaataagggatgaggaagtaaatctgtatgtcaatattatgaaatctctacagctattttatctatagggcaatatttattgcagtagggaaacattcatgattattgccaaaatgaaaaaag

SEQ ID NO: 133919 - DNA, 601 bp, Human
gatttcagcatttaaaaataattgtcctggcacagtggctcacgcctgtaatcccagcactttgggaggctgaggcgggcagatcacttgagttcaggagttcaaagccagcctgaccaacatgccctgtctgtgctaaaatacaaaaaaattagctgggtatggtggcacatgcctgtaatgccagctactcgggaggccgaggcaggagaatcgctttaacccaggaggtggaggttgcagtgagccaagatcatgccactgcactccagcctgggcgacagagtgatactcagtctcaaaaaaaaaaaaaattactatataacaatgattttttgaatgaaggtagatgtagcataattgaactttgttacttatgtattctgtattatgtgcttgttaggtggttctcttaagagtaagggttttgcaagatgcttctttcataattggacacaacttgtagaaagtgaggtgtgagtttgtttgatttatatgtttttcttatcagattatggaactatccattaataagctactctagaaattatttggatttaaaaactctctttggagagttgcaagggcctgcctgatctga

SEQ ID NO: 133920 - DNA, 601 bp, Human
catcctttcaaagttggaatagactttaaatgaatcatttaattatttaattggtcaatggaacaaaatggaaagtccagcaataagtagtacattgtggtgatttggtatacaataaaggcagtatttaaaatcatcaaaaaagaatagattatttagtaaatggcatttggacaattagctattcgtttgagaaataaaatttaatcctttttgtcacatcttaaaataaattttaactagttggaaaatatgaaggtaaaagagtgtaaaaagaaaatatggtttcttttgaaatggrgaatactttctaaacataacatatcatgcagagactgtgcactatggatgaaggctggtgaatttttgctacttgtaaaaatgaagaactgctgagtagcaaaggatcctaaagatggttgaagtgactaatgggattaagatttgcagcatacaattaaaaataaaatttacaaaacccagccttggcaagggtacactgccaaatggcactgtatttccagcaggttcttctttctgggatccagttaggcaatatgtgtcaatatgcagattccctttgattaaggtacttcttgga

SEQ ID NO: 133921 - DNA, 601 bp, Human
gagacggttaaacagcacagctggctccgattctgatgttttctcagttagatcttcagagaacagttttaataaagctttaattatggagcatccctacacacactgtagacagggatcattcagctgcataatgttgctgatgatatatttatggaatgctatttccatcctagtttaaggtatctgttgctcttagttactggagctatgctgatttcagaactacaaacagcttttaatattgaacatgctaactggttcaatgtatatgttgtactactttagtttttgtggggartggactttaaagattagtttcatgctgatccacagtgtgggaacatgtttggtatttttaaaaactctttactcattgtctgaggtgagaaattgttggaagacagagcagaggggagaaagagatatgttatttatgtaggtgaaaaataccatgtgaatttagagtttagagtttagaatatggcaaccttaatgaattttggagctgcagtaggtaatggatctctaaatttttttctgcaatttttgttgttatccattagctcagtgacaatcactgtgatcccctcccttggtc

SEQ ID NO: 133922 - DNA, 601 bp, Human
tcaagttctctggaatgcttaaatagagctgaagtacgttttaggtcattttgagttggtacacttttgttggtgacttgttgtgtcccaaaaacttggggtatggtcactggggaagagaatcctattggtgggaaatcttcatctgtctgtggtgggtttgatgctgccaaataggtaaaagtaattacaattctggtagtatgaaagagaaatggtcaagcttgggagtcatggattgtactttggggctgggaatcttatagattgttcatatatggaaagcattttaagggcattkcagaaagccttctggttgaacttcatgaaacttaactcttccttcccgactgtctctcccaccttctgaaaaccacagaaacagctctatttattgggttctatgacttaaaagaagaaaagactgaagagtgacaatcagacgtctttaaagttctcttttggacccaaggcaggatgctcgtggcatttcaacaccttcctcaggatcagagtagggagagacagaaatgatctttatttttgggatcacagcttgaaatggggctgctgggctgtattggatttgattctgtccaaa

SEQ ID NO: 133923 - DNA, 601 bp, Human
caccttcctcaggatcagagtagggagagacagaaatgatctttatttttgggatcacagcttgaaatggggctgctgggctgtattggatttgattctgtccaaaaggcgaaagtaatgatagctgctgggctcccatcctccatgaaaacccagtcagttcattgtcagtttaattgttgttttctgagctcttctgttttgaacatttttaaaaaagacttttgctttcctctttctaagtgttttgtatcataccccaatgcagaggccaccagccaccttgcctctttcacccccrtctccaggagattggcaggtctaatggctgtcactgtagaacagaccttccaggtgactcttgacccctcaaatgaggagtaaccggatcccatgtagacctggcagtataaaaaaactttaatattattgatttgcaaaagaaggattataaacaaaacgctaacaagacagttgattgtcaaattttcctctttatttctccatttttggggaagatggagtgggaataaggtaggaaacatgcaccaaaatgaaaacatttcttgtaggtgagaataacaaggactctatcactgaa

SEQ ID NO: 133924 - DNA, 601 bp, Human
acatttttaaaaaagacttttgctttcctctttctaagtgttttgtatcataccccaatgcagaggccaccagccaccttgcctctttcacccccatctccaggagattggcaggtctaatggctgtcactgtagaacagaccttccaggtgactcttgacccctcaaatgaggagtaaccggatcccatgtagacctggcagtataaaaaaactttaatattattgatttgcaaaagaaggattataaacaaaacgctaacaagacagttgattgtcaaattttcctctttatttctccrtttttggggaagatggagtgggaataaggtaggaaacatgcaccaaaatgaaaacatttcttgtaggtgagaataacaaggactctatcactgaaacattctctttttaatgtttaactgcaggatgcttaaagaaatcctacaattattgtagacattgatgtgctatcaagaaaaatccatcttaaatcccctgcaaagttcattaaaatcttcctcattgtggtactttacttgagattaatttctttaggtagcatgtttttactttagttgtagcaaagagccacatttacaaca

SEQ ID NO: 133925 - DNA, 601 bp, Human
ctttcacccccatctccaggagattggcaggtctaatggctgtcactgtagaacagaccttccaggtgactcttgacccctcaaatgaggagtaaccggatcccatgtagacctggcagtataaaaaaactttaatattattgatttgcaaaagaaggattataaacaaaacgctaacaagacagttgattgtcaaattttcctctttatttctccatttttggggaagatggagtgggaataaggtaggaaacatgcaccaaaatgaaaacatttcttgtaggtgagaataacaaggactctatcactgaaacattctctttttaatgtttaactgcaggatgcttaaagaaatcctacaattattgtagacattgatgtgctatcaagaaaaatccatcttaaatcccctgcaaagttcattaaaatcttcctcattgtggtactttacttgagattaatttctttaggtagcatgtttttactttagttgtagcaaagagccacatttacaacaggagcttgggcccagtcatggaacagtgctgtgtgtgcacattctgtgggactgattctgaggacatgccactgagtcttttgg

SEQ ID NO: 133926 - DNA, 601 bp, Human
atgcaccaaaatgaaaacatttcttgtaggtgagaataacaaggactctatcactgaaacattctctttttaatgtttaactgcaggatgcttaaagaaatcctacaattattgtagacattgatgtgctatcaagaaaaatccatcttaaatcccctgcaaagttcattaaaatcttcctcattgtggtactttacttgagattaatttctttaggtagcatgtttttactttagttgtagcaaagagccacatttacaacaggagcttgggcccagtcatggaacagtgctgtgtgtgmacattctgtgggactgattctgaggacatgccactgagtcttttggtctgtgttggagaggtcaccttaattccagagcagcaaagagttttatttatgagaaatatcctgatatgttaaaatatgtttttgaacatattttggatcaatttgtcttattaaaaagccagcattatttgtatgccaatgttcattgcagcattattgaccatagtcaagaggtgggagcaacccaagtgtctgtggagagataaatagataaacaaaatatggtagatcctgccacatgctacaccatgg

SEQ ID NO: 133927 - DNA, 601 bp, Human
ttacttgagattaatttctttaggtagcatgtttttactttagttgtagcaaagagccacatttacaacaggagcttgggcccagtcatggaacagtgctgtgtgtgcacattctgtgggactgattctgaggacatgccactgagtcttttggtctgtgttggagaggtcaccttaattccagagcagcaaagagttttatttatgagaaatatcctgatatgttaaaatatgtttttgaacatattttggatcaatttgtcttattaaaaagccagcattatttgtatgccaatgttcmttgcagcattattgaccatagtcaagaggtgggagcaacccaagtgtctgtggagagataaatagataaacaaaatatggtagatcctgccacatgctacaccatggatgagctgtaaggacattaagctaagttaaataacacagaaataaaaagccaaagactctgtgatcccacttataaggtacctagagtagtcaaattcatagacagaaagtagaacagtggttgagaggggagggcaactggggagttgtgtaacgggtacagagtttcagatgggagagatggaaagagttc

SEQ ID NO: 133928 - DNA, 601 bp, Human
ttattaaaaagccagcattatttgtatgccaatgttcattgcagcattattgaccatagtcaagaggtgggagcaacccaagtgtctgtggagagataaatagataaacaaaatatggtagatcctgccacatgctacaccatggatgagctgtaaggacattaagctaagttaaataacacagaaataaaaagccaaagactctgtgatcccacttataaggtacctagagtagtcaaattcatagacagaaagtagaacagtggttgagaggggagggcaactggggagttgtgtaacrggtacagagtttcagatgggagagatggaaagagttctagagatggacggtggtgatggttgcataaaacatgaatacacggctgggcgtggtggctcactcctgtaatcccagcactttgggaggtcaaagcccatgggtcacctgaggtcaggggttcgagaccagcctggccaacatggagaaaccccatctctattagaaatacaaaattagccgagtgtggtggtgcatgcctgtaatcccagctactcgggaggctgagacaggagaatcatttgaacccgggaggcggaggtt

SEQ ID NO: 133929 - DNA, 601 bp, Human
gtacagagtttcagatgggagagatggaaagagttctagagatggacggtggtgatggttgcataaaacatgaatacacggctgggcgtggtggctcactcctgtaatcccagcactttgggaggtcaaagcccatgggtcacctgaggtcaggggttcgagaccagcctggccaacatggagaaaccccatctctattagaaatacaaaattagccgagtgtggtggtgcatgcctgtaatcccagctactcgggaggctgagacaggagaatcatttgaacccgggaggcggaggttgyggtgtggtgagctgagatcgtgccattgcactccagcctgggcaacaagagcgaaactccgtgtcaaaaaagaaacaaacaaaagcaaccatgaataaacttatgccactgaattatatatacacttacaagttaagatggtaaattttatgttacatatattttactacaaataaaagttaaaaaatagaaaaaagggtgagtcagtctccgatatgttgtttttagtttctggtcatggtggggtttggctgccctggtcctacgcttgttacaaaactgctggtgggaagggtcctt

SEQ ID NO: 133930 - DNA, 601 bp, Human
cataaaacatgaatacacggctgggcgtggtggctcactcctgtaatcccagcactttgggaggtcaaagcccatgggtcacctgaggtcaggggttcgagaccagcctggccaacatggagaaaccccatctctattagaaatacaaaattagccgagtgtggtggtgcatgcctgtaatcccagctactcgggaggctgagacaggagaatcatttgaacccgggaggcggaggttgtggtgtggtgagctgagatcgtgccattgcactccagcctgggcaacaagagcgaaactccrtgtcaaaaaagaaacaaacaaaagcaaccatgaataaacttatgccactgaattatatatacacttacaagttaagatggtaaattttatgttacatatattttactacaaataaaagttaaaaaatagaaaaaagggtgagtcagtctccgatatgttgtttttagtttctggtcatggtggggtttggctgccctggtcctacgcttgttacaaaactgctggtgggaagggtccttagacctgtcatctgctccaacactttcacttcatacgtgagaaaactgggtctcagaagtg

SEQ ID NO: 133931 - DNA, 601 bp, Human
aaattttttgtagagatggggtctttctgtgttgcccaggcttgtcttgaacacctggcctcaaatgatcctcttgtcttggcctcccaaagtactggcattacagacaagagctactgcagtaggctacagttacttttgtttccaatcccaggtaatagacatcccctcactactgactcatcctcttcctgactgtttttcactagcttagccttacctacttccagaggaagacttcatccgaaattgagatgaccagggaggtcatttgtgctcaagaaaaattcatctagcaggyatgtattgagaaccagtatatgataggggtaagaggctagaaatataaagggtaatgaaatgctgctgacatgcaggggctcagcactttcagtatatagtcctagtacctgagagctagcaaaaaacaagcagagatgtttctcttagcccaggcagctcctcactgtgggggtctggtgccaacattgcaactgtattgtgtattatttaaatgtgtttgtatgtttgtgttcagtgtacatatgttttcagatttgtgaaaaatacataataaactgcatgtcataaaattcatggt

SEQ ID NO: 133932 - DNA, 601 bp, Human
taatgaacctgtacagcatattaccatactgaatgttgtaggtaattataacaccatcatagcatttgtgtatcgaaacatatttaaatgtagaaaagatacagtaaaaatatggtataaacgattaaaaatagtataactgtacagggcactttccatgaatggggcttgtaggactggaagttgcttctgggtgaattggtgagtgagtggtgatgaaatcatctaatcagttatgacatagctgagtttttcaggtcttataatcttacaggactaccatcatgtatttgagccatcrttgaccaaaatgtctatgcggcacgtggctgtatttagctgaacgattaagtagaaataacctattaagacctttttccaaagtattttttacatggttcattgttcacattctgtatatatttacatcatactgtatggtctgcaattgtatttttgactttttcttcaaattttgaatggctaaaaattccagcagggttcaagagcttgtcctttttgattgtgttttgtttcatccgtagcagaattgcctagattgaaatgaaatgaaaataatgaatggtatgacacttggtat

SEQ ID NO: 133933 - DNA, 601 bp, Human
acttggtatcatcacaaactgatcattcaaatgaatgggttaaatactgttcatgtcatgatttatggaatgctttcctgtcccaaatacttgtgcttggtgctaggcatacaattatatgaaatgtttattatggtgaagaaattcaagattttccttcaccttacctcatctgttcaaatgaaaatgggatctttgtgtttggggggctgttttgcacttgtatatataaacaagtgaggaagctggatatttaggaataaaatctctttttgaatttagaatttgtaagctttcctcctttttttttttttttttttgagatggagtcttgctctgttgcccaggctggagtgcagtggcacaatctcagctcactgcaagctctgcctcccaggttcacgccattctcctgcctcagcctcccgagtatctgggactacaggcgcccaccaccacacctggctaaattttgtacttttagtagagacagggtttcaccgtgttagccaggatggtctcgatctcctgacctcgtgatctgcccgccttggcctcccaaagtgtaaactttcctcttaacggtcaaatcttactgaag

SEQ ID NO: 133934 - DNA, 601 bp, Human
ttggtatcatcacaaactgatcattcaaatgaatgggttaaatactgttcatgtcatgatttatggaatgctttcctgtcccaaatacttgtgcttggtgctaggcatacaattatatgaaatgtttattatggtgaagaaattcaagattttccttcaccttacctcatctgttcaaatgaaaatgggatctttgtgtttggggggctgttttgcacttgtatatataaacaagtgaggaagctggatatttaggaataaaatctctttttgaatttagaatttgtaagctttcctcttttttttttttttttttttgagatggagtcttgctctgttgcccaggctggagtgcagtggcacaatctcagctcactgcaagctctgcctcccaggttcacgccattctcctgcctcagcctcccgagtatctgggactacaggcgcccaccaccacacctggctaaattttgtacttttagtagagacagggtttcaccgtgttagccaggatggtctcgatctcctgacctcgtgatctgcccgccttggcctcccaaagtgtaaactttcctcttaacggtcaaatcttactgaagaa

SEQ ID NO: 133935 - DNA, 601 bp, Human
ctccttacataagtgtttccagaaagctaataaaattattcctgaaggttaaaaacaaggaagttatgaaccggatttgaggttgaaattaggtagggggaacatgaattattttctgtaacgtacaagtggaaacaatttaatcaatcctttttatttttattgaatgtagacagaaaattcagtgcaggtggctgcattgcatttcatttacaataattaaaaaatgtttgagtaaaacagctctgttttggtggacagagatccaggacacccactttcacttacaggtgatccgctstttcactgatcccagcatctgctgcttctgtgtcacaccgctgggggaatgggagatccagagctgatgaaggcatggtcctggctctgctttgtccagctagtgacaatgttagtaacccgcattattgagcacttaataaacaataattctcacagcccgataaagtagttttttatggcatcctcatttttagatgaggaaatagaaatgcagagatgtgatagcttgcccaagatcagtctgtaagaggtataattagagtttgaagccaggtagtcagagtttttttttttctgg

SEQ ID NO: 133936 - DNA, 601 bp, Human
acaaggaagttatgaaccggatttgaggttgaaattaggtagggggaacatgaattattttctgtaacgtacaagtggaaacaatttaatcaatcctttttatttttattgaatgtagacagaaaattcagtgcaggtggctgcattgcatttcatttacaataattaaaaaatgtttgagtaaaacagctctgttttggtggacagagatccaggacacccactttcacttacaggtgatccgctctttcactgatcccagcatctgctgcttctgtgtcacaccgctgggggaatgggrgatccagagctgatgaaggcatggtcctggctctgctttgtccagctagtgacaatgttagtaacccgcattattgagcacttaataaacaataattctcacagcccgataaagtagttttttatggcatcctcatttttagatgaggaaatagaaatgcagagatgtgatagcttgcccaagatcagtctgtaagaggtataattagagtttgaagccaggtagtcagagtttttttttttctggatattttgcaaagaaagtttgagacttaaggaaagagcaaagatgctcttgtgt

SEQ ID NO: 133937 - DNA, 601 bp, Human
cccagcatctgctgcttctgtgtcacaccgctgggggaatgggagatccagagctgatgaaggcatggtcctggctctgctttgtccagctagtgacaatgttagtaacccgcattattgagcacttaataaacaataattctcacagcccgataaagtagttttttatggcatcctcatttttagatgaggaaatagaaatgcagagatgtgatagcttgcccaagatcagtctgtaagaggtataattagagtttgaagccaggtagtcagagtttttttttttctggatattttgcaragaaagtttgagacttaaggaaagagcaaagatgctcttgtgtttaagcagatccattgagcactttttgggtcatggtctctgtacccataaaactctgaaaagtacaggggttgcaaatcatatgcgtgcgtaagccaagcaggtagaatagaggcatgaagttggccagatggtctgtggtgagcaggggagctctccgtggggccacctccctgcagctgtagccagtgagaaagtgagcccagtatggctgatctctagaagggaagctaatgaaaggtttaacaaaacatctct

SEQ ID NO: 133938 - DNA, 601 bp, Human
cagagcgagactccgtctcaaaaaaaaaaaaaaaaaaaaaaaaattcccctcgttaatatgtgtttattgttaaaaacttaggacgaaagttaaaaaaaaaaacccacactacttaattacagagatcttcattaacataattctgtatttattttctataggaaaatttttaatgctaactttctagaactcagtcaaaaactactgtaatcattttaatcagctgattaatttgctctagcagcttaaaatgtttttgctccattttactttttctactgcatgatagaaaaattgttkttctgtgaatgagaaagttaaaatttgtgctcaatggcaggaccccagagagatgtttctgggaattgagattcagaggcagcctgcattcagctttcttcaggttacctttattaatgatgcccttgatcagtaaggtggattacttacccattaacacttattctacatcagccttaatgttttagggaaaatatatttactaagctgtttgtgtacaggagtatcacacagtagatgaagcacttatgtttctggaaaaaaagagataaattaggaagctttcagatttgtttataa

SEQ ID NO: 133939 - DNA, 601 bp, Human
tttttgctccattttactttttctactgcatgatagaaaaattgttgttctgtgaatgagaaagttaaaatttgtgctcaatggcaggaccccagagagatgtttctgggaattgagattcagaggcagcctgcattcagctttcttcaggttacctttattaatgatgcccttgatcagtaaggtggattacttacccattaacacttattctacatcagccttaatgttttagggaaaatatatttactaagctgtttgtgtacaggagtatcacacagtagatgaagcacttatgttyctggaaaaaaagagataaattaggaagctttcagatttgtttataaaagaaatatgaggctaggaaagaagcatgatgacttttgtgatacacacagtgagtcagcaacccattttccagaagttagcagctgcatttttttccattgagggcaaaacataatatatgggtataactttagtgctagctaattacttctattggtgcttaaaaaaattaaaatcaacaaggagaaatctacccaaactgatccaatatacactgagctaatgaaggaaggtggtgtactttttgtggggt

SEQ ID NO: 133940 - DNA, 601 bp, Human
cttattctacatcagccttaatgttttagggaaaatatatttactaagctgtttgtgtacaggagtatcacacagtagatgaagcacttatgtttctggaaaaaaagagataaattaggaagctttcagatttgtttataaaagaaatatgaggctaggaaagaagcatgatgacttttgtgatacacacagtgagtcagcaacccattttccagaagttagcagctgcatttttttccattgagggcaaaacataatatatgggtataactttagtgctagctaattacttctattggtrcttaaaaaaattaaaatcaacaaggagaaatctacccaaactgatccaatatacactgagctaatgaaggaaggtggtgtactttttgtggggtggtatttttattttgattatgttgaagtggtagagaaagaaggggagagatctgggggtctgagagtcagaggaggctacaaatgatatagcaaagcaaataactagattatgaatcttttgaaatcatgcaggggaacaaaatattgttactgccttatcaaaaagtattttctcctgtataatttaaaaaatcaagaaggtgtc

SEQ ID NO: 133941 - DNA, 601 bp, Human
ctggaaaaaaagagataaattaggaagctttcagatttgtttataaaagaaatatgaggctaggaaagaagcatgatgacttttgtgatacacacagtgagtcagcaacccattttccagaagttagcagctgcatttttttccattgagggcaaaacataatatatgggtataactttagtgctagctaattacttctattggtgcttaaaaaaattaaaatcaacaaggagaaatctacccaaactgatccaatatacactgagctaatgaaggaaggtggtgtactttttgtggggtrgtatttttattttgattatgttgaagtggtagagaaagaaggggagagatctgggggtctgagagtcagaggaggctacaaatgatatagcaaagcaaataactagattatgaatcttttgaaatcatgcaggggaacaaaatattgttactgccttatcaaaaagtattttctcctgtataatttaaaaaatcaagaaggtgtcaaccttaaaaatcgtatcattgaatatagtaagtccctttttttttgttaatatagcctgttggtttagtagatttttgcatcttattgtctgat

SEQ ID NO: 133942 - DNA, 601 bp, Human
gacttttgtgatacacacagtgagtcagcaacccattttccagaagttagcagctgcatttttttccattgagggcaaaacataatatatgggtataactttagtgctagctaattacttctattggtgcttaaaaaaattaaaatcaacaaggagaaatctacccaaactgatccaatatacactgagctaatgaaggaaggtggtgtactttttgtggggtggtatttttattttgattatgttgaagtggtagagaaagaaggggagagatctgggggtctgagagtcagaggaggcyacaaatgatatagcaaagcaaataactagattatgaatcttttgaaatcatgcaggggaacaaaatattgttactgccttatcaaaaagtattttctcctgtataatttaaaaaatcaagaaggtgtcaaccttaaaaatcgtatcattgaatatagtaagtccctttttttttgttaatatagcctgttggtttagtagatttttgcatcttattgtctgatttttataccatacagactaataaaaattagtttatgcacttatttgttacttttatttctgaatagataatacagtc

SEQ ID NO: 133943 - DNA, 601 bp, Human
tatagcaaagcaaataactagattatgaatcttttgaaatcatgcaggggaacaaaatattgttactgccttatcaaaaagtattttctcctgtataatttaaaaaatcaagaaggtgtcaaccttaaaaatcgtatcattgaatatagtaagtccctttttttttgttaatatagcctgttggtttagtagatttttgcatcttattgtctgatttttataccatacagactaataaaaattagtttatgcacttatttgttacttttatttctgaatagataatacagtcagcgtagtrtaaaaggttagacagtgatgtctgaattctactccttcccctagctagtttccttcccagaggcaaccattgttactgttaccatgttttcctaaagacagttcctgcaaatgttggcaaatctgtgtgtgttctctttccttgtctctgtgccttcctttcttttaggaatgctagcatacatactataatattctgggtctgtctggttgtttttacttcatgtgctctgtagattatttcagtacaccaagagcttccccattgtttcatagttgggtagtattctgttgtattatt

SEQ ID NO: 133944 - DNA, 601 bp, Human
aatagtttgggaaatgttgacctatgtgattactacctgtctcaccaattccatagatactggaaactagctaactgagttttcagctgacaaattgcttgcttttggagtcaagtgtcttgacatatgtagcttgttcacctctctggtcctattgcttaaagtgagaaatagcgtatttggaaggttgtatgtcaggaccatcttctgtttgtgagcgcgagagaaggtaggatcagatatcttgggtggagcccagtctccagctcaagacttgagttgtaaaaatcgtgttgtattktgggacaaaaatcaagcagttcattttggctagggtttaggggatagaaatgggtggaggagagtcataaggctttctaaaataagctgcactacagcagaagttgcagttgggagttctgttgtagaaaatggagaggaaagcaatagatttttttccctccagtttgcattggttctcaaccggggatgattttgctttcctgctaaaggggatgtttggcaatgtctggagacatttttggttaccacgactggaaaggtgctaccagcatctggtaagtagagctcaaggatgctg

SEQ ID NO: 133945 - DNA, 601 bp, Human
gtttaggggatagaaatgggtggaggagagtcataaggctttctaaaataagctgcactacagcagaagttgcagttgggagttctgttgtagaaaatggagaggaaagcaatagatttttttccctccagtttgcattggttctcaaccggggatgattttgctttcctgctaaaggggatgtttggcaatgtctggagacatttttggttaccacgactggaaaggtgctaccagcatctggtaagtagagctcaaggatgctgctaaacatcctgcaatgcacaggacaaaaaaatayctcagtaaagaattatctagtccaaaatgtcagtagtacctccattgatatacccttctctaatgggattctaccagggttggagagttaggaaattgttactttcttcatacatggagaggagcataagtgagccatgtgccattctggactgaggtgccaccatggtgccagcatttgataatagtaaactcatgaccccttattcatagtttggaaatttaaaaaacgctggaaaatgtgacgtttcttcataattcagttagcagtaaaaccttgcctgtgttgatgtaaaggtat

SEQ ID NO: 133946 - DNA, 601 bp, Human
agttaggaaattgttactttcttcatacatggagaggagcataagtgagccatgtgccattctggactgaggtgccaccatggtgccagcatttgataatagtaaactcatgaccccttattcatagtttggaaatttaaaaaacgctggaaaatgtgacgtttcttcataattcagttagcagtaaaaccttgcctgtgttgatgtaaaggtatttatagtctttatttacctggttttgtgtgaatgttaatgcgcttgactgtagggtgctggcctagacctggcttggggctttatwtagtaaatatgctgtatcactcttctaaagtttgtaacattctatacttggaaacactttggtccccaaaggtttcagagaagagattgtgaacttatatattgaactaaatttttgccaaatttggcttattttgtgtgtgtgtgtgtgtgtgtgtggtttaaggagttgaaagtttaatagaagaaaggagagaggagagcatctccttgcaagagagagagagaaagagagaaacgtctgaaaaagtccaaagttggcttatttttaaaaattcagcgcttttagtaacgtttattg

SEQ ID NO: 133947 - DNA, 601 bp, Human
aaatttaaaaaacgctggaaaatgtgacgtttcttcataattcagttagcagtaaaaccttgcctgtgttgatgtaaaggtatttatagtctttatttacctggttttgtgtgaatgttaatgcgcttgactgtagggtgctggcctagacctggcttggggctttatttagtaaatatgctgtatcactcttctaaagtttgtaacattctatacttggaaacactttggtccccaaaggtttcagagaagagattgtgaacttatatattgaactaaatttttgccaaatttggcttattttgtgtgtgtgtgtgtgtgtgtgtggtttaaggagttgaaagtttaatagaagaaaggagagaggagagcatctccttgcaagagagagagagaaagagagaaacgtctgaaaaagtccaaagttggcttatttttaaaaattcagcgcttttagtaacgtttattgatttttttaaattccaaaaatgacataagatcattttgaaaagtttaagtacaaaaaagtagtaatattatcaaccaactgtatggtacttaactgtgcgctagatacaattctcagcactttatgtgcagt

SEQ ID NO: 133948 - DNA, 601 bp, Human
tttaaaaaacgctggaaaatgtgacgtttcttcataattcagttagcagtaaaaccttgcctgtgttgatgtaaaggtatttatagtctttatttacctggttttgtgtgaatgttaatgcgcttgactgtagggtgctggcctagacctggcttggggctttatttagtaaatatgctgtatcactcttctaaagtttgtaacattctatacttggaaacactttggtccccaaaggtttcagagaagagattgtgaacttatatattgaactaaatttttgccaaatttggcttatttggtgtgtgtgtgtgtgtgtgtgtggtttaaggagttgaaagtttaatagaagaaaggagagaggagagcatctccttgcaagagagagagagaaagagagaaacgtctgaaaaagtccaaagttggcttatttttaaaaattcagcgcttttagtaacgtttattgatttttttaaattccaaaaatgacataagatcattttgaaaagtttaagtacaaaaaagtagtaatattatcaaccaactgtatggtacttaactgtgcgctagatacaattctcagcactttatgtgcagtaac

SEQ ID NO: 133949 - DNA, 601 bp, Human
tacttggaaacactttggtccccaaaggtttcagagaagagattgtgaacttatatattgaactaaatttttgccaaatttggcttattttgtgtgtgtgtgtgtgtgtgtgtggtttaaggagttgaaagtttaatagaagaaaggagagaggagagcatctccttgcaagagagagagagaaagagagaaacgtctgaaaaagtccaaagttggcttatttttaaaaattcagcgcttttagtaacgtttattgatttttttaaattccaaaaatgacataagatcattttgaaaagtktaagtacaaaaaagtagtaatattatcaaccaactgtatggtacttaactgtgcgctagatacaattctcagcactttatgtgcagtaactaatttaatcttacgaatcccattatacctactttacaagtgcagaagccgtggcatagtaacttgctcaagatcccctagttgatggcagagctgggctttgaactctggcacagagaaggaagtgattcatcatctccacagctggagtgggctgctgtgtgtacatggatgtatttccttatagccttctttcagccttccctactc

SEQ ID NO: 133950 - DNA, 601 bp, Human
agtaatattatcaaccaactgtatggtacttaactgtgcgctagatacaattctcagcactttatgtgcagtaactaatttaatcttacgaatcccattatacctactttacaagtgcagaagccgtggcatagtaacttgctcaagatcccctagttgatggcagagctgggctttgaactctggcacagagaaggaagtgattcatcatctccacagctggagtgggctgctgtgtgtacatggatgtatttccttatagccttctttcagccttccctactcaactatatttgagaawttcccctgttgtcttaaatattttcaaaaaacctgattgttgaatggctgactacctatttaaaagaataggtgaggtggggcatggtggctcacgcctgtaatcccagcactttgggaggctgagccaggcagattacctgaggtcaggagttcaagaccagcctgaccaatatgatgacaccccgtctctactaaaaatacaaaaattagctgggcttggtggcatgcacctgtaatcccagctactcgggaggctgaggcaggagattcgtttgaacccgggaggcagaggttgcag

SEQ ID NO: 133951 - DNA, 601 bp, Human
tttcaaaaaacctgattgttgaatggctgactacctatttaaaagaataggtgaggtggggcatggtggctcacgcctgtaatcccagcactttgggaggctgagccaggcagattacctgaggtcaggagttcaagaccagcctgaccaatatgatgacaccccgtctctactaaaaatacaaaaattagctgggcttggtggcatgcacctgtaatcccagctactcgggaggctgaggcaggagattcgtttgaacccgggaggcagaggttgcagtgagccaagagtcaccattgcrctctagcctgggcaacaagagtgaaactccatctcaaaaaaaaaataaaataaaataagtgagtgaaccataaattatttaaacattcttttgttgttgggcatttaggctctgtccattttttcacaatagaaaattgacatggacacatttatgtataaatacttatccatatctgattatttctttagagaatgttttaatggggctttttaatagactcttcatatatactgtgaaatgtaccagtttattctctcattagaattcattgtcatcagcctggagtgttaaatgctt

SEQ ID NO: 133952 - DNA, 601 bp, Human
cctttgatttctgattctgtgatgtagtatcttgaagttttctgagaaaatcagacagatgattggaaatttagtatgattttttttaaattggtcaggaaacaagtagttggaataactgattttataaaattttatatttcaaaaaattcaattttagagccattttattttcagattaacccatgaagttaaatcaaggctccatttcacattgttatgaagagctggtagaaataaggatagtgcagcattaagagatactctgacctgaatcttactggtatgtgatcagtatatrcctaaaacaaccattcagtaaacatttatggaggatctgctacgcaccatacactgcattttgcactgggtatccagtgaggaacaagtgtataaaaggaaaaatagcaaatacttacacagtgctttttaggtgtcagacactgttttaacagcttacgcatgttacttaatttattactcccaacaaccctatgaggtagatactattattgtatccatttaactgatgagactgaagcacagagaagatgagtaatgggctcgcagacatgcaactactaaccaaggcaaaccactg

SEQ ID NO: 133953 - DNA, 601 bp, Human
tgtgatgtagtatcttgaagttttctgagaaaatcagacagatgattggaaatttagtatgattttttttaaattggtcaggaaacaagtagttggaataactgattttataaaattttatatttcaaaaaattcaattttagagccattttattttcagattaacccatgaagttaaatcaaggctccatttcacattgttatgaagagctggtagaaataaggatagtgcagcattaagagatactctgacctgaatcttactggtatgtgatcagtatatgcctaaaacaaccattcagtaaacatttatggaggatctgctacgcaccatacactgcattttgcactgggtatccagtgaggaacaagtgtataaaaggaaaaatagcaaatacttacacagtgctttttaggtgtcagacactgttttaacagcttacgcatgttacttaatttattactcccaacaaccctatgaggtagatactattattgtatccatttaactgatgagactgaagcacagagaagatgagtaatgggctcgcagacatgcaactactaaccaaggcaaaccactgactgtgctagtttggaa

SEQ ID NO: 133954 - DNA, 601 bp, Human
ttaaattggtcaggaaacaagtagttggaataactgattttataaaattttatatttcaaaaaattcaattttagagccattttattttcagattaacccatgaagttaaatcaaggctccatttcacattgttatgaagagctggtagaaataaggatagtgcagcattaagagatactctgacctgaatcttactggtatgtgatcagtatatgcctaaaacaaccattcagtaaacatttatggaggatctgctacgcaccatacactgcattttgcactgggtatccagtgaggaayaagtgtataaaaggaaaaatagcaaatacttacacagtgctttttaggtgtcagacactgttttaacagcttacgcatgttacttaatttattactcccaacaaccctatgaggtagatactattattgtatccatttaactgatgagactgaagcacagagaagatgagtaatgggctcgcagacatgcaactactaaccaaggcaaaccactgactgtgctagtttggaagggcagacagaagagggttggtgcagtactctgggcatgagaaactggtggcttttgccaccagcaaa

SEQ ID NO: 133955 - DNA, 601 bp, Human
ttggtcaggaaacaagtagttggaataactgattttataaaattttatatttcaaaaaattcaattttagagccattttattttcagattaacccatgaagttaaatcaaggctccatttcacattgttatgaagagctggtagaaataaggatagtgcagcattaagagatactctgacctgaatcttactggtatgtgatcagtatatgcctaaaacaaccattcagtaaacatttatggaggatctgctacgcaccatacactgcattttgcactgggtatccagtgaggaacaagtktataaaaggaaaaatagcaaatacttacacagtgctttttaggtgtcagacactgttttaacagcttacgcatgttacttaatttattactcccaacaaccctatgaggtagatactattattgtatccatttaactgatgagactgaagcacagagaagatgagtaatgggctcgcagacatgcaactactaaccaaggcaaaccactgactgtgctagtttggaagggcagacagaagagggttggtgcagtactctgggcatgagaaactggtggcttttgccaccagcaaattggt

SEQ ID NO: 133956 - DNA, 601 bp, Human
ttaagagatactctgacctgaatcttactggtatgtgatcagtatatgcctaaaacaaccattcagtaaacatttatggaggatctgctacgcaccatacactgcattttgcactgggtatccagtgaggaacaagtgtataaaaggaaaaatagcaaatacttacacagtgctttttaggtgtcagacactgttttaacagcttacgcatgttacttaatttattactcccaacaaccctatgaggtagatactattattgtatccatttaactgatgagactgaagcacagagaagatragtaatgggctcgcagacatgcaactactaaccaaggcaaaccactgactgtgctagtttggaagggcagacagaagagggttggtgcagtactctgggcatgagaaactggtggcttttgccaccagcaaattggtcaagcagtccagcaatgggattggagagaaatggaggcatcagaaagatttttcaagatagaatttatcagacatggtgattgaatgtggagggagagggagaagtcaagggtaaagcctaggtatcttggtatgagtgacctgctagatgatggagcccttc

SEQ ID NO: 133957 - DNA, 601 bp, Human
attctctgagaaagtgggctggtaggtaggtgctcttgatgtccttaatttcaaaatgaggaagtcagagcaggcacggtaagtaaagaataatggatcctgagcctcaccttttggtcactccgttggcagggtatgtgcttggggcatgaaaaccaagactcaaagactgccaatcctctgccgcagtttttgagagtaagaactatgcttgctgtaatatggcagaatgaaattatacctgctccttccttgcttcttccttcccttcctccctcccttttcctttcgtttcctttcstttcctttcctttccgtttcctttcctttcctttcctttcctttcctttcctttcctttcctttcctttcctttcctttccttccccttccccttccccttccccttccccttccccttccccttcccctttcctatctttgcattcgttctgctttagttcactgtttggaagggtgaaataaagccctggttctgttctttccccttgtccttccatcggagtgggccctttagtggttaagggtgagggatgagaagttagtctctggtgtctaaggtccctacgatacgtctgaat

SEQ ID NO: 133958 - DNA, 601 bp, Human
ggtagtgtgtagactgagaacaaaatgacctatcaatcttagggaatgaattaagaagaaggttgcctgtgaaggacaagtcagagagaaatccagaagagattgatgttctgaaagttaagactggacaatgtttcatgaaaaatgtaatcggagaatgaaggttcaatatgttttttgtttgcattttctttttgcttggaaatcatttcaaatttacagaaaaaaattacaaagaatacctgtccatttatttatctaattcaccttttcttatatttaaccctatttataatttccwacacacacacacacacacacacacacacacacaccacccaccatatatttttctgaaccattttgaggatatgttactatatcatggtcctttacttctaattacctaagtatttatttcctaagaattgggatattctcttatactataaccgcagcactattatcaacttgagtaaatttaacattgatacaatttaaaaaatcagatctaatatttatattccaattaacaagttaacccaattacattttgaataatatttttctgtctcatacaggttctagtctggggtcaaat

SEQ ID NO: 133959 - DNA, 601 bp, Human
agcactattatcaacttgagtaaatttaacattgatacaatttaaaaaatcagatctaatatttatattccaattaacaagttaacccaattacattttgaataatatttttctgtctcatacaggttctagtctggggtcaaatacttcattttatttcattcgttcgtttcttttaatctgaaacatttgcacagccttggtttatctcgtttttaagactgcatcctgcccgttaaaaatgcagtggctgtcagtttgaggttgttgctgcctcatgattagattcagggtgatgcartctcagttggaatattgcatagtgatgtgtccttgccaggatgtccaacctgcaggcaccttatgcccatcggtggcgatgatttttaacatcctttcacagtgttgtctagtttcctgattatataattattgttttctctttcttcccttgcaataagtggtctgtggggagctactgtaaggtcatatagatatcctccttctcctcaaagtcagtgcaagatttagcatccattgatgattattactgggtccagtcttcacagtgataggtgcgcaaacatgattttccatctcc

SEQ ID NO: 133960 - DNA, 601 bp, Human
tatgcccatcggtggcgatgatttttaacatcctttcacagtgttgtctagtttcctgattatataattattgttttctctttcttcccttgcaataagtggtctgtggggagctactgtaaggtcatatagatatcctccttctcctcaaagtcagtgcaagatttagcatccattgatgattattactgggtccagtcttcacagtgataggtgcgcaaacatgattttccatctccatgctctttccatgtttaccatttagcctttgacattctgctctaagcaagagtctcatatmatttctatttatttattttttgtgtgcactcaagagttcccattttccgttggttcataatttaccactgtactcaatttgagccctcaatcaaatttgagttggctagtgggggccccttcaagatggctcctgtgtccatgtggcatgttcccatcacttacttttgacaaatttttcagtttctggcataacaatgtgatcaggctcatcttgtatatactctagccctggagccatctgttcctttgaggatcccagattccttttagtggagaaagggtataggcagtatggtct

SEQ ID NO: 133961 - DNA, 601 bp, Human
ccatcggtggcgatgatttttaacatcctttcacagtgttgtctagtttcctgattatataattattgttttctctttcttcccttgcaataagtggtctgtggggagctactgtaaggtcatatagatatcctccttctcctcaaagtcagtgcaagatttagcatccattgatgattattactgggtccagtcttcacagtgataggtgcgcaaacatgattttccatctccatgctctttccatgtttaccatttagcctttgacattctgctctaagcaagagtctcatatcatttctatttatttattttttgtgtgcactcaagagttcccattttccgttggttcataatttaccactgtactcaatttgagccctcaatcaaatttgagttggctagtgggggccccttcaagatggctcctgtgtccatgtggcatgttcccatcacttacttttgacaaatttttcagtttctggcataacaatgtgatcaggctcatcttgtatatactctagccctggagccatctgttcctttgaggatcccagattccttttagtggagaaagggtataggcagtatggtctgtgtt

SEQ ID NO: 133962 - DNA, 601 bp, Human
caggaggtatgtcttaaaccccatgcttacctcaaggcaattagagaaaaccatgtgacagcatcggtctcactgactgtggttgatgaagcagagcagaaaagctgttttcttctccttgtcctttacttcagtcttccccatctcatcttccctacctgagctgatggactgtcttgtgaggctggggaggtgtccacttggctctttggttttggttcccagagggaggctctggccgcaggacacagcagatggagcctgtgggagcccatgtttgtgcctcggcaggtgtgggtcygggacgggtctgacctccacctggcacctgcttcttttattgcctccatatgtcaaggggatatgagcccatgtgagtgctttcagattgctctggcctgaggccatggttgggaatggcaggagcatgttgcgggggacagggacctttgtgagggacagttgagccactctgaggttagaggaccacacagctgccccttctagaagcctcgctgggccagaggtgtggcttcattaaggtcctagttggactgtgtcctcatctctctcttatttcctgctctgtttttgattttat

SEQ ID NO: 133963 - DNA, 601 bp, Human
actgtcttgtgaggctggggaggtgtccacttggctctttggttttggttcccagagggaggctctggccgcaggacacagcagatggagcctgtgggagcccatgtttgtgcctcggcaggtgtgggtctgggacgggtctgacctccacctggcacctgcttcttttattgcctccatatgtcaaggggatatgagcccatgtgagtgctttcagattgctctggcctgaggccatggttgggaatggcaggagcatgttgcgggggacagggacctttgtgagggacagttgagccastctgaggttagaggaccacacagctgccccttctagaagcctcgctgggccagaggtgtggcttcattaaggtcctagttggactgtgtcctcatctctctcttatttcctgctctgtttttgattttattttcttaaaatcttcatgctcatggatttttaaaatggcagtaatgatttttatttttttaaagagtaaaacaatggcagtctagtgcagttactttaagacatatcaggtaacctttaccagtaaatcgaaggccattgaataaggaatgtgtaaggatctgtggactc

SEQ ID NO: 133964 - DNA, 601 bp, Human
catgtttgtgcctcggcaggtgtgggtctgggacgggtctgacctccacctggcacctgcttcttttattgcctccatatgtcaaggggatatgagcccatgtgagtgctttcagattgctctggcctgaggccatggttgggaatggcaggagcatgttgcgggggacagggacctttgtgagggacagttgagccactctgaggttagaggaccacacagctgccccttctagaagcctcgctgggccagaggtgtggcttcattaaggtcctagttggactgtgtcctcatctctctyttatttcctgctctgtttttgattttattttcttaaaatcttcatgctcatggatttttaaaatggcagtaatgatttttatttttttaaagagtaaaacaatggcagtctagtgcagttactttaagacatatcaggtaacctttaccagtaaatcgaaggccattgaataaggaatgtgtaaggatctgtggactccctgaaattagatgcaaaatgttatatgtttgtatgaatgcattttttggaggaatggctcccatagctttctgcagattcttgtggacatttgacagtccc

SEQ ID NO: 133965 - DNA, 601 bp, Human
gggacagggacctttgtgagggacagttgagccactctgaggttagaggaccacacagctgccccttctagaagcctcgctgggccagaggtgtggcttcattaaggtcctagttggactgtgtcctcatctctctcttatttcctgctctgtttttgattttattttcttaaaatcttcatgctcatggatttttaaaatggcagtaatgatttttatttttttaaagagtaaaacaatggcagtctagtgcagttactttaagacatatcaggtaacctttaccagtaaatcgaaggcyattgaataaggaatgtgtaaggatctgtggactccctgaaattagatgcaaaatgttatatgtttgtatgaatgcattttttggaggaatggctcccatagctttctgcagattcttgtggacatttgacagtccctctccaaagtatggcctccaatatgtcttcttcacattcctttggagaactgcctttacctcccgtgtctctcatagatatctgagcactttaatttgtggaagagtcgaggaagaggaggccttgaaaatagtctcctttctaactaccaaatttgggggctg

SEQ ID NO: 133966 - DNA, 601 bp, Human
gctctgtttttgattttattttcttaaaatcttcatgctcatggatttttaaaatggcagtaatgatttttatttttttaaagagtaaaacaatggcagtctagtgcagttactttaagacatatcaggtaacctttaccagtaaatcgaaggccattgaataaggaatgtgtaaggatctgtggactccctgaaattagatgcaaaatgttatatgtttgtatgaatgcattttttggaggaatggctcccatagctttctgcagattcttgtggacatttgacagtccctctccaaagyatggcctccaatatgtcttcttcacattcctttggagaactgcctttacctcccgtgtctctcatagatatctgagcactttaatttgtggaagagtcgaggaagaggaggccttgaaaatagtctcctttctaactaccaaatttgggggctggctcagcttcccctcccccattactggttccctgagcaggtctgagccaggataatcttctttaacctccactttctgtcaggccctggtcgtgtgctggatgtacctctcctcatgtaattgtcacaactaccctgtattggagg

SEQ ID NO: 133967 - DNA, 601 bp, Human
gctggctcagcttcccctcccccattactggttccctgagcaggtctgagccaggataatcttctttaacctccactttctgtcaggccctggtcgtgtgctggatgtacctctcctcatgtaattgtcacaactaccctgtattggaggtgccaaagactgaataacatgtttaacttactaaatagaagaattgggactgccggtaaaaactgccagattccaaagccagagttttttcaatacactcaaggaataaaacgtcagctgctgtttttattagcactcaccaatgagacascatcctgtcctgttccctgttttcatcctgcagcgccatatattgctccaaagcttagatagtgcccagagcccacctacagctcatcttcctatgaggcagagagctagcttgatctttggggaataatggcagagctctcagaaggtgctggatccctaaccgctttgctgggttcttcattcctggcccacccgagagctcttctggaagtaaaggcctgaaactgtgaccttcttggctatggtgaaaagtaacagacgtcaagtgttagcaagcagaccctatctgttatttgac

SEQ ID NO: 133968 - DNA, 601 bp, Human
cacaaattgctaacatactgcctttcatttcataacattcttccaaaaaacaatattcttgtgactattattgagtataaactggatacttctggatacagctctggttgtacataagtgttttcctaactaaaggattgtttggggaaaatgagatttaaagaaccaagatactgatttttggttatttagcactatatccttgccatttttcatggattcccttgtcttatattcagagaacattttcagattgccttaagcctgtttgtttcctgtttatccaggtttcacttttcaytgatgggctactacaaggcctaacttttgcatatacctgtgtccaggtgtctcagtccaggaagttctgtagtcctgtttatgccatgtatttggactttcaaatattcagcaactatttttttctgtatatattttggggtctcttacaccactgtttaaaatgtggttcccaggccacctgtaatggaatcacatggagatgcttgaaaaagtggcacgtttctggttaatgtgccgttcttactggagcagaatatcttggggacagacataaaaagcctcatgttttgcaagtgac

SEQ ID NO: 133969 - DNA, 601 bp, Human
gaatctaacatataattagaattcaatgaatatttttgagcaataagtgagcacatgagttgctgggtttgtggtagttagaaagctatacaatacctttaccagtctttttgtaatgaaagctctgaaatatttattgaatgaatgaatggtgctaataataaggtgatgaaaataatttttcattcacaaattgctaacatactgcctttcgtttcataacagtcttccaaaaaacagtattcttgtgactgttactgagtataaactggatacttctggatacggctctggttgtacrtaagtgtttttcaccttgtgttacacacaaacacacaccctactccgtttgttggaagcctgcaagtgatcatgcgtatcaatgctaggagtgacgtcaagtagactggctgggaagggcagaatgtggtaggcggttaaaaagcaaaaggcacatgctatatgactttttgccttttcttgttgtctttaagacttttgtgatggttacataacaccagtgggaccagagactagggcaggccaaagatgcactgattaaggaaattactgctacctaacagttattctggagctcaag

SEQ ID NO: 133970 - DNA, 601 bp, Human
gtagttagaaagctatacaatacctttaccagtctttttgtaatgaaagctctgaaatatttattgaatgaatgaatggtgctaataataaggtgatgaaaataatttttcattcacaaattgctaacatactgcctttcgtttcataacagtcttccaaaaaacagtattcttgtgactgttactgagtataaactggatacttctggatacggctctggttgtacataagtgtttttcaccttgtgttacacacaaacacacaccctactccgtttgttggaagcctgcaagtgatcaygcgtatcaatgctaggagtgacgtcaagtagactggctgggaagggcagaatgtggtaggcggttaaaaagcaaaaggcacatgctatatgactttttgccttttcttgttgtctttaagacttttgtgatggttacataacaccagtgggaccagagactagggcaggccaaagatgcactgattaaggaaattactgctacctaacagttattctggagctcaagtatttcctgttcattatgcaataatgtagcctttcgagtctccaaatgccatttggaagaagagggtggggga

SEQ ID NO: 133971 - DNA, 601 bp, Human
atggtgctaataataaggtgatgaaaataatttttcattcacaaattgctaacatactgcctttcgtttcataacagtcttccaaaaaacagtattcttgtgactgttactgagtataaactggatacttctggatacggctctggttgtacataagtgtttttcaccttgtgttacacacaaacacacaccctactccgtttgttggaagcctgcaagtgatcatgcgtatcaatgctaggagtgacgtcaagtagactggctgggaagggcagaatgtggtaggcggttaaaaagcaamaggcacatgctatatgactttttgccttttcttgttgtctttaagacttttgtgatggttacataacaccagtgggaccagagactagggcaggccaaagatgcactgattaaggaaattactgctacctaacagttattctggagctcaagtatttcctgttcattatgcaataatgtagcctttcgagtctccaaatgccatttggaagaagagggtgggggagttggaggtagtaggttggatctgaggcttagtctcttgcctgctgttttatgggcaaggtggggcaggacctat

SEQ ID NO: 133972 - DNA, 601 bp, Human
ggtgatgaaaataatttttcattcacaaattgctaacatactgcctttcgtttcataacagtcttccaaaaaacagtattcttgtgactgttactgagtataaactggatacttctggatacggctctggttgtacataagtgtttttcaccttgtgttacacacaaacacacaccctactccgtttgttggaagcctgcaagtgatcatgcgtatcaatgctaggagtgacgtcaagtagactggctgggaagggcagaatgtggtaggcggttaaaaagcaaaaggcacatgctatatractttttgccttttcttgttgtctttaagacttttgtgatggttacataacaccagtgggaccagagactagggcaggccaaagatgcactgattaaggaaattactgctacctaacagttattctggagctcaagtatttcctgttcattatgcaataatgtagcctttcgagtctccaaatgccatttggaagaagagggtgggggagttggaggtagtaggttggatctgaggcttagtctcttgcctgctgttttatgggcaaggtggggcaggacctataaaaattccttcaccc

SEQ ID NO: 133973 - DNA, 601 bp, Human
taacagtcttccaaaaaacagtattcttgtgactgttactgagtataaactggatacttctggatacggctctggttgtacataagtgtttttcaccttgtgttacacacaaacacacaccctactccgtttgttggaagcctgcaagtgatcatgcgtatcaatgctaggagtgacgtcaagtagactggctgggaagggcagaatgtggtaggcggttaaaaagcaaaaggcacatgctatatgactttttgccttttcttgttgtctttaagacttttgtgatggttacataacaccrgtgggaccagagactagggcaggccaaagatgcactgattaaggaaattactgctacctaacagttattctggagctcaagtatttcctgttcattatgcaataatgtagcctttcgagtctccaaatgccatttggaagaagagggtgggggagttggaggtagtaggttggatctgaggcttagtctcttgcctgctgttttatgggcaaggtggggcaggacctataaaaattccttcacccatggcccttttctcctacaatgactgtagaaaattagaaccctttaactgtttag

SEQ ID NO: 133974 - DNA, 601 bp, Human
acaatgactgtagaaaattagaaccctttaactgtttaggaatgtgagtgttcagcataaggatccaattaggatgatggggaggagagataagtagcaatagatttaatatgtgatgtttgatagcattaaaaatgtcccaagcctatgcatgcagtgattgcttgatactgtagttttaatttgagttatagcatagagatggtgatgctatagaggaaaaaacccgcaattatttttgcaccaacctaatattaagttttatatttcacatttgtgggcttgtttcatcaacggagcrgtttccaaggcttcaaggaaacattgttctatgttttctctcatccatccccctgtggagggatgttgagaggagagtcggttttgaaggtgcagttcttgctttcatagcatgtagttaaaataaaaaccacagtgtagtgttctgacatcccctcttgctcaggcatagggcatatttggtgaaccttggccattctgacaactgttctggcagctgtttcttgtgtcattcttttctgggctttattgtaatgtaaacccaccaaacaagatttctggcagttctgtacatggaaaa

SEQ ID NO: 133975 - DNA, 601 bp, Human
aaatataaggactcaatttgtaggtaagtggtttctatcctggagaaaacaaagcccatcatactggatgttcacatcagctgggctgtatgacaatgttggtgagtcagtgctttgaaggccctaaggttaaatgttttgaataccacccccatgcatagtattttgggttcagtggggctttaaaacatcctttattctccccacatcccatcatcttctgcaaacttaacaatttactatactttttctgaaaatgagccttttaatctcccaatccatagttggacgaggctcactytgaaaagtaaagaggttggcttattgataacttcaggcctgctccttgcttacatgctgatgtttactttttgaaatcgacctaaaaaatgtcaatactttgttatggttttgaaatgtatctgataattcctttctgggcatgttaaaagtcttaattttcttggcaacagaattttccttttagggttcagtatctgcttttcagggttatttctggaaagattttaagatagcttaagggctttcttaaccacataaaacataatttcctcaatacattttgggggaaaaatcaata

SEQ ID NO: 133976 - DNA, 601 bp, Human
gtcatacaacaacctatccatggcagtagagaaaaataattaaaaaatgcacaatctctaacacaactatttttagttttgcattttctttccatcttggccgacatagctacaaagcacaattattggaactacagtaattattttgatttttgatttttattatgtatctaatcactgttttcattttcccatatactatacaaatgtcactgtcaaagctacatattgggctgtccgggtgatttactgtgagcatgcccatattcttagaatttagattccatccagttatttgaarttgtagatgatgttatagggaacatatttttgcctatgtttttcttttaatgattacatcctttaattaaatttggactttaaatttggaatttctgggtcacagttgtttttatggccctgaaataacattctgttttatacttgtagaaatagtttttgttcttgtaaccaaccagagcacaagtgacaggcaagcttttagctttagggatgttcttaacacatcccgaagattttgtgctctcaatgtgtccctgctatttggagcttccctgaaaaagattctgtcaggagcttc

SEQ ID NO: 133977 - DNA, 601 bp, Human
ttcttaacacatcccgaagattttgtgctctcaatgtgtccctgctatttggagcttccctgaaaaagattctgtcaggagcttctgctaattaaattgaattggtccagctttgttgtaaacaggtaacggattgtggtgttttattacttgatacttattgctgaaacaagttttatgaaaaaaggagagtattagcctgaggacaaaagtagtttggagttctgtagaggagctgccagtattaatgaactatcacttggagcctgcaacctgtcagccttgacttttcctctcctgrgtcagccatcattggtcctccacattgcttttcactttgccagctaaggcttttcagtggcttctgatataggtcttgtttctcaagtgagtgtgccctcaggaggggaactgggcaatctgggaagggagctttgatttcacaaccatgtgggaatgccagtagaatgagacgccatgatgagtgtgggtacctgcccttcttggcaggagtggactagaaatcagttggtgttactgcaagcccagtccattgatgtgcacatccattgtgggaggatactactctcaatggctgcac

SEQ ID NO: 133978 - DNA, 601 bp, Human
ttttatgaaaaaaggagagtattagcctgaggacaaaagtagtttggagttctgtagaggagctgccagtattaatgaactatcacttggagcctgcaacctgtcagccttgacttttcctctcctgggtcagccatcattggtcctccacattgcttttcactttgccagctaaggcttttcagtggcttctgatataggtcttgtttctcaagtgagtgtgccctcaggaggggaactgggcaatctgggaagggagctttgatttcacaaccatgtgggaatgccagtagaatgagaygccatgatgagtgtgggtacctgcccttcttggcaggagtggactagaaatcagttggtgttactgcaagcccagtccattgatgtgcacatccattgtgggaggatactactctcaatggctgcactgctgccagtgacgttaaaaagtcatccatgtaaaagcatgggtaactgcttaacatgtattaaatgaaaaagcaaaatacgaaatgatctaggtactgcacaagtgtcctaaatgttttgcatatcgtcaaaataatattaatataagaaagtgtaaatagctgtaataagt

SEQ ID NO: 133979 - DNA, 601 bp, Human
tactgcaagcccagtccattgatgtgcacatccattgtgggaggatactactctcaatggctgcactgctgccagtgacgttaaaaagtcatccatgtaaaagcatgggtaactgcttaacatgtattaaatgaaaaagcaaaatacgaaatgatctaggtactgcacaagtgtcctaaatgttttgcatatcgtcaaaataatattaatataagaaagtgtaaatagctgtaataagttatggtgagattaaaagccatttctttttcttttttgcaccaacgtgttctttagtgttttrgcacatttgtagtagagttttgaagttatttttataaatcagatatgtaggattctaggtctgtgaaatgaaattgaatgaagaggatttgacagtcttcttaaacttctgggaaataaaggctgaaaacagcaggctttcatctgtgtatcttctgaagctgaaatgaacactatgcccattttgctgtatgtccatttgagtattttctaatacctttttggggagtaggtgtatcttcagctgaaagaatatttctaagtatccaagtccttaaggaagctaaaagttttgagttat

SEQ ID NO: 133980 - DNA, 601 bp, Human
atagagtgcagaagtaaagaatgctggttctggactcagactcttgatgtggagtcctggctggttttggaactttgggctcttgaagggagtatcctcatctgtacggtggagaccactggtaccctcaggtggctgtggaggttgcatcggttaacactagtgaagttctgagtgcaatgcttggtccatactaacccagaactgcagtggtgatgatacatatgatacatcttcttgggtagttacatattttcttcttgttaccagggtattccttttaactatgagaaatcagaaraatacagaaaatcacaaagaagagactagaaataacccaaactccacaacaggttttgctttttgtcttctctgatgatgaagtaaaatatgttggccatttggagaagtaaagatgtttgtaagtggggtgtttccagaccctctgaaatatatgcctcttttcttgctatgcctagtataatacctcactcattgtcaaccactagagacttagcttcttgttcttggttctactactaaattttttgacttgggcaaatcatttaaatatttctaggtgttctttaaggcttaaaaa

SEQ ID NO: 133981 - DNA, 601 bp, Human
ttcttgggtagttacatattttcttcttgttaccagggtattccttttaactatgagaaatcagaaaaatacagaaaatcacaaagaagagactagaaataacccaaactccacaacaggttttgctttttgtcttctctgatgatgaagtaaaatatgttggccatttggagaagtaaagatgtttgtaagtggggtgtttccagaccctctgaaatatatgcctcttttcttgctatgcctagtataatacctcactcattgtcaaccactagagacttagcttcttgttcttggttckactactaaattttttgacttgggcaaatcatttaaatatttctaggtgttctttaaggcttaaaaaccaaggttagtttagctttgtcattctttcttctcttaacctgtgacttggtttatttatggtttgttcatttcctttatatgtcttcagtgaaagcagcacagaaaatgactttggccatgtcagtcagccaacagcttttgagcagacactcttctggccctgggaattacagaaccacacaatacacacatgatctgtggcttttggagcctgtggcagggccctggatgg

SEQ ID NO: 133982 - DNA, 601 bp, Human
aagaacatatagtatatggttttctgttcctgcattagtttgctaaggataatggtctctagcttcatccatgtccctgcaaaggacatggtctcattttttatggctgcatagtattccatgttgtatatgtaccacattttctttatccagtctatcattgatgggcatttagattgattccatgcaagttcttagagaccttcaaagaatatttgagcatttctaactggaaggaagtgaaaaagaaaggtgtggtgagttgagcacgtggctgactcattgaggagtcctgggtttsaactgctttatctgtaagagctcaatttaattcagagttaagtgcctaaaaggtatccagcacatgcctcctggggttcgggatgcactgttcttgacctcacagagcatttatttaagctgaaagtcatgtgcctgctgtgagattgggtgctctgagtgtacacaacagaggaaatctggctggtctatgttatttccttggaatgtctcttggagtcagctgtgatgcccccaggggttcaggcacaagggagaaaaatgagtggacatcctaaggctctctgaggatttcctggtt

SEQ ID NO: 133983 - DNA, 601 bp, Human
gcatttagattgattccatgcaagttcttagagaccttcaaagaatatttgagcatttctaactggaaggaagtgaaaaagaaaggtgtggtgagttgagcacgtggctgactcattgaggagtcctgggtttgaactgctttatctgtaagagctcaatttaattcagagttaagtgcctaaaaggtatccagcacatgcctcctggggttcgggatgcactgttcttgacctcacagagcatttatttaagctgaaagtcatgtgcctgctgtgagattgggtgctctgagtgtacacracagaggaaatctggctggtctatgttatttccttggaatgtctcttggagtcagctgtgatgcccccaggggttcaggcacaagggagaaaaatgagtggacatcctaaggctctctgaggatttcctggttgcttccaactcaagttgagtattacaggaaggtttggaaggataaaagccacaaaaatggcagtttctattttctctcacctccatttatcagcctggtcacagcagcaagtaaccaagaggtcctaaatgcagtgtccaaactgtatgtgggcccaagacctgcca

SEQ ID NO: 133984 - DNA, 601 bp, Human
tgagtggacatcctaaggctctctgaggatttcctggttgcttccaactcaagttgagtattacaggaaggtttggaaggataaaagccacaaaaatggcagtttctattttctctcacctccatttatcagcctggtcacagcagcaagtaaccaagaggtcctaaatgcagtgtccaaactgtatgtgggcccaagacctgccaaggtattcaagtacagccacactgaagctttgctttctaggcacaaagtttgattatcttatatctgcttgccatgctttttaatataactggarttagatgttggggtttctcagtctgtggacaaatatgcaggtgcttatgtatggaatattaatgatggagtttaaaaagagttacttaagaagaagtatctagcatgggataaccgtggattgaaaagcaccaagtgcatcttatgaatgcatttctaggccctagcacagaacttgccactgtgggcagcatgggaatgttaggtaaaggtaatggatgaatggtctgtgttctaataacctgcctgacctgtctggaatttccaacatttatcccacacccaaaactcccatctttcc

SEQ ID NO: 133985 - DNA, 601 bp, Human
cacctccatttatcagcctggtcacagcagcaagtaaccaagaggtcctaaatgcagtgtccaaactgtatgtgggcccaagacctgccaaggtattcaagtacagccacactgaagctttgctttctaggcacaaagtttgattatcttatatctgcttgccatgctttttaatataactggagttagatgttggggtttctcagtctgtggacaaatatgcaggtgcttatgtatggaatattaatgatggagtttaaaaagagttacttaagaagaagtatctagcatgggataaccktggattgaaaagcaccaagtgcatcttatgaatgcatttctaggccctagcacagaacttgccactgtgggcagcatgggaatgttaggtaaaggtaatggatgaatggtctgtgttctaataacctgcctgacctgtctggaatttccaacatttatcccacacccaaaactcccatctttccaaacaatattatattgcccttcctgctaaactgtttgtgtacggaaaccttatgatatataacagcatggcataacctgatccatctttgcattctccacgttgatcatagcttta

SEQ ID NO: 133986 - DNA, 601 bp, Human
ttatcagcctggtcacagcagcaagtaaccaagaggtcctaaatgcagtgtccaaactgtatgtgggcccaagacctgccaaggtattcaagtacagccacactgaagctttgctttctaggcacaaagtttgattatcttatatctgcttgccatgctttttaatataactggagttagatgttggggtttctcagtctgtggacaaatatgcaggtgcttatgtatggaatattaatgatggagtttaaaaagagttacttaagaagaagtatctagcatgggataaccgtggattgaraagcaccaagtgcatcttatgaatgcatttctaggccctagcacagaacttgccactgtgggcagcatgggaatgttaggtaaaggtaatggatgaatggtctgtgttctaataacctgcctgacctgtctggaatttccaacatttatcccacacccaaaactcccatctttccaaacaatattatattgcccttcctgctaaactgtttgtgtacggaaaccttatgatatataacagcatggcataacctgatccatctttgcattctccacgttgatcatagctttacaaaatgac

SEQ ID NO: 133987 - DNA, 601 bp, Human
tcctaaatgcagtgtccaaactgtatgtgggcccaagacctgccaaggtattcaagtacagccacactgaagctttgctttctaggcacaaagtttgattatcttatatctgcttgccatgctttttaatataactggagttagatgttggggtttctcagtctgtggacaaatatgcaggtgcttatgtatggaatattaatgatggagtttaaaaagagttacttaagaagaagtatctagcatgggataaccgtggattgaaaagcaccaagtgcatcttatgaatgcatttctaggycctagcacagaacttgccactgtgggcagcatgggaatgttaggtaaaggtaatggatgaatggtctgtgttctaataacctgcctgacctgtctggaatttccaacatttatcccacacccaaaactcccatctttccaaacaatattatattgcccttcctgctaaactgtttgtgtacggaaaccttatgatatataacagcatggcataacctgatccatctttgcattctccacgttgatcatagctttacaaaatgacctttttcactactggagtcatgtcacagtacaactt

SEQ ID NO: 133988 - DNA, 601 bp, Human
tctctactaaaaatacagaaaaattagccgggcatggtggcaggcgcctgtagtcccagctattcgggaggctgaggcaggagaatggcatgaacccgggaggcggagcttgcagtgagccgagatcgcgccactgcactccagcctgggcgacagagcgagactccctctcaaaaaaaaaacaaaaaaacaaaaaaaccactgatttcatagcactgatgttttgcaagatatcctagaggggcccttaaaaatttatcatttctcattttcaagtcagtatcaaaaaagtcctatttcrttagacattcatttatgtatctattatccagatatttattgggttcctgctgtattccaggccctctgctgagtgctagaggtatataaaccagcaaaacaggtaacgttttgggttgatctacctgtatcttacttacagtagagagagacaaaaaagtcaacaagtaaatgaaaacattgttgtgaaagtatcatgaggaaaaccaaatgatgaggtgaagactggttgggagtgatagaaaattattttggatagagtggtgagagaattcccctttgagaaatgatgtataagctg

SEQ ID NO: 133989 - DNA, 601 bp, Human
ggaggctaatctatcaattattaaccctggttgtactttaaaattctgattaagaaacgatttttggcaggagaggctattagccaagtgtaatgtatgtaacacttactttataaaggtatgttgaatgaatgtatgaattctaaattgtaagatttgaaatgaaaccattgccattttctctcatgacattagattatggaaagatttattttaaaagacatggaaggcatgaactgcaaaagaaaaaagtggtaaattttaatcaaaatttaaaacttttgttctttggaagatagayctgggggaacaaggcaagtcataaactgggagaaaatattgtaaagcaaaaatctaatgaaatgtgtgtgcttagaatatgtgaagaactcttacaccatacaaaacagacaacccaataaaaatatagacaaatggtttgtatagacctgtcttaaaagaagatgcataaatgatcaaaagtatgtgaaatttcaaggaaatgcatattaaagccacaatgcgatacaactgtatacccactggaatggccaaagttaaaaagagaataccaaatgctggtgacgatgtggagcaaccg

SEQ ID NO: 133990 - DNA, 601 bp, Human
aagaactcttacaccatacaaaacagacaacccaataaaaatatagacaaatggtttgtatagacctgtcttaaaagaagatgcataaatgatcaaaagtatgtgaaatttcaaggaaatgcatattaaagccacaatgcgatacaactgtatacccactggaatggccaaagttaaaaagagaataccaaatgctggtgacgatgtggagcaaccggcacctttatacatttttgttgggaatgcaagttggaaaacattatggttgtataagataacataaaattgccgtataattcakcagttcaactccttggtgttagtcgaagagaaaggagaacatgttcatacagactttatgtgaatattcatggcagtgctattcataatagtcttaaaaactggacgcaacctaattatggtatgtctgtactattgaatattatgtaacaacaaaaagaataaaatgttaatacatgaaaagacatgttgaatcttaatgaaacttttaaaagttatgctaagtgaaagatgtcaaacccaaaagaataaatactgttcaatttcattatatgaaaattgaaaattggcaaaactagtg

SEQ ID NO: 133991 - DNA, 601 bp, Human
atatcctttaggcctaatcacttttttctttcaacatgcctaatgtagcataatagttaatagcatagtagtttgacttttaaaattgatttctagggaagaatgtaaatataggaaagcttcctgatagagattatctaaacttaggcataaataataagtaaaactctgaatttaggtatgtaattgtagaatccctttgattataagcaagttgaaaaaaattgttttttacctagatgagtttattttaaaaagttattaagcatttataaaggagccttttttggggtggctcctrattattaccaagtttccaatattataaactctgtgcttgagttgaatattatagtttaggcttctatctcctagtagtgtttccaagcaaacagtttttccagtctctcagaagttcatttcagttaccatctcctcactattcctggagtgtatgttgcttatggtagcagctcaagggacagatgtatgaatgagagcaatccataaatgtttgaattcaaattatagtttttttaaaataaattctgctataaaaagaaatgaaatatttgtccatgctaaaacatggagaaacctt

SEQ ID NO: 133992 - DNA, 601 bp, Human
ttacttatttatttttattatactttaagttctgggatacatgtggagaatgtgcaggtttgttacattgatatacatgtgccatggtagtttgctgcacccatcaacccgtcatctacattaggtatttcttctaatgctatcccttcccttgccccacattccctgacaggccccagtgtgtgatgttcccctccctgtgtccatgtgttctcattgttcaacacccatttatgagtgagaacatgtggtgtttggttttctgttcctctgtgagtttgctgagaatgatggtttccarcttcatccatgtccctgcaaaggatatgaacttatccttttttgtggctgcatagtattgcatggtttatttatgccacattttctttatccagtctatcactgatgggcatttgggttggttccaagtctttgctattgtgaataatgctgcaataaacatacgtgtgcatgtgtctttagagtagaatgttttataatcctttgggtatatacccactaatgggattgctgggtcaaatggtatttctagttctagatccttgaggaatcaccacactgtcttgcccaatagttgaac

SEQ ID NO: 133993 - DNA, 601 bp, Human
cagttttctgcatatggccagccagttttcccaacaccattgattaaatagggaatctttttcccattacttgtttttgtcaggtttgtcaaagatcagattgttgcagatgtgcggtgctatttctgagggctctgttctgttccactggtccatatatctgttttggtatgagtaccatactgttttggttactgtagccttgtatagtttgaagtcaggtagcgtgatacctccagctttgttgtttttgcttaggattgtcttggctatatggacttttttggttccatatgacatktaaagtagttttttctaattctgtgaattttctaattctgtgaagtaggattttctaattttgtgaagaaagtcaatggtagtttgatggaaatagcattgaatctataaattactttgggcagtatggccattttcatgatattgattcttcctgtccacgagcatggaatgtttttccatttgtttgtgtcctctgttatttccttgagcagtggtttgtagttctccttgaagaggtccttcacatcccttgtaagttgggttcctaggtattttattctctttgtagcaattgtga

SEQ ID NO: 133994 - DNA, 601 bp, Human
caatggtagtttgatggaaatagcattgaatctataaattactttgggcagtatggccattttcatgatattgattcttcctgtccacgagcatggaatgtttttccatttgtttgtgtcctctgttatttccttgagcagtggtttgtagttctccttgaagaggtccttcacatcccttgtaagttgggttcctaggtattttattctctttgtagcaattgtgaatgggagtttgctcatgatttggctctgtatttgtctatttttggtgtataggaatgcttgtgatttttgcacrttgattttgtaccctgagactttgctgaagttgcttatcagcttaaggagtttttggactgagacgatggggttttctaaatatacaatcatgtcatctgcagacaatagtttgagttcttctcttcctatttgaatacctttatttctttctcttgccttattgccctggccagaacttccaatactatgttgaataggagtggtgagatgttgaataggagttttcaaagggaatgcttccagcttttgcccattcagtatgatattggctgtgggtttgtcataaaaagttcttatt

SEQ ID NO: 133995 - DNA, 601 bp, Human
gaagaggtccttcacatcccttgtaagttgggttcctaggtattttattctctttgtagcaattgtgaatgggagtttgctcatgatttggctctgtatttgtctatttttggtgtataggaatgcttgtgatttttgcacattgattttgtaccctgagactttgctgaagttgcttatcagcttaaggagtttttggactgagacgatggggttttctaaatatacaatcatgtcatctgcagacaatagtttgagttcttctcttcctatttgaatacctttatttctttctcttgcsttattgccctggccagaacttccaatactatgttgaataggagtggtgagatgttgaataggagttttcaaagggaatgcttccagcttttgcccattcagtatgatattggctgtgggtttgtcataaaaagttcttattattttgagatatgttccatcaataccgaccttatggagtgttttagtcattggttctgtttatgtgttttttgtcattggttctgtttatgtgatggattacgcttattgatttgtatatgttgaagcagccttgcatcccacgggtgaagccgacttg

SEQ ID NO: 133996 - DNA, 601 bp, Human
ggagttttcaaagggaatgcttccagcttttgcccattcagtatgatattggctgtgggtttgtcataaaaagttcttattattttgagatatgttccatcaataccgaccttatggagtgttttagtcattggttctgtttatgtgttttttgtcattggttctgtttatgtgatggattacgcttattgatttgtatatgttgaagcagccttgcatcccacgggtgaagccgacttgatcgtggtggataagctttttgatgtgctgctggattcggtttgtcagtattttattgagsattttcacattggtgttcatcagggatgttggcctgaaattctcttttttgttgtgtttctgccaggttttggtatcaggatgatgctggcctcataaaatgagtaagagaggagtccctctttttctgttgtttggaatagtttcagaaggaatggcaccagctcctctttgtacctctggtagaattcagctgtgaattcgtctggtcctgggcttttctttggttggtaggctattaattactgcctcaatttcagaacttgttattggtctgttcagggatttgacttcttcctgg

SEQ ID NO: 133997 - DNA, 601 bp, Human
gtaagagaggagtccctctttttctgttgtttggaatagtttcagaaggaatggcaccagctcctctttgtacctctggtagaattcagctgtgaattcgtctggtcctgggcttttctttggttggtaggctattaattactgcctcaatttcagaacttgttattggtctgttcagggatttgacttcttcctggtttagtcttgggagggtgtatgtgtccaggaatttatccatttcttctggattttctagtttatttgcatagagatgtttatagtattctctgatggtagtttrtatttctgtggggtcagtggtggtatcccctttatatcattttttattgtgcctatttgattcttctctcttttcttctttattagtctggctagccatctatctagtttgtcaactctttcaaaaaaacagctcctagattcattgatttttcgaagggttttttatctccttcagttctgctctgatcttagttatttcttgttttctgctagcttttgaatttgtttgctcttgcttctgtagttcttctaattgtgatgttagggtgttgattttagatctttccctctttctccc

SEQ ID NO: 133998 - DNA, 601 bp, Human
tgttcagggatttgacttcttcctggtttagtcttgggagggtgtatgtgtccaggaatttatccatttcttctggattttctagtttatttgcatagagatgtttatagtattctctgatggtagtttatatttctgtggggtcagtggtggtatcccctttatatcattttttattgtgcctatttgattcttctctcttttcttctttattagtctggctagccatctatctagtttgtcaactctttcaaaaaaacagctcctagattcattgatttttcgaagggttttttatctycttcagttctgctctgatcttagttatttcttgttttctgctagcttttgaatttgtttgctcttgcttctgtagttcttctaattgtgatgttagggtgttgattttagatctttccctctttctcccgtgggcatttagtgctataaatttacctgtaaacacgctttggctgtgtcccagagattctggtacactgtgtgttcttattggtttcaaataacttatttgtttctgccttaattttgatatttaccttgtagtcattcaggagcaggttgttcagttttcatgtagtcg

SEQ ID NO: 133999 - DNA, 601 bp, Human
aactctttcaaaaaaacagctcctagattcattgatttttcgaagggttttttatctccttcagttctgctctgatcttagttatttcttgttttctgctagcttttgaatttgtttgctcttgcttctgtagttcttctaattgtgatgttagggtgttgattttagatctttccctctttctcccgtgggcatttagtgctataaatttacctgtaaacacgctttggctgtgtcccagagattctggtacactgtgtgttcttattggtttcaaataacttatttgtttctgccttawttttgatatttaccttgtagtcattcaggagcaggttgttcagttttcatgtagtcgtgcggttttgagtgagtttcttcatcctgagttctaatttgattacactgtggcttgagaaactgtttgttatgatttccatttttttgcatttgctgaggagtgctttacttccaattatgtggtcagttttagaataagtgcgatgtggtgctgagaagaatgtatcttctgtttgtttggggtggagagttctgtagatgtctattaggtctgcttggtccagagctgagttcaagtcgt

SEQ ID NO: 134000 - DNA, 601 bp, Human
ctgatgggtctcctgaatacaacacaccgatgggtcttgaatctttatgcaatttgcaagtctgtgccttttaattggggcatttatcccatttacatttaaggttaatattcttatgtgtgaatttgatcctttcattatgatgctagctggttattttgcccattagtggatgaagtttgttcataatgttgacgttctttacaattttgtttgtttttgcagtggctggtactggtttttccttaccatatttagtgcttccttcaggagttcttgtaaggcaggcctgatggtgacrtaacctctcagcatttgcttgtctgtaaagggttttatttctccttcatttatgaagtttagtttggctggatatgaaattctgggttgaaaattcttgtctttaagaatgttgaatattggcccccactgtcttctggctcctagggtttctgctgagagatccgctgttagtctgatgggcttccctttgtgggtaacctgacctttctcactgcttgcacttaacattttttccttcatttcaaccttggtgaatctgacgattatgtgtcttggggttgctcttcttgaggagtat

SEQ ID NO: 134001 - DNA, 601 bp, Human
atcctttcattatgatgctagctggttattttgcccattagtggatgaagtttgttcataatgttgacgttctttacaattttgtttgtttttgcagtggctggtactggtttttccttaccatatttagtgcttccttcaggagttcttgtaaggcaggcctgatggtgacataacctctcagcatttgcttgtctgtaaagggttttatttctccttcatttatgaagtttagtttggctggatatgaaattctgggttgaaaattcttgtctttaagaatgttgaatattggcccccrctgtcttctggctcctagggtttctgctgagagatccgctgttagtctgatgggcttccctttgtgggtaacctgacctttctcactgcttgcacttaacattttttccttcatttcaaccttggtgaatctgacgattatgtgtcttggggttgctcttcttgaggagtatctttgtggtgttctctgtatttcctgaatttgaatgttggcctgtcttgctaggttggggaagttctcctgggtaatatcctgaaatatgtcttccaacttggttccgttttccccatcactttcaga

SEQ ID NO: 134002 - DNA, 601 bp, Human
cttcaccaagttctcgtgctatgtttttccgctccatcaggtcatttatgttcttctctaaactgattattctagttagcaattcctctaaccttttatcaaagttcttagcttccttgcattgggttaggacatgcttctttagctcagaggagtttgttataacccaccttctgaagcctacttctgtcaatttgtgaaactccttctctgtccagttttgctcctttgctggcaaggagttgtgatcctttggaggagaagaggcgttctggtttttggacttttcagccttgttgcrctggttttccctcatctttgtggatttatctacctttggtctttggtgtcagtgacctttggatggaatttttgcgtggtcatgctttttgttgatgttgatactattgctttctgtttgtcagttttccttctaacagacctgtcttctgcaggcctgatggagtttgctggggggccactccaggccctgtttgcctcggtatcaccagcggagtctgcagaacagcaaagattgatgcctgctcctacctgtggaagcttcatcccacaggggcaactgccagatgccagccagagc

SEQ ID NO: 134003 - DNA, 601 bp, Human
ttatctataagcccctgaccggggctgttgcctttcctcagagatgccctgcccagagaggaggaatccagagaggcagtatggctacagtggctttgtggcgctcaaaattcttgtgttctaatgatgtgaagttaacaggatgcagatcacatatctaaattgacttgtaaacatttattttaggaaatgatagtatattctctcatcactaatatatttctgttgcttcaatgtgcaaaacactgtgctagatattgtggggaagactaaaatgaataatagctaacactaggcaagktcacattgtttgtcagatgctatgctaaatgctagatgtgggtgatttcatttagtgctgaaacagccctgtgacagagctcttgttagtttctctctctctctctctctctgtctctctctctaccgtttgaggaaactgatgctttaggaagacataaagatacaaatggtggaactggaattcaaattgagaccacaaagctgttgttcttaagtctgtaacatacaaagcctcacctttctcatctgaaagtgaggataacaagctagcttgttgcaaaggttaaataaagtaata

SEQ ID NO: 134004 - DNA, 601 bp, Human
gccctgcccagagaggaggaatccagagaggcagtatggctacagtggctttgtggcgctcaaaattcttgtgttctaatgatgtgaagttaacaggatgcagatcacatatctaaattgacttgtaaacatttattttaggaaatgatagtatattctctcatcactaatatatttctgttgcttcaatgtgcaaaacactgtgctagatattgtggggaagactaaaatgaataatagctaacactaggcaagttcacattgtttgtcagatgctatgctaaatgctagatgtgggtgrtttcatttagtgctgaaacagccctgtgacagagctcttgttagtttctctctctctctctctctctgtctctctctctaccgtttgaggaaactgatgctttaggaagacataaagatacaaatggtggaactggaattcaaattgagaccacaaagctgttgttcttaagtctgtaacatacaaagcctcacctttctcatctgaaagtgaggataacaagctagcttgttgcaaaggttaaataaagtaatactgtaaaacacttggtaccacagaatactactattacttcttaat

SEQ ID NO: 134005 - DNA, 601 bp, Human
gggcattggtaaataccacaaaacttattttctgttttaaatggaaaaaatagtttactatgtgcctatttaacttacacaagggagtttgctttattagagtaactgcaaatgaggcaacaaaatttttcttttggcaaatacacgtattaggtctcatttcaggtttgaggaaaatagtgaatatttttagttattttgaatacaaatatgtaatattctttttctgagaagcctaagtagtttttcttgctatgcctgaattttggcagataaacgtgtcaaaccaatttgttatacmcctgttgtaacagaagtgacaaagaaaaatcacagttcagagatttgacaggtttgtactgaaatggtgtttagtatatctaggtgttctatctagaaaaaaagtatagaatggctcaactttaaattgattaatctaaaaagaaaagccttcataaccaccagcttttatttagtgttccacatatttctaatattccaacaaggatatcttccctggagagagtagagttgagatcataccaactctgattagaattttcacttaagaacagcagttgagatgatgttatctacattc

SEQ ID NO: 134006 - DNA, 601 bp, Human
cttattttcactgtcttgttttctgtcttctatttattataactgttttgtgtcttgctcgcattgctgttttcttttctaccttccagtggaaactctttaaatcagatgtcttatttttttccctcagttctgggaaatatttgactgttatttcttcaatactttctcccatctgtttactttcctctattcttttgagattcctaatacttctagcctccagattttttatcttatatctcattctttttacctttaagatgccatctggagagatttttggccaggttttctaagmtactgtgtaggttgtttgagctgttgtcttttattgatggtgcttctgctcctcatttgcctcataattttctctggactcatctttaattcctctggagttattacctgcttctgtggttggaatgtgtcccttcccaagtccaagtgctgccaatgtgatagtacaaagaggtagggcctttaaaaggtgattaggccatgagagctcctcgccttgtgaatgagaccattcctttgtgtacttaaatgatttattgctcagaggaacttaacttttacatggaagcctgaagggtga

SEQ ID NO: 134007 - DNA, 601 bp, Human
tttaattatcactgactgtatgaaccagtagctagtgtgaacaagaaatagcatgctggcaggaatgagaacacattatcacgtgacagaagtgtaatacccaactgcaaaggtgctataggatcaaaatgcatagaggaaattaggtaatagtacaaaataaaaataaccaacatctggtaacatgtagacattttccatctaaattgttgcttttaatgacaaagtcatgctcctcctggaggatgtgatgggagctgtgcagtgagattaaataggtactggaagaaaccatagtttsgtgttttgcagttgttcatagatcaaatagttctttgctttgtgtgaaaaatccctcagcagcgagagatgaggaggatgaattagatcagcatgaattttccttttcctctagaaatgcttcagacacctaagggccttaagccagggtccataagtggaaagctgtaagggaaaaaagaaacttcacagtccaacaggtgagaagactgtaatttctgatcaaataaatacctaggtgtttcattgtcttgtctttttgaattcatgtagtacttcctttctcaaataaccccagaag

SEQ ID NO: 134008 - DNA, 601 bp, Human
gaaaaatccctcagcagcgagagatgaggaggatgaattagatcagcatgaattttccttttcctctagaaatgcttcagacacctaagggccttaagccagggtccataagtggaaagctgtaagggaaaaaagaaacttcacagtccaacaggtgagaagactgtaatttctgatcaaataaatacctaggtgtttcattgtcttgtctttttgaattcatgtagtacttcctttctcaaataaccccagaaggatggcaaggggtgtacgtgctgtgttttgtccctccctcttcctrtgcccaactggtaaggaaattggatgttttactacgatctctggctccccacccctgccccctgctcatatagcttgggaagtgatgatatgcgctgagtccattctaataaaacacacaacatgacttactgcttcatgatatgttttataagatggattgatttatgcacctatataagttgagtctgaatagtcagttttcgaagtgaattaagaataaatttttgttacattgcatcttatcaataagcattttaaaaccccaagcatatttatttaaacatataatttaaaaata

SEQ ID NO: 134009 - DNA, 601 bp, Human
tgcaaagaagaaataactgccagtggtagctgttgaaattatattcagatctattgaggagcatgttttgaacatcttttatgcttatttaaaaagaggcggagcttgtagtgagccgagttagtgccactgcactgcaagcctgggcgacagagtgagactacatctcaaaaaaaaaaaaaaaaacaaaaaaggcttttctatgggattctcatttgtttaaattatacatgtgattacttgacacgttaaagtgtacacaatttaggaaaatgggattaaaaatccagaaacacttaaraagttcttatagtgaagattaaaaaagtgatttcatttaatgactttcagaaaaaaaaatcactgggtggaacataaatgtttgaagtattcttgaacaaaagtgctctctgatactatagacataaaaattcttaaattacccgtgaaatatgctgttcctagggaatggttgtgaagtactttttagtcactcacctgatagagaaaagtagtctgaaaagctcatacacactgaattacttcttcagtttaactttttttgtgcctgctagttagttgccaggcactttacattgag

SEQ ID NO: 134010 - DNA, 601 bp, Human
gttagtgccactgcactgcaagcctgggcgacagagtgagactacatctcaaaaaaaaaaaaaaaaacaaaaaaggcttttctatgggattctcatttgtttaaattatacatgtgattacttgacacgttaaagtgtacacaatttaggaaaatgggattaaaaatccagaaacacttaagaagttcttatagtgaagattaaaaaagtgatttcatttaatgactttcagaaaaaaaaatcactgggtggaacataaatgtttgaagtattcttgaacaaaagtgctctctgatactayagacataaaaattcttaaattacccgtgaaatatgctgttcctagggaatggttgtgaagtactttttagtcactcacctgatagagaaaagtagtctgaaaagctcatacacactgaattacttcttcagtttaactttttttgtgcctgctagttagttgccaggcactttacattgagtagtgaataacagacacctgcttttcaagggctgcttctgtagtatgagaaagagatacatgaacagacaatttttaatatactgtagtgaatgctgtcatagatgtacatgcacatga

SEQ ID NO: 134011 - DNA, 601 bp, Human
cacgttaaagtgtacacaatttaggaaaatgggattaaaaatccagaaacacttaagaagttcttatagtgaagattaaaaaagtgatttcatttaatgactttcagaaaaaaaaatcactgggtggaacataaatgtttgaagtattcttgaacaaaagtgctctctgatactatagacataaaaattcttaaattacccgtgaaatatgctgttcctagggaatggttgtgaagtactttttagtcactcacctgatagagaaaagtagtctgaaaagctcatacacactgaattactwcttcagtttaactttttttgtgcctgctagttagttgccaggcactttacattgagtagtgaataacagacacctgcttttcaagggctgcttctgtagtatgagaaagagatacatgaacagacaatttttaatatactgtagtgaatgctgtcatagatgtacatgcacatgacctgttgtaaaatctggagcatgataggagagagagagatttgtgggcaggttgtcttctaggtcacccttccctcaacaccatgtagatgtgacctctctggtcttggcagtagtgtggttgta

SEQ ID NO: 134012 - DNA, 601 bp, Human
acttatgaggtgagcaggtgctcccctttagctcacactatttgctgaatagtttggaaatgcctctttctggcattcaaataatatactcttctttagttgcagaaagtcagtttaatgaacagtgattaagatgctgccttttggacagtcattaataaatgttaattaaaaaccccagtctagagcatctgccgttgtcccctcagatgggtacctactatttcagatctgttttgtttagagaactacagcaagcttagtagccatttctgatacctgttttagtagcaaattatastgcttcctgttcgtttgatttcttccagggacatattttattttcctgcctccttagaatgtctggcaaaaagctttatttcatctgaattctgctgggtcatcacattggacttgtggaagaaaatggatttataatagcaattaataaaaaatagtaacaaataatattgcttaatagtaaatgtgtactgtatgtgccagccacagtgctaagcattttaatacaaaagcataaaataacattgtgagatttcctctagcaattttaaacttaaactagatgtttattcgagggcag

SEQ ID NO: 134013 - DNA, 601 bp, Human
atacaaaagcataaaataacattgtgagatttcctctagcaattttaaacttaaactagatgtttattcgagggcagctttaagctgcatttgcatagcaggctttttgctgtgtatttattgggaggagagctgttggaaattacagagctgttggaaataaaccctagctaattctcagggtttcttccagtattgaacttgtctgaaaagctgttggaaattagtgtgcactgactcccccaagatgcccctggaaatcaccactgcttgctctaccaaggtaccagaaaatctgccytggaaaatgagtcctttggattaaatctttccatcttcaggacctgcttgaagtgcaggtgtccctggagagggagctaattaaatcatttaacacttaaatagggattcagttatgaaattatcttctgagaaagaaaggagctgaaggctcaagtaacttttaatgggagaagaaaatggtgatggaagatttcttgctagtggtacttcctagggaattaactggagatagaactgggaagccagggagagaatatagagtgcagaaaaagaacgggaaagggcagatgggagtgag

SEQ ID NO: 134014 - DNA, 601 bp, Human
taagaatttaataagatgtatgctaaatgcctggcatgcattaagttggtttgccattcacgtgtgctttctttggccagggctgtgttaaatttgaaatagtttctaacacttaagcatcagatgattccactgtaataatctggatttcagaaatcagaagatctggcagccttgtgtctgtccctctggctgcctgactcctcaagctgtgtgtctgtggacctctttgggtaggatgtgttctccagttttccacagaactgctgctgcctacagcgttctaccctgactgttcatkcccatatgttctgtagctgagccggtagacatttattgttctgccagtaaatgaatgttttggttgaaaagtatgttgcactaggtgtgatatttggtacacaatagatggtcattaaatatttccctttttctctattaggctgctgatgatgtagtgaagagaaagtttaaatccaaatgatttcagccctgaactagaaagttctgtctcagtgggctgtatgatctcagaaaatcacttaatttctccattgctcagtgtttttctagggacactagagaatttggactagctgat

SEQ ID NO: 134015 - DNA, 601 bp, Human
tcagaaatcagaagatctggcagccttgtgtctgtccctctggctgcctgactcctcaagctgtgtgtctgtggacctctttgggtaggatgtgttctccagttttccacagaactgctgctgcctacagcgttctaccctgactgttcatgcccatatgttctgtagctgagccggtagacatttattgttctgccagtaaatgaatgttttggttgaaaagtatgttgcactaggtgtgatatttggtacacaatagatggtcattaaatatttccctttttctctattaggctgctgmtgatgtagtgaagagaaagtttaaatccaaatgatttcagccctgaactagaaagttctgtctcagtgggctgtatgatctcagaaaatcacttaatttctccattgctcagtgtttttctagggacactagagaatttggactagctgattctcagggtttcttccagtactgaacttgcctgaaaagtgatacataaccacacgcaaacttccatggggtgtttgaataaaaacttatatcctaaaaataaaataatgaagtatggattgtaagaacaattaggttaattacaaagtg

SEQ ID NO: 134016 - DNA, 601 bp, Human
cagtaaatgaatgttttggttgaaaagtatgttgcactaggtgtgatatttggtacacaatagatggtcattaaatatttccctttttctctattaggctgctgatgatgtagtgaagagaaagtttaaatccaaatgatttcagccctgaactagaaagttctgtctcagtgggctgtatgatctcagaaaatcacttaatttctccattgctcagtgtttttctagggacactagagaatttggactagctgattctcagggtttcttccagtactgaacttgcctgaaaagtgatacrtaaccacacgcaaacttccatggggtgtttgaataaaaacttatatcctaaaaataaaataatgaagtatggattgtaagaacaattaggttaattacaaagtggcttaaaattaatgttcaggctgggcacagtggctcacgcctgtaatcccagcactttgggaggcttaggtgggcggatcacttgaggccaggagttcgagaccagcctgaccaacgtggtgaaaccctgtctctactaaaaatacaaaaattagctgggcacgatggcaggcacctgtaattccagttactcggg

SEQ ID NO: 134017 - DNA, 601 bp, Human
gaagtatggattgtaagaacaattaggttaattacaaagtggcttaaaattaatgttcaggctgggcacagtggctcacgcctgtaatcccagcactttgggaggcttaggtgggcggatcacttgaggccaggagttcgagaccagcctgaccaacgtggtgaaaccctgtctctactaaaaatacaaaaattagctgggcacgatggcaggcacctgtaattccagttactcgggaggctgaggcaggagaatcgcttgaacctgggaggcagaggttgcagtgagccgagattgtacyactgcactccagtctgggcaacagagtaagactccgtctcaaaaaacaaaaacaaaaacaaaaacaaaattaatgttcagcgttgttggttagtaccaatctagaaaactgaagaatttaatcttttagccctgtgctgttgatttggataaagctatggggggcagggatatcaatataggagctattgtgaagctgggtgtgacagtcatatgatggatgacaggcccaggatggagagacatcttgatagcatggagcagtggacacaaaattgaacaaagatgtgtacacagtggt

SEQ ID NO: 134018 - DNA, 601 bp, Human
gccgagattgtaccactgcactccagtctgggcaacagagtaagactccgtctcaaaaaacaaaaacaaaaacaaaaacaaaattaatgttcagcgttgttggttagtaccaatctagaaaactgaagaatttaatcttttagccctgtgctgttgatttggataaagctatggggggcagggatatcaatataggagctattgtgaagctgggtgtgacagtcatatgatggatgacaggcccaggatggagagacatcttgatagcatggagcagtggacacaaaattgaacaaagatrtgtacacagtggtgtaatttggtttgaataaaaccaaccgaaaaagtaaagatgaagaaggaaataacaggtaaaacagagctagggttttagatgaaatgttcaatctcaagtgatatatatacatggccatcaatgtgtcatataaagagaatattaggatttccatttatgtttatttaaataagcaacttttcaatttgtgtgtgtgttgaattacataacaggatggtactacataaataaaacaaaacatgcccttggggtattgatgtaatcttttttttaactaataggaga

SEQ ID NO: 134019 - DNA, 601 bp, Human
cttattgttctttttttcttttttgttatggagagagacacttctctagtctccatttcttggttactgtcaccaacagtggcagttttagataaaataatgtcgagggagaagaatactgaaacgtaaaaatgtggtggtggtagttttatttttaaaaaatatatatcctgtggaaatagttttcagttttagcttcactgtatccaccctcctagcattaattcagtacgcctaagtgaagttgctagctgctaaagaaatagttggagtgctattcagctgtgaggctaaaaatctygaactaaaacatggaaattgtttttctaatttcatttgggtaaaaatgaattcccgtgaatacatgttagcaaagcaagcttccttttattatttctcataccacagatacaatatccagaaatgtgttgatgtgaaataaaatcaaatcaaggtgattatcatgtggacattggatcaggattctggaatgttcagtttgtgggttgctttgcatttctcacttggagatgcactcacaactttatacctctttgccttagttttttgcactttaaaaatgagaagtataatgatcttg

SEQ ID NO: 134020 - DNA, 601 bp, Human
tgttgatgtgaaataaaatcaaatcaaggtgattatcatgtggacattggatcaggattctggaatgttcagtttgtgggttgctttgcatttctcacttggagatgcactcacaactttatacctctttgccttagttttttgcactttaaaaatgagaagtataatgatcttgagctcacatggttgtcagacagtgaagaattttgaaaaaggcaagtttttcatttaagtgcattacatattaagaaattcatatcaaacttttgaaaaacaagtttgacaaaaaagcaagtgataktggctctacaaaatgtacttctgaactttctatatgatgtatttctataatatatagaagtatatagaaatattctataatatagaaatatataatcatatagaaaattcaaaagtacattttggagggagtctggggatatttttcagccactttcatgtataatctttctttcctagcccttcttttttccccttttaattcactcaactgtcctagaggacagtgacattttagaggaaatttattcaaaccacaagggaatatttacgaagagtttctttgcttgaaaaaaaaatt

SEQ ID NO: 134021 - DNA, 601 bp, Human
aattttaaaatgatgtcaaacttacataaaagttccacaggtagtgtgagatacttccatgtgtactctttaccttgattcaccagtgttcatcttttgcttcattgactttatcattagttctgtctccctcgtacacaaactattttttctctgaaccgtttaagagttcctgtagactaacccttaactgtttcaacgcatacctcctaagaataaggacattttcttatataaccatagtacagtgataagaaacaaaactttttatatccagtccacaatctgaacttaaattttrtcagttgtcccaataataacttttgtagcatttctctcctccactgggtccaggatccatccacttgtattgtgtttaattattatgtcttaagtttcttttaatcttgaatcattcttcatccttttttctttcgtgaccttgatgtttttgatgagtacaggcaaattattttgtagaatgtgtcttaacagatttgtctgctgtttcttcataatagtattcaggtgtttatttgcttatttattcattaacgtttattatgtcctcttggattctcatacagtgttataaactatt

SEQ ID NO: 134022 - DNA, 601 bp, Human
tgtcaaacttacataaaagttccacaggtagtgtgagatacttccatgtgtactctttaccttgattcaccagtgttcatcttttgcttcattgactttatcattagttctgtctccctcgtacacaaactattttttctctgaaccgtttaagagttcctgtagactaacccttaactgtttcaacgcatacctcctaagaataaggacattttcttatataaccatagtacagtgataagaaacaaaactttttatatccagtccacaatctgaacttaaattttgtcagttgtcccartaataacttttgtagcatttctctcctccactgggtccaggatccatccacttgtattgtgtttaattattatgtcttaagtttcttttaatcttgaatcattcttcatccttttttctttcgtgaccttgatgtttttgatgagtacaggcaaattattttgtagaatgtgtcttaacagatttgtctgctgtttcttcataatagtattcaggtgtttatttgcttatttattcattaacgtttattatgtcctcttggattctcatacagtgttataaactattactgtcaacattt

SEQ ID NO: 134023 - DNA, 601 bp, Human
attagttctgtctccctcgtacacaaactattttttctctgaaccgtttaagagttcctgtagactaacccttaactgtttcaacgcatacctcctaagaataaggacattttcttatataaccatagtacagtgataagaaacaaaactttttatatccagtccacaatctgaacttaaattttgtcagttgtcccaataataacttttgtagcatttctctcctccactgggtccaggatccatccacttgtattgtgtttaattattatgtcttaagtttcttttaatcttgaatcaytcttcatccttttttctttcgtgaccttgatgtttttgatgagtacaggcaaattattttgtagaatgtgtcttaacagatttgtctgctgtttcttcataatagtattcaggtgtttatttgcttatttattcattaacgtttattatgtcctcttggattctcatacagtgttataaactattactgtcaacatttattctgatgctcaaattgttacaaatctggccagtaagagccccgtcagcttaaagaatgatgtcatcatcgttctttacatcatacatcatcttgtacttt

SEQ ID NO: 134024 - DNA, 601 bp, Human
acagtaaagttcatatgtttctgttgtattccttttaccattccttcaccaatgcttgttgattttatttatttggatatatgaaacagtatggtttcaaaaatgaaagatgtccccagaaacattatgactctaattctttcagtttctctgctctgtttatgcagctcccaccctagttcctgttacctataggtaactggtatcattagtttttggtttatccttcttgtatttcttttgcaaaaacaagcagattcatgtgttttcttttcccactctttcatacacaaaggtaacttgtgtgtgtgtgtgtgtgtgtgtgtgtgtgtgtgtatatacattaagtttgcttttttcatcagttcataggaagcattctcattcatcctaacagcttattcagccagttttctaaatattggcatttcacttgtttccagtagtttgcgattcggaaacactgtagtggataacctagtgtatatatatgtttataatattggaggtgaatattttgggtaacttcctggaagtaatattgctagatcaaaaggtaaatgtaagtacttttgttagatttgtcaaattcccatccata

SEQ ID NO: 134025 - DNA, 601 bp, Human
tcaaattcccatccataaaggctgtaccagttttcatttgcacaagccaagttgtgagaggacctatttctccacagttttgtcaacagaatgtgttgtcaaatgttttaatttttgctgatctgaaacatgagaaatggtattgcagcgtagttgtcatttgcttttattatgtgttaagttgaagagttttcatgtgataaatacaatttttagatcttcatttgtgaattgtctgtgtcttttggctgttttttacatggtgtttatcttgtcttttaaacatatttggtatatattwttagtgttattggctttttaactgtgatacatgttgcagcaaatacttttttctagcttgtcgtgtattcttttttgattgggatataattcacataccataacattaatcctttaaaagtgtacaattcagtgatatttagcatattcacaagattgtacagcatcaccactagaaaatgttctaattctagagcattttcatcttcctaaaaagaaaccccatgcccactggcacccactctcctcaacccacaaatcccctgacagtcaccatactttcagtctctagggatttgac

SEQ ID NO: 134026 - DNA, 601 bp, Human
tataaaacattttctcatcagttggacatttataatgtttccactttttggctattaagaatgatgctgtcatgaacccttgtgtgcacgtttttgtgggacaaaattttcttttttttgcatataccttgaggtggaactatcgagtcatatgataaatttatgtttaaccttttgaggtactgccagactgttttccaaagcagttgtaccattttacaattttggcagtgcttgagagtttccatttctccacatctctaccaatacttgctgttgtctgtccttttgactataaccrtcttattgggtgtgaaatggtatcttattgtgatttgatttgtgtttctcttaagactaaggatgttgagcatctcttcatgtgcatattggtcatttgtatgttttatttagagaaacgtcttctttaaatcctttgcccattttaaatattgagttgtttttattaagtttatatgttctggacactagactcttgtcagatatatgagctgcaaatattttctcccattctatgggttgtcttttcatgttcttgatgatgttctttgaaacacaaagttttgatgaggtccagctt

SEQ ID NO: 134027 - DNA, 601 bp, Human
ctggtctcaaactcctgggctcaagcagtacccctgccttggcatccgagagggctgggattacacaggtgagtcaccatgcctggccagaatcatttattaaaaatccatttcactcagtgatttcaggtgccacctgtagcatatactaaatttgcatatgtatatgagtctatttttggacttcaaagtccgtttctctgtttatgtaataccatgatttttttaattaaaaattttattttgtgttagttttagattcatatgcagttgtaagaaataatacagagattttctgtaktctgtatccagttttccccagtggtaacatcttgaaaaacggtagtatggtatcaaaaccaggatattgacattgataacagtctacaggttttttgcagtttacttgaactcatttatgtatatatgtgtgtatttacttcggtgccattctgtcacatatataggttcaagtgttcaccaccgcagtcaaaacatagagcagtttcatcactgcaaggatcacttatgttgctcttttataaccgtacccacttcctctttcatcttccctagcctctggcaaccacagaaatgttct

SEQ ID NO: 134028 - DNA, 601 bp, Human
gcatccgagagggctgggattacacaggtgagtcaccatgcctggccagaatcatttattaaaaatccatttcactcagtgatttcaggtgccacctgtagcatatactaaatttgcatatgtatatgagtctatttttggacttcaaagtccgtttctctgtttatgtaataccatgatttttttaattaaaaattttattttgtgttagttttagattcatatgcagttgtaagaaataatacagagattttctgtagtctgtatccagttttccccagtggtaacatcttgaaaaackgtagtatggtatcaaaaccaggatattgacattgataacagtctacaggttttttgcagtttacttgaactcatttatgtatatatgtgtgtatttacttcggtgccattctgtcacatatataggttcaagtgttcaccaccgcagtcaaaacatagagcagtttcatcactgcaaggatcacttatgttgctcttttataaccgtacccacttcctctttcatcttccctagcctctggcaaccacagaaatgttctccatttctgtaattttgtcattttagtggcattagaaaagc

SEQ ID NO: 134029 - DNA, 601 bp, Human
tataattgtttagtttttgaaggacaccggggttggttctgggtttatactcataaataaagctgctatgatcacaggtttttgtgtgaacataagtcttccacattcctctgagataaatgcttatgagggtgattgtattgaagtggccttgttttctggggtgacgctcagaattcttggtctcatagccaaggaaatcaaggacatggatacaccaagggtgaagtttagagcagaaatttaataggagaaagaaaaagaacagctctctgctgcagaaaggggtcccagaaaaagrgttgccatcctgtagtgaaatacaggaatttttacagacaagctagtggggaggcagtatctgaacatagggtgtgaaaaaccagttaggatcaggtgtgtcatctgcatagggtgcaaatctctggaagcccctaccccaatcttttatcatacaggcaggtcctcagcctgagctactccatgttgcttatttctttcttactgtgcatgtgctcaaaaaggggaggtagaatccccatggtggacatgcctggccccagctagccctttctgtccatgcaactgctggcatccccca

SEQ ID NO: 134030 - DNA, 601 bp, Human
ttagtactgaaaggagatagaaaagttcagcttttaagtcattcatttatttaatctttaatttattcatcagattttattgcttccaactacatttgctaggcagtgaaatggtttctgttttacacaatgaggaattttttttttaagaagagttaaatatattttctaaaattctatatttaagaatcagaaagttactggagattaggaagggtagtgtgtggcagggtgaggggaaggttatgaggcgataacacgacaaggtgactgtagtcaataataacttaattgtacattkaaaaataactaaaacagtataattagattgattgtatcacagaggataaatgcttgagtggatggatattctattttccatggtacgattatcactcattgcatgcttgtatcaaaacatctcatgtaccccatacatatacccatctattatgtacctacaaaactaaaaaaaattataaaagcaaaaaacaaaaacgaaaaaagcccttgactttcagaagcctctgactaacctttgcagtattgtgcctctgttctacacataattaactgtgttgaaactgagaattaaagctga

SEQ ID NO: 134031 - DNA, 601 bp, Human
aattctatttaagtcagagtagaatcaactagcagttacccactgactaatatcagagcccagtgtgttacatgaaactaaattggaaaccgacctctggaactcaatgttttgttttgacctaaatctactctgcagtgtgaggtaaatacaattgtttaaagattcttaagctgtcgatgttgaatttgcttattttgtatttaattaaaaaggtgcatacagatatgtatgtagtgtggtttggcaatagttaaaattgggagcaggaaaggaaaattttagaaatcttggtttccargcaaccaaacacacaatatcatatctgtgtaccacttgcttcatgttaagatgccctaaatgtaaataattgatggagcagagactaaaagaaccattatagtcagctgaattccaaggtccttgacctgagctcattaagctcaggttagagaatagggtggctgaattttcttagaaaaagagcccagataatatctggcatgtacatagatcttgaaaattagctggacttaagtaggcatttagttttcaagctttagtttagtgaatgtggggatcctgatctgtaatccttcag

SEQ ID NO: 134032 - DNA, 601 bp, Human
gctgttctttcttactcacccttgagtctttattaattcttttgctttcaagactttgctctggcttttctagggtgcctcccttgatttcttttgctcacccatctgctgccatcccagattatgtcaattgactctaccctaaggtctccatagggcatcctgtgtctatctctatgatagatccttgcccactttattgaattcatctttaagctccttgaatggagggtctgtgttttatttctctttgtttccctctttccttgtgtggctcttgaaatcattatgaattgatctragcacttccttatggaggcatgcagaattaacagcataattgtggcaagaaatgtctttgccttttctttttaatgcaaatgagagttagtaacatgttctttgtatttatcttgggtatccattgctgactaccagatcaccagatcaccccaaaactaagcagcttaaaacaataaacattttgtgtgtatgtgtgtgattttatttatttatttatttttttaagacggagtctctctctgttgcccaggctggagtgcagtggtgtgatctcagctcactgaaacctccgcctcac

SEQ ID NO: 134033 - DNA, 601 bp, Human
tcttactcacccttgagtctttattaattcttttgctttcaagactttgctctggcttttctagggtgcctcccttgatttcttttgctcacccatctgctgccatcccagattatgtcaattgactctaccctaaggtctccatagggcatcctgtgtctatctctatgatagatccttgcccactttattgaattcatctttaagctccttgaatggagggtctgtgttttatttctctttgtttccctctttccttgtgtggctcttgaaatcattatgaattgatctgagcacttcsttatggaggcatgcagaattaacagcataattgtggcaagaaatgtctttgccttttctttttaatgcaaatgagagttagtaacatgttctttgtatttatcttgggtatccattgctgactaccagatcaccagatcaccccaaaactaagcagcttaaaacaataaacattttgtgtgtatgtgtgtgattttatttatttatttatttttttaagacggagtctctctctgttgcccaggctggagtgcagtggtgtgatctcagctcactgaaacctccgcctcacgagttcaag

SEQ ID NO: 134034 - DNA, 601 bp, Human
ccttgagtctttattaattcttttgctttcaagactttgctctggcttttctagggtgcctcccttgatttcttttgctcacccatctgctgccatcccagattatgtcaattgactctaccctaaggtctccatagggcatcctgtgtctatctctatgatagatccttgcccactttattgaattcatctttaagctccttgaatggagggtctgtgttttatttctctttgtttccctctttccttgtgtggctcttgaaatcattatgaattgatctgagcacttccttatggaggyatgcagaattaacagcataattgtggcaagaaatgtctttgccttttctttttaatgcaaatgagagttagtaacatgttctttgtatttatcttgggtatccattgctgactaccagatcaccagatcaccccaaaactaagcagcttaaaacaataaacattttgtgtgtatgtgtgtgattttatttatttatttatttttttaagacggagtctctctctgttgcccaggctggagtgcagtggtgtgatctcagctcactgaaacctccgcctcacgagttcaagcgattctttt

SEQ ID NO: 134035 - DNA, 601 bp, Human
tatttgttcatgattttgttggaaaatcatgggctcatgattgagttgggctcagctggatgtttcttctttttgtctttttaggggtcactcatgggtcctcattcatctggtcgcccagctgaaggtagaaggtctagaatgaccttactcacatctctggcaatttgttgctggctgtcagctctgcctccctctctcatccttaaggggactggccagggtttctttccatggcagtctcagagcagcaagagactaagggtgaaagttgcaaggtctttagaggcccaggcccggraagtgtacagtggcagttcattaacattgtcttggccagtgcaagtgaccagaccagcccagattcaagggatggggagtagacttcatctagataggaggagccaccaggttacattgccaaggggtgtgcatacagggatgggaggaatgtgattgtttgttgctgtcagcacagtataccttactagaactgaattgacgtctctactttttgagcattttttgtacattgttgtggtatttctttgtggtagtcatctcacatgctttaaacttcgtatgtcttatttccttcctt

SEQ ID NO: 134036 - DNA, 601 bp, Human
gggctcagctggatgtttcttctttttgtctttttaggggtcactcatgggtcctcattcatctggtcgcccagctgaaggtagaaggtctagaatgaccttactcacatctctggcaatttgttgctggctgtcagctctgcctccctctctcatccttaaggggactggccagggtttctttccatggcagtctcagagcagcaagagactaagggtgaaagttgcaaggtctttagaggcccaggcccgggaagtgtacagtggcagttcattaacattgtcttggccagtgcaagtsaccagaccagcccagattcaagggatggggagtagacttcatctagataggaggagccaccaggttacattgccaaggggtgtgcatacagggatgggaggaatgtgattgtttgttgctgtcagcacagtataccttactagaactgaattgacgtctctactttttgagcattttttgtacattgttgtggtatttctttgtggtagtcatctcacatgctttaaacttcgtatgtcttatttccttccttagtaggtcacattgggagctcatcttccccttcacttaggagacagt

SEQ ID NO: 134037 - DNA, 601 bp, Human
aagagactaagggtgaaagttgcaaggtctttagaggcccaggcccgggaagtgtacagtggcagttcattaacattgtcttggccagtgcaagtgaccagaccagcccagattcaagggatggggagtagacttcatctagataggaggagccaccaggttacattgccaaggggtgtgcatacagggatgggaggaatgtgattgtttgttgctgtcagcacagtataccttactagaactgaattgacgtctctactttttgagcattttttgtacattgttgtggtatttctttgtrgtagtcatctcacatgctttaaacttcgtatgtcttatttccttccttagtaggtcacattgggagctcatcttccccttcacttaggagacagtgcaataaacatttgtatctctcatagcacataccagatttttaaaatttggcgggttttaattcaggacttaaggggtgaattatcttattaaataaataactcaagtatacagggaagtgaaagacagtcatttacctaatgctctgaacatctttcttgagataaagtagtgctgtgaactgataaagttcacataaagctaa

SEQ ID NO: 134038 - DNA, 601 bp, Human
aatgtgattgtttgttgctgtcagcacagtataccttactagaactgaattgacgtctctactttttgagcattttttgtacattgttgtggtatttctttgtggtagtcatctcacatgctttaaacttcgtatgtcttatttccttccttagtaggtcacattgggagctcatcttccccttcacttaggagacagtgcaataaacatttgtatctctcatagcacataccagatttttaaaatttggcgggttttaattcaggacttaaggggtgaattatcttattaaataaataaytcaagtatacagggaagtgaaagacagtcatttacctaatgctctgaacatctttcttgagataaagtagtgctgtgaactgataaagttcacataaagctaaagaaattcctttatgtattaatattacaggcatttatgtaatatcagtatctgtctgaaaagaatgcattgattacaaaactctttaagttgtacagaagttatttttccctagaacttcaaaagtctttgctctgcaagggaggggagagtaaaaaaggtgccttaaggatgtagacatgctgtatccagcactgt

SEQ ID NO: 134039 - DNA, 601 bp, Human
gtttttaccctgcattgtatctgaaaaacataaatccctgctgttaatcttaatatctaatcttagtctttagtgtctcttccttttcttttttccttcccttctcctcaacttttctacaaaaatatttatgcatctaaaatgggaagaattatttttgctcagactgtaaaaagtatatcacaggctgggcacggtggctcacgcatgtaatcccagcactttgggaggccaaggtgggtagatcatatgaggttaggagttcaagaccagcctagccaacagggtgaaaccctgtctstactgaaaatactaaaattagctgggcatggtagtgggcacctgtaatcccagctactctggaggctgaggcaggagaatcacttgaacccaggagttggaggttgcaatgagctgagattgcaccactgcactccagcctgggtgacagagcaagactctgtctcaaacaaagaaacaaacaaaaagtatatcacaaatattgttacatattcttctttaatacataattatgcatccctgaaagtggcattttgctacatagcctcaatatagttttcacaactcagttttgccctct

SEQ ID NO: 134040 - DNA, 601 bp, Human
tacaaaaatatttatgcatctaaaatgggaagaattatttttgctcagactgtaaaaagtatatcacaggctgggcacggtggctcacgcatgtaatcccagcactttgggaggccaaggtgggtagatcatatgaggttaggagttcaagaccagcctagccaacagggtgaaaccctgtctctactgaaaatactaaaattagctgggcatggtagtgggcacctgtaatcccagctactctggaggctgaggcaggagaatcacttgaacccaggagttggaggttgcaatgagctgmgattgcaccactgcactccagcctgggtgacagagcaagactctgtctcaaacaaagaaacaaacaaaaagtatatcacaaatattgttacatattcttctttaatacataattatgcatccctgaaagtggcattttgctacatagcctcaatatagttttcacaactcagttttgccctcttaaaacaagattgctggcaccatcttcactgatgaaagacttgtgtctaagaaggtctgagtcataacagatgcttctccatcttgctttctcatctttctctagtttctttttgtc

SEQ ID NO: 134041 - DNA, 601 bp, Human
atgttagggtgtgaattttagatctttcctgctttctcttgtgggcatttagtgctataaatttccctgtacacactgctttaaatgtgtcccagagattctggtatgttgtgtctttgttctcgttggtttgaaagaacatctttatttctgccttcatttcgttatgtacccagtagtcattcaggagcaggttgttcagtttccgtgtagttgagcagttttgagtgagtttcttaatcctgagttctagtttgattttactgtggtctgagagacagtttgttgtaatttctgttcytttacatttgctgaggagagctttacttccaactatgtggtcaattttggaataagtacagaactcacaccaaatcttttaactacccatgcttctagaagctttcaaggaatcaaaaaggggctatattaaaatgggaaaaaataggaagaagcttagaaataattttaggaaaggtattacgtttaagcatagaactaagtaggaagaggtaagtggcaaaacaacaataacaacaacaaaagagtctaatcagtatgtggtggaagactactacagtgagtagtactttacagtgtt

SEQ ID NO: 134042 - DNA, 601 bp, Human
ggatctcattaaactaaagagctcttgcacagcaaaagaaactacagtcagagtgaataggcaaccaaagaataggagaaaatttttgtaatctacccatctgccaaaggtataatatccagaatttacaagaaatttaaacaaatttacaagaaaaaaccccatcaaaaagtaggcaaaggatatgaacagacacttctcaaaagaagacatgtggccaacaaacatatgaaaaaaagctcaacatcactgaaaaaaagctgaacatcagtgatcattagagaaatgcaaatcaaaactrcaatgagataccatctcacgccagtcagaatggcgattattaaaaagtcaagaaacaatagatgtgagcctgtggagaaatgggaacactttcacactgttggtgggaatgtaaattagttcaaccattttggaagacagtgtggcgattcctcaaggatctacaaccagaactaccgtttgacccagcaatcccattactagatatatacccaaaggattataaatcattctaccctaaagacacatgcatgcatatgttttttgcgtattattttcaatagcaaagtcatggaaccaa

SEQ ID NO: 134043 - DNA, 601 bp, Human
tttgacccagcaatcccattactagatatatacccaaaggattataaatcattctaccctaaagacacatgcatgcatatgttttttgcgtattattttcaatagcaaagtcatggaaccaacccaaatgcccatcagtggtagactggataaagcaaatgtggtacatgtacaccatggaatactatgcagctatgtgaaggaatgagatcagatcctttgcaggggcatggatgaagccagaagccatcatcctcagcaaactcacacaggaacagaaaatcaaacactacgtgttctygtaagtgcgagttgaacatagagaacacctggacacagggaggggaaccaacatgcaccagggcctgttgtggagggaggcaaggggagggaacttagaggatgggtcaataggtgcagcagaccaccatggtacacatatacctatgtaacaaacctgcatattctgcgtatgtatcctggaagttaaagcaaaattaaaaaaaaaaaaaaggaaaacatgggcttaaataggacacaagatctattcctcctttgaaaaacccattaagtttggataaattctaagaggtagcatttt

SEQ ID NO: 134044 - DNA, 601 bp, Human
aaggaatgagatcagatcctttgcaggggcatggatgaagccagaagccatcatcctcagcaaactcacacaggaacagaaaatcaaacactacgtgttctcgtaagtgcgagttgaacatagagaacacctggacacagggaggggaaccaacatgcaccagggcctgttgtggagggaggcaaggggagggaacttagaggatgggtcaataggtgcagcagaccaccatggtacacatatacctatgtaacaaacctgcatattctgcgtatgtatcctggaagttaaagcaaaattaaaaaaaaaaaaaaggaaaacatgggcttaaataggacacaagatctattcctcctttgaaaaacccattaagtttggataaattctaagaggtagcattttaactagcatcctaagcacttcctcacatgctcatagtttgcaagttaacatgatgtatgtgtatttgtgtatttcaaactccggaagcttttgtattattgaaaccaaaactgacaagaaaccttctgtgaacatgcttctgctggggtgtagaaagctcacagagtgttgccttcatgcttacaatagtaaaaaatcc

SEQ ID NO: 134045 - DNA, 601 bp, Human
tgtaattagaatcccagaatgagaagtgagtcaatagtgtggtataaaatagtgcaatacaaaaaatatttgaagagatgatagtacagttttcccaaactaatgacacataccacataagaaatccaataagctcactaagcagaatgaataccctgcaacacacatacagtcagacatattgtattcacactgagaaaaaacaaaatttcaaagtcaaccagagaaaaagacacattatatacagaagaagaaagatgagtcaaagcagacttctcatcagaattaggtaaggttacastgttaacagaataaactgtcaacccagattcctatgtccttcaaaatatccttcaaaatgaaagaaagcaaatataagtgatcttattactcttcatttcactgccaacatttaaaaatcaatggaaatgaagataaggctctggtctcaaccacattgatctgaactgacaactgcgataaataagcagtgtgtcttgatttatgaatttgtctgtgatgtttgagttttgtttaatcctaatacatggtatagctttggtggtttttaagggtggtgtacttggtacctatatcagcc

SEQ ID NO: 134046 - DNA, 601 bp, Human
tcacaatgtggcagcctttttggccaaattttcaaccactggaattgccttttggggagttattttctgtttacgtagtattttctatagcttgctttgatcaacggtgaaaaaaaatgtagtttgggatggaaaatgggtgaaaggagaatattagatataagagaagtaacgtactgtttaacaggtgaagctctggatacattatttataagcaggagaagacaaacgaaaataagacccagtgtgaaaaaaataacagagatcgtgagcacacctagtgctcagctctggtttccartaccatccttcagtaaaaggaaccagggcacctcggagaaatggctgattctagtatgggggcaggaagcatgcaagatgagcctggagcattttgtagtgcgagagaggaaaggggtgctaaagaataaaaactccagagaacatgctgatgggagtatgtcaaagggatacagaagccagctcaaagagctcctaatggccaaagacagaaaaatttgaacagaaaaataacatagtattggatcataacctgacgtatcaaataaatatctatgagttcatactgatggaagtaaat

SEQ ID NO: 134047 - DNA, 601 bp, Human
gaacagaaaaataacatagtattggatcataacctgacgtatcaaataaatatctatgagttcatactgatggaagtaaatgatgggataaattaataaatgggggagaagacacatacttcctgtgcagaggaattgcaaattatgcactctgttctagcatacctgcccactctttaagtgtgacatgctcatagagacttcctcttgaagcatacagaatggagagggggtgcagtgggagagtcactttacagtggagaaacccacacacactaccccagccaggtgatcaaggtgyacgtcatcaacagtgataaatcatgttgatagtgtgttcccttaatatgatgtgatgaaaatggcacttcacctctgtggtcttcctcccttaaactcccacctctagtctcatcatgagaaagaaacaccagaaaacccccaacagagggtcatcctataatatacctgatcagtactcctcaaaactttcagggtcatcaaaaacaaagaaaagtctgagaaactgtcaaaccaagaggagtctaatgagatacgaaaactaaatatgtggcaccctgaatgagttcctgtaacagaa

SEQ ID NO: 134048 - DNA, 601 bp, Human
ttatttcatttaggtctttgggcaaataccacctcattagaaaagcctcttctgaccttcctgattataatagtatctcctgcagtctataaccacaaaacttgtgttctttgtcttcataatactcagttactgaaattatttatttattttaacttcttatcccactagaattaggcacatgaattcggggactttgttaattctgtttgttcctctgtctgtagcaactagaacaactccaggcaagtggtaggtagcactgagtaaatatcatgtgaatgaaagaattctcaaattstgccccttagtttcctctgaatgcttaaccgcacattctgtgtgactcttggaaagattgttctctgctgtgtgttatctttttgtgcctgtatgagactttgtttcccttctggattgccaaaactgcagcagttgtatacctctgatttatgtctacacccccacaatatctagctaggtgcctggcaaaaagaagtgactgctcagtagcgtttatgggataaacatgtgtttctgctttggacctgtccttttactgcattcagcattcccccgggcgaggcctcaggcactgcat

SEQ ID NO: 134049 - DNA, 601 bp, Human
aaagcctcttctgaccttcctgattataatagtatctcctgcagtctataaccacaaaacttgtgttctttgtcttcataatactcagttactgaaattatttatttattttaacttcttatcccactagaattaggcacatgaattcggggactttgttaattctgtttgttcctctgtctgtagcaactagaacaactccaggcaagtggtaggtagcactgagtaaatatcatgtgaatgaaagaattctcaaattgtgccccttagtttcctctgaatgcttaaccgcacattctgkgtgactcttggaaagattgttctctgctgtgtgttatctttttgtgcctgtatgagactttgtttcccttctggattgccaaaactgcagcagttgtatacctctgatttatgtctacacccccacaatatctagctaggtgcctggcaaaaagaagtgactgctcagtagcgtttatgggataaacatgtgtttctgctttggacctgtccttttactgcattcagcattcccccgggcgaggcctcaggcactgcataaaaagttgaatatgtctgactttgtttttatggactcctc

SEQ ID NO: 134050 - DNA, 601 bp, Human
taaccacaaaacttgtgttctttgtcttcataatactcagttactgaaattatttatttattttaacttcttatcccactagaattaggcacatgaattcggggactttgttaattctgtttgttcctctgtctgtagcaactagaacaactccaggcaagtggtaggtagcactgagtaaatatcatgtgaatgaaagaattctcaaattgtgccccttagtttcctctgaatgcttaaccgcacattctgtgtgactcttggaaagattgttctctgctgtgtgttatctttttgtgcmtgtatgagactttgtttcccttctggattgccaaaactgcagcagttgtatacctctgatttatgtctacacccccacaatatctagctaggtgcctggcaaaaagaagtgactgctcagtagcgtttatgggataaacatgtgtttctgctttggacctgtccttttactgcattcagcattcccccgggcgaggcctcaggcactgcataaaaagttgaatatgtctgactttgtttttatggactcctccaagctttatctccctatccactatctgaacttcgtgctgcagctccc

SEQ ID NO: 134051 - DNA, 601 bp, Human
tcccactagaattaggcacatgaattcggggactttgttaattctgtttgttcctctgtctgtagcaactagaacaactccaggcaagtggtaggtagcactgagtaaatatcatgtgaatgaaagaattctcaaattgtgccccttagtttcctctgaatgcttaaccgcacattctgtgtgactcttggaaagattgttctctgctgtgtgttatctttttgtgcctgtatgagactttgtttcccttctggattgccaaaactgcagcagttgtatacctctgatttatgtctacacycccacaatatctagctaggtgcctggcaaaaagaagtgactgctcagtagcgtttatgggataaacatgtgtttctgctttggacctgtccttttactgcattcagcattcccccgggcgaggcctcaggcactgcataaaaagttgaatatgtctgactttgtttttatggactcctccaagctttatctccctatccactatctgaacttcgtgctgcagctcccttgattttgacctctttggctttggtcttggtttcccccacatcacatgtcctctttagacttgacaacatca

SEQ ID NO: 134052 - DNA, 601 bp, Human
agaattaggcacatgaattcggggactttgttaattctgtttgttcctctgtctgtagcaactagaacaactccaggcaagtggtaggtagcactgagtaaatatcatgtgaatgaaagaattctcaaattgtgccccttagtttcctctgaatgcttaaccgcacattctgtgtgactcttggaaagattgttctctgctgtgtgttatctttttgtgcctgtatgagactttgtttcccttctggattgccaaaactgcagcagttgtatacctctgatttatgtctacacccccacartatctagctaggtgcctggcaaaaagaagtgactgctcagtagcgtttatgggataaacatgtgtttctgctttggacctgtccttttactgcattcagcattcccccgggcgaggcctcaggcactgcataaaaagttgaatatgtctgactttgtttttatggactcctccaagctttatctccctatccactatctgaacttcgtgctgcagctcccttgattttgacctctttggctttggtcttggtttcccccacatcacatgtcctctttagacttgacaacatcactcccat

SEQ ID NO: 134053 - DNA, 601 bp, Human
ttgattttgacctctttggctttggtcttggtttcccccacatcacatgtcctctttagacttgacaacatcactcccatttttaaaaacaaggccctgacctagacatcccataggatctcgcctcattctgctcaaaaattatgttgatgaggcccaccaagctcctgtggccagctaagcccaagacaggtgttaggacctgtgagtggaagcccagtggtagaaatgtgcactgtggcttgcatgtggcaatctacctaatgggagaattactctctctccattctttcctagcccstcacatttattaagaataacatgaaaagtgccgggtactaggggcacctatgtgaataaaatacaaaggctgaagaactcatagtggaaacacatggtctccatatcatgagaatcattatttatcctctagaaggccagggaatttgttcatgaagcttaacccagagtcctcttgtctacttagaagatcttgccagaatgggttacagacatagtgattagctggaagtaaacagacttctgcaacctagccttcaaaaaccttactaccgaagtgtggcaaatattatacttttaa

SEQ ID NO: 134054 - DNA, 601 bp, Human
caaaaattatgttgatgaggcccaccaagctcctgtggccagctaagcccaagacaggtgttaggacctgtgagtggaagcccagtggtagaaatgtgcactgtggcttgcatgtggcaatctacctaatgggagaattactctctctccattctttcctagcccgtcacatttattaagaataacatgaaaagtgccgggtactaggggcacctatgtgaataaaatacaaaggctgaagaactcatagtggaaacacatggtctccatatcatgagaatcattatttatcctctagaargccagggaatttgttcatgaagcttaacccagagtcctcttgtctacttagaagatcttgccagaatgggttacagacatagtgattagctggaagtaaacagacttctgcaacctagccttcaaaaaccttactaccgaagtgtggcaaatattatacttttaaataatttcttccagtggagaaaagggcatgctttgtgaaacagagacttctgaaacctcttattaccaataagaaccttagcatgctagggtaaagttaatgatgaattggtctcggcaggtgccacaggctaga

SEQ ID NO: 134055 - DNA, 601 bp, Human
cttttcctagatgatatttttcaagaaccaaagttgctaagaactccagttctctgctggatgaatcaagcgagcagtgaacgaaatgcctggcaaggcttttgatgggagaggagtctcattttgctttcaggatagacactgaacatcagtacatttgtaatcgtggtaaccacccctgtcttggttagagctttcatggtaataatttaatttctattgataaaagaatttattactgaatgtatagtggagaagaggaagcttattaatgatctgaatttatgtgaagtgtacgctrtattttattttcctactttcttccatgcctaataatatttttcaagatttttagtggcagtgcttctctcgtttttctagttggaaactttcatattattcagaaagaaaaaatcctggtaaggaaattggagaccaattttctgtattagtctgttcttatactgctataaagaagtacctgagactggtaatttatgaagaaaagaggcttaattgactcacagttccacaggctgtccaggaagcttgtcttggggggccttaggaaacttaaaaccatggcagaaggtgaaccgga

SEQ ID NO: 134056 - DNA, 601 bp, Human
aaaaaatcctggtaaggaaattggagaccaattttctgtattagtctgttcttatactgctataaagaagtacctgagactggtaatttatgaagaaaagaggcttaattgactcacagttccacaggctgtccaggaagcttgtcttggggggccttaggaaacttaaaaccatggcagaaggtgaaccggaagcaagcacatcttcacaatggcggagcaggagagagagaaagagagagcaaatcttggaatatactaagagtctggtgttgattgcctattttttaatgctaataastaagtgttctttttctctgggggatttcttaactgttctattgtaaaagcaactactataattgccttttataatacccagatcgctggatttgctatatactagacttgatgtacctgaagctgctaacaggattgcctgtcatttagctttcagaattcaatttataaaatgtcattatttttccccttccactgcaatactagagctgaagacagacagggaaaagcaagcaaatatttgagagtgtgaatggtataagttgagggtatgaatgttggaaatgaacatattcacctc

SEQ ID NO: 134057 - DNA, 601 bp, Human
aagcaagcaaatatttgagagtgtgaatggtataagttgagggtatgaatgttggaaatgaacatattcacctctaaataaagtgagagaaaccgctattctttctaaattttccatgtgccagtaaaatgggaatggtgatttccttaaggtattgctctggagaatttaaataattgagttaaatgtcaaacttcacatttagagagcttactaaaaccttcacaagtgggggcttacagactagagttttatttttatttttattttttctgtagggaatggagtaggggaggcagtrgcacacttaggtgataccttgcacagcagtcacaatgttgaaatttgaagaaatctagtgaaaattataaaattttcactagacatgaataaatcattatgaaagaatataaaaatagccagagatcactagaggggaaagaggcactgcaaaagttactggagggaatacaagagaagaaaataattagaaaacagtcagtaagaaatgtcatcccattctgtcccctggctgctttttgtggctttgttcagtgggtgaaaattctggagtgtttattggtgtcttgtagcataagat

SEQ ID NO: 134058 - DNA, 601 bp, Human
ttttgtggctttgttcagtgggtgaaaattctggagtgtttattggtgtcttgtagcataagatgaaatatcttatcaagatattttcattttctcaaagtgaaatgcgatccctttaacttcttaggatgacaggtacatgtggaagcatcagagaggaacttgggatcccacgagctagcctctgcttcatacacagtggagtagatgcctgaggttgtcagcaaatattgaagatttttatttccagggggttagaaacttcacgtagcttctctgctctgcacacataaggagtaaktggattattttccctgagtcagtaaggttttcggtgtcacataatctcaggggaacaaatgcaattgcttagatctcaatatactcctcagatggcaactttgaggaggtaaccaggaggtatctgcactccctctgtgctcgcctggggccttctgactttctctgtaaaaagccctttctgtattgatgctcccgggtggtagtgggttggatggccattacataatcacaacctctttttttcagtcagggtagctattatgcagagagctaggagtggattacttcttggcaggaa

SEQ ID NO: 134059 - DNA, 601 bp, Human
gcaccttcaacttgagcatgagctcaaatgcatttcttttttttttttttaaggcggagtctcactttttcacccaggctggagtgcagtgacatgatctcggctcactgcaaactccgcctcccgggttcaagggattcttctgcctcagccacctgagtagttgggattacaggtgcacgccaccatgcctggctaatttttgtatttttagtagagacagggtttcaccatgctggtcaggctgatctccaactcctgacctcgtgatccgcccaccttggcctcccaaagtgctggyattacaggtgtgagccaccgtgcctggcctcaaatgcatttctatacaggtccagtcagagtagtggccagtcccactcatgtgttcaaaatataacctgaggaatgcaaagcaacatgtttagtcttttgtcttaataattcctctattagcaacttcattagacatccactagtacataactttgtcactgaaaccatatcattgccccccgaatagccttctagactcctaaccttggaatgcaccaaggaatatttaaactgtctcatagttttgcagaagcagaaaatgctagga

SEQ ID NO: 134060 - DNA, 601 bp, Human
ccactcatgtgttcaaaatataacctgaggaatgcaaagcaacatgtttagtcttttgtcttaataattcctctattagcaacttcattagacatccactagtacataactttgtcactgaaaccatatcattgccccccgaatagccttctagactcctaaccttggaatgcaccaaggaatatttaaactgtctcatagttttgcagaagcagaaaatgctaggattgtaaccctgatgatcagttctccctgatgacttggcctgtgttgcgcctactaaattcttcttgtcttctcstttgctctattgtcatgatattggttgaagggaattagtaaatcagactggcattgaatctctgggagctagaaaatgggctaagatttagatggcatattcactttctgcgttccgtttgtctgtgtgcttgttcttattcattcctaattttttcctgtagctagtcttttaggattttggtgtcaaccttacatataattgcctgggtacttcctgaggtgatcctgctgattttagaagaagtgaaagggaatattacatatggtagtagaaggagtcctggataggaagactttg

SEQ ID NO: 134061 - DNA, 601 bp, Human
tcctctattagcaacttcattagacatccactagtacataactttgtcactgaaaccatatcattgccccccgaatagccttctagactcctaaccttggaatgcaccaaggaatatttaaactgtctcatagttttgcagaagcagaaaatgctaggattgtaaccctgatgatcagttctccctgatgacttggcctgtgttgcgcctactaaattcttcttgtcttctcctttgctctattgtcatgatattggttgaagggaattagtaaatcagactggcattgaatctctgggarctagaaaatgggctaagatttagatggcatattcactttctgcgttccgtttgtctgtgtgcttgttcttattcattcctaattttttcctgtagctagtcttttaggattttggtgtcaaccttacatataattgcctgggtacttcctgaggtgatcctgctgattttagaagaagtgaaagggaatattacatatggtagtagaaggagtcctggataggaagactttgcagtcctggcttcaagtccagatgcaggcagtcacttgtcactttggtcaacatcttaaggcctccag

SEQ ID NO: 134062 - DNA, 601 bp, Human
tgtcactgaaaccatatcattgccccccgaatagccttctagactcctaaccttggaatgcaccaaggaatatttaaactgtctcatagttttgcagaagcagaaaatgctaggattgtaaccctgatgatcagttctccctgatgacttggcctgtgttgcgcctactaaattcttcttgtcttctcctttgctctattgtcatgatattggttgaagggaattagtaaatcagactggcattgaatctctgggagctagaaaatgggctaagatttagatggcatattcactttctgcrttccgtttgtctgtgtgcttgttcttattcattcctaattttttcctgtagctagtcttttaggattttggtgtcaaccttacatataattgcctgggtacttcctgaggtgatcctgctgattttagaagaagtgaaagggaatattacatatggtagtagaaggagtcctggataggaagactttgcagtcctggcttcaagtccagatgcaggcagtcacttgtcactttggtcaacatcttaaggcctccaggcttcagttaccttgtctaaaacaaggcaccttctgcctctgaa

SEQ ID NO: 134063 - DNA, 601 bp, Human
tgatattggttgaagggaattagtaaatcagactggcattgaatctctgggagctagaaaatgggctaagatttagatggcatattcactttctgcgttccgtttgtctgtgtgcttgttcttattcattcctaattttttcctgtagctagtcttttaggattttggtgtcaaccttacatataattgcctgggtacttcctgaggtgatcctgctgattttagaagaagtgaaagggaatattacatatggtagtagaaggagtcctggataggaagactttgcagtcctggcttcaaktccagatgcaggcagtcacttgtcactttggtcaacatcttaaggcctccaggcttcagttaccttgtctaaaacaaggcaccttctgcctctgaatttctgactcataaaatggtccaagccatattgtcagtgattagtgcttttaatatcagcttcatacagaggtagctttccaggctgctctaacttttggattacataacagagatagagtgcctgatggatggatatctcggtatctggcatgttatggtgagtgggagacagccagaagaaaatccttggaaagtatttttt

SEQ ID NO: 134064 - DNA, 601 bp, Human
ttcattcctaattttttcctgtagctagtcttttaggattttggtgtcaaccttacatataattgcctgggtacttcctgaggtgatcctgctgattttagaagaagtgaaagggaatattacatatggtagtagaaggagtcctggataggaagactttgcagtcctggcttcaagtccagatgcaggcagtcacttgtcactttggtcaacatcttaaggcctccaggcttcagttaccttgtctaaaacaaggcaccttctgcctctgaatttctgactcataaaatggtccaagccrtattgtcagtgattagtgcttttaatatcagcttcatacagaggtagctttccaggctgctctaacttttggattacataacagagatagagtgcctgatggatggatatctcggtatctggcatgttatggtgagtgggagacagccagaagaaaatccttggaaagtatttttttaaatctgtgtgaatatgtttatattgggatggttctgaattctaggttttagataaactaagaaaattggatgtaatatgaagagataaaattccatgagctgaagttgatgagtaatataca

SEQ ID NO: 134065 - DNA, 601 bp, Human
aataagagattaaatgagatagagaaaaataatgctgggcaggccatttaataaattctctgactttgtttctgcttatgcagaagaggtggactaaattatacctgaactcctctgttctgtgaaggtcacaagtacagatgtttctaaccttgaagggaagtaaggtgtttattcatttttttcttttagcttttgttctttccctaaagatagagaatatgcaaattattaaaaaatcaaatacaggccaggcgcgatggctcatgcctgtaatcccagctctttgggaggccaaggygggtggctcatgaagtcaggagactgagaccatcctggccaacatggtgaaaccccgtctctactaaaatacaaaaaactagccaggcatggtggtgcgtgcctgcagtctcagctacttgggaggctgaggcaggggaatcgcttgaacctcagaggcagaggttgcagtgagccgagatcatgccactgcgctccagctaggtgacagagtgagactctgtctcaaaaaaaaaaaaaaaaaaaaaaatcaaatacagaaagacatgggggaggaaaagccaaaattcggtgaaatatt

SEQ ID NO: 134066 - DNA, 601 bp, Human
ttttgttctttccctaaagatagagaatatgcaaattattaaaaaatcaaatacaggccaggcgcgatggctcatgcctgtaatcccagctctttgggaggccaaggcgggtggctcatgaagtcaggagactgagaccatcctggccaacatggtgaaaccccgtctctactaaaatacaaaaaactagccaggcatggtggtgcgtgcctgcagtctcagctacttgggaggctgaggcaggggaatcgcttgaacctcagaggcagaggttgcagtgagccgagatcatgccactgcrctccagctaggtgacagagtgagactctgtctcaaaaaaaaaaaaaaaaaaaaaaatcaaatacagaaagacatgggggaggaaaagccaaaattcggtgaaatattcctctctgtataaaaccatgattgagtcactgtcagtcatttggtaaagatactattagacttctgtgcaagcagcatgaactgttgcatagcattcaaggtgaaggaaacaagcagtcacagcttatatttttccaaactaaattaaatccaactgaaatgtatacttgccagactgacaggaatttcaata

SEQ ID NO: 134067 - DNA, 601 bp, Human
aaaattcggtgaaatattcctctctgtataaaaccatgattgagtcactgtcagtcatttggtaaagatactattagacttctgtgcaagcagcatgaactgttgcatagcattcaaggtgaaggaaacaagcagtcacagcttatatttttccaaactaaattaaatccaactgaaatgtatacttgccagactgacaggaatttcaatatcaccctccagggatattctctcctgtgcctagtttgtcagccccctaaccccaatccccacacgtgtgtacagtctagaaaggaatttygctgaaatctgctttcaagcagagaagagccttaccatccaccaatctcctgctgccatccctggcctgccctcagccttactaccatgtggcaccactattgagcactagcccctcttggctgtccagtagtgcttgcttttgatactgtgaaatatcatgagcttgagctcccagcaaagaccacgtgcctctttgaacaagggcagctctattagttcagtgcatcatccattttctgtgttacataatatatcattgatggcatgtgccatcatttattcagccagtcatctcatg

SEQ ID NO: 134068 - DNA, 601 bp, Human
agcttatatttttccaaactaaattaaatccaactgaaatgtatacttgccagactgacaggaatttcaatatcaccctccagggatattctctcctgtgcctagtttgtcagccccctaaccccaatccccacacgtgtgtacagtctagaaaggaatttcgctgaaatctgctttcaagcagagaagagccttaccatccaccaatctcctgctgccatccctggcctgccctcagccttactaccatgtggcaccactattgagcactagcccctcttggctgtccagtagtgcttgsttttgatactgtgaaatatcatgagcttgagctcccagcaaagaccacgtgcctctttgaacaagggcagctctattagttcagtgcatcatccattttctgtgttacataatatatcattgatggcatgtgccatcatttattcagccagtcatctcatggtgaatgcatagatcagcattatttataaagtgtcacgatgaacactttacatgtatctttggccacctatctgtgtttttagagctaacactcaggagttatgttgctgtatcaaaaggtttacctgttaagttttga

SEQ ID NO: 134069 - DNA, 601 bp, Human
ttgagcactagcccctcttggctgtccagtagtgcttgcttttgatactgtgaaatatcatgagcttgagctcccagcaaagaccacgtgcctctttgaacaagggcagctctattagttcagtgcatcatccattttctgtgttacataatatatcattgatggcatgtgccatcatttattcagccagtcatctcatggtgaatgcatagatcagcattatttataaagtgtcacgatgaacactttacatgtatctttggccacctatctgtgtttttagagctaacactcaggagtyatgttgctgtatcaaaaggtttacctgttaagttttgacccctattgcaagtttgcattctggaatagatgcaccagtttacattcctgagagtgcattggagtgcacttccttgtcacgcttgctgatgatctctgtgcaagaagaaaatagttctggctaccacaatctcagaagaagaacatatggtcatacacatggcaacattatctctagagaacttgggttcctctggtattcaggatccatctgctagggatttattatttttcttgtttcccctctctaagttggtgttga

SEQ ID NO: 134070 - DNA, 601 bp, Human
cagtgcatcatccattttctgtgttacataatatatcattgatggcatgtgccatcatttattcagccagtcatctcatggtgaatgcatagatcagcattatttataaagtgtcacgatgaacactttacatgtatctttggccacctatctgtgtttttagagctaacactcaggagttatgttgctgtatcaaaaggtttacctgttaagttttgacccctattgcaagtttgcattctggaatagatgcaccagtttacattcctgagagtgcattggagtgcacttccttgtcacrcttgctgatgatctctgtgcaagaagaaaatagttctggctaccacaatctcagaagaagaacatatggtcatacacatggcaacattatctctagagaacttgggttcctctggtattcaggatccatctgctagggatttattatttttcttgtttcccctctctaagttggtgttgaattggtcatgttgacccacttaaattcagaggatgagctattttatttatctcatgttctcttaccatatttgaaggaatggccagatttttctcagccttccaaccctttcactgtgtt

SEQ ID NO: 134071 - DNA, 601 bp, Human
tggctaccacaatctcagaagaagaacatatggtcatacacatggcaacattatctctagagaacttgggttcctctggtattcaggatccatctgctagggatttattatttttcttgtttcccctctctaagttggtgttgaattggtcatgttgacccacttaaattcagaggatgagctattttatttatctcatgttctcttaccatatttgaaggaatggccagatttttctcagccttccaaccctttcactgtgttttgtcgtgtatgtaggatttacccagtagcaaaactrtaaattcagggtcttcaagctaaaacttcctaaagcaataccctaagactcagttgtgaactgaaaaatctgtgggactctagaggagcggaagatctgccccttggcctcttggttccctggattcctgtggttaggttagctggaactaattgctgaatatttgtttctttctgaagttaaccagttattttcttatcttttgttctttagccagattcatttgtctttctgactttttcatgatttttctgtattttacccttattctttagaaatgtttctctattctgtgcttgt

SEQ ID NO: 134072 - DNA, 601 bp, Human
gttctttagccagattcatttgtctttctgactttttcatgatttttctgtattttacccttattctttagaaatgtttctctattctgtgcttgtgattgatttctaacgtctcctagaagttacaaagggcctgggttaaaatcctgtcagcaataacgccatatggtttcctagatgctctgcacactaaagaaaacacttattctgatattttaatcaaactctgaggacttaaacatatggtataaagaatgctagttaatagctttttgtgttattttaatggcaaaaactgcarttatgtttgcaccaacctaaatagaaccatatcagagtagcagaagaactcatctcaaagcctgtcttagagaggtggatggacctgtgcactgtgtttcatcatgctaatatggaatgtgcctgcctttgggcaactcatttcatagtgggccttaatcccaattggtaaaatgaactataacctttcatcattccatagattcagcttaaagtgggcccacagaagaagagagggtagagagtgaaaatggagtcacaaacccagcagagaatcctccctctggtttctgaataaaca

SEQ ID NO: 134073 - DNA, 601 bp, Human
aacagattaatagtttaacataagatacaagtgtatttcaaatcactaaaacaaaatagataataaatggttttgggaaagatggatagtctgcttggaaaaaaggttggatccataattcacatcttggatccataattcacattggcaggaccaggaaaattttccagtggaataaataaagatttaaatgttaatgaatgaaatcataaaaatcacttgaagaaaccagtgaagaaatttgaaagtagttttgatctgatggaagcttttctaattatgatcccaaacccagaaactrtaaaggaaagaatcaggatatatgtaccgatataaagaggagaaatgttgcacagcaaaaaaaaacacccatgagctgggtcacgaaaaaatttaaacagatggaaaagcaaggagcaaaacatagtgaaccctcttgtttccatctcccaatttcaaccatttcaaactcatgactgaatttctttattttgaaggtaatccttgcttatcatatcattgcatctaaaacaacctgcatgtgaatataaaagagtccttttttccctcaacacattaaaatgccattattacaattagg

SEQ ID NO: 134074 - DNA, 601 bp, Human
tggaaaactggaagaagacaaggatgccctctttcaccactcctattctacatagtattggaagtcctagccagagcagtcagcaagaggtataaaaagcattcagataggcagagaggaagtcaaactatctgtctttgtagaccatatggttctatacctagaaaatcccatagtctctgccagaaagctccttgatctgataaataacttcagtgaaatttcaggatacaaaattaatgtacaaaaatcagtggcatttctgtacaccaacatcatccaagctgagagccaaaccaaraacacactcccattcacaatagccacaaaaagaataaaacaactaggaaaacagctaaccagggaggtgaaagatatctacaatgagaattacaaaacactgctcaaagaaatcggagataactcaaagaaatggaaaatattttatgctcacagataggaagaatcaatattgttaaaacagttatactctccaaagcaatttacagatttaatgccattcctatcaaattaccaatgacattcttcacagaattagaaaaaaaaaatattagaactcctatggaatcaaaaagcctga

SEQ ID NO: 134075 - DNA, 601 bp, Human
atcatccaagctgagagccaaaccaagaacacactcccattcacaatagccacaaaaagaataaaacaactaggaaaacagctaaccagggaggtgaaagatatctacaatgagaattacaaaacactgctcaaagaaatcggagataactcaaagaaatggaaaatattttatgctcacagataggaagaatcaatattgttaaaacagttatactctccaaagcaatttacagatttaatgccattcctatcaaattaccaatgacattcttcacagaattagaaaaaaaaaatattaraactcctatggaatcaaaaagcctgaatagacaaggctaagctaaaaagacaaagctggaggcatcgcattacctgacttcaaattatgctacaggctatggtaaccaaaacagtatggtactggtagaaaacagacacacataccaatggaacagaataaagagcctagaaataaagccacacacttaacaaccatctgatttttgataaagttgacaaaaagaagcaatgggggaaagtactccttattcagtaaatgttgctgggataactggctagccaatatgcagaagattgaa

SEQ ID NO: 134076 - DNA, 601 bp, Human
gataactggctagccaatatgcagaagattgaaactataccccttccttacatcatctaaaaaattaacaccagatggattaaagacttaaatgtaaaacctaaaactgtaaaaatcctggaaggataacctaggacatgctgctgtggacataggacttggcaaagatttcatgacgaaaatgccaaaagtaattgcaacaaaaacaaaaattgacaaaatagagatcttctgcacagcaaacagacaatctacagaatgggagaaaatatttgcaaactatgcatgcaacaaaggtctratatccagaatttataaggaacttaaatttacaaacaaaaaaaaaccccattaaaaaatgcacaaaagacataagcagacacttttcaaaagaaagcatacatgtggccaacaagcatataaaaacatgctcaacatcactgatcattagaaaaatgcagatcaaaatgacaatgagatactatctcacaccagtcagaatgactgttatcaaaaagtcagacaataacagatgttggcaagattgcagagaaaagagaatgcttatacactgctgctggaaatgtaaattagtttagcc

SEQ ID NO: 134077 - DNA, 601 bp, Human
cttacatcatctaaaaaattaacaccagatggattaaagacttaaatgtaaaacctaaaactgtaaaaatcctggaaggataacctaggacatgctgctgtggacataggacttggcaaagatttcatgacgaaaatgccaaaagtaattgcaacaaaaacaaaaattgacaaaatagagatcttctgcacagcaaacagacaatctacagaatgggagaaaatatttgcaaactatgcatgcaacaaaggtctaatatccagaatttataaggaacttaaatttacaaacaaaaaaaaamcccattaaaaaatgcacaaaagacataagcagacacttttcaaaagaaagcatacatgtggccaacaagcatataaaaacatgctcaacatcactgatcattagaaaaatgcagatcaaaatgacaatgagatactatctcacaccagtcagaatgactgttatcaaaaagtcagacaataacagatgttggcaagattgcagagaaaagagaatgcttatacactgctgctggaaatgtaaattagtttagccattgtggaaagcagtgtggcaatttcttaaagaacttcaaacggaa

SEQ ID NO: 134078 - DNA, 601 bp, Human
aagacttaaatgtaaaacctaaaactgtaaaaatcctggaaggataacctaggacatgctgctgtggacataggacttggcaaagatttcatgacgaaaatgccaaaagtaattgcaacaaaaacaaaaattgacaaaatagagatcttctgcacagcaaacagacaatctacagaatgggagaaaatatttgcaaactatgcatgcaacaaaggtctaatatccagaatttataaggaacttaaatttacaaacaaaaaaaaaccccattaaaaaatgcacaaaagacataagcagacayttttcaaaagaaagcatacatgtggccaacaagcatataaaaacatgctcaacatcactgatcattagaaaaatgcagatcaaaatgacaatgagatactatctcacaccagtcagaatgactgttatcaaaaagtcagacaataacagatgttggcaagattgcagagaaaagagaatgcttatacactgctgctggaaatgtaaattagtttagccattgtggaaagcagtgtggcaatttcttaaagaacttcaaacggaattaccactcaacccagcaatcccatattgggtatat

SEQ ID NO: 134079 - DNA, 601 bp, Human
aaacagacaatctacagaatgggagaaaatatttgcaaactatgcatgcaacaaaggtctaatatccagaatttataaggaacttaaatttacaaacaaaaaaaaaccccattaaaaaatgcacaaaagacataagcagacacttttcaaaagaaagcatacatgtggccaacaagcatataaaaacatgctcaacatcactgatcattagaaaaatgcagatcaaaatgacaatgagatactatctcacaccagtcagaatgactgttatcaaaaagtcagacaataacagatgttggcragattgcagagaaaagagaatgcttatacactgctgctggaaatgtaaattagtttagccattgtggaaagcagtgtggcaatttcttaaagaacttcaaacggaattaccactcaacccagcaatcccatattgggtatattcctaaaggaatataaatcattctaccataaaggcacatgtatgcatatgttcagcacagcagtattcacagtagtaaagacatagaatcaacctaaatggacttgatatagaaaatatgtatcatatgtaccatattcaggccacttaaattgacgt

SEQ ID NO: 134080 - DNA, 601 bp, Human
gtagggcctgaatcccatgtcatgatcccagtgcctttttcctttccatgtgatcatacttcttcctttcatacctttaagtcaattatcttccttccttagaatgtgtgttgaagttttgaataaagcataatagacatgaatgtatttttatgctttcctaatttaagctgtttttctccacattgcctgtgatgctagcacctcttcatgaactttcctgtcctctcagttgtaccaggcttttgattctgccagatgcagcgggagagcaattgctcttcctaaagaaatccatagytggctttattttcctcttatcttttcttgccatggtaaacttttatggtcatttatctctgtcataaaaatgaatgttgtacgtgtaatctttcctgtcttaaattatatgacatatactgttcatgtctttgttctagtttcttttatgtaaatgggcattttggtttatgaagaaagatttgtatcttatttttttcctcctggctttagacatcttataggtgagtcccttagagttttggatcttccttgcaggtccctctattcctgatatctaagactaatcttataccattaa

SEQ ID NO: 134081 - DNA, 601 bp, Human
aagcatttgaaaggcaattcaagcagtgtgctttggccagagaaatgtagcatttcagagtaaaagggatttttaggcaatttgtatatatatatgcacttgacatataaagcccttacactgctaaccagtggtcagccaatccttgcttaacccatgctgaagaccagaaaatcaggagagcagcctacagtaatggggggaacttgtgcttttaatcaggcaaatttctgtatcctgactgcaacacacacatgttgtgaccttgggcaagacccttgactctctgattctccatttycttgttgtggtctcattagagaattaaatgacatatcaactaccactattctcatctatcacatctgagctgaaatatcttccactggctctcatgtctttcttctaaatcttcctcttggggtcatacagaacacggttgtaatctcactagctatcttctaggtgtgtttaatttcaagtctcaactctctctagggctgtccattatcttttatgtgtttgaaagctgtgcaatcaaaggacaatggagacagaacattggtaagccaatgtcaccttctagcattctctgtgatct

SEQ ID NO: 134082 - DNA, 601 bp, Human
tctctgattctccatttccttgttgtggtctcattagagaattaaatgacatatcaactaccactattctcatctatcacatctgagctgaaatatcttccactggctctcatgtctttcttctaaatcttcctcttggggtcatacagaacacggttgtaatctcactagctatcttctaggtgtgtttaatttcaagtctcaactctctctagggctgtccattatcttttatgtgtttgaaagctgtgcaatcaaaggacaatggagacagaacattggtaagccaatgtcaccttcyagcattctctgtgatctacctgtattttactgtgctgtactaactttgtgctatgcaactgtgctgtactaactttgtgctatgcaacagtcactttgtgaacttgtggtatttgtgaacaggagctcaaattaaatattccatttcagtcattaactgatgtgaaaaactcttccttttctggatgaaactatagatatgtttgggcaaaggagagtgaaagttgatattgataccagacactttacagctattagaccttacacctaaatccttatgtctaagatttaaagcacggtc

SEQ ID NO: 134083 - DNA, 601 bp, Human
tgtagcaagtccatgaaaccaaagggctgatccatacataaatgtgtgatacccctcagcagagagagatgctccagatattaggctgtttttggtgctgtctctaacatgcaagtgggctgtgtatcattggtctcttttcctccgatgtgcctagtagagcatcctaaaggagcttacaactgaagatgaaaactagcatgtgaataattacatgttacatataaagaaaacgtttctcattatattaacataaatattatatatgtgtgtgtatatatagtttaacttatttgtattccacacacacacacacacacacacacacacacgtttaacctgtattctgtctcccctgttactttgcttattttagaatatggcaatattttaatattttggacagccaaactgacatttattcaatatattgagttcctagtatgttccaggcactgtggaagggtgctgaagacacaaagaggagtaaaaatatgcatccttttcttaaatagttggaagcctagtgagggagatagaaatatataccattaacaatagagtgagggcagtacccctagaggccctataagtacaaagt

SEQ ID NO: 134084 - DNA, 601 bp, Human
gtgtccccacccaaatctcatcttgaattgtagttaccattcaattgtgagtgagttctcacaagatctcatggtttaaaaagaggctttcctcccttttgctctgcatttcttcttgctgctgccatgtgaagaaggatgtgtttgcatccctttctgtcatgactgtaagtttcctgaggcctccccagccctgcagaactgagtcaattaaacctctttcctttataaattatccagtcttgggtatgtccttataacagcatgagaacggactaatacagggaccattaaggaattytaagccttggagtgttatggtcaggtattccttctagaaagttgatactgtggactgcaatttaggaatgagaagctagaggaatttttcaacaaattaaaacaatgaattactatatgatgcaggaattctacttctagatgtagactcaaaagaactgaaagcagagacttgagcagatatttgtacatccatgttcacagcaacattattcatgatagtcaaaaggtggaaaaacccaaatgtggataaacaaaatgtggtatatatatgtgcaatggcatatcgttaaaaccttaa

SEQ ID NO: 134085 - DNA, 601 bp, Human
gacttgagcagatatttgtacatccatgttcacagcaacattattcatgatagtcaaaaggtggaaaaacccaaatgtggataaacaaaatgtggtatatatatgtgcaatggcatatcgttaaaaccttaacaagggataaaattttgacatatcctacaatagggataaaccttatagacattataccaagtgaaataagccaatcctcatctttgaagtgtgataataatagtacagctctctcctcttatctgcaaggggtatgttccaaaatccccaatgtatgcctgaaactggrtattactgaatgctgtatataaattagatacagtaggagattcacaacaataactaaagtagaacaattataacagtatacttaataaaagatatatgattgtgcacattcattctctgtctctcgctctctcagaatgactgtgggtaactgaaaccatggaaagtgagatcacagataatggggaaaaaattgtgtctatttaataaaatgacagggtggtggccctgaggaataaattggctaactcatgtaaggtgcttcaaaggatgcctgacacagtaactcctcagtaaatgt

SEQ ID NO: 134086 - DNA, 601 bp, Human
agtacttttgttaccactactaccattagtgtttttttatttgaagaactaacttaaatatatgacatattaatcttgtttccttgactttgatgggatgtcttatttttaatagctttattgtggcattcttcactacagtaactgtacttatttaaagcatatagcatgataagttttgacatatatatacatctgtgaattgatcactgaaatccagaaagcgaacagaatccattactttctcaacagaacccaatgctttctcaaatcccttggtaattcctccatttccccagaygaccaatgttattctttctcttaccatagattagtttgagttttctagagttttggatacctgtaatcatataatattgtattcctttttgtctgacttctttcaatcggcataattgttttgagactccatgtttttgtgtatataaagttaattcctttatattgccaaatagtattccattgcatgaatataccacagtttgtttatccataagcacctgttgatggatgttgggttgttttcagctttggagaattataaataaacctgctatgaatattcttgtacaagacatat

SEQ ID NO: 134087 - DNA, 601 bp, Human
atctctgtgagcttcagttgtctcatctataaaatgtgctatttattttaaaaaggattcctgtatctgtgagtgcctcctttactgagtcagataccatgccagatgctcaggatgcagaagagaatatgccctctctgccttccagggactcagacaaagcgggggaagagaagttaaatgatacagcgcacagataaaattgctaacagaagtatgccaggcatgctgggcaagtcataggattttatagatgaaattaatggaagtatgtgaaatgtactctatgtgctgtaaaggwctgtatgtttgattatgtttgatattatttagtagtagtcaaagatgtactagcagctgctccatacccattatttttttctggagtctgttatgctttgaccttttcggtgttaaggttctgtgtgaatcctctgggttccacataattaataagttttagtgtgtgccaacagggggtggaaacatgacagtaagttcattttcttcctgctgttgcaggttatttgggcttggctcttgtaaaagacaacttgtacccagtgaattctcacatgaattcaaatcttgtaagctagga

SEQ ID NO: 134088 - DNA, 601 bp, Human
atctataaaatgtgctatttattttaaaaaggattcctgtatctgtgagtgcctcctttactgagtcagataccatgccagatgctcaggatgcagaagagaatatgccctctctgccttccagggactcagacaaagcgggggaagagaagttaaatgatacagcgcacagataaaattgctaacagaagtatgccaggcatgctgggcaagtcataggattttatagatgaaattaatggaagtatgtgaaatgtactctatgtgctgtaaaggactgtatgtttgattatgtttgatrttatttagtagtagtcaaagatgtactagcagctgctccatacccattatttttttctggagtctgttatgctttgaccttttcggtgttaaggttctgtgtgaatcctctgggttccacataattaataagttttagtgtgtgccaacagggggtggaaacatgacagtaagttcattttcttcctgctgttgcaggttatttgggcttggctcttgtaaaagacaacttgtacccagtgaattctcacatgaattcaaatcttgtaagctaggaatactgtaaatctctactgatgct

SEQ ID NO: 134089 - DNA, 601 bp, Human
tctataaaatgtgctatttattttaaaaaggattcctgtatctgtgagtgcctcctttactgagtcagataccatgccagatgctcaggatgcagaagagaatatgccctctctgccttccagggactcagacaaagcgggggaagagaagttaaatgatacagcgcacagataaaattgctaacagaagtatgccaggcatgctgggcaagtcataggattttatagatgaaattaatggaagtatgtgaaatgtactctatgtgctgtaaaggactgtatgtttgattatgtttgatawtatttagtagtagtcaaagatgtactagcagctgctccatacccattatttttttctggagtctgttatgctttgaccttttcggtgttaaggttctgtgtgaatcctctgggttccacataattaataagttttagtgtgtgccaacagggggtggaaacatgacagtaagttcattttcttcctgctgttgcaggttatttgggcttggctcttgtaaaagacaacttgtacccagtgaattctcacatgaattcaaatcttgtaagctaggaatactgtaaatctctactgatgctt

SEQ ID NO: 134090 - DNA, 601 bp, Human
gctgtaaaggactgtatgtttgattatgtttgatattatttagtagtagtcaaagatgtactagcagctgctccatacccattatttttttctggagtctgttatgctttgaccttttcggtgttaaggttctgtgtgaatcctctgggttccacataattaataagttttagtgtgtgccaacagggggtggaaacatgacagtaagttcattttcttcctgctgttgcaggttatttgggcttggctcttgtaaaagacaacttgtacccagtgaattctcacatgaattcaaatcttrtaagctaggaatactgtaaatctctactgatgcttgactgagtaggactttacaactccagatggcagttgtaatactttagcatttaccatacagagaaatagaaaacaattttctgaagaaagcagtgacaaaattccaatatcatggttttgtagcactagttcatgccatcctccctcacacagtgttagaacttcttatcgtgatttatcaagcatttcattacattgccaacgatatgaaaaacaaaattaagaactgctgtatactggtgtggcatggtgctgaagtcaggct

SEQ ID NO: 134091 - DNA, 601 bp, Human
actttacaactccagatggcagttgtaatactttagcatttaccatacagagaaatagaaaacaattttctgaagaaagcagtgacaaaattccaatatcatggttttgtagcactagttcatgccatcctccctcacacagtgttagaacttcttatcgtgatttatcaagcatttcattacattgccaacgatatgaaaaacaaaattaagaactgctgtatactggtgtggcatggtgctgaagtcaggctttgggaaagtacacaatgtggcagcatttcttaaaggcctggagacsgtgttaaaaatgcagattctggccaggtgcagtggctcactcctgtaattgccacactttgggacgccaaggcgggtggattgcttgagcccaggagtttgagatcagcctgggcaacatggtgaaatcccatctctaccaaaacaaccccacaaaaattagctgggcatggtggcacacacttgtagtcccactgactcagggggctgagatggaaggatcacctgagcctgggggagatcaaggctgaagttagttgtgatcatgccactgcactccagcctgggtgacagagtgaga

SEQ ID NO: 134092 - DNA, 601 bp, Human
agtctgtttgcacatctagttaggttacagttcactacctgctaagaaacctttaggctgaacctaaattatataaggaggcagttttaggctaagctcaatttaacaaggtgaaataagatataaggaaacgtaagaaaaatgaaggacttaccactcagttttctaaatttaacttttcagaaagcctaatggtcttggtattgaagatgcatacctatctaaactggtggttcttgacttatgagccatgatgtgcttttaggtgagccaccaaaatttgatgaatgtggacaattakcgtttgctgcagtggtcactacagtggctttccagaggaaacattttgattggattgagtggtagtgtgttgtggagcagggtacgacttgtggcacataagacatgggaagccttatagactggttaacaaaacgaggtcagtgtttcaggccacatctgctctgctttctgaactctcgcactctcctctggctagttcctgcctgcttggtcctgagtctctttgtggccctctagattggcagcttggctaaactgactgcttggcttttgattttgtttttggctcttagaagtg

SEQ ID NO: 134093 - DNA, 601 bp, Human
agaggccttcccagcctccgtaacacatgagccaattcccctaataaataccctctcatttatctgtatgtgtatatctcctattggttctgtttctctggagaaccctaatataaccactaataggaaaattaggacaatgagatgggggttagttctggagagaacccagtggaggtgtccgcagtgaggtgaggtgaggttgatagttaacgctggtgcctgagacacatgtatgattttcatcacagtagcgaaggattcactctctctacgttgctatatccacttgtaagtacartttgtaaactctactttggaggaatctgaaggtggtgaggaagtgaaagacctgcccaaagtgacatacccagaaagtggcaggattgatacccaggaagtgtggctttttgggcttcctgtctttaagttaacctcagatctgttctttgcctgccaagagaaggtaaatatgattatgaaaatcttctgtttagtaagctttactggtctctacttttagacaaaatgtcagttgtctgtatatgcagtaccaatatattgcacatacagaaaacttgcatatactgacatgtagtta

SEQ ID NO: 134094 - DNA, 601 bp, Human
cccttcagcatctgataaggcttatgcatacattgtcacttattttcttcataaattagccattttcttctgtcagtaatttatgtccatatctgactataacaactaggattccagtaggatgtggcagatccaggtgagagatgcatatccagggcaccctaaatggaattagctggttctttgtgtcagctcattatctcagcttcactgctgatcctttctctcacagatgccttgaatctaaatcacagtgcctgcttagtaattttacttaaattgtaaaagatgactagcactrtacagtcaaagcacatttaaaacacactcacagtttgttttctgtgacagaaaacaaaacagaaaaatgttttccagatgccagtgcaagcttattgcattggtgtagataaatggtctttgtggattttatttgcttcatatttgtacaaagctttcataatgtactgtcacattctcaccttaagtattttttatgttttttatattagtgtgcatggagccttctaaaatttcttctatgttcactatttttaccaaacttcaatatattatattttcagttaaaaaattagaatga

SEQ ID NO: 134095 - DNA, 601 bp, Human
gatcctttctctcacagatgccttgaatctaaatcacagtgcctgcttagtaattttacttaaattgtaaaagatgactagcactgtacagtcaaagcacatttaaaacacactcacagtttgttttctgtgacagaaaacaaaacagaaaaatgttttccagatgccagtgcaagcttattgcattggtgtagataaatggtctttgtggattttatttgcttcatatttgtacaaagctttcataatgtactgtcacattctcaccttaagtattttttatgttttttatattagtgtkcatggagccttctaaaatttcttctatgttcactatttttaccaaacttcaatatattatattttcagttaaaaaattagaatgaataagttctctggttgttttatgtaattaatatcacattatttttgccttcagtatcatgtacatggtacatgtttatgagctgttattaataatttagcaacttctttctaaacaaatgattttatacatctttcatatatgaacctaaatacagagcagttcactgccaggtgtggttgagaaatgtatctcaataatttgttgagatgaaat

SEQ ID NO: 134096 - DNA, 601 bp, Human
tgtggttctctttgagttttttgtacttgtaattcattgagcttctttgaagtatagattagcatttttcatcagtttggaaaatttttagctatgatttctttgaatattctttgtacttctttctgtctctcatctccttcttgtattttgattatgtgttggtttgctaactgctatcccccatttctgaagccctgtttactttttcttctttatttcctctctgttctttggatcatctcatctgccttcatgtatcatcaggtttgttgattcattcttttgcccatgcaaatgragtgcttagcccttcttgtgaatttttcatgcaaatttttatactcttcaagagtcccatttgactcttttagaaaataatttgtgtttgtatttatatcctctatttgataagacattgtcatcatgccttactttacttccgtaggcatggttttcccttagttctttggacatatttaaaatgactactgccgagccatatctgctaattccaacatctgggccctgaaaaggaagtgtctgttgcctgttttgcacatcccccctccccccgtgtatgtgtcacattttcctgggg

SEQ ID NO: 134097 - DNA, 601 bp, Human
cttgtgaatttttcatgcaaatttttatactcttcaagagtcccatttgactcttttagaaaataatttgtgtttgtatttatatcctctatttgataagacattgtcatcatgccttactttacttccgtaggcatggttttcccttagttctttggacatatttaaaatgactactgccgagccatatctgctaattccaacatctgggccctgaaaaggaagtgtctgttgcctgttttgcacatcccccctccccccgtgtatgtgtcacattttcctgggggtgtgtgtgtggatrtgtgtgtgcatgcacatgcatgtgtgtgtatgtgtttgaatgtctcataattccttgttgaaacctgtacattttagatactatggtaactctggatattgatcctctccctcttctagggaaagtttcttgaagttgttgtttgctcatttgtttatttgtttagtgacttggctttactaattatttgaagaatatttttctcactctgtgtggcccctgatgtccctgctcaaatttgtttctttgtgtttatctgttagtgtgggttcgtaggagtcacccctgggtctgcctaaa

SEQ ID NO: 134098 - DNA, 601 bp, Human
tcattgtcattgaatgtgttcatcaggctgcgacctcttatatctttgtgttccctgtctccagtaatatgaatgctacttcatagtaagtactcaataaacgtctgaatgaatgaatagatactacatttttaaagtgatgtgttgatttttattcacaaggagtgatgcaaacagtgtggactttgggcactgtagggctttgctggctgtggaagtaggttttgactctgctgacccagcataatcatagtgagctcgaatgtttaaaaatagaaggggtatgaagaactactacacracacacgaataagaagagacaacccaatagcagaacaaacaacagtagcagcaacaacaaaaaatagatgtgtgatatgcctaggcaggctataaaataggaagcagagaggatcaattagcattaaagatattccacctatcaggaatatgacatttaaaacaatgatgtatcataaacttataatcatcagatttgcaaaaattaaaaagtctgacaaagtattggggaagatgtggagaaacagaaattttggtaaactgcagataggactataagttggtataactccttcgggga

SEQ ID NO: 134099 - DNA, 601 bp, Human
gtgttgatttttattcacaaggagtgatgcaaacagtgtggactttgggcactgtagggctttgctggctgtggaagtaggttttgactctgctgacccagcataatcatagtgagctcgaatgtttaaaaatagaaggggtatgaagaactactacacgacacacgaataagaagagacaacccaatagcagaacaaacaacagtagcagcaacaacaaaaaatagatgtgtgatatgcctaggcaggctataaaataggaagcagagaggatcaattagcattaaagatattccacctrtcaggaatatgacatttaaaacaatgatgtatcataaacttataatcatcagatttgcaaaaattaaaaagtctgacaaagtattggggaagatgtggagaaacagaaattttggtaaactgcagataggactataagttggtataactccttcggggaggaatgcagcagtaacaaaataggttgaatattatatagtcacacactagacacagtaattatactacaaggcatagattccagggaaaactgtcactcatgagcagcaggagacattaatagagagatgcttgttgctgc

SEQ ID NO: 134100 - DNA, 601 bp, Human
tgtttaaaaatagaaggggtatgaagaactactacacgacacacgaataagaagagacaacccaatagcagaacaaacaacagtagcagcaacaacaaaaaatagatgtgtgatatgcctaggcaggctataaaataggaagcagagaggatcaattagcattaaagatattccacctatcaggaatatgacatttaaaacaatgatgtatcataaacttataatcatcagatttgcaaaaattaaaaagtctgacaaagtattggggaagatgtggagaaacagaaattttggtaaactkcagataggactataagttggtataactccttcggggaggaatgcagcagtaacaaaataggttgaatattatatagtcacacactagacacagtaattatactacaaggcatagattccagggaaaactgtcactcatgagcagcaggagacattaatagagagatgcttgttgctgcactttttgtaatagtgaaaatcataaaacaacccaaataggtatcagtggggaaatggagaagtaaatgttaatatagacttacagtggaacacgatgcagcagttaagatgaatagtctgc

SEQ ID NO: 134101 - DNA, 601 bp, Human
gaataagaagagacaacccaatagcagaacaaacaacagtagcagcaacaacaaaaaatagatgtgtgatatgcctaggcaggctataaaataggaagcagagaggatcaattagcattaaagatattccacctatcaggaatatgacatttaaaacaatgatgtatcataaacttataatcatcagatttgcaaaaattaaaaagtctgacaaagtattggggaagatgtggagaaacagaaattttggtaaactgcagataggactataagttggtataactccttcggggaggaatgyagcagtaacaaaataggttgaatattatatagtcacacactagacacagtaattatactacaaggcatagattccagggaaaactgtcactcatgagcagcaggagacattaatagagagatgcttgttgctgcactttttgtaatagtgaaaatcataaaacaacccaaataggtatcagtggggaaatggagaagtaaatgttaatatagacttacagtggaacacgatgcagcagttaagatgaatagtctgcctctacagagagcaacatatataagtttgatgggtaacaagtta

SEQ ID NO: 134102 - DNA, 601 bp, Human
tccacctatcaggaatatgacatttaaaacaatgatgtatcataaacttataatcatcagatttgcaaaaattaaaaagtctgacaaagtattggggaagatgtggagaaacagaaattttggtaaactgcagataggactataagttggtataactccttcggggaggaatgcagcagtaacaaaataggttgaatattatatagtcacacactagacacagtaattatactacaaggcatagattccagggaaaactgtcactcatgagcagcaggagacattaatagagagatgcttrttgctgcactttttgtaatagtgaaaatcataaaacaacccaaataggtatcagtggggaaatggagaagtaaatgttaatatagacttacagtggaacacgatgcagcagttaagatgaatagtctgcctctacagagagcaacatatataagtttgatgggtaacaagttacagaaggttgtataaggttgtatgcggtatagtattttatactgtttatgtaagttaaaatacagcaaataagtttttgttgtttatggataccatagcacaggtgtcaactatgtaaagtgtgtag

SEQ ID NO: 134103 - DNA, 601 bp, Human
ttataatcatcagatttgcaaaaattaaaaagtctgacaaagtattggggaagatgtggagaaacagaaattttggtaaactgcagataggactataagttggtataactccttcggggaggaatgcagcagtaacaaaataggttgaatattatatagtcacacactagacacagtaattatactacaaggcatagattccagggaaaactgtcactcatgagcagcaggagacattaatagagagatgcttgttgctgcactttttgtaatagtgaaaatcataaaacaacccaaatakgtatcagtggggaaatggagaagtaaatgttaatatagacttacagtggaacacgatgcagcagttaagatgaatagtctgcctctacagagagcaacatatataagtttgatgggtaacaagttacagaaggttgtataaggttgtatgcggtatagtattttatactgtttatgtaagttaaaatacagcaaataagtttttgttgtttatggataccatagcacaggtgtcaactatgtaaagtgtgtaggctgtttttgaacagctcacaagctaagaatgacgtttacattttaa

SEQ ID NO: 134104 - DNA, 601 bp, Human
taatcatcagatttgcaaaaattaaaaagtctgacaaagtattggggaagatgtggagaaacagaaattttggtaaactgcagataggactataagttggtataactccttcggggaggaatgcagcagtaacaaaataggttgaatattatatagtcacacactagacacagtaattatactacaaggcatagattccagggaaaactgtcactcatgagcagcaggagacattaatagagagatgcttgttgctgcactttttgtaatagtgaaaatcataaaacaacccaaataggtrtcagtggggaaatggagaagtaaatgttaatatagacttacagtggaacacgatgcagcagttaagatgaatagtctgcctctacagagagcaacatatataagtttgatgggtaacaagttacagaaggttgtataaggttgtatgcggtatagtattttatactgtttatgtaagttaaaatacagcaaataagtttttgttgtttatggataccatagcacaggtgtcaactatgtaaagtgtgtaggctgtttttgaacagctcacaagctaagaatgacgtttacattttaaaag

SEQ ID NO: 134105 - DNA, 601 bp, Human
aacaacccaaataggtatcagtggggaaatggagaagtaaatgttaatatagacttacagtggaacacgatgcagcagttaagatgaatagtctgcctctacagagagcaacatatataagtttgatgggtaacaagttacagaaggttgtataaggttgtatgcggtatagtattttatactgtttatgtaagttaaaatacagcaaataagtttttgttgtttatggataccatagcacaggtgtcaactatgtaaagtgtgtaggctgtttttgaacagctcacaagctaagaatgaygtttacattttaaaagtgtaaaaacaaccaaaacatgttacatagactccacctgaccctcaagttttaaaatatttctatttgctcctttactaaaaaagttttctggtttctgcagtacagatgatctgtgtgcccagggccatgccctccatgccctccagcccaagcttggtagacagctccctgaaggccacctctgactttcctgccccaggagttattcttgtgccttggaacttcagttcttcctgggggcagcctgaaacatcagggattaacacactggaggcaaccaca

SEQ ID NO: 134106 - DNA, 601 bp, Human
ggataccatagcacaggtgtcaactatgtaaagtgtgtaggctgtttttgaacagctcacaagctaagaatgacgtttacattttaaaagtgtaaaaacaaccaaaacatgttacatagactccacctgaccctcaagttttaaaatatttctatttgctcctttactaaaaaagttttctggtttctgcagtacagatgatctgtgtgcccagggccatgccctccatgccctccagcccaagcttggtagacagctccctgaaggccacctctgactttcctgccccaggagttattcytgtgccttggaacttcagttcttcctgggggcagcctgaaacatcagggattaacacactggaggcaaccacagccactgggaatgtgaatcagtggatgacgatttccatatcttcctcttcaaccaaggagcagtgctgaggcatgttcttcatggtccctcacagggacccagcagaattgagccattttgcctaacttggtgaccggctccagaacatgccctttactgaccttccctttccctgccccacccctctcttctggctccttccctctgtttgctggaaccatcaccc

SEQ ID NO: 134107 - DNA, 601 bp, Human
tccccttgctcccgaccccagacaagccccagtgtgtgatgttccccttcctgtgcccatatgttctcactgttcagctcccacttattagtgagaacatgcagtgtttggttttctgttctagtgttggtttgctgagaatgatggtttccatcctcatccatgtctctgcaaaggacatgaactcattattttttatggctgcatagtattccatggtgtatatgtgccacattttctttatccagtctatcattgatgggcatttgggttggttccaagtctttgttactgtgaatastgtggcaataaatatacatgtgcatgtgtctttatggtagaatgatttataatacttttggtatatactccgtaatgggattgctgggtcaaatagtatttttacttctagatccttggggacttgtcacactttccacaatgacaaatttatactccaactaacagtgtaaaagtgttcttgtttctccatatcctctccagcatctgttgtttcctgacttttaatgatcattattgtaactggcatgagctggtatctcactgtggttttgatttgcatttctctaatgaccggtga

SEQ ID NO: 134108 - DNA, 601 bp, Human
ttccatatgacatttaaagtagttttttctaattctgtgaagaaagtcaatggcagcttgatgggaatagcactgaatctgtaaattactttgggcaatatggccgttttcatgatactgattcttcctatccatgagcatggaatgttttcccatttgtttgtgtcctctcttatttccttgagcagtgtcatgtacttctctttgaagaggtccttcacatcccttgtaagttggattcctaggctttttattctctttgtagcaattgtgaatgggagtttactcatgattgggctcwctgtctattattggtgtatgggaatgtttttgattttttgcacattgatttttttaatcctgagactgctgaagttgcttatcagcttaaggagtttttgggctgagatgatgggattttctaaatatccagtcatgtcgtttgcaggcagagacagtttgaattcgtctcttcctgtttgaatacactttatttctttctcttgcctgattgtcttggccagcacttccaatactatgttgaataggagtggtgagagagggcatccttatcttgtgccggttttcaaagtgaatgctg

SEQ ID NO: 134109 - DNA, 601 bp, Human
tgtcctctcttatttccttgagcagtgtcatgtacttctctttgaagaggtccttcacatcccttgtaagttggattcctaggctttttattctctttgtagcaattgtgaatgggagtttactcatgattgggctcactgtctattattggtgtatgggaatgtttttgattttttgcacattgatttttttaatcctgagactgctgaagttgcttatcagcttaaggagtttttgggctgagatgatgggattttctaaatatccagtcatgtcgtttgcaggcagagacagtttgamttcgtctcttcctgtttgaatacactttatttctttctcttgcctgattgtcttggccagcacttccaatactatgttgaataggagtggtgagagagggcatccttatcttgtgccggttttcaaagtgaatgctgccagctttttgcccattcaatatgatattggctgtgggtttgtcataaatagctcttattattttgagataggttcaatcaatacctggtttattaagtgttttagcatgaaggagtgttgaattttacaaaggccttttctgcatctattgaagatactctc

SEQ ID NO: 134110 - DNA, 601 bp, Human
aaggagtgttgaattttacaaaggccttttctgcatctattgaagatactctcctaaattttaaataacaggtcaaacatgatctaagttgctctaaatatgacgtgaattgatggtaattcaacaaagtgcaaaattttcaggaaactatagttctttgggaaatttcacttagacttcagaaaattaaatctcactgaagatttcaatatgctgtgtaaggagaggaaccaaaacaaaaggacaaaaacagttttttaaataagtgcacacttaggcttacttagagaacgggatgttyttattagcagatttgggacttgaggcatgcaaaactttcagagagagccatatgttcttatgcatgccagccttgcgacagtcacgattctgtggttctgcagatgaaagcaaaacgttgtatagtccttgtggcaggaatgataccttttcctaaagcagcgtcctttggttatgccaagctgttatttggctgagtggctttgcactaaatatatctagagcgatgttttaaaattataaatcttatgtttctccctgctatggactgaatgtttgtgttcccccaaatatacgttga

SEQ ID NO: 134111 - DNA, 601 bp, Human
agggtagaaccctgctgatggaatttgtgcccttaaaagaagaggaagaggaaaagggagggaggtggggggaggtagggaagagagagagagagaaagagagagagagagacagacagagagagagagagagcatctttctctctccacacaaccacagaggaaggtttatgtgaggacacagtgagaaggcaaaggcagcgtcatgcaagccaggaattgagcgttcaccaaaaaccaaccatgttggcactcttatcttgggcttctagttctagaaccacaagaaggtaaaattctrttgtttaagcttacccggtctctggtattttgttatgacagcccaagctgactgatagactccctcatcgctgttaggatggaagccttagtttagtccaaaggggcttgcaggttctggcttttgccagtgtcttcagcttcatctcaagtgctctctccctccctctctgatttgcatcggtgctggtctcttggaggagctatgctttccctatttaccccctgggcttttggacatcctcctcacagtatcctcagtgccggacatacaaaagacattcagtgactatttttaaat

SEQ ID NO: 134112 - DNA, 601 bp, Human
ggagctatgctttccctatttaccccctgggcttttggacatcctcctcacagtatcctcagtgccggacatacaaaagacattcagtgactatttttaaatgaacaagtggtagaaattagaaggtagtcaggttctgacctgtgatggcagaggaggagatactgtgatagggaaacaagcatataaaaaaggcaacacatttgactgttgtgtctgatcatgactgttttaaatgacatgagtgttgagtaggccaactcactttcactctttttttggacttcatcatattctcaayaacaatcataacagcacattaatattaccctttaaaaaataacctgtttaaggtagtactgttggagatggtgaccggagttgttgctaattactctttttttctgtaactgccttttgccctcaaggtttgccactggaagaggcatatctggtgggaaagaggaaaagacaaatgcatggtggttcaggggaatgatatcaaagagaattaattagaaattggaagttaaaggaaggataagcagatcaaattagtatagaggttggtatactgttccactgcctccttgtctgttaa

SEQ ID NO: 134113 - DNA, 601 bp, Human
taaatgaacaagtggtagaaattagaaggtagtcaggttctgacctgtgatggcagaggaggagatactgtgatagggaaacaagcatataaaaaaggcaacacatttgactgttgtgtctgatcatgactgttttaaatgacatgagtgttgagtaggccaactcactttcactctttttttggacttcatcatattctcaacaacaatcataacagcacattaatattaccctttaaaaaataacctgtttaaggtagtactgttggagatggtgaccggagttgttgctaattactctttttttctgtaactgccttttgccctcaaggtttgccactggaagaggcatatctggtgggaaagaggaaaagacaaatgcatggtggttcaggggaatgatatcaaagagaattaattagaaattggaagttaaaggaaggataagcagatcaaattagtatagaggttggtatactgttccactgcctccttgtctgttaatgtattctggagcatatatcaggcctacattaggcactgggaaagagggatgaacaagatcaaaatcactgccttgcaggaactcagaaagtttgta

SEQ ID NO: 134114 - DNA, 601 bp, Human
aaccagtctcttaagtcttttctttctaaatattcctctgtctcttcctctcaggtctcacttgaacaactaaaggggcagcctcctagaatcctggtattcactacctaccactcactggcagatgttgacattagcacattactaagcctaagcagaattaagagaaaaggaagccattagtgccaggttggaatcctgcaataggacttagcacctgtcctcagtttaatgtatgagtataagcaccctgaatctatagaaaatccagaaatgtccattatttataaaatgctccctrtatatttgtgtttgtgcatgtgtgagatttgtatttatgtaagagtatgacatatagctacagttgacccttgaacaatacttacttgaactgtggggtccacttatacatgaattttttttttcaaccaaacgtgggtggaatatagaatattcatgggatgtgagccctgcctatgcagaggaccaactttttgtatatgtgggttctacagggccaactgagggacttgagcatataagattttggtagacacaggggttctaggttctagaaccaatcccctgcatacactgaggg

SEQ ID NO: 134115 - DNA, 601 bp, Human
ctagaatcctggtattcactacctaccactcactggcagatgttgacattagcacattactaagcctaagcagaattaagagaaaaggaagccattagtgccaggttggaatcctgcaataggacttagcacctgtcctcagtttaatgtatgagtataagcaccctgaatctatagaaaatccagaaatgtccattatttataaaatgctccctgtatatttgtgtttgtgcatgtgtgagatttgtatttatgtaagagtatgacatatagctacagttgacccttgaacaatacttayttgaactgtggggtccacttatacatgaattttttttttcaaccaaacgtgggtggaatatagaatattcatgggatgtgagccctgcctatgcagaggaccaactttttgtatatgtgggttctacagggccaactgagggacttgagcatataagattttggtagacacaggggttctaggttctagaaccaatcccctgcatacactgagggacaactctgttggcacagagttgattgaggcagtaggaaatgggaagataaagctggcagctctttccacacatggaaagcataa

SEQ ID NO: 134116 - DNA, 601 bp, Human
tgtttgtgcatgtgtgagatttgtatttatgtaagagtatgacatatagctacagttgacccttgaacaatacttacttgaactgtggggtccacttatacatgaattttttttttcaaccaaacgtgggtggaatatagaatattcatgggatgtgagccctgcctatgcagaggaccaactttttgtatatgtgggttctacagggccaactgagggacttgagcatataagattttggtagacacaggggttctaggttctagaaccaatcccctgcatacactgagggacaactctrttggcacagagttgattgaggcagtaggaaatgggaagataaagctggcagctctttccacacatggaaagcataataggaaagaagggcttaagttagcaggtaggtggtgtgggattcagggacattactctgcgtatatgtttcatctattgcagcagcctttcctgttacatacttataccctgtgggggcagtggacaagtacagttctgatacctgagactgtgcgaagaaagcaagccaggaatttgtgtgataggggagactccacaatttctcgtttgattcagcataagc

SEQ ID NO: 134117 - DNA, 601 bp, Human
ttctacagggccaactgagggacttgagcatataagattttggtagacacaggggttctaggttctagaaccaatcccctgcatacactgagggacaactctgttggcacagagttgattgaggcagtaggaaatgggaagataaagctggcagctctttccacacatggaaagcataataggaaagaagggcttaagttagcaggtaggtggtgtgggattcagggacattactctgcgtatatgtttcatctattgcagcagcctttcctgttacatacttataccctgtgggggcagyggacaagtacagttctgatacctgagactgtgcgaagaaagcaagccaggaatttgtgtgataggggagactccacaatttctcgtttgattcagcataagcctgcattgttggggtatctccaggaagtcagccccagtgcaggcagcagacctcacggcatagggtggaagcaaagtggagcatctgtcagtgcatagccttcttaagcaatgatgagctgcttagcattcaggacattcagcccaagattataaatgaaatgtgtttgtgtgtttatatgtgtgtgtatgtatgtat

SEQ ID NO: 134118 - DNA, 601 bp, Human
cagtgcaggcagcagacctcacggcatagggtggaagcaaagtggagcatctgtcagtgcatagccttcttaagcaatgatgagctgcttagcattcaggacattcagcccaagattataaatgaaatgtgtttgtgtgtttatatgtgtgtgtatgtatgtatggatatgtatgtctgccctgtcactggaaggctttttaaattttttgatttagatcatagaatttctagagatactaattttcaaattttatacctcagacaggaatccatctttctgagttttgtgtagttatatktttggtcctaatttgtcagtaaacaggacttttatttcctccatagagaagtcagtgatttttctgtctggggtgtcttcttgcatgccccctggttgtccatccactttcatgactacctctgcagtctcttcatatctctttcttattgttacctaaggtaaagcttacgatttattattgtatctgtgagcatggtgccagtagcttcctttggcttaggaaggaagaacatttatctcaggatagagcttcactgccacatttggtgacataaaatgctatatggagaactgacta

SEQ ID NO: 134119 - DNA, 601 bp, Human
tcatatctctttcttattgttacctaaggtaaagcttacgatttattattgtatctgtgagcatggtgccagtagcttcctttggcttaggaaggaagaacatttatctcaggatagagcttcactgccacatttggtgacataaaatgctatatggagaactgactatactgaggtgtgaaatacatgtaggaagtctctcaaatacattcagatatccatcggcttgcagtttgtccctgatgttggctttctgtgaagctgaagtgcctaccttgaatggatggaaaaaaactgtccragtctttgtgccctgtagccgtcaattactgtacttttcatgagcattgcctgtggttccaaatgatatttctataggcagaaagtgagatggaagagggaaatattgtacacaaaaatatgaggatgtgaacagagcaggactgttcacaatagcaaagacttggaaccaacccaaatgcccatcaatgatagattggataaagaaaatgtggcacatatacaccatggaatactatgcagccataaaaaaggatgagttcatgtcctttgcggggacatagccgaagctggaaaccat

SEQ ID NO: 134120 - DNA, 601 bp, Human
cgtcctctgagcttgcttatactcattagggaaacttctttgactgttatgacctctttctttcctgattatccctttactttctgttttttggttttggtcgttttcgttggttctttccctgcctcgtctttaattgttggtgatgctcagggttccttccttgactcagctgtactctggagatgcatgttctccctgagcagtcgcctttgagctctggcaacacactctcctgtgcatatgccacatgttttgcttgtttgctttttgtcatgtaggaacttctgtgtaataaagsttcttccctaatcccatgtctgttcatctggcttacttactcctttcagaatcagcccagcctacaggaagcttttcccagcctactcttctctctcaactatgttctaattgtccatgagggtattctgtactttggttaatgtatgtacaccattgtattgaaatgatttgtttatatatacagtcatctaaacaaaactgcaggttcccagacagcatgtgcctgttttatttgcatttaaaaccttcagtgcttgcaaagtcccaggtatatagtaggcattcaatttgagtgctg

SEQ ID NO: 134121 - DNA, 601 bp, Human
ctatgaaaatgtataaaattttttcctattgccagggatgggaaactatggaaatgtcatccctgcttgctgaactgccctcttaaattgccccttatctgatgatgaactaaattatttgggggagttgaaaaatagagaaatgccagttattttttattcagcacattgtatatactcaaaacattttctgtaaggcaaaaacaggaaaccttgcaaacgaaactgtgggtaatatgtagttataaaccatctttccaggaaggagctgaaagctctgcatgatccctctattataaakttttccaactccttttgaaggatgttaagtaatttgccccatagtctatgggaatttttcacctcggggaaatggggctgagaaagttattacttttaaccccagtgaaccacaccagaaacagttacagcatcatacaaatcaatttctgcattttccataaagtgtttggcaaggaacaaaataggctggaagctgggaaaaaggccaagtacttaactcactcaaactcattttaaagtttttagctctagatattcaaagaaaatcagtgttcatcctgttgaattcatgggaaca

SEQ ID NO: 134122 - DNA, 601 bp, Human
cccatagtctatgggaatttttcacctcggggaaatggggctgagaaagttattacttttaaccccagtgaaccacaccagaaacagttacagcatcatacaaatcaatttctgcattttccataaagtgtttggcaaggaacaaaataggctggaagctgggaaaaaggccaagtacttaactcactcaaactcattttaaagtttttagctctagatattcaaagaaaatcagtgttcatcctgttgaattcatgggaacatcattgttttttatattatataaaaggaaactttccarttttcttaaatatacaattttttgatagtgagaaataaaattaactcaatttagatagacaaaatgcctttactcattttctaagaaaatcttaaatttccggataggaaaataaatatatattttttgaaatccattttcaaaacatcatggcatttaagcattccaacttaatgacagctgagaaagactgctgtgagacatatactgcgtaaagtgaatccaccctgtctattatacatggggataccaccatctggaaaaacaagatctatgtatatttagccaaataccaaaaga

SEQ ID NO: 134123 - DNA, 601 bp, Human
gaaagttattacttttaaccccagtgaaccacaccagaaacagttacagcatcatacaaatcaatttctgcattttccataaagtgtttggcaaggaacaaaataggctggaagctgggaaaaaggccaagtacttaactcactcaaactcattttaaagtttttagctctagatattcaaagaaaatcagtgttcatcctgttgaattcatgggaacatcattgttttttatattatataaaaggaaactttccaattttcttaaatatacaattttttgatagtgagaaataaaattawctcaatttagatagacaaaatgcctttactcattttctaagaaaatcttaaatttccggataggaaaataaatatatattttttgaaatccattttcaaaacatcatggcatttaagcattccaacttaatgacagctgagaaagactgctgtgagacatatactgcgtaaagtgaatccaccctgtctattatacatggggataccaccatctggaaaaacaagatctatgtatatttagccaaataccaaaagaatactgctgaaatttcactctcctgtttccctctaagtatttga

SEQ ID NO: 134124 - DNA, 601 bp, Human
tgcgtaaagtgaatccaccctgtctattatacatggggataccaccatctggaaaaacaagatctatgtatatttagccaaataccaaaagaatactgctgaaatttcactctcctgtttccctctaagtatttgatatgtcatcaagtattgtattgtattgtattgtattgtattttttaaatgttttggtactttactaaataacaaagaacttttgcacagagtcagaggatggtcttttatttattatcagaggtgatgcctttctataaatattgagaatacagtagtgtcctayagggatagctatttcgtctttctaaagagcttgtgcattaagtaatgttgttctttaataatgcacttaaattacatttagatttttttgctaaatgtgtgaaatcagtttaaaattccatctttcatttaagactgcttattaaggaataataatcccttatttaaattatgatttttgacagttgacaaagtgcttttacacatattttctcatctaattctaaaaacagatctagtgttagatgatgttggttttcattcctgaggtgaagaaattgaggcagcaagagtttaggca

SEQ ID NO: 134125 - DNA, 601 bp, Human
aaatcagtttaaaattccatctttcatttaagactgcttattaaggaataataatcccttatttaaattatgatttttgacagttgacaaagtgcttttacacatattttctcatctaattctaaaaacagatctagtgttagatgatgttggttttcattcctgaggtgaagaaattgaggcagcaagagtttaggcattttctttttcacgcaactattaggtgacatttccaagactggaattcatgtgtcttgactctaaatccaatttttaaaaacccttgcctaaagtggctctyatttactgaattgtcaacggtattctttgtacatataaataaattattttatggattgccccataatgcagattaggcaggataatttatgaattctgatttctactcttaaaacctatgcatacttaatttatagaatgttaattaaagtaattctgttttaatatgagtaaaattatggtgatttttcaaaaaagtattttggaaaagtattatgtttattttctatcaaatgtatgtgggtatacacacaaaaacacatttgcctacatatgtgtgtgtttatatatgcaaatatgt

SEQ ID NO: 134126 - DNA, 601 bp, Human
gactctaaatccaatttttaaaaacccttgcctaaagtggctctcatttactgaattgtcaacggtattctttgtacatataaataaattattttatggattgccccataatgcagattaggcaggataatttatgaattctgatttctactcttaaaacctatgcatacttaatttatagaatgttaattaaagtaattctgttttaatatgagtaaaattatggtgatttttcaaaaaagtattttggaaaagtattatgtttattttctatcaaatgtatgtgggtatacacacaaaracacatttgcctacatatgtgtgtgtttatatatgcaaatatgtgcatatgcatataaactaaaatacatgtatttagacggtagcaagattaagaaaataattaggtcattaatactaattgcagttgtaatgaaagttgtatagtggatgaatgcagaatagttaaaatgaagatagaattttctttagccttggctgtaagtaaaatgtaatacatcacacagtttgttgaattttcttactctttccctgtttttgatagagtaaaagatatactttggagtggagattaaactct

SEQ ID NO: 134127 - DNA, 601 bp, Human
atttactgaattgtcaacggtattctttgtacatataaataaattattttatggattgccccataatgcagattaggcaggataatttatgaattctgatttctactcttaaaacctatgcatacttaatttatagaatgttaattaaagtaattctgttttaatatgagtaaaattatggtgatttttcaaaaaagtattttggaaaagtattatgtttattttctatcaaatgtatgtgggtatacacacaaaaacacatttgcctacatatgtgtgtgtttatatatgcaaatatgtrcatatgcatataaactaaaatacatgtatttagacggtagcaagattaagaaaataattaggtcattaatactaattgcagttgtaatgaaagttgtatagtggatgaatgcagaatagttaaaatgaagatagaattttctttagccttggctgtaagtaaaatgtaatacatcacacagtttgttgaattttcttactctttccctgtttttgatagagtaaaagatatactttggagtggagattaaactcttaagagatacagaccaatgccgactcatagttaagggtccttatt

SEQ ID NO: 134128 - DNA, 601 bp, Human
ataaattattttatggattgccccataatgcagattaggcaggataatttatgaattctgatttctactcttaaaacctatgcatacttaatttatagaatgttaattaaagtaattctgttttaatatgagtaaaattatggtgatttttcaaaaaagtattttggaaaagtattatgtttattttctatcaaatgtatgtgggtatacacacaaaaacacatttgcctacatatgtgtgtgtttatatatgcaaatatgtgcatatgcatataaactaaaatacatgtatttagacggyagcaagattaagaaaataattaggtcattaatactaattgcagttgtaatgaaagttgtatagtggatgaatgcagaatagttaaaatgaagatagaattttctttagccttggctgtaagtaaaatgtaatacatcacacagtttgttgaattttcttactctttccctgtttttgatagagtaaaagatatactttggagtggagattaaactcttaagagatacagaccaatgccgactcatagttaagggtccttatttaacttacatgcaatttttggttttagaataattcatt

SEQ ID NO: 134129 - DNA, 601 bp, Human
agagccacccctagaggatggaatgtcttctgcgtagaggtgacagctaactgggggaggatgagtcattattggaaagcaggacaacatcctttgggctgagaacagtggccatttatttaagctgtcgctggctggtggtcctctttgacatttttcttatttggtatatggaaaaaatatagcataagacatccactactgcaggcttaaaattaagacttttaatttaaaacgtgagttgattgtattatttattttcttttttgaaatttgagctgtttgaaataccatcccagartgaggtgagcagtcttatttgccttgatttatgctacctctaagtcatcttaacattagtattcacaaaactacattgcagtgaaattcaacaaatctttactgaatacctcttatgaggaagacgataaagaataagaggaaaatgagatttttagtttgtttggaatacagagtgtatgggaagtataatagattagaagtataaagtctcaatgctgtactaaatgggcaccattaaaggttttgaaccatcaatgtttttaggtttttaaatggtacaggagagttgtttttagga

SEQ ID NO: 134130 - DNA, 601 bp, Human
tgtcgctggctggtggtcctctttgacatttttcttatttggtatatggaaaaaatatagcataagacatccactactgcaggcttaaaattaagacttttaatttaaaacgtgagttgattgtattatttattttcttttttgaaatttgagctgtttgaaataccatcccagagtgaggtgagcagtcttatttgccttgatttatgctacctctaagtcatcttaacattagtattcacaaaactacattgcagtgaaattcaacaaatctttactgaatacctcttatgaggaagaygataaagaataagaggaaaatgagatttttagtttgtttggaatacagagtgtatgggaagtataatagattagaagtataaagtctcaatgctgtactaaatgggcaccattaaaggttttgaaccatcaatgtttttaggtttttaaatggtacaggagagttgtttttaggagttgtttttagttttttggatgatacagggggacatattggttcacttgttctgtttgattcgcatatcttttgcttttaaataggtgaacagtttctcaaatggcaaatatgttagtcaaagta

SEQ ID NO: 134131 - DNA, 601 bp, Human
ttgtgacttggaaaaatagcccagagaacaatatagatgttatttttaatattactttttcccccaggaatctaattacgtaagaaattttttatatcaaccaaccattcaggccagtataagtgtatcagtacataactgctaataacatcattcgctatatttggtgaactgtctctctcagcagctcaaatgtcagtttttatagagaagaggaaagctctctcttgttcgcattctcattgaggcactcctccctccttcttcctttccctctcttcttccctctctcttttgtgaccacacacacacacacacacacacacacaccccaaatagttaaagccaatggattgatgatttgaccccgttgtgttatcaagactagttctgaattactaatggccagtgggatccaagtatctcatttgatagagtgatgcagctactgtggtgctatgctgtggatggatgcaagaagaggggaaattaaaatcactctatatttaacagtataggattgaaagtgtgatgtaggcccttgtgcttttgataagggaaatggtttattcactagagttggtcaaaatgtgattaacac

SEQ ID NO: 134132 - DNA, 601 bp, Human
tgtggtgctatgctgtggatggatgcaagaagaggggaaattaaaatcactctatatttaacagtataggattgaaagtgtgatgtaggcccttgtgcttttgataagggaaatggtttattcactagagttggtcaaaatgtgattaacacagggttaccaggattctctattaatgaaagcatctctcagctatatatttccttgtgtgtctgttttttaaatgaaattaaatatcacaggtcacaggtcacatgaaggggtctatctataatgattctctttgacaacaaatggaatwttggaatatagtgagtttcctgacattggagacagccatgtagaatggagacaacaattgatttggggttttgtagaaaatattttttattgtgtgggaattcagctagattagagtttcctagcccaaatttaatggtaaaccatgtacttgaaaaataagacaagaggggactgacatgtgagccagaactgttgtcactgagcaaaatgagagatagggaatcagtgtgacagtaaaaattggtttggtgatagggacaatattaataacctttaagaccccctctattcatgagtt

SEQ ID NO: 134133 - DNA, 601 bp, Human
ctggaaaaactgcttctaattcttcctagctaaagatgtctactatacacaagtatcggactttatgcaaccctctcttttctcatcttcaatgtagtaataataaatgttctatatagttctctgggtacacatattaaatgataaattgaaagtatgtgtcagtgatacaaatttaataacctttcactttgaatcattgccctttatctacctaagattgtattatgtcaaggaaaattgccagcttcttcttaaagtatgaaataacagttaaataaactgatgggagaaactgtgrtatggtaaacagatatacactttattggtgagagataggaactaggatttattgtataccatgtaggttcagacatatgctcttataattcttatgccatttaattttcataaccgctctgtgtacctatcaaggaatggaggggtcagtccatgtcatgctcttccactgcgccatatttctcctatttctactgatgggatggaatgggtgacatctggtatgcagggccagagtgatgatagaattccaacttgtggctgtcctaagagtggtctcttctgagtgttttcccgatgg

SEQ ID NO: 134134 - DNA, 601 bp, Human
atgtagtaataataaatgttctatatagttctctgggtacacatattaaatgataaattgaaagtatgtgtcagtgatacaaatttaataacctttcactttgaatcattgccctttatctacctaagattgtattatgtcaaggaaaattgccagcttcttcttaaagtatgaaataacagttaaataaactgatgggagaaactgtggtatggtaaacagatatacactttattggtgagagataggaactaggatttattgtataccatgtaggttcagacatatgctcttataattsttatgccatttaattttcataaccgctctgtgtacctatcaaggaatggaggggtcagtccatgtcatgctcttccactgcgccatatttctcctatttctactgatgggatggaatgggtgacatctggtatgcagggccagagtgatgatagaattccaacttgtggctgtcctaagagtggtctcttctgagtgttttcccgatggcaggaagtgggagtgaaggacagatagagggggtaagcaacacagctcaggtcccccaacaaggagatatcagagcattcctggccaggag

SEQ ID NO: 134135 - DNA, 601 bp, Human
tgagagataggaactaggatttattgtataccatgtaggttcagacatatgctcttataattcttatgccatttaattttcataaccgctctgtgtacctatcaaggaatggaggggtcagtccatgtcatgctcttccactgcgccatatttctcctatttctactgatgggatggaatgggtgacatctggtatgcagggccagagtgatgatagaattccaacttgtggctgtcctaagagtggtctcttctgagtgttttcccgatggcaggaagtgggagtgaaggacagatagagggggtaagcaacacagctcaggtcccccaacaaggagatatcagagcattcctggccaggagatggagcagggtatccaggggccctttggaatgaggtaaaccaggttgttgctgagcttactgtgggttggtcatggtaggaatcttctcaaagaccctcaacctagctgctattgaaggaaatgaaaaaccatactttgatatctgtgtgcgataactttatgtaatacagtgacaacttagggaaaagcatctatctttacaattagggtattttaaagggaatgaaaaggtcttc

SEQ ID NO: 134136 - DNA, 601 bp, Human
gataggaactaggatttattgtataccatgtaggttcagacatatgctcttataattcttatgccatttaattttcataaccgctctgtgtacctatcaaggaatggaggggtcagtccatgtcatgctcttccactgcgccatatttctcctatttctactgatgggatggaatgggtgacatctggtatgcagggccagagtgatgatagaattccaacttgtggctgtcctaagagtggtctcttctgagtgttttcccgatggcaggaagtgggagtgaaggacagatagagggggwaagcaacacagctcaggtcccccaacaaggagatatcagagcattcctggccaggagatggagcagggtatccaggggccctttggaatgaggtaaaccaggttgttgctgagcttactgtgggttggtcatggtaggaatcttctcaaagaccctcaacctagctgctattgaaggaaatgaaaaaccatactttgatatctgtgtgcgataactttatgtaatacagtgacaacttagggaaaagcatctatctttacaattagggtattttaaagggaatgaaaaggtcttcgtgcc

SEQ ID NO: 134137 - DNA, 601 bp, Human
gtatttaatttgaatcattatttcagaatataaaagtgtatctaatttttttattttattttttgagacagagtctcgctgtcgcccaggctggagtgcagtggtgggatctccgctcactgcaggctccgccccgctgggttcacaccattctcctgcctcagcctcctgagtagctgggactacaggtgcccgccaccacgcccagctaatttttttgtatttttggtagagacggggtttcaccgtgttagccaggatggtctcaatctcctgacctcgtgatccacccgcctcggcytcccaaagtgctgggattacaggtgtgagtcactgcgcccggccctaattttttatgaacatgaattttacatgtggttagtgactgtttgcatttgttatttgacaaacataaaatgtatcataatggaaaatgatcaagtagcaaagaaatgccttcaacagctttctatatgttttggcttatgtacttaaggatgtagacagctttatgagacagactatactatacaagtacttttgtctgaagattagctgggctgagactttttttcttttcataacagtttgatagatgttt

SEQ ID NO: 134138 - DNA, 601 bp, Human
tgtatctaatttttttattttattttttgagacagagtctcgctgtcgcccaggctggagtgcagtggtgggatctccgctcactgcaggctccgccccgctgggttcacaccattctcctgcctcagcctcctgagtagctgggactacaggtgcccgccaccacgcccagctaatttttttgtatttttggtagagacggggtttcaccgtgttagccaggatggtctcaatctcctgacctcgtgatccacccgcctcggcctcccaaagtgctgggattacaggtgtgagtcactgygcccggccctaattttttatgaacatgaattttacatgtggttagtgactgtttgcatttgttatttgacaaacataaaatgtatcataatggaaaatgatcaagtagcaaagaaatgccttcaacagctttctatatgttttggcttatgtacttaaggatgtagacagctttatgagacagactatactatacaagtacttttgtctgaagattagctgggctgagactttttttcttttcataacagtttgatagatgtttgtgattatctgttcaatagcccatttaggactaggt

SEQ ID NO: 134139 - DNA, 601 bp, Human
ttgacaaacataaaatgtatcataatggaaaatgatcaagtagcaaagaaatgccttcaacagctttctatatgttttggcttatgtacttaaggatgtagacagctttatgagacagactatactatacaagtacttttgtctgaagattagctgggctgagactttttttcttttcataacagtttgatagatgtttgtgattatctgttcaatagcccatttaggactaggttgaagaagcagcagttttctgcataggtagcatttgagatccattatcagagggaaatgattattrtatgatgctgttgtcccttagaactttcaagaggaaaatgttaggattaggtagttatataatgatttgtttgatagaaggagcactgaggttgaaatcagaagatacaaatttgaatgcttgcttctatacccaccagatgcatagcctttagtaagtttttcagaccctcagagccacagtttgctgctataaaaatgagactctccacctaagtcagggaatggttgtgagattacattagatgacatttgtgaaagtgcttaaaatttctaacacattttttaaagaaactgttta

SEQ ID NO: 134140 - DNA, 601 bp, Human
gcatagcctttagtaagtttttcagaccctcagagccacagtttgctgctataaaaatgagactctccacctaagtcagggaatggttgtgagattacattagatgacatttgtgaaagtgcttaaaatttctaacacattttttaaagaaactgtttataataattctcctttgtggttattttctacagaaagtgagtgagaaggttggaggagctgaaggaaccaagctagatgatgacttcaaagagatggaaagggtaagccttcactactgcctagtgttccctttgacataaamatgtctaccataattagaggagaagagaaaacgggagagggcaactgttttccactggtctctgagaatactacattttgttatttaaaactacttttcatgtatattttaaaacataaaatgtaaaatattctgtcttccctttgtactgtcctgaggacaaaacctcagtgaaggtgaaaggtcacgatgaactttttctggtgggtttcatcatcattttaaaaaaataaggacagtgttgagctgatgtttgaattagggtgagatgcgtagaaaagaagctgcagaatgacatcc

SEQ ID NO: 134141 - DNA, 601 bp, Human
acatttgtgaaagtgcttaaaatttctaacacattttttaaagaaactgtttataataattctcctttgtggttattttctacagaaagtgagtgagaaggttggaggagctgaaggaaccaagctagatgatgacttcaaagagatggaaagggtaagccttcactactgcctagtgttccctttgacataaaaatgtctaccataattagaggagaagagaaaacgggagagggcaactgttttccactggtctctgagaatactacattttgttatttaaaactacttttcatgtatrttttaaaacataaaatgtaaaatattctgtcttccctttgtactgtcctgaggacaaaacctcagtgaaggtgaaaggtcacgatgaactttttctggtgggtttcatcatcattttaaaaaaataaggacagtgttgagctgatgtttgaattagggtgagatgcgtagaaaagaagctgcagaatgacatcccaaatgtttttgggagagtttaagtcactttctggctttaaggaccttccttactggatgattggccagaggcagccatgtatagtggagagaatacagttttaga

SEQ ID NO: 134142 - DNA, 601 bp, Human
tattattattattgttattatttttttgagatggagtcttgctctgttgcccaagctggagtgcagtggcatgatcttggctcactgcaacctccgtctcctgggttcaagcgatctcctgcctcagctccctgagtatctgggattacaggcacgcaccaccacgtctggctaattattgtattttttgtagagatggggttttaccatgctggccaggctggtctcgaactcctaacctcaggtggtccgcctgcctcagcctcccaaagtgctgaggttccaggcatgaaccactgcrcccagcagagcccctttttaagtgaatgtaaaatgagaagactaatactcatttgggggattttagttaaggcttaaaaataatgtagattatttagctttctgcttaaaaggtaggttctcagcaagtgagggtagaagtgatgaacaaaacatctcattttatttttcttgggacatgagccatattttcgcttttacttttcttttactttaacgctcttcagaacaggtgatatttaggcttatgattaaaagtgtgtgttacattgtgcacagaaacattttaggtcttaagtgg

SEQ ID NO: 134143 - DNA, 601 bp, Human
ctgcatagtattgatccagctggtcattctggctaagttcttgagatagacctcactgatggatacccagtggtgaggagattttatactggaattctgagtcccagccttcagaagtctggaaaaccagactcttacagctgaggcctggcacctacttcctccaactggaccaaagtctgcattggttcctatttctcatctctggatggttctaaataccacctgatcctcaaccaaagctggtagccactaatatccatagttctggaaataatattttacccattcatcttctacrgcatctgagactccaggaactgacacacatttccagaaatgtcttgtctttgactcttctactgcccataaaattggagttcctcacgcttcatttgaacagcccatgggttaatccgcctctgtcttcacccagtcttgcttgatccctccttgtactttgatgctcctccttccccctcacccctggagagcatttatagtttgccacgtggccaatgtcatgtcattaatgaaagattaggcaggtatttaggaatttggaactaagtaccaggaatcagaatttgacacttccttt

SEQ ID NO: 134144 - DNA, 601 bp, Human
tttttaaggagcaactttgagttttaagaagagcaagttgttgagaaagaatgccatttcatatgagagtaagagaggattattggcagattcaggtgtggagaaagtccaataggaaaatgtccatggtcattatcttcatacactcagtcactgggtggagaggggttcaatttttctatccagcccaagtggtagagctagaattaatgagtagaaaccatggggagatagattctggctcaatataagaaaaacttttggctatcaaagctgggtttttggtgtgtgtgtttttgtrtgtgcgtgtgtgtgtgtgtgtgtgtgtgtgtgttttgcctcagcaatgactgaattccctatcactgcccatgtttgaccccctcgttcccaccgcccatgttggaacacacactgacctgctagttccctcccatcatgtgaggcacaccagtcatctcttgtgagttttgtggttagtaatttgttactaataatgtcactttttaatgatgtcactcttacttggattccagtgatctctctcaaatggggagagaaaggagtagagtttcagctggaatgctctgagcaacacgta

SEQ ID NO: 134145 - DNA, 601 bp, Human
actgacctgctagttccctcccatcatgtgaggcacaccagtcatctcttgtgagttttgtggttagtaatttgttactaataatgtcactttttaatgatgtcactcttacttggattccagtgatctctctcaaatggggagagaaaggagtagagtttcagctggaatgctctgagcaacacgtatccctgagtgcacccataatgtctccttcatggtgtgatgggaaaggaggaggcgtggagcattgtgctaagacacacccccccggtgtggggatgtaagaagggccagagcyccaaacaagatgagctttgaagacatctttttccttagtctgaaattcaatgatgacaagcttcctctgagttacatgtttgcaatatatagttccaagcttatattcattaaaggtaatgaccaagaagattaacagcaaaaaaaatacattggagcaatcacagcattctaataaccttgtttatttttgttttttaacacgttgtttgtcagttgggctttctgaaaacataagataatgctttaaatcaaagcagcttggggacagatggattaactcttctgagtcagcagggga

SEQ ID NO: 134146 - DNA, 601 bp, Human
gtgagttttgtggttagtaatttgttactaataatgtcactttttaatgatgtcactcttacttggattccagtgatctctctcaaatggggagagaaaggagtagagtttcagctggaatgctctgagcaacacgtatccctgagtgcacccataatgtctccttcatggtgtgatgggaaaggaggaggcgtggagcattgtgctaagacacacccccccggtgtggggatgtaagaagggccagagctccaaacaagatgagctttgaagacatctttttccttagtctgaaattcartgatgacaagcttcctctgagttacatgtttgcaatatatagttccaagcttatattcattaaaggtaatgaccaagaagattaacagcaaaaaaaatacattggagcaatcacagcattctaataaccttgtttatttttgttttttaacacgttgtttgtcagttgggctttctgaaaacataagataatgctttaaatcaaagcagcttggggacagatggattaactcttctgagtcagcaggggactattaaaaacatcactcttggacctgcctgtatctcgctgccagacaga

SEQ ID NO: 134147 - DNA, 601 bp, Human
ggagagaaaggagtagagtttcagctggaatgctctgagcaacacgtatccctgagtgcacccataatgtctccttcatggtgtgatgggaaaggaggaggcgtggagcattgtgctaagacacacccccccggtgtggggatgtaagaagggccagagctccaaacaagatgagctttgaagacatctttttccttagtctgaaattcaatgatgacaagcttcctctgagttacatgtttgcaatatatagttccaagcttatattcattaaaggtaatgaccaagaagattaacagcaaaaaaaatacattggagcaatcacagcattctaataaccttgtttatttttgttttttaacacgttgtttgtcagttgggctttctgaaaacataagataatgctttaaatcaaagcagcttggggacagatggattaactcttctgagtcagcaggggactattaaaaacatcactcttggacctgcctgtatctcgctgccagacagaccttcccaggacacggttttcatcatgtctctgtgattgtttattgagctgttcttgttcaggagtctcagtactttaagtgggtgtgta

SEQ ID NO: 134148 - DNA, 601 bp, Human
tgggctttctgaaaacataagataatgctttaaatcaaagcagcttggggacagatggattaactcttctgagtcagcaggggactattaaaaacatcactcttggacctgcctgtatctcgctgccagacagaccttcccaggacacggttttcatcatgtctctgtgattgtttattgagctgttcttgttcaggagtctcagtactttaagtgggtgtgtatgcattattaatagttgtagtttcttaacttcagtgacagaaaagttaagaatttgaaaatattttagtttttcatwtgcctttttaatatttcttttatgttaccactgtgagttacccattttcaagtgggtgtgtaattcatctacttatttatctaatttatttatttacttacttatgtggagattgaggtctcactctattgtccaggctggagtgtagtagctcagtcatagctcactatcacctcaaacttctgggctcaagtgattctcctgcctcagcctctcaagtagctaggactaccagcacacaccaccatgcctgcctaatttttattatttatttgatatttgaggtccaatttctttctt

SEQ ID NO: 134149 - DNA, 601 bp, Human
ggtattaagcctagtactcattagttatttttcccgattgtctccctcctcccaccctccaccctccaataggtcccagtgtgtgttgttcccctctgtgcgttcttgtgttctcatcatttttgtcccacttataagtgagaacatgtggtatttggttgtctcttcctgcattagtttgctaaagataatggcctccaggttcatccatgtccctgcaaagaacctgctctctctcttttatggctgcatagtattccatggtgtatacgtagcacattttctttatccagtctctcaytgatgggcatttgggttgattccatgtctttgctattacgaatagtgctgcagtgaacacatgtgtgcatgtgtctttataatagaacaatttatattcctttgggtgtatatccactaatgggattgctgggtcaaatggtatttctgtctttaggattttgaggaatcaccacactatcttccacaatggttgaactaatttacactcctaccaacagtgtataagcattcctttttctccacaaccttgtcagcatctgttgttttttgactttttatctcattgtggttttgattt

SEQ ID NO: 134150 - DNA, 601 bp, Human
tcctagttctgctaagaatcttaatggtagtctaataggaatagcattgaattcataaactgctttgagcagtatggccattttgatgatattgagtcttcctatccatgagcatggaacgtttttccatttgtttgtatcatctctgatttctttcagcagtgtttgtagttcttcttgtaaagaacttttggccgggtgcagtgactcacgcctgtaatcccagcactttgggaggctgaggtgggcagatcatgaggtcaggagatcgagaccatcctggctaacatggtgaaacccygactctactaaatatacaaaaaattagctgggtatggtggcaggcgcctgtagtcccagctactcgggaggctgaggcaggagaatggcttgaacccaggaggtggagcttgcagtgagccgagatcacgccactgtactccagcctgggcggcagagtgagactctgtctcaaaaaaataaaataaataaataactttcacctccctggttagctgtattcctaggtattttattatttttgtggcaattgtgaaggagattgttcctgagttggctcttggcttgactgttcttggtg

SEQ ID NO: 134151 - DNA, 601 bp, Human
agatcatgaggtcaggagatcgagaccatcctggctaacatggtgaaaccctgactctactaaatatacaaaaaattagctgggtatggtggcaggcgcctgtagtcccagctactcgggaggctgaggcaggagaatggcttgaacccaggaggtggagcttgcagtgagccgagatcacgccactgtactccagcctgggcggcagagtgagactctgtctcaaaaaaataaaataaataaataactttcacctccctggttagctgtattcctaggtattttattatttttgtggcawttgtgaaggagattgttcctgagttggctcttggcttgactgttcttggtgtataggaatgctagtgatttttgaacattgattttgtatcctgagactttgctgacattctttatcagcttaagaatctttttggctgagactgtggggttttctggacataggatcatgccgtctgcaaacatggatagcttgacttcctctcttcctacttggatgtgctttatttctttctcttgcctaattggcctggtcaggacttccaatactatgttaaataggaggggtgagagagggcat

SEQ ID NO: 134152 - DNA, 601 bp, Human
acctagcacaggaatcaagatttttttgtaagtgctttaggtttttggggccagagggtctctgtggtctcttacaactccttgccaatgctgtcaaaacacaaaagcgtccattgacagcgtttaaatgaataagtatggctgttttccaacaaaactttatctaaggatgctgaaatgtgaatttgaaatttgaataattattttgtgcagtaaaatagtagtctcatttcaaattttttcaaccatttaaagaagtagaaatggaagtttttattacctaaaaaacatgcctgtatcygtatatatttacagtttcactttcttttttttatttttattttttattatactttaagttctagagtatgtgtacatgtgcacagcttgcaggtttgttacatatgtatacatgtgccatgttggtgtgctgcacccattaactcgtcatttacattaggtatatctcctaatgctatccctcccccctccccccaccccacggcaggcccccatgtgtgatgttccccttcctgtgtccaagtgttctcattgttcatttcccacctatgagtgagaacttgcggtgtttggttttttg

SEQ ID NO: 134153 - DNA, 601 bp, Human
gaagacttaaatgttagacctaagaccataaaaaccctagaagaaaacctagacaataccattcaggacataggcatgggcaaggcattagacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaatctattcatctgacaaagagctaatatccagaatctacaaagaactcaaacaaatttacaagaaaaaaacaaccccatcaaaaagtgggcgaaggatatgaacagtttcactttctttaaacagccttccctaatggctcctcacaccaatcccaggcaaggttagttgaagacggaggctcaggagcttataagatgagaaattcttgtaatttaggatgcatcaaaacttactttcaaatagtaattggaaattttggacattgagaaaaataacagttacatgtcataagttcaaagttaaactgtactgttctcaaatggcaataagctcaattctgggagcttatgggaattgctagt

SEQ ID NO: 134154 - DNA, 601 bp, Human
caggacataggcatgggcaaggcattagacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaatctattcatctgacaaagagctaatatccagaatctacaaagaactcaaacaaatttacaagaaaaaaacaaccccatcaaaaagtgggcgaaggatatgaacagtttcactttctttaaacagcsttccctaatggctcctcacaccaatcccaggcaaggttagttgaagacggaggctcaggagcttataagatgagaaattcttgtaatttaggatgcatcaaaacttactttcaaatagtaattggaaattttggacattgagaaaaataacagttacatgtcataagttcaaagttaaactgtactgttctcaaatggcaataagctcaattctgggagcttatgggaattgctagttataataagttacttaagtggaaatcttctttatgctaagttaatcaggcctgttactaagag

SEQ ID NO: 134155 - DNA, 601 bp, Human
agagaagttagaaattagtcagcctcctactggcagatgacttcagaatgtgactaatcattggaccattcagttcttctggtacttttttaaagaaagcctctgattaatggccttgggaactacttttctcctcataacacacttaaagagctcctttcccttctctaggccacaggtgtggacatttaataaattaaagcgttaaacagaatgctcccctggtctcttcctcttatgtccatgaagtctatcaagtaattatctgtaagaatgcagccatgcctggtgcagtgactcwtgcctgtaatcccagcactttggaaggccaaggcggatggatcacttgaggccaggagttcgagaccagcctgaccaacatggcaaaaccccgtctctaccaaaaaatacaaaaattagccaggcatggtggtgcgtgcctctagtcccagcttcttgggaagctggggagggagaatcgcttgaacctgggaggaggaggttgcggtgagctgagattgctctactgcactccagcctgggggagagagtaagaccctgtctcaaaaaaaaaaaaaaaaaaaaaaaaaaaaaaaattgc

SEQ ID NO: 134156 - DNA, 601 bp, Human
tttttgaatgattttccttctcatcataactacaggatatttagacacatttgtcatctaattccttaattcccatcacataggcagcaggagatctacatttgtacttctatcacacatgtaccatggagtttcagcatatttgttccatacacacctttgatccatttccctggcataagacattctatgacttgagtacatagtggttgtttggaattttgctaatactaggaccttcacatatggcttcacaagttgtgtactgcacaactccagggggctactgagcatttttaarctaatcactacctggtacacactcaatcttaaagatctttgaaatttgaatcaatcaaaaggatatttatacaagatttatatgtagacaggcacatttgaaattgcatccttctaaagataattttatatcattataacttcacaagaaaaaatttgttttcctctgttgatcctagtaatagcaaacacacacagtaatatgactgccatggaatgaaaaattattaagtattgaaaaactgaactgaaagataaaatcttttaatgtgtggattatggaaaaggaggaggcttactt

SEQ ID NO: 134157 - DNA, 601 bp, Human
tccatttccctggcataagacattctatgacttgagtacatagtggttgtttggaattttgctaatactaggaccttcacatatggcttcacaagttgtgtactgcacaactccagggggctactgagcatttttaagctaatcactacctggtacacactcaatcttaaagatctttgaaatttgaatcaatcaaaaggatatttatacaagatttatatgtagacaggcacatttgaaattgcatccttctaaagataattttatatcattataacttcacaagaaaaaatttgttttyctctgttgatcctagtaatagcaaacacacacagtaatatgactgccatggaatgaaaaattattaagtattgaaaaactgaactgaaagataaaatcttttaatgtgtggattatggaaaaggaggaggcttactttatgcaaggctgatattatataccggtatatattatataccggtatatattggtatatactgatattatactggtatatactgatattatatactggtatatattatataccactaggtacagcaggttatggaaaagtttctcatagttgaagggggagcct

SEQ ID NO: 134158 - DNA, 601 bp, Human
gaccttcacatatggcttcacaagttgtgtactgcacaactccagggggctactgagcatttttaagctaatcactacctggtacacactcaatcttaaagatctttgaaatttgaatcaatcaaaaggatatttatacaagatttatatgtagacaggcacatttgaaattgcatccttctaaagataattttatatcattataacttcacaagaaaaaatttgttttcctctgttgatcctagtaatagcaaacacacacagtaatatgactgccatggaatgaaaaattattaagtaytgaaaaactgaactgaaagataaaatcttttaatgtgtggattatggaaaaggaggaggcttactttatgcaaggctgatattatataccggtatatattatataccggtatatattggtatatactgatattatactggtatatactgatattatatactggtatatattatataccactaggtacagcaggttatggaaaagtttctcatagttgaagggggagccttttaacaaacagaaaatttctccagtggacttaattgatacctaaatttctacattaaaatttaatcactt

SEQ ID NO: 134159 - DNA, 601 bp, Human
actgcacaactccagggggctactgagcatttttaagctaatcactacctggtacacactcaatcttaaagatctttgaaatttgaatcaatcaaaaggatatttatacaagatttatatgtagacaggcacatttgaaattgcatccttctaaagataattttatatcattataacttcacaagaaaaaatttgttttcctctgttgatcctagtaatagcaaacacacacagtaatatgactgccatggaatgaaaaattattaagtattgaaaaactgaactgaaagataaaatcttytaatgtgtggattatggaaaaggaggaggcttactttatgcaaggctgatattatataccggtatatattatataccggtatatattggtatatactgatattatactggtatatactgatattatatactggtatatattatataccactaggtacagcaggttatggaaaagtttctcatagttgaagggggagccttttaacaaacagaaaatttctccagtggacttaattgatacctaaatttctacattaaaatttaatcactttcatttatacctatgtcatatattacatgt

SEQ ID NO: 134160 - DNA, 601 bp, Human
caaacacacacagtaatatgactgccatggaatgaaaaattattaagtattgaaaaactgaactgaaagataaaatcttttaatgtgtggattatggaaaaggaggaggcttactttatgcaaggctgatattatataccggtatatattatataccggtatatattggtatatactgatattatactggtatatactgatattatatactggtatatattatataccactaggtacagcaggttatggaaaagtttctcatagttgaagggggagccttttaacaaacagaaaatttctscagtggacttaattgatacctaaatttctacattaaaatttaatcactttcatttatacctatgtcatatattacatgtacataccttgaataggaggatgcatttattctcattagtcatttaccatgtagggcgaataggaggcccacagatgctgataagaaaaggatttcttggagaaagacagagagcactgcagtgagcaccttccatgacctctttcaagtggggagaggggcctgacaaagagaacacggtgagatgctgaaggcaaacactgaccattccaaatttagaaa

SEQ ID NO: 134161 - DNA, 601 bp, Human
ggtgagatgctgaaggcaaacactgaccattccaaatttagaaatttagaggatagaacaaatttggaggatagactctagcatcaagatttttgtttagcattaaccaaaagttcaaggacagactagaagtctttgctcaagattttatatttttaggatgttcttagaagttaaataaaaagctccccacttcttgaataagcagagttgatgctgcatgattctttcttgagggcagcaaaatctgcctccatgcctgacccactgtaggcatccaataaatgcctctgggacaaartatgtttcattttattcaccttattttcaccagaaggtaatgaattatattttgaaacaaattttaggaaactacaagcttcttctttggataaacgggctttccacatcttggcagaccactgctgagtacagtgtcagcatgacttccagccgcgtctcagcctccctcacctactgcgggacttgtccggggctctgttgcataccccgccattgtatacagactcaaccaaaaaccggtattctaaagctcatcatttttgtcatttagagcacttattttctcatttcagaaagt

SEQ ID NO: 134162 - DNA, 601 bp, Human
tttagaggatagaacaaatttggaggatagactctagcatcaagatttttgtttagcattaaccaaaagttcaaggacagactagaagtctttgctcaagattttatatttttaggatgttcttagaagttaaataaaaagctccccacttcttgaataagcagagttgatgctgcatgattctttcttgagggcagcaaaatctgcctccatgcctgacccactgtaggcatccaataaatgcctctgggacaaaatatgtttcattttattcaccttattttcaccagaaggtaatgawttatattttgaaacaaattttaggaaactacaagcttcttctttggataaacgggctttccacatcttggcagaccactgctgagtacagtgtcagcatgacttccagccgcgtctcagcctccctcacctactgcgggacttgtccggggctctgttgcataccccgccattgtatacagactcaaccaaaaaccggtattctaaagctcatcatttttgtcatttagagcacttattttctcatttcagaaagtggatgtcaccagcagggctgtgatggaaataatgactaaaacaa

SEQ ID NO: 134163 - DNA, 601 bp, Human
atattttgaaacaaattttaggaaactacaagcttcttctttggataaacgggctttccacatcttggcagaccactgctgagtacagtgtcagcatgacttccagccgcgtctcagcctccctcacctactgcgggacttgtccggggctctgttgcataccccgccattgtatacagactcaaccaaaaaccggtattctaaagctcatcatttttgtcatttagagcacttattttctcatttcagaaagtggatgtcaccagcagggctgtgatggaaataatgactaaaacaattgaataccttcaacccaatccaggtaaggcatcatcttatatgtttaaaggatccctcgaggtaacttttagtttctctttgatagacattttaagtttggtgtgtttcttcttttggtgttgcttcctcggtccacttttctgagaggttagcgacttcatggatagcacattttaactggggagaagggctttttaaagctcacattgaagtaactggaagatctgtggtattttatctgactgtggtatatttaacaaataatgtatgcaaacagttcaggtgacacataatatcagag

SEQ ID NO: 134164 - DNA, 601 bp, Human
cagagggtttcttcatagggcatcaccaaagtcttcagagcgttgatcttgattctgattcttctccaagcacatcacagatcagcattggttcctgctaacttgttatactctaagaaaaagaagtggtaatagagataacggagctatatgttgataagaggaccaggcagagttggggcagtttcggtaggcactaggtatagcaaagcaaagcaaagcaaagcagcctacctgatagacctcctcattaccattcctgtgtgtcagtttctaaccacagggcatggaaacgggaagygaggctggttgtatttaagtgagatgtgtgaatatttggaataccccttaatcttgaggctagtttctttgcaagtttcaggttggggttccgtgtattttatggtcctagagaggatggtgcagacaactgcttcagccccaatgagtttggatactgagcaatagtggacaagtgatcaaaaaaaaaaaaaaaagggggcgggtgtgggctgagaggaagcaggtgtgtgctgtactaagtgctggctccttttctatgccccctgctgctggctgcagcttccttccatccttattc

SEQ ID NO: 134165 - DNA, 601 bp, Human
ttcttggtaaccactgtttttcacagagatgcaaagatctcttggatgcacatttattccttactgtttaaaccactgtcataggtcaagttctgaaagagaactgctcgccctgcttccccgcaagaaatcattatataggggcaagaagttttggtctttatctttgcctagaaccttgaagtactccatgatttcctgggattttcacgagttgtacttgtaactcatggttgtagggctaagagaaaggcagtgggaggaggaatatagtatttattgagcactgatgcattttcartgcagtgctaggtatatgaggcattgtctcatctttaaaagtaaccatttttctccatataaagtaaaaacagttgaagaatttctagtatgaaaatagactaaaaattcattgtaacacaaattatcagtgggagctcatcagttttcctgagtataatggaactgtgctctgttgtaggtaggtgtggtgggttgcatagtgtgtctccccaaattcaggtccatccagaactaaacttataaggaatgtgaccttatgtggaaataatccttgcagatgtaagtagtgatgtaggat

SEQ ID NO: 134166 - DNA, 601 bp, Human
gagctcatcagttttcctgagtataatggaactgtgctctgttgtaggtaggtgtggtgggttgcatagtgtgtctccccaaattcaggtccatccagaactaaacttataaggaatgtgaccttatgtggaaataatccttgcagatgtaagtagtgatgtaggatcttgagatgaactcttcctagatttagggtggcccctagaaccagtgatgggtgtccttatgagaagaggagaggacacagagaaacacaggaaagaaggccacgtgaagaatgagaagaggttgaagttacaygtcacgagcaaaggaatgccaggagccaccaccacaagctggaagacatgaggaaggattctctcagagcctccagagggaaccaactttgccgacaccttgatttcagacttccggtatgctgaactgtgagggaatcaattcttttctttgaggctgcccagtttgtggtcatttgaaatgacagctctagaaaactaatccagtacgctagcctcattttattcaggaaaaaacaagggtcagagaatttaaggaactttcccattcatacacctaggaagggatgaagacaagatt

SEQ ID NO: 134167 - DNA, 601 bp, Human
tccagtacgctagcctcattttattcaggaaaaaacaagggtcagagaatttaaggaactttcccattcatacacctaggaagggatgaagacaagattggaactcaggtctgactacctcctaagtctctgcacttcacgttgcacgatcctgcctctgagaagggtaggctccatttcatttaggtgtgaagggtccttccctttcagagagtaccagagaaattcagaaaggaaattgtgggattaaggcttatttttattttaataaaaaacatcaaaggaggaggtaattgagaaratctgaatgtttagaaatgacatttttaatacaatattgcatgtgctaattggctgccaatataatggttttgtgactatttgagagttgaatggacatctgccactaagaacaatgaaggccattacaggcaattcgaggttggtttcagaaaaacagttatgtatgggcaggccacatacatatatgagtaagtactacccagaagagtccagaacaaaacgaaaattttgtgtaatcattccacagaatttaaacaacctgcatttaattgtttacaacaggtacaatttcatccct

SEQ ID NO: 134168 - DNA, 601 bp, Human
aagcaagatatggcctgggttaggacagggcctgatgccaagtaacacatttacatggacaggccaggggaatcagtaggatttgatgcttcgagggtactttgggagtacatctgtattagattactgctcccgggtgcttgctggctttcacatcttgggtacatggacaggccaggggaatcagtaggatttgatgcttcgagggtactttgggagtacatctgtattagattactgctcccgggtgcttgctggctttcacatcttgggtacatggacaggccagggcaatcagtargatttgatgcttcaagggtactttgggagtacatctgtattagattactgctcccgggtgcttgctggctttcacgtcttgggtacatggacaggccaggggaatcagtaggatttgatgcttcgagggtactttgggagtacatctgtattagattactgctcccgggtgcttgctggctttcacatcttgggtacatggacaggccagggcaatcagtaggatttgatgcttcgagggtactctgggagtacatctgtattagattactgctcccgggtgcttgctggctttcacatc

SEQ ID NO: 134169 - DNA, 601 bp, Human
ctgggttaggacagggcctgatgccaagtaacacatttacatggacaggccaggggaatcagtaggatttgatgcttcgagggtactttgggagtacatctgtattagattactgctcccgggtgcttgctggctttcacatcttgggtacatggacaggccaggggaatcagtaggatttgatgcttcgagggtactttgggagtacatctgtattagattactgctcccgggtgcttgctggctttcacatcttgggtacatggacaggccagggcaatcagtaagatttgatgcttcragggtactttgggagtacatctgtattagattactgctcccgggtgcttgctggctttcacgtcttgggtacatggacaggccaggggaatcagtaggatttgatgcttcgagggtactttgggagtacatctgtattagattactgctcccgggtgcttgctggctttcacatcttgggtacatggacaggccagggcaatcagtaggatttgatgcttcgagggtactctgggagtacatctgtattagattactgctcccgggtgcttgctggctttcacatcttgggtacatggac

SEQ ID NO: 134170 - DNA, 601 bp, Human
gacagggcctgatgccaagtaacacatttacatggacaggccaggggaatcagtaggatttgatgcttcgagggtactttgggagtacatctgtattagattactgctcccgggtgcttgctggctttcacatcttgggtacatggacaggccaggggaatcagtaggatttgatgcttcgagggtactttgggagtacatctgtattagattactgctcccgggtgcttgctggctttcacatcttgggtacatggacaggccagggcaatcagtaagatttgatgcttcaagggtactytgggagtacatctgtattagattactgctcccgggtgcttgctggctttcacgtcttgggtacatggacaggccaggggaatcagtaggatttgatgcttcgagggtactttgggagtacatctgtattagattactgctcccgggtgcttgctggctttcacatcttgggtacatggacaggccagggcaatcagtaggatttgatgcttcgagggtactctgggagtacatctgtattagattactgctcccgggtgcttgctggctttcacatcttgggtacatggacaggccaggg

SEQ ID NO: 134171 - DNA, 601 bp, Human
taggatttgatgcttcgagggtactttgggagtacatctgtattagattactgctcccgggtgcttgctggctttcacatcttgggtacatggacaggccaggggaatcagtaggatttgatgcttcgagggtactttgggagtacatctgtattagattactgctcccgggtgcttgctggctttcacatcttgggtacatggacaggccagggcaatcagtaagatttgatgcttcaagggtactttgggagtacatctgtattagattactgctcccgggtgcttgctggctttcacrtcttgggtacatggacaggccaggggaatcagtaggatttgatgcttcgagggtactttgggagtacatctgtattagattactgctcccgggtgcttgctggctttcacatcttgggtacatggacaggccagggcaatcagtaggatttgatgcttcgagggtactctgggagtacatctgtattagattactgctcccgggtgcttgctggctttcacatcttgggtacatggacaggccagggcaatcagtaggatttgatgcttcgagggtactttgggagtacatctgtattag

SEQ ID NO: 134172 - DNA, 601 bp, Human
tgggagtacatctgtattagattactgctcccgggtgcttgctggctttcacatcttgggtacatggacaggccaggggaatcagtaggatttgatgcttcgagggtactttgggagtacatctgtattagattactgctcccgggtgcttgctggctttcacatcttgggtacatggacaggccagggcaatcagtaagatttgatgcttcaagggtactttgggagtacatctgtattagattactgctcccgggtgcttgctggctttcacgtcttgggtacatggacaggccagggsaatcagtaggatttgatgcttcgagggtactttgggagtacatctgtattagattactgctcccgggtgcttgctggctttcacatcttgggtacatggacaggccagggcaatcagtaggatttgatgcttcgagggtactctgggagtacatctgtattagattactgctcccgggtgcttgctggctttcacatcttgggtacatggacaggccagggcaatcagtaggatttgatgcttcgagggtactttgggagtacatctgtattagattactgctcccgggtgcttgctggc

SEQ ID NO: 134173 - DNA, 601 bp, Human
gggtgcttgctggctttcacatcttgggtacatggacaggccagggcaatcagtaagatttgatgcttcaagggtactttgggagtacatctgtattagattactgctcccgggtgcttgctggctttcacgtcttgggtacatggacaggccaggggaatcagtaggatttgatgcttcgagggtactttgggagtacatctgtattagattactgctcccgggtgcttgctggctttcacatcttgggtacatggacaggccagggcaatcagtaggatttgatgcttcgagggtactytgggagtacatctgtattagattactgctcccgggtgcttgctggctttcacatcttgggtacatggacaggccagggcaatcagtaggatttgatgcttcgagggtactttgggagtacatctgtattagattactgctcccgggtgcttgctggctttcacatcttgggttcatggacaggccaggggaatcagtaggatttgatgcttcgagggtactttgggagtacatctgtattagattactgctcccgggtgcttgctggctttcacgtcttgggggtgtggagcttacacat

SEQ ID NO: 134174 - DNA, 601 bp, Human
acatcttgggtacatggacaggccagggcaatcagtaagatttgatgcttcaagggtactttgggagtacatctgtattagattactgctcccgggtgcttgctggctttcacgtcttgggtacatggacaggccaggggaatcagtaggatttgatgcttcgagggtactttgggagtacatctgtattagattactgctcccgggtgcttgctggctttcacatcttgggtacatggacaggccagggcaatcagtaggatttgatgcttcgagggtactctgggagtacatctgtatyagattactgctcccgggtgcttgctggctttcacatcttgggtacatggacaggccagggcaatcagtaggatttgatgcttcgagggtactttgggagtacatctgtattagattactgctcccgggtgcttgctggctttcacatcttgggttcatggacaggccaggggaatcagtaggatttgatgcttcgagggtactttgggagtacatctgtattagattactgctcccgggtgcttgctggctttcacgtcttgggggtgtggagcttacacatgttttctattcttaaaac

SEQ ID NO: 134175 - DNA, 601 bp, Human
tcgagggtactttgggagtacatctgtattagattactgctcccgggtgcttgctggctttcacatcttgggtacatggacaggccagggcaatcagtaggatttgatgcttcgagggtactctgggagtacatctgtattagattactgctcccgggtgcttgctggctttcacatcttgggtacatggacaggccagggcaatcagtaggatttgatgcttcgagggtactttgggagtacatctgtattagattactgctcccgggtgcttgctggctttcacatcttgggttcatgracaggccaggggaatcagtaggatttgatgcttcgagggtactttgggagtacatctgtattagattactgctcccgggtgcttgctggctttcacgtcttgggggtgtggagcttacacatgttttctattcttaaaactcagttcctattgaagtgatgaccaaagtgattttgtttagcttttaagaatacatggctatgctctgtgaaggtcctacatccactcttgcccatctccagaatgatattttaaaaagcaaatttggtcatattatgtaaaacccttccatggcttttc

SEQ ID NO: 134176 - DNA, 601 bp, Human
ttggaataaatgaattatgaagcacagttgactgtcagtgtctaatgtactaaaacttctctaatacaaaaagtaggaggaaaaattcttccttttccctaaatcatcagatactcatatgtaaccaacatttgtcacatgcatttacttttatgcaaagagcaattctagatgctgtggggcagaaatgagaccaagactggaggcttgtcctctggaacctcacagtcttagtgtaagttacacacagtctgaggagaggagcccagaaggcttcacagctaattcctcctggaaaatscagctaactgatgagatgtggaagtgtgagcgggatcacaggcttaaacgtctgccctgtgagggtgggctttcgagaacgcaggacagacagctgtaaagtcatccaagcttgaactgcaatagcataaaccagtacacattcctaaaatgcttaaataagatataatttgaatatagaaagtactgtgcacaaattccattctactggttgtaagtgcctattcttatgatatctgtgagcaaaaatcactgaagaagatataactcagttttctttacatattctgatgccttacgg

SEQ ID NO: 134177 - DNA, 601 bp, Human
atttgtcacatgcatttacttttatgcaaagagcaattctagatgctgtggggcagaaatgagaccaagactggaggcttgtcctctggaacctcacagtcttagtgtaagttacacacagtctgaggagaggagcccagaaggcttcacagctaattcctcctggaaaatgcagctaactgatgagatgtggaagtgtgagcgggatcacaggcttaaacgtctgccctgtgagggtgggctttcgagaacgcaggacagacagctgtaaagtcatccaagcttgaactgcaatagcatraaccagtacacattcctaaaatgcttaaataagatataatttgaatatagaaagtactgtgcacaaattccattctactggttgtaagtgcctattcttatgatatctgtgagcaaaaatcactgaagaagatataactcagttttctttacatattctgatgccttacgggggagcaaaaactgaatcgatgttgtccaatagaaataggatgcaagccacatatgtaattttgaattttctagaaaccacattatacaagtaaagagaaagatgaaattgtctttaataatatatttt

SEQ ID NO: 134178 - DNA, 601 bp, Human
cttgtcctctggaacctcacagtcttagtgtaagttacacacagtctgaggagaggagcccagaaggcttcacagctaattcctcctggaaaatgcagctaactgatgagatgtggaagtgtgagcgggatcacaggcttaaacgtctgccctgtgagggtgggctttcgagaacgcaggacagacagctgtaaagtcatccaagcttgaactgcaatagcataaaccagtacacattcctaaaatgcttaaataagatataatttgaatatagaaagtactgtgcacaaattccattctwctggttgtaagtgcctattcttatgatatctgtgagcaaaaatcactgaagaagatataactcagttttctttacatattctgatgccttacgggggagcaaaaactgaatcgatgttgtccaatagaaataggatgcaagccacatatgtaattttgaattttctagaaaccacattatacaagtaaagagaaagatgaaattgtctttaataatatattttatttaacccattatagccaaaatattaaccactattaaaaattattgagatattctatgttttttttcatactctgg

SEQ ID NO: 134179 - DNA, 601 bp, Human
tttacctccttggttttatgttttatcagtgggtttttcttttcaatagagaaatggattcttgatttagaattaggatatatttaggctctggattttttaaaaaaaattctgaaagtctgtttcatgacacttgaatggaattgtagacagttggactgtggaccttttccagacttagcatccttgttatgagagaggccttttcagtttgcactgagaagttactcttaccctgatgtgataatctaatacaaatttccaaactgcttacataaaaagcagcttgaatgtgaaaaaygttgtacacagtaggggtttgtttctctatggaaatgcttttcccttgaatgcctatatggtctagatttttccagcatttctgagatttgggtatcaaattggggtcattcgatgtctatttagaattttttaataatttcaaatctcatttgtgaaatattgcctgtggaaataaaagctagctgtattagtttcaaaatgtaccattagtccctggaaagatactctattaaaattagtgtacttcttttcccacaggctgtgctcttaatcatgtccttccaaagatgaataaata

SEQ ID NO: 134180 - DNA, 601 bp, Human
tatgatttgttcactatactgcctttttccattattactctcctattttacattcttcacatagcagccagttccatccattaaagatgtaattcacatcttgtcactcctctgcttgtaactctccactggcttccattgcactgagaattatcctcagacttgttcctgcctcggggtctttgcacaggtgtttcttctgcctggaacactcttctccagctcctgttaatgtctgctgctcctcatcactccaccttcagtcagatgccgtctccctgtacagtcctttcctgccccsacccctattgaaaatagtttctcctcatccctctcatacctccttatattatttcctatcaacatttggaattatcttctaatttatctttttgtttattgttttcacatcactcccatttctcatatagaacgtaatctccagaagggtagaatcttgtctgtcttatttactattcgtaataatggaagtagtgccctcagtaaatatttattgaatgaatgctgttcatctcttccagtatattgtaaacatagtcattgaagacaaggactatgtctcttttactcctttatatat

SEQ ID NO: 134181 - DNA, 601 bp, Human
ggaattatcttctaatttatctttttgtttattgttttcacatcactcccatttctcatatagaacgtaatctccagaagggtagaatcttgtctgtcttatttactattcgtaataatggaagtagtgccctcagtaaatatttattgaatgaatgctgttcatctcttccagtatattgtaaacatagtcattgaagacaaggactatgtctcttttactcctttatatatacccagttcctagcacagagtttggtgctagcgattgattaatttgcttaatgaatgaatcaaatcaygtgaagcatacataagctccatcttacgggagtagctaacttttcaggtaagtgtcgtggtctgcagacttttacagatcagtatcagagctgttctctgtgtaatatctatttggtgtcatgtacaattagtatatttcacaattgctttgggaaaagtgtggatgtgcatactgtcatgtataaaatcactgggctgaagctattaatagacatttgtgtttatatacatagataatagttgtatctatttttgaatgagaaaactgaagctgcaaggtgattagcaatttgcccgaa

SEQ ID NO: 134182 - DNA, 601 bp, Human
tctaatttatctttttgtttattgttttcacatcactcccatttctcatatagaacgtaatctccagaagggtagaatcttgtctgtcttatttactattcgtaataatggaagtagtgccctcagtaaatatttattgaatgaatgctgttcatctcttccagtatattgtaaacatagtcattgaagacaaggactatgtctcttttactcctttatatatacccagttcctagcacagagtttggtgctagcgattgattaatttgcttaatgaatgaatcaaatcatgtgaagcatmcataagctccatcttacgggagtagctaacttttcaggtaagtgtcgtggtctgcagacttttacagatcagtatcagagctgttctctgtgtaatatctatttggtgtcatgtacaattagtatatttcacaattgctttgggaaaagtgtggatgtgcatactgtcatgtataaaatcactgggctgaagctattaatagacatttgtgtttatatacatagataatagttgtatctatttttgaatgagaaaactgaagctgcaaggtgattagcaatttgcccgaagtatacaaca

SEQ ID NO: 134183 - DNA, 601 bp, Human
ctaatttatctttttgtttattgttttcacatcactcccatttctcatatagaacgtaatctccagaagggtagaatcttgtctgtcttatttactattcgtaataatggaagtagtgccctcagtaaatatttattgaatgaatgctgttcatctcttccagtatattgtaaacatagtcattgaagacaaggactatgtctcttttactcctttatatatacccagttcctagcacagagtttggtgctagcgattgattaatttgcttaatgaatgaatcaaatcatgtgaagcatayataagctccatcttacgggagtagctaacttttcaggtaagtgtcgtggtctgcagacttttacagatcagtatcagagctgttctctgtgtaatatctatttggtgtcatgtacaattagtatatttcacaattgctttgggaaaagtgtggatgtgcatactgtcatgtataaaatcactgggctgaagctattaatagacatttgtgtttatatacatagataatagttgtatctatttttgaatgagaaaactgaagctgcaaggtgattagcaatttgcccgaagtatacaacag

SEQ ID NO: 134184 - DNA, 601 bp, Human
ccagaagggtagaatcttgtctgtcttatttactattcgtaataatggaagtagtgccctcagtaaatatttattgaatgaatgctgttcatctcttccagtatattgtaaacatagtcattgaagacaaggactatgtctcttttactcctttatatatacccagttcctagcacagagtttggtgctagcgattgattaatttgcttaatgaatgaatcaaatcatgtgaagcatacataagctccatcttacgggagtagctaacttttcaggtaagtgtcgtggtctgcagactttyacagatcagtatcagagctgttctctgtgtaatatctatttggtgtcatgtacaattagtatatttcacaattgctttgggaaaagtgtggatgtgcatactgtcatgtataaaatcactgggctgaagctattaatagacatttgtgtttatatacatagataatagttgtatctatttttgaatgagaaaactgaagctgcaaggtgattagcaatttgcccgaagtatacaacagaacagccagaatctttattcagatattactatctccaaggcacattctgttttcaaaacaaa

SEQ ID NO: 134185 - DNA, 601 bp, Human
ttcgtaataatggaagtagtgccctcagtaaatatttattgaatgaatgctgttcatctcttccagtatattgtaaacatagtcattgaagacaaggactatgtctcttttactcctttatatatacccagttcctagcacagagtttggtgctagcgattgattaatttgcttaatgaatgaatcaaatcatgtgaagcatacataagctccatcttacgggagtagctaacttttcaggtaagtgtcgtggtctgcagacttttacagatcagtatcagagctgttctctgtgtaatayctatttggtgtcatgtacaattagtatatttcacaattgctttgggaaaagtgtggatgtgcatactgtcatgtataaaatcactgggctgaagctattaatagacatttgtgtttatatacatagataatagttgtatctatttttgaatgagaaaactgaagctgcaaggtgattagcaatttgcccgaagtatacaacagaacagccagaatctttattcagatattactatctccaaggcacattctgttttcaaaacaaaatgtcttatgctacaaagtcttaaactacaaagat

SEQ ID NO: 134186 - DNA, 601 bp, Human
gtgaagcatacataagctccatcttacgggagtagctaacttttcaggtaagtgtcgtggtctgcagacttttacagatcagtatcagagctgttctctgtgtaatatctatttggtgtcatgtacaattagtatatttcacaattgctttgggaaaagtgtggatgtgcatactgtcatgtataaaatcactgggctgaagctattaatagacatttgtgtttatatacatagataatagttgtatctatttttgaatgagaaaactgaagctgcaaggtgattagcaatttgcccgaastatacaacagaacagccagaatctttattcagatattactatctccaaggcacattctgttttcaaaacaaaatgtcttatgctacaaagtcttaaactacaaagatacctccaggcttggtaagtgtggcaagtgtactctagggtgacttgtacaggttcacacccttatataatcccttcccgttgggtgtagatggaacctgtgacttgctgctaaccaataaatatggcaaaggtaatggaatcaactactcaccactcccttgatagtgattacattatatggccaaatcgatg

SEQ ID NO: 134187 - DNA, 601 bp, Human
acaattagtatatttcacaattgctttgggaaaagtgtggatgtgcatactgtcatgtataaaatcactgggctgaagctattaatagacatttgtgtttatatacatagataatagttgtatctatttttgaatgagaaaactgaagctgcaaggtgattagcaatttgcccgaagtatacaacagaacagccagaatctttattcagatattactatctccaaggcacattctgttttcaaaacaaaatgtcttatgctacaaagtcttaaactacaaagatacctccaggcttggtawgtgtggcaagtgtactctagggtgacttgtacaggttcacacccttatataatcccttcccgttgggtgtagatggaacctgtgacttgctgctaaccaataaatatggcaaaggtaatggaatcaactactcaccactcccttgatagtgattacattatatggccaaatcgatggtgcatcactcccatgaccaagtcacattatgtgagacagtcttagcagactaatacgagagacattcccttccttgtctagaagaagcacactgccatgttatgacagcccaaggagaggacc

SEQ ID NO: 134188 - DNA, 601 bp, Human
tcaaaacaaaatgtcttatgctacaaagtcttaaactacaaagatacctccaggcttggtaagtgtggcaagtgtactctagggtgacttgtacaggttcacacccttatataatcccttcccgttgggtgtagatggaacctgtgacttgctgctaaccaataaatatggcaaaggtaatggaatcaactactcaccactcccttgatagtgattacattatatggccaaatcgatggtgcatcactcccatgaccaagtcacattatgtgagacagtcttagcagactaatacgagagrcattcccttccttgtctagaagaagcacactgccatgttatgacagcccaaggagaggaccacatgtcaaggaactgggggtagtctctagaacctaagggtggccactggccaacagccagcgggaagccagagctctcaatcacactgccacagagaagtgaacagcccggactcaggaagacagcaacccacgtgagcctggatgcagacttctcccctctctggcctccacatggcaaagcagtctgactctacattgtttgcagcctggcgagaccctgagcataggactcaatt

SEQ ID NO: 134189 - DNA, 601 bp, Human
gtgacttgtacaggttcacacccttatataatcccttcccgttgggtgtagatggaacctgtgacttgctgctaaccaataaatatggcaaaggtaatggaatcaactactcaccactcccttgatagtgattacattatatggccaaatcgatggtgcatcactcccatgaccaagtcacattatgtgagacagtcttagcagactaatacgagagacattcccttccttgtctagaagaagcacactgccatgttatgacagcccaaggagaggaccacatgtcaaggaactgggggtrgtctctagaacctaagggtggccactggccaacagccagcgggaagccagagctctcaatcacactgccacagagaagtgaacagcccggactcaggaagacagcaacccacgtgagcctggatgcagacttctcccctctctggcctccacatggcaaagcagtctgactctacattgtttgcagcctggcgagaccctgagcataggactcaatttaggcatgcccagacttacttgcagaaactgtgaggtaatgtgtgttgtttgaagccactgagtttgtggtactttgttattc

SEQ ID NO: 134190 - DNA, 601 bp, Human
tttgcagcctggcgagaccctgagcataggactcaatttaggcatgcccagacttacttgcagaaactgtgaggtaatgtgtgttgtttgaagccactgagtttgtggtactttgttattctatgtagaaaactaatacagtgtggctgttcccagccagagctcctatttcaagcatacaactgtctgctggggccatcaggctatttgccctgtggctttaggctccttggataccttacattgaagtaggaggtagattgggaacacctgtcactgtcttttcagcttaagatgaggkctcctgaaccccccagggagtataggtcagtccagttccaccaaagactgaagatatctttgtgttttgaaacatgatagcaaagaacacttggcacagtgcctgacacttagtagggactcaagaaatattatgcaccttcctttcctggggtactgcagctcaacctagggcatctcagatgctaacccagcagttcctccctgggcaaggtctttagaaatcccactgcaggacccttcttacaataaggatatattatttaccaccaccctctatttgctctgaaaacctgagaaa

SEQ ID NO: 134191 - DNA, 601 bp, Human
gacacttagtagggactcaagaaatattatgcaccttcctttcctggggtactgcagctcaacctagggcatctcagatgctaacccagcagttcctccctgggcaaggtctttagaaatcccactgcaggacccttcttacaataaggatatattatttaccaccaccctctatttgctctgaaaacctgagaaagcaaaggctgatgatgttagtacactgagggttgtgtatttttcagatttcacaaactgttttatgcccctgagggggacagttgcctgctttgccagggcactstgtgagacctgtgttggcaccttgcagcacccaatcttgaggtgggagatgtttgctgccccatgtcacaagttcttagggctgctgactgtgtactacagcacagggtcttaatatccctccctgctgtttcctacttgaggcataagagagctttgtcaccttggagagaggtgttatataaataccattatttgggttgagagtagcacgatccagtgctagggttgtctatttgtgtaagtcagtaggcaaatcttcctcttcccttttctcagtgtcttctaatagttaactaca

SEQ ID NO: 134192 - DNA, 601 bp, Human
cttcctttcctggggtactgcagctcaacctagggcatctcagatgctaacccagcagttcctccctgggcaaggtctttagaaatcccactgcaggacccttcttacaataaggatatattatttaccaccaccctctatttgctctgaaaacctgagaaagcaaaggctgatgatgttagtacactgagggttgtgtatttttcagatttcacaaactgttttatgcccctgagggggacagttgcctgctttgccagggcactctgtgagacctgtgttggcaccttgcagcacccartcttgaggtgggagatgtttgctgccccatgtcacaagttcttagggctgctgactgtgtactacagcacagggtcttaatatccctccctgctgtttcctacttgaggcataagagagctttgtcaccttggagagaggtgttatataaataccattatttgggttgagagtagcacgatccagtgctagggttgtctatttgtgtaagtcagtaggcaaatcttcctcttcccttttctcagtgtcttctaatagttaactacaaaagaaacaacatagatgtgagtatatttaccta

SEQ ID NO: 134193 - DNA, 601 bp, Human
ttttcagatttcacaaactgttttatgcccctgagggggacagttgcctgctttgccagggcactctgtgagacctgtgttggcaccttgcagcacccaatcttgaggtgggagatgtttgctgccccatgtcacaagttcttagggctgctgactgtgtactacagcacagggtcttaatatccctccctgctgtttcctacttgaggcataagagagctttgtcaccttggagagaggtgttatataaataccattatttgggttgagagtagcacgatccagtgctagggttgtctatttgtgtaagtcagtaggcaaatcttcctcttcccttttctcagtgtcttctaatagttaactacaaaagaaacaacatagatgtgagtatatttacctaagttctcattacagtataactctttctgtcattttgtaattgttagtgtgcaaaacagcagagcacattggtatcagtgcagagagcatcagagggccacgtttcagacttgtagatgctctgagacttcacctaagaaaaccaggccataatatgcaataatcacatgttgccaaaatgaaatgcatgctaagatgctat

SEQ ID NO: 134194 - DNA, 601 bp, Human
tcagatttcacaaactgttttatgcccctgagggggacagttgcctgctttgccagggcactctgtgagacctgtgttggcaccttgcagcacccaatcttgaggtgggagatgtttgctgccccatgtcacaagttcttagggctgctgactgtgtactacagcacagggtcttaatatccctccctgctgtttcctacttgaggcataagagagctttgtcaccttggagagaggtgttatataaataccattatttgggttgagagtagcacgatccagtgctagggttgtctatttgtgtaagtcagtaggcaaatcttcctcttcccttttctcagtgtcttctaatagttaactacaaaagaaacaacatagatgtgagtatatttacctaagttctcattacagtataactctttctgtcattttgtaattgttagtgtgcaaaacagcagagcacattggtatcagtgcagagagcatcagagggccacgtttcagacttgtagatgctctgagacttcacctaagaaaaccaggccataatatgcaataatcacatgttgccaaaatgaaatgcatgctaagatgctattta

SEQ ID NO: 134195 - DNA, 601 bp, Human
caagttcttagggctgctgactgtgtactacagcacagggtcttaatatccctccctgctgtttcctacttgaggcataagagagctttgtcaccttggagagaggtgttatataaataccattatttgggttgagagtagcacgatccagtgctagggttgtctatttgtgtaagtcagtaggcaaatcttcctcttcccttttctcagtgtcttctaatagttaactacaaaagaaacaacatagatgtgagtatatttacctaagttctcattacagtataactctttctgtcatttygtaattgttagtgtgcaaaacagcagagcacattggtatcagtgcagagagcatcagagggccacgtttcagacttgtagatgctctgagacttcacctaagaaaaccaggccataatatgcaataatcacatgttgccaaaatgaaatgcatgctaagatgctatttattacataaattttgttggaagtattaagccccaaatcttatttagtgtgatttgaggatttatactcatcttacaattgtaatctctatattagacttcacaaatttagttaaaataatttagaattaatt

SEQ ID NO: 134196 - DNA, 601 bp, Human
ggctgctgactgtgtactacagcacagggtcttaatatccctccctgctgtttcctacttgaggcataagagagctttgtcaccttggagagaggtgttatataaataccattatttgggttgagagtagcacgatccagtgctagggttgtctatttgtgtaagtcagtaggcaaatcttcctcttcccttttctcagtgtcttctaatagttaactacaaaagaaacaacatagatgtgagtatatttacctaagttctcattacagtataactctttctgtcattttgtaattgttartgtgcaaaacagcagagcacattggtatcagtgcagagagcatcagagggccacgtttcagacttgtagatgctctgagacttcacctaagaaaaccaggccataatatgcaataatcacatgttgccaaaatgaaatgcatgctaagatgctatttattacataaattttgttggaagtattaagccccaaatcttatttagtgtgatttgaggatttatactcatcttacaattgtaatctctatattagacttcacaaatttagttaaaataatttagaattaatttttcttatttt

SEQ ID NO: 134197 - DNA, 601 bp, Human
attttgtaattgttagtgtgcaaaacagcagagcacattggtatcagtgcagagagcatcagagggccacgtttcagacttgtagatgctctgagacttcacctaagaaaaccaggccataatatgcaataatcacatgttgccaaaatgaaatgcatgctaagatgctatttattacataaattttgttggaagtattaagccccaaatcttatttagtgtgatttgaggatttatactcatcttacaattgtaatctctatattagacttcacaaatttagttaaaataatttagaatkaatttttcttatttttcatagtaaaacatgcataacatgaaattatcttaactatttttaagtatacatttcactggtattaaatacattcataatgttgcgtaatcaccaccaccatccatctccataactctttttgtcttgtaaaagtaaaactctatccccattaagtaataactccccctttcctacttcagccgctggctaccaccattctactttctggctctatgattttaattattctaatcacttcatgtaagtggaatcacatagcatttgtcttttttgtgacggctt

SEQ ID NO: 134198 - DNA, 601 bp, Human
ctaagaaaaccaggccataatatgcaataatcacatgttgccaaaatgaaatgcatgctaagatgctatttattacataaattttgttggaagtattaagccccaaatcttatttagtgtgatttgaggatttatactcatcttacaattgtaatctctatattagacttcacaaatttagttaaaataatttagaattaatttttcttatttttcatagtaaaacatgcataacatgaaattatcttaactatttttaagtatacatttcactggtattaaatacattcataatgttgcrtaatcaccaccaccatccatctccataactctttttgtcttgtaaaagtaaaactctatccccattaagtaataactccccctttcctacttcagccgctggctaccaccattctactttctggctctatgattttaattattctaatcacttcatgtaagtggaatcacatagcatttgtcttttttgtgacggctttatttcacttggcataatgtcccaaggtttacttatgtaatagtgtatataagaattgccttcctttttaaggctgaatagtattctgttgtgtgtaaatag

SEQ ID NO: 134199 - DNA, 601 bp, Human
cattcataatgttgcgtaatcaccaccaccatccatctccataactctttttgtcttgtaaaagtaaaactctatccccattaagtaataactccccctttcctacttcagccgctggctaccaccattctactttctggctctatgattttaattattctaatcacttcatgtaagtggaatcacatagcatttgtcttttttgtgacggctttatttcacttggcataatgtcccaaggtttacttatgtaatagtgtatataagaattgccttcctttttaaggctgaatagtattcygttgtgtgtaaatagtgcaatttttatatagattcacctgttgatagacaactgagttgctttcacattttagctattgtgaataatgcttctatgaccatgagtatacaaatatcactctgaaactctgctttcaattattttgggtagatatccagaaatggaattgctggaacttaagggaattctattttttatttctgaggtaccactgtgctctcttccacagcattttactttctcaccaacagtgcacaagggttcgagttactctacatccttgctaacgcttgttatttt

SEQ ID NO: 134200 - DNA, 601 bp, Human
ccatccatctccataactctttttgtcttgtaaaagtaaaactctatccccattaagtaataactccccctttcctacttcagccgctggctaccaccattctactttctggctctatgattttaattattctaatcacttcatgtaagtggaatcacatagcatttgtcttttttgtgacggctttatttcacttggcataatgtcccaaggtttacttatgtaatagtgtatataagaattgccttcctttttaaggctgaatagtattctgttgtgtgtaaatagtgcaatttttatrtagattcacctgttgatagacaactgagttgctttcacattttagctattgtgaataatgcttctatgaccatgagtatacaaatatcactctgaaactctgctttcaattattttgggtagatatccagaaatggaattgctggaacttaagggaattctattttttatttctgaggtaccactgtgctctcttccacagcattttactttctcaccaacagtgcacaagggttcgagttactctacatccttgctaacgcttgttattttctggttttttgatgtttaccatccttat

SEQ ID NO: 134201 - DNA, 601 bp, Human
cattctactttctggctctatgattttaattattctaatcacttcatgtaagtggaatcacatagcatttgtcttttttgtgacggctttatttcacttggcataatgtcccaaggtttacttatgtaatagtgtatataagaattgccttcctttttaaggctgaatagtattctgttgtgtgtaaatagtgcaatttttatatagattcacctgttgatagacaactgagttgctttcacattttagctattgtgaataatgcttctatgaccatgagtatacaaatatcactctgaarctctgctttcaattattttgggtagatatccagaaatggaattgctggaacttaagggaattctattttttatttctgaggtaccactgtgctctcttccacagcattttactttctcaccaacagtgcacaagggttcgagttactctacatccttgctaacgcttgttattttctggttttttgatgtttaccatccttatgagtgtgaggtggtatctcattgtagttttgatttgtaatgacctaatgattagtgaagttaaccacctttttatgtgctttttagccatttgtatg

SEQ ID NO: 134202 - DNA, 601 bp, Human
gaatagtattctgttgtgtgtaaatagtgcaatttttatatagattcacctgttgatagacaactgagttgctttcacattttagctattgtgaataatgcttctatgaccatgagtatacaaatatcactctgaaactctgctttcaattattttgggtagatatccagaaatggaattgctggaacttaagggaattctattttttatttctgaggtaccactgtgctctcttccacagcattttactttctcaccaacagtgcacaagggttcgagttactctacatccttgctaacrcttgttattttctggttttttgatgtttaccatccttatgagtgtgaggtggtatctcattgtagttttgatttgtaatgacctaatgattagtgaagttaaccacctttttatgtgctttttagccatttgtatgtcttctttggggaaatgtcaattcaagccttcgctcatttattaatccagttgtttgggttttttgttgcgttttaggagttctgtacatatcagatatgatttacaaatattttcccccattctgtgggttgcctttttactcagtttctagtgtcttttgat

SEQ ID NO: 134203 - DNA, 601 bp, Human
gtgtgtaaatagtgcaatttttatatagattcacctgttgatagacaactgagttgctttcacattttagctattgtgaataatgcttctatgaccatgagtatacaaatatcactctgaaactctgctttcaattattttgggtagatatccagaaatggaattgctggaacttaagggaattctattttttatttctgaggtaccactgtgctctcttccacagcattttactttctcaccaacagtgcacaagggttcgagttactctacatccttgctaacgcttgttattttctgkttttttgatgtttaccatccttatgagtgtgaggtggtatctcattgtagttttgatttgtaatgacctaatgattagtgaagttaaccacctttttatgtgctttttagccatttgtatgtcttctttggggaaatgtcaattcaagccttcgctcatttattaatccagttgtttgggttttttgttgcgttttaggagttctgtacatatcagatatgatttacaaatattttcccccattctgtgggttgcctttttactcagtttctagtgtcttttgatgcacacaatttctta

SEQ ID NO: 134204 - DNA, 601 bp, Human
acatccttgctaacgcttgttattttctggttttttgatgtttaccatccttatgagtgtgaggtggtatctcattgtagttttgatttgtaatgacctaatgattagtgaagttaaccacctttttatgtgctttttagccatttgtatgtcttctttggggaaatgtcaattcaagccttcgctcatttattaatccagttgtttgggttttttgttgcgttttaggagttctgtacatatcagatatgatttacaaatattttcccccattctgtgggttgcctttttactcagtttmtagtgtcttttgatgcacacaatttcttaactttcgtgaagtccaattgtgtaattttttttgttgttgcatatgcctttggtatcatatccaggaattcattgccacatccagtgtcatgaagcttttgcctgtgttttcttctaagagttctagagttttagatcttacagctagctctttaatgtatttggagttaatttttgtatatagtattagaaaaaggtccaaattcatttttttgcatatagatccatttttcccagcaccattggttgaaaagactattatttctcgtga

SEQ ID NO: 134205 - DNA, 601 bp, Human
tcattgtagttttgatttgtaatgacctaatgattagtgaagttaaccacctttttatgtgctttttagccatttgtatgtcttctttggggaaatgtcaattcaagccttcgctcatttattaatccagttgtttgggttttttgttgcgttttaggagttctgtacatatcagatatgatttacaaatattttcccccattctgtgggttgcctttttactcagtttctagtgtcttttgatgcacacaatttcttaactttcgtgaagtccaattgtgtaattttttttgttgttgcrtatgcctttggtatcatatccaggaattcattgccacatccagtgtcatgaagcttttgcctgtgttttcttctaagagttctagagttttagatcttacagctagctctttaatgtatttggagttaatttttgtatatagtattagaaaaaggtccaaattcatttttttgcatatagatccatttttcccagcaccattggttgaaaagactattatttctcgtgagtggtcttggtacctttgtcaaaaatcatttgaccgtgtatgcaagagtttatttctgggccctctgctct

SEQ ID NO: 134206 - DNA, 601 bp, Human
tagttttgatttgtaatgacctaatgattagtgaagttaaccacctttttatgtgctttttagccatttgtatgtcttctttggggaaatgtcaattcaagccttcgctcatttattaatccagttgtttgggttttttgttgcgttttaggagttctgtacatatcagatatgatttacaaatattttcccccattctgtgggttgcctttttactcagtttctagtgtcttttgatgcacacaatttcttaactttcgtgaagtccaattgtgtaattttttttgttgttgcatatgcstttggtatcatatccaggaattcattgccacatccagtgtcatgaagcttttgcctgtgttttcttctaagagttctagagttttagatcttacagctagctctttaatgtatttggagttaatttttgtatatagtattagaaaaaggtccaaattcatttttttgcatatagatccatttttcccagcaccattggttgaaaagactattatttctcgtgagtggtcttggtacctttgtcaaaaatcatttgaccgtgtatgcaagagtttatttctgggccctctgctctgttccc

SEQ ID NO: 134207 - DNA, 601 bp, Human
ttgtcaaaaatcatttgaccgtgtatgcaagagtttatttctgggccctctgctctgttcccttggcctacatgtctgtctttatgacagtaccacactgtattaccatagctttgtagtgagttttcaaatcaggaggtgtgagtcttctagctttgtttttttaagattctttttgctatttggagtcccttgagattccatatgaattttagggtgggatttccatttctacaaaaaatgttactgagactttgatagggattgcattgaatctttagattgctttgaataatgttgrcatcttaataatattaagtcttcgagttcatgaacatgggatgtatttccatttatatatgtcttttaaaatttctttcagcagtgtttggtagttttcattgttgaagtcttttacctccttggttaaattaattcctgagtattttattctttttgatactattgtaaatggaattaaccttttaatttccttttcagattgttcgttgtcagtgtatagaaatgcaactgatttttgtgtgttgactttgtgtcctgctactttgttgaattcatttattagttctgacagcttttt

SEQ ID NO: 134208 - DNA, 601 bp, Human
ttctagctttgtttttttaagattctttttgctatttggagtcccttgagattccatatgaattttagggtgggatttccatttctacaaaaaatgttactgagactttgatagggattgcattgaatctttagattgctttgaataatgttgacatcttaataatattaagtcttcgagttcatgaacatgggatgtatttccatttatatatgtcttttaaaatttctttcagcagtgtttggtagttttcattgttgaagtcttttacctccttggttaaattaattcctgagtattktattctttttgatactattgtaaatggaattaaccttttaatttccttttcagattgttcgttgtcagtgtatagaaatgcaactgatttttgtgtgttgactttgtgtcctgctactttgttgaattcatttattagttctgacagctttttgtgggaaatctttagagatttctatatgtaagatcatgtcatctgaaaatagataattttacttgtttacatccaatttggattcctttttcttaccaaattgccctggccagaactttcagtactgtgttgaatagatgtggtcac

SEQ ID NO: 134209 - DNA, 601 bp, Human
ttctttttgctatttggagtcccttgagattccatatgaattttagggtgggatttccatttctacaaaaaatgttactgagactttgatagggattgcattgaatctttagattgctttgaataatgttgacatcttaataatattaagtcttcgagttcatgaacatgggatgtatttccatttatatatgtcttttaaaatttctttcagcagtgtttggtagttttcattgttgaagtcttttacctccttggttaaattaattcctgagtattttattctttttgatactattgtmaatggaattaaccttttaatttccttttcagattgttcgttgtcagtgtatagaaatgcaactgatttttgtgtgttgactttgtgtcctgctactttgttgaattcatttattagttctgacagctttttgtgggaaatctttagagatttctatatgtaagatcatgtcatctgaaaatagataattttacttgtttacatccaatttggattcctttttcttaccaaattgccctggccagaactttcagtactgtgttgaatagatgtggtcacagtgggcatcattgtctcgtta

SEQ ID NO: 134210 - DNA, 601 bp, Human
attttagggtgggatttccatttctacaaaaaatgttactgagactttgatagggattgcattgaatctttagattgctttgaataatgttgacatcttaataatattaagtcttcgagttcatgaacatgggatgtatttccatttatatatgtcttttaaaatttctttcagcagtgtttggtagttttcattgttgaagtcttttacctccttggttaaattaattcctgagtattttattctttttgatactattgtaaatggaattaaccttttaatttccttttcagattgttcrttgtcagtgtatagaaatgcaactgatttttgtgtgttgactttgtgtcctgctactttgttgaattcatttattagttctgacagctttttgtgggaaatctttagagatttctatatgtaagatcatgtcatctgaaaatagataattttacttgtttacatccaatttggattcctttttcttaccaaattgccctggccagaactttcagtactgtgttgaatagatgtggtcacagtgggcatcattgtctcgttactgatcttagagtaaaagctttcagtctttcaccattta

SEQ ID NO: 134211 - DNA, 601 bp, Human
cctagcttattgtttttatcatgaaaaggtgttgaacttagtcaacacttattcctgcatcaattgagatgatcgtgtgtgtggtttttttttttactctattttgttaatgtgaggtattagatggacccatttttgtatattgaaccatatgcttgtatttcaggaacaaataccacttggtcatggggtataatttttaaaatatgctgttgaatttgctttgctagcattttgttgagaattttcacaacaatgatcgtaagagatattggtctgtagttgtcttgtagtgtctttrtctggctttgctatcaagataatgctgtcctcatagaatgagcaggaaattttccttcttcaattttttggaaaagtttgaggagagttggtgttagttcttcaaatatttggtagaagtcactggtgaagccatcagatcctaggcttgtttttgttgggagatttttgattactgattcaatcttcttactaatgataggtctgttcagattttctatttctttgtgagttagtcttggtaggttttgtgtttctaagagtttgtccatttcatttaggttatacagttcattgttgt

SEQ ID NO: 134212 - DNA, 601 bp, Human
gtattagatggacccatttttgtatattgaaccatatgcttgtatttcaggaacaaataccacttggtcatggggtataatttttaaaatatgctgttgaatttgctttgctagcattttgttgagaattttcacaacaatgatcgtaagagatattggtctgtagttgtcttgtagtgtctttgtctggctttgctatcaagataatgctgtcctcatagaatgagcaggaaattttccttcttcaattttttggaaaagtttgaggagagttggtgttagttcttcaaatatttggtaraagtcactggtgaagccatcagatcctaggcttgtttttgttgggagatttttgattactgattcaatcttcttactaatgataggtctgttcagattttctatttctttgtgagttagtcttggtaggttttgtgtttctaagagtttgtccatttcatttaggttatacagttcattgttgtgcagttgttcatagtactcttaataatcttatttacttgtgtagatcagaatgaatatccccactttttatttctgattttagtaatttgtgtcttttctctctgtttttttctag

SEQ ID NO: 134213 - DNA, 601 bp, Human
agataatgctgtcctcatagaatgagcaggaaattttccttcttcaattttttggaaaagtttgaggagagttggtgttagttcttcaaatatttggtagaagtcactggtgaagccatcagatcctaggcttgtttttgttgggagatttttgattactgattcaatcttcttactaatgataggtctgttcagattttctatttctttgtgagttagtcttggtaggttttgtgtttctaagagtttgtccatttcatttaggttatacagttcattgttgtgcagttgttcatagtattcttaataatcttatttacttgtgtagatcagaatgaatatccccactttttatttctgattttagtaatttgtgtcttttctctctgtttttttctagttcagctagctaaatgtttgtcaattttgttgatcttttccaagaacaaacttttaattttttccatcaattaaagacatccttggctcttgataggtgatgaaggggcaagtgtatttttagctgttggttgccatttcaacgaaatagccgtcaactgtaattttctccaaaagtgggaaaatagagaaaaaaactaac

SEQ ID NO: 134214 - DNA, 601 bp, Human
tcatagaatgagcaggaaattttccttcttcaattttttggaaaagtttgaggagagttggtgttagttcttcaaatatttggtagaagtcactggtgaagccatcagatcctaggcttgtttttgttgggagatttttgattactgattcaatcttcttactaatgataggtctgttcagattttctatttctttgtgagttagtcttggtaggttttgtgtttctaagagtttgtccatttcatttaggttatacagttcattgttgtgcagttgttcatagtactcttaataatcttrtttacttgtgtagatcagaatgaatatccccactttttatttctgattttagtaatttgtgtcttttctctctgtttttttctagttcagctagctaaatgtttgtcaattttgttgatcttttccaagaacaaacttttaattttttccatcaattaaagacatccttggctcttgataggtgatgaaggggcaagtgtatttttagctgttggttgccatttcaacgaaatagccgtcaactgtaattttctccaaaagtgggaaaatagagaaaaaaactaacatttttctgtactt

SEQ ID NO: 134215 - DNA, 601 bp, Human
catcagctgtgttcatcaactcacaccaagggtgggggttggattctcttcttccctgttgtgatagacagatgccctgtcattatgtttttatgtgaaatttcacagtgaaagaaggaagccactcttgagaatacagcaatttaaatcaggttgtaatttttaaaaagtgatttacaaaaggtctttcccaaaatactgccatcataatcatctagggtggggagaaaaatagggtgcggagggcagaatcacccctcatccttgctcttccagcagggaacactcattttcacacccytgtgcctctgcagccccaccctttgttgaggtttgtgctgggcatgtacgttccacagagtctgctggtttccagtgtgacagaaatctcatttgtgataaaccttgattttgaattgtagtaaatgaaactttaaaaaaagcagacattaaaactccctgtttttttccctaggaaaaggagcattccatcttctggcatcactgtccttgggactaaacccccttagaaaacaccgcttttgcctagccctcagaggcttggtcccctgacattttacacttttccagaaaaagaatc

SEQ ID NO: 134216 - DNA, 601 bp, Human
tgatagacagatgccctgtcattatgtttttatgtgaaatttcacagtgaaagaaggaagccactcttgagaatacagcaatttaaatcaggttgtaatttttaaaaagtgatttacaaaaggtctttcccaaaatactgccatcataatcatctagggtggggagaaaaatagggtgcggagggcagaatcacccctcatccttgctcttccagcagggaacactcattttcacacccttgtgcctctgcagccccaccctttgttgaggtttgtgctgggcatgtacgttccacagagwctgctggtttccagtgtgacagaaatctcatttgtgataaaccttgattttgaattgtagtaaatgaaactttaaaaaaagcagacattaaaactccctgtttttttccctaggaaaaggagcattccatcttctggcatcactgtccttgggactaaacccccttagaaaacaccgcttttgcctagccctcagaggcttggtcccctgacattttacacttttccagaaaaagaatctcaggggctttcctacaaatgtctgtcacaacctcaacaacctcacaacctcaagtctgtc

SEQ ID NO: 134217 - DNA, 601 bp, Human
cctcagaggcttggtcccctgacattttacacttttccagaaaaagaatctcaggggctttcctacaaatgtctgtcacaacctcaacaacctcacaacctcaagtctgtcctattttagagacacacacacaaaaatgctataaaggaagtattaatacttgtttagagagattatcaggaacattgtacttaacagtgagaaatctgaataatgtgtatatgagtgtgttatgttattctttgtactttgcattttcaaaatgtcccatctttttttttttttttaagccaagaagtaygataatacttacctggccaccacagatgagaattgaagtgcaataaaacttgccacaagctgggaggaaccagcagtgtgctgctacaggcttaacaaccatctttctggaagaaaaaccttgatttgtagcatgagccagtttctgtgtctcacatggccattttcaagctaccagtgtgacatcactgaactgtgacttggaaaaagaggctcacacttggctcccctgagcagtgctggcctaactccagcacaccactggattgaactgccaagaaagagtagctcccacggatag

SEQ ID NO: 134218 - DNA, 601 bp, Human
ttcctacaaatgtctgtcacaacctcaacaacctcacaacctcaagtctgtcctattttagagacacacacacaaaaatgctataaaggaagtattaatacttgtttagagagattatcaggaacattgtacttaacagtgagaaatctgaataatgtgtatatgagtgtgttatgttattctttgtactttgcattttcaaaatgtcccatctttttttttttttttaagccaagaagtatgataatacttacctggccaccacagatgagaattgaagtgcaataaaacttgccacaakctgggaggaaccagcagtgtgctgctacaggcttaacaaccatctttctggaagaaaaaccttgatttgtagcatgagccagtttctgtgtctcacatggccattttcaagctaccagtgtgacatcactgaactgtgacttggaaaaagaggctcacacttggctcccctgagcagtgctggcctaactccagcacaccactggattgaactgccaagaaagagtagctcccacggatagggaggaagcaaatgctctgtaaatacctgtagacagaggcagggagacctttgtagaat

SEQ ID NO: 134219 - DNA, 601 bp, Human
taacaaccatctttctggaagaaaaaccttgatttgtagcatgagccagtttctgtgtctcacatggccattttcaagctaccagtgtgacatcactgaactgtgacttggaaaaagaggctcacacttggctcccctgagcagtgctggcctaactccagcacaccactggattgaactgccaagaaagagtagctcccacggatagggaggaagcaaatgctctgtaaatacctgtagacagaggcagggagacctttgtagaatggagagtgttagggaccttcctcttctttatttsggaaaatcttagattacatattcattggttgatctcatgcttgtgtgcttatggaaataaagcatttagtcagtaaaatattgttacccaaggactcaataaccatgcagtcaataaactgtatatatttttagaggcttctttcaaacataactttttaagatgactttattcaaaaagagtaaacccaggtggaatatttataaagataaaagcttcagaaatccatgtgaaatgaaaattatgtaataattggtttgctcacaaatatagtaattcagatagttttaaaaaattact

SEQ ID NO: 134220 - DNA, 601 bp, Human
ataaccatgcagtcaataaactgtatatatttttagaggcttctttcaaacataactttttaagatgactttattcaaaaagagtaaacccaggtggaatatttataaagataaaagcttcagaaatccatgtgaaatgaaaattatgtaataattggtttgctcacaaatatagtaattcagatagttttaaaaaattactttgatttaaagtttgttaaaataatcaagtttaaaaagaaagtatatgggttgagtgatatccctcccaaattcatttcattttcccccggaacctcaraatttgatctatgtcagctcaggctgccataacaaaatatcataaataatagaaatttattttcttgcagttctggaggttatatagtccaagatcaagttgcttgaccatgttttaatttctgatgagggctctcttcctggctggtagttagacgccttctcactatgtcctcatgtaaccttttcgtggtgcatgtgtgtggagggagagagattgttctctctcttcctctcttataaggttaccaatcctactggattaggactttgacctcctgacttcctttaattacttcct

SEQ ID NO: 134221 - DNA, 601 bp, Human
aatatcataaataatagaaatttattttcttgcagttctggaggttatatagtccaagatcaagttgcttgaccatgttttaatttctgatgagggctctcttcctggctggtagttagacgccttctcactatgtcctcatgtaaccttttcgtggtgcatgtgtgtggagggagagagattgttctctctcttcctctcttataaggttaccaatcctactggattaggactttgacctcctgacttcctttaattacttcctaaaagcactatctcaaaatacaattacattgggtaytggggtttcagcatatgaatttggggaggacaaatagcagtcttcttaccttttttacattcatcacttaccaactctattcctttagcgtaggttgggctctcatccctatctttagttttatactagaggcagactagatatttatagcagaacccaccaactctaagaactttcctcttgtccatgacaatctgggagtgccatatttatacatttcagtatacctcttggttaacatacttccataacacaatttaccatactggtcatagcctccattttattgaatagttccat

SEQ ID NO: 134222 - DNA, 601 bp, Human
ataaataatagaaatttattttcttgcagttctggaggttatatagtccaagatcaagttgcttgaccatgttttaatttctgatgagggctctcttcctggctggtagttagacgccttctcactatgtcctcatgtaaccttttcgtggtgcatgtgtgtggagggagagagattgttctctctcttcctctcttataaggttaccaatcctactggattaggactttgacctcctgacttcctttaattacttcctaaaagcactatctcaaaatacaattacattgggtattggggyttcagcatatgaatttggggaggacaaatagcagtcttcttaccttttttacattcatcacttaccaactctattcctttagcgtaggttgggctctcatccctatctttagttttatactagaggcagactagatatttatagcagaacccaccaactctaagaactttcctcttgtccatgacaatctgggagtgccatatttatacatttcagtatacctcttggttaacatacttccataacacaatttaccatactggtcatagcctccattttattgaatagttccataagtgc

SEQ ID NO: 134223 - DNA, 601 bp, Human
tacagtgtaaagggctagcctgcagagatacatgagaatcatcagcttgccaactcaaggaggtgatacaattggccagacctgataagaggtgggacttcagggcccaggcttgcttgcttatatccccaaggccccttggacacatgcttggtggcctaacccactggatagtccaaatcatcaagatagagatggggtccttaaatctatggttttaaaatgttttctgagtaattctgatatgcatcaggttgaccaccactagtaaaagcctttagacaaggattttgttttttgragacttaggggtttccatctgaaactttgagtcccacaggaaatttgacggaatgggaaagagaatgggtttgggagtggctcagacctgagcctgaatccaatcttttcctgttagtaactatgagagctcggataggctttccaggctctctgaggttccatatcctttctttatagatgcagcccatccctctttctgcaaataggagtaattgaaccaaacccacagagttgtgaagattaaggtaaattgtttgtataaagctcctggcttagagtagacaccaattaaaagcta

SEQ ID NO: 134224 - DNA, 601 bp, Human
ccaactcaaggaggtgatacaattggccagacctgataagaggtgggacttcagggcccaggcttgcttgcttatatccccaaggccccttggacacatgcttggtggcctaacccactggatagtccaaatcatcaagatagagatggggtccttaaatctatggttttaaaatgttttctgagtaattctgatatgcatcaggttgaccaccactagtaaaagcctttagacaaggattttgttttttggagacttaggggtttccatctgaaactttgagtcccacaggaaatttgayggaatgggaaagagaatgggtttgggagtggctcagacctgagcctgaatccaatcttttcctgttagtaactatgagagctcggataggctttccaggctctctgaggttccatatcctttctttatagatgcagcccatccctctttctgcaaataggagtaattgaaccaaacccacagagttgtgaagattaaggtaaattgtttgtataaagctcctggcttagagtagacaccaattaaaagctaatctcacctgccacatataaaaccactggaagaaaactgttcttgaatt

SEQ ID NO: 134225 - DNA, 601 bp, Human
caaggccccttggacacatgcttggtggcctaacccactggatagtccaaatcatcaagatagagatggggtccttaaatctatggttttaaaatgttttctgagtaattctgatatgcatcaggttgaccaccactagtaaaagcctttagacaaggattttgttttttggagacttaggggtttccatctgaaactttgagtcccacaggaaatttgacggaatgggaaagagaatgggtttgggagtggctcagacctgagcctgaatccaatcttttcctgttagtaactatgagarctcggataggctttccaggctctctgaggttccatatcctttctttatagatgcagcccatccctctttctgcaaataggagtaattgaaccaaacccacagagttgtgaagattaaggtaaattgtttgtataaagctcctggcttagagtagacaccaattaaaagctaatctcacctgccacatataaaaccactggaagaaaactgttcttgaattttgtttcatcttcatttgggggcaattatcttctgcttctttctgttatctaatggcctagccttcaagatttcagatgt

SEQ ID NO: 134226 - DNA, 601 bp, Human
atcaggttgaccaccactagtaaaagcctttagacaaggattttgttttttggagacttaggggtttccatctgaaactttgagtcccacaggaaatttgacggaatgggaaagagaatgggtttgggagtggctcagacctgagcctgaatccaatcttttcctgttagtaactatgagagctcggataggctttccaggctctctgaggttccatatcctttctttatagatgcagcccatccctctttctgcaaataggagtaattgaaccaaacccacagagttgtgaagattaagrtaaattgtttgtataaagctcctggcttagagtagacaccaattaaaagctaatctcacctgccacatataaaaccactggaagaaaactgttcttgaattttgtttcatcttcatttgggggcaattatcttctgcttctttctgttatctaatggcctagccttcaagatttcagatgttgtcagataagttggttttctttaccccccaccaccatcctttgagcccaagaccgatttgcttggttgtctgctatacaaccacatggatattgttagactttgtgtttctgcagttg

SEQ ID NO: 134227 - DNA, 601 bp, Human
accaaacccacagagttgtgaagattaaggtaaattgtttgtataaagctcctggcttagagtagacaccaattaaaagctaatctcacctgccacatataaaaccactggaagaaaactgttcttgaattttgtttcatcttcatttgggggcaattatcttctgcttctttctgttatctaatggcctagccttcaagatttcagatgttgtcagataagttggttttctttaccccccaccaccatcctttgagcccaagaccgatttgcttggttgtctgctatacaaccacatggrtattgttagactttgtgtttctgcagttgaagtacttacacacttccactctaaaatcttctctttgtcctgtgttctttatctcacatttgtatcatcacctcccacgttttcagtctagagacgaacacagtggttctcaaccttggctgcacattagaatcgcctttgggattttaaaaactgccgtgtccagaccacatgccaaaccaattacatcagaatgtttaggagtgaaatttctgaatttgttattgatctgtaacatacaaaaagtacaacacatatatcataagtata

SEQ ID NO: 134228 - DNA, 601 bp, Human
aaaggtacatggttcaagaaactgaacattgtcaacatcccaaaacctccttccacagatcctagctgcccttacctttaatactatacatttttatctgtcttgtaactgaaatatgatcatagaacatgtattcttttgatctggcttattttgttcatctttctatttgtcctacttctttcattctcattgctctgtagaattcccttgtgagaacatagcacagtttacttgtccattttctccactgatgagcatttaggtgtttgcattttctagatattttgaatagcacagttttttttttaaattttttttttattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccatagtccccagagtgtgatattccccttcctgtgtccatgtgatctcattgttcaattcccacctatgagtgagaatatgcggtgtttggttttttgttcttgcgatagtttactgagaatgatg

SEQ ID NO: 134229 - DNA, 601 bp, Human
ttcaagaaactgaacattgtcaacatcccaaaacctccttccacagatcctagctgcccttacctttaatactatacatttttatctgtcttgtaactgaaatatgatcatagaacatgtattcttttgatctggcttattttgttcatctttctatttgtcctacttctttcattctcattgctctgtagaattcccttgtgagaacatagcacagtttacttgtccattttctccactgatgagcatttaggtgtttgcattttctagatattttgaatagcacagttttttttttaawttttttttttattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccatagtccccagagtgtgatattccccttcctgtgtccatgtgatctcattgttcaattcccacctatgagtgagaatatgcggtgtttggttttttgttcttgcgatagtttactgagaatgatggtttccaatttc

SEQ ID NO: 134230 - DNA, 601 bp, Human
cattgctttgtacatgtctgttatgcatgtacacatttctgatggatatacacctagaagtggagttactgggttgcagggtatgtgtctattcagctttagtaaacactaccaaattgttgtccagaattttctaccaatttatcctcctaccagcagtatttgagagttctggttgttccaaactctgaacacttgatctatctctgttttgtatactttactcagattctccaggtacctagaatggcctttcccaggtctctccctttacggttcactctttcagaaagcccagctsgagcatcatctgttcattagccttcccagccttactctttcaggtggaatttgttactgtgtcttctgcagtgtaaatattaatacattacagcctcacccacactctgcctcacagcagtgagtgagcactctgactctccacctggataataagctttttaagagcagaggctgcacctcacttctttcagagtccccctagacatagcacttgcacattataggtgcttcatgaatatttcttttgctcactttatcacagagaaaatcttttaaaaatagatttttggtaaatgac

SEQ ID NO: 134231 - DNA, 601 bp, Human
agcatcatctgttcattagccttcccagccttactctttcaggtggaatttgttactgtgtcttctgcagtgtaaatattaatacattacagcctcacccacactctgcctcacagcagtgagtgagcactctgactctccacctggataataagctttttaagagcagaggctgcacctcacttctttcagagtccccctagacatagcacttgcacattataggtgcttcatgaatatttcttttgctcactttatcacagagaaaatcttttaaaaatagatttttggtaaatgactrtattcaaccaggcagtgaaacttcacatttcttctgtatagggaatgcataattgtttccagtgtaacctccttattgattttaatcaatttaatcttttttaaactccttggtgtgggactcgtgatttggtgtaggactcatgatttagcttgggaactctctttttcggggaaaataagagccttttttctgattctgtgagagcacgtgatcactttttgtcatcctcacatagagcagattttcatggcataatttaagaaggaagtgcttccaaagagccagattcctaaggga

SEQ ID NO: 134232 - DNA, 601 bp, Human
agtggaactgtactcttctgtactttacgaaatggagtcaggagaaatgaaaagactcagtggtagccttggaatccttaacatttaattagtgtgaaggaaaagcaggcctggtgccaaggagacctgctctcaaaccatcctatgagaccacagagtgagtggtgtgatcagattgtatcagcagcctctagtgccattccaaagcacagtgggcggtcatggtacttctgaacaggaaagctttacctaagggtttgaaaaaatgatgtatacagaagcattttataaaaaattaaartgtttaaatgaagtaattcagtacacagtggggaagagcaaggaaaaactggaagccacaggcacctctgcatctttctgtcaccctctctaacgcacgccagccttcatagtattagggctgctgcttcaacttcacctcccaaatcttgcgcaacctcactttggaccaattctgatttttgtccatggaaacacgcaaggaagggactctgggcagtgcagttctctgtgcaaccaagttgtcagtagagcattccagaacacacacacagacaggggagcctggaaggaggaaaga

SEQ ID NO: 134233 - DNA, 601 bp, Human
tgagaaatgattttgaaaatagttctgtttcatacatggtataagtgaaacaaggcataaggcccactctgcaggaatttaccattggttccttattttaatccttagactcctagaattgaactataaaactagaataaaatttagagatcatcacataattcgagagtttgtaaaaagctctccatggaagcacccagctccacagagtcactgcaggggccaccacagtgaagggaggatggggaagggcacacagtgatagaatttgagcgtgtaatcctgcttcatccagaacagwattgctgtaattcattttaagatcttaagggaaagggagagtttagtgctttaaaaaagtggttgataagactgactgacggagagaacactggagcgtactgaaggtacacttatcagtagctgagctactttgtaggctgctctgagacctgatcctccatccagccctatttccgcagtgtcacattgcctactctgaaagcttgttctctcttcaccttcagcttccagagctaagctcagcatgatcaacaccatgtcaaaaatccgtggccaggagaaggggccaggctatcct

SEQ ID NO: 134234 - DNA, 601 bp, Human
gagaaatgattttgaaaatagttctgtttcatacatggtataagtgaaacaaggcataaggcccactctgcaggaatttaccattggttccttattttaatccttagactcctagaattgaactataaaactagaataaaatttagagatcatcacataattcgagagtttgtaaaaagctctccatggaagcacccagctccacagagtcactgcaggggccaccacagtgaagggaggatggggaagggcacacagtgatagaatttgagcgtgtaatcctgcttcatccagaacagarttgctgtaattcattttaagatcttaagggaaagggagagtttagtgctttaaaaaagtggttgataagactgactgacggagagaacactggagcgtactgaaggtacacttatcagtagctgagctactttgtaggctgctctgagacctgatcctccatccagccctatttccgcagtgtcacattgcctactctgaaagcttgttctctcttcaccttcagcttccagagctaagctcagcatgatcaacaccatgtcaaaaatccgtggccaggagaaggggccaggctatcctc

SEQ ID NO: 134235 - DNA, 601 bp, Human; identical to SEQ ID NO: 26362

SEQ ID NO: 134236 - DNA, 601 bp, Human; identical to SEQ ID NO: 26363

SEQ ID NO: 134237 - DNA, 601 bp, Human; identical to SEQ ID NO: 26364

SEQ ID NO: 134238 - DNA, 601 bp, Human; identical to SEQ ID NO: 26365

SEQ ID NO: 134239 - DNA, 601 bp, Human; identical to SEQ ID NO: 26366

SEQ ID NO: 134240 - DNA, 601 bp, Human; identical to SEQ ID NO: 26367

SEQ ID NO: 134241 - DNA, 601 bp, Human; identical to SEQ ID NO: 26368

SEQ ID NO: 134242 - DNA, 601 bp, Human; identical to SEQ ID NO: 26369

SEQ ID NO: 134243 - DNA, 601 bp, Human; identical to SEQ ID NO: 26370

SEQ ID NO: 134244 - DNA, 601 bp, Human; identical to SEQ ID NO: 26371

SEQ ID NO: 134245 - DNA, 601 bp, Human; identical to SEQ ID NO: 26372

SEQ ID NO: 134246 - DNA, 601 bp, Human; identical to SEQ ID NO: 26373

SEQ ID NO: 134247 - DNA, 601 bp, Human; identical to SEQ ID NO: 26374

SEQ ID NO: 134248 - DNA, 601 bp, Human; identical to SEQ ID NO: 26375

SEQ ID NO: 134249 - DNA, 601 bp, Human; identical to SEQ ID NO: 26376

SEQ ID NO: 134250 - DNA, 601 bp, Human; identical to SEQ ID NO: 26377

SEQ ID NO: 134251 - DNA, 601 bp, Human; identical to SEQ ID NO: 26378

SEQ ID NO: 134252 - DNA, 601 bp, Human; identical to SEQ ID NO: 26379

SEQ ID NO: 134253 - DNA, 601 bp, Human; identical to SEQ ID NO: 26380

SEQ ID NO: 134254 - DNA, 601 bp, Human
aactcagtgacaaagataaaacatctgccaaaacacagatgacagcatgagcaagtgtcctaatggtaggcatttagtgtaatgctttaaaaaacactgcctctagactgctggggcggccccataaatacgtacttttaaataggcatttacttccttaaaatggcaacttgtaattaaaaataatatattctttaagagaaaacatttttatttaaacaagccaaattactactagacttagacgatggaaaaaaattttatttaatcatatgtaccctgatttaaaaaaaaaaacaaytcattttgaacaaagaggaatcattcaaccactgaaaagacagttcacaacaccatcattatttatttaaagttttatttgctagctaataaataccactgaaactatgcacttttaaacaaagtataattgtacatgagtgggggcagagtggaatgcaacatagtaattcatttcacatcttgcataccattaaggtgccttccagtttgcctgtaattgcatgaaatgagtatctgagataacttcttttaccacaaaggccactaacactgtagagggtgccaggaaaggtccctg

SEQ ID NO: 134255 - DNA, 601 bp, Human
aacaactcagtgacaaagataaaacatctgccaaaacacagatgacagcatgagcaagtgtcctaatggtaggcatttagtgtaatgctttaaaaaacactgcctctagactgctggggcggccccataaatacgtacttttaaataggcatttacttccttaaaatggcaacttgtaattaaaaataatatattctttaagagaaaacatttttatttaaacaagccaaattactactagacttagacgatggaaaaaaattttatttaatcatatgtaccctgatttaaaaaaaaaaamaactcattttgaacaaagaggaatcattcaaccactgaaaagacagttcacaacaccatcattatttatttaaagttttatttgctagctaataaataccactgaaactatgcacttttaaacaaagtataattgtacatgagtgggggcagagtggaatgcaacatagtaattcatttcacatcttgcataccattaaggtgccttccagtttgcctgtaattgcatgaaatgagtatctgagataacttcttttaccacaaaggccactaacactgtagagggtgccaggaaaggtcc

SEQ ID NO: 134256 - DNA, 601 bp, Human
ggtatctcctgattacgaatttcctcctgctttgtccaccccatcctagtttgctttctttgttgaaatctattccttgactcacactaaatgttagtgtccctaagggcttcagattcagtaccctctgccccctagtattttccctgactcccatggttttcttcacctgcaaacttttaaataaaaaactgaatcatgcactgcctttcttctaaactgcagatgttggacagccaactgtctgctgtgcacttccacttggatgtaatacagttacttcaaagtcagtatgtccaamaacttacgtacccccacttcttaccctcagcctaaatcactttgctaaagtattttctatcatctaccagtgaaccagacctggacctaagaatcacattagattactccctctccttagccatggagaattcttagtaggttcaacctaattaatagttcctaaatccaatgtctgttgaatgaatgaattagacactcatcctcccccctcgaactactgccatacccttctaaccagctccctgcctccatcctcaaggtttctccatcctggccctgatgtattttctacagttcc

SEQ ID NO: 134257 - DNA, 601 bp, Human
ctcatatcatagtctagaaaagagctttgtagtggcagagaagactcaatccatggtggtcacagcacacaagttcaggttagaaattttaaaaatgcaatcaacatttgtcaagaattacctgtgatgaaatattgtgataggatgtggggatatagtgatgaaaaaatatagttattatcttttaggagcttacaattctcaaatgggcgatgataagtatataatacaaggttacaagtgttatcttttctgcatggacaacgtccttatggatgggcagaagagtaattggtcttayagatttctaagaaaattcatgttgctaataggcaaaaacagaagaatgtcatagtccctgctcctccgggccttcaatctttaccattttacatatttcatgtaaatgttcgcttctttttaacaactcttaaattactcccttctgccctttatcccatactctccaacagtcctctctccctatttcttaatacaaactgaaaccttcagaggagaatcctgaagcttccaatactccttccctataaacctacctgtaaccccaactatccacacctttttttttttttgcttcctt

SEQ ID NO: 134258 - DNA, 601 bp, Human
actgtactttaatatacaaagtaaataggatgaatcaaatcatatctttccactaggatggaaaatcttaaaatactaatgaggaaaaaaaaaacattatctgtggctactttcccatagcaaaatataggcagcaatagacattttgtatgggagtcttgaatgacattttcccacccccacatttcattgacactacagaacaacagtctccaaatgtatattatgggtattcttcctccaagaaaccacaaaacggtgaaaaagctaagtaagatgcaagttgaaaccaagagcagtwactgctaataagcatcctatctacgcttctcaataggataaactaccagttgttgccttatagaagaggcactgggtaaataaatgtaatcactcattgttcaactaaaatgtacaagaatgtgtaggaattgtagttgtcttccatattcttcagccactcagcaactcttttacctaagtagctacttggccttcccctcaaaacataaacaaaaacaaaacacaaattactaacaaatataaataaaatatcaactttgttaatagttcacacttaagatttacttctacataaact

SEQ ID NO: 134259 - DNA, 601 bp, Human
gtgaagtctagaaaacagctttctaatttcaagtccagtgctccttctaatggactatatcatacataggcacagaggtatataaaactatatcttatagtgtttccatgtattcagtcctagtcctccaaaaaatttaaaaaggcacaaagaatggtcactattatctgcattctattaagtagaattcacttctctattgagcaaattctgtttctcatttatgcctgtatttgcaaaaatcacgacatagtaaaaatggtttctaatgcttaaatcctcaaagtccgtgacaagtaartattcttattagaaaagaacttatactccatagtaagagtcctgccccatttaacctttttgtgcagataactttttaactggtttttgtttgtttgttgtttttttcagttaaaaatggttacaacatagtggcaccagatactggtgaggatgtggagaaaccagatcactcttacattgttgatggaaatgtaaaatgaaatagccactctggaaaagtctggcagtttctttaaaaactaagcatatacttaccatacagcccagtaaccatacttctgagcatttatcccagaga

SEQ ID NO: 134260 - DNA, 601 bp, Human
tattaaacagtgaagtctagaaaacagctttctaatttcaagtccagtgctccttctaatggactatatcatacataggcacagaggtatataaaactatatcttatagtgtttccatgtattcagtcctagtcctccaaaaaatttaaaaaggcacaaagaatggtcactattatctgcattctattaagtagaattcacttctctattgagcaaattctgtttctcatttatgcctgtatttgcaaaaatcacgacatagtaaaaatggtttctaatgcttaaatcctcaaagtccgtracaagtaagtattcttattagaaaagaacttatactccatagtaagagtcctgccccatttaacctttttgtgcagataactttttaactggtttttgtttgtttgttgtttttttcagttaaaaatggttacaacatagtggcaccagatactggtgaggatgtggagaaaccagatcactcttacattgttgatggaaatgtaaaatgaaatagccactctggaaaagtctggcagtttctttaaaaactaagcatatacttaccatacagcccagtaaccatacttctgagcattta

SEQ ID NO: 134261 - DNA, 601 bp, Human
caagctgaagtgttattaaaacccaggacctcatttgtcttatcactgtacaaaaatgagacaacctaaaaaagtgaagacaccattcctatcaacaaagtgtctccttcaaactcccacaaacatagggaacaccaggttacacacacacacacacgcatacaccacagtaacatttacaatcctaaaatgcaaaccaaatttttacttgatgtttcaggattgtgatggcttttctgatgtgtcgacttgctaggctacagtcccattatttatttaatcaaacccagaattctaaggyggtcccaaaacccctgccctagccatgcatcttttataattccctccccttgtgtgtgggagactaggactgtgaatgtattggatttcattttcatgattatatcacccagcaaaagggagtttgctgatgtaattaagatcccaaatcagctgactttaagaaagagagattatttttgagggagagagagctgacctaaccaagtggtctcttaaaagggtctgggttcttcctggcaaaataaactcaatatgtgagagggattcaacaagaggaagattctcctttgctggcttt

SEQ ID NO: 134262 - DNA, 601 bp, Human
tcctcaaggggagagtgagacatgatacttctttcagctctgaatttctatgccactaagaacataaattaagcttaaaatggactaagaacaatgtcagatatttttccatcacaagattaataaagataagccaaggacattcacatccttattctacccaagctatggctgacaactgtgtctatcactctcctccaattcctggacaggcagaatggcttccacgaaaatgaacttcttgctagtggaaaggcaaagaagtgatattacaagggtgtagtcaatgaataagtgtttmatttttgctttcaagctgaagtgttattaaaacccaggacctcatttgtcttatcactgtacaaaaatgagacaacctaaaaaagtgaagacaccattcctatcaacaaagtgtctccttcaaactcccacaaacatagggaacaccaggttacacacacacacacacgcatacaccacagtaacatttacaatcctaaaatgcaaaccaaatttttacttgatgtttcaggattgtgatggcttttctgatgtgtcgacttgctaggctacagtcccattatttatttaatcaaaccca

SEQ ID NO: 134263 - DNA, 601 bp, Human
tctcctgtctcagcctcccaagtagctgggattataggcaggcgccaccatgcccagctaaattttgtaattttggtagagacagggttttatcatgttggccaggctggtctcaaattcctgacctcaggtgatccacctgcctcagcctcccaaagtgctggtattacaggcgtgggctgccacacctggcctgtctaagtgattcttaactggaacttatcagtttgtcactctcccttctcattattgtgccaggattttaaattgttccctgatatgtggggcgggtggggggggsgggcacacaatggagaagggcatccaggattctctcagtttgaaatcactgctgcacatttctgctgtatttgaactacagtcactgatgaacatgttcctcctctctctaatttgttacagtgggaaaagtttgaggatcatggaattagatatttaagaaccaactgagatgctgggggaaaaaaaccaacattttatataaagccacttatatgcctattaagctattgatttgttatggtagtactgtcagatgacgttaactcttgttcctcaaggggagagtgagacatgatac

SEQ ID NO: 134264 - DNA, 601 bp, Human
aataatgtctcatcatgtcaagctttcagtaaaaaatctgaatcgccagctacttggggtgtgatagaaataattcgtaaattagatgatgagatagactagatgactacttgatgactcccagattctatgtgaaacaagaaatatgagacatttcaatgacagagaggaagattacagaacaaaaaatactgtctaagtgattcttttttttttatttttgagatggagtctcactctgttgcccaggctggagtgcagtggtgtggtctcagctcactgcaacctccacctcccgggytcaagcaattctcctgtctcagcctcccaagtagctgggattataggcaggcgccaccatgcccagctaaattttgtaattttggtagagacagggttttatcatgttggccaggctggtctcaaattcctgacctcaggtgatccacctgcctcagcctcccaaagtgctggtattacaggcgtgggctgccacacctggcctgtctaagtgattcttaactggaacttatcagtttgtcactctcccttctcattattgtgccaggattttaaattgttccctgatatgtggggcggg

SEQ ID NO: 134265 - DNA, 601 bp, Human
caggcatgtagcttggtgtccagcaatcagtaggcaccctgtcactaggtatttgcagaataagtaaacaaatcaggtcaacattctgctctcctaataagttttagctactcagtattatgtgcttagatataggttcacccttcatggaaataaaatcctcaaaataaatgcaaaacggggaggcagtacagtgcagtggtaaacagtactagttcaaatcccagtactatcaggaaacggctgggtgattgcgggcaaattgcctaatctatctgtgcctgtttcttatctacaaaaygggaataacaacagtgtctatgcccatagagtttctgggagaaataaatgtcatttcagatatagagtactttgcacagaacctgtcaagcagagcaagagctccacaaatggttagctactattatcatcaacacctttaaatgtgagcgcaggctgggtgaatcatgtatagacatacctcttccatgcacatacacacacatctacctgtttcaagatgagccaaaacaaaaaattcccaccaaaatatttctttaggtttataagcacgttccttaaaatatgaccagtacaaaaa

SEQ ID NO: 134266 - DNA, 601 bp, Human
agacatctttcaagatacagctctggtataaagaaactctttctcctcagagtgagcaaatgagggcataacctgctgtctttactgaaagtttagcctggtaaaggtccaggtttgtcttggaccacaaagactcacatgcagagctggaaaaaccactgagagaaatcccctgtagccaagtacagaccataaatggtaatcaggaaaagttaagcagaactagaaatctataaaataaaagtcatgggtctgagttattatgaatgctttagaagatttaccatactggattctaaawaatatacatctaagcaggtggagaatagaggtgctttctatttctatttggtggaatgctcaggccatcaacagaggcactaacagaaaagttagatttggatccatgactatctcaaagatgtgacaaggcatgggatgcacatacattcgtgtctccctggcttaaatgtgggtgctacaaaaccagggcaatatgcacatcacacccacatttcaggcatgtagcttggtgtccagcaatcagtaggcaccctgtcactaggtatttgcagaataagtaaacaaatcaggtcaacat

SEQ ID NO: 134267 - DNA, 601 bp, Human
caaacaaagcgtctgaaattcaatactatcagttaagccttggtgtttgattctagcaatctctgagctgtttgctaagcatagagattctgcttaaaagttcctaagttaaagctaagctaaaggtgaaggtatttaggaacatttccctgtaagaggcctttatctttgaaacgtggtccagggctcaccaagtgctggctgggctctgggagtttaagagtcttctcaggcttcttcctcagtaggaccaatggcatcctgagacatctttcaagatacagctctggtataaagaaastctttctcctcagagtgagcaaatgagggcataacctgctgtctttactgaaagtttagcctggtaaaggtccaggtttgtcttggaccacaaagactcacatgcagagctggaaaaaccactgagagaaatcccctgtagccaagtacagaccataaatggtaatcaggaaaagttaagcagaactagaaatctataaaataaaagtcatgggtctgagttattatgaatgctttagaagatttaccatactggattctaaaaaatatacatctaagcaggtggagaatagaggtgctt

SEQ ID NO: 134268 - DNA, 601 bp, Human
gcaagaaagatgaaagagtaaagaaataaaaactgacaaatgctaggagtgaaatttgaatagaccataaatggagtaagagaagaaatagctgattgtgcgaatgtcgacattactgcaatgcaagaaactctagagatgaagccagaagaactcagcgaaggtggacttactgatataaatgaggaaagtgaggaggatgtaacaaaaagaataaagatgtcccagaggaagtgactggcaataaaataaactttaaacattcaaaaaaacattaaaggaattctttcatgacattgasagtgcaaaggataaaacggtagaaaccgatccaaacttagaaaggggtatgacaattcaccaagccatagagaagatgcttgctctgtatccaaagttatgcaagaagaacacacaagtgttgttcaaactactcttgataacacactttcattctcgatgtttctaatgatttaatttaccacatactaaatactagctttactatttttcatttcccaatgccgttgttattgataataacagagtttttaaggttttaacaacaaaaaaaattttaaaggtcatggaacaatataat

SEQ ID NO: 134269 - DNA, 601 bp, Human
actatgtaaatagcagatgtcccatcatgatcagtgatcaaccatgtcacttcttttgaagactgttggtgactagtcactgtacatctgatatttaggtcatgcacagacagcaaagtatggagttttgttacctccttgtttcccagtgataaacccatgtgacattttataatggataaatcaaaagaggaaactaggcaagaaagatgaaagagtaaagaaataaaaactgacaaatgctaggagtgaaatttgaatagaccataaatggagtaagagaagaaatagctgattgtgsgaatgtcgacattactgcaatgcaagaaactctagagatgaagccagaagaactcagcgaaggtggacttactgatataaatgaggaaagtgaggaggatgtaacaaaaagaataaagatgtcccagaggaagtgactggcaataaaataaactttaaacattcaaaaaaacattaaaggaattctttcatgacattgagagtgcaaaggataaaacggtagaaaccgatccaaacttagaaaggggtatgacaattcaccaagccatagagaagatgcttgctctgtatccaaagttat

SEQ ID NO: 134270 - DNA, 601 bp, Human
ctgagccgtaaccaaaatctctgtggagtaattttgagcagggaggggaaagttgaaaaaaaaaaattaaagatgcctagaatacagttttaaatttggaatcaagtacagcagtcctcactttgcactattctgatatgaattccagttaccatggtttaatcaaataaatccctcataaacagtccaaatttcaattaccacaatatattaactgagtaactgcataaagtacaacttcactgctatttcttcagttcaaaaataactatgtaaatagcagatgtcccatcatgatcartgatcaaccatgtcacttcttttgaagactgttggtgactagtcactgtacatctgatatttaggtcatgcacagacagcaaagtatggagttttgttacctccttgtttcccagtgataaacccatgtgacattttataatggataaatcaaaagaggaaactaggcaagaaagatgaaagagtaaagaaataaaaactgacaaatgctaggagtgaaatttgaatagaccataaatggagtaagagaagaaatagctgattgtgcgaatgtcgacattactgcaatgcaagaaactct

SEQ ID NO: 134271 - DNA, 601 bp, Human
aaactgttttcagacattgtcaatgcccccgatgagcaaaaccactccaagtgacaacacaacactgatgtacataatactaatgggaaataatgggttaattaacaatattgagaaaaagagaattttgtcctaccttataaaaaattagtaaacaatctggaaatctagttattttgttttgaaaaaaatgacagaataaaactgggcagattacacccttgtgaaatcctgatgaagaaaaaaagcttaaattgttcaattaaaatattttaataaaaataaactgcaaagactcaaygggattcatcatacatgttattgtttctgctgctagctccactgtcaagtatctcataccttctctgaaagaatggaatgggtcaatctgcgaatattagttcttttactatatatgaatcttttaaattttggttaatattgaagttgattttttcaccaaggaagttgtttaaggcaacctaaaagcaaactgagtagcggaaagaaacagcgtgtgattgaaatgctgctgtgtgtcatccacatagagatagtctccatgacagtaatcaattggtggctgtcatgaaggggaaaa

SEQ ID NO: 134272 - DNA, 601 bp, Human
tccaagtaattgtgctagagctaagatactcaaacctgaaatcagaagagggccatgcattggtatacacgctgtaaaaacaaataaaattctgtattagaaaagcatatgaaataacttactaaaaaacagtaataatcccaagttttaagagagttattctaatgatcaaaaaacaaaaattatccatatatgtttattaacttaaccagtaaaatgactcaaaattattagaagaacaaagccctcctttgcataacacataccttatcatatcaagaaatgggaactggtgtttcamgtctaaggctccaaccaatttgagcccagttattttaaaagctcttccacaaatacaggcatatcagtttgggtgctagaacaatcagccaccaagccatatatacagctaatatctttgtagcgaggaggaaagcactattaccactggggtaaattggaagtttaaaaagaaaagctcagaatgctaaatgctgtcaagtatatgaatgaacaaaaactcttatttattggtggtgataatacaaaatggtacagctattttgatacagagagtttggcagtttatttcaacatactc

SEQ ID NO: 134273 - DNA, 601 bp, Human
aaggtatctcatactacttcaccagagttgtatggatactgcaaatcacacactattctcaggcatttgtggggagcaacaaaaccaggagtgtcatcttccagaaccagacacatggtgattggaagatgtaacaaaaatagaatatgcaccaacattcaagatgttcactgtagctaccacatgaattccattctgctttagatgtctccattgtattttatggcattatgtggtataaaattagaaaatttcattgagcaacaactaagacttatgaactcatatgctaaggatacgyagattttagttaagtattttaattatttatctaataagcattaattaaagaaagacacagaatatatgacagaattgaattcaattaacaatcatcaagaaccaaagttcagaaataaaggtaaaagttttttgaaactattatgtgagtcatatgagaaattatttgactataacaattcaagtttcgtattaagttttagaaacacatacagcaaagtttacctaaagcaaagcagaaacactatttttttactccattaatttataacttttgattattttgataggtggttaagag

SEQ ID NO: 134274 - DNA, 601 bp, Human
gataaggttttagagttacatttttgagctcataaatgtatttatcagaataaacactgccaggtgtagtggcacatgcctgtagtcccagctacttgggaggctgaggtgggagcattgcttgagcccaggagctcgaggccagcctggtcaacataatgagaccctgtctctaaaaacaaaacaaaacaaaatagaatattgctaaccgccaagtaactccttttcttccctaataatgtagaaagaatactttctagttctaaatctccgatccaagggatgtcacagttggctggcycattctgaaaaaaaaagatttatgaagaatggtacttcaaagggacatcagtcagttgtgatccctctaaatattataaaaccaaacagtgtacaagttaatttcacctgagttaattctctccaatatggatataacccatgtgacaaaagaattattacgatttctgctgctaccatgagcctaagacattgacagccatatatatatattttttaaccacaagccttaagcattccatatgagcatacttgcaatgcttcttgatttgttcttctctccctgaaacatctgactcca

SEQ ID NO: 134275 - DNA, 601 bp, Human
ggttgtatagtcttctgattggaagctgatataaataacaaataagaatataaatttaataaatgaaataaactaaggcatttggtaatgtttaattttaagataaaatgttcagggctaaaactaaaggtgccagagatgttaatgaaagagttccagctctgacagtctattcaaacatgctgaatattcttgattatatacactgatttgaaaaatgaagcaaataacccatctacatcaaatagtaaacacattctctcatttgtttatgccatctttcccccaaatcagccacttsttacactggctggtgggaaaatgctgtcaccaacatacccccaccatgggtgctccatcctccctcctctatctacccagagtgtagacagaatgtgccagaatttgtccccactactccatctcccttagctcactgctcctgtgtcttacaagctcagtctctttctccacatcactccctgggtctttccagtttcaaagctccaaagagctaacaaactaaagaaaatactcagatagctctgagtattcctctatctatttcttcttagctttctgagttgcctttttcactgct

SEQ ID NO: 134276 - DNA, 601 bp, Human
cccattcatgcaaaggtcatgcaatgacttcaacattctcttaatttgacgtgagacaaaacagatagcaaaatatctcaattaccaagttcctcagtctaatccctcaaatgatcattcacaattcatttaataaactttaacttaccctaggaggttgtatagtcttctgattggaagctgatataaataacaaataagaatataaatttaataaatgaaataaactaaggcatttggtaatgtttaattttaagataaaatgttcagggctaaaactaaaggtgccagagatgttaawgaaagagttccagctctgacagtctattcaaacatgctgaatattcttgattatatacactgatttgaaaaatgaagcaaataacccatctacatcaaatagtaaacacattctctcatttgtttatgccatctttcccccaaatcagccacttgttacactggctggtgggaaaatgctgtcaccaacatacccccaccatgggtgctccatcctccctcctctatctacccagagtgtagacagaatgtgccagaatttgtccccactactccatctcccttagctcactgctcctgt

SEQ ID NO: 134277 - DNA, 601 bp, Human
cgaggagtgattataaatatcaaaggtaagaagacattttttgataagataaaaacataaacataattactaaatgccaacaaaactgaggaatcataatatgttaaggtaaaaccaaaataaatgcttgtagcactcaatatctcaaacctatgtatctttaagaacaaatatatttctttgaaatattctataaagattagaagttattagcccagagttcttaaaaaaaaaatggaagcaaaagctgaggacgaaacatctctctctctctctctctctctctctctctctctctcttaacctctctctttaatcatctcccaaaaggttagaaccaagctcctgattggaaaagcagagatgttaagtccccatgggttaaatgcaacaaaatcaccaacacaagcataaaagaaactctgtcaaaatgataaagatttgtgccagattatttatgtgccttataaaaggcatcttaaagttacagtcaccagacacggaatctgaaaaacattttacaaaaagtggtaatttctctttgctgggagccatatgactggagtctgattcgtgacaccctacagtttttacagtagta

SEQ ID NO: 134278 - DNA, 601 bp, Human
ctggcctgttggcctgatggtgacacacattttgttgccatgcaggagactcatagttcaaatttcaatcttgcttttttcatgccccagatcagaaaagaagtgaagaaacactgtagatttttgccttcaaatcagaggaagggaatacatatgttacaaccatagctatttttgctgaaaagtgtgaacacagtgctctgagaacaagtctggctccttcctgcaactggtgctaccgtgtcactagaccatgttcaaagaggagaaaaggtgctacatcttgtacagcagaagcaartaacaggaggacaagacagggtttcaaggggttatgtgaataaaaggaaaacatatccatcaataaaagtaccctaaatctgggaaggacctgttacactgtttgttgaagggggaatgtgggaatggcaacccccaagaatgaggaccactatctccatcaatatcacatcatacggagatcatacaagatgctcccaaccaaattcctgcctgtacttaatttattattccattgacccagaagtggcagacacctctcagctaatgccatactgccataactgcccaaagctgctgt

SEQ ID NO: 134279 - DNA, 601 bp, Human; identical to SEQ ID NO: 22804

SEQ ID NO: 134280 - DNA, 601 bp, Human; identical to SEQ ID NO: 22805

SEQ ID NO: 134281 - DNA, 601 bp, Human; identical to SEQ ID NO: 22806

SEQ ID NO: 134282 - DNA, 601 bp, Human
agcctaaatcagtcaatcagtgtcgatcagtcagtcagtgtttattgacgcccactcagggtcccaggcattccctgtcagggagagaattgaatgagatcaagtttttcattgttctatcaaagaagcttccaccataaatgtggtttgatggtgcatgctacctgctactcagcctagctgtcaaagcaacactggtaaacataaagatggctagcaattattaaatgcttactatgtgccaaatactgttttattactctatgtgatctgatatagttatatttcatgatagcactaygattatttccattttatagatgaggaaactgagtcaccaaaaggttaggtaacttgtctagggtcacagagccagtgagtgggggtactggaatttgaactcatgctatctggcttgggagagcccacttttagccactggatgctctactgattgtgacaatttgtctcttttggaattcactgtgattttcaaaatggtatctccagaaactcctccaattaatccctgaaatgtaagggtagtctctttttcttttctagaaacctgatcctggcaaaatgattagctttaacagta

SEQ ID NO: 134283 - DNA, 601 bp, Human
cagctcccgagccagccagtctggacccaaatgccacctgtgctcttggctggtcttgcgcattcaccgaggctcactgtaccttggtgttcccatttctaaaataaggcctgtagtaatccctacctcactgagttgttgagagacttcatgtaaattgtttagcagggagcctggcacagaacaagagcctagcagaaaagtaagctgttgttactttaagcaaatatttagcagcctaaaatggtggctttaccagtttctgtaatggttgaagtgatgacagaattcagccaatccyacccatagtttttcttgctaataaagcagtttgtttctaagtgtgttttgatgcgtataattaatacttcctgtccttgatttttggctgaaaaatgtcttctcttcctcgcaccctctgttattcccgtagtgaatattttcattgtggaagagaaattcccattggctcatggttggcattttatttctcctgtccagagacaatatttccacagcctcaaacgtgaaaactgaaaatctggtgccacttaccaccttgtaaaatcaagtcattgtaattgtgccagtataatcattg

SEQ ID NO: 134284 - DNA, 601 bp, Human
gtctggacccaaatgccacctgtgctcttggctggtcttgcgcattcaccgaggctcactgtaccttggtgttcccatttctaaaataaggcctgtagtaatccctacctcactgagttgttgagagacttcatgtaaattgtttagcagggagcctggcacagaacaagagcctagcagaaaagtaagctgttgttactttaagcaaatatttagcagcctaaaatggtggctttaccagtttctgtaatggttgaagtgatgacagaattcagccaatcccacccatagtttttcttgytaataaagcagtttgtttctaagtgtgttttgatgcgtataattaatacttcctgtccttgatttttggctgaaaaatgtcttctcttcctcgcaccctctgttattcccgtagtgaatattttcattgtggaagagaaattcccattggctcatggttggcattttatttctcctgtccagagacaatatttccacagcctcaaacgtgaaaactgaaaatctggtgccacttaccaccttgtaaaatcaagtcattgtaattgtgccagtataatcattgatctgaaataaaagcaga

SEQ ID NO: 134285 - DNA, 601 bp, Human
ggtagctggagagagaggccatcaggtaacttcacatctctctgtttccatttcctgccctcaaatgccttcataatagagtctacgtaataaggttatagggattcagtgcagatgaagtgctggcacttgatacgggatcagtaagtattagctattattctatcacattaagttgcataaactttaacctcattactcttaaattctctatagaaacctagtctttatctgtcttacaagccctcaaatttagctaatagcgttgttcattgaataccttaaaattgtatttaaagayaggccgtgaatacaattaggcattgctttttgaagccaaaataccatgagggtggggagggtcatgttcatttacccagatcagcaataaaaatactaatggctaacaaggctttctggggaaattgcctgtcattgggtagcccagtgcctctggtgtcagctgaccccggagtccatgaagacatgttaaaagaagaggaaatgtgaatgctttcaaaccagccatggctggcagcagaaggggaggcctttcagtctgttgcaaatggcctgtgacaataaaaatgcctttgtgggt

SEQ ID NO: 134286 - DNA, 601 bp, Human
gtcatgttcatttacccagatcagcaataaaaatactaatggctaacaaggctttctggggaaattgcctgtcattgggtagcccagtgcctctggtgtcagctgaccccggagtccatgaagacatgttaaaagaagaggaaatgtgaatgctttcaaaccagccatggctggcagcagaaggggaggcctttcagtctgttgcaaatggcctgtgacaataaaaatgcctttgtgggtattagcaggctgactgtggacagtctggatctgcggccactgcagggattcctggaacctkttgggaaggtgtccggcgagctcactgtggtgtctgttaggaatctggagcaaatcctatttcttttgaaagcacagagaactgtgtttttacattatacctttaggattttggccatggtttatatttcagtcaaaacaaatcattatgttccctaggcttttatataggttttcctggtcaggttgcatttgtttttcaactttactatctgtcattattgctgctcttattacaggttaacagattattaaactgcacttttcagtaccttgtagctaaagacagacaagtgcaggg

SEQ ID NO: 134287 - DNA, 601 bp, Human
tggccctgatagtagggagtggaggtggaatggccaaagggggacccagccaagggcgtggtagagcatggaaaggacagaagtgatgagagattgaggaggaaaagtgccaagatgcagggtgggaactgacagaggatgacttccagcctcagtcctgatatgggcgtcaatggcaggtgttcagaatggccttgaagatagtggcatctctatttatgagtgtctttgtactccatttccagtaattggagactttttcaccgtagattcttggaaggtgacacaattttttttttttcctttttggttgagggagggggacagggactgtgtatcttcagaaaggttaatatttgaggccaaggcaggcagatcacttgaggtcaggagttcaagaccagcctggccaacatggtgaaaccccgtctttactaaagatataaaaattagctgggcatggtggtaggcgcctgtaatcctagctactcaggaggttgaggcaggagactcacttgaacccgggaggcggaggttgaagtgagccaagatcgcgccaccgcactccagcctgaatgacaagagtgaaactcggtttccc

SEQ ID NO: 134288 - DNA, 601 bp, Human
gaaacctcctttaaaaataaagttatttaattagtccaaggtttaaatatttcccctggaatcttttacatgacaatgtcttagccagacaatttttaagaaacaaaattctccatcctaactcctatccccatcaacagtccaaatcttaacctttctttttttttttttagacagagtcgagctctgttgcccaggctggagcgtggtgatgcaatcttggctcactgcaacctccaccttccgggttcaagcgaaacccctgcctcagcctcccgagtagctgggactgcagatgtgyaccaccacgcccagctaattgttgtatttttagtagagacgtggtttagtagagacgacctcccaaagtgctgggattacaggagtgagccaccacacctggccagaaaccaggtgtttgatatcaggtgacggttgtgatcattgttcgcaccactactttgaaatgacatagttgccactggaccttgttatttaatgtgcgaataaagagacagttatttaaggcattaataagagctatattacaagtttttaaaagtcttttgaggactgtttcaaaaagtcttttgaggactgt

SEQ ID NO: 134289 - DNA, 601 bp, Human
ggagtgagccaccacacctggccagaaaccaggtgtttgatatcaggtgacggttgtgatcattgttcgcaccactactttgaaatgacatagttgccactggaccttgttatttaatgtgcgaataaagagacagttatttaaggcattaataagagctatattacaagtttttaaaagtcttttgaggactgtttcaaaaagtcttttgaggactgttctcctttgcaatcctctgtaaatgcaccattgcattccaacccgggcaacaagagcaaaactctatctaaaaaaaaaaaaattcatccacaggacagcgctggccttccgttagacttttgctgttgagtctgtaagttttcagcagctgtgtttctccaaggagcggggctactgctggttctttacgtctttcccccactgccctgcccctccctgcaccctagcagctgacacagtgttttgggatttgaagataacacaaaggctgtgttcagttaaacgtatgtctgtgtgtgtgtgtgtgtgtgtgtgtgtgcttgtgtgtgtgtgtgttttaataattttaacttctctgggtgaaggtgtaaattacaaaata

SEQ ID NO: 134290 - DNA, 601 bp, Human
gcggggatctgcattctgcttattccaggtgttttccaggccacttccccgattatgtaactttgatcaaatccagatgcggcagaatgtttgatagaagaggtcaaatggcatttgagaagaaaagcatttctgtattcatgactttggtttaatttcctgtgtgggcctggtctgccaaagttgtatgctcatggccacgaggttgacgcaccagagggaggcactcaagtgccttttcaggacagcctgaaggaagcctccctccccagcatgctttttcatgttaaattatcaattrtgtaagtttagggccaggcgcggtggctcctgcctgtaatcccagcactttgggaggctgaggtgagtagatcacttgagaccaggagttcaagaccagcctggccaacatggcaaaaccccgtctctactgaaaatgaaaaaaaaaaaaaaaaaaaaaacttagccaggcgcagtggctcacatctgtaatcccagctactcaggaggctgaggcaggagaatcacgtgaacctgggagctggaggttgcagtgagcctagatcgcaccactgcacttcagcctgggcgatggagtgag

SEQ ID NO: 134291 - DNA, 601 bp, Human
tgtgtgggcctggtctgccaaagttgtatgctcatggccacgaggttgacgcaccagagggaggcactcaagtgccttttcaggacagcctgaaggaagcctccctccccagcatgctttttcatgttaaattatcaattatgtaagtttagggccaggcgcggtggctcctgcctgtaatcccagcactttgggaggctgaggtgagtagatcacttgagaccaggagttcaagaccagcctggccaacatggcaaaaccccgtctctactgaaaatgaaaaaaaaaaaaaaaaaaaaaacttagccaggcgcagtggctcacatctgtaatcccagctactcaggaggctgaggcaggagaatcacgtgaacctgggagctggaggttgcagtgagcctagatcgcaccactgcacttcagcctgggcgatggagtgagactccaactcaaaaaaaaaaaaaaaaaatttcaattggcttctattaaagcttttttatgtttgtcattgttttctagtaataacaacaatccacattttttgtgagaaatataccataatatagagaagtataaagaaaatgtaaggccagacacggtg

SEQ ID NO: 134292 - DNA, 601 bp, Human
tcctgcctgtaatcccagcactttgggaggctgaggtgagtagatcacttgagaccaggagttcaagaccagcctggccaacatggcaaaaccccgtctctactgaaaatgaaaaaaaaaaaaaaaaaaaaaacttagccaggcgcagtggctcacatctgtaatcccagctactcaggaggctgaggcaggagaatcacgtgaacctgggagctggaggttgcagtgagcctagatcgcaccactgcacttcagcctgggcgatggagtgagactccaactcaaaaaaaaaaaaaaaaaatttcaattggcttctattaaagcttttttatgtttgtcattgttttctagtaataacaacaatccacattttttgtgagaaatataccataatatagagaagtataaagaaaatgtaaggccagacacggtggctcacgccgataatcccagcactttgggaggctgaggcaggcttatcacctgaggtcaggagttcgaaaccagcctggccaacatggtgaaaccccatctctactaaaaatacaaaaaaagtagccgagtgtggtggcgggcacctgtaatcccagctactcaggag

SEQ ID NO: 134293 - DNA, 601 bp, Human
cccttttctgtgctgttgtttaaaattagtgtatagaaataattgtgttgatcacttaggataaattcctagaggtaaatcagatattaaattctttatagacttctggttcatattccagttgccctcaatttatacacctactactagcattgtatgagagtgcccgtttctctgaaatcttacccacactggctgtcagcgtcaaaaagatgtatctgcagatttggcaaggaatttgcatttcagtgattattatcaagcgttcacacactttccatgtttaatggtaattttttttgtttttttttgagacgatgtctcactctgttgcccaggcagagtgcagtgccgcgaccttggctcactgcaacctctgcctcccaggttcaggtgattctcctgcctcaactccttagcagcttggattacaggcatgcgccaccatgcccggctaatttgtgtatttttagtagagacggggtttcaccatattggccaggttagtctcaaactcctgacctcaagtgattgcccgccttggcctcccgaagtggtgggattacaggtgtgagccaccgcacctggcctttaatgataa

SEQ ID NO: 134294 - DNA, 601 bp, Human
tgctgttgtttaaaattagtgtatagaaataattgtgttgatcacttaggataaattcctagaggtaaatcagatattaaattctttatagacttctggttcatattccagttgccctcaatttatacacctactactagcattgtatgagagtgcccgtttctctgaaatcttacccacactggctgtcagcgtcaaaaagatgtatctgcagatttggcaaggaatttgcatttcagtgattattatcaagcgttcacacactttccatgtttaatggtaattttttttgtttttttttgagacgatgtctcactctgttgcccaggcagagtgcagtgccgcgaccttggctcactgcaacctctgcctcccaggttcaggtgattctcctgcctcaactccttagcagcttggattacaggcatgcgccaccatgcccggctaatttgtgtatttttagtagagacggggtttcaccatattggccaggttagtctcaaactcctgacctcaagtgattgcccgccttggcctcccgaagtggtgggattacaggtgtgagccaccgcacctggcctttaatgataatgtaaatttt

SEQ ID NO: 134295 - DNA, 601 bp, Human
cttcttctacactctaggagatgtcagtattgcaagatcctgttccttgaaattatctttgccccccgccattcagaaaaattaccaaatattgtaataatgtaatttaggacttaccctttcagagaaacagttcctgaaggttgacttcagttagtagtacagaagcgagacttgaagctcttcatggtttatgttctgttggtttatcccaaagagatgttttagagcacattcatttctgaaagttctcggtcatgtttccggaagtttgatcaggtgggttctttttctttttttwaaagataattttttttttaaagataattcagaatcagtcccacccctgagatggtattattacccaggaaagaatgcgtgaggatcctctaaatccatagagaaggaaaactaaaacaattttgttaccatttgtttggctcaagcatctggtagatccttcagttcttttcaaattagaattttcctctctttttcttttttttttttttttttgagatggagtcttactccatttcccaggctggagtacagtggcacaatctcggctcactgcagcctcacctcccgggttcaggca

SEQ ID NO: 134296 - DNA, 601 bp, Human
tctcactctgtcacccaggctggagtacagtggcacgatcttggctcactgcaacctccgcctcccaggttcaagcaattctcctgcctcagcctcccaagtagctgggactacaggcacctgccaccatgcccggctgatttttgtatttgtagtaaagacaggatttcactgtgttggtcaggttggtcttgaactcctgacctcatgatccacccccggcttttttttttgacacggagtttctcgttacccaggctggagtgcagtggcgcaatctctgctcactgagacctccacytcctgggttcaagcgattctcctgcctcagcctcctgagtagctgggactacaggtgtgcgtcaccatgcccggctaatttttgtatgtctaatggagacagggtttcaccatgttggtcaagttggtctcaaactcctgaactcaggtgatccacccaccttggcctcccaaagtgctgggattacgggcgtgagccaccatgcccggctaaagcaagaaattttcattgcatattttaagcaaaggcaaatgcatatgtggatagactgttttaatttgactaaagtcatattgaatc

SEQ ID NO: 134297 - DNA, 601 bp, Human; identical to SEQ ID NO: 36139

SEQ ID NO: 134298 - DNA, 601 bp, Human; identical to SEQ ID NO: 36140

SEQ ID NO: 134299 - DNA, 601 bp, Human; identical to SEQ ID NO: 36141

SEQ ID NO: 134300 - DNA, 601 bp, Human; identical to SEQ ID NO: 36142

SEQ ID NO: 134301 - DNA, 601 bp, Human; identical to SEQ ID NO: 36143

SEQ ID NO: 134302 - DNA, 601 bp, Human; identical to SEQ ID NO: 36144

SEQ ID NO: 134303 - DNA, 601 bp, Human; identical to SEQ ID NO: 36145

SEQ ID NO: 134304 - DNA, 601 bp, Human; identical to SEQ ID NO: 36146

SEQ ID NO: 134305 - DNA, 601 bp, Human; identical to SEQ ID NO: 36147

SEQ ID NO: 134306 - DNA, 601 bp, Human; identical to SEQ ID NO: 36148

SEQ ID NO: 134307 - DNA, 601 bp, Human; identical to SEQ ID NO: 36149

SEQ ID NO: 134308 - DNA, 601 bp, Human; identical to SEQ ID NO: 36150

SEQ ID NO: 134309 - DNA, 601 bp, Human; identical to SEQ ID NO: 36151

SEQ ID NO: 134310 - DNA, 601 bp, Human; identical to SEQ ID NO: 36152

SEQ ID NO: 134311 - DNA, 601 bp, Human; identical to SEQ ID NO: 36153

SEQ ID NO: 134312 - DNA, 601 bp, Human; identical to SEQ ID NO: 36154

SEQ ID NO: 134313 - DNA, 601 bp, Human; identical to SEQ ID NO: 36155

SEQ ID NO: 134314 - DNA, 601 bp, Human; identical to SEQ ID NO: 36156

SEQ ID NO: 134315 - DNA, 601 bp, Human; identical to SEQ ID NO: 36157

SEQ ID NO: 134316 - DNA, 601 bp, Human; identical to SEQ ID NO: 36158

SEQ ID NO: 134317 - DNA, 601 bp, Human; identical to SEQ ID NO: 36159

SEQ ID NO: 134318 - DNA, 601 bp, Human; identical to SEQ ID NO: 36160

SEQ ID NO: 134319 - DNA, 601 bp, Human; identical to SEQ ID NO: 36161

SEQ ID NO: 134320 - DNA, 601 bp, Human; identical to SEQ ID NO: 36162

SEQ ID NO: 134321 - DNA, 601 bp, Human; identical to SEQ ID NO: 36163

SEQ ID NO: 134322 - DNA, 601 bp, Human; identical to SEQ ID NO: 36164

SEQ ID NO: 134323 - DNA, 601 bp, Human; identical to SEQ ID NO: 36165

SEQ ID NO: 134324 - DNA, 601 bp, Human; identical to SEQ ID NO: 36166

SEQ ID NO: 134325 - DNA, 601 bp, Human; identical to SEQ ID NO: 36167

SEQ ID NO: 134326 - DNA, 601 bp, Human; identical to SEQ ID NO: 36168

SEQ ID NO: 134327 - DNA, 601 bp, Human; identical to SEQ ID NO: 36169

SEQ ID NO: 134328 - DNA, 601 bp, Human; identical to SEQ ID NO: 36170

SEQ ID NO: 134329 - DNA, 601 bp, Human; identical to SEQ ID NO: 36171

SEQ ID NO: 134330 - DNA, 601 bp, Human; identical to SEQ ID NO: 36172

SEQ ID NO: 134331 - DNA, 601 bp, Human; identical to SEQ ID NO: 36173

SEQ ID NO: 134332 - DNA, 601 bp, Human; identical to SEQ ID NO: 36174

SEQ ID NO: 134333 - DNA, 601 bp, Human; identical to SEQ ID NO: 36175

SEQ ID NO: 134334 - DNA, 601 bp, Human; identical to SEQ ID NO: 36176

SEQ ID NO: 134335 - DNA, 601 bp, Human; identical to SEQ ID NO: 36177

SEQ ID NO: 134336 - DNA, 601 bp, Human; identical to SEQ ID NO: 36178

SEQ ID NO: 134337 - DNA, 601 bp, Human; identical to SEQ ID NO: 36179

SEQ ID NO: 134338 - DNA, 601 bp, Human; identical to SEQ ID NO: 36180

SEQ ID NO: 134339 - DNA, 601 bp, Human; identical to SEQ ID NO: 36181

SEQ ID NO: 134340 - DNA, 601 bp, Human; identical to SEQ ID NO: 36182

SEQ ID NO: 134341 - DNA, 601 bp, Human; identical to SEQ ID NO: 36183

SEQ ID NO: 134342 - DNA, 601 bp, Human; identical to SEQ ID NO: 36184

SEQ ID NO: 134343 - DNA, 601 bp, Human; identical to SEQ ID NO: 36185

SEQ ID NO: 134344 - DNA, 601 bp, Human; identical to SEQ ID NO: 36186

SEQ ID NO: 134345 - DNA, 601 bp, Human; identical to SEQ ID NO: 36187

SEQ ID NO: 134346 - DNA, 601 bp, Human
caggagacgccccgcccagcccctggccgactataaagtgtcgagcttctcctcgcgagagacttagtgctcatgctcgctgcaggggtcggaggtcagggcgagcgtctcgcaggccgtaggaggaagatggcggtggagtcgcgcgttacccaggaggaaattaagaaggagccagagaaaccgatcgaccgcgagaaggtgaaggccccctccgctttggggtccgggaagaggttggggatgagtcccgcagggtgcagaggcgcggcctgtgtgctggaggagatggtgtttttgrtctcggggaggctcggaggccgcaacgcctcgggaagagagatgagctccgggttcgcagctggtgtttttaacttctgcccttccgttttctctctccctcagacatgcccactgttgctacgggtcttcaccaccaataacggccgccaccaccgaatggacgagttctcccggggaaatgtaccgtccagcgagttgcagatctacacttggtgaggagggcggggtggcctcagggacccgggccgggaacctggaacaacagttaattgcctttgccagtgtagagttattctcc

SEQ ID NO: 134347 - DNA, 601 bp, Human
tcaaggctgaatcatatttcattgtatgtgtgcatcacatatgtactcatctattgatggacacttgggttgtttcaccttttttgccattgtgaataatgctgctgtgaacattggcatacaaatgtgtttgtgtcgctgctttcagttcttttgggtatgtacctaggaggggattactgggtcatatgttaactttgtttaatttttgaggaaccaccaaactttttcacagcagctgcactattttatattccccaaaagatgtataattttaaactatttaagccctgtacactasagctaatcccttgaagattgggaccttacttgtcttatttggaggtgcttgttaaatttatgtagtagtatgatacctgtacttaagcatcactcaagggtaagtgttctaggaaggttgatttagcttatatggaagaactgttgaataatggcttgatgaaaatctcttcagaaattaaagtgtatgtttcttccaacaagagttcctatttgccaggtgctgtgtgtgcttagatcctgagggtataaagtcaagacggtactgctcctccctgtagtaagtccttttatcagggaa

SEQ ID NO: 134348 - DNA, 601 bp, Human
ctgagcatcgcaagtccaaaatctgaaatgccacaaaatctgaaacttttgagagctgacgtgacaccggtggaaaattgcacacataagttcttgacctctttttttttttttttttttgagacagagtcttgctctgtcatccaggctggagtgcagtggcgcgatctcggctcactgcaacctctgcctcccaggtataagcgattctcctgcctcagcctcctgagtagctgggattacaggcgtgcaccaaacttcctttcatgcacacaattacttaaaatgatgtataaaattrtattccagctgtgtataaggtatgtttgaaacataaatgagtttcttatttaaacttgggtcacaaccccaagatatcttacgtatatgcaaaaattctaaaatttgaaaaaacctaaaacgcttctagtcccatgtattttgggtaagggatactgaacctataattgatacagaatagttaacatcaaaatatcaggttgaaaaaaggtcacctctgagacagataaaccaatgtgacctcaggtttttttgtttttgagacagagtctcagtctgtcacccaggctggagcacagtg

SEQ ID NO: 134349 - DNA, 601 bp, Human
cataaggtgttgtgtagcaacagaagatagcatatagaatctctgaagtcccttttagcactaagagtctaattaattgaaatttccagcagtaaggctggtacatggagtttttggaggcaaatagtatttttagctgctttaaaattaatctctagtataagaccctggcagtttctaatgtaaatcacaactcagatatatgtaattaactcattgttagtatcccttttaatattattgctgattaataagcaaatgtaaatgtcttttttaaaaaaaatccaggatggatgcaacyttgaaagaactgacaagcttagtaaaagaagtctacccagaagctagaaagaagggcactcacttcaattttgcaatcgtttttacagatgttaaaagacctggctatcggtaggtaacttctcatttttaagtcctgtaatctctttgtttttagtatgttttaactgatacagataactccttcaatgaatcttgttagtgggagaatatgggtttatattaatacgtggtttggcttaataaagtagttaaattttggaagtgtgttataaaatgatggagaaaatccagtgccata

SEQ ID NO: 134350 - DNA, 601 bp, Human
atgtcttttttaaaaaaaatccaggatggatgcaaccttgaaagaactgacaagcttagtaaaagaagtctacccagaagctagaaagaagggcactcacttcaattttgcaatcgtttttacagatgttaaaagacctggctatcggtaggtaacttctcatttttaagtcctgtaatctctttgtttttagtatgttttaactgatacagataactccttcaatgaatcttgttagtgggagaatatgggtttatattaatacgtggtttggcttaataaagtagttaaattttggaastgtgttataaaatgatggagaaaatccagtgccatattcactttgtagtacatactgggtttcattgatttggatccattaacagttgattttctttcttacagagttaaggagattggcagcaccatgtctggcagaaaggggactgatgattccatgaccctgcagtcgcagaagttccagataggagattacttggacatagcaattacccctccaaatcgggcaccacctccttcagggcgcatgagaccatattaaattctatttactatttgttgaatttatttttccgtcagt

SEQ ID NO: 134351 - DNA, 601 bp, Human; identical to SEQ ID NO: 25782

SEQ ID NO: 134352 - DNA, 601 bp, Human; identical to SEQ ID NO: 25783

SEQ ID NO: 134353 - DNA, 601 bp, Human; identical to SEQ ID NO: 25784

SEQ ID NO: 134354 - DNA, 601 bp, Human
atttgggggtgggagaatttgtgttttcatttatactcttaaactgtgtgtgtgttttattttatttttattattatttttttgagacagtcttgctctgtcacccaggctggactgcagtggtgcaatctcggctcactgcaacctctgcctcctgggttcaggcgattctcctgcctctgcctcctgagtagctggggctacaggtgcctgccaccacacctggctaatttttgtatttttagtagagatggggtttcaccataatggccagtctggtcttgaactcctgaccttgtgrtctgcccaccttggcctcccgaagtgttgggattacaggtgtgagccaccatgcctggcctgttttttgagacaggatctcactctgttgcccaggcctgagtgcagtggtgcgatcatggctcactgcagtctctaccttccaggctcaggtgatcctcctgcctcagcttcccaagtagctgggactacaggtgtgtgccaccacgcccaactaatttttatgtgtttttgtagagatgaggttttacaatgttgcctaggcgggtctcgaactcctggactcaagtgatctgccacc

SEQ ID NO: 134355 - DNA, 601 bp, Human
tatttttattattatttttttgagacagtcttgctctgtcacccaggctggactgcagtggtgcaatctcggctcactgcaacctctgcctcctgggttcaggcgattctcctgcctctgcctcctgagtagctggggctacaggtgcctgccaccacacctggctaatttttgtatttttagtagagatggggtttcaccataatggccagtctggtcttgaactcctgaccttgtgatctgcccaccttggcctcccgaagtgttgggattacaggtgtgagccaccatgcctggcctrttttttgagacaggatctcactctgttgcccaggcctgagtgcagtggtgcgatcatggctcactgcagtctctaccttccaggctcaggtgatcctcctgcctcagcttcccaagtagctgggactacaggtgtgtgccaccacgcccaactaatttttatgtgtttttgtagagatgaggttttacaatgttgcctaggcgggtctcgaactcctggactcaagtgatctgccaccttcggcctcccaaagggttgtgattataggcgtaagccactgtacccagtcatgtactctta

SEQ ID NO: 134356 - DNA, 601 bp, Human
tttttcccttttacttcaggcacaacaactaattctttagatctgagaggaatttgtttttaaggctctagatgtgaaaaaaggaatgtttaatagtttatcttaggttttatttgaattggtccaataagtagtttttaaaagcaagtaaactctttttgtcttttaacttcaagtttaaaccttgattacaaagagtgatcctagctctgctgggagaagtattatagatacgatctcgtttaaattcgtggttaccatcacatcatttcattatttgtttttatctgggatcaaactrgaatgtgaattccacaggctcaggaccctctcctatttgtttttaatttcctgttgcctagcataggtcttggcctggcagatccagaaaatggcttattgagttaatgaaataactcagtaatctagacattcttggatcactatgttgggcttgaattgtttttcctgataacatttcttttggcaggagggtctcttgctatctgcagtagcatccaaaaaaacccaattttcaggattttgtcttgcagtgtgttactgttgtgtgcatcacagataattgttgtcaagacattaa

SEQ ID NO: 134357 - DNA, 601 bp, Human
cctagcataggtcttggcctggcagatccagaaaatggcttattgagttaatgaaataactcagtaatctagacattcttggatcactatgttgggcttgaattgtttttcctgataacatttcttttggcaggagggtctcttgctatctgcagtagcatccaaaaaaacccaattttcaggattttgtcttgcagtgtgttactgttgtgtgcatcacagataattgttgtcaagacattaatgaatatctgatttgttactcacatgttatgtgagtactaatggcttgtactaatgrcttttgcccattaataaaggatagcatctgttatcatctgaggtacattctgttgagagtgtttcaagtgttactctctttttttcccctttggaattggtgttttcctcttaacttacattgttaatggaagaagagattggaagtgactgagatagactatcattggaacatgagagtgccagctttacatgccgaaggatctcattttgcaaactcgtaatttctttcaggaggaggcaaaacagattcagaatctgcagaaagcaggcactcgtacagactcaagggaggatgaga

SEQ ID NO: 134358 - DNA, 601 bp, Human
catttcttttggcaggagggtctcttgctatctgcagtagcatccaaaaaaacccaattttcaggattttgtcttgcagtgtgttactgttgtgtgcatcacagataattgttgtcaagacattaatgaatatctgatttgttactcacatgttatgtgagtactaatggcttgtactaatgacttttgcccattaataaaggatagcatctgttatcatctgaggtacattctgttgagagtgtttcaagtgttactctctttttttcccctttggaattggtgttttcctcttaacttacattgttaatggaagaagagattggaagtgactgagatagactatcattggaacatgagagtgccagctttacatgccgaaggatctcattttgcaaactcgtaatttctttcaggaggaggcaaaacagattcagaatctgcagaaagcaggcactcgtacagactcaagggaggatgagatttctcctcctccacccaacccagtggttaaaggtaggaggcgacgaggtgctatcagcgctgaggtctacacggaggaagatgcggcatcctatgttagaaaggtagttttgatatt

SEQ ID NO: 134359 - DNA, 601 bp, Human; identical to SEQ ID NO: 25785

SEQ ID NO: 134360 - DNA, 601 bp, Human; identical to SEQ ID NO: 25786

SEQ ID NO: 134361 - DNA, 601 bp, Human; identical to SEQ ID NO: 25787

SEQ ID NO: 134362 - DNA, 601 bp, Human; identical to SEQ ID NO: 25788

SEQ ID NO: 134363 - DNA, 601 bp, Human; identical to SEQ ID NO: 25789

SEQ ID NO: 134364 - DNA, 601 bp, Human; identical to SEQ ID NO: 25790

SEQ ID NO: 134365 - DNA, 601 bp, Human; identical to SEQ ID NO: 25791

SEQ ID NO: 134366 - DNA, 601 bp, Human; identical to SEQ ID NO: 25792

SEQ ID NO: 134367 - DNA, 601 bp, Human; identical to SEQ ID NO: 25793

SEQ ID NO: 134368 - DNA, 601 bp, Human; identical to SEQ ID NO: 25794

SEQ ID NO: 134369 - DNA, 601 bp, Human; identical to SEQ ID NO: 28507

SEQ ID NO: 134370 - DNA, 601 bp, Human; identical to SEQ ID NO: 28508

SEQ ID NO: 134371 - DNA, 601 bp, Human; identical to SEQ ID NO: 28509

SEQ ID NO: 134372 - DNA, 601 bp, Human; identical to SEQ ID NO: 28510

SEQ ID NO: 134373 - DNA, 601 bp, Human; identical to SEQ ID NO: 28511

SEQ ID NO: 134374 - DNA, 601 bp, Human; identical to SEQ ID NO: 28512

SEQ ID NO: 134375 - DNA, 601 bp, Human
aactgaggtcggaagttcaagaccagcctgaccaacatggagaaaccctgtctctactaaaaatacaaaattagccaggcatggtggtgcatcatgcctgtaatcccagctactcaggaggctgaggcaggagaatcacttgaacccgggaggcagaggttgcagtgagccaagattgtgccactgcactccagcctgggcgacaagaaggaaacttcgtctcaaaaaaaaaaaaaaaaaaaaaaaaaggaatacaacagacactggtatgtaatgcaggcacactcatttggggtagcargaggttaaacctttaagtcttagtcatcccattggctcgtgagcactgagagggtggtgggacatggatcacccaggcttgggattctggggtctggattcgggacctctgttgtggtcagatagaagaaggggtggtgaatttagaatcagaccaggagagtccctggataagagcagggacaatttgggtcacagagtagctaacaggctggggacaaaaggtggggtgggtttggggttctgggcttgagttaggggagagtttccaatgctggctgaggctcatacaggaagccag

SEQ ID NO: 134376 - DNA, 601 bp, Human
caaaaatcaaccaggcatggtggtgtgtacctgtggtcccagctactcaggaggcagaagtaggaggatcacttgagcccggaaggtggaagttgcagtgagctgagatggcgccactgccatctcagggtgacaaagcaaggccctgtctcgaaaaaaaaaagagagagacaaggtcttgctatgttgctcaggctggacttgaacttctgggctcaaatgatccttctgcctcagtctcctgagtagctaggactataggcatgtgccaccacatgtggctacagatttttttttttttaaccatgaacagaaattatttaaatgatgatgatgataatagccactgccccaaaaggattacaaatattaaatgaataaggtaagccttacaacaaccttatggggtggacatcattcagattctcaggtagggaaactgaggcacagagcgatcaaacagctccctggcagtcacgcagcacgtgagtgatacagacagagctgagatttgaacctagtcaggcctgtgctctgaacgacagcaatctctccttcccctccacaatgcttccttccaaacctgccccaagttttcctg

SEQ ID NO: 134377 - DNA, 601 bp, Human
gccttggtgacagagcaagactctgtctcaaaaatgaactaaaacccaaaaccctagaggcaccctcacctttgtcctttacccacatattcacctgggtaccttcagcacatcctactgctcccacatttttttgtaatgcagttttgctctgtcacccaggctgcagtgcagtggcaaaccacagctcaaactcctgagctcaagtgatcctcctgcctcagcctcccaaatagttgggactatagtactcagtcaccaagcctggcctgacctccacttttatttaattaattaattwatttatttatttatttttgagatggaatttcgctcttgttgcctaggctgaagtgcaatggcacgatctcggctcacagcaacctctgcctcccaggttcaagcgattctcctgcctcagccccccgagtagctgggattacaggcacacaccaccatgcccggctaattttgtattttcagtagagatgaggtttctccatgttaggctggtctcaaacttccaacctcaggtgatctgcccacctcagcctcccaaagtgctgggattacaggcgtgagccactgcgcccggcctcca

SEQ ID NO: 134378 - DNA, 601 bp, Human
gggttttgccatgttggccaggctggtcttgaactcctgcccttaggtgatctgcctgccttggcctcccaaagcactgagattacaggcgtgagccaccgtacccagctggaaatttaaattttatttaactttaatttaaatttagatagtgcaatctagaacaaaagccagcaaatttttttttggtaaagggacagactaaatatttctggttccgtgagccatatggtctccatcacgactcaactctgctgtggtagagcaagatcggttgtagatgatagggaaacaattgagygtggcttctttgttctaataaaactttattataaagacaggcagtgagtctgggagctgcggtttgcagaacctggtctagatggctatgcccatagaagcttctagaaactcagggccagtcctgcagctagacccattttacagacgagaaaaccagtgtgatcaaccagtgagccaagtggtaggaataggatcaaacagtgtcctacttagattcaacgtctattaccacttccaaaaatatagccagtgagaccttgtctttataaaaacataatttaaaaaaaaattagctaga

SEQ ID NO: 134379 - DNA, 601 bp, Human
gcctggctaattttacttttagtagagatggggttttgccatgttggccaggctggtcttgaactcctgcccttaggtgatctgcctgccttggcctcccaaagcactgagattacaggcgtgagccaccgtacccagctggaaatttaaattttatttaactttaatttaaatttagatagtgcaatctagaacaaaagccagcaaatttttttttggtaaagggacagactaaatatttctggttccgtgagccatatggtctccatcacgactcaactctgctgtggtagagcaagatcggttgtagatgatagggaaacaattgagtgtggcttctttgttctaataaaactttattataaagacaggcagtgagtctgggagctgcggtttgcagaacctggtctagatggctatgcccatagaagcttctagaaactcagggccagtcctgcagctagacccattttacagacgagaaaaccagtgtgatcaaccagtgagccaagtggtaggaataggatcaaacagtgtcctacttagattcaacgtctattaccacttccaaaaatatagccagtgagaccttgtctttata

SEQ ID NO: 134380 - DNA, 601 bp, Human
cgccagccggtggtccccgttgtccccgttgtcccttgcacatccccaagctggcttcctgcctattgatattttacctatttgagacggagtctcactctgtcacccaggctggagtgcagtggtgcaatctcggttcactgcaacctccacctcccaggttcaagtgattctcctgcctcagcctcccaagtagctggggttaccgacgcctgtcaccatgcctggctaattttacttttagtagagatggggttttgccatgttggccaggctggtcttgaactcctgcccttaggtkatctgcctgccttggcctcccaaagcactgagattacaggcgtgagccaccgtacccagctggaaatttaaattttatttaactttaatttaaatttagatagtgcaatctagaacaaaagccagcaaatttttttttggtaaagggacagactaaatatttctggttccgtgagccatatggtctccatcacgactcaactctgctgtggtagagcaagatcggttgtagatgatagggaaacaattgagtgtggcttctttgttctaataaaactttattataaagacaggcagtgag

SEQ ID NO: 134381 - DNA, 601 bp, Human
gtaatgggtccccaggacctgcctcctctccctccttggcctcgctggccttagagttggggacccagaggccagagtcaatgcagcgctgcatgtggtactttgcgtcctgtgaggagaaggcaggcagatgaggtggggccgccagccggtggtccccgttgtccccgttgtcccttgcacatccccaagctggcttcctgcctattgatattttacctatttgagacggagtctcactctgtcacccaggctggagtgcagtggtgcaatctcggttcactgcaacctccacctcccrggttcaagtgattctcctgcctcagcctcccaagtagctggggttaccgacgcctgtcaccatgcctggctaattttacttttagtagagatggggttttgccatgttggccaggctggtcttgaactcctgcccttaggtgatctgcctgccttggcctcccaaagcactgagattacaggcgtgagccaccgtacccagctggaaatttaaattttatttaactttaatttaaatttagatagtgcaatctagaacaaaagccagcaaatttttttttggtaaagggacagactaaat

SEQ ID NO: 134382 - DNA, 601 bp, Human
cctacataatggtgatgtcacctcagagtacctgagagctcctttcaagaagcgggattccaaaagtaataataaaagagaaacgagactcccctgtaaaatgtctcccagggaatatagggatgtcttgcaatctgacattgttcctccattggggcccccatactatatcaaggatccgcataacctttaggaatgaagaccccacccccaagtaaccagatttgtctcagagagccccctacaaaatgaggaacccctagagacaggacctctccttccagagatcggatctccccayagaagccccaagaaacgtgagccgtccccatggaaacggcatccaaaggagctgaacccgcacccacggaataagaacctccccagggaaagtgaatccccggcactcagagaaccaggaatcctcccagagaagatgctaaaaagctctcccctccccccacaacctagcctcacccaccacccaccttcgaagggggactgtgggggaacaatgaaagcctagagaagaaggaccggttcccagtgggtcaccaccagggccaggagaccagagaggagctctggggtctcgatcctc

SEQ ID NO: 134383 - DNA, 601 bp, Human; identical to SEQ ID NO: 126750

SEQ ID NO: 134384 - DNA, 601 bp, Human; identical to SEQ ID NO: 126751

SEQ ID NO: 134385 - DNA, 601 bp, Human; identical to SEQ ID NO: 126752

SEQ ID NO: 134386 - DNA, 601 bp, Human; identical to SEQ ID NO: 126753

SEQ ID NO: 134387 - DNA, 601 bp, Human; identical to SEQ ID NO: 126754

SEQ ID NO: 134388 - DNA, 601 bp, Human; identical to SEQ ID NO: 126755

SEQ ID NO: 134389 - DNA, 601 bp, Human; identical to SEQ ID NO: 126756

SEQ ID NO: 134390 - DNA, 601 bp, Human; identical to SEQ ID NO: 126757

SEQ ID NO: 134391 - DNA, 601 bp, Human; identical to SEQ ID NO: 126758

SEQ ID NO: 134392 - DNA, 601 bp, Human; identical to SEQ ID NO: 126759

SEQ ID NO: 134393 - DNA, 601 bp, Human; identical to SEQ ID NO: 126760

SEQ ID NO: 134394 - DNA, 601 bp, Human; identical to SEQ ID NO: 126761

SEQ ID NO: 134395 - DNA, 601 bp, Human; identical to SEQ ID NO: 126762

SEQ ID NO: 134396 - DNA, 601 bp, Human; identical to SEQ ID NO: 126763

SEQ ID NO: 134397 - DNA, 601 bp, Human; identical to SEQ ID NO: 126764

SEQ ID NO: 134398 - DNA, 601 bp, Human; identical to SEQ ID NO: 126765

SEQ ID NO: 134399 - DNA, 601 bp, Human; identical to SEQ ID NO: 126766

SEQ ID NO: 134400 - DNA, 601 bp, Human; identical to SEQ ID NO: 126767

SEQ ID NO: 134401 - DNA, 601 bp, Human; identical to SEQ ID NO: 126768

SEQ ID NO: 134402 - DNA, 601 bp, Human; identical to SEQ ID NO: 126769

SEQ ID NO: 134403 - DNA, 601 bp, Human; identical to SEQ ID NO: 126770

SEQ ID NO: 134404 - DNA, 601 bp, Human; identical to SEQ ID NO: 126771

SEQ ID NO: 134405 - DNA, 601 bp, Human; identical to SEQ ID NO: 126772

SEQ ID NO: 134406 - DNA, 601 bp, Human; identical to SEQ ID NO: 126773

SEQ ID NO: 134407 - DNA, 601 bp, Human; identical to SEQ ID NO: 126774

SEQ ID NO: 134408 - DNA, 601 bp, Human; identical to SEQ ID NO: 126775

SEQ ID NO: 134409 - DNA, 601 bp, Human; identical to SEQ ID NO: 126776

SEQ ID NO: 134410 - DNA, 601 bp, Human; identical to SEQ ID NO: 126777

SEQ ID NO: 134411 - DNA, 601 bp, Human; identical to SEQ ID NO: 126778

SEQ ID NO: 134412 - DNA, 601 bp, Human; identical to SEQ ID NO: 126779

SEQ ID NO: 134413 - DNA, 601 bp, Human; identical to SEQ ID NO: 126780

SEQ ID NO: 134414 - DNA, 601 bp, Human; identical to SEQ ID NO: 126781

SEQ ID NO: 134415 - DNA, 601 bp, Human; identical to SEQ ID NO: 126782

SEQ ID NO: 134416 - DNA, 601 bp, Human; identical to SEQ ID NO: 126783

SEQ ID NO: 134417 - DNA, 601 bp, Human; identical to SEQ ID NO: 126784

SEQ ID NO: 134418 - DNA, 601 bp, Human; identical to SEQ ID NO: 126785

SEQ ID NO: 134419 - DNA, 601 bp, Human; identical to SEQ ID NO: 126786

SEQ ID NO: 134420 - DNA, 601 bp, Human; identical to SEQ ID NO: 126787

SEQ ID NO: 134421 - DNA, 601 bp, Human; identical to SEQ ID NO: 126788

SEQ ID NO: 134422 - DNA, 601 bp, Human; identical to SEQ ID NO: 126789

SEQ ID NO: 134423 - DNA, 601 bp, Human; identical to SEQ ID NO: 126790

SEQ ID NO: 134424 - DNA, 601 bp, Human; identical to SEQ ID NO: 126791

SEQ ID NO: 134425 - DNA, 601 bp, Human; identical to SEQ ID NO: 126792

SEQ ID NO: 134426 - DNA, 601 bp, Human; identical to SEQ ID NO: 126793

SEQ ID NO: 134427 - DNA, 601 bp, Human; identical to SEQ ID NO: 126794

SEQ ID NO: 134428 - DNA, 601 bp, Human; identical to SEQ ID NO: 126795

SEQ ID NO: 134429 - DNA, 601 bp, Human; identical to SEQ ID NO: 126796

SEQ ID NO: 134430 - DNA, 601 bp, Human; identical to SEQ ID NO: 126797

SEQ ID NO: 134431 - DNA, 601 bp, Human; identical to SEQ ID NO: 126798

SEQ ID NO: 134432 - DNA, 601 bp, Human; identical to SEQ ID NO: 126750

SEQ ID NO: 134433 - DNA, 601 bp, Human; identical to SEQ ID NO: 126751

SEQ ID NO: 134434 - DNA, 601 bp, Human; identical to SEQ ID NO: 126752

SEQ ID NO: 134435 - DNA, 601 bp, Human; identical to SEQ ID NO: 126753

SEQ ID NO: 134436 - DNA, 601 bp, Human; identical to SEQ ID NO: 126754

SEQ ID NO: 134437 - DNA, 601 bp, Human; identical to SEQ ID NO: 126755

SEQ ID NO: 134438 - DNA, 601 bp, Human; identical to SEQ ID NO: 126756

SEQ ID NO: 134439 - DNA, 601 bp, Human; identical to SEQ ID NO: 126757

SEQ ID NO: 134440 - DNA, 601 bp, Human; identical to SEQ ID NO: 126758

SEQ ID NO: 134441 - DNA, 601 bp, Human; identical to SEQ ID NO: 126759

SEQ ID NO: 134442 - DNA, 601 bp, Human; identical to SEQ ID NO: 126760

SEQ ID NO: 134443 - DNA, 601 bp, Human; identical to SEQ ID NO: 126761

SEQ ID NO: 134444 - DNA, 601 bp, Human; identical to SEQ ID NO: 126762

SEQ ID NO: 134445 - DNA, 601 bp, Human; identical to SEQ ID NO: 126763

SEQ ID NO: 134446 - DNA, 601 bp, Human; identical to SEQ ID NO: 126764

SEQ ID NO: 134447 - DNA, 601 bp, Human; identical to SEQ ID NO: 126765

SEQ ID NO: 134448 - DNA, 601 bp, Human; identical to SEQ ID NO: 126766

SEQ ID NO: 134449 - DNA, 601 bp, Human; identical to SEQ ID NO: 126767

SEQ ID NO: 134450 - DNA, 601 bp, Human; identical to SEQ ID NO: 126768

SEQ ID NO: 134451 - DNA, 601 bp, Human; identical to SEQ ID NO: 126769

SEQ ID NO: 134452 - DNA, 601 bp, Human; identical to SEQ ID NO: 126770

SEQ ID NO: 134453 - DNA, 601 bp, Human; identical to SEQ ID NO: 126771

SEQ ID NO: 134454 - DNA, 601 bp, Human; identical to SEQ ID NO: 126772

SEQ ID NO: 134455 - DNA, 601 bp, Human; identical to SEQ ID NO: 126773

SEQ ID NO: 134456 - DNA, 601 bp, Human; identical to SEQ ID NO: 126774

SEQ ID NO: 134457 - DNA, 601 bp, Human; identical to SEQ ID NO: 126775

SEQ ID NO: 134458 - DNA, 601 bp, Human; identical to SEQ ID NO: 126776

SEQ ID NO: 134459 - DNA, 601 bp, Human; identical to SEQ ID NO: 126777

SEQ ID NO: 134460 - DNA, 601 bp, Human; identical to SEQ ID NO: 126778

SEQ ID NO: 134461 - DNA, 601 bp, Human; identical to SEQ ID NO: 126779

SEQ ID NO: 134462 - DNA, 601 bp, Human; identical to SEQ ID NO: 126780

SEQ ID NO: 134463 - DNA, 601 bp, Human; identical to SEQ ID NO: 126781

SEQ ID NO: 134464 - DNA, 601 bp, Human; identical to SEQ ID NO: 126782

SEQ ID NO: 134465 - DNA, 601 bp, Human; identical to SEQ ID NO: 126783

SEQ ID NO: 134466 - DNA, 601 bp, Human; identical to SEQ ID NO: 126784

SEQ ID NO: 134467 - DNA, 601 bp, Human; identical to SEQ ID NO: 126785

SEQ ID NO: 134468 - DNA, 601 bp, Human; identical to SEQ ID NO: 126786

SEQ ID NO: 134469 - DNA, 601 bp, Human; identical to SEQ ID NO: 126787

SEQ ID NO: 134470 - DNA, 601 bp, Human; identical to SEQ ID NO: 126788

SEQ ID NO: 134471 - DNA, 601 bp, Human; identical to SEQ ID NO: 126789

SEQ ID NO: 134472 - DNA, 601 bp, Human; identical to SEQ ID NO: 126790

SEQ ID NO: 134473 - DNA, 601 bp, Human; identical to SEQ ID NO: 126791

SEQ ID NO: 134474 - DNA, 601 bp, Human; identical to SEQ ID NO: 126792

SEQ ID NO: 134475 - DNA, 601 bp, Human; identical to SEQ ID NO: 126793

SEQ ID NO: 134476 - DNA, 601 bp, Human; identical to SEQ ID NO: 126794

SEQ ID NO: 134477 - DNA, 601 bp, Human; identical to SEQ ID NO: 126795

SEQ ID NO: 134478 - DNA, 601 bp, Human; identical to SEQ ID NO: 126796

SEQ ID NO: 134479 - DNA, 601 bp, Human; identical to SEQ ID NO: 126797

SEQ ID NO: 134480 - DNA, 601 bp, Human; identical to SEQ ID NO: 126798

SEQ ID NO: 134481 - DNA, 601 bp, Human; identical to SEQ ID NO: 126750

SEQ ID NO: 134482 - DNA, 601 bp, Human; identical to SEQ ID NO: 126751

SEQ ID NO: 134483 - DNA, 601 bp, Human; identical to SEQ ID NO: 126752

SEQ ID NO: 134484 - DNA, 601 bp, Human; identical to SEQ ID NO: 126753

SEQ ID NO: 134485 - DNA, 601 bp, Human; identical to SEQ ID NO: 126754

SEQ ID NO: 134486 - DNA, 601 bp, Human; identical to SEQ ID NO: 126755

SEQ ID NO: 134487 - DNA, 601 bp, Human; identical to SEQ ID NO: 126756

SEQ ID NO: 134488 - DNA, 601 bp, Human; identical to SEQ ID NO: 126757

SEQ ID NO: 134489 - DNA, 601 bp, Human; identical to SEQ ID NO: 126758

SEQ ID NO: 134490 - DNA, 601 bp, Human; identical to SEQ ID NO: 126759

SEQ ID NO: 134491 - DNA, 601 bp, Human; identical to SEQ ID NO: 126760

SEQ ID NO: 134492 - DNA, 601 bp, Human; identical to SEQ ID NO: 126761

SEQ ID NO: 134493 - DNA, 601 bp, Human; identical to SEQ ID NO: 126762

SEQ ID NO: 134494 - DNA, 601 bp, Human; identical to SEQ ID NO: 126763

SEQ ID NO: 134495 - DNA, 601 bp, Human; identical to SEQ ID NO: 126764

SEQ ID NO: 134496 - DNA, 601 bp, Human; identical to SEQ ID NO: 126765

SEQ ID NO: 134497 - DNA, 601 bp, Human; identical to SEQ ID NO: 126766

SEQ ID NO: 134498 - DNA, 601 bp, Human; identical to SEQ ID NO: 126767

SEQ ID NO: 134499 - DNA, 601 bp, Human; identical to SEQ ID NO: 126768

SEQ ID NO: 134500 - DNA, 601 bp, Human; identical to SEQ ID NO: 126769

SEQ ID NO: 134501 - DNA, 601 bp, Human; identical to SEQ ID NO: 126770

SEQ ID NO: 134502 - DNA, 601 bp, Human; identical to SEQ ID NO: 126771

SEQ ID NO: 134503 - DNA, 601 bp, Human; identical to SEQ ID NO: 126772

SEQ ID NO: 134504 - DNA, 601 bp, Human; identical to SEQ ID NO: 126773

SEQ ID NO: 134505 - DNA, 601 bp, Human; identical to SEQ ID NO: 126774

SEQ ID NO: 134506 - DNA, 601 bp, Human; identical to SEQ ID NO: 126775

SEQ ID NO: 134507 - DNA, 601 bp, Human; identical to SEQ ID NO: 126776

SEQ ID NO: 134508 - DNA, 601 bp, Human; identical to SEQ ID NO: 126777

SEQ ID NO: 134509 - DNA, 601 bp, Human; identical to SEQ ID NO: 126778

SEQ ID NO: 134510 - DNA, 601 bp, Human; identical to SEQ ID NO: 126779

SEQ ID NO: 134511 - DNA, 601 bp, Human; identical to SEQ ID NO: 126780

SEQ ID NO: 134512 - DNA, 601 bp, Human; identical to SEQ ID NO: 126781

SEQ ID NO: 134513 - DNA, 601 bp, Human; identical to SEQ ID NO: 126782

SEQ ID NO: 134514 - DNA, 601 bp, Human; identical to SEQ ID NO: 126783

SEQ ID NO: 134515 - DNA, 601 bp, Human; identical to SEQ ID NO: 126784

SEQ ID NO: 134516 - DNA, 601 bp, Human; identical to SEQ ID NO: 126785

SEQ ID NO: 134517 - DNA, 601 bp, Human; identical to SEQ ID NO: 126786

SEQ ID NO: 134518 - DNA, 601 bp, Human; identical to SEQ ID NO: 126787

SEQ ID NO: 134519 - DNA, 601 bp, Human; identical to SEQ ID NO: 126788

SEQ ID NO: 134520 - DNA, 601 bp, Human; identical to SEQ ID NO: 126789

SEQ ID NO: 134521 - DNA, 601 bp, Human; identical to SEQ ID NO: 126790

SEQ ID NO: 134522 - DNA, 601 bp, Human; identical to SEQ ID NO: 126791

SEQ ID NO: 134523 - DNA, 601 bp, Human; identical to SEQ ID NO: 126792

SEQ ID NO: 134524 - DNA, 601 bp, Human; identical to SEQ ID NO: 126793

SEQ ID NO: 134525 - DNA, 601 bp, Human; identical to SEQ ID NO: 126794

SEQ ID NO: 134526 - DNA, 601 bp, Human; identical to SEQ ID NO: 126795

SEQ ID NO: 134527 - DNA, 601 bp, Human; identical to SEQ ID NO: 126796

SEQ ID NO: 134528 - DNA, 601 bp, Human; identical to SEQ ID NO: 126797

SEQ ID NO: 134529 - DNA, 601 bp, Human; identical to SEQ ID NO: 126798

SEQ ID NO: 134530 - DNA, 601 bp, Human
agcagatctgcacaccccaaacttgcctttctcacaacaacagaggaagcccccggcccctcccactcactatcacggttttctgcttcactcaatggtttgagacagtgccccgacccctactgccccgctcctcttcagccctttctctcttgctaaaggtcacttctccactgtcatccgagctgaccactctccggcagcagtcagcacagcggtcgctccatccttctggaagcacctcctgcctgggcttctggagttccacttggcagtgcagggcgtcccatggcctgccccygagccctatccttctatgcccaacccaacccggcgacagcagtcctggcccagaggcagagctcggatggatgagcagtttcggttctggcctctccgtctactcctgcctgaagcatctggacccggcctaaccagctcactgaggtatgcacaagcttctcccacggccaaactcaatccttcatcccaccagccccatctgggaacgggcttattactcacactgtgggctaacacaagtgtcctgaatacgtttaacgcagacaaagccaggccagggtgtgcaggaggctgggtg

SEQ ID NO: 134531 - DNA, 601 bp, Human
ctctcccacactgccccacagtccgctcctccacctggcctcctcccggtcgcccagccaggggccttctggaactgtccctgctccggtgacttcacgcatcactgaaaagtcccaaagcagacctccatcctgccgccacccagcctgcccatgctctgcaccccaaaccctcttcctggagcagccggtggctggtttgtcccctcccacctgaccgacccaccctaggttccatcctgtttcctcccaaggacttggctccctccagctttccttctccccgctcccttgtcagctrtgccccctctaagcagatctgcacaccccaaacttgcctttctcacaacaacagaggaagcccccggcccctcccactcactatcacggttttctgcttcactcaatggtttgagacagtgccccgacccctactgccccgctcctcttcagccctttctctcttgctaaaggtcacttctccactgtcatccgagctgaccactctccggcagcagtcagcacagcggtcgctccatccttctggaagcacctcctgcctgggcttctggagttccacttggcagtgcagggcgtccca

SEQ ID NO: 134532 - DNA, 601 bp, Human
agcagggggtccctctgcccattggcagccccctctggacctgcacatcccctccatctcttgtcaccttccagactctcccacactgccccacagtccgctcctccacctggcctcctcccggtcgcccagccaggggccttctggaactgtccctgctccggtgacttcacgcatcactgaaaagtcccaaagcagacctccatcctgccgccacccagcctgcccatgctctgcaccccaaaccctcttcctggagcagccggtggctggtttgtcccctcccacctgaccgacccaycctaggttccatcctgtttcctcccaaggacttggctccctccagctttccttctccccgctcccttgtcagctatgccccctctaagcagatctgcacaccccaaacttgcctttctcacaacaacagaggaagcccccggcccctcccactcactatcacggttttctgcttcactcaatggtttgagacagtgccccgacccctactgccccgctcctcttcagccctttctctcttgctaaaggtcacttctccactgtcatccgagctgaccactctccggcagcagtcagcaca

SEQ ID NO: 134533 - DNA, 601 bp, Human
cagagaggcctctcctggccttctttgggcactgtcctgtctgccacacctcccgctacaaatgccatgagagcagggccagggccaggcggtcaccagcatctggccctgcagacacctgagaagtgcctgctgaatgaagggctgaatggacagagactcagccacccatggcaagtgggccacaccccaaagccagccaggagagaccgtccctgccctcgtggacagggggccaaggtgtcagctctgtgaacgagtatagcccagggagccgcatgagccccagtgaggggccagrtgcggtcctgagggctggggaaggccagcagggacccagccccgaaggcactgggggatgcagagggctcccagcggctggctgaccatgccctcactgcccaggtggctgggctctaaatcccaaggtgcagccagggacagctcagggtggtcaccgagggacctgcttcccttcccatgcacaaatgcaataaaacagatcctagaaggaaatccgggcccatgttcagggtcatctcactctgccctcccaggacaatgatttcacagccacacacccctgcacctgcctcaggcc

SEQ ID NO: 134534 - DNA, 601 bp, Human
gtcccacacggacaggtcattacccccttcacaggagccagcgttaccgcagtcgatgacgttctgcacggacaggagggtggagggccacgctcccttcctcttgatgttgatccgatctgcaacagtcagcacctgccagtcagcactcacccactctccacccacttccccgaacggacctggacgcctcaggcgggatgcaggcgctgcccagcctggcctgccttcagctctgcccagctgcctgtgtctccttctccctgctgacctcttcatggaggtctccgctcagacgtcrctctgcagagaggcctctcctggccttctttgggcactgtcctgtctgccacacctcccgctacaaatgccatgagagcagggccagggccaggcggtcaccagcatctggccctgcagacacctgagaagtgcctgctgaatgaagggctgaatggacagagactcagccacccatggcaagtgggccacaccccaaagccagccaggagagaccgtccctgccctcgtggacagggggccaaggtgtcagctctgtgaacgagtatagcccagggagccgcatgagccccagtgaggg

SEQ ID NO: 134535 - DNA, 601 bp, Human
tgagggagatctgagtcaggtggcttaaaactaccagttatggccgggcacggtggctcacacctgtaatcccagcactttgggaggccgaggcaggcatatcacgaggtcaggagatcaagaccatcctggttaacacagtgaaatcccgcctctactaaaaatacaaaaaattagccgggcgcggtggcgggcgcctgtagtcccagctactccggaggctgaggcaggagagtggcgtgaacccgggaggcggagcttgcagtgagccgagatcgcgccactgcagtcctgcctgggygaaagagcgagactccgtctcaaaaaaaaaaaacaaactaccagttatggccgggcgcagcagctcatgcctgtaatcccaccattttgggaggccaaggcaggtggatcacttgaggttgggagtttaagaccagcctgaacaacatggagaaaccccgtctctactaaaaaatacagaagtagctgggcgtggtggcgcatgcctgtaatcccagctactcaggaggctgaggcaggagaatcactcaaacccgggaggcggaggttgcagtgagcagagatcgtgccattgcactcc

SEQ ID NO: 134536 - DNA, 601 bp, Human
cgtctcaaaaaaaaaaaaaaagaaagaaagaaagaaagaaagaaaggacaggcgtggtggctcacacctgtaatcccagcacttcgggaggccgaggcaggaagatggcttgataccaggagtctgagaccagcctggacaacagagcgagacctcatctctacagaaaaaaaattttataaattaatttaaaaaaaagaaaaagtacagctctcggttttgcaaggctcagagtcactgtgttcccacttttcactccatccacacggcggccctcggcctgccattcgctgctttggcrcgacctgtctgtcatagttacacatctgtcgggattcctcccccaggaacatgagcaccttgaggctcagacactggttcaatttgttccttgcacaccaagtgcccagtgcccagtactacgggaaaatggtggatgtgtggccacacttttgctaacactacaaagatgactatttatcgcaatcaggtttttttattcttttcttttcttttttttttggagacagagtctcactctgtcacccaggctggagttcagtggtatgatcctggctcactgcaacttctgcctcctggg

SEQ ID NO: 134537 - DNA, 601 bp, Human
cactccagcctgagcgacaagagcgagactccgtctcaaaaaaaaaaaaaaagaaagaaagaaagaaagaaagaaaggacaggcgtggtggctcacacctgtaatcccagcacttcgggaggccgaggcaggaagatggcttgataccaggagtctgagaccagcctggacaacagagcgagacctcatctctacagaaaaaaaattttataaattaatttaaaaaaaagaaaaagtacagctctcggttttgcaaggctcagagtcactgtgttcccacttttcactccatccacacggyggccctcggcctgccattcgctgctttggcgcgacctgtctgtcatagttacacatctgtcgggattcctcccccaggaacatgagcaccttgaggctcagacactggttcaatttgttccttgcacaccaagtgcccagtgcccagtactacgggaaaatggtggatgtgtggccacacttttgctaacactacaaagatgactatttatcgcaatcaggtttttttattcttttcttttcttttttttttggagacagagtctcactctgtcacccaggctggagttcagtggtatga

SEQ ID NO: 134538 - DNA, 601 bp, Human
attcacatagtgtcttccctgctgaaactgccccctcggtacagcttggagcgtctcatccgcattccgcacaaccatccataggggcagacttgctatcagctgagtgttaactctgagaaaactgaagttcttagaggggaaatgatgtggctgtctcgagcctactgagtacaaccggccagaaggaaagtggcgaaggacggagatgcctacatgagcaccgacatgagcccacactggcgctgtcaccgcggatctctcctcacccgcgggacctttcctcacccgcgggaccttycctcacccgcaaacctctctttgcccgcgggacctctcctcacctgatgggaccatttgcgtagatttctgccatcatcttctccctcccagagagggagccgtagtctcccaccctccagagggtgtagttccggatggcgtggcactctttgaattcattgcatgtcccacattggttaaacttgtcacactctgggggagagcaagaaaagtcagcatgaggccgtctcctcatcaacccactgacaaagaagcccgccaagcccactctccactctcatcatgcagcctaccactc

SEQ ID NO: 134539 - DNA, 601 bp, Human; identical to SEQ ID NO: 38338

SEQ ID NO: 134540 - DNA, 601 bp, Human; identical to SEQ ID NO: 38339

SEQ ID NO: 134541 - DNA, 601 bp, Human; identical to SEQ ID NO: 38340

SEQ ID NO: 134542 - DNA, 601 bp, Human; identical to SEQ ID NO: 38341

SEQ ID NO: 134543 - DNA, 601 bp, Human; identical to SEQ ID NO: 38342

SEQ ID NO: 134544 - DNA, 601 bp, Human; identical to SEQ ID NO: 38343

SEQ ID NO: 134545 - DNA, 601 bp, Human; identical to SEQ ID NO: 38344

SEQ ID NO: 134546 - DNA, 601 bp, Human; identical to SEQ ID NO: 38345

SEQ ID NO: 134547 - DNA, 601 bp, Human; identical to SEQ ID NO: 38346

SEQ ID NO: 134548 - DNA, 601 bp, Human
taataaaatatttactaattcaaaatgaaaatgaaaagtgcttaggggagacagttccaataagtaaaattgctcataaccataagctgccaaaggattaatatttatcacatttctgtgctattatgggtctgaagctttttaaaagcaaaacaagaaaaattaaatctgaaaaacatctctctgataatttgccttgcctacttttgaaataacaatgtcaagaaagtactttagagatcaaaccacttttataatgtggaacacaaaagtctacacttatcaactgtacagacctttytatttcacgagaatttaactttacatcaccaacatctttggaaaagtaaaatgaaccaaaccctctgaaagcataataaattagcaaaacagtattcgctgcggggtcttgcagattttattgcttgatacaacagcaggacccttgcctgtgcctgtagttattatgttcgggaagtagtgatttgtgagaacattagtggttgtgggggaaataaaaatgtaaagaactgtagtttttcatgctcttggactgttatgtaactccaattgcaattatacaagtggggagttcatcctc

SEQ ID NO: 134549 - DNA, 601 bp, Human
ctggttcaagtacacaggcttagtcaagcaggcattttcctgctgagtaaaagtaaacactctcccagaataaagaaactactttgcctttaaaagacactaacatctccttgtgctaatgaggtggggtctgtaaccctgaagggcataacagagaggggctaatgctttgtttaaggggatcggacactacttcctgacccccaggactttgcaaaatctcagcattagatgcagtctggcagctctgagccgagtgaggctaaatgattttctgttagcttactgttaaaacaaaacmacccaacataaaaccaggtctcattactcagaattatgagattagacagagagcccctagaaaaagggctaaattcaaaacactgcatctccagacttgtaataaaatatttactaattcaaaatgaaaatgaaaagtgcttaggggagacagttccaataagtaaaattgctcataaccataagctgccaaaggattaatatttatcacatttctgtgctattatgggtctgaagctttttaaaagcaaaacaagaaaaattaaatctgaaaaacatctctctgataatttgccttgcc

SEQ ID NO: 134550 - DNA, 601 bp, Human
agcaccccccccccccgcaccccccgccttggcgtcactgcgctacaggccgcctgtaatttacatatgttttaacgctaacattgggaagcattgggcctttctgaagcctttttgtttcgttttgtttgaagctcccctccccccagtaatgagcctcagtttggtcctaagggctgggtcgccggatcgtagacccaaatccttgcaaaatgaacgactccctcccctcaaagaggagggagttgtgttgttgttttgttttgttttgtttttccgcccgttttcttttaacggcccsgcagccctctgtgtggccttgttccctgtgaataattgcctcactgttcttcctgggggcttgcgtttgtgagactcaaggtgctagcctcttcactttccatttcccagacaggaaattaagctttcctctccattcgaactttttaaaaaaagcctgaggaggtatatgtgaaaattaaccccgtaaaatagcactttttttttttaattaaccacaacctttagttagcctagcagtagcgttttttaagggtggtcctggaaaaattactgtttggggtttgtttttaatgggggc

SEQ ID NO: 134551 - DNA, 601 bp, Human
actttagaaaattattttctaagttaggcaattttaaaaaatatttaagctaagcagaataattaaaaatggatagttaacgtatacagtttggaaaaatagatatgtcagggtatatacagatacatttagctaactcacagttttttgaaaatagatttctaaacccaactaaaaatacatttctaagaacgttaaaaaatgttttctaaatgtcataccattgaaaatgttaatatttatattagtctgaccatttaaaatctttctcagatcattgaaagcagtcatatcatttaamatatccttatagtcaatccatactatctcaaaaataggttttgcagtctaacaaacatagtttgcctgaattcaaatttaaaaataaaacacagatttatatattttaattgtgttaaaaaatggcatgtcataaatttctgaagtatttagggttgaagtgttacatcttcactttgcttacaggtgattcgtaacaaaatctattctgcacacagtacggcgaaatgctaacaagactaaatagaggttatgattttttcaacttttctggaagttggaaaagctttataaacatttt

SEQ ID NO: 134552 - DNA, 601 bp, Human
tgagagctgcagtggaataagccccagacacatggcggagtggaaagacccagatgcagagcagcatggataatatgattcctgctccttttttttttttttttttttttttttttcaggaaaaataactcatatttatgcttgtgtgtgcttaaaaaattcctgaaaagatacacaagaaactgttaacagtggatacaccccaagaaacatctgggatagaaaacttcctttctattgcaaacccttttcttagggtggatatatatttttaaaccatgtgcatgtatactttgccacyaaaaacaattagttaaaaaaaaaaaacaccactcaacgggtagctgactgagccaggtgtcatggtcatgcctgtgtgggggtttcctttcccattcaggaacctcactgccagctccccgcctgggcacggggccctggagagggcttgggggcttggagagcaggcgttctgagttaaaatagatgttgctactggctgaacagtttgaagatatggagcttatgacctcaaaaggaagtgtataggatgcgagggagggtaacaaattatggaaccacttaggttgaagaaccattt

SEQ ID NO: 134553 - DNA, 601 bp, Human
gtgctattagaaatgcaggttgctgcctcatcgtgggtgcccacggccacctcatttccttgtgcgtttcacttgcctcttttgctcttttgtgcagtgccgttatctttttcatgaagtgtggcttccacaattgtctgtgacgtacattttatttacctcgtgcattcattccactcgtttcttgtcggatcactcagctggttgtgattgtgcgttcaggactctgaagtgccaggtactggcctaggagcagggggtgtggttggggacagtgtccagaggcttctttgaagctgamgcagggcctcacattggcatctctggaaatagtgaacacccagctccagagtggattagatgttagccacccctttataggggaggcctgagcaaatgtccctgagtgaatatcacttgcatctcccagagtaaaggcatctgacggcctcacttcagaggcttcctgcagtctgtccatgtttgattgtcattctcctcctctagcctgagtaccctggagatgtcacttttccttctcagaaaacactaagtaaggtgttccctgaggaggacccgagcccaccattggttctcttac

SEQ ID NO: 134554 - DNA, 601 bp, Human
ggactggcatgggccaggtcagtagcagtgctcagtacagtgctcacagaaggcagggagggacggattgctcccctcctttttcttcccctcagagtatgtatgttagttgagaaaaaaggaaaatcagtgaaacttaacaacagtatcagggtgatgtgattctcaagtgtttttatctctatattttttgtatcatttatttttatttttttgagacagagtctcactctgttgcccaggctagagtgcagtggcgcgatctcggctcactgcaacctctgcctccccagttcaagcrattctcctgcctcagcctcctgagtagctgggactacaggtgcgtgccaccatgcgtggctattttatttatttatttatttttgtattttttagtagagacggagttttgacacgttgctcaggctggtctcgaactcctgagctcaagtgatccgcctgccttggcctcccaagtgctaggattacaggcgtgagccactgcgtcatcctatgccattttaaaagtatttattttgaccatttactaatttcataattagaaaaggtaagcattattttaaaattattacgggtttag

SEQ ID NO: 134555 - DNA, 601 bp, Human
aaaaaggaaaatcagtgaaacttaacaacagtatcagggtgatgtgattctcaagtgtttttatctctatattttttgtatcatttatttttatttttttgagacagagtctcactctgttgcccaggctagagtgcagtggcgcgatctcggctcactgcaacctctgcctccccagttcaagcaattctcctgcctcagcctcctgagtagctgggactacaggtgcgtgccaccatgcgtggctattttatttatttatttatttttgtattttttagtagagacggagttttgacaygttgctcaggctggtctcgaactcctgagctcaagtgatccgcctgccttggcctcccaagtgctaggattacaggcgtgagccactgcgtcatcctatgccattttaaaagtatttattttgaccatttactaatttcataattagaaaaggtaagcattattttaaaattattacgggtttagaaaaatgtagtgctgacatcacttttttcttttatccacatgcttattcacttctccaacaactcggatttcttaagcctaattgtctattagcgaagtagtctgacttcatcat

SEQ ID NO: 134556 - DNA, 601 bp, Human
ttgggtgtgctgttttgaacatctgttggattttttctgcatttctctcaggaaggatggctctaggttagggtagcggaccccagtagttcttggagagaggaactacatatcaaagaggcaagaattcttaattctcttaagtacaatttttatttaaaaaatatggatttttttttttttacttcagaagcacaaatttatttatttatttatgtattgagatggagtctcgctctgtcttaataaaaggctggagcacattggcacgatcttggctcactgcaacttctgccttccrggttcaagtgattctcctgcctcagcttcccgagtagctgggattacaggtgcatgccaccatgcccggctaatttttgtattttcagtagagacggggtttcaccgtgctggctaggctggtcttgaactcccgacctcaggcaatccgcctgcctcagcctcccaaagtgctgggattaccggcgtgagccaccatggccagctgcacaaaccaacatcatatatttggagggggcaccatgttgaaattcagtaagggtaaggagagagaattagaaacctggccattttttaagat

SEQ ID NO: 134557 - DNA, 601 bp, Human
ccaaaatgctccaaaatttgaaactttcttttgagtgccaatatgacactcaaaggaatgctcattggagcattttggatttcgaattttcagattggggtactcaactagtaggtattctgcaaatattccaaaatctcccgaaatttgaaatcctaaacattgccaatcccaagcatttcggatgagggatactcagcctgtctaacgtgatgatatgtgagcagctgggcacacagcaggccctacatagcaggagctgaaatctagtgaaatctttctgtgtatataaatgaagccrcagattccttttatctgttcacctttctctaaaccagactgagtgaacagagcctctcacttctcactctggcttgtgatgtggcagtgttagcagaggggcttctctcccaggcttgccctgagcctcgggcttgttctcttagctcttccacaggtgccagcgtgccgtgcaggccctgccgagccgggcccgggcctgctccgagcaggaggggcggctgcttgggaacgtggtggcctcgctggcgcaggccctgcaggaactctccaccagcttccggcacgcacagtcaggcta

SEQ ID NO: 134558 - DNA, 601 bp, Human
atccaacacattgtgcactgtcttgctagggttttacagaggaccagttagttctggtggagcagaacacactgatggtggaagagcgggaacgagagattcgccagattgtacagtccatttctgacctgaatgaaatattcagggacttaggggcgatgattgtagaacaggtacgtgagctggccttcctcgtgaataggttttcctgccatactatctgtaccttctttttcctgtactcctttcagggaaaaaaattggagccaattttcccaacatgtgtgtgcacctgtcctttatgtgtgtgtgggtgtgtgtgtgtgtgtgtgtgtgtgtgtgtgtgtgtatattaatattaatcaaatattaaatttgattaattttaaaataataggactagtgttgaaacctcagtgtttacattttttactgaagtctcctgggtgctaattatcagaggagtgtggtgctttgagaaaagccctggggggttggaatgttggaaccctggctcttagcagtttaacagttacatgattctcatttaatccctctgactctagtgttctcatctgtaaaatgggactaataatcatag

SEQ ID NO: 134559 - DNA, 601 bp, Human
caacacattgtgcactgtcttgctagggttttacagaggaccagttagttctggtggagcagaacacactgatggtggaagagcgggaacgagagattcgccagattgtacagtccatttctgacctgaatgaaatattcagggacttaggggcgatgattgtagaacaggtacgtgagctggccttcctcgtgaataggttttcctgccatactatctgtaccttctttttcctgtactcctttcagggaaaaaaattggagccaattttcccaacatgtgtgtgcacctgtcctttatrtgtgtgtgggtgtgtgtgtgtgtgtgtgtgtgtgtgtgtgtgtgtatattaatattaatcaaatattaaatttgattaattttaaaataataggactagtgttgaaacctcagtgtttacattttttactgaagtctcctgggtgctaattatcagaggagtgtggtgctttgagaaaagccctggggggttggaatgttggaaccctggctcttagcagtttaacagttacatgattctcatttaatccctctgactctagtgttctcatctgtaaaatgggactaataatcatagtac

SEQ ID NO: 134560 - DNA, 601 bp, Human
gtgcactgtcttgctagggttttacagaggaccagttagttctggtggagcagaacacactgatggtggaagagcgggaacgagagattcgccagattgtacagtccatttctgacctgaatgaaatattcagggacttaggggcgatgattgtagaacaggtacgtgagctggccttcctcgtgaataggttttcctgccatactatctgtaccttctttttcctgtactcctttcagggaaaaaaattggagccaattttcccaacatgtgtgtgcacctgtcctttatgtgtgtgtgkgtgtgtgtgtgtgtgtgtgtgtgtgtgtgtgtgtgtatattaatattaatcaaatattaaatttgattaattttaaaataataggactagtgttgaaacctcagtgtttacattttttactgaagtctcctgggtgctaattatcagaggagtgtggtgctttgagaaaagccctggggggttggaatgttggaaccctggctcttagcagtttaacagttacatgattctcatttaatccctctgactctagtgttctcatctgtaaaatgggactaataatcatagtaccatcctcat

SEQ ID NO: 134561 - DNA, 601 bp, Human
attctgtgctaataaggtagctgtttcagggatgtttttatgatattctcttttaaaaaaatagatggaaagcatcttaggaatcttatcggttataagaaacatgcataaacggctgagactctcatatataattggttacgtattttctttaaaaggaatataacaatacttcacaaattaaataatatccatttccttgtatctttgagacccagtggagtttctagccatataatgagtgttttgccaattcactgttggactactctaccatttttctgaaatcagtcgcttcctrtaccagagatcgccccatttaatagcagtattgggtttacaaaaagtcagcccttgcactagtctaaccagaagccctgagctgtcttttcagggggcttgttgccatgtgtaggtggatatgagactccagcctgtggtgggaagagaagtctgaccttgtctatgcagggtttttttaagcatttagattaatttggttgccaagccctgtctattaaaagtgaaaactaacttaagtttctcactctgtaatacccaggttttgatgtgctgctgaattatgcattggttttgaagt

SEQ ID NO: 134562 - DNA, 601 bp, Human
tggctctgtgcgaagcaaagtggacacggggatccagggaagacaaaccagcccaagcgaggtgtgcgccgacctcatccctcccgtcagaagcgcgggatgctaatgacctcattaagattccgataacgagtgcctccggcagaagggagggctctttcttaaaggccaggcactaaacagggggaggggctgcgcccttgtttacacagcggcaaatgagccaattaggggctgggggcgggggcgggccaccaaggccagggtgtggccaggtttgtggccacctggtgaacgctgsgctcctcccagctgagcaggtgggcgtggccggagcagcttagagaagcaccgcctcctcctcggagtctggctcctggctgcctcaatttccaaataatgaataaagcccatgggcggaggcaccggtcactacagccaccaggctcctgcctgcaggccagcctaagggtgatccacagctgggggctggatcttcccaggcactacccagccctccacggacgagtgggatgcctctctagtgtctgccaaagttgcagcccattcctgggccggaaacgggttcctcacagaccct

SEQ ID NO: 134563 - DNA, 601 bp, Human
ctctgcccaagaggtcctgggcaaagggctcccccactttgatgcccacacccgaaccagcacccccccaagccccacctctgtgctcaggaggcagaagctcagggctgcacctctggccctcccgcccacggccttgggcctgtggctctgtgcgaagcaaagtggacacggggatccagggaagacaaaccagcccaagcgaggtgtgcgccgacctcatccctcccgtcagaagcgcgggatgctaatgacctcattaagattccgataacgagtgcctccggcagaagggagggcyctttcttaaaggccaggcactaaacagggggaggggctgcgcccttgtttacacagcggcaaatgagccaattaggggctgggggcgggggcgggccaccaaggccagggtgtggccaggtttgtggccacctggtgaacgctgggctcctcccagctgagcaggtgggcgtggccggagcagcttagagaagcaccgcctcctcctcggagtctggctcctggctgcctcaatttccaaataatgaataaagcccatgggcggaggcaccggtcactacagccaccaggctcctgcctg

SEQ ID NO: 134564 - DNA, 601 bp, Human
ggaacagagggcagtgctgttagcctcagggtcgccccctacccgctaattccggaatcttctgtgatgcccccccccccgcttcagagagcatcaggtagggctggccggacacaggaatcaagagttcagggcaggtcaggcctctgcgcccttaaccctcacaccaaccctcctctgcccaagaggtcctgggcaaagggctcccccactttgatgcccacacccgaaccagcacccccccaagccccacctctgtgctcaggaggcagaagctcagggctgcacctctggccctccygcccacggccttgggcctgtggctctgtgcgaagcaaagtggacacggggatccagggaagacaaaccagcccaagcgaggtgtgcgccgacctcatccctcccgtcagaagcgcgggatgctaatgacctcattaagattccgataacgagtgcctccggcagaagggagggctctttcttaaaggccaggcactaaacagggggaggggctgcgcccttgtttacacagcggcaaatgagccaattaggggctgggggcgggggcgggccaccaaggccagggtgtggccaggtttgt

SEQ ID NO: 134565 - DNA, 601 bp, Human
cactgtataacaaggggacaaactaaccctttgtttacaaactaaccctttgtttactccattttgtccagaaaatacaacaatcagttttggcaaagggcttcactgtgtaacaaggggacaaactaaccctttgtttactccattttgggagactatgatcagacaggcagttgtgactcagcagcaacaaatgccttctgagacagggattcttttgattttgcttggacattgtggagaagtgttagccccaatgtggactgatctgggaacagtgggaaattaacttcttgttggyaaatatcaggctgaggtgagaaagcgacattttcaccgtccatctttgctgatttaccatgctcccaggatggtgggagtgtgtgtttttaagatggagagtgtatgcttctgggttcaagttcacaggtgtctctgctggttatctgcactcaccttggtaacagggagaaagtgagtgaatggattccaagaacttactgatggaagtctaattcaggagttggttctgcagccatggaggtaaagatgtgttgatagtctttcaatgtgtaaaagggcaattagagattctgtgtga

SEQ ID NO: 134566 - DNA, 601 bp, Human
ttgtggagaagtgttagccccaatgtggactgatctgggaacagtgggaaattaacttcttgttggtaaatatcaggctgaggtgagaaagcgacattttcaccgtccatctttgctgatttaccatgctcccaggatggtgggagtgtgtgtttttaagatggagagtgtatgcttctgggttcaagttcacaggtgtctctgctggttatctgcactcaccttggtaacagggagaaagtgagtgaatggattccaagaacttactgatggaagtctaattcaggagttggttctgcarccatggaggtaaagatgtgttgatagtctttcaatgtgtaaaagggcaattagagattctgtgtgactgtgtgttaattccactggggtcaggggaaaaatttatttctaacagaaaagaagaagatacgttattaggaagaatttcatggctaggagatactatcagaaaaggctcttaagagattttaaggatgactttaatagccgcatttgaagtttgcagaggatccacttttcctctttttgtgacctaaaattctgggatgatgaaataactcaccaattccatcttcttata

SEQ ID NO: 134567 - DNA, 601 bp, Human
ttcatggctaggagatactatcagaaaaggctcttaagagattttaaggatgactttaatagccgcatttgaagtttgcagaggatccacttttcctctttttgtgacctaaaattctgggatgatgaaataactcaccaattccatcttcttataatatggagtcatgtagacaacaccattttcacacaaatggctaatggtatttaaaaaccatgatggaatgtgaattgggagtcatttggaggtctgtagttgaacttgaaaaaataataaatgtaatggagacaatatttcaccrtgtttccaaaatattttacagaggcattttaaatgaaagtcactttgagggaacagctgtgctgtaagttctcttacatgaccgcgcaagatggtagccttcatcaagacctctcaaggtagtgtgggtagggtgacgtgtttgattcaggcctcgtttgttatgaaaaggctcaaattcaattgtatttgttatttttttggttaaaaagcacctatttgttcaattcaaacaatcctttttggtttttttttgagatgaagtctccgtcgcccagcctggagtgcagtggcatgatct

SEQ ID NO: 134568 - DNA, 601 bp, Human
tttaatagccgcatttgaagtttgcagaggatccacttttcctctttttgtgacctaaaattctgggatgatgaaataactcaccaattccatcttcttataatatggagtcatgtagacaacaccattttcacacaaatggctaatggtatttaaaaaccatgatggaatgtgaattgggagtcatttggaggtctgtagttgaacttgaaaaaataataaatgtaatggagacaatatttcaccgtgtttccaaaatattttacagaggcattttaaatgaaagtcactttgagggaayagctgtgctgtaagttctcttacatgaccgcgcaagatggtagccttcatcaagacctctcaaggtagtgtgggtagggtgacgtgtttgattcaggcctcgtttgttatgaaaaggctcaaattcaattgtatttgttatttttttggttaaaaagcacctatttgttcaattcaaacaatcctttttggtttttttttgagatgaagtctccgtcgcccagcctggagtgcagtggcatgatcttggctgactgcaacctccgcctcccaggttcaagtgattctcccaactcagccc

SEQ ID NO: 134569 - DNA, 601 bp, Human
ataataaatgtaatggagacaatatttcaccgtgtttccaaaatattttacagaggcattttaaatgaaagtcactttgagggaacagctgtgctgtaagttctcttacatgaccgcgcaagatggtagccttcatcaagacctctcaaggtagtgtgggtagggtgacgtgtttgattcaggcctcgtttgttatgaaaaggctcaaattcaattgtatttgttatttttttggttaaaaagcacctatttgttcaattcaaacaatcctttttggtttttttttgagatgaagtctccktcgcccagcctggagtgcagtggcatgatcttggctgactgcaacctccgcctcccaggttcaagtgattctcccaactcagccccccgagtagctgggattacatgtgctcgccactatgcccagttaagttttgtatttttagtagagacggggttttgccatgtcagccaggctggttttgaactcctgacctcaggtgatccacctgcctcagcctcccaaagtgctgggattataggcttcagccaccgtgcccagccatattgttttcatttttaatctattagtctatcgtga

SEQ ID NO: 134570 - DNA, 601 bp, Human
gagtacctgggggtcagcaggataagcacgaatctgtgagagctgagaacaggtgggagaagccttctaaggatgaggcaggaaagattagcaagagcccttaaatggattctttagggccttcagaattttggctaaaggctatactagtggaggtactaagacctgacacctggagcctttattaaggatgttagaatccactcccatgacaacatcccagctttgccaatttgcctcatgtgtctcaagctggtgggaatgtagaagtggatgaaacagactgttttgtgatggcagrgaacagcctatgcacaggggcaggtgctctactggtgtcttctataaaacgccaaagcagcccgccagaaaatggacatttaggcactcgtggtgtctactgagtttgtatggtactgatgagcttgcttgactgattatccatgacttactgagtagatcgaacgtatgtggactcacttctcctagaggaagaccctgtggctgccccagccactgagcagcctaacctggagaccctgatgtgcccagaaagcgtcaaccttgtatctggagaaaccagaacttgcaacagggccaa

SEQ ID NO: 134571 - DNA, 601 bp, Human
tgttttaaaagagacaccctgtaaaatactcctatgaaaacttatttcacaagcacctaaccgcattctgtctttggtttgttttacggggccgggccccttgttctggtcaattggtctgcattatctctcctcctccaatctcaccacacaccctggcctctgggaggcttcctcccttctttttttttgtttgttttgtttttttagcatcttagttgttactaggggtacttgcctacttatttaaaatatggccagtataggtgcatacaaaatgtgctttctgattaaaacaaasccaaaaataaaaagaaaccaaaatgcctattatagtagttggatttttagactaacagaccacctcattaaccctgtcattttaccataacaacttatttttatctttgtatgaccttgtctcaatgtcctttttctttgatgttgttgcaattatgaacatcaaatttcatagctgcttttccaccccactttctatcacagaagcacaataaataatcttgggggctgggctcttgttggcccaactgtggcttcaaaacatttcagttgcctgtccagccctttcttagcctgatac

SEQ ID NO: 134572 - DNA, 601 bp, Human
atcaaatttcatagctgcttttccaccccactttctatcacagaagcacaataaataatcttgggggctgggctcttgttggcccaactgtggcttcaaaacatttcagttgcctgtccagccctttcttagcctgatacaacatcccccaaaagtctgttgagcttttcctggaataagaagagggtcttctactttttgaatagagcaatggagattggagaatatggtcatcttgtggaggttattccaggcttcttcttaggaaccttaaaaaaaatctcctcagaagggctgatgwtatattctggacaataaggtgagcagagtctgaaagatgagagcaattttcaatcttgtcatgatttcatctagtcagcctcatttcatctagtcatgaggctgactaatgataagacttgctttgtctttgcagtgtactctagatttgactctaaattcagcctctgtcttgatcatgcccacttagaaaattagagtgcagctagctcaccttttagtcatcttaattccactaggcagaaggctgtgggtcaaggaatgttgatggagtaaaatttgactgcatgtgtatctgaag

SEQ ID NO: 134573 - DNA, 601 bp, Human
gtaggaggctaagagattttatggcttggaagctgctgagatgtggtgtaaagaacactggacttagagtccagacacctgagtttaagctggactctaccactgggtagttgaatgactttgagtgagttatataagctctagcatctaagttttctcatctggaaaatggagttaataacatctactgcattgggctgttgtaaagattaaattaacaaagaatgtgaaagcacctgaacaaaagcttgtgagtaaataattagtaatttgtggaatgaacatcaagggaagtcttcartttgggtgttttcagtgagtttctgttgggtcagagtgaatggatattaaattctgggattttggtttgtgtgtgtgtgtgtgtgtgtgtgtgtgtgtgtggcgatcaacattggttcttcactgtgaccttaggaaagaaatgcaatagggtttttattgggaaggtgggtagcagggagatgcatgaaccatattaaggggggacctccaaattgaaccttgttttgagtcaactgcaaaccacaaccaaggaggtcctgggagacctggggtgacttggggtgattgggtatgcagc

SEQ ID NO: 134574 - DNA, 601 bp, Human
gcttggaagctgctgagatgtggtgtaaagaacactggacttagagtccagacacctgagtttaagctggactctaccactgggtagttgaatgactttgagtgagttatataagctctagcatctaagttttctcatctggaaaatggagttaataacatctactgcattgggctgttgtaaagattaaattaacaaagaatgtgaaagcacctgaacaaaagcttgtgagtaaataattagtaatttgtggaatgaacatcaagggaagtcttcaatttgggtgttttcagtgagtttytgttgggtcagagtgaatggatattaaattctgggattttggtttgtgtgtgtgtgtgtgtgtgtgtgtgtgtgtgtggcgatcaacattggttcttcactgtgaccttaggaaagaaatgcaatagggtttttattgggaaggtgggtagcagggagatgcatgaaccatattaaggggggacctccaaattgaaccttgttttgagtcaactgcaaaccacaaccaaggaggtcctgggagacctggggtgacttggggtgattgggtatgcagcacattcctgttcttgtgtcctga

SEQ ID NO: 134575 - DNA, 601 bp, Human
taaagaacactggacttagagtccagacacctgagtttaagctggactctaccactgggtagttgaatgactttgagtgagttatataagctctagcatctaagttttctcatctggaaaatggagttaataacatctactgcattgggctgttgtaaagattaaattaacaaagaatgtgaaagcacctgaacaaaagcttgtgagtaaataattagtaatttgtggaatgaacatcaagggaagtcttcaatttgggtgttttcagtgagtttctgttgggtcagagtgaatggatatkaaattctgggattttggtttgtgtgtgtgtgtgtgtgtgtgtgtgtgtgtgtggcgatcaacattggttcttcactgtgaccttaggaaagaaatgcaatagggtttttattgggaaggtgggtagcagggagatgcatgaaccatattaaggggggacctccaaattgaaccttgttttgagtcaactgcaaaccacaaccaaggaggtcctgggagacctggggtgacttggggtgattgggtatgcagcacattcctgttcttgtgtcctgatgcctggcaagtagggacctgcaga

SEQ ID NO: 134576 - DNA, 601 bp, Human
aaatcttataatattttaatttgtcatgtaaaaatattattttgagaagaggcctgtaggcctcactagattacaaaacagatccatcgtacagatgaaaggttaagaacacctcatttacagcattctctcacacacgactaacgaaatgacttctgaacagcgccagttgatagatgttctctgccaaaaggggaatatgatcttcccatatgttcctgcctatgggtagccttggagttgtgaagggactttggcataatgaagatgataataagaatgataatggtaatttgttgartgcctgctgtaagccaggtggttacagtcctgttcaatgtcatgtttagtttaatcctcccaatgacctcaggaggtagtgcatggaacaaagacagaagagatcccctgcccacccacggtaatgaaacatgggtacaggtgaaggcaaaagtggggactgaccctttggagatggctgatgtcacgagtgtgcaacctgtgcagttccacggggccccatgcttagaaaggttccatgtttggtttaaggctctgctgttgccatcttaaaattcttcgtaagttttgaacaaagggc

SEQ ID NO: 134577 - DNA, 601 bp, Human
taatagtaggttatctgcagatggattagaggttgaattctctacattgaatcttttgtctctaactttataaggacttgcttgcatttatggacatttctttcaaggctggtatctcctggagttgatcatcttgtggtgggaaagggaagggaggcaagtgggtaagtctatatagaccagaaaatctcaatggcgagagtgttcaagacttcgttaagggaggttctcagaaatgcagattttagtttagagatctggggtttcagtagccaaacattgttgactctaacaacatggkggtactgagcattaggacctattttatttcaagttggcaaataatacagtgataggttgtccacagaggcccacagaaaacaagcaaaaccaggaggatgtaaatgtttggaagaagaggagagtcaaagtttcttttgagggctcaaaagcctctgtgatgttttacaatctgaagcttgccctattcttaatcatatctgatgggtttgataaaggccctgggggtcatcttaggcaagcttgtcttttgatcaacttgggtgcctgccactgtcagtatgtgctgcctagcctgggt

SEQ ID NO: 134578 - DNA, 601 bp, Human
atatgaatatatatacatatatttgtatataagcttgataaaggtgtaaggcagcagacggcacagggagaatgctgtgaccatgtctagaatgggagtcaaagtgagaatgagtcttctctggcaaagcaccctcttctcagcagagagtggcccagttcccaggttttattgcaagacaatctgagtttgaattctcttccagttccaattctttctaaactgtgtgaccttgaacaagtcacctaactcctctgtgcctcagagaggccatctgttaaatgacataatgcctcctagrgttgttgtgagcattgattgagataatctgtttaaaccagcagtgcagagctggtacattttaagtgttcagtaagtcctaattactataatatagttattattattatttttaaagtgtttaatcctgagtctcagtagccccatcactgagcaaaagaaagacctccctccagctgagcaggcccaagctggcctgcgttggtctcttctggaaggttcgctctgtatatttaagaagggaggccagtggagcagtccttgggcttgttaggaatcccgaggctgagcagagcctcct

SEQ ID NO: 134579 - DNA, 601 bp, Human
gagaatgctgtgaccatgtctagaatgggagtcaaagtgagaatgagtcttctctggcaaagcaccctcttctcagcagagagtggcccagttcccaggttttattgcaagacaatctgagtttgaattctcttccagttccaattctttctaaactgtgtgaccttgaacaagtcacctaactcctctgtgcctcagagaggccatctgttaaatgacataatgcctcctagagttgttgtgagcattgattgagataatctgtttaaaccagcagtgcagagctggtacattttaagtrttcagtaagtcctaattactataatatagttattattattatttttaaagtgtttaatcctgagtctcagtagccccatcactgagcaaaagaaagacctccctccagctgagcaggcccaagctggcctgcgttggtctcttctggaaggttcgctctgtatatttaagaagggaggccagtggagcagtccttgggcttgttaggaatcccgaggctgagcagagcctcctgggtcttgggatgtgtggttccagttccctgccagtggcccagggttttttcttgcttttctgtccc

SEQ ID NO: 134580 - DNA, 601 bp, Human
cctccctccagctgagcaggcccaagctggcctgcgttggtctcttctggaaggttcgctctgtatatttaagaagggaggccagtggagcagtccttgggcttgttaggaatcccgaggctgagcagagcctcctgggtcttgggatgtgtggttccagttccctgccagtggcccagggttttttcttgcttttctgtccctattagccctagccccaatccgaaaccttattctttttttttttttttttttgagatggagtttcactctttttgcccaggctggagtacaatggtgygatctcagctcactgcaacctctacctcccgggttcaagtgattctcctgcctcagcctcccaagtagcaaaccttattctttgcagtatttgagcattctctgtgctaagggactcagaggaaagagaaacctttagccgttctctatcaggagcttgcgttttagacatgctgctcttcctggtctttttttttttttttttttgcacctccaaaccagctatggtatgtgggagtgcaaagcctttgacaacacagagcttaggagcatatgccttaccactgttcttggcagcctt

SEQ ID NO: 134581 - DNA, 601 bp, Human
gagtacaatggtgtgatctcagctcactgcaacctctacctcccgggttcaagtgattctcctgcctcagcctcccaagtagcaaaccttattctttgcagtatttgagcattctctgtgctaagggactcagaggaaagagaaacctttagccgttctctatcaggagcttgcgttttagacatgctgctcttcctggtctttttttttttttttttttgcacctccaaaccagctatggtatgtgggagtgcaaagcctttgacaacacagagcttaggagcatatgccttaccactgytcttggcagccttggcaatgtgtctagtgagaggaagggggacaggagggatggctttcgtcctttgggtaagaactgtgcccagccagaggggaacatcatggcttctgcaagcagagtccaagccccgctgtttatagttcagccataatggtacgtctacacagcagctctcggaatagggagtggggaggcatgagatctagtcctaggctccactgtgccagtcagccagaactggagaagactgtacagataagagagctttgaagctttgctcgaaatgaacttggctctcaa

SEQ ID NO: 134582 - DNA, 601 bp, Human
acctcccgggttcaagtgattctcctgcctcagcctcccaagtagcaaaccttattctttgcagtatttgagcattctctgtgctaagggactcagaggaaagagaaacctttagccgttctctatcaggagcttgcgttttagacatgctgctcttcctggtctttttttttttttttttttgcacctccaaaccagctatggtatgtgggagtgcaaagcctttgacaacacagagcttaggagcatatgccttaccactgttcttggcagccttggcaatgtgtctagtgagaggaarggggacaggagggatggctttcgtcctttgggtaagaactgtgcccagccagaggggaacatcatggcttctgcaagcagagtccaagccccgctgtttatagttcagccataatggtacgtctacacagcagctctcggaatagggagtggggaggcatgagatctagtcctaggctccactgtgccagtcagccagaactggagaagactgtacagataagagagctttgaagctttgctcgaaatgaacttggctctcaatttcctccttgagagttcaataaaataaaaactacaa

SEQ ID NO: 134583 - DNA, 601 bp, Human
gataagagagctttgaagctttgctcgaaatgaacttggctctcaatttcctccttgagagttcaataaaataaaaactacaagtatgattatgattattataaaaaccagcaaacatttatcaaatacttactatgtgtcatgcttttccaagcattttacaggtatcatttcattgttgtctttcgacaacacttttcatgtcatctctactttatagatgaggaaactgaggtcctgagaagttaaataacttgtccaaacttgccccattaggaaattggcaaagccaggatttgayctgtggccatgtaactccagagcctggggctcccaaccatgatcctgcttctgaggagtctactcctaccacaaggatgtccccagtgccagccaacacagtttaaacagagactcatgggcagaccctctaataagcatagacattgactagacacttgctacatatgagacattatgctggggactttacaaataatctcatttagtcctcatattagctccaccttccaaagtggaattttgttatgtggggagactgaggtggtagagaggatagaaattctccaaggtcaacata

SEQ ID NO: 134584 - DNA, 601 bp, Human
gcctaaggctaaataggtcttggcaagaagcctggcatgttgtacttgccagttcttcagtctattgggtagcacacagggctccttctcttcaaataaagagtacgattctgccccacaactgtgagtcttacaaacttctgcccaaagaggtgaagtttgggaaaaatgtcaacctctggacaatcagtagtgtctcaaaatcaaatacacttccctccaattgttcctacctatgaaaaaggatagggaaatatatatgaaaaaaatctcaggataatctacatttcatttcactcctttttttttttttcctttttgagtcagagtctcgctctgttgcccaggctggagtacagtggctcgagctcggctcgctgcaacctctgactcctgggttcaagcgattctcctgcctcaacctcccgagtagctgggattacaggcatgcaccaccacacccagctaatttttgtatttttagtagagacagggtttcaccatgttggccaggctggtctcgaactcctgacctcaagtcatccacccgcctcggcctcccaaagtgctgggattacaggcgtgagccatcgcacccggt

SEQ ID NO: 134585 - DNA, 601 bp, Human
aaggatagggaaatatatatgaaaaaaatctcaggataatctacatttcatttcactcctttttttttttttcctttttgagtcagagtctcgctctgttgcccaggctggagtacagtggctcgagctcggctcgctgcaacctctgactcctgggttcaagcgattctcctgcctcaacctcccgagtagctgggattacaggcatgcaccaccacacccagctaatttttgtatttttagtagagacagggtttcaccatgttggccaggctggtctcgaactcctgacctcaagtcrtccacccgcctcggcctcccaaagtgctgggattacaggcgtgagccatcgcacccggtcacacttcactctttgagtttgaaataagaggtatagtttttctttgtgtgtgcagtttgtaatagctcaggtaataatttatacaatctccccagaatacataccacctgggaacagacaaaggtggctctgatacccagtgtattctcttaaaccttcacagatcaggcaattactctataggtaccaggcactctgctgtgggctttgaggtgccttgtctcatttaaccctccagca

SEQ ID NO: 134586 - DNA, 601 bp, Human
tctgcctccccatccgaggttcctgcctccagcagaagatggggagaagtgagttcttttcccagcttgcttttgactcccagggtggagtcattctcacttaggctctgaactggggattcagtcctggaagaaataaaatgtgttagaggaacaccttgagaattaatgtttaaagaagggaaaggaaactgattttgatgggggacatgtttgccaggggctagacaagacacctttagacccattataattatttatctttcaaaacagcccttaggcttaggagaaacaaatactmccccgcaaccccctccagctctcccatttctaaaccagtgagagaaatggaggctcagaaaggttaacgtgctcaaggtcacatggctgaaagatgggacctagagtctaacccaggaatctcagattctgaagtctctacttccacacatttgatggtattttttttttaaggaaaataatgaaagctatgctgaaagcaaagtagggagctgaaataagagcattcaataattcccctactttctaattaaaaggattgctttttataccccagaaagcaattactatatactacaga

SEQ ID NO: 134587 - DNA, 601 bp, Human
gggagaagtgagttcttttcccagcttgcttttgactcccagggtggagtcattctcacttaggctctgaactggggattcagtcctggaagaaataaaatgtgttagaggaacaccttgagaattaatgtttaaagaagggaaaggaaactgattttgatgggggacatgtttgccaggggctagacaagacacctttagacccattataattatttatctttcaaaacagcccttaggcttaggagaaacaaatactcccccgcaaccccctccagctctcccatttctaaaccagtgmgagaaatggaggctcagaaaggttaacgtgctcaaggtcacatggctgaaagatgggacctagagtctaacccaggaatctcagattctgaagtctctacttccacacatttgatggtattttttttttaaggaaaataatgaaagctatgctgaaagcaaagtagggagctgaaataagagcattcaataattcccctactttctaattaaaaggattgctttttataccccagaaagcaattactatatactacagaaagtctacattagcatatgggagtatgggtgagttcgttat

SEQ ID NO: 134588 - DNA, 601 bp, Human
tttgcatatgagaaaactggggttcagagaggttaggtaacttgtctgggtgagtactaaccttagctagtaagtaggaaggcttggaatcgaccccagctcttctggcttcaaagctcctatacatggtgccaggacatataatccagtcctcctatcttcccacccagtggctctttgctgttataatgtccatcatccctaccctgtctttccttctccaccttctacttaggctggattcagtcctaattatttaccaagcaacagtgatgatgaagctaataatcatcatacatgwttgtgtgtagcctagttcaacctttaattactgctctctccccagcacctagaatagtgcccagcccattattgggctgataaatatttgttgaataaatgaatacatgaatatattcgtatgccttttgcagacccctcttctcccccagtaggccttactcagaacaagaggagcggtagctaaattaggggaaggaatgccaagggctgaaaatcctctgggttggcaattgtaatcctgtggacattggtaatacccgaggatgcaaaatttccccaaaacaagcagaaaattttc

SEQ ID NO: 134589 - DNA, 601 bp, Human; identical to SEQ ID NO: 36539

SEQ ID NO: 134590 - DNA, 601 bp, Human; identical to SEQ ID NO: 36540

SEQ ID NO: 134591 - DNA, 601 bp, Human; identical to SEQ ID NO: 36541

SEQ ID NO: 134592 - DNA, 601 bp, Human; identical to SEQ ID NO: 36542

SEQ ID NO: 134593 - DNA, 601 bp, Human; identical to SEQ ID NO: 36543

SEQ ID NO: 134594 - DNA, 601 bp, Human; identical to SEQ ID NO: 36544

SEQ ID NO: 134595 - DNA, 601 bp, Human; identical to SEQ ID NO: 36545

SEQ ID NO: 134596 - DNA, 601 bp, Human; identical to SEQ ID NO: 36546

SEQ ID NO: 134597 - DNA, 601 bp, Human; identical to SEQ ID NO: 36547

SEQ ID NO: 134598 - DNA, 601 bp, Human; identical to SEQ ID NO: 36548

SEQ ID NO: 134599 - DNA, 601 bp, Human; identical to SEQ ID NO: 36549

SEQ ID NO: 134600 - DNA, 601 bp, Human; identical to SEQ ID NO: 36550

SEQ ID NO: 134601 - DNA, 601 bp, Human; identical to SEQ ID NO: 36551

SEQ ID NO: 134602 - DNA, 601 bp, Human; identical to SEQ ID NO: 36552

SEQ ID NO: 134603 - DNA, 601 bp, Human; identical to SEQ ID NO: 36553

SEQ ID NO: 134604 - DNA, 601 bp, Human; identical to SEQ ID NO: 36554

SEQ ID NO: 134605 - DNA, 601 bp, Human
gtcaggggagaagggtaggtggggggctttccttgaagctgaatatttttctgagtaaaatccagcttcccttcctaaagaagctttagggaggatagagaactgagcgcctgggcgcgttctcttaattccccttggttcagctaagggatccagagggagtggtggctgtgaggagggctggtggccacacggcctgcggaggcaagcaggtctctctgaggcaagccgtcacatccgtgtcaaacagctcccggaggccctgggactgcacccagcgcaggtgccggccctggagctrgagatggacgagcagacccaggccccaggccgagcctctgagccctgacaccccttacgattcatccaaaaaagcaaagaaaaggcgcttacgtgagggcagcggtggctaggtccaaagaggaggctttcaaggcaagagaaggcaggcgctcccagcaccagcgtgcagtggaaataaagacacctgtagccttgtgatataagtgacacctacagacaggtccgtttggtttttcaggtttacgcacagcccctttgatgacggtgacatacagtgtgacacggctccttggagggg

SEQ ID NO: 134606 - DNA, 601 bp, Human
aaagattgagggttgggtgcttgagggtttgttcttctgagaggaaccctagcaactgtgagaaccaatttgctgacctcttgtcaagtgattcctcatttttctttagctcgcttagggagtttgcgtgtttgtttgtttgtagctgtttttctgaaggtgcagcgaagatccaaaaaggtatgccatgtagtttgctgtaggcttcgatgcaaagcttaccagttttggattacatatatcaggggttaaatcctacctctgctgctgcgaacgtggggcacatttcttactacccagmctgctgaaattcttaagctttttttcatatagatgtggtatataaatattcatgcccctcttcgaactacggtttcctcatctctaaaatggggatttttttttttttaaatcatgcaatccgatatatgcaaaggacggggcataatacatatattcaatcctgttttagagggaaaaatcagccatcaacaatgtatctaaaaatttgccactctggtgacttctgaaaaagggagatgaccaaactgaaaactccggcccgagaataccttagattatgaaaaacagtattgcagag

SEQ ID NO: 134607 - DNA, 601 bp, Human
attgattatatttgcatttttttggtcaagcaagtccaccaaattggaggaaaatccaaccactacacacagactgaacttttagtgctgaaaaagctccctgatttcctcttctcccttttctcctgtgcccactgccttctaccccagttggaggtagatacctcaggacaactggatattctttgcccagcctagctgggtaccttaaacactctggaccctcactcactgcccaccgatagatccgtggaagctggaatcagtttcccccaaatgtagtcatcattctagctgcctmgtaagtaggaaaagctcaagaatgattaacacaaggtggtggaatcaggtgggctcacttcacacatgagaaagttggctgcaggtacctgtgggagtgaggcagagatggcatggaagctgaggtccccagatgcctccagtggcttctgaacccttctcagagctggctcacacaccaaatgcacacagagagggtccaccgagttggagggacaggcctgtgggcttctcagtgtcacacaaatcagaggcagcaataacaggtgtggctcccatggcctgagcaacccggcacccc

SEQ ID NO: 134608 - DNA, 601 bp, Human
tgcatacacattgattatatttgcatttttttggtcaagcaagtccaccaaattggaggaaaatccaaccactacacacagactgaacttttagtgctgaaaaagctccctgatttcctcttctcccttttctcctgtgcccactgccttctaccccagttggaggtagatacctcaggacaactggatattctttgcccagcctagctgggtaccttaaacactctggaccctcactcactgcccaccgatagatccgtggaagctggaatcagtttcccccaaatgtagtcatcattcyagctgcctagtaagtaggaaaagctcaagaatgattaacacaaggtggtggaatcaggtgggctcacttcacacatgagaaagttggctgcaggtacctgtgggagtgaggcagagatggcatggaagctgaggtccccagatgcctccagtggcttctgaacccttctcagagctggctcacacaccaaatgcacacagagagggtccaccgagttggagggacaggcctgtgggcttctcagtgtcacacaaatcagaggcagcaataacaggtgtggctcccatggcctgagcaacc

SEQ ID NO: 134609 - DNA, 601 bp, Human
cccccctctttagggaacaaagatgagttcttggggatcaaaaaactgagttattaattacagtgttttatcatgctccaaaggtctacagtagatgtatagtttatctctggtactcacatttctggtggggagatgattaagaaaaaatgacctaaaaagtgtccttaggagaagtgataaaaaaaaggtggagaagcgctgtgatagatccacctagtgtcagcgccagtacagacagggatctgctgggaggtctcttggcctgctgttctggacatacttttcattttgtgagggrctagctggctcatcatggaaggagccctgggcctggagttatgattctgcctcttgcccctctccaaatctcagttcttcaactactaaacaagaacacagataaaacagcccccaaggtctgccctaactctgtgactttctgcagacacccacctgattgagccaacacatccaaacctgggcactcacacacatatgcatacacattgattatatttgcatttttttggtcaagcaagtccaccaaattggaggaaaatccaaccactacacacagactgaacttttagtgctgaaa

SEQ ID NO: 134610 - DNA, 601 bp, Human
tctgggctctccacaaaagaccttggctacttagccagcatgcagtaggtgtgagagttcaagaataatggctgctttgtattcagtagcctctcttctctaggccctctaaggtccttgcaataattgaacattttagctcttaaggacttctttagtggaggtagagcaggataggtgtgaaaaggcagatgtccagagccccctttctcagaagtaacactgaggcccagggatatgtgaacacaggcctgaggttaggccaggcctgctcaaggggggtgatattgcccccctcttyagggaacaaagatgagttcttggggatcaaaaaactgagttattaattacagtgttttatcatgctccaaaggtctacagtagatgtatagtttatctctggtactcacatttctggtggggagatgattaagaaaaaatgacctaaaaagtgtccttaggagaagtgataaaaaaaaggtggagaagcgctgtgatagatccacctagtgtcagcgccagtacagacagggatctgctgggaggtctcttggcctgctgttctggacatacttttcattttgtgagggactagctggct

SEQ ID NO: 134611 - DNA, 601 bp, Human
tgggtttgggctgtgattttcccacggattggctggttttatatcctgagtgaggggggcagggagggggtaggatgctgagggatggggtgagaggttatgaggaagggaagggcctcaggagctgaaagccacttctgctttctggactggacttcagaaaagttcctttaagtgagggctgaagacaaatatatcccttttcttctgggccagaaggctcagaaaactaaagaagaggatggcaggcctgtgatatgaccttctttgggttgggagaaaggagaggtgaattccacayggaagaaaacagaaaacagtccccaggtcttcagtgtcaaataaggaatccatcaaatacaaaacacgacagtgggaatgagatcttcctcatctatgcctcactaattgctctcaaaagtcattgggtattaacaaaaaaaaaggtcatttggtaaattgaatggcattatataaaaactagaaatattttttgatcaatagtatttttacctcttttaatattgttattctttctcctctttataccggcctactcacttgatctgtaatctctctagtgctatacacaatgctgtat

SEQ ID NO: 134612 - DNA, 601 bp, Human
acctgggaggcagaggttgcagtgaaccgagattgtgccactgcactccagcctgggcgacagagcaagactatgtctcacaaaaaaataaaaaataaaaaataaaaaataaaaaaaactttacatttttaagtggttacattttaagtggttatataaatatttacatcatatccttgattttgccttttggcctgctaatcctaaaatacctggccctttaagaaaaagtttgcaacccctaaccagattcatctggcatgttgccagttgatgtgagtaccacgtgttggaagatacygagttagtccaatttccctcctcgcctccaccattttacagttgaggaagttgagactcagggaatttgtgtaactagctcaaggtcacatagccagtggatgccagagttaagtggcagggaggtccttagttttctgactctcagcccatctgcttctctttctgaaaacacaattgagccccaaggcacacttatatagcaaatcaaacctcagtactaagaggggcaggattgtgtgattctgaaaccaaaggtcaattctttgcagatgcttgaaaatctccaaccaccatcatc

SEQ ID NO: 134613 - DNA, 601 bp, Human
cagaacaaccactctgagataggtactggcagcagttccatttcataggtgagggatggaggctctgagattccgggtaatacatgcaaagccagcgaagctgggtggtggctcaggtgtgtctgtttaaaaagcccattctaattgctgtgctccagtccccacacactttggtggcggcaaggagctctggggcagggtgtgtggttgaggctggaaggaaggcagaaaagaacaggcctagggcccccgcttgcacacattcttgcctgtgctggtctcaactttgctgcttcccatrttcccacatgccactctctactgaatcccatctccccgcaattcagaaaaaataataatctgtgtttggtggattaaaacaatctgttcacccgaattcttttttctgattcttgaaataatgttgacatagagtagttctttcctcgttttgcaaagggaacatagctgctcaagatcacaccactggtaagtgtcttgggatattaaacacatggaattttaagattggcaggagtgaattcttcatctagtccagtgtttcctaaacttcagtcatttgcctacgactgtgataatt

SEQ ID NO: 134614 - DNA, 601 bp, Human
ataagaaagaacaagatcatgccctgtgcagtaacacagatgcagctggaggctattatcccgagcaaattaagtcaggaacagaaaaccgtatacctcatcttctcacttagaagggggcactaaatgttgagtactcctggacataaaggtggggacaatagacactggggactaccagagggaggaggcagggaagggggccaaggttgaaaaactaactactggatactatactcagtacctgtgtgatgagatcaatagcacctgaaacctcagcatggtgcaatacacacaggtracaaacctgcacacataccccctgaatctaaactaaaagttgaaataataaaaataaaataaaattgttttttttaaaagatgtaatcctgctctgtcgccaggctggagtgtagtggtgtgatctaggctcactgcaacctctgcctcctgggttcaagcgatcctcccacctccacctcccgagtagctgggtctacaagtgtgtaccatcaaacctggctaatttttgtatttttagtaaagatggagtttcaccatgttggccaggctggtctcgaactcctgacctcaagtgatc

SEQ ID NO: 134615 - DNA, 601 bp, Human
ttgcctctttatttatgtttcctgtttgctcacatctgacccctgaactctgacttatgatgttcaataatatgcttctagaaacagcgtgagatgcagccataagaaagaacaagatcatgccctgtgcagtaacacagatgcagctggaggctattatcccgagcaaattaagtcaggaacagaaaaccgtatacctcatcttctcacttagaagggggcactaaatgttgagtactcctggacataaaggtggggacaatagacactggggactaccagagggaggaggcagggaagrgggccaaggttgaaaaactaactactggatactatactcagtacctgtgtgatgagatcaatagcacctgaaacctcagcatggtgcaatacacacaggtaacaaacctgcacacataccccctgaatctaaactaaaagttgaaataataaaaataaaataaaattgttttttttaaaagatgtaatcctgctctgtcgccaggctggagtgtagtggtgtgatctaggctcactgcaacctctgcctcctgggttcaagcgatcctcccacctccacctcccgagtagctgggtctac

SEQ ID NO: 134616 - DNA, 601 bp, Human
ctagaaagtggcaaagaggggactggagcatggaggctctgattatgcaatattgcctctttatttatgtttcctgtttgctcacatctgacccctgaactctgacttatgatgttcaataatatgcttctagaaacagcgtgagatgcagccataagaaagaacaagatcatgccctgtgcagtaacacagatgcagctggaggctattatcccgagcaaattaagtcaggaacagaaaaccgtatacctcatcttctcacttagaagggggcactaaatgttgagtactcctggacatraaggtggggacaatagacactggggactaccagagggaggaggcagggaagggggccaaggttgaaaaactaactactggatactatactcagtacctgtgtgatgagatcaatagcacctgaaacctcagcatggtgcaatacacacaggtaacaaacctgcacacataccccctgaatctaaactaaaagttgaaataataaaaataaaataaaattgttttttttaaaagatgtaatcctgctctgtcgccaggctggagtgtagtggtgtgatctaggctcactgcaacctctgcc

SEQ ID NO: 134617 - DNA, 601 bp, Human
gaggtactcctgaagccacactgtgcaggagcccctagcagggcgatacttgttttttaaaaatgataacaaatatgtcactcactaggagcaggcaccgcctagtgtcacctacgagtgacattattccacccttgccatatcctgtctatccccattttagatgagaaaactgaggcaaaagggttgagacaattgccaaagtgatataactagaaagtggcaaagaggggactggagcatggaggctctgattatgcaatattgcctctttatttatgtttcctgtttgctcacatcygacccctgaactctgacttatgatgttcaataatatgcttctagaaacagcgtgagatgcagccataagaaagaacaagatcatgccctgtgcagtaacacagatgcagctggaggctattatcccgagcaaattaagtcaggaacagaaaaccgtatacctcatcttctcacttagaagggggcactaaatgttgagtactcctggacataaaggtggggacaatagacactggggactaccagagggaggaggcagggaagggggccaaggttgaaaaactaactactggatactata

SEQ ID NO: 134618 - DNA, 601 bp, Human
tcctggctgcactcagatgggctccttcaaatgtacgcacctgtctgatgctcaaaggcagggtagtactcttcattgctgaacagatcagtccacgacatcaggggatcgcagaaggatgcattaggcaggaaggtgctgtgtgtcaccgagtccaacattaccctgcaacagcaggagaggtcgtgaggaggctggggtgaggtactcctgaagccacactgtgcaggagcccctagcagggcgatacttgttttttaaaaatgataacaaatatgtcactcactaggagcaggcaccscctagtgtcacctacgagtgacattattccacccttgccatatcctgtctatccccattttagatgagaaaactgaggcaaaagggttgagacaattgccaaagtgatataactagaaagtggcaaagaggggactggagcatggaggctctgattatgcaatattgcctctttatttatgtttcctgtttgctcacatctgacccctgaactctgacttatgatgttcaataatatgcttctagaaacagcgtgagatgcagccataagaaagaacaagatcatgccctgtgcagtaac

SEQ ID NO: 134619 - DNA, 601 bp, Human
ggtgggggcaggtgtgggattgcattatgtaggtaagtgcctcaagtctgtgagtgtggcctggtccctggccccagaggcaggggcttctggtagtggactttttgcagtccctggaggcatggcctctcttgcacactgcctgcctccggacactgagtctggactcctacatggggttaacactcagtgaggactgacagcttgattggcacttgcatgaccgctgagcagcgtgtgctcctgttgtgccagcagtcagccaggtgtgctgtgatatgtggtcacccaagcacctcaktgacagaggccctcagagggtttctgggggcaaagctcggctggcctccctccggcatgggattttctcaaggtcccatgctgccttctcaggtggagaaatccaggctgagaaagaggagggagggtggggaaggaggcctggggaacagtgaggggctcatatttactgaacacttgttttgtgccaggctacatatttacaccctttggctcccttagtccttatagtagctctcatcacccctggtttagggaaaaagaaatagaagctcagagaataatgatatattaatatcaa

SEQ ID NO: 134620 - DNA, 601 bp, Human
ctcaggctggagtgcagtggcgtgactgcagctcactgcagcctcggccttccgggctcaagggatcctcctgcctcagcctcccaagtagctaggactacaggcatgtgccaccataccaggccaatttttaaacaattttttgtagatacaaggtctcactatgttgcccaggctggtctccaattcctaggctcaagtgataatcctgcctcggccttccaaagtgctaggattacaggtgtaagccatcacgtccagctaatccttcaattttttaaacagttatgtgtgcttaccrggtaccggactgtgtcctaaacacttcccatatgataactcatttcattagcataacaactctacaaggtagcattgtggtcattcccattttacagatgagaaactaactgggacatgagaggttaagatgacacagctagtgtcagagccagacttcccatttgggacacaccaggtcttcatgacacagagccgctgcttcactgcccaggccattgcctggggcagctggttgtagcccgcccctcccactgccaccccaactacttcccagcagaataggcagaaagagggggct

SEQ ID NO: 134621 - DNA, 601 bp, Human
tgaaactaatcctttttttttgacccagagtctccccctgttgctcaggctggagtgcagtggcatactcacagctcactgcagcttcaaccttctgagctcaagggatcctcctgtctcagcctcccgagtagctgggactacaggtgcgtgccaccatgcccagctaatttttgtattttttcgtagagacggggtttctccatgttgcccaggctggtcttaaactcctgacctcaggtgatctgcctgccttggcctcccaaagtgctgggattacaggcaggagccaccatgcctrctccccaaccttttttttttatctcactgtcgctcaggctggagtgcagtggcgtgactgcagctcactgcagcctcggccttccgggctcaagggatcctcctgcctcagcctcccaagtagctaggactacaggcatgtgccaccataccaggccaatttttaaacaattttttgtagatacaaggtctcactatgttgcccaggctggtctccaattcctaggctcaagtgataatcctgcctcggccttccaaagtgctaggattacaggtgtaagccatcacgtccagctaatcc

SEQ ID NO: 134622 - DNA, 601 bp, Human
agagggaaggctgtttttccacccaacagggagtggtgaggagttcttggctagggtgagcacttcccaagtgccaggcacgtgactaaacacttcgtacacaaaatatcattcaatctccccaactccaggaggcagaggaaagcatatctcaaaaaactggctgcaggtcacatggctggtaagtggcagtgcctgcccatgaacctgggtgaacaggaagctgccactgcaacaatctttaggagggcccagaattccagatagtatttcctgggaggtgggtaaggacctcaggagrggtatctcagagcctgctggccatggagcagggaaagttggctgagcagtgcccagaggcaaagctggctgtctcctgacccacccctgccagagggggcttttgtagaaactccaaatggctgcacctctctgggtggcaacgtccttgttgataaaagacagaaggcccctcctgctaatcctcccacctgtggaggagagcaggggctacaaggctcacccggtgcccaggcagctccaagagaggtgtttactccaggtgaacatttcacacccaacttcgaccttttggaggtca

SEQ ID NO: 134623 - DNA, 601 bp, Human
tgcttagggatggaggtggacagagaaggactgaagccccatcttctcaactgtcacttccactcccttctctggtggtccctaaggaacctctgggaaacccctaaagcctctcaggaacctcagtttagaaacctctgcagctgacaaagtataagcaagattccaaagcaaaggaggcgctgcatgtgtgcgtggcacattggctgtcaggggaggggtgttggtctgtggaggttaaggaaagaattccagaaagaaagtagtggcaaggccagggtactcaatgactactggaggrttggctactggaactcgactggagaaaccatcttttaaaaatatcatatgcatgtgaactacatgcagcctcccccccaaccaactctcccgcccacttggatacattttccagtagtcatcgttctttactttgaaaaagccacaggcaaggcagggtaagttcatgaaattctagagtattttgcaatctggactgtccaacctcctgcctgcagtgcagccaagcagaagtcctgcttcaaagagcaggtcagaatcctttgtggttaccacaccagggcacagattcagcggcact

SEQ ID NO: 134624 - DNA, 601 bp, Human
gggccaagagagccaagccctgagcagtcctggggccatggccacccagaaggctcaggtgcatgtccactgggctagaggtggccaacagtgagtcctcctgaggtgtgggcgctgccacagggctcacctcagactttcagatgattttgtatttgttgatctggttttgacttagaagttcttagattctttcctttgtatctgctctcaagcttctgtacataaaacatgaatcttgcttaggaaagcccatgtggggatgcagatgcctctttctctgaccagtgggttttgcacttttttttttcttacaaaaagtgctttcttcaaataaaatctcacattgtgcaataatattatagctaacatatttattgagcacttagtatgtgcccgttatcatgctaaattatttgtgctttctcatgttgtccctaacacaatgctatgaagtcctctgtcatgttacccattttacaaagggagaaagtaaggctcacgggtgtgacccttttcaagctcacgtaacccgtaagtggcagagctaggagtgggttatctgggtgtattctggctcctgcagcccagcctcactgtg

SEQ ID NO: 134625 - DNA, 601 bp, Human
tattttcaagtgtggcaactggcttggtttttacaaaacaccacgggaagcccagtcaaaatgtcttcatgggctggatcactcctggccatcactttgtgatgaacaatctgacaggcttttggccacttgtctccttcaagattattgtttggagtgggcatgctaagactttgaaggattcttttatggttgaataatattttcttcaagttaaaacttatctggaaaaaagcaaccctgttttactgggagtggaggtgaaggtattagctccaggaagctccttgaaaatcactgytctcaaacttgaaaccaggattcctatattttgaattccccttcaaagttgaaagggcacatggtctctcacacttagtggtcctgcctccttggactcgtctgcaaaataaaaataataggacctacttatctgggctattaaaaggattatgtaaattaatacatggaaagtacttagaacagggccaggcatatggcaagtgctcattaaatatcatccacttatacttgtcaatattagggttacctcctgggcttcccgtgtcaccactttaattacattccttcaaacacttct

SEQ ID NO: 134626 - DNA, 601 bp, Human
accaccataccgggtcagcacagagcagagatggaacgtgaagagtggctgaggcacggggaaagctggagagaacacaacacgagggcctgaaaagaaaggcagagagcagagagtggctaaggtgacgatgacagaaagggtccctcacatgttataccccacagcaaatagcagtggtgcgatttgcagcgtttaaaggtgagtagaactcgcaccattgtcagttgctgatgattccaggcaggaggtgggtcctctgcctgtcaggtgctactactcactcagcaccctcagccarccgaggcgctacgcgttcttgtcgtctcaagtttctcaggtcccctcaacaatcctatccagtaggtgtaattgggctattccacaaaaaaggaaatagaggctccccttaaaactcaaaggtcttccagagatctcttttaccaccgaagggtgggtggaggggcagttgatttattttatttaaaaattttcagaattttatatgcattaagatcaaagcgtcaatattgtgccagggtgcttgaggctgatgtcgtagcctctacctggcagataggaagagccagggagccggtga

SEQ ID NO: 134627 - DNA, 601 bp, Human
ccgtcccccaggagatcacagaagaggaacttgaaagtcatgaaggactttcccaagaacccacgccagcgtgtggcagagctggatttgaaccctagcctgaacttgaaagccattgctctccccacaccaccataccgggtcagcacagagcagagatggaacgtgaagagtggctgaggcacggggaaagctggagagaacacaacacgagggcctgaaaagaaaggcagagagcagagagtggctaaggtgacgatgacagaaagggtccctcacatgttataccccacagcaaatrgcagtggtgcgatttgcagcgtttaaaggtgagtagaactcgcaccattgtcagttgctgatgattccaggcaggaggtgggtcctctgcctgtcaggtgctactactcactcagcaccctcagccagccgaggcgctacgcgttcttgtcgtctcaagtttctcaggtcccctcaacaatcctatccagtaggtgtaattgggctattccacaaaaaaggaaatagaggctccccttaaaactcaaaggtcttccagagatctcttttaccaccgaagggtgggtggaggggcagttga

SEQ ID NO: 134628 - DNA, 601 bp, Human
agattaaatgacttaatatacataaaagtacctggaacagagcctggaggatttaaatgctattacaaacattattattgaatatctactatgtgtgcagccacacgttgtatgttaaggattcatggtggacaggtttggtcccccgtcccccaggagatcacagaagaggaacttgaaagtcatgaaggactttcccaagaacccacgccagcgtgtggcagagctggatttgaaccctagcctgaacttgaaagccattgctctccccacaccaccataccgggtcagcacagagcasagatggaacgtgaagagtggctgaggcacggggaaagctggagagaacacaacacgagggcctgaaaagaaaggcagagagcagagagtggctaaggtgacgatgacagaaagggtccctcacatgttataccccacagcaaatagcagtggtgcgatttgcagcgtttaaaggtgagtagaactcgcaccattgtcagttgctgatgattccaggcaggaggtgggtcctctgcctgtcaggtgctactactcactcagcaccctcagccagccgaggcgctacgcgttcttgtcgtct

SEQ ID NO: 134629 - DNA, 601 bp, Human
catttcattcaataaataaaagctttagtttccttactggtaaaattggaataattacagcacctgtatcatagtgctgttctgcagattaaatgacttaatatacataaaagtacctggaacagagcctggaggatttaaatgctattacaaacattattattgaatatctactatgtgtgcagccacacgttgtatgttaaggattcatggtggacaggtttggtcccccgtcccccaggagatcacagaagaggaacttgaaagtcatgaaggactttcccaagaacccacgccagcrtgtggcagagctggatttgaaccctagcctgaacttgaaagccattgctctccccacaccaccataccgggtcagcacagagcagagatggaacgtgaagagtggctgaggcacggggaaagctggagagaacacaacacgagggcctgaaaagaaaggcagagagcagagagtggctaaggtgacgatgacagaaagggtccctcacatgttataccccacagcaaatagcagtggtgcgatttgcagcgtttaaaggtgagtagaactcgcaccattgtcagttgctgatgattccag

SEQ ID NO: 134630 - DNA, 601 bp, Human
cctgttcccttgggaggatcctaaatggagtcccaagctccttcttctggagccgttgtgacttggtcaaacttgtcctctttcagggagtgcccactctgagcacaggacacagatcccagctcttggcaggtcattgtcactggagttttggctcccagggccccagccatgtagtgcccaagggccaccattcttagcttttctgccttcaagcgctcatgatggatgaggatcaagaggaggccaaagaatcacagagcaggagggtcctctgtggtttttctgtgcaaacaagagkcgctgtcatatcctcctcttcaagcagggggctattagactacttgattatctccagtggtggggatcgtcctatctcctgtatcttctgaattaccttttcaaaagaaggtactaacctttaaaaagatccttcttaaaactgagctgagataggcttcctttaacatcctataatatgcctcttgattatattaatgatgatggaaaaacagctgccatttactgcatttccatcttcatatgctgttctaggtaatatttccctgaatcctctcaaaaagcccatggaggtgtcatt

SEQ ID NO: 134631 - DNA, 601 bp, Human
ttttttttttttttcaggattttgctctttttgcccaggctggagtgcaatggtgcaatctcggctcacttgcaacctccacctcctgggttcaagtgattctcatgcctcagcctcctgagtaactgggattataggcacgcaccaccatgcctgtctaattttgtatttttagtagagacggggtttcaccatgttggccaggcttgtctcgaattcctgaccttagatgatctgcctgcctcagcctcccaaagtattgggattacaggcctgagcaactgtgcctggccaacaggtwttttttgtttgtttgttttttgatgcaaccattgccagggaagagaggtgcttgtggtgggagatgccagcacaggggctgcacaagagcatggagacaaatgaggttgacttgacatttggccaagctggcattgccaagctgcatctttttccagaataaaatacacccctctctgtggccctaggatttttgtgcgagcctgttcccttgggaggatcctaaatggagtcccaagctccttcttctggagccgttgtgacttggtcaaacttgtcctctttcagggagtgcccactc

SEQ ID NO: 134632 - DNA, 601 bp, Human
tgaagaggggctcattcccctcctaggctgtggaagccaacctctgaccttgcttcccagcaaccagtgtccccaggttgctaggcccttaaatcctactgcaatacctaccgagctggatggtgctgaggccttacaacccccttccagctcctctcctccataaaactgccttattctgtgtcctgttctgccagagtcaaaacctatggggtagtataaggcatacatgaggtaataacccccagtcaactgtagaatttatgatctaaatggagacacttttgaggatgaaaggtartgctatggtaataataattactctaggatcacaggcagaaacgatgtctcctgggcaaatgggagacagtgtgaactttgatcacaatatatatatctccacaatctacaatccacatatctgattgagaaacattaaaagaggaatttcagaatggagtagattggtggagtagatagttttactgctcaatatggaacactcctggcctagagagtgcttgaaatcccaccattaaaggtggcattgtgattgcaggaattccttacaataagaagaggtaatgtatgacctattaaa

SEQ ID NO: 134633 - DNA, 601 bp, Human
agtttaggctgaaggatacctatgtcctagcttggtccaacacgaggactaatctctacttgctaagcagactggagcagggcacagttgtgattttttattcttggcgtcatgttctcattggttttggtcagccacgcgcctcagttgactctgtccaaagggccgactgagaacaggatgggagattgaagaggggctcattcccctcctaggctgtggaagccaacctctgaccttgcttcccagcaaccagtgtccccaggttgctaggcccttaaatcctactgcaatacctacsgagctggatggtgctgaggccttacaacccccttccagctcctctcctccataaaactgccttattctgtgtcctgttctgccagagtcaaaacctatggggtagtataaggcatacatgaggtaataacccccagtcaactgtagaatttatgatctaaatggagacacttttgaggatgaaaggtagtgctatggtaataataattactctaggatcacaggcagaaacgatgtctcctgggcaaatgggagacagtgtgaactttgatcacaatatatatatctccacaatctacaa

SEQ ID NO: 134634 - DNA, 601 bp, Human
ggtggcgcatgctgggctctttgtgtgcatcatttctcaaacttaccacgacccacaagggtcacactattttacagataggggaatggagtctcagacgataagcaatccatagacccaagctatggtcctacagacccacacccacgctctttctgtcacactctttccaccacgcttttccccactgctttctccaggtctgggattgttttggttcatcagcttttcagtatgatcctaaaagaatggtcaagcccatgtaccaatgacaaccttgacagagccttgggtggcttgmgcttggttacttacagtctttgatggtggccttgctttcttcagcgtcattaaaaaaggagtaacctgggaaagaaaaagaaatccagaaaccataccatgcaatcctggtttccactggccaggccaggagagggggtgttggagggaagtggagtgactgtccctcttgaggttggttacaatttagagggaaccttggagaccatctggtcttagagtgtcaccctgaagccatccctgagaggtgataatttcctcattattaaaggtcatttggagggagcacccagaaccaggc

SEQ ID NO: 134635 - DNA, 601 bp, Human
aacagtccctctgtgtctgcccctccagcttgcagccctcagaggccttggaaatcaccatgcgctctgctccctctctgcagatgactgagctgaagcccatgggggaatggggtttgcccaggaccacatttcctcctggcctctgggccagggactcagtaactaatagtaatcatcattgtcatctttgaaaaatgaaagcaccaaagatccctttcccgagccttcttcatctgcccaagtgaaacagggaaggttaatcatcagcatcaacaaggctatttgagatcctccatcktcttataattataaactctacctgcttagtgagctcagagtcttcttaagcattatgaaccacaaggcttctaatagtattattaatgtatgacaaatggatactggtttgggagcatctacactggtggcgcatgctgggctctttgtgtgcatcatttctcaaacttaccacgacccacaagggtcacactattttacagataggggaatggagtctcagacgataagcaatccatagacccaagctatggtcctacagacccacacccacgctctttctgtcacactctttccacca

SEQ ID NO: 134636 - DNA, 601 bp, Human
gccacagtaatgtctcccaggcttcacaggctcatttcttccaggggctttgactgggttaggtgtggtggtaaaagctgggatttacatcccccaggctgctgcagatggatcacaagggattctaccagcaccaggaaacagtgtgtgagctttgttcacaggtgggtgagatgctacaccccggggccccgagtgatgaaacctggcagaatgcagagctgctcgtgtgagggcagctgcggtctgcagagcagggtgcacctgcttaagcccgtagcgtgtggtccacgaactggcyattcctgtgctaaagcaccaaaaacaaaacgaaaaacgaaattccaaaaacttttgttaactaggatccaagtaacgtgagtcctcagttgattgtttgggactgtaaggaggaaaaaatcataacccataagaacagtccctctgtgtctgcccctccagcttgcagccctcagaggccttggaaatcaccatgcgctctgctccctctctgcagatgactgagctgaagcccatgggggaatggggtttgcccaggaccacatttcctcctggcctctgggccagggactcagtaact

SEQ ID NO: 134637 - DNA, 601 bp, Human
ctgacccctggagaaagggttggtcaggtctaggtcactactacttagagagtaaagcaaatgcctgcctgtggctcaagcctttggccacagtaatgtctcccaggcttcacaggctcatttcttccaggggctttgactgggttaggtgtggtggtaaaagctgggatttacatcccccaggctgctgcagatggatcacaagggattctaccagcaccaggaaacagtgtgtgagctttgttcacaggtgggtgagatgctacaccccggggccccgagtgatgaaacctggcagaaygcagagctgctcgtgtgagggcagctgcggtctgcagagcagggtgcacctgcttaagcccgtagcgtgtggtccacgaactggccattcctgtgctaaagcaccaaaaacaaaacgaaaaacgaaattccaaaaacttttgttaactaggatccaagtaacgtgagtcctcagttgattgtttgggactgtaaggaggaaaaaatcataacccataagaacagtccctctgtgtctgcccctccagcttgcagccctcagaggccttggaaatcaccatgcgctctgctccctctctgc

SEQ ID NO: 134638 - DNA, 601 bp, Human
tatttatcatttgggttatttaatatctctaccccgaccttgcctcaatgagagcaagactcaaatagtgctcatcaccacagctacagtgcctagctctgggcctggcatatagtaagtgtccaataaatgtttgttcaaagaatgaaggaaacaggagagaaataaatgggtaaggggagcaaaggcatgaagggctttagatttagacacacctgggtcatctgttgccttctaagcatgtcacctttaacctctaagcttcagtttctacccctataaaaaggctatagcactaggrcttgtctcatattgggaagattacctgacacaatgtctataaagatattagcacagggcctggttcataggaagcactcaataaatgctagctgtcatcctcatccttatcctcatcatcataatcatcagcacattgaatctaactgtggctagttatatattcaggttacacctacttcaaaagaacttactggacacaccttctctttccattgtattagcttccttttgtcgtgtggaaggcaggctggtaagtgattcctatttgtaggtgaagacactgacccctggagaaagg

SEQ ID NO: 134639 - DNA, 601 bp, Human
acaccaagattgttccacctcgtgacctccgcactggccattcgctgcttggaaccttttcttctctctcttttcctgggtaacttcttctcatgctttaattcaactatctcttcctccaaatagctgtccctggacccagtttaaatgcactctttccccattacacacaaaacatgctgatctttccctttataatatcatcgtgatgagcagttatgtatttatcatttgggttatttaatatctctaccccgaccttgcctcaatgagagcaagactcaaatagtgctcatcaccwcagctacagtgcctagctctgggcctggcatatagtaagtgtccaataaatgtttgttcaaagaatgaaggaaacaggagagaaataaatgggtaaggggagcaaaggcatgaagggctttagatttagacacacctgggtcatctgttgccttctaagcatgtcacctttaacctctaagcttcagtttctacccctataaaaaggctatagcactagggcttgtctcatattgggaagattacctgacacaatgtctataaagatattagcacagggcctggttcataggaagcactc

SEQ ID NO: 134640 - DNA, 601 bp, Human
ctattgagcacttgaaatttggctatgcaactgaggagttgaattttaatataacttaagtaattaaactggccccgtgtggctagtggctactgtactggccaagctaatgctagactcactggccttctttggttctttctctaagacaccaagattgttccacctcgtgacctccgcactggccattcgctgcttggaaccttttcttctctctcttttcctgggtaacttcttctcatgctttaattcaactatctcttcctccaaatagctgtccctggacccagtttaaatgcamtctttccccattacacacaaaacatgctgatctttccctttataatatcatcgtgatgagcagttatgtatttatcatttgggttatttaatatctctaccccgaccttgcctcaatgagagcaagactcaaatagtgctcatcaccacagctacagtgcctagctctgggcctggcatatagtaagtgtccaataaatgtttgttcaaagaatgaaggaaacaggagagaaataaatgggtaaggggagcaaaggcatgaagggctttagatttagacacacctgggtcatctgttgcc

SEQ ID NO: 134641 - DNA, 601 bp, Human
gctgagactactgatgctgtgagtgttatacaagttattacgcctccactatcacagaattgaaccgctcagtagaatctgagcggttcaagatggcagccacctgtggctattgagcacttgaaatttggctatgcaactgaggagttgaattttaatataacttaagtaattaaactggccccgtgtggctagtggctactgtactggccaagctaatgctagactcactggccttctttggttctttctctaagacaccaagattgttccacctcgtgacctccgcactggccattcrctgcttggaaccttttcttctctctcttttcctgggtaacttcttctcatgctttaattcaactatctcttcctccaaatagctgtccctggacccagtttaaatgcactctttccccattacacacaaaacatgctgatctttccctttataatatcatcgtgatgagcagttatgtatttatcatttgggttatttaatatctctaccccgaccttgcctcaatgagagcaagactcaaatagtgctcatcaccacagctacagtgcctagctctgggcctggcatatagtaagtgtc

SEQ ID NO: 134642 - DNA, 601 bp, Human
agaaacttctccccatctcttccccatcgctgggtccaggccaccatcatcatcactcctctgggcaggagcatcctggctagactgctttctgacccagacaatagcagcccaagagatgttaaaatgtaaatgtgatctgatcactttcgtgcttatgacctttcagtggcttcccagcttgctcagaatgaaatcctaactctgctgcccacaaagtggtgagtgatctggccctatcctgctctcggcctcagctcccacccctccttctgctgatgctgctgagactactgatgcygtgagtgttatacaagttattacgcctccactatcacagaattgaaccgctcagtagaatctgagcggttcaagatggcagccacctgtggctattgagcacttgaaatttggctatgcaactgaggagttgaattttaatataacttaagtaattaaactggccccgtgtggctagtggctactgtactggccaagctaatgctagactcactggccttctttggttctttctctaagacaccaagattgttccacctcgtgacctccgcactggccattcgctgcttggaaccttttc

SEQ ID NO: 134643 - DNA, 601 bp, Human
tcacgtgtcctggactttctggaatgggctcattgtataaactaccaacctgtcgtcttcatacctccccttgtgcccatcaaactatccattagggtttctgtttggggaaagcatgatcatcagggttgggggagagccagagatggtcctcaggggtctcgggggaaggccatggtgtcctggccagggcattgaggctggaataaggcaaagcctctggggctggctctcaggtggacttaaacttcttaaccctgagttcagtctagttctaggctcccaaatggagcagacaggsaagagcccatggcaccaaccatcagcagagggcttgtctccatgagttcatgctccagagatgctagcccagagcccttgccccaccacttctatttctagaaacttctccccatctcttccccatcgctgggtccaggccaccatcatcatcactcctctgggcaggagcatcctggctagactgctttctgacccagacaatagcagcccaagagatgttaaaatgtaaatgtgatctgatcactttcgtgcttatgacctttcagtggcttcccagcttgctcagaatgaaatccta

SEQ ID NO: 134644 - DNA, 601 bp, Human
gcgtgcatgtgtgagtgtgcatagcacacaatgtaaaaagcacaggctttgaggaaatgtgttggaatctcacccctgcacttacttgcaagttattacacctccagtttcctcagatgcaaatggagataataacactccctaatggagctagaacaaggattaaatgtgataatgtaagcagaacacttggcacagtgttatgcttagtacatagtaagtgcttaataaatggtaaagacagctatattcattttcgttgaagacccaatgggaacattgctgaaagccccaggatgcyactttccttattggccaggtcttggtctttggatgggacatcagcactgaaaggcagcctctcatttttgggtcagggaatatctgagatcaggaaacatcacctgagccataggcaccatgatcacgtgtcctggactttctggaatgggctcattgtataaactaccaacctgtcgtcttcatacctccccttgtgcccatcaaactatccattagggtttctgtttggggaaagcatgatcatcagggttgggggagagccagagatggtcctcaggggtctcgggggaaggccatg

SEQ ID NO: 134645 - DNA, 601 bp, Human
tgcgtgcatgtgtgagtgtgcatagcacacaatgtaaaaagcacaggctttgaggaaatgtgttggaatctcacccctgcacttacttgcaagttattacacctccagtttcctcagatgcaaatggagataataacactccctaatggagctagaacaaggattaaatgtgataatgtaagcagaacacttggcacagtgttatgcttagtacatagtaagtgcttaataaatggtaaagacagctatattcattttcgttgaagacccaatgggaacattgctgaaagccccaggatgmcactttccttattggccaggtcttggtctttggatgggacatcagcactgaaaggcagcctctcatttttgggtcagggaatatctgagatcaggaaacatcacctgagccataggcaccatgatcacgtgtcctggactttctggaatgggctcattgtataaactaccaacctgtcgtcttcatacctccccttgtgcccatcaaactatccattagggtttctgtttggggaaagcatgatcatcagggttgggggagagccagagatggtcctcaggggtctcgggggaaggccat

SEQ ID NO: 134646 - DNA, 601 bp, Human
agcctggacacttttaaaatgtggccaaaggatgtatcctcaattgtttattgcaagcactccagaagctggggtgggggcctgagttgcagggtttccgaaacaagtttatcgtatccccatgacactagcagtccagccatggagcccacaccccatgccaggctggtgcagagaagctctgaggctcaggagcagggaggtgcctggcagtgaacccaggactgtaggcttggttcctgggcccagaacaccctctactggcatttctgcagtggaggtgggtggggagtgggacagrtggagagaagagaccaagcagaaagggaatgggttgtttcactttggccagctctgacagttttgtagcttgtgtgtctgggcaccttcagtgggcactaagttgaaaatcatcctgttgtttgaattattgtcaagctgggcccagaacttgaggagtttccaggccttggatctcaacttagtgggcagcagagtgaatagaagggcatgggaacatgtgtgcctatgtgaatatgtgtgtgtgtgcgtgcatgtgtgagtgtgcatagcacacaatgtaaaaagcacaggctttgag

SEQ ID NO: 134647 - DNA, 601 bp, Human
tcccatgttttggatgaaggggatctggcttggtaggaggaacacagtacagatcagcatgagaggggtttatgaggctgatgggaatttcttccgtgggtcttgctgagataaccctgttctgtctgttcctagttctgcagtgatggctttgaaggtactcattggttgactagtcaaggccttgcttggctggtggtggcaggggcagggggccaaagtcattactgcaatgttaatactgaggcaggttcccaaatcaacctccaccagcgctgggtggtggatctgtagcaccacygtgaacccactatatttctctgtaaatgccagttgtgtttcagggtgcagctctcccttgctcacaacttttgtcatcttgactatgtccctgcagctggtgggggatgaggggagacatggcccaggctctctgcagtctgtgggatttggagaggcttggttggccttgagcctggacacttttaaaatgtggccaaaggatgtatcctcaattgtttattgcaagcactccagaagctggggtgggggcctgagttgcagggtttccgaaacaagtttatcgtatccccatgacact

SEQ ID NO: 134648 - DNA, 601 bp, Human
agaagcaaagagactagagcttatgaagggtagaaagcaagacgttaactccgtgctgatttaactaataactcaggctgtgagtcacaacctgagacaccaggacaagcattgccagagtagtatatgagtttttaaaatggtggcaccagatctgcccctccagctcacactcgtctccaccgcttctcttagccccctgcttgctttgccccagccaccctggcttcaggctctccggaaacgtgcaggcacattccacatcagggacttcgcagttgctcttccacttgtcctgcaygttgttcccttggatacttgtggtgcacgccctcatctcaatcctgtttcaaaatcaccttccagtgaggtctcctctgaccactcaagttgggtctgcacatcctccccactgctccgcattttacatagaatattcgagcatattctatggtgtatttattcatgaagttcactgtctgtctgtgcacacgagggggcagggatttgtgtttcccaacataaccctgcagcacctagcacactgccgggcatatagtaggtgctcagtatcatcgagcagccactgtgctatgctata

SEQ ID NO: 134649 - DNA, 601 bp, Human
gacacaagtagaagcaaagagactagagcttatgaagggtagaaagcaagacgttaactccgtgctgatttaactaataactcaggctgtgagtcacaacctgagacaccaggacaagcattgccagagtagtatatgagtttttaaaatggtggcaccagatctgcccctccagctcacactcgtctccaccgcttctcttagccccctgcttgctttgccccagccaccctggcttcaggctctccggaaacgtgcaggcacattccacatcagggacttcgcagttgctcttccactygtcctgcacgttgttcccttggatacttgtggtgcacgccctcatctcaatcctgtttcaaaatcaccttccagtgaggtctcctctgaccactcaagttgggtctgcacatcctccccactgctccgcattttacatagaatattcgagcatattctatggtgtatttattcatgaagttcactgtctgtctgtgcacacgagggggcagggatttgtgtttcccaacataaccctgcagcacctagcacactgccgggcatatagtaggtgctcagtatcatcgagcagccactgtgc

SEQ ID NO: 134650 - DNA, 601 bp, Human
accattctcagctcaaaacgtgtttttctttgtgtgtgtgggcgtgtgagatggcctggattcagagtgatccctggggaatgctgccaagaatgctaaggacagcgtgtcaatttacaaaccataatcctacctgtaactaagaaccaaagttttgtctcatgacctttccattatcaagtaaaaaacctgcaaaaacagtgtaattttctacagccagccattgtatataactcttcttgaaggctcatagtattttatgctattaacttacctcagggctctgctcaacttttcataygtcattctgtcatttttcttcctttgtccccacatctttgccagggcttccgatttaaccacccgaaaaattccttgttccctatcttcccattccagaatgccacagttttcttcaggagatagaagcaggtctcgtacaaattcccatagatgagaactttggaggccttttgaaaaggggaaaacattaactatttaccattgttttttaaattaattaattaattaattaatttttttgagacagagtcttgctctgtcgcccaggctggagagcaatggtgcgatctcggctcac

SEQ ID NO: 134651 - DNA, 601 bp, Human
atgagcttgatgcctggagcagatcatagcttgtcttcctgccacccgtgtgcattttttccaaatttgtacactaaccttcggtcaacccgctccaaaattcctgttttatagtagtatctgaaaaagcaagcagaagagaaattctgggagagcttgcaccctaggaaaacaacagaacacaaacactgtctcctcattcctctcaggtgacaaggctggtctttggttaccctggtattttcatgccctgttatcaacttacacttaaacctttcccagacatcttgaagactgaacytcaccattctcagctcaaaacgtgtttttctttgtgtgtgtgggcgtgtgagatggcctggattcagagtgatccctggggaatgctgccaagaatgctaaggacagcgtgtcaatttacaaaccataatcctacctgtaactaagaaccaaagttttgtctcatgacctttccattatcaagtaaaaaacctgcaaaaacagtgtaattttctacagccagccattgtatataactcttcttgaaggctcatagtattttatgctattaacttacctcagggctctgctcaacttttca

SEQ ID NO: 134652 - DNA, 601 bp, Human
cctctttctccggttggggtccgccgacttggcctaatgcatgctgtgaagggctttcttggcagctgagagaactcgactctgccctaggccccctggtttgtatggctttgtgaccttgccttggaatttgggttatttgtgaggcgcagagagggttcccaaactctcctccctcagccccctttccaatcaaggctcaggtttctttagggttgtcaaacgtctcggacgagaaaaagctgcccaaggttgccgagattgaaaagccactgttgggagttcttacttattctctagrcctctctctgttaggaggtgttttcattgaggccagtcgagttttaccccacgccatgactcgtggaagacttaaatttgtaaattcctacggcatcacgatagacaaaggtccaggagaatgtttcaagcaaatattcgcttgaaagagcaaacatttaggagataaatcataccaaaaatttattatagaaaattgttgtttagtaatgatattgatgcagttaacacaattcttgcagtatttaacagtatgcaaaatggcaggccgggtattatttttccttattttgggagaagg

SEQ ID NO: 134653 - DNA, 601 bp, Human
gccccctttccaatcaaggctcaggtttctttagggttgtcaaacgtctcggacgagaaaaagctgcccaaggttgccgagattgaaaagccactgttgggagttcttacttattctctaggcctctctctgttaggaggtgttttcattgaggccagtcgagttttaccccacgccatgactcgtggaagacttaaatttgtaaattcctacggcatcacgatagacaaaggtccaggagaatgtttcaagcaaatattcgcttgaaagagcaaacatttaggagataaatcataccaaraatttattatagaaaattgttgtttagtaatgatattgatgcagttaacacaattcttgcagtatttaacagtatgcaaaatggcaggccgggtattatttttccttattttgggagaaggttggagggaggcggggatggagaataggactgacgttttttagtgtgacgtattacctgccaatcatcgttcctggcactctacagaatgaattttaatttaaataggtctagtagacgttgccttcatattctgagctaccttaggctcagaaaaaaaaaatcacacaaagtcatatg

SEQ ID NO: 134654 - DNA, 601 bp, Human
ctgagctaccttaggctcagaaaaaaaaaatcacacaaagtcatatggtaagatgagtgtattggggttcctaaaggttccttaatgggaacaatttatttcatttttggtgtaatgtttcataacatattccttggagcagaggtgctttaacagtgtgtgcagaattccttctcttccctcctccaagtttgttgaaattaaacttttttccagctcctagagattcggtctggtctggtgtggggctcaggaatctgcattttacaaatgttggatgagttttgatgttttattttgrcatttaatggaatgagctttgagactcactgccttagaaaatcatggaatattaaaagtttagtattggatataatctaggaagagtgctcttaatcttgtttatcaagcagatccttttgagaatctttgaaaatgttacagactctctgtacagaggaagtaccataaatggtcacacacaaaaatgtgcacgtagtggctcacgcctgtaatcccagcactttgggaggcgaagctggaagattgctagagcccaggagttggagaccagcccgggcaacaaagtgagacccccgtc

SEQ ID NO: 134655 - DNA, 601 bp, Human
ctgtcaggaagaaggcatggcatctcaaggaaagccaaattagttttctagtgctgctgcaacaaattaccagaaattagtggcttaaaacaacacaaattcacatctcatagttctagaggtccgaagtccaaaatggatctaactaggctaaaatcaagctattggtaggagctgcattcttttctggaggctcgagaccccattcccttaagttttccagattctagaggtttctaagattctttgactcatgggcttcaaagtcagcaatggctggttcagtctttatcacattacrtcactcttaatactcccctctgccttctgccacttacaaggacccttgtgattacattgggctcatctggatgatcctgaatattttccccatctcaaggttgagtagaaaccttaattccatctttaaccttaattccctcttgccatgtaacagcatattcataggttctgggtattaggacgtgaaccttttgaggcatggcattctgcatgtgaagctgtggaaagtatttggaaatactaagtatttggaagtgttggacttttttcctaataccgagccaaaatatatccgctt

SEQ ID NO: 134656 - DNA, 601 bp, Human
tccgaagtccaaaatggatctaactaggctaaaatcaagctattggtaggagctgcattcttttctggaggctcgagaccccattcccttaagttttccagattctagaggtttctaagattctttgactcatgggcttcaaagtcagcaatggctggttcagtctttatcacattacgtcactcttaatactcccctctgccttctgccacttacaaggacccttgtgattacattgggctcatctggatgatcctgaatattttccccatctcaaggttgagtagaaaccttaattccrtctttaaccttaattccctcttgccatgtaacagcatattcataggttctgggtattaggacgtgaaccttttgaggcatggcattctgcatgtgaagctgtggaaagtatttggaaatactaagtatttggaagtgttggacttttttcctaataccgagccaaaatatatccgcttctgactttcacctacatacagatttttgttttgccatgccgaaaacacgtggcaatccttgaactatttgttttacaaactgtgaatttacggtggtgttttttctctgagcttggtagaaa

SEQ ID NO: 134657 - DNA, 601 bp, Human
ggaaatactaagtatttggaagtgttggacttttttcctaataccgagccaaaatatatccgcttctgactttcacctacatacagatttttgttttgccatgccgaaaacacgtggcaatccttgaactatttgttttacaaactgtgaatttacggtggtgttttttctctgagcttggtagaaactgtagttttataaaactaaacaactatttggattactgtaaactatataaattaagtacatttattgaactgtttcgtctttcacacaaatatctttaaaaatttgtcagtcrgaactacctttggagttttaatttccttaagaggtgctggcagcatttttatgagctatgacatatgccattttcttagcactttctagaatttctcattcacttctcacataacctagtaaagttggcatcatctgcatttagttggacaaaaacaccaaggcttagagaaattgagtctcctaaagacatgtaactgtgttgatgaactgaagtgcatgtatatatttatatacatatattaatttgtttaacaaatctttaatttgtatcattctctcaacagatttattgagaatg

SEQ ID NO: 134658 - DNA, 601 bp, Human
ccgagccaaaatatatccgcttctgactttcacctacatacagatttttgttttgccatgccgaaaacacgtggcaatccttgaactatttgttttacaaactgtgaatttacggtggtgttttttctctgagcttggtagaaactgtagttttataaaactaaacaactatttggattactgtaaactatataaattaagtacatttattgaactgtttcgtctttcacacaaatatctttaaaaatttgtcagtcggaactacctttggagttttaatttccttaagaggtgctggcakcatttttatgagctatgacatatgccattttcttagcactttctagaatttctcattcacttctcacataacctagtaaagttggcatcatctgcatttagttggacaaaaacaccaaggcttagagaaattgagtctcctaaagacatgtaactgtgttgatgaactgaagtgcatgtatatatttatatacatatattaatttgtttaacaaatctttaatttgtatcattctctcaacagatttattgagaatgcagagactatcttttttaccacttacattattgaagaatgagt

SEQ ID NO: 134659 - DNA, 601 bp, Human
aaaacacgtggcaatccttgaactatttgttttacaaactgtgaatttacggtggtgttttttctctgagcttggtagaaactgtagttttataaaactaaacaactatttggattactgtaaactatataaattaagtacatttattgaactgtttcgtctttcacacaaatatctttaaaaatttgtcagtcggaactacctttggagttttaatttccttaagaggtgctggcagcatttttatgagctatgacatatgccattttcttagcactttctagaatttctcattcacttytcacataacctagtaaagttggcatcatctgcatttagttggacaaaaacaccaaggcttagagaaattgagtctcctaaagacatgtaactgtgttgatgaactgaagtgcatgtatatatttatatacatatattaatttgtttaacaaatctttaatttgtatcattctctcaacagatttattgagaatgcagagactatcttttttaccacttacattattgaagaatgagtgaagaaattagcatctattaggtgccaggcacatggtaccctgcttgggaagtagtggccagc

SEQ ID NO: 134660 - DNA, 601 bp, Human
gaagtgcatgtatatatttatatacatatattaatttgtttaacaaatctttaatttgtatcattctctcaacagatttattgagaatgcagagactatcttttttaccacttacattattgaagaatgagtgaagaaattagcatctattaggtgccaggcacatggtaccctgcttgggaagtagtggccagctgaatcaaacagattctcagtatttgccacatggcacatttaatcatacttagctcctggacatgcaatccaaaattctatatagggctgatccttaaggtatttrtagtctctttggggacataaacaataaaggtatgatttcaatagtgtatacagtaagctcagagggggtaagtttgaaatgatcaggaaataatatataaggcagcttcttagaggaagaggtgacagcccttacaggctgaaggaacagcagaaacaaagacccagagaccagagtgatcattatataattgacacagcatctgtaaacagtttttcaacctactctagacagttaacttcagagagtttaaattgtggtcctttcagagtaggtagcatgatttggaatataattggt

SEQ ID NO: 134661 - DNA, 601 bp, Human
cagtaagctcagagggggtaagtttgaaatgatcaggaaataatatataaggcagcttcttagaggaagaggtgacagcccttacaggctgaaggaacagcagaaacaaagacccagagaccagagtgatcattatataattgacacagcatctgtaaacagtttttcaacctactctagacagttaacttcagagagtttaaattgtggtcctttcagagtaggtagcatgatttggaatataattggtaagatgttaattaatagtattggttttaagttgtctctgaagaataacatrttgaatttaaaataacctgtgaatagaaaagtaactgaggttcaatcttggtggcgatttgcctagtatataattataggcaatacatattatagatgttcaataaacatatctaaggaagctagtaatctaggaagttataaaagaacactagagcctacagtaggattccaagttggcagccagggaactgacccacattgttttagcagaaaaacttatggcaaaattttaaaatcaggagactttacagagaaatctagatttttgttctctctttaaaattgatagttaaatcct

SEQ ID NO: 134662 - DNA, 601 bp, Human
atcaggaaataatatataaggcagcttcttagaggaagaggtgacagcccttacaggctgaaggaacagcagaaacaaagacccagagaccagagtgatcattatataattgacacagcatctgtaaacagtttttcaacctactctagacagttaacttcagagagtttaaattgtggtcctttcagagtaggtagcatgatttggaatataattggtaagatgttaattaatagtattggttttaagttgtctctgaagaataacatgttgaatttaaaataacctgtgaatagaaaartaactgaggttcaatcttggtggcgatttgcctagtatataattataggcaatacatattatagatgttcaataaacatatctaaggaagctagtaatctaggaagttataaaagaacactagagcctacagtaggattccaagttggcagccagggaactgacccacattgttttagcagaaaaacttatggcaaaattttaaaatcaggagactttacagagaaatctagatttttgttctctctttaaaattgatagttaaatcctatgtggtgacaattatctaacactgagtaat

SEQ ID NO: 134663 - DNA, 601 bp, Human
tatgccgcctactctgtattacatcttagcaaggctgaatgtcccttggtatttgcatcacctctagttgtcatttttttttcttgtactcttatctctacggaaggcagaagacaaaagaccaagaaaaatgggagaaagcagatattgtgtatatgtgtaaaggaggaaaatgcttatccatttaatatgaaaataaaggatgtcagaatctaaagaaaaaacctgaagatgctagtcctcttctctcacctgcctgttttttgtaggcatctgagtttttgacagcagtgctataacmaggagagagggaacttctttgatagagttaatggtatggtatttctgccaaaacacggatactcttttaggcctggttcttattaagtgcttatacactgataagattgatattctcctttgaattctcatttaactgtggaaacagaaacatgtagaatagctctagtaaaagtaggatttattaaaaggatagaacatcacttataaaatgctgcagggccatggggaaaccataattattccatctatttcttctagggctcatattatttgtcttctttctcttatttactttgtt

SEQ ID NO: 134664 - DNA, 601 bp, Human
gtaggatttattaaaaggatagaacatcacttataaaatgctgcagggccatggggaaaccataattattccatctatttcttctagggctcatattatttgtcttctttctcttatttactttgttttcctgtacagacttgcaattatcaatctgtttactcctggcttttctttctcagtgtcagcttgccttgcctcagtggtgattcaggcctttatgcacgatgcgctgtcagttttgtttaagtgctcaccatcatttctgtaatctcctttcaaattccttgaatagagaaactgacccaaagtagaccagttgtgctacagggcatgcaaggctgattctttcgaaggctacgatttggacattttctttaagaaagtagttgagaatcaatgattgacatttctgttgctatgaccatctgactaaaataggccagtaatgcagtattttattttattttatttattttaattgtttctgcgctaagtaatgaccaagcaaagtgtatcatctaagcaaagcacttgtaggctactcagctgagatgtttgcccatccaaagaaaataggacaggggtaaatgagatctta

SEQ ID NO: 134665 - DNA, 601 bp, Human
tttcagcagaacagtgtcagcatgctgacgttttaaagttcaccgtgtgtacatcctaaatgaacatttttgctttttttaaaaaaatgaaatcagacatagtaataaccgcattgtagactagcatttctgtgacagcctatcattttagaacaattaaggacaccaaaattcttgactacgtgtaagggtggcaggactatttaagagagttagagtatatattgacttctcctatctgtaaatttctaaggtgatgtactcttaaatataccttcttgttgttgtcttgagcttaatytgccttttacgacaaaatgtgtaaattcccaaagtatcgttgtgtgtgtgtgtgtgtgtgtgtgtgtgtgtgtgtatgtattcttttgctaggctgtaaatggaatggtaatttcttttggctcttctcccaagatggcaaagtaaagtgaacttcatgtagaattttaattttatagtttaataccaagaaggacagtattccaagctgaaatctcttctaaaatgtttggtttatttcattcaaaggaaatgcattctacaccatatgctatctaaaaattctggctaacctcttttc

SEQ ID NO: 134666 - DNA, 601 bp, Human
gtgtgtacatcctaaatgaacatttttgctttttttaaaaaaatgaaatcagacatagtaataaccgcattgtagactagcatttctgtgacagcctatcattttagaacaattaaggacaccaaaattcttgactacgtgtaagggtggcaggactatttaagagagttagagtatatattgacttctcctatctgtaaatttctaaggtgatgtactcttaaatataccttcttgttgttgtcttgagcttaatttgccttttacgacaaaatgtgtaaattcccaaagtatcgttgtgtgtgtgtgtgtgtgtgtgtgtgtgtgtgtgtatgtattcttttgctaggctgtaaatggaatggtaatttcttttggctcttctcccaagatggcaaagtaaagtgaacttcatgtagaattttaattttatagtttaataccaagaaggacagtattccaagctgaaatctcttctaaaatgtttggtttatttcattcaaaggaaatgcattctacaccatatgctatctaaaaattctggctaacctcttttctaatgtgccattggatactaagtagaagtataataatatagaat

SEQ ID NO: 134667 - DNA, 601 bp, Human
caattaaggacaccaaaattcttgactacgtgtaagggtggcaggactatttaagagagttagagtatatattgacttctcctatctgtaaatttctaaggtgatgtactcttaaatataccttcttgttgttgtcttgagcttaatttgccttttacgacaaaatgtgtaaattcccaaagtatcgttgtgtgtgtgtgtgtgtgtgtgtgtgtgtgtgtgtatgtattcttttgctaggctgtaaatggaatggtaatttcttttggctcttctcccaagatggcaaagtaaagtgaamttcatgtagaattttaattttatagtttaataccaagaaggacagtattccaagctgaaatctcttctaaaatgtttggtttatttcattcaaaggaaatgcattctacaccatatgctatctaaaaattctggctaacctcttttctaatgtgccattggatactaagtagaagtataataatatagaatcagcagattctatgaacaagatggggtatatgggtgattcatttttttggtaggcagtacatttactatagctagtgatctgcttgatatctttctgttactgtataaa

SEQ ID NO: 134668 - DNA, 601 bp, Human
aggactatttaagagagttagagtatatattgacttctcctatctgtaaatttctaaggtgatgtactcttaaatataccttcttgttgttgtcttgagcttaatttgccttttacgacaaaatgtgtaaattcccaaagtatcgttgtgtgtgtgtgtgtgtgtgtgtgtgtgtgtgtgtatgtattcttttgctaggctgtaaatggaatggtaatttcttttggctcttctcccaagatggcaaagtaaagtgaacttcatgtagaattttaattttatagtttaataccaagaaggmcagtattccaagctgaaatctcttctaaaatgtttggtttatttcattcaaaggaaatgcattctacaccatatgctatctaaaaattctggctaacctcttttctaatgtgccattggatactaagtagaagtataataatatagaatcagcagattctatgaacaagatggggtatatgggtgattcatttttttggtaggcagtacatttactatagctagtgatctgcttgatatctttctgttactgtataaatcaaggactttattatatgaaacattcctagggaaaaattag

SEQ ID NO: 134669 - DNA, 601 bp, Human
atgtattcttttgctaggctgtaaatggaatggtaatttcttttggctcttctcccaagatggcaaagtaaagtgaacttcatgtagaattttaattttatagtttaataccaagaaggacagtattccaagctgaaatctcttctaaaatgtttggtttatttcattcaaaggaaatgcattctacaccatatgctatctaaaaattctggctaacctcttttctaatgtgccattggatactaagtagaagtataataatatagaatcagcagattctatgaacaagatggggtatatgggtgattcatttttttggtaggcagtacatttactatagctagtgatctgcttgatatctttctgttactgtataaatcaaggactttattatatgaaacattcctagggaaaaattaggatcagcaaatgtataattcaggagagatttcttgggaatatattagccctggtttttggaggggaacaaatctgttaaactataaaagctataccactaacttcttcaggaaagtgcatacatacacaattttatatataattctgagtccagaggactcagatctccctgtaatttgtc

SEQ ID NO: 134670 - DNA, 601 bp, Human
aacctctgcctcccggtttcaggcctcccaagtagctgggactataggcatgtgccaccaagcctaatttttgtatttttagtaaagacgggctttcaccatgttgtccaggctggtcttgaacttctgacctaatgtgatccacccgcctcagcctcccaaagtgctgggattacaggcatgagccactgctcccggcctaccttatttctttacaaaaatctatttatggcaccattttagagaagaggaaacagacatagatagaataaataacttgtaggtggtggatctgaaattwgagcctaggcagtttgattccagtacctattctctaaatcactgtggtattctgcttctccttgagtttttttaaattaaatatttaaataataaaatatttcatttagcacaatagtacatgcatatagtttaaatagtactgaaaggcttgtaacagtacagtggatctctgccccatctcacccaactttcccagtcttccttagaagtaactagttttgtctcttaactttcttctggcatttgcccatctctctgtttctattttagccgttttctgtggatgactgccggtcag

SEQ ID NO: 134671 - DNA, 601 bp, Human
tttttactccagtaccacaccaaaataactatttgaacaaagaagacttatatgacaaacgatcctttaaaacaaaaaatactataactgcctttattccaagtgttaatattactctgtgcctagtgctgatttttaaattacttttactttattctgccttatttcatccagcctgcagatggcagaattgtttcatttgaacagcaattttgaaggctccgttttatttagtgtgttctgacattggaatgagaagtgattaaatgaacagtctctctccctattagagaagaagcamattaatgttagagacagggagccacactaagaaagtactggataatttactttttcatttggtctatcttcatttcatgatttttgcatgcttggattataaatgaactagagcctataaatgaactagagcatgatgtttaagctgtaccatatgtaaactgctgaattcccttaattactttagtcagagtaatggagcttaaatctgcttcatattaaccataaagcagtttgttctgcatttgtattttaagagtttgcttgtattaaattttttttttaatctagagacctttta

SEQ ID NO: 134672 - DNA, 601 bp, Human
tctctctccctattagagaagaagcaaattaatgttagagacagggagccacactaagaaagtactggataatttactttttcatttggtctatcttcatttcatgatttttgcatgcttggattataaatgaactagagcctataaatgaactagagcatgatgtttaagctgtaccatatgtaaactgctgaattcccttaattactttagtcagagtaatggagcttaaatctgcttcatattaaccataaagcagtttgttctgcatttgtattttaagagtttgcttgtattaaattttttttttaatctagagaccttttagcattcatgaatcaatcatcaatttaaagctttgatataattgagtttgctgaagtatgagcattttgttcttaggataaaagaaatactttagggaagaagaaactagaattagattagtgtaccatatttgaaattgaagtcagaattatgctgtagaaaaattggaagagcccatttgaggaaatacaggaattgcttagagggattactgtaaaattcagtgattggtaaattgctcatgtagcagaaatggcagggaaaacagcaataa

SEQ ID NO: 134673 - DNA, 601 bp, Human
ttgaaaaacttgtgtaatgagtgcagcaaactacttacctgtagttgtgggaaactaatactaggaaacgtaattggtgcatatcttaaggccttcttaatttgacaagagaatggtagaatgtacagcttactggaataaggagggagtctgcatataagttcaaatgcaaattaattaatattaggtaaaggataaaattccattccaaggagtctagaaaagtctacactatcttagtagagttgacagcagccataaagggcagatattaattatgtgcaggcctgtcacttcaagyttatcttacgattgtgtaattactttcccatcagaaaaatacgtctggaaaagataccatatagtgttctaatcaaaagagggtatgctagaatgaaatatgtacttttattaacacattaatgcttatgaaatgatttttctagcatgaaagcctgaggatagattagttagaataactacaaaatatattgcacatttaactctccgtaataagcgagtgtaatctatcaagagatagtattgaataatggagatgtccaaaatatctttctttggtttttgtcaccttcatttcaga

SEQ ID NO: 134674 - DNA, 601 bp, Human
gaaagataataataaatgcagaggtttcataatatagtccttaatgtcaagagtaatggaaatgtgaaggtctcttaggtgagagattatagcaggagatagaatcataaaataaatgtgaattgtgtcgtgacaactggaaccaaagcatacaaatattggagagagactttaagagaattaagttagtatttgtcgtaaattggaatctggctatagaagcattgaggtccatttagttgcttctttgaaatggaactctttgatatataaatgtaatatgtatatatttatgaaataytctgttcataatgcctggcttgaactttttgatagaaagaacacattgggacttttttttttttaagcctttgttttcgaaaagaggctggcctcttaccgtggtgctatttaaaagataagagtttttttttgcccacccccctccttttttttttttttccccagaacaagtgagtttgttattctgagcttaacaaaataaatgctgaggctcaggctgacagtacattctttaagcaactgtttttgattttttcatcaagccatgtaaaaaagaaaaaggcagtagacacaccac

SEQ ID NO: 134675 - DNA, 601 bp, Human
tgatagaaagaacacattgggacttttttttttttaagcctttgttttcgaaaagaggctggcctcttaccgtggtgctatttaaaagataagagtttttttttgcccacccccctccttttttttttttttccccagaacaagtgagtttgttattctgagcttaacaaaataaatgctgaggctcaggctgacagtacattctttaagcaactgtttttgattttttcatcaagccatgtaaaaaagaaaaaggcagtagacacaccacatagtgtagaggattagaaagctcattctsttatctccaaatgcattcagtgtgttaagctttatgcacgttttaagaattcttgcaattaagtgtaggattgttatggtttggatttggagatgcatcactaatgttataagttttcctgtgtgtaagagagtatgtgtgtatgtgtgttttccaagtgcacttccctaattttagttcactcaagaatttagttctccagcattttatagacaaaacattatggttgtatttagtagtttgcattattttttacctatttaatattttaatcacaaggacttattttactaagtaaaa

SEQ ID NO: 134676 - DNA, 601 bp, Human
caaaacattatggttgtatttagtagtttgcattattttttacctatttaatattttaatcacaaggacttattttactaagtaaaaaatgcaaagattttgaaagctatcttctagttataatttagcatttcaactagaggtagcttgggaattcagtgaaactgtttcagctacagttattgagagtcatggtggactggagttggatggctttgttcttcagtgtcttccaaaataacggtgtttcgtaattaggagttaggaaactcattgtggctatttttcctcctgtttttcatatataatgcacttagagataacctgttctcttatgcatttgaaatattcattgtcagtagtaaaagtggtatttttgttttgtttttctcaggcagagtcttggtctgttgcccatgctggagtgcagtgatcttggctcactgcaaccatctcctcccagattcgagtgattctcatgcctcagccccccaaatagctgggattacaggcgtgtgccatcacgcctggctaatttttaaattttaatagagtggggtttcgccatgttggccaggctggtctcaaactcctggcctca

SEQ ID NO: 134677 - DNA, 601 bp, Human
tggctttgttcttcagtgtcttccaaaataacggtgtttcgtaattaggagttaggaaactcattgtggctatttttcctcctgtttttcatatataatgcacttagagataacctgttctcttatgcatttgaaatattcattgtcagtagtaaaagtggtatttttgttttgtttttctcaggcagagtcttggtctgttgcccatgctggagtgcagtgatcttggctcactgcaaccatctcctcccagattcgagtgattctcatgcctcagccccccaaatagctgggattacasgcgtgtgccatcacgcctggctaatttttaaattttaatagagtggggtttcgccatgttggccaggctggtctcaaactcctggcctcaaatctgcccacctcggcaaaagtggtgttttaatacaagaattctgcatgttcaaggtggggaaaaggcttataaggatatttgattagacatatgaagaatgctcacatggatctgatatgtctggtttgctatatttggatttctgagtgaatataagctatcaataaccattaattaattgatgatccatatttgtaaggaacattg

SEQ ID NO: 134678 - DNA, 601 bp, Human
acggtgtttcgtaattaggagttaggaaactcattgtggctatttttcctcctgtttttcatatataatgcacttagagataacctgttctcttatgcatttgaaatattcattgtcagtagtaaaagtggtatttttgttttgtttttctcaggcagagtcttggtctgttgcccatgctggagtgcagtgatcttggctcactgcaaccatctcctcccagattcgagtgattctcatgcctcagccccccaaatagctgggattacaggcgtgtgccatcacgcctggctaatttttraattttaatagagtggggtttcgccatgttggccaggctggtctcaaactcctggcctcaaatctgcccacctcggcaaaagtggtgttttaatacaagaattctgcatgttcaaggtggggaaaaggcttataaggatatttgattagacatatgaagaatgctcacatggatctgatatgtctggtttgctatatttggatttctgagtgaatataagctatcaataaccattaattaattgatgatccatatttgtaaggaacattgagatgtaaagttagcacagctttgagagtt

SEQ ID NO: 134679 - DNA, 601 bp, Human
aagcgcctttatcacgaagccataggaaatctccatttgaaaatgcagtacaagttattcagcttcccaagagaaatatttattctcatttaacattagtgctcaatttccttgcttttaaccctaaaacatcaggggagacaaaagaagccctgttcttccacatttgaaatatgttagctatgctacagtgttttgcttgtttgggtctggaaagttgagtaatctgaagagagaatagggtctatggaaagctataggggatggacgtatttgttaccatggtattttattagtaaaytgtaatctaaaagccatggtgctcttgaatgtaaccctggacggtggattgggaagtgcagccggacaaatacatagtgtttgctttttcgatacctaaggaaaatgtagttatgtttcattgggagatcattctggtttgaggtctacttctctggatccccagttgaattgtggtatgcaacaaaatgtgaggttaatttaaccatttaaattctgatcatccttgacaaggcaaacgtttcctttcatacttattagtaggaacctttgaatcttgaatactataatattagatgaa

SEQ ID NO: 134680 - DNA, 601 bp, Human
tctccatttgaaaatgcagtacaagttattcagcttcccaagagaaatatttattctcatttaacattagtgctcaatttccttgcttttaaccctaaaacatcaggggagacaaaagaagccctgttcttccacatttgaaatatgttagctatgctacagtgttttgcttgtttgggtctggaaagttgagtaatctgaagagagaatagggtctatggaaagctataggggatggacgtatttgttaccatggtattttattagtaaattgtaatctaaaagccatggtgctcttgartgtaaccctggacggtggattgggaagtgcagccggacaaatacatagtgtttgctttttcgatacctaaggaaaatgtagttatgtttcattgggagatcattctggtttgaggtctacttctctggatccccagttgaattgtggtatgcaacaaaatgtgaggttaatttaaccatttaaattctgatcatccttgacaaggcaaacgtttcctttcatacttattagtaggaacctttgaatcttgaatactataatattagatgaaaataaaaacagccagtttcttaaagtctg

SEQ ID NO: 134681 - DNA, 601 bp, Human
tccatttgaaaatgcagtacaagttattcagcttcccaagagaaatatttattctcatttaacattagtgctcaatttccttgcttttaaccctaaaacatcaggggagacaaaagaagccctgttcttccacatttgaaatatgttagctatgctacagtgttttgcttgtttgggtctggaaagttgagtaatctgaagagagaatagggtctatggaaagctataggggatggacgtatttgttaccatggtattttattagtaaattgtaatctaaaagccatggtgctcttgaatrtaaccctggacggtggattgggaagtgcagccggacaaatacatagtgtttgctttttcgatacctaaggaaaatgtagttatgtttcattgggagatcattctggtttgaggtctacttctctggatccccagttgaattgtggtatgcaacaaaatgtgaggttaatttaaccatttaaattctgatcatccttgacaaggcaaacgtttcctttcatacttattagtaggaacctttgaatcttgaatactataatattagatgaaaataaaaacagccagtttcttaaagtctgat

SEQ ID NO: 134682 - DNA, 601 bp, Human
tctcatttaacattagtgctcaatttccttgcttttaaccctaaaacatcaggggagacaaaagaagccctgttcttccacatttgaaatatgttagctatgctacagtgttttgcttgtttgggtctggaaagttgagtaatctgaagagagaatagggtctatggaaagctataggggatggacgtatttgttaccatggtattttattagtaaattgtaatctaaaagccatggtgctcttgaatgtaaccctggacggtggattgggaagtgcagccggacaaatacatagtgtttsctttttcgatacctaaggaaaatgtagttatgtttcattgggagatcattctggtttgaggtctacttctctggatccccagttgaattgtggtatgcaacaaaatgtgaggttaatttaaccatttaaattctgatcatccttgacaaggcaaacgtttcctttcatacttattagtaggaacctttgaatcttgaatactataatattagatgaaaataaaaacagccagtttcttaaagtctgatcttgattattctgttgtcgatcatcagaaccgtgtttttgttgttgttgctg

SEQ ID NO: 134683 - DNA, 601 bp, Human
gttagctatgctacagtgttttgcttgtttgggtctggaaagttgagtaatctgaagagagaatagggtctatggaaagctataggggatggacgtatttgttaccatggtattttattagtaaattgtaatctaaaagccatggtgctcttgaatgtaaccctggacggtggattgggaagtgcagccggacaaatacatagtgtttgctttttcgatacctaaggaaaatgtagttatgtttcattgggagatcattctggtttgaggtctacttctctggatccccagttgaattgtrgtatgcaacaaaatgtgaggttaatttaaccatttaaattctgatcatccttgacaaggcaaacgtttcctttcatacttattagtaggaacctttgaatcttgaatactataatattagatgaaaataaaaacagccagtttcttaaagtctgatcttgattattctgttgtcgatcatcagaaccgtgtttttgttgttgttgctgttttgttgttgttgttttatttggctttttctttggtcattttacctgtaaatctattttgcagaaacaaaagggaaaggaggaggtgaaac

SEQ ID NO: 134684 - DNA, 601 bp, Human
atacaatttactggagacttagtttaccagttgggaatcttttagactttggaataccttctttttcaaattgaatttgacgttaatttacttgaacttatattgatgcctcatgaggtgcattatttgttgtggctcatctttcctttttttcaatttcaggtgatcccattaagatactaatgccatcactgtctcctacaatggaagaaggaaacattgtgaaatggctgaaaaaggaaggtgaggaggtaccttcctaatgtcctgtgtgctttgttatttggttattttgttttgtttttttttttcctaatctgtcctgttatacagtatgtgatataaattaaataaattgtgttcctttggtagttaatgtaagtttggttgaataaaattttcccatgataaagcagcaaaggttttctgggttcagcatatatccttacacaagcacagaatggtaaaaaatattttaaggctttttccccaacttttagtccttatgcctagcttttagtttcaacatcatagttttgacattctccttaatttataactttatcatgattgtgtgtgtgtgtgtgtgtgtgtgtgtgtg

SEQ ID NO: 134685 - DNA, 601 bp, Human
ctttgttatttggttattttgttttgtttttttttttcctaatctgtcctgttatacagtatgtgatataaattaaataaattgtgttcctttggtagttaatgtaagtttggttgaataaaattttcccatgataaagcagcaaaggttttctgggttcagcatatatccttacacaagcacagaatggtaaaaaatattttaaggctttttccccaacttttagtccttatgcctagcttttagtttcaacatcatagttttgacattctccttaatttataactttatcatgattgtgtgtgtgtgtgtgtgtgtgtgtgtgtgtgtgtgtgttctgggaggtaggcaagttcatcataaattttattgaaaagaacaaataagtagaatataaggaaaaccctcaaaagcagatcagcggaggagggttgtagccctgctaattattgaaatatagtattaagcatttctaattaaaactctgggattggtgcttaaaagacagaccagtgcagctgagtagagaataaagaaatagatgcagttgcacatggaatttaagtatataataaaggaagacaatattagatttattctt

SEQ ID NO: 134686 - DNA, 601 bp, Human
aattacaaatgaattatacacttaatgtataaaaatgaaactatgcaagtcttgaattcctctgaacccggaagtggaataaacaccctaactataactcaaaatccagattataatatgggaaataaaatttgatggtaaaagtactaacttttatatggctaaaaatacaagttaagtaaaaaaagaagtgacaaattggacaagagtatttgcgatttctatcacaaagggttaatatccctaaaaaatcgataagactgtcaactcaacaagaaagtgggcgatacatgaacagatrgtttacagaaaaataattgcaaatgactcttacacgtagaaaaagacgcctaacctttcaactggtaagaaatacgcagacactttactgaaatgtcatttcttactgattatattgacagtacttaaaaagttcgacaagctgttctcttgatgatgctgtggagggaagggaagaagcaggactctcagacattgctggaggaaatgctaaatggtgtaaatactagggaagagaatttggcactatatagaaaaattacatttatgtttaccctttggcccagcagctctacttcga

SEQ ID NO: 134687 - DNA, 601 bp, Human
atcgataagactgtcaactcaacaagaaagtgggcgatacatgaacagatagtttacagaaaaataattgcaaatgactcttacacgtagaaaaagacgcctaacctttcaactggtaagaaatacgcagacactttactgaaatgtcatttcttactgattatattgacagtacttaaaaagttcgacaagctgttctcttgatgatgctgtggagggaagggaagaagcaggactctcagacattgctggaggaaatgctaaatggtgtaaatactagggaagagaatttggcactatwtagaaaaattacatttatgtttaccctttggcccagcagctctacttcgagggatttgtctcagtgttacaccagcaaaaataagaatagacacaaacacacactaggctgtttatcacagcactgtttgaaatagcaaaaggtagaaacaatccaaatgttggttagtacaggatttgttgaataacttttactgtatctacacctgtaaaaaggaatgaggaatatctctttatactgctatggggtgatcttcattgaaaaaaagcaaggtacagacaagtgagtatagtatatatc

SEQ ID NO: 134688 - DNA, 601 bp, Human
gctggaggaaatgctaaatggtgtaaatactagggaagagaatttggcactatatagaaaaattacatttatgtttaccctttggcccagcagctctacttcgagggatttgtctcagtgttacaccagcaaaaataagaatagacacaaacacacactaggctgtttatcacagcactgtttgaaatagcaaaaggtagaaacaatccaaatgttggttagtacaggatttgttgaataacttttactgtatctacacctgtaaaaaggaatgaggaatatctctttatactgctatggrgtgatcttcattgaaaaaaagcaaggtacagacaagtgagtatagtatatatcatttatcaaagaaagaggtggcagtgctaatatttaagaaattagaaaggataaaataaaactttaaaaacaacaatagttggttatctacagagtaatggagggaaccgtgtgggggagaaactggaagctggacttctgaatatatcttgttttgtctctttgactttgggacaatatacatatcttgcacaattttaaaacaaaattaaagtgtaaaagagccctaaagattgaaacgagacag

SEQ ID NO: 134689 - DNA, 601 bp, Human
atgagcttttaatatcttgtcagttcagaaagcaaggaagctgtcagaaactcctgagggcatcttaaaggactcaggagccagagatgagatagtttgaggatcactaaggataataaggataatatatttaatatatttcaatacattaaatatatttgaatcctaagttcacagtaatactaaagaaaaaaaattaataataattggttagctttagagggtgctaagaaattaactcattttgaaaacgtaataaatggaaagactcaagcatttttctctacctcttctgctatakgaaccgtagctctgagtaaccaagtaattgatgagaagtttctcattattagcatatcacagttgttaaaagatagaagaatcatagaacatcactgtattgccattttgcaatctctggtaaaatagtatagccagtgatcattaatagctgctaacatcacaaaaagagagataaccagatattacatgtttcccactgtgaagtagtcttgccagaaaattgaaccaaatatgttcaagcctgtagctctatcattttccaggaaatacaggggaaaatataacgtgttcaatgaca

SEQ ID NO: 134690 - DNA, 601 bp, Human
gttcaagcctgtagctctatcattttccaggaaatacaggggaaaatataacgtgttcaatgacaccatgagaagtatatcagcaaaagctagactgaggaattctgtatgccagtttcttcaaccaataaatttcagggtggtagggaagagcccgggggaggaaggtgggggaacctatagcatacaagagatttgagaccagtgccaatgtatggacctaattttaattatgattcaagcaaacaaaacacatgcggacatttgaaaactggctggatatttaatgatattatggattttttttttttttttttttttttgagacatggtctcactctgttgcccagcctggagtataatggcgcgatctctgctcactacagcctcagcctcctgggctcagggtgattctcccacctaagcctcttgagtagctgggaccacaggcatgcgccaccatgcctggttagttttttgtatttttttagagacagggtctccctgtgttgcccacgctggttttgaactcctgggctcaagtgattctcctgcctcgacctcccaaagtgctaggattacaggcataagccaccgcacc

SEQ ID NO: 134691 - DNA, 601 bp, Human
taattttaattatgattcaagcaaacaaaacacatgcggacatttgaaaactggctggatatttaatgatattatggattttttttttttttttttttttttgagacatggtctcactctgttgcccagcctggagtataatggcgcgatctctgctcactacagcctcagcctcctgggctcagggtgattctcccacctaagcctcttgagtagctgggaccacaggcatgcgccaccatgcctggttagttttttgtatttttttagagacagggtctccctgtgttgcccacgctgrttttgaactcctgggctcaagtgattctcctgcctcgacctcccaaagtgctaggattacaggcataagccaccgcacccagcataggaattattaattttaaaggtttaataatattttggttatattttgattattaaaaaaaaaaaatctcacctataagagatgtgagatgaaatacttacgaataaaatgacagtatctctgggattagcttcagaataaccctggttgaggttgagagggtagggaggggtataactgaaacaagatcggtcatgaatcacttggcagttgtat

SEQ ID NO: 134692 - DNA, 601 bp, Human
aatggcgcgatctctgctcactacagcctcagcctcctgggctcagggtgattctcccacctaagcctcttgagtagctgggaccacaggcatgcgccaccatgcctggttagttttttgtatttttttagagacagggtctccctgtgttgcccacgctggttttgaactcctgggctcaagtgattctcctgcctcgacctcccaaagtgctaggattacaggcataagccaccgcacccagcataggaattattaattttaaaggtttaataatattttggttatattttgattattwaaaaaaaaaaatctcacctataagagatgtgagatgaaatacttacgaataaaatgacagtatctctgggattagcttcagaataaccctggttgaggttgagagggtagggaggggtataactgaaacaagatcggtcatgaatcacttggcagttgtataagtgaggtaaaaggtatatgtggcttcattgcctttccttaccacttttgtataattcaaaatttattttttatatataaatttttttaatatattttttaaaggttgtgcatagtgctttcaggatataatttgaga

SEQ ID NO: 134693 - DNA, 601 bp, Human
aggcatgcgccaccatgcctggttagttttttgtatttttttagagacagggtctccctgtgttgcccacgctggttttgaactcctgggctcaagtgattctcctgcctcgacctcccaaagtgctaggattacaggcataagccaccgcacccagcataggaattattaattttaaaggtttaataatattttggttatattttgattattaaaaaaaaaaaatctcacctataagagatgtgagatgaaatacttacgaataaaatgacagtatctctgggattagcttcagaataamcctggttgaggttgagagggtagggaggggtataactgaaacaagatcggtcatgaatcacttggcagttgtataagtgaggtaaaaggtatatgtggcttcattgcctttccttaccacttttgtataattcaaaatttattttttatatataaatttttttaatatattttttaaaggttgtgcatagtgctttcaggatataatttgagatgagaaactagtaccagatgaattggaatgttgatattattaagagaatatttgatacaataccatctataaagctgtattatgtca

SEQ ID NO: 134694 - DNA, 601 bp, Human
tttgagatgagaaactagtaccagatgaattggaatgttgatattattaagagaatatttgatacaataccatctataaagctgtattatgtcactgtttctggcaaccattttgccagattttaagtacctaatatggtgcttagaaaataaagactatgaataaaagaggtgagtatgttacagtgcttatacagaaggatagaggaacagttaatgtgaaggaagctgggctttttgtttttctggcagctactttcttttccttttcttttcccctttttcctttgccatgtgtggyggtagagtctcccctccaggtattggccactggataacctcttttagcaccctatgtagctgtctttctctgtgcttgattcattctgtatcaggttaaactattgtggaggaaagaggatgagtctacagtacctattagggattgttagacagaaaaatagagaaattagaggtgactgaatgagtcccccacagccattattatgcgtcatctggagcaatggtgaatcaagtgttaaaaagggaaagaaagaagggaagtgcaagtagagaatgaataacatggtctggggaggac

SEQ ID NO: 134695 - DNA, 601 bp, Human
cagttaatgtgaaggaagctgggctttttgtttttctggcagctactttcttttccttttcttttcccctttttcctttgccatgtgtggcggtagagtctcccctccaggtattggccactggataacctcttttagcaccctatgtagctgtctttctctgtgcttgattcattctgtatcaggttaaactattgtggaggaaagaggatgagtctacagtacctattagggattgttagacagaaaaatagagaaattagaggtgactgaatgagtcccccacagccattattatgcktcatctggagcaatggtgaatcaagtgttaaaaagggaaagaaagaagggaagtgcaagtagagaatgaataacatggtctggggaggacttgtctaattccagagactagccctggcaaggacttccagggtatcctaatgtgatttagtaggcacagatgtcactcatacaaatgttggtattgagtggtccagtctagtgcttgtaaaatagtatcaaaagagtttaggcagtgggcaggacaccagagtctggaagagctgtgttgtgattctagaaggtctagcctttcatagca

SEQ ID NO: 134696 - DNA, 601 bp, Human
gccaaaagcagggtacatgacagggatccaagaaggctttgcagatgaggtagtatttgaactggtccttgtagaataaatgggctttttaaaaataatgagaaggacattccagctagaaaaacatgggtaaactcttggaagaaagatgtcactgagacatacttttgcaacagcaggtaggtctggctgcattggggacataatggctgtaagatcagatagattattggaaggatcttgaatgccaatctgcagtttatcagtctgtgagggtccttatcctaaagccaaaatagawccacattcatggtttcttaataggaagtggtttcttttcttttcttttcttttcttttttttttttttttttttttgagacagagtctcactctgtcacccaggctgtagtgcagtggcccgatcttgctcactgcaacctccacctcccaggttcacgtgagtcttgtgcctcagcctcccaagtagctgggactacaggcgagcaccaccatgcccagctaatttttatgtttttagtagagacaaggtttcaccatgttggctggtctcgaatttctgacctcaagtgatctgccca

SEQ ID NO: 134697 - DNA, 601 bp, Human
agaccctaagagtaacctggtatgaggagataactgtaggcaatttaaagtagcctccttttcctgctctcatttgaaaagccaacactgagaactcctaatcaatgtgataatctaaacagatggggtaaagcatctgctctctatcggatataatattataagtaaatcttttcaatgttaagtggtgctggaatgcagagaaaggaaatcaccaagtgtccccacatctggagtggtgaatgggagttgaggccatgtgcaccactagggctgagctggaaggctggagttgctgacttttttttttttttttggtggcggggtgggtggaaggagcaaggaagggaaatcaagaatcagattaaaatttgaatatggtaagatttgaaatgcatatgaggcattcaagggaaggtgttcaatagataactgattataggagttgaagttcaggagtgaagtctgacttggagacagaaatttgagagtcatcagcatgtggatggaatttaatgccatgtgataacaggcaaaatgattttgaatctatatggaataagaatgcctactcccctaaagagtcctcctgagggtcaaa

SEQ ID NO: 134698 - DNA, 601 bp, Human
tgacttggagacagaaatttgagagtcatcagcatgtggatggaatttaatgccatgtgataacaggcaaaatgattttgaatctatatggaataagaatgcctactcccctaaagagtcctcctgagggtcaaatttatagaacttgcattttctgggaacccacagatagaagtgaagttgtcctgggctgatcgcctccctgggttacctggtagaagccattattctggaagaatacagcttctaatccaaaccatacagaatttgcagataaagtctcaccaaaagtcacaatccmacatttaataacgtatgtggaagaagtcttttaggagtgaagtcagtaggcataacaagcagcaggactggatcccaagaacttcagttaattggaattacaaaagtccaggcagatttgaaaaggataaacagaacttctagtaatgaaaaatatagtctctcaaattaaaaccccccaaacctcaagggtgggctgaagtgtgattagacaggactgaatgaagaatttgtgaacagaaggacgactagaggaagttaggttgcatgtagcacatagagacagcactggaaaatatga

SEQ ID NO: 134699 - DNA, 601 bp, Human
caggactgaatgaagaatttgtgaacagaaggacgactagaggaagttaggttgcatgtagcacatagagacagcactggaaaatatgaaagagaagttgacatatgaagggtaaaatgaaaattattcaataacccaataggaatttcagaagaagaaaaaaagagggaaatgggaagaggtaattttcaaagaaaaacatggcagagaattttctagaatttaagaaagatatgtgtaatgtaaatgaaagagccagtaccccattggaaagcatttagagcaattggctctgcatggytgctgctatcttttaaaataattgtcagtatctaagaaagttttacctttataaataatgtaatcagttggaatgtgtttttaggtttcttttctctgatgaattacagagctttggctatttccatattcgatatgacagggtgttggtgtcattaaataatgattcagacacagaacagtcttttagggattattttaaaaagattaactttcttcacactttgagaatttataggtaagcagatgaggggattcttgggccacatttatctttcagacttccagctcactggcaatc

SEQ ID NO: 134700 - DNA, 601 bp, Human
acacttatttactgtatacatgggtgtcaatatatgtttaagtatgcctggttcttggtacatttatgataacttgctccattcattttatattaaaaacaaatttatattctgacagcatacttttcatatattttttctcttattaactgttttttgtttgtttgatttttgagatctttttaaatgtatggtcaccataaaacaatgagtttaaacctttatgcattaagaaaattgatatttttcatgaaaaatgatagtgttgcatcgaattatgaatctagtttacttctaagcraagactagataagtatttgagaacattcaatggacagcagttcagtcttaaaaaccattaagttttttcaaagatctgagactgattcacagcttcttttactaatggtgtgtgtgtgtgtgtgtgtgtgtgtgtgtgtgtgcacttgcatgcgcgcagcgttttacaccaaggaggtaagggtgcaaagaaaaaactctggcccaggaatcatggtttttcctttggggttcctcctctgccatgaactacctgggagtgagttgaactagctgaaatctaaggtacggaatatcctgg

SEQ ID NO: 134701 - DNA, 601 bp, Human
cttattaactgttttttgtttgtttgatttttgagatctttttaaatgtatggtcaccataaaacaatgagtttaaacctttatgcattaagaaaattgatatttttcatgaaaaatgatagtgttgcatcgaattatgaatctagtttacttctaagcgaagactagataagtatttgagaacattcaatggacagcagttcagtcttaaaaaccattaagttttttcaaagatctgagactgattcacagcttcttttactaatggtgtgtgtgtgtgtgtgtgtgtgtgtgtgtgtgygcacttgcatgcgcgcagcgttttacaccaaggaggtaagggtgcaaagaaaaaactctggcccaggaatcatggtttttcctttggggttcctcctctgccatgaactacctgggagtgagttgaactagctgaaatctaaggtacggaatatcctggatttataattctatgataactcatttttattttctttttttaagtaactgaaatatgcagtattatagcatataaattatttccgtctttgttgaactcatgattctaagaaaataagttttataatgactattagagtac

SEQ ID NO: 134702 - DNA, 601 bp, Human
aaggtcaattgagctatcatttggcatttttattacaagttttttatttggagggggcatgtgcttcagatattttcagtttaaactgcacctagtttattttttcatcaattgaactgtcaaatctgttaaaataacagaaaggaaaaaaaattcttgttctccttttgtaagagaatatttgaggttatgaaaaaccttgttttttttcctcagaatatttgagatttttctgctctgccgtgaagcactatggaacaaaaccaggctaagataattccatcaagcacttagccacacmcacagtgcctagaatgtacgtagtaagcatgcttaacagtggtgcttgttgctgcggtattccttatgtcatgagacaagggatttttttgtatttcaaatagtttttgtctaatatactgttactgtataaaattcagaaataaaaccattttgaagaaagccttatcctatatcactagatgccactagagagttatatgggtctctggattctactatagaagacactttggttccgttatttctggcaatatgtatatgtttgtggtgctaaaatggaaaattttgaaaagtccat

SEQ ID NO: 134703 - DNA, 601 bp, Human
cttttgtctatgtttcatataaatagaagcatgtaatgtttggtcttttgtgactagattttttcagatttagcatgattaaggttcatccatgttgtagcatttatcagctgttcattccttttgttactaaattatattccatcattatgcgtttttacatttattgctaaatctttgtattatatcagaatttttaaattagtgaatggaattatagattatagttttattcaatagaagtttctgtggtgatggaaatgttctgtgttaaactgtcgaatacagtagctactagactttaagaagccagagggatgtgtgggtggttgaccttgtctaactgggcccttctcaaactctcctactcatgccttcaccccatagggcaggacctcaactggcctagcaaccaggttgcctcaggtctttggccatgcaaatattatccttctttgtgtgtgtgtgaagtgaaaagggatgacaaacactgactaggggtccctcctctacattcccattctgctgtaggtactaattggatgggattgtcattgcctgcttgttgtactgttcttcaatcagattaggaacttcttga

SEQ ID NO: 134704 - DNA, 601 bp, Human
aagccagagggatgtgtgggtggttgaccttgtctaactgggcccttctcaaactctcctactcatgccttcaccccatagggcaggacctcaactggcctagcaaccaggttgcctcaggtctttggccatgcaaatattatccttctttgtgtgtgtgtgaagtgaaaagggatgacaaacactgactaggggtccctcctctacattcccattctgctgtaggtactaattggatgggattgtcattgcctgcttgttgtactgttcttcaatcagattaggaacttcttgaagcagktctgtcttattttattactatttttatcatagtgtcgcacacagtgtcattcacatgggcagctagtaaatacttgtagagtcaacaattgaattatttttgtttctgattattgttatcattatggttcaacatagcactaagaagaggaatttttctttaatgttcatgttaatctgataacttggtcttacagataaaaactagctctcttccaccaccaccaccacacacatcttttacgtaaagacttttattcttaatttttggcagaacaaaattattttgtgaaagcctcag

SEQ ID NO: 134705 - DNA, 601 bp, Human
aggtctttggccatgcaaatattatccttctttgtgtgtgtgtgaagtgaaaagggatgacaaacactgactaggggtccctcctctacattcccattctgctgtaggtactaattggatgggattgtcattgcctgcttgttgtactgttcttcaatcagattaggaacttcttgaagcagttctgtcttattttattactatttttatcatagtgtcgcacacagtgtcattcacatgggcagctagtaaatacttgtagagtcaacaattgaattatttttgtttctgattattgttrtcattatggttcaacatagcactaagaagaggaatttttctttaatgttcatgttaatctgataacttggtcttacagataaaaactagctctcttccaccaccaccaccacacacatcttttacgtaaagacttttattcttaatttttggcagaacaaaattattttgtgaaagcctcaggacttattctattaataaaataaacatcaccattaactgtgtttgaccaaggctatgcttaatatctagaatttaaaaagagaaagggaagcctccgtatacttcagtcctcagctct

SEQ ID NO: 134706 - DNA, 601 bp, Human
agcttggaatcaaactcatatttgaattaggagaggttccttgtaactactctgccaaggagtctttctaagttatagcactaaatttttgatcacagctgaaactcagtagatttgaaatattcatggctcattatttgctctcagagttttcttttggcatttacatgatgtttgattattgaaagatagaactttggttttgtgatgagttaggggtaatgcttccatacgtaatattactatgtttttaaaacttccctgtgatttattggtaaagtgttctgtgtttcttttcccyacctccctctcttttgtcctctccttttttccttctctctcctcctgcttttctcttctaccctctcccttggcattctcatctagctaacatatatgtctgtgttatgtgaatagatatagttttttaaaaaagaaaaaaaggctatctttttaaatatcagaagcatgctacaaatcaaatgttagaagcaaaagaaatgtaaaagataatttgatgtataccttatgaggaaataaggattcgtgaagttatcatgtttttttctaaagcattttaatctaaaattcattgggtatg

SEQ ID NO: 134707 - DNA, 601 bp, Human
gctgaaactcagtagatttgaaatattcatggctcattatttgctctcagagttttcttttggcatttacatgatgtttgattattgaaagatagaactttggttttgtgatgagttaggggtaatgcttccatacgtaatattactatgtttttaaaacttccctgtgatttattggtaaagtgttctgtgtttcttttccctacctccctctcttttgtcctctccttttttccttctctctcctcctgcttttctcttctaccctctcccttggcattctcatctagctaacatataygtctgtgttatgtgaatagatatagttttttaaaaaagaaaaaaaggctatctttttaaatatcagaagcatgctacaaatcaaatgttagaagcaaaagaaatgtaaaagataatttgatgtataccttatgaggaaataaggattcgtgaagttatcatgtttttttctaaagcattttaatctaaaattcattgggtatggtgcattggccatgaaacctgaggaatggggatgggaatataaaacatttaagtgtcctgtccgtattgtgaagaagctcatagtctagtaaataga

SEQ ID NO: 134708 - DNA, 601 bp, Human
atgagttaggggtaatgcttccatacgtaatattactatgtttttaaaacttccctgtgatttattggtaaagtgttctgtgtttcttttccctacctccctctcttttgtcctctccttttttccttctctctcctcctgcttttctcttctaccctctcccttggcattctcatctagctaacatatatgtctgtgttatgtgaatagatatagttttttaaaaaagaaaaaaaggctatctttttaaatatcagaagcatgctacaaatcaaatgttagaagcaaaagaaatgtaaargataatttgatgtataccttatgaggaaataaggattcgtgaagttatcatgtttttttctaaagcattttaatctaaaattcattgggtatggtgcattggccatgaaacctgaggaatggggatgggaatataaaacatttaagtgtcctgtccgtattgtgaagaagctcatagtctagtaaatagaggaaatcacaatttaaaaaagtaattagcagtaatataacattttatatgcaatttgtgatttttaaataaattagacctactataggaatctggaatatgaacaaaatt

SEQ ID NO: 134709 - DNA, 601 bp, Human
cctgtgatttattggtaaagtgttctgtgtttcttttccctacctccctctcttttgtcctctccttttttccttctctctcctcctgcttttctcttctaccctctcccttggcattctcatctagctaacatatatgtctgtgttatgtgaatagatatagttttttaaaaaagaaaaaaaggctatctttttaaatatcagaagcatgctacaaatcaaatgttagaagcaaaagaaatgtaaaagataatttgatgtataccttatgaggaaataaggattcgtgaagttatcatgtttttttctaaagcattttaatctaaaattcattgggtatggtgcattggccatgaaacctgaggaatggggatgggaatataaaacatttaagtgtcctgtccgtattgtgaagaagctcatagtctagtaaatagaggaaatcacaatttaaaaaagtaattagcagtaatataacattttatatgcaatttgtgatttttaaataaattagacctactataggaatctggaatatgaacaaaattatgtaggtcaagttactcagagaaagttatatagctgaagtcgaatctgtagt

SEQ ID NO: 134710 - DNA, 601 bp, Human
tgtttacagattgtctcctcctcacctcttcaggctcagaataggtggtcattgtattctaggaagccttttctcaccttacaaaaactgaattagatgcccctcctgaacattcccaaagcatcctgacctcaccttatcctgctgtattttccagtttacttgtcaatggatattaagcaagcttcttgaggtcaggaatcttaaatctttgctgttattactgtccattgctgtatcctcagtgcctacatatgtatatatattttatatgtaatatataaatatataatacaaataygtgtgtgtgtgtgtatatatatataaaatatatttatataattattattattttttagacagagtttttgctcttgttgcccaggctggagtgaaatggcatgatcttgactcactgcaacccccttctcccaggttcaagtgattcttctgcctcaacctcccgagtagctgggaccacaggtgcctgccacctctcctggctaatttttgtatttttagtagggacggggtttcacaatgttggccaggctggtcttgaacccctggcctcaggtgatccacccacctcggcctccca

SEQ ID NO: 134711 - DNA, 601 bp, Human
ttaatattgctattccagctatttttggtgtgtgaggaggtgtatttatatgttacatattttttatccccttgttttttattctgtttttgtgttagggctatctcttgtaagctacatttacctagattttattttcatatccattttgataatctctacttttaatgggtgattttaatccatttatatttattgtgattacggatacatggggacttatttctaccattttttgtgcatttttgtttttatcctttgccttttctttccatgtgcctgccctcagttagataatcamcttcttatttttcctctgtttttctaatgctgtagattatatttctgtttttaaattttaaattaaattttgccaataaagtttagtattattcagtatttttctcctattataagttgatgcaaaagtaattggggtttttgaaagtaaggtggtaaaaataaaattacttttgcaccagctgaatatatcaaagttgttagcatgccttaccatctaaacatttccttacctatcttattattttttagagtttgagttttacactttttaaaccctcaaacattactttaaaaatac

SEQ ID NO: 134712 - DNA, 601 bp, Human; identical to SEQ ID NO: 27602

SEQ ID NO: 134713 - DNA, 601 bp, Human; identical to SEQ ID NO: 27603

SEQ ID NO: 134714 - DNA, 601 bp, Human; identical to SEQ ID NO: 27604

SEQ ID NO: 134715 - DNA, 601 bp, Human; identical to SEQ ID NO: 27605

SEQ ID NO: 134716 - DNA, 601 bp, Human; identical to SEQ ID NO: 27606

SEQ ID NO: 134717 - DNA, 601 bp, Human; identical to SEQ ID NO: 27607

SEQ ID NO: 134718 - DNA, 601 bp, Human; identical to SEQ ID NO: 27608

SEQ ID NO: 134719 - DNA, 601 bp, Human; identical to SEQ ID NO: 27609

SEQ ID NO: 134720 - DNA, 601 bp, Human; identical to SEQ ID NO: 27610

SEQ ID NO: 134721 - DNA, 601 bp, Human; identical to SEQ ID NO: 27611

SEQ ID NO: 134722 - DNA, 601 bp, Human; identical to SEQ ID NO: 27612

SEQ ID NO: 134723 - DNA, 601 bp, Human; identical to SEQ ID NO: 27613

SEQ ID NO: 134724 - DNA, 601 bp, Human; identical to SEQ ID NO: 27614

SEQ ID NO: 134725 - DNA, 601 bp, Human; identical to SEQ ID NO: 27615

SEQ ID NO: 134726 - DNA, 601 bp, Human; identical to SEQ ID NO: 27616

SEQ ID NO: 134727 - DNA, 601 bp, Human; identical to SEQ ID NO: 27617

SEQ ID NO: 134728 - DNA, 601 bp, Human; identical to SEQ ID NO: 27618

SEQ ID NO: 134729 - DNA, 601 bp, Human; identical to SEQ ID NO: 27619

SEQ ID NO: 134730 - DNA, 601 bp, Human; identical to SEQ ID NO: 27620

SEQ ID NO: 134731 - DNA, 601 bp, Human; identical to SEQ ID NO: 27621

SEQ ID NO: 134732 - DNA, 601 bp, Human; identical to SEQ ID NO: 27622

SEQ ID NO: 134733 - DNA, 601 bp, Human; identical to SEQ ID NO: 27623

SEQ ID NO: 134734 - DNA, 601 bp, Human; identical to SEQ ID NO: 27624

SEQ ID NO: 134735 - DNA, 601 bp, Human; identical to SEQ ID NO: 27625

SEQ ID NO: 134736 - DNA, 601 bp, Human; identical to SEQ ID NO: 27626

SEQ ID NO: 134737 - DNA, 601 bp, Human; identical to SEQ ID NO: 27627

SEQ ID NO: 134738 - DNA, 601 bp, Human; identical to SEQ ID NO: 27628

SEQ ID NO: 134739 - DNA, 601 bp, Human; identical to SEQ ID NO: 27629

SEQ ID NO: 134740 - DNA, 601 bp, Human; identical to SEQ ID NO: 27630

SEQ ID NO: 134741 - DNA, 601 bp, Human; identical to SEQ ID NO: 27631

SEQ ID NO: 134742 - DNA, 601 bp, Human; identical to SEQ ID NO: 27632

SEQ ID NO: 134743 - DNA, 601 bp, Human; identical to SEQ ID NO: 27633

SEQ ID NO: 134744 - DNA, 601 bp, Human; identical to SEQ ID NO: 27634

SEQ ID NO: 134745 - DNA, 601 bp, Human; identical to SEQ ID NO: 27635

SEQ ID NO: 134746 - DNA, 601 bp, Human; identical to SEQ ID NO: 27636

SEQ ID NO: 134747 - DNA, 601 bp, Human; identical to SEQ ID NO: 27637

SEQ ID NO: 134748 - DNA, 601 bp, Human; identical to SEQ ID NO: 27638

SEQ ID NO: 134749 - DNA, 601 bp, Human; identical to SEQ ID NO: 27639

SEQ ID NO: 134750 - DNA, 601 bp, Human; identical to SEQ ID NO: 27640

SEQ ID NO: 134751 - DNA, 601 bp, Human; identical to SEQ ID NO: 27641

SEQ ID NO: 134752 - DNA, 601 bp, Human; identical to SEQ ID NO: 27642

SEQ ID NO: 134753 - DNA, 601 bp, Human; identical to SEQ ID NO: 27643

SEQ ID NO: 134754 - DNA, 601 bp, Human; identical to SEQ ID NO: 27644

SEQ ID NO: 134755 - DNA, 601 bp, Human; identical to SEQ ID NO: 27645

SEQ ID NO: 134756 - DNA, 601 bp, Human; identical to SEQ ID NO: 27646

SEQ ID NO: 134757 - DNA, 601 bp, Human
ccaggttccatggtcagttcaatcacctagtcacagttggtaagtgacagagttgggacttgaacctatgcctgcctgacaccaagtctttttttgacacctagagccaagacatctgaagacaaactccctaggagagctggcgtcatagaaaccttaaaggttagggagacctgggtttgaatcaggctttgtcagttatgacttgtgtgaccctagcaagttatttaacctttctgggtctcagtttcctcatctgcaaactgaggataataacagtacctaccaaaaagaactgtcrtgaaaaccatataatttctgcaatgctcctggcacagtgtcctgttctaaagcatagttccccttctctttcttagctccatattgattattaccctaacttgcacaaagagacttggaggacccccatagagtatcggagggtcccccatttcctgctctttccactccacacccccagcaagcacagggaagttctgggggccataatccacccacaggaaccaaatctaagccacctttctggctggtagacatccaggtatgtgggcacagaggtagacaggctgaaatgctgctg

SEQ ID NO: 134758 - DNA, 601 bp, Human
tctctcctgcctaaatgtcctgcctaagtgccttcaagaacccttcaccatcctgctcctgcatgtgaccaggttccatggtcagttcaatcacctagtcacagttggtaagtgacagagttgggacttgaacctatgcctgcctgacaccaagtctttttttgacacctagagccaagacatctgaagacaaactccctaggagagctggcgtcatagaaaccttaaaggttagggagacctgggtttgaatcaggctttgtcagttatgacttgtgtgaccctagcaagttatttaacytttctgggtctcagtttcctcatctgcaaactgaggataataacagtacctaccaaaaagaactgtcgtgaaaaccatataatttctgcaatgctcctggcacagtgtcctgttctaaagcatagttccccttctctttcttagctccatattgattattaccctaacttgcacaaagagacttggaggacccccatagagtatcggagggtcccccatttcctgctctttccactccacacccccagcaagcacagggaagttctgggggccataatccacccacaggaaccaaatcta

SEQ ID NO: 134759 - DNA, 601 bp, Human
aggaataagtgacttgtccaaggtaacacagccaaaaaatagccagggatcagtactcagacccaagttgtgacttcctgtcaggaccaagaggcagcctgctgtggcgcaaaagttggacctgggttcaagttcttctcttccacttgcaggctgtgagatttaaccccagtcttggttgttccctgtaaagtaggatggaagtgttatgaaatgtaatggacacataagcaatgcttggttaccagaacaggtcccattcatggcccacatgacaacctgcttccccagtgggtatttytggagacagctcttctgtttccaggttttctctcctgcctaaatgtcctgcctaagtgccttcaagaacccttcaccatcctgctcctgcatgtgaccaggttccatggtcagttcaatcacctagtcacagttggtaagtgacagagttgggacttgaacctatgcctgcctgacaccaagtctttttttgacacctagagccaagacatctgaagacaaactccctaggagagctggcgtcatagaaaccttaaaggttagggagacctgggtttgaatcaggctttgtcagttatga

SEQ ID NO: 134760 - DNA, 601 bp, Human; identical to SEQ ID NO: 18605

SEQ ID NO: 134761 - DNA, 601 bp, Human; identical to SEQ ID NO: 18606

SEQ ID NO: 134762 - DNA, 601 bp, Human; identical to SEQ ID NO: 18607

SEQ ID NO: 134763 - DNA, 601 bp, Human; identical to SEQ ID NO: 18608

SEQ ID NO: 134764 - DNA, 601 bp, Human; identical to SEQ ID NO: 18609

SEQ ID NO: 134765 - DNA, 601 bp, Human; identical to SEQ ID NO: 18610

SEQ ID NO: 134766 - DNA, 601 bp, Human; identical to SEQ ID NO: 18611

SEQ ID NO: 134767 - DNA, 601 bp, Human; identical to SEQ ID NO: 18612

SEQ ID NO: 134768 - DNA, 601 bp, Human; identical to SEQ ID NO: 18613

SEQ ID NO: 134769 - DNA, 601 bp, Human; identical to SEQ ID NO: 18614

SEQ ID NO: 134770 - DNA, 601 bp, Human; identical to SEQ ID NO: 18615

SEQ ID NO: 134771 - DNA, 601 bp, Human; identical to SEQ ID NO: 18616

SEQ ID NO: 134772 - DNA, 601 bp, Human; identical to SEQ ID NO: 18617

SEQ ID NO: 134773 - DNA, 601 bp, Human
aagaggtccaagttcctgaccaccccacacacgtcagactgcacctcagcaaggggaggaggccacccctgaatgaagccacttccaggcctcttccaccctggaattctgtgtggaaaactcccagcctgcctagaggccaccaggactgctgcgtttgccaaatcatttgaacatatatcctctctcttttatcttcttttattgcattttgggggcgaatagggggatattttaacccgggctccttgcctgttttcacagactctaagtcgtaaaactctgttacaaaggaaatgaytgagaaaatgaattcgagtctttgaaatacaaccttacacaaaaatcactgtcttaaagcttcaagggcaggtggaaatataactatccccagttcttcttgttcaagggaattccccctcctttattccccatcccccaacttgagaacagggtgacacctgagctcactcgggcttagggagtctaaggggggaccacagtcatctcaagcagccctttcctagccttgggtccaggacagttgaggagaggcccagagattctaactacagttcagctggcaggagatgttttcaga

SEQ ID NO: 134774 - DNA, 601 bp, Human; identical to SEQ ID NO: 25637

SEQ ID NO: 134775 - DNA, 601 bp, Human; identical to SEQ ID NO: 25638

SEQ ID NO: 134776 - DNA, 601 bp, Human; identical to SEQ ID NO: 25639

SEQ ID NO: 134777 - DNA, 601 bp, Human; identical to SEQ ID NO: 25640

SEQ ID NO: 134778 - DNA, 601 bp, Human
cttcctcgccacagcctcaccccaacccctgtgaaggaggtcctaccattatcttcattctgtagatgaggaaattgaggtttaggaaggttggcatttgcctgaggccagccacctggtttgtggcaagagccacgagagcatgagagaaagggaggtgtgtgattgtagggtcatgctcttaaccacagcaccgctgacaccagaagattcaggggcgcttgttttccctctccaagctaaaagggggtgggtgtcctggcctcctggcccaccagtggtcccacaacacctctgcccrcagcagggctggcgcttatttggagtaagcgctcctctggacaagggagccaggtcatccactggttggtaatggggcgagaggactcggatcttcttagtataccaagcagggctctctgacagggatgttggggggctctgacggctgggagggcggtcaaataaaaacctcatcccggtgttttccctactagtttttcacggggaaaaggagtttgtgcacatctgacaatttcccacgcatgccctgcagaggccggcgagatgcggagtccgcggctgcagggtagatcccctc

SEQ ID NO: 134779 - DNA, 601 bp, Human
gacttgtttactggttccaacacatatccagtcaactatctttcctgtttctcttaattcatggattaattatctggtttggatgaagtaactttttgcaaatatttgacatgtgtcctagatttcagacacctggctatcatacctcgttggtatcctaagagtaacagcagggatttgccctttaaaggtggtttataccagtttgcctctaagccctttctgtggacagtttatgagtgagctaatgaatgttcattttcacacaccaatgattacttttctcaaattaattttttttcttgaaggatgggagaatggaggaaaacatttttttttctttagctgaccttttcatatgtctacagaaataaaagtctgtctaaactggacttaaagaagaacctccaataaactaaaacttggctaaagcaggaaaaatctcccaaaggttcttgagtaggaccagagcaacacaaattgctataggtttcataagttgccatgggatagagagtttgataaatgagtcattcagtgagctgaccactttctccattgatttttttggcaagttggctttgggtgaatttattttata

SEQ ID NO: 134780 - DNA, 601 bp, Human
ccatagctattttgctgtggtggccaatgatatatattacaggtgtttttatactttggatctatggttttgggaatgataatttcttgtgcattttgaacttcggggtgatatgcatgtcaagggtcttataaacaaaaagacttgtttactggttccaacacatatccagtcaactatctttcctgtttctcttaattcatggattaattatctggtttggatgaagtaactttttgcaaatatttgacatgtgtcctagatttcagacacctggctatcatacctcgttggtatcctwagagtaacagcagggatttgccctttaaaggtggtttataccagtttgcctctaagccctttctgtggacagtttatgagtgagctaatgaatgttcattttcacacaccaatgattacttttctcaaattaattttttttcttgaaggatgggagaatggaggaaaacatttttttttctttagctgaccttttcatatgtctacagaaataaaagtctgtctaaactggacttaaagaagaacctccaataaactaaaacttggctaaagcaggaaaaatctcccaaaggttcttgag

SEQ ID NO: 134781 - DNA, 601 bp, Human
ggcactttctacagtgacaggtgggacttagaagactcttcagcagggacaggccagaagccagggggagggtccacatctctggatccacaaggtcaggtctggggacaatatgctcatcccagccccgggcaccagaaatcagctccaagtcaggtgctgaaaaatcaatctcctgagagccaatttgtccaaactcagtttttcaagtgaccaacttgctgaacaactgcttcaccaaaagcctgttaactcacggtttgtaataattccctttgaatttttttgagattaaaaaaaattcatttagccatagctattttgctgtggtggccaatgatatatattacaggtgtttttatactttggatctatggttttgggaatgataatttcttgtgcattttgaacttcggggtgatatgcatgtcaagggtcttataaacaaaaagacttgtttactggttccaacacatatccagtcaactatctttcctgtttctcttaattcatggattaattatctggtttggatgaagtaactttttgcaaatatttgacatgtgtcctagatttcagacacctggctatcatacctcgt

SEQ ID NO: 134782 - DNA, 601 bp, Human
actgcattccagcctgggtgatagagcaaaactcagtctcaaaaaaaaaaaaaaaaaaaatggagagagagaacagaaaggcccatcccttgggctatcagcatttgggagatggagatccagatgccacatctcaggagggccgaggaagcttgggcagggcctgaagaggggcactttctacagtgacaggtgggacttagaagactcttcagcagggacaggccagaagccagggggagggtccacatctctggatccacaaggtcaggtctggggacaatatgctcatcccagcccsgggcaccagaaatcagctccaagtcaggtgctgaaaaatcaatctcctgagagccaatttgtccaaactcagtttttcaagtgaccaacttgctgaacaactgcttcaccaaaagcctgttaactcacggtttgtaataattccctttgaatttttttgagattaaaaaaaattcatttagccatagctattttgctgtggtggccaatgatatatattacaggtgtttttatactttggatctatggttttgggaatgataatttcttgtgcattttgaacttcggggtgatatgcatg

SEQ ID NO: 134783 - DNA, 601 bp, Human
gagacaggccagtggagaagctggggcaatagcaaaaagtggcactggaggccctggactttggtcatatatggatttgggcttgtggcttaacctttctgagcttcagtttcatcatctacactaatgggcacctaacatttagagctactccaagaatgaaaagaaaccacacgagacaggactagtacagcagcacacaccagatgcccacctcccatgcagcccatctcaggcccccgctgcttgcagacagcttgggctcagggcaccatgtggtctggttgctattgttgaacaygccccatatttggggtccttccctgccctgtagcttctacctgcttttccagaacctccttttactgcctcctctttcaggaagtcttcctgtttcctccaaccagatgcagtttctgcctccagatccttatctctcactctgcacacacctcttctgctggtaaccagggccttgttattgggatctttcctttaccttacccatgaagaggatctatgtccagggaagagacaggggggccttcctgcaggaaggagggagctggggtggtactggatggaaggagggagcaggaag

SEQ ID NO: 134784 - DNA, 601 bp, Human
agaactgccccaaaggccacgcagacagaggccacgcagaagtcagcgttgatgaggctgtggggagacaggccagtggagaagctggggcaatagcaaaaagtggcactggaggccctggactttggtcatatatggatttgggcttgtggcttaacctttctgagcttcagtttcatcatctacactaatgggcacctaacatttagagctactccaagaatgaaaagaaaccacacgagacaggactagtacagcagcacacaccagatgcccacctcccatgcagcccatctcaggyccccgctgcttgcagacagcttgggctcagggcaccatgtggtctggttgctattgttgaacatgccccatatttggggtccttccctgccctgtagcttctacctgcttttccagaacctccttttactgcctcctctttcaggaagtcttcctgtttcctccaaccagatgcagtttctgcctccagatccttatctctcactctgcacacacctcttctgctggtaaccagggccttgttattgggatctttcctttaccttacccatgaagaggatctatgtccagggaagagaca

SEQ ID NO: 134785 - DNA, 601 bp, Human
acccccaccacctcatccccattctgagccctgctcacctttagcaggttaaggagaatgaactcattcacagcgaagagggtcacttggaagaaagtcatgatgagcagctgaatggggctgactttacccagaactgccccaaaggccacgcagacagaggccacgcagaagtcagcgttgatgaggctgtggggagacaggccagtggagaagctggggcaatagcaaaaagtggcactggaggccctggactttggtcatatatggatttgggcttgtggcttaacctttctgagcytcagtttcatcatctacactaatgggcacctaacatttagagctactccaagaatgaaaagaaaccacacgagacaggactagtacagcagcacacaccagatgcccacctcccatgcagcccatctcaggcccccgctgcttgcagacagcttgggctcagggcaccatgtggtctggttgctattgttgaacatgccccatatttggggtccttccctgccctgtagcttctacctgcttttccagaacctccttttactgcctcctctttcaggaagtcttcctgtttcctccaacc

SEQ ID NO: 134786 - DNA, 601 bp, Human
ggaagttaagtgactcgccaggctggcatgtctccccagctgtctatttctccataccctgctgtcccccaaagcacccccaccacctcatccccattctgagccctgctcacctttagcaggttaaggagaatgaactcattcacagcgaagagggtcacttggaagaaagtcatgatgagcagctgaatggggctgactttacccagaactgccccaaaggccacgcagacagaggccacgcagaagtcagcgttgatgaggctgtggggagacaggccagtggagaagctggggcaayagcaaaaagtggcactggaggccctggactttggtcatatatggatttgggcttgtggcttaacctttctgagcttcagtttcatcatctacactaatgggcacctaacatttagagctactccaagaatgaaaagaaaccacacgagacaggactagtacagcagcacacaccagatgcccacctcccatgcagcccatctcaggcccccgctgcttgcagacagcttgggctcagggcaccatgtggtctggttgctattgttgaacatgccccatatttggggtccttccctgccct

SEQ ID NO: 134787 - DNA, 601 bp, Human
aggtgcctcttatctgagccactgaattgacctccccgagggagcagcactcctgtcatggcccatgtgaatggcagctctggtgctgtgtcgtacacaccatggccaccttggccattcacctgggatcctgtcctacagatttgccccttcaatacaccggattccttttcttggcagaggaatctggaaatgtggtatgtgtgcaagagtatgtgcagggatatcctattcattccatgtgatgtgtgggaaagaaaggagggggaaaaaaacaacattcaaggaagccctgctctgyccacgtgctggattgatgggctaggtggactgtagtacctgcctggtagatattattactcccactttagagatgagaaaactgagtgacgttcaggaagttaagtgactcgccaggctggcatgtctccccagctgtctatttctccataccctgctgtcccccaaagcacccccaccacctcatccccattctgagccctgctcacctttagcaggttaaggagaatgaactcattcacagcgaagagggtcacttggaagaaagtcatgatgagcagctgaatggggctgactttac

SEQ ID NO: 134788 - DNA, 601 bp, Human
aggcaggcatcctgccctttagctctagagatgaccccacacccagctgtttccacctctgcagctttagtcatgcaggggctcttcctggaaggccctccctgccttccttaccccccacttagccttccacaccactccaggaagtctaccctgacccccatttctgggctaaatgcccccaccctgttcccacagcgccaggagggagaatcttttctctactgtagggagatcctccacatggcactgctttctcttccactacgctgtgaggagctcctggagggcagggctgggwtttgagagaccagaatggctgtggtcagtgtcttctctggaatgaatggacacaggaagtggaaatgcacatcttgccctagcccaggggatggagtgagcagctcctggttaccactgtgtctgccttggggcattctaggggaaatacaggatgagtgaccaacttctttcagcttcatggggaagggggacagacatatgggattctagaagtatctataggcaaactctgtttgcccttcccccaaaaagaactggcagccatgcaccataccacgtggggatcaggtctgatcat

SEQ ID NO: 134789 - DNA, 601 bp, Human
ggtgaggggggttaaatgacttgtccaagaccacagagctagcaagaggcagaaaggtgtcttgatccaggttgtgtggccccagagtccctgtccttgaccctattccatgtcccttcctgcaggtgggtgtggatacacacaggtgtgccagtctgtgtgtctgattctcttccccaggtgcctgaatccccacctctctgcatggtgatagtgtccccaaataatcgatactccagacagtgtctcagcacacatatgcccacgtcaagacgcttgtgtcagattataagataggttsggcgcagtggcttacacctgtaatcctagcactttgggaggctgaggtgggtggatcacctgaggtcaggaatttgagaccagcctgacgaatatggtgaaaccccatctctactaaaaatacaaaaattagctaacttagctgggcgtggtagcctgcacctgcagtcccagctagttgggaaactgagacaagagaattgcttaaacttgggatgcagaggttgcagtgagccgagatagcgccactgcactccagcctgggtgacagagcgagactccatctcaaaaaaacaaaaca

SEQ ID NO: 134790 - DNA, 601 bp, Human
ccacccaggcttgctacagctgctccctgtgcctctctgcacatgccacccatcccgcctagtaggtctgggcattttccatgtgctggtgcacttgctggtgagccctgacaacaagcacactgttgttttatgtataccatgtatacctgtgtgcccagactagcatgtctgaacgttcttgccatggatgcaagtccacgtcaagtgcctatggggtctagacataggcacgcaccagctgctgctgtctgaatgctaacctgtaccaggtaccgtgctgctggctgtaggggttagygctttccatctctacaacaagtctgcaaggtgaggacagttatcttgcaacatttgcagatggcgaaactgaggtgaggggggttaaatgacttgtccaagaccacagagctagcaagaggcagaaaggtgtcttgatccaggttgtgtggccccagagtccctgtccttgaccctattccatgtcccttcctgcaggtgggtgtggatacacacaggtgtgccagtctgtgtgtctgattctcttccccaggtgcctgaatccccacctctctgcatggtgatagtgtccccaaataat

SEQ ID NO: 134791 - DNA, 601 bp, Human
cctggagcaccgggcctggaggagctcacttgctggctgtgcaagggtgcagcctggctcctgggagccggggatggctgggagttcacctcagcaagccaggagcctgcagaggacttcagccccacccaggcttgctacagctgctccctgtgcctctctgcacatgccacccatcccgcctagtaggtctgggcattttccatgtgctggtgcacttgctggtgagccctgacaacaagcacactgttgttttatgtataccatgtatacctgtgtgcccagactagcatgtctgaaygttcttgccatggatgcaagtccacgtcaagtgcctatggggtctagacataggcacgcaccagctgctgctgtctgaatgctaacctgtaccaggtaccgtgctgctggctgtaggggttagcgctttccatctctacaacaagtctgcaaggtgaggacagttatcttgcaacatttgcagatggcgaaactgaggtgaggggggttaaatgacttgtccaagaccacagagctagcaagaggcagaaaggtgtcttgatccaggttgtgtggccccagagtccctgtccttgaccct

SEQ ID NO: 134792 - DNA, 601 bp, Human
ggggagggtgggtctcatctgagctgagcaactgaatacaaccagacgtgtcagcttcatttttatagatgaggaaatcgaggcccagtctctggggtgaagagattctcaaagtcacacaccagcaggcacagtcacaaagccaagtgtgcccccaggtctccttccatattccttccaggcccttgtgccttcacctgttcctgtgtctgtcctggatgcacgttgtctgactctaagaagctcccctgccaaccccatgtgcccactgcacctcaggcaggaggggtggaagccctcmtttcttgatgtttgctttttgcctctttgctagtaacatctgattctgagagctgggcccccactgggagaacctccctgtcatcccccaagccaagcccatgctcacctgctcctcacctgccctgggagcctagggtaccaagggtaccgaggaagccatgggtagtggggacaccatgggtactgagggtactgagggtcctgagggcttgaaggtggggtcctcagggatgtagacagtgctgttcccttcaggcatctacagagagaggatgcaactctgagggccctgtcccag

SEQ ID NO: 134793 - DNA, 601 bp, Human
aacggaagtgtggcggcgttgggttgagcgggctttttggaagtttgtggcggaggtgaggccgaggtgactgcagagcggctcgcgaggtgctcgggctgtgggactgggcccctgggagggagcggttctgtgggggaaaggaggctcctgtcctgacttggcgttctggtattttctctggcgtggaaagtaggcgcgctccgctgtctcccgccgcctgcctcagctttcgcggttccctcctaggggtgtgcctcagtcggagccccttctgttaaattcttcccccttggccgasggtgagctcttacttctgagaaatttcccttaaccttgctttgcatttgttgtccggtcgcggtctccatcaccagctgcttcgtgttatagtttttgtatttgcgctcacggcttgttaactgaagaacccggaagggaaggccgcggcgtttcccgccggcggggctctgccattctcggatcttggcttcagatctctgatgctccccagcgtctcttggcaaggaatctacttcgcgttcagggaattcacagccacccgcctctggtcttacctctggttttaggatgattttag

SEQ ID NO: 134794 - DNA, 601 bp, Human
gtgttttccctattataggggttcaataatttgttcaacaaacatttgttacctagtttgagctaggtactgtgctaagtgctggagatacaatgataaacaaaaccagctacggcccgtgtccttaggggacttatagtctagtgggagataacatttgttaatctgataattacacatgtaatattaaaaattggtgacagtatgtaagagagtttactggtgccatgagaggatgtactaggggaacgtttaacaacctatactgagcttttcttttcttttcttttcttttttttttgagacagagtctccctctgttgccaggctggagtgcagtggcgcgatctcggctcactgcaacctccgcctcctgagttcaagtgattctcctgcctcagcctcacaagtagctgggactacaggtgcgtgccgtcacgcccagctattttttttttttttttttttttttttttttttttgtatttttagtagagacggggtttcaccatcttggccaggaaggtctggatgtcttgacctagtgatccgcccgccttggcctcccaaagtgctgagattacaggcgtgagctactgcg

SEQ ID NO: 134795 - DNA, 601 bp, Human
tctccctctgttgccaggctggagtgcagtggcgcgatctcggctcactgcaacctccgcctcctgagttcaagtgattctcctgcctcagcctcacaagtagctgggactacaggtgcgtgccgtcacgcccagctattttttttttttttttttttttttttttttttttgtatttttagtagagacggggtttcaccatcttggccaggaaggtctggatgtcttgacctagtgatccgcccgccttggcctcccaaagtgctgagattacaggcgtgagctactgcgcctggcctaractgagcttttgaggagatgtggattgagctaagatctgaaggatttgtaggaattagtaataaaagattggggggcagtggatggaagcaggaatatttatttaagttccagatggaaacatgtggaagggcctgtggcagaaagaacttggagatttgaaggactggaagcaattctgcatggctggagcagagtgatgaaagggaggtaggcatgggtcagaacttgcaggacttattttatccttacttaagggttttggactgataaagcaatggaagccactgaagagctttaa

SEQ ID NO: 134796 - DNA, 601 bp, Human
aaacttccaagttctttgaatgaagcaagtataacattgaattaaacaaatataacattgatttttttatgctatctttatcaggtataaccttaaacctcataaagatagcatagaaaaaagaggatatagactaatgtaacttacgaatattgatataaaagtcttaaatattaggggacagattgcaacaccacatttaaaaaaagtacaccatgatcaagtgggatttaatagcaggaatacaaggttggttcagtatttgaaagtatattactataaagattatacgattatcttyatggatcagagaaagcctttgacaaaattcaacactcattcctaataaaaacttgagaaaaatcagaatgggtggctgtttcctttacatcataaaatgtatatatctaaattctagagtcagcatcttagtgggaaaccatagagacatttcctctaaggccgggaacaaagcaatgatgcctactgtctccattactatataatgttctgattggctagcctatgcatttaacctagagaaaacaatcacaggcataataatggaaaaataaaggctgagtgcagtggctcacaccca

SEQ ID NO: 134797 - DNA, 601 bp, Human
ataacattgatttttttatgctatctttatcaggtataaccttaaacctcataaagatagcatagaaaaaagaggatatagactaatgtaacttacgaatattgatataaaagtcttaaatattaggggacagattgcaacaccacatttaaaaaaagtacaccatgatcaagtgggatttaatagcaggaatacaaggttggttcagtatttgaaagtatattactataaagattatacgattatcttcatggatcagagaaagcctttgacaaaattcaacactcattcctaataaaarcttgagaaaaatcagaatgggtggctgtttcctttacatcataaaatgtatatatctaaattctagagtcagcatcttagtgggaaaccatagagacatttcctctaaggccgggaacaaagcaatgatgcctactgtctccattactatataatgttctgattggctagcctatgcatttaacctagagaaaacaatcacaggcataataatggaaaaataaaggctgagtgcagtggctcacacccataatcccaacgctttgggaggccaaggtgggcagatcacttgaggtcagga

SEQ ID NO: 134798 - DNA, 601 bp, Human
ggaacaactggatggacatttggaaaaaatagatgaaattagatgtgtttctcatattcaagagaaagctccaaatgaatcagaaatttaaatgtaaaaaacaaatctaaataaatgttagggctgggcacaggggcttatccctgtaatcccagcactttgggaggctgaggtgggaagatcgcttgagccacgaggttcagattacagtgagctatgattgtgccactgcacttcaacgggtgaaagtgagactctgtctcttaaaaataaataaataaataaataaataaataaatatgtatatgttagaagaaaacatggatgaatttctctttaagctcagtgcagtgaaaagctttctaactgtcatacaaagtatagatgcaagaaaagataagtttgtctacatataagttaaaaagtttgtgtggccagaaataccataagcagagtcaaaagacaaatggcaaactgggaaaaaatatttgtaacgtatcacagaaaaaggattaatatccctaattcataaataacttgtgggggtgggggggaagataaactgtattttaaaaaggcaaaaaacatgagaataatcact

SEQ ID NO: 134799 - DNA, 601 bp, Human
aagtgagactctgtctcttaaaaataaataaataaataaataaataaataaataagtatatgttagaagaaaacatggatgaatttctctttaagctcagtgcagtgaaaagctttctaactgtcatacaaagtatagatgcaagaaaagataagtttgtctacatataagttaaaaagtttgtgtggccagaaataccataagcagagtcaaaagacaaatggcaaactgggaaaaaatatttgtaacgtatcacagaaaaaggattaatatccctaattcataaataacttgtgggggtgggggggaagataaactgtattttaaaaaggcaaaaaacatgagaataatcactaaaagatatataaaaatggccttaaacataagaaaatatgctcaacttcactcataataagagaaaaataaattaaaataaaagatagtgatccacctgccttggcctcacaaagtgctgggattacaggcaggagccaccatgcctggccccatgtatatttttatgtgtataaacatgcatacatttcctggctctctccaatgaaagaaccatgaagcaaagatgccatagttgctcggtgcg

SEQ ID NO: 134800 - DNA, 601 bp, Human
aactcattctccacacaaggagcaaggatgatttttgaaaaatctatcatcccatttccttcttttctctttagtaacttccgttgcacttagagaaaagctaaacttcctaccatggcctgtaagattcttcataatctggtcctttcccgtttctcttcaaactcatcttctactactcttttctttattattctccagccatgttgatttttttttttttaagcaaggctttggcctcaaatatgccaagttctttgctgcttcttggacattgcacgtgatcatacttccatctggratatccttctctaacgcctttgaataattagctccttcttgtccgccaggtctctacttaaatgtcacctacttctgagaagcttccccttactaccctagaggaaatttccttcctttcctcacttattgtctatctcagcctcttatttggttcttttacaatttttttctgccatcctttcccctcctgctctgttatgaactctgagtcaaattactatgtctgttttgttcatctttataacatgcctaaggaaaataacatgctcaaaaagtatttgttcgatgaatgtatgtt

SEQ ID NO: 134801 - DNA, 601 bp, Human
atacttccatctgggatatccttctctaacgcctttgaataattagctccttcttgtccgccaggtctctacttaaatgtcacctacttctgagaagcttccccttactaccctagaggaaatttccttcctttcctcacttattgtctatctcagcctcttatttggttcttttacaatttttttctgccatcctttcccctcctgctctgttatgaactctgagtcaaattactatgtctgttttgttcatctttataacatgcctaaggaaaataacatgctcaaaaagtatttgttsgatgaatgtatgttcccaacttagtgctaagttataaacataaatgtttatagaatgagtaagaatagattttagtcttgacaatccaggatcatattaagatataccctcctctgtctaaaaattatggtgtttgtaatacttggcgtctctgaatgatctgaacgtgacagaagagtactttttcatattgagtgtttaggtcattggggtaaaagactgttgccagagacttgtacctttttctttctttgcagttgactaatctccttcagaatcaagcagtgaaaggaaaagttg

SEQ ID NO: 134802 - DNA, 601 bp, Human
gccggatcatgtggaaactcttatgtttaactgagaaaccgccaaactgttttccaatgtggctggattaggatgccaattttttcacatcctcatcaacacttgttattatctttttttttcagttttgatttattttcatcactttttctacatgatccagatattttaaaatgcaaagaaaattaactttaatgatatgttccaggatcggcactaaaaaaaaattttcagactgcaaatgaattatacaaatgaaaatatcaaatggagatccccttatccaaatgaaagcactcamcttattaaaagttcacaagtatttgtatagagcacattaaaaaagtcagcttgctaaatgttttgattttaaagaacgattgcagaagtctgaagaaaatagattagttattaaatttgggttactggacttctcaaaagctgtaagacctattagaaggttacttcatcctgtaattattaaaataataggtagatgaagaaaagatgacattttagtccctttattttggctaaattaagcactttttcaaagcccttaaccattgctgttctaagcaccgtagtaatcagtcgtttg

SEQ ID NO: 134803 - DNA, 601 bp, Human
ccaaatgaaagcactcaacttattaaaagttcacaagtatttgtatagagcacattaaaaaagtcagcttgctaaatgttttgattttaaagaacgattgcagaagtctgaagaaaatagattagttattaaatttgggttactggacttctcaaaagctgtaagacctattagaaggttacttcatcctgtaattattaaaataataggtagatgaagaaaagatgacattttagtccctttattttggctaaattaagcactttttcaaagcccttaaccattgctgttctaagcaccrtagtaatcagtcgtttgataattctgtttttttgtatttaactacaaacctgttcgtttttcctatttacctgtcaatgttgtaagacttgtttctgaaccccctgtttaaaacaataaggttccccctgctctgaggaagctggaacacttaggagacgtaagatatacacttgttgtatccagttggtggaatcgggggatttgcagaaagaaatagcgtctgagatcataggattactgatgctggaggtaagatggcaaacaaaaacttttatttgggggtaggtttttgagggtt

SEQ ID NO: 134804 - DNA, 601 bp, Human
aaagatgacattttagtccctttattttggctaaattaagcactttttcaaagcccttaaccattgctgttctaagcaccgtagtaatcagtcgtttgataattctgtttttttgtatttaactacaaacctgttcgtttttcctatttacctgtcaatgttgtaagacttgtttctgaaccccctgtttaaaacaataaggttccccctgctctgaggaagctggaacacttaggagacgtaagatatacacttgttgtatccagttggtggaatcgggggatttgcagaaagaaatagygtctgagatcataggattactgatgctggaggtaagatggcaaacaaaaacttttatttgggggtaggtttttgagggtttgtaatttgttgagggaaggaaaacttaagtgcccaacctagcatagtccttatttatgagtaagacctgttgttaaaaaacaaagaagcaggccgggcatggtgactcacacctgtaatcccagcactttgggaggctgaggtgaggatcgcttgagctcaggagtttgagaccaccctctgcaacatggtgaaaccccatctctaccaaaaatacaaa

SEQ ID NO: 134805 - DNA, 601 bp, Human
gttctaagcaccgtagtaatcagtcgtttgataattctgtttttttgtatttaactacaaacctgttcgtttttcctatttacctgtcaatgttgtaagacttgtttctgaaccccctgtttaaaacaataaggttccccctgctctgaggaagctggaacacttaggagacgtaagatatacacttgttgtatccagttggtggaatcgggggatttgcagaaagaaatagcgtctgagatcataggattactgatgctggaggtaagatggcaaacaaaaacttttatttgggggtagrtttttgagggtttgtaatttgttgagggaaggaaaacttaagtgcccaacctagcatagtccttatttatgagtaagacctgttgttaaaaaacaaagaagcaggccgggcatggtgactcacacctgtaatcccagcactttgggaggctgaggtgaggatcgcttgagctcaggagtttgagaccaccctctgcaacatggtgaaaccccatctctaccaaaaatacaaaagaaaaaaaattagccgggctcgtggcgcatgtcagtggtcacagctacttgggaggctgaggcagga

SEQ ID NO: 134806 - DNA, 601 bp, Human
gaaatgatttactatattctgtcctctaagactgttcatatagttttatttgcttgactgtatcttcttacagcaatttagtgtgttaagatacacataattaaatgttaatttagtgtgtttaatgctccaatctaagcattattggagtctcaaggtcgtgaaggctgggaaagtcaccctgctgctgcatcttttctttttttcttttttcttttttttttgagggagtagaatatacaagtgatgtatcctttaaccagtaattgtatttctgggaatctacattaaagaatgactscaacatacaagaaaatcctcacatatgaacatgttcaacacagaaatttgtgaccagtatgagcatacagtaatagagacatgtaaactatgtaagttaaggtagagccactccatgacatttatacctattaaaagtgaaatgtatacatcaaagatgaaaaattctaaccatataattaacaaagagattactatgttatataatactgtgattgcgtgtaggtttgttaaaaagaacaagaagggaatacccaagattatctaaaccagagataattgcttttatggttccttacat

SEQ ID NO: 134807 - DNA, 601 bp, Human
gtgaatagagtttgttttccacaatctcaccaacattgggtatcatcagaattttgattttgcgagtcgggtaggttaacaactgctatttcattgttttaaatggtatttatttgatcttgtttctcggtattgcaaaatcaaacttgaattggccctgtttttttgtcctcattaattttacaaagttatatctaaataagttgtaaagaaataaactttgtcattttcttctaccaggtgggatcagcaatatgtaatccaactcacctccatgttcaagtaagcatcatcttttccyttttctttgtatatcctgctttgtgaacttacttgctagaaattaaactatagcaaacgtaaacatcactctctcctgattgtaagaatattagtagttatgttttctgttacagattcacagattccctcctcactcctgcctcctttttggctttacttacttatttaaaacataactttattttttttataagaatgactttgcttaggtaaggttattggttcccttaaaggttcttcattagagaaaaatcaaaagggacagttataataatctattatctctttaattctctgc

SEQ ID NO: 134808 - DNA, 601 bp, Human
ttgttttccacaatctcaccaacattgggtatcatcagaattttgattttgcgagtcgggtaggttaacaactgctatttcattgttttaaatggtatttatttgatcttgtttctcggtattgcaaaatcaaacttgaattggccctgtttttttgtcctcattaattttacaaagttatatctaaataagttgtaaagaaataaactttgtcattttcttctaccaggtgggatcagcaatatgtaatccaactcacctccatgttcaagtaagcatcatcttttcctttttctttgtrtatcctgctttgtgaacttacttgctagaaattaaactatagcaaacgtaaacatcactctctcctgattgtaagaatattagtagttatgttttctgttacagattcacagattccctcctcactcctgcctcctttttggctttacttacttatttaaaacataactttattttttttataagaatgactttgcttaggtaaggttattggttcccttaaaggttcttcattagagaaaaatcaaaagggacagttataataatctattatctctttaattctctgctcccaagtttc

SEQ ID NO: 134809 - DNA, 601 bp, Human
aattgtcctataagctgcaagtttaaaacctatttattaggtgtcagctctctgccaggaactgtttagccttggggctaccgtgctgaaccagtcagacaatgtccctgctcttgtagaacttcaattttagtgagaagaggaaagaaaataaataacaagaaaaatgttatagtaaaagtgctatgcaggtaattcaaatggatgatctaccactgacagtatagctactttagattgggtcagggaaaacctctctcagatgtgctattttaactgaagcctgaatgataagatccawaatatatagatcagagaacattctcaggtagggaaataatacaaaggcagaagaacagtgtgacatgtctgagaaagaggattttgggttttttttgtttcattttgttttgtttttgagacagagtgtagctctgtggcccaggctggagtacattggcatgatctcagctcactgcatcttccacctcccaggttcaagtgattctcctgcctcagcctcctgagtatctggtactacaggtgcgcaccactacgcccagctaatttttgtatttttagcagagacagggtttgccat

SEQ ID NO: 134810 - DNA, 601 bp, Human
ggctggagtacattggcatgatctcagctcactgcatcttccacctcccaggttcaagtgattctcctgcctcagcctcctgagtatctggtactacaggtgcgcaccactacgcccagctaatttttgtatttttagcagagacagggtttgccatgttggccaggctggtctcaaactcctggcctgaagtgattcaccctcctcggtctctcaaagtgctgggattacagacatgagccactgtgcctggccaaggatttttgttttttctttctttctttttttttgagatggggtytcactctgttgcccagactggagtgcagtggtacgatctcggctcagtgcaacctccacctcctgggttcaagagattctcctccctcagcctcctgagtagctgagattgcaggcatgcgccaccacgcccagctaactttttgtatttttagtagcgatggggtttcaccatgttggccaggctggtcttgaactgacctcaggtgatccacctgcctcggcctcccaaagtgctgggatcacaggcgtgagccaccgtgcctggccggattttttgttttttaagcaaacatttgta

SEQ ID NO: 134811 - DNA, 601 bp, Human
agagacagggtttgccatgttggccaggctggtctcaaactcctggcctgaagtgattcaccctcctcggtctctcaaagtgctgggattacagacatgagccactgtgcctggccaaggatttttgttttttctttctttctttttttttgagatggggtctcactctgttgcccagactggagtgcagtggtacgatctcggctcagtgcaacctccacctcctgggttcaagagattctcctccctcagcctcctgagtagctgagattgcaggcatgcgccaccacgcccagctaaytttttgtatttttagtagcgatggggtttcaccatgttggccaggctggtcttgaactgacctcaggtgatccacctgcctcggcctcccaaagtgctgggatcacaggcgtgagccaccgtgcctggccggattttttgttttttaagcaaacatttgtaggatgttcattctgtgccaggggctattctaagcactttaaacctcacaaccctattttacctctactttatggatatggaaatcgagagacaaagaatttagttagtttggcttgagcaatttattagaggtggtttc

SEQ ID NO: 134812 - DNA, 601 bp, Human
ctaagactgagttcagaggcattccaccatttcaaggtcaagcactttgggaggccgaggcaggcagattgcttgagctcaggagttcaagaccagcctggatgacatggtaaaaacctatctctacaaaaagtacaaaaatagccaggcgcagtggctcatgcctgtagtcccaactacttgggaggctgaggcaggagaatcacttgagctcaggaggcggaggttgcagtgagctgagattgcacctttgcattccatcctgggcaatgggagtgaatccttgtctcaaaaaaaaaaatttttttttttttttttgagaagaggccagtgatgatgccctggaagctaagagaagaaaatttttcaagaaagaagtagttaattgtgtcagatctgagatgttcattaagatgggactttattgtttttgacaacttggaggtcatttgtgacccttgaaaaaataatctaatgttattgtgggggtgagggtagaaagaggatagaagcctgattgaattggattgtactgggaagagattgtgagataaaaaaggagaaattatgactatacacatttattttacgaaatcttgta

SEQ ID NO: 134813 - DNA, 601 bp, Human
agacagacagacaggagcagaaaattgggcagtagaatttctagtaaacacctgccttcagtgattgtatgagtttagcttgagttggtctacttgctcatcgtagcacctgtccttgtctctcactcaaaaaccatagctcataccttttttttgttgttgttgagacagggtctctctgttgcctaggctgaagtgcaatggcacaatcttggctcacggcaacgtccaccttccgggctgaagcaatcctcccacctcagcctcccaagtagctgggactataggaatgccaccacaycgggctgatttttttgtatttttagtagaggctggtcttgaactcctgggatcaagtgatgcgcccgccttggcctcccaaagtgctggcattacaggcatgagccactgcaccttatagctcataactttctgttgaatcttttaggctattggatgttgtcactgtgccatcaggtgaacttcgtcatgtggaaggcaccattattctacacattgtgtttgccatcaaattggactatgaactaggcagagaactcgtgaaacacttaaaggtagcatcaaacttgtaaggtgatct

SEQ ID NO: 134814 - DNA, 601 bp, Human
tgattgtatgagtttagcttgagttggtctacttgctcatcgtagcacctgtccttgtctctcactcaaaaaccatagctcataccttttttttgttgttgttgagacagggtctctctgttgcctaggctgaagtgcaatggcacaatcttggctcacggcaacgtccaccttccgggctgaagcaatcctcccacctcagcctcccaagtagctgggactataggaatgccaccacatcgggctgatttttttgtatttttagtagaggctggtcttgaactcctgggatcaagtgatscgcccgccttggcctcccaaagtgctggcattacaggcatgagccactgcaccttatagctcataactttctgttgaatcttttaggctattggatgttgtcactgtgccatcaggtgaacttcgtcatgtggaaggcaccattattctacacattgtgtttgccatcaaattggactatgaactaggcagagaactcgtgaaacacttaaaggtagcatcaaacttgtaaggtgatctgggtctcttttgaatgaaagtgtttgaacttaagccactgttatgccagttaatgacagga

SEQ ID NO: 134815 - DNA, 601 bp, Human
ttttaatagaggtggggtttcgccatattggccaggctggtcttcaactcctggcctcaagtgatctgcctgccttggcctcccaaagtgctgagattacaggcgtgagccactgcactggccttcctttgattttttttttcccccaaccatttaaaaccataaaaaccagtgttagctcatgggttgcacaaaaacaggtagtgggttggatttggccaacaggctgtatgtagtttgccaaccactgttctgtgcattacatcaggaggaacatagtattagctaccttactatttgwgaggctgaatcatttgcttttaagaaaatgaccattgattttcttcatttataggtacatatgtatccctttgtattagaaagaaatctataggatcatagttcgagatagtattcaaaatccttttcccaacaacatttcacagaaggttttcgttttcccatctattgatgattcttggcctaaatcagtaattataccaggaattcaaattttatatcttattttttttttcttttttttgtcctcacaatctgttcccaaggaattctaattttaattagaaaattttaattgcat

SEQ ID NO: 134816 - DNA, 601 bp, Human
tgagccactgcactggccttcctttgattttttttttcccccaaccatttaaaaccataaaaaccagtgttagctcatgggttgcacaaaaacaggtagtgggttggatttggccaacaggctgtatgtagtttgccaaccactgttctgtgcattacatcaggaggaacatagtattagctaccttactatttgtgaggctgaatcatttgcttttaagaaaatgaccattgattttcttcatttataggtacatatgtatccctttgtattagaaagaaatctataggatcatagttcragatagtattcaaaatccttttcccaacaacatttcacagaaggttttcgttttcccatctattgatgattcttggcctaaatcagtaattataccaggaattcaaattttatatcttattttttttttcttttttttgtcctcacaatctgttcccaaggaattctaattttaattagaaaattttaattgcatctttctttcggcattattagctggcattcttctgtaaaaagagcctctcctttccctattgttttgaatatcattatgcactcatgaacctttttaaattcaatg

SEQ ID NO: 134817 - DNA, 601 bp, Human
tttgtgtggacatacattttatttcttttgtgcatatatccaggagtagaactgctggcttatatgagaaatttatgtttatatttttaagaaactgcctgttttccaaaacggtatcattttacattcccactatcactatgtgagggttcctatttctctgtgtcttggccaacatttgttattgtctgtcttttttattatatccattctaatgggtatgaaacagtacctcattgaggtttaactttgcattttcttaatgactgatgataattgagcatcttttcatgtgctcatkaactgttctaataccttctttggtgaaatgtctattcaaatcttttgcccgttttttgagtgtgttgtttgtcttcttaattaaaattctttgtatattctactgacaagctcttttttattttttcaataactttgttatgaatggtgacaagttctttatcaggtatataattagcaaatattttttctcagtctgtgacttgtctttttattttcttaatggtatcttttgaagtacaaaagttttaaattttggtgaggtccagtttatcaattttttcttgtagaaattatgctt

SEQ ID NO: 134818 - DNA, 601 bp, Human
cagtctgtgacttgtctttttattttcttaatggtatcttttgaagtacaaaagttttaaattttggtgaggtccagtttatcaattttttcttgtagaaattatgcttttggtattgtatgtaagcaatctttacttaatccaaggtcttgaaatttttctatatgttttcctctaaaaatattacaatttttgctcttacatttggatttctgatccattcaaggacctatttttattttttattactattaaaaaatgttttttatgtctctcgagtcataaggacttttttgggggrtgcagtggcgcaatctgagctcactgcaaccttcgcctcccagattcaagtgattctcctgcctcaacctcccgagtagctgggattacaggtgtgtgccaccactcccagctaatttttgtactttacaagacagggtttcaccatgttggccagactgatcttgaactcctgacctcaagtgacccacctgcctcagtctcccaaagtgctggcattacaggcataagccaccacacccggccaagggacttactgttaaataggctgttatacttttaagatgtatgtaatgggacc

SEQ ID NO: 134819 - DNA, 601 bp, Human
gtggtggttcacacctgtaatcccagcactttgagagaccaaggtgggaggatcacttgaggccaggagtttgagactctcctgggcaacatagtgagacttcatctctccaaaaaaattaaaaattaaaaattaaaaaattagccaggcatggtatagtcccagctacttgggaggctaagccaggaggatccgttgagcctgggaaatcaaggctgcagtgagctatgattgcatcactgcactctagcctgggcaacagagagacccaatctttttttttttaaaaaaaaaaaaaaaagaaaaaagaaaatgtaagtaaatgacttccttttggttgctctcttctaggtaggacagcaaggagattccaataataacttaagtcccttcagcattgctcttcttctgtctgtaacaagaatacaaagatttcaggaccaggtatttttttaaaatgccattttgtttctttctgtagttggtaaaaaaaaaaaaaaaaaaaaaaaatcacagtaatctgtttttgttgtatccgttcctaaacaattttatccccttcctgccagcagcaaagctgcaataagacatgtatgtcccc

SEQ ID NO: 134820 - DNA, 601 bp, Human
atttgagtatgtattagtttgacagaggatatatgacagagattaggataatattgaaacattatagatccagtttgatggaatacttacttacgtattcttctatgtaagtttttcatttattccacttaatccaattgtttctgacctagaagtttgaatataagacagctttttcatgatttttccttcttcttccagaagtaaaccatttctagtttttgttttgttttgttttaatgctgttcctttacacagaagaaatttttttaggtcactgtagagcatcaagcttaaagartcatgcttaagaatttttactgaaaataaaacaaagaatcatgcttggtcgggcatggtggctcaagcctataatcccaacactttgggaggctgaggtgggcagatcacttgagctcaggagtttgagaccagcctgggcaacgtggcgaaacctcatctctacaaaaaacacaaaaattagccaggtgtggtggcacgcacctgcagtcccagctacttaggtgactgaggtggatcacttgagcccaggaagtcaaggctacagtgagctgtgtttgcaccactgcactccagcctg

SEQ ID NO: 134821 - DNA, 601 bp, Human
atgcttggtcgggcatggtggctcaagcctataatcccaacactttgggaggctgaggtgggcagatcacttgagctcaggagtttgagaccagcctgggcaacgtggcgaaacctcatctctacaaaaaacacaaaaattagccaggtgtggtggcacgcacctgcagtcccagctacttaggtgactgaggtggatcacttgagcccaggaagtcaaggctacagtgagctgtgtttgcaccactgcactccagcctgggtaacaaagtgagatcctatctcaaaaaaaaaaaaaaaaraagaagaatcatacttattggttcattgtttctgaagaaaccaaaatgggaaatgtacatttttttgacattattaccaaattatcactgacatctcaatcttaattactgaaacagttttcaaaaatttattttctcttgaataaaaaaatgctagatcatatctgaggttaaacaacttttctagtaattcctctaagtcttcttgatgttcaattgtttaatgtagctacacaccaagagtgtctgctgaaaatgtttatttgggaggctgatctaaatgtaaatctagtgttctaa

SEQ ID NO: 134822 - DNA, 601 bp, Human
ggcaacgtggcgaaacctcatctctacaaaaaacacaaaaattagccaggtgtggtggcacgcacctgcagtcccagctacttaggtgactgaggtggatcacttgagcccaggaagtcaaggctacagtgagctgtgtttgcaccactgcactccagcctgggtaacaaagtgagatcctatctcaaaaaaaaaaaaaaaaaaagaagaatcatacttattggttcattgtttctgaagaaaccaaaatgggaaatgtacatttttttgacattattaccaaattatcactgacatctcmatcttaattactgaaacagttttcaaaaatttattttctcttgaataaaaaaatgctagatcatatctgaggttaaacaacttttctagtaattcctctaagtcttcttgatgttcaattgtttaatgtagctacacaccaagagtgtctgctgaaaatgtttatttgggaggctgatctaaatgtaaatctagtgttctaatccagaactatgaagtaaatgtcagaatagttcttgagagttatcagtgtatttgatgatataaattaccctgcttaacagtgatattgttaaagaca

SEQ ID NO: 134823 - DNA, 601 bp, Human
aagaattttaactacaattcaagtgaaaattcagaatgggtctttttaacagcaactgctgtgcttctagaaactgagaaaggggttagggaagatcttttaagtttctagaaatcttcatgggcttttacattttaatttttagaataaaagttatgtatactgtcaggaatatggatattgtcaggtaatggatacctaagtagaattgatcctgtttgatgctgaaccttatatgtagcaatagtttaatgtgatctgtacttttaggctaataaacatggtatttatcctactaatraatcatctaagcacagaacaaggggaaagttgagtgattctgtctttccagatgattcacattatattctgattttttgagttttactcatatccaaacggttcttcatgctgcctgacatgcattgatatacttaaaagctgaagggtcacccaggaatattttatttattctgttctttttagatccatgagatgatcagacaagaaattttggagcaggtcctcaacagggttgttaccagagcatcttctcccatcagtcatttcttaggtattcaactttgaaagaatgaataaa

SEQ ID NO: 134824 - DNA, 601 bp, Human
cccagcatcattgatttccctaccatcttctgaatatgtcttaaacttacctttctcatacctttactcatacttttccctttatatatgtaggcctttctggtgctttgtgcatttaaatgttccccatcttttagaacctagtttaagttccttctcctcattgctttcctaatatataccaactcataatgagctcttcttcctttgaactcctatttaaactctccctttaccatttggtaggcaataaactatgtttggaattaatagatatttgatattgctctgtgatttaccyctttaattctttaaaaaaatttttttacttccaactaaattattaaaatttttgaagaaagactatgttttatacttttatgttcctaataggaccatattacgctggtgcatagtaaaaattcagaaatatttattgatttattttagcttagaagtaagaagatgtgtgctactacttatgtctaggcagtgtaatcggtttcttcctttcttttaggcagtttaatttttatagaaattgaaactatcatagaaaaaagctaaaattatcctggttacattggagaaaaagtatata

SEQ ID NO: 134825 - DNA, 601 bp, Human
ttgtgcatttaaatgttccccatcttttagaacctagtttaagttccttctcctcattgctttcctaatatataccaactcataatgagctcttcttcctttgaactcctatttaaactctccctttaccatttggtaggcaataaactatgtttggaattaatagatatttgatattgctctgtgatttacctctttaattctttaaaaaaatttttttacttccaactaaattattaaaatttttgaagaaagactatgttttatacttttatgttcctaataggaccatattacgctkgtgcatagtaaaaattcagaaatatttattgatttattttagcttagaagtaagaagatgtgtgctactacttatgtctaggcagtgtaatcggtttcttcctttcttttaggcagtttaatttttatagaaattgaaactatcatagaaaaaagctaaaattatcctggttacattggagaaaaagtatatatagcatcagtagaaatttgtattgcagtatacttgacttatttgagaaaggaaacaaaagacttcacatttctttctccgtatttttcttttatttcagttatcttt

SEQ ID NO: 134826 - DNA, 601 bp, Human
taattctttaaaaaaatttttttacttccaactaaattattaaaatttttgaagaaagactatgttttatacttttatgttcctaataggaccatattacgctggtgcatagtaaaaattcagaaatatttattgatttattttagcttagaagtaagaagatgtgtgctactacttatgtctaggcagtgtaatcggtttcttcctttcttttaggcagtttaatttttatagaaattgaaactatcatagaaaaaagctaaaattatcctggttacattggagaaaaagtatatatagmatcagtagaaatttgtattgcagtatacttgacttatttgagaaaggaaacaaaagacttcacatttctttctccgtatttttcttttatttcagttatctttagttatttgagacaactgattatagattctgtttttcagacctgctttcaaatatcgtcatgtatgcacccttagttcttcaaagttgttcttctaaagtcacagaagcttttgactatttgtcctttctgccccttcagactgtacaaaggctgcttaaggcagtgcaggtaagtcttcagattcccaagtaactt

SEQ ID NO: 134827 - DNA, 601 bp, Human
tatgctaaactgtgctatccagtatggtagccactgtcctcagtgtggctattgaatggaacatttgattgaaatgtggctagtccacattgtgttgtgctatacatgcaaaattcataccagattttgaaataaaagaatgtaaaaatctaataatttttaatattgattacatcttcagagagaattttgtatgtgttgggttacagaaaacattaaaatttgactttatctctttctcttttttaatgtggctactagaaaatataaaattacatacatggcttgcatttgtggttcrtattatatttctttctttttttttttttgagacggagtcagtctgtcacccaggctggagtgcagtggcgcgatctcggctcactgcaactcactgcaagctctgcctcccgggttcacgccattctcctgcctcagcctcccgagtagctgggactacaggcgcctgctaccgtgcctggctaattttttgtatttttagtagagatggggtttcattgtgttagtcaggaggtctcgatctcctgacctcgtgatccacccgcctcggcctcccaaagtgctgggattacaggcgtga

SEQ ID NO: 134828 - DNA, 601 bp, Human
tagctgggactacaggcgcctgctaccgtgcctggctaattttttgtatttttagtagagatggggtttcattgtgttagtcaggaggtctcgatctcctgacctcgtgatccacccgcctcggcctcccaaagtgctgggattacaggcgtgaaccaccacacccggcccatattatatttcttttggatagcacggtgctagatattgtgccaaaatgctttacatttattatctcatttaatcttcacagcagtcctctgaggctagatactattattatcccattttcttacgtcaktgtatttactttgcacaggaacatatattacaccttgtaatctgggaaaacaaaactttttataataatctggtaatctaggctttggagcaataaaattgtcttcataatttaaatgatgtactataagatttataaataggagacatttatatataacagtttgactaggaatcctcactttattgctttggtataactacataaagctttgtctataacatatagcatagattaaatattaggaacactaggtatcatttgtgtgttattatccccattttaaagacagggaaactg

SEQ ID NO: 134829 - DNA, 601 bp, Human
gtcctctgaggctagatactattattatcccattttcttacgtcagtgtatttactttgcacaggaacatatattacaccttgtaatctgggaaaacaaaactttttataataatctggtaatctaggctttggagcaataaaattgtcttcataatttaaatgatgtactataagatttataaataggagacatttatatataacagtttgactaggaatcctcactttattgctttggtataactacataaagctttgtctataacatatagcatagattaaatattaggaacactagrtatcatttgtgtgttattatccccattttaaagacagggaaactgaggctgagccaggttaaataacttgcccaaggttaaataaccaagaaagggtggaagaaggatttggcctcaggcagtatgaactacattactgtgatgcctggagtaaggattaggaattcttggtctataattgctgattttattatgtaatttacacaaaggatgtcagttctttgtcatgtccatttctaaacaaaagactgtcttcctctcaacctttctagaatttgtggaatagtgagattcttctag

SEQ ID NO: 134830 - DNA, 601 bp, Human
tgtaatctgggaaaacaaaactttttataataatctggtaatctaggctttggagcaataaaattgtcttcataatttaaatgatgtactataagatttataaataggagacatttatatataacagtttgactaggaatcctcactttattgctttggtataactacataaagctttgtctataacatatagcatagattaaatattaggaacactaggtatcatttgtgtgttattatccccattttaaagacagggaaactgaggctgagccaggttaaataacttgcccaaggttawataaccaagaaagggtggaagaaggatttggcctcaggcagtatgaactacattactgtgatgcctggagtaaggattaggaattcttggtctataattgctgattttattatgtaatttacacaaaggatgtcagttctttgtcatgtccatttctaaacaaaagactgtcttcctctcaacctttctagaatttgtggaatagtgagattcttctagctattgaagaagtcttagaccttttaaataaaattatgtatattgttactactggattctagtggcttgaaataagcagtg

SEQ ID NO: 134831 - DNA, 601 bp, Human
tattttaatttgaaatatttaaatatactataaatttgccagtcttaagactaagtcctttttttttgctttgttaatgattacaagtttacttcctgcctctcatacaaacccatacccttaatttattgcctatagtttcaaatttgtgtttacctaaagtggtatgaaaactttaagctacctcagatacagtttagcacaaaaatcttttagatagcttcagttttttctctttttacaattgtgttacctctaatttatcagaaattggtttgagagactgactttccaaacattkttccaaacttagttttttttttttctttgggacagagtctcgctctgtcacccaggctggagtgcagtggcacaatctcggttcactgcagcctccatcctccatctcctgggttcaagcagttctcctgcttctcaacctcccaagtacctgggattacagccatgcaccaccatgcccagctgatttttgtatttttagtagagatgggatttcaccatgttggccaggctggtcttgtactcctggcctcaagtgatccacctgtctcggcatcccaaagtattgggattacaggcg

SEQ ID NO: 134832 - DNA, 601 bp, Human
atactataaatttgccagtcttaagactaagtcctttttttttgctttgttaatgattacaagtttacttcctgcctctcatacaaacccatacccttaatttattgcctatagtttcaaatttgtgtttacctaaagtggtatgaaaactttaagctacctcagatacagtttagcacaaaaatcttttagatagcttcagttttttctctttttacaattgtgttacctctaatttatcagaaattggtttgagagactgactttccaaacatttttccaaacttagttttttttttttctttgggacagagtctcgctctgtcacccaggctggagtgcagtggcacaatctcggttcactgcagcctccatcctccatctcctgggttcaagcagttctcctgcttctcaacctcccaagtacctgggattacagccatgcaccaccatgcccagctgatttttgtatttttagtagagatgggatttcaccatgttggccaggctggtcttgtactcctggcctcaagtgatccacctgtctcggcatcccaaagtattgggattacaggcgtgagccaccatgcctggcctaact

SEQ ID NO: 134833 - DNA, 601 bp, Human
cccaaagtattgggattacaggcgtgagccaccatgcctggcctaacttagtttttataaaagcaacttctttttctttttgcactgggttttcaacagtttactgaacgtctgattaaatcactagttattatgacagtacagctaagagaaatacaactactgacttgtgattagcatataactcacccagaggatattgtggtagcatatgtgaaaacaacattcatctttctgtacatttccatcagagctcttagatgcctaggtgcactatcaatgagcagtaatattttgagargaatctttttttttctgagcagtaggtctcaacagtgggcttaaaatattcagcaaaccatgctataaacagatgtgttatcatgcaggctttgcttttccatttataaagcacaggcagagtagatgtagcataattcttaagggccctaggatttttggaatagtaaatgagcattgatttcaacttaaagtcagcagctacattaacccctaacaagacagtcagcctgtcctttgaagccaggcattgacttctcctccctagctaggcaagtcccagataaagtcttcttccaat

SEQ ID NO: 134834 - DNA, 601 bp, Human
atcttcacccttatttagctctaaagtaaaaaaaattaacatgaagtggatcatagacttaaacctattagaatattgctgttcatttattcatcagtcttagtatatcattggtatataaaaataccttatgtagtgataaaacttgtcatatttgttgcaagtgtatgccagattgccatttgctttttttttaatatgatccttttacacttaaataataatttttggttactaaatctattgattttcttcctctgagatgtcttctattacttttttttttttttttaagagacaragtcttcctctgttatccaggctggagtgcactagtgcagtctaactcactgcagcctccagctcctaggctcaaataatcctcttgcctcagccccatccccaaacgattgggaccataggcacaagccactgcacccagctaatttttctgtttgtttttttttttaaccttttgtagagacagggtctcactttgttgcccaggatggtctcaaatgccctggcttcaagcgatcctcctgcctcagtcttccaaagtgctgggattaaaagcatgagctaccgtgcccggcccatc

SEQ ID NO: 134835 - DNA, 601 bp, Human
actgcagcctccagctcctaggctcaaataatcctcttgcctcagccccatccccaaacgattgggaccataggcacaagccactgcacccagctaatttttctgtttgtttttttttttaaccttttgtagagacagggtctcactttgttgcccaggatggtctcaaatgccctggcttcaagcgatcctcctgcctcagtcttccaaagtgctgggattaaaagcatgagctaccgtgcccggcccatctttattattattttatctgtagaaagtccaaatccttccaatgaatatwcactaacattttctttgaggtttttttttttatgcatttgtttttgacgtttagctacttaattcatcctgaatttgtatgataatatatatgaggagcttttcccccaagctaaccatttgttcagacatcattgcctccttaatgtgtactatgtatctctgtatgccattttaaaattttgcctgtagatttttgtgccaagacaaagtgtctttttattattattacacattcataaaatattttaattgctgttaggattaattttcctttgttccgttcctttcccctttcccc

SEQ ID NO: 134836 - DNA, 601 bp, Human
caggcatgagccaccgtgtctggcctgtttcttttctttaaacaaaaaaatttttttgatcaattctcatttgcttttactcacagatgaactgtataacctcttttccaggttccagaatgaaagttctccccaggattttttttttttttaagacagagttttgctctattgcccaggctggagtgcactggtgtgatctcagctcactgcaaccttcatacctcagcctcccgagtagctgtgattacaggcatgtgccaccacacctggctaatttttgtattttttagtagagacrgggttttgctgtgttggccaggctggtctcgagctcttggcctcaagtgatccgcctgtctcagcctcccacagtgctgggattacaggtgtgagttacttcacctggcttccccaggattttactctgagcagttcttaactaagactaggacattttgggtgggaaaaaaatatggtcatttatattagggcatttaggactgtcaaatatggtctcaataggaaaaaactgagaagaggataaagaaagtgttatttttaagttatgattgtccagatcactagtatctctgttaaa

SEQ ID NO: 134837 - DNA, 601 bp, Human
ttttgatcaattctcatttgcttttactcacagatgaactgtataacctcttttccaggttccagaatgaaagttctccccaggattttttttttttttaagacagagttttgctctattgcccaggctggagtgcactggtgtgatctcagctcactgcaaccttcatacctcagcctcccgagtagctgtgattacaggcatgtgccaccacacctggctaatttttgtattttttagtagagacggggttttgctgtgttggccaggctggtctcgagctcttggcctcaagtgatcygcctgtctcagcctcccacagtgctgggattacaggtgtgagttacttcacctggcttccccaggattttactctgagcagttcttaactaagactaggacattttgggtgggaaaaaaatatggtcatttatattagggcatttaggactgtcaaatatggtctcaataggaaaaaactgagaagaggataaagaaagtgttatttttaagttatgattgtccagatcactagtatctctgttaaagtgcttatttcttctctttgattcctcttaggggttttatgatgttcttcgaa

SEQ ID NO: 134838 - DNA, 601 bp, Human
ctgtgttgtattcagcattgtttggcctggtataagaatacagtcatacccttacagcagggagaggaggaagaggaggaggaagaggcattctacgaagacctagatgatatattggagtccattactaatagaatgattaagagtgagctggaagactttgaactggtaattgctaagtcctcagctgtattgaatgatggagttctttagtagcttgttaatttttatcttgtgtcttttaggataaatcagcagatttttctcagagcaccagtattggcataaaaaataatatctstgcttttcttgtgatgggagtttgtgaggttttaatagaatacaatttctccataagtagtttcaggtaaggttttgctataactccatttgtaatttgatgaattctccattttatttacatatttttactgtagcagtattctaggcagtaaacagaccacagacgatgacactgtctcttaaatgagcacctagtctaagactaaactgtgttctttccactagagagcgctgaagtatatgcttaccaggcctataaaatgaaagccttccagcagggtttcacttactcagaatt

SEQ ID NO: 134839 - DNA, 601 bp, Human
tatatgcttaccaggcctataaaatgaaagccttccagcagggtttcacttactcagaatttcccagaccctgaattcaagaactcctaattttaacatggaaattttgattggtggtagtattggactttaatactctgcagggactggtataaataagggaggggaggccaggtgcggtggctcacgcctgtaatcccagaactttgggaggccaagctgggtgtatcacttgaggtcaggagttcaagaccagcctggccaacatggtgaaaccccatctctactaataatgtaaaamttagccaggtgttagtgcctgggaactgtagtcctagctactcgggaggctgaggcaggggaatcacttgagcctgggaggcggaggttgcagtgagccaaggtcacaccaggggaaacaaaacccagatagattgctgtgacctgggagtattatattaatgaagttctattcatttataatgttacgtctaaaatatgacatttaaagaagcattgtgattattatcatatgtaaaagtaaaccacaatattctgatgtttgtccttagcggtctcttttttgttttttacagtaaga

SEQ ID NO: 134840 - DNA, 601 bp, Human
gaaagccttccagcagggtttcacttactcagaatttcccagaccctgaattcaagaactcctaattttaacatggaaattttgattggtggtagtattggactttaatactctgcagggactggtataaataagggaggggaggccaggtgcggtggctcacgcctgtaatcccagaactttgggaggccaagctgggtgtatcacttgaggtcaggagttcaagaccagcctggccaacatggtgaaaccccatctctactaataatgtaaaacttagccaggtgttagtgcctgggamctgtagtcctagctactcgggaggctgaggcaggggaatcacttgagcctgggaggcggaggttgcagtgagccaaggtcacaccaggggaaacaaaacccagatagattgctgtgacctgggagtattatattaatgaagttctattcatttataatgttacgtctaaaatatgacatttaaagaagcattgtgattattatcatatgtaaaagtaaaccacaatattctgatgtttgtccttagcggtctcttttttgttttttacagtaagaataggtttgaggacattctgagctt

SEQ ID NO: 134841 - DNA, 601 bp, Human
gcggtggctcacgcctgtaatcccagaactttgggaggccaagctgggtgtatcacttgaggtcaggagttcaagaccagcctggccaacatggtgaaaccccatctctactaataatgtaaaacttagccaggtgttagtgcctgggaactgtagtcctagctactcgggaggctgaggcaggggaatcacttgagcctgggaggcggaggttgcagtgagccaaggtcacaccaggggaaacaaaacccagatagattgctgtgacctgggagtattatattaatgaagttctattcayttataatgttacgtctaaaatatgacatttaaagaagcattgtgattattatcatatgtaaaagtaaaccacaatattctgatgtttgtccttagcggtctcttttttgttttttacagtaagaataggtttgaggacattctgagcttatttatgtgttacaaaaaactctctgacattcttaatgaaaaagcgggtaaagccaaaactaaaatggccaacaagacaagtgatagtcttttgtccatgaaatttgtgtccagtcttctcactgctcttttcaggtaaggttctgctaga

SEQ ID NO: 134842 - DNA, 601 bp, Human
agcctgggaggcggaggttgcagtgagccaaggtcacaccaggggaaacaaaacccagatagattgctgtgacctgggagtattatattaatgaagttctattcatttataatgttacgtctaaaatatgacatttaaagaagcattgtgattattatcatatgtaaaagtaaaccacaatattctgatgtttgtccttagcggtctcttttttgttttttacagtaagaataggtttgaggacattctgagcttatttatgtgttacaaaaaactctctgacattcttaatgaaaaagckggtaaagccaaaactaaaatggccaacaagacaagtgatagtcttttgtccatgaaatttgtgtccagtcttctcactgctcttttcaggtaaggttctgctagagtgcttaaagacagccactccctgaggatcgtatacctacctaggctcacttgtttcacctcgtttggattgtttacagtaagaaataagtcaggaggttttatttttcttgaaataaaagctggacaatcctaggtaggtactttaagtaggtaccttgaattattaaaggacaaatgagaaacagtgggccaa

SEQ ID NO: 134843 - DNA, 601 bp, Human
gaggttgcagtgagccgagatcatgccattgcactccagcctgggcaacaagaacaaaattctgcctaaataaataaaaaggtagggggggtgactgaattaaaaatacaaagggacaaaaaaaaccaaacctaaaagactaagactgacatttaaattttatcaaagtaaaggatttggggagggagagaaaatgaggaaccactaagaataacgattataaaagggcagccatagcagtgactatagcttgggctgcctagagagtctgccagtcggaacttactggcaagctctgttrggtgctgctgttctgaacaatttctagaaagcttaattccatataccaatagcagtaagggaatcttcctttttctttctctctctctgtctctctctagggatagtatccaaagccaccaagaaagcctttctgttctcaggtccagcaatgagtttatgcgctatgcagtgaatgtagctctgcagaaagtacagcagctaaaggaaacagggcatgtgagtggccctgatggccaaaacccagaaaagatctttcagaacctctgtgacataactcggtaagccactcccacccctt

SEQ ID NO: 134844 - DNA, 601 bp, Human
ggattacctgaggttgggagttcgagaccagtctgaccaacatggagaaaccctatctctactaaaaatacaaaaattagcctggcatggtggcacatgcctgtcataccagctactcgggaggctgaggcaggagaattgctcgaacctgggaggcggaggttgcagtgagcctagattgtgccattgcactctagcctgggcaacaagagcgaaactccatcttaaaagagtgaaaaaaagtgcagtcattgacatagggtcttttttctagtcttgccttcccctggcgccccccccmcctttttttttttgttgttgttgttgttttggctttttttttggctttttttgagagagtctcgctctattgcccagggtggaatgccgtggtgcaatctcggctcactacaaccccttcctcccaggttcaagcagtccttccactgcagctttctgagtagctgggactacaggtgcacaccaccatgcccaactactttttaatttttaattttagtttattttatttactactttttttggagacagggtcttgctctgtcacccaggctagagtgcagtggcgtgatcttggctt

SEQ ID NO: 134845 - DNA, 601 bp, Human
attacctgaggttgggagttcgagaccagtctgaccaacatggagaaaccctatctctactaaaaatacaaaaattagcctggcatggtggcacatgcctgtcataccagctactcgggaggctgaggcaggagaattgctcgaacctgggaggcggaggttgcagtgagcctagattgtgccattgcactctagcctgggcaacaagagcgaaactccatcttaaaagagtgaaaaaaagtgcagtcattgacatagggtcttttttctagtcttgccttcccctggcgccccccccacctttttttttttgttgttgttgttgttttggctttttttttggctttttttgagagagtctcgctctattgcccagggtggaatgccgtggtgcaatctcggctcactacaaccccttcctcccaggttcaagcagtccttccactgcagctttctgagtagctgggactacaggtgcacaccaccatgcccaactactttttaatttttaattttagtttattttatttactactttttttggagacagggtcttgctctgtcacccaggctagagtgcagtggcgtgatcttggcttac

SEQ ID NO: 134846 - DNA, 601 bp, Human
tgaggcaggagaattgctcgaacctgggaggcggaggttgcagtgagcctagattgtgccattgcactctagcctgggcaacaagagcgaaactccatcttaaaagagtgaaaaaaagtgcagtcattgacatagggtcttttttctagtcttgccttcccctggcgccccccccacctttttttttttgttgttgttgttgttttggctttttttttggctttttttgagagagtctcgctctattgcccagggtggaatgccgtggtgcaatctcggctcactacaaccccttcctccsaggttcaagcagtccttccactgcagctttctgagtagctgggactacaggtgcacaccaccatgcccaactactttttaatttttaattttagtttattttatttactactttttttggagacagggtcttgctctgtcacccaggctagagtgcagtggcgtgatcttggcttactgcaacctcggcctccccggttcaagtgatcctcctgcctcagtctcccaagtagctgggattacagggcaccaccatgccctgctaatttttgtatttttagtagagacagggtttcaccat

SEQ ID NO: 134847 - DNA, 601 bp, Human
tttagtttattttatttactactttttttggagacagggtcttgctctgtcacccaggctagagtgcagtggcgtgatcttggcttactgcaacctcggcctccccggttcaagtgatcctcctgcctcagtctcccaagtagctgggattacagggcaccaccatgccctgctaatttttgtatttttagtagagacagggtttcaccatgttggccaggctggtctcgaactcctgacctcaggtgatccaccaccctggcctcccaaagtgctgggtttacaggcgtgagccactgcmcctggcccttattttttttttttaattttctgtagagataggatttcaccatattgcccaggctggtcttgaactcctgggctcaagcgatacgcccatctcagcctcccaaagtgctgggattacaggcctgagccactgtggcttttgttttttcgtttgtttttttgttttgttttgtttttgtttttgtttttgtttttccatttaaccctgagtggacacagcacatgtttcagagagcacggggttgcgggtaaggtcacagatcaacaggatcccaaggcagaagaatttttc

SEQ ID NO: 134848 - DNA, 601 bp, Human
aagaacactccacagcaccttcaaaatacacacttctttttaggtgcacatggtgtattcaccaagatgagccatattttgggccataaaactcagcaaattaaaaaaaagtagaaattctctgaccaaacagaattaaagaagaaagcagtaacagaaagatatctagataatccccatatattagaaattaaatgcatttttaaatagcccatagtcaaaaagtcgtcagggaaattagaaaacatcttgaatagaatggaaacaaacagacaacatgtcaaaagatatgatccagccraagtgctattgaggaaattaaagcagttagtgatttaaaaatctcagatctcccatataaacttccacattaagaaaatagaaaaagaagagcaaattataatgaaagtaatcagaaggaaggaaatagacaaaagcacaactatgaagaagcagaaaattaaaatagaaaacattaaaagaaagctggttctttgagaagatcaataaatttaatgaactttagccagactaatcaggaaaagagaagacacattacaaattgcagaattgaggaagaagggacatcactactgatcct

SEQ ID NO: 134849 - DNA, 601 bp, Human
agaaggaaggaaatagacaaaagcacaactatgaagaagcagaaaattaaaatagaaaacattaaaagaaagctggttctttgagaagatcaataaatttaatgaactttagccagactaatcaggaaaagagaagacacattacaaattgcagaattgaggaagaagggacatcactactgatcctacagatgctaaaaaatagataatagaatattaacgattttatgccagtaaacttttaagtttaatggacagatttcttgaaagctcactcaacaaaaaataggcaacctggccrggcgtggtagctcacatctgtaatcccagcacttttgggaggccgaagcaggtggatcacctgaggtcagcagttcaagaccagtctggccaacatggtgaaaccccagctctactaaaaaaaatacaaaaattagctgggcgtggtggtatgcacttgtagtcccagctactcaggaagctgaggcaggaagaccacttgaatctgggaggtgtgagtttgcagtgagatcaccccactgcactccagcctgggtgacagagtgagactctgtctcaaaaaaaaaaaaaaaacctgagt

SEQ ID NO: 134850 - DNA, 601 bp, Human
aagatcaataaatttaatgaactttagccagactaatcaggaaaagagaagacacattacaaattgcagaattgaggaagaagggacatcactactgatcctacagatgctaaaaaatagataatagaatattaacgattttatgccagtaaacttttaagtttaatggacagatttcttgaaagctcactcaacaaaaaataggcaacctggccgggcgtggtagctcacatctgtaatcccagcacttttgggaggccgaagcaggtggatcacctgaggtcagcagttcaagaccagyctggccaacatggtgaaaccccagctctactaaaaaaaatacaaaaattagctgggcgtggtggtatgcacttgtagtcccagctactcaggaagctgaggcaggaagaccacttgaatctgggaggtgtgagtttgcagtgagatcaccccactgcactccagcctgggtgacagagtgagactctgtctcaaaaaaaaaaaaaaaacctgagtaatcttatctctattcaaaaaaacctgagtaatcttatctctattcaaagaaattgaatttgtggttcaaacttttttcacaaaa

SEQ ID NO: 134851 - DNA, 601 bp, Human
acattacaaattgcagaattgaggaagaagggacatcactactgatcctacagatgctaaaaaatagataatagaatattaacgattttatgccagtaaacttttaagtttaatggacagatttcttgaaagctcactcaacaaaaaataggcaacctggccgggcgtggtagctcacatctgtaatcccagcacttttgggaggccgaagcaggtggatcacctgaggtcagcagttcaagaccagtctggccaacatggtgaaaccccagctctactaaaaaaaatacaaaaattagcygggcgtggtggtatgcacttgtagtcccagctactcaggaagctgaggcaggaagaccacttgaatctgggaggtgtgagtttgcagtgagatcaccccactgcactccagcctgggtgacagagtgagactctgtctcaaaaaaaaaaaaaaaacctgagtaatcttatctctattcaaaaaaacctgagtaatcttatctctattcaaagaaattgaatttgtggttcaaacttttttcacaaaacttaagatctaggtctattccgtggtaaattcatccaaacatttaagggagaa

SEQ ID NO: 134852 - DNA, 601 bp, Human
ggtagctcacatctgtaatcccagcacttttgggaggccgaagcaggtggatcacctgaggtcagcagttcaagaccagtctggccaacatggtgaaaccccagctctactaaaaaaaatacaaaaattagctgggcgtggtggtatgcacttgtagtcccagctactcaggaagctgaggcaggaagaccacttgaatctgggaggtgtgagtttgcagtgagatcaccccactgcactccagcctgggtgacagagtgagactctgtctcaaaaaaaaaaaaaaaacctgagtaatctyatctctattcaaaaaaacctgagtaatcttatctctattcaaagaaattgaatttgtggttcaaacttttttcacaaaacttaagatctaggtctattccgtggtaaattcatccaaacatttaagggagaagtaatgtaaattctgtgcaaattcttccaggaaataggagagaacatattccacctcatttaattaatgaggtcagcattaccctgataccaaaccagacccagaccattgcaagaaaactgcatagcaatatccctgatgaatatagagtctgctgtgttaaaggca

SEQ ID NO: 134853 - DNA, 601 bp, Human
gagaggctttgcaaaggaactgttagcaggggcagctggtaagaatgggcagacagtgaccaagtaggagaagaattttttctgggtcatacaggcaacaggacatagctctcagaatggaagataatgtatttaaaaggaccctagtgaggataggtatttagccaccccaacctgcaatactcattacttctaaggaccactgtttgagttgatgtaaacagaaaggagtcttcaaggcatagagtctgtgtttttgttttctgagtctgtggtataatttggcttggtctgacagacwacgtaaacactggacaataaagtttgttagtttctaaccaatagttgtcaaaatatcaggatgttctatcacaggagttttttatttaacaagtaattctgaagttcctaccatgtgccagaaacagttctaggtgctggggatgtagcagggaacaaaagagacaaaatattcctatccttatggagcttacattatagtagaaagacactgacaaataatcaaatacatagttatttcaggtaacagggaaggtatataagcattgctgggtttggtgccttttctaagcctgagatc

SEQ ID NO: 134854 - DNA, 601 bp, Human
cttggtctgacagacaacgtaaacactggacaataaagtttgttagtttctaaccaatagttgtcaaaatatcaggatgttctatcacaggagttttttatttaacaagtaattctgaagttcctaccatgtgccagaaacagttctaggtgctggggatgtagcagggaacaaaagagacaaaatattcctatccttatggagcttacattatagtagaaagacactgacaaataatcaaatacatagttatttcaggtaacagggaaggtatataagcattgctgggtttggtgccttktctaagcctgagatcaatggataggctccagggagctgtgagccaccagaaattgggtacatagttcattatctacattttgcatggggttggaacggaaagagtcagttttcaggagcattctcagagaggtttatggtcaaaaacagcttaggaaactactgctcaattcaggtgtattttcagattttatcctcttagaattttggtagctttgaattctttctgtcctagtcttaggagtctctgactagatgcctcttcttcctgataggaacgtgtctgctaacattgcttgct

SEQ ID NO: 134855 - DNA, 601 bp, Human
aggaaactactgctcaattcaggtgtattttcagattttatcctcttagaattttggtagctttgaattctttctgtcctagtcttaggagtctctgactagatgcctcttcttcctgataggaacgtgtctgctaacattgcttgctgtgtgtgccttcctttctcagaggtccttgttgaatttacttagcagtcaagaggaagattttaatagcaaagaagccctcctgctagtcacggttcttaccagtttgtccaagttactggagccctcctctcctcaggtactagtaccgctmacttaatcccatttagcattcctcagaaggcaaggattattgcatcataaaagtgtatatctaaatgtcctcttgaaattgagcttattttacataatgtgtttaattatacacctgagttaatataagacctataagatgtattctttcctgtgtaatgcgtctaccacagcatacttacatgcagccatacagggcaagaacatactgcttttgttttgtttgttcagggtagagtgaaacaccacagaaagaatcctgtgttgatctttggtgccttcaaccttcttaaacctgtgt

SEQ ID NO: 134856 - DNA, 601 bp, Human
tccttgttgaatttacttagcagtcaagaggaagattttaatagcaaagaagccctcctgctagtcacggttcttaccagtttgtccaagttactggagccctcctctcctcaggtactagtaccgctcacttaatcccatttagcattcctcagaaggcaaggattattgcatcataaaagtgtatatctaaatgtcctcttgaaattgagcttattttacataatgtgtttaattatacacctgagttaatataagacctataagatgtattctttcctgtgtaatgcgtctaccacarcatacttacatgcagccatacagggcaagaacatactgcttttgttttgtttgttcagggtagagtgaaacaccacagaaagaatcctgtgttgatctttggtgccttcaaccttcttaaacctgtgttctttgccactcttggtgtttacttcttttctaagaagaaaatttgttaattatgaagaaggcagttgacattcagcagttgactttctcagcacagttacctggtactgactttggaggaaattcaaccaaagatgattaattcagaaagtgtaactatagtcccaaagca

SEQ ID NO: 134857 - DNA, 601 bp, Human
tttttttgagacagagtctcgctctgtctcccaggctggagtgtagtggcgccatctcagctcactgcaggcgccgccttccgggttcacgccattctcctgcctcagcctcccaagtagctgggactacaggcgcctgccacaacacccggctaattttttgtatttttaatagagacggggtttcaccgtgttagccaggatgatctcgatctcctgacctcgtgattcacccgcctcggcctcccaaagtgctgggattacaggtgtgagccaccgcgcctggccaaaaatttttaawtttaattttgaatgggtaataaagtcctatgatttgaaaaccagagattatcaagagatttatggtaaatggtgtcccccacccatgtcctccatctgttcagttcctcctctccccaaataagtaaacacctttagttttttgtgtccttcaaccttctttattcccttccaagtaaatatagagttttattcccaatcctacccctcttcacacaaaaacttgttctgcatcctgcttatttcattgagcacggtattctgaagatcttttaatatcagtttgtagagagctttcagt

SEQ ID NO: 134858 - DNA, 601 bp, Human
tagtaggtaaaacaaacctaagtgttcatcagcagtagaaaggataaaagaattatgatatattcacacagtggaatcctatacagcaaataagcatgaacaaactacatgtacacacaacttggagaggatctcacaaatgtactgtaaaacaaaagaagccagacacaagaaagggtacttactgtagaattccgtttagatgaagttcaaaattagacaaaatttatctgtgatgttagaagtcaggatagcagtttccttggcggggcaagttaggagggagtccctagaatactcrtaatgtacttgatctggatgctagttacacagtaatcttaactaatgatgggaaatgtctgccttctttgggcatgtggataaagaggcatcattgcagactagctgcttggctgtagtatgtgtaacactgggatgttgtgcctgagacacgacaagctacctcctgttctggttaggcactccaccccacacaccctgtacacatacctgagggacctgactgggttataacttaacttttttttttttttttgagacagagtttcactcttgttgcccaggcaggaatgcaatggca

SEQ ID NO: 134859 - DNA, 601 bp, Human
agtgcagtgagggcactttcagggaagtggaaggacgtggctttgtaagtgtcatttggtcctaaataccatcagattcctgcagtacttgaatctcctttactgtttgcttaaaccagttttttaacctcaccactattgacatgttgcgctagatagttctttgttgtgggacctgttctgtgcattttgggatgttgagtagcatccctggcctccacctaccagatgccagtagcagccccctagttttaacagccaaaaatgtctccagaaattgccagttgtccttaagggacaraatcacccctggttggaaagaggaagaaacgagagatctactgtctcctaaggccacttagtcatgcagtaaatgtatcacagggctgttactgatctttgaggaatcaaagagaatgggtccactaagtgtcaatctcagccaagattctagaaccaattattaaagcaatggatcgtgaccactttggtagtgatgcttcacttgttttctgcctctgcatcacttacaggcacaatatcattctatcagtaacttgcctcattatgtgtattcagggtgcctcttcccctcccttta

SEQ ID NO: 134860 - DNA, 601 bp, Human
atcagctgggcacagtggctcatgcctgtaattgcagcactttgggaggccgaggcgggtggatcacctgaggtcaggacttcaagaccagcctggccaacatggtgaaaccccatctctacaaaaaatacaaaaaattagctgagcatgctggcgggcacctgtaatcccagctacttgggaggctgaggcaggagaatcgcctgaacctggagggcggaggttgcagtgagcaaagatcgcactgttgtgctccagcctagcaacaagagcgaaactccgtctcaaaaaaaaaaaaaaataaagaatcagccatcaagtgggctgtcatctgggtttagctgaaggagttcttagtaatgggctgatagttgagactctctgtcaccttgcctttgtatcagttttgtgatctgggtcaggaatgcatcatccattttctatatccagccatccagccagtagtcaactgtcataaagctattacttctggtcctctccttttatctcacccaaatgcttgcaggaatgctttctcaaacctcatgcttgtaaattttcatgtgggtgccattcgtcaaacaaatctgttgtctatata

SEQ ID NO: 134861 - DNA, 601 bp, Human
ttctatatccagccatccagccagtagtcaactgtcataaagctattacttctggtcctctccttttatctcacccaaatgcttgcaggaatgctttctcaaacctcatgcttgtaaattttcatgtgggtgccattcgtcaaacaaatctgttgtctatatataggatatatatctgtccattcccatatttgggttttgagtttcctcatctccaagtcttaatgatacctataaagacacatttcacaaaatatgctatatagactgagacagtcctcaaaaaaaaaaggaattcagsgagagatgctcatactgtatatctctcaccttagagattcgtggtgtccatttgcatattaaaggtgctgagaccagtcatggtggttaatggaggctgaggtaagaagatcacttgaggccaggagttcaagaccagcctgggcaacatagtgagaccccgtctctacaaaaaatttaaaatttaagccaggtgtttgcctatagtcccagttacttgggaggctgaggcaggaagatcacttgagcctaggacttgaaggctgcagtgagccatgatcatgccactgtactccaaggc

SEQ ID NO: 134862 - DNA, 601 bp, Human
ccagccagtagtcaactgtcataaagctattacttctggtcctctccttttatctcacccaaatgcttgcaggaatgctttctcaaacctcatgcttgtaaattttcatgtgggtgccattcgtcaaacaaatctgttgtctatatataggatatatatctgtccattcccatatttgggttttgagtttcctcatctccaagtcttaatgatacctataaagacacatttcacaaaatatgctatatagactgagacagtcctcaaaaaaaaaaggaattcagcgagagatgctcatacygtatatctctcaccttagagattcgtggtgtccatttgcatattaaaggtgctgagaccagtcatggtggttaatggaggctgaggtaagaagatcacttgaggccaggagttcaagaccagcctgggcaacatagtgagaccccgtctctacaaaaaatttaaaatttaagccaggtgtttgcctatagtcccagttacttgggaggctgaggcaggaagatcacttgagcctaggacttgaaggctgcagtgagccatgatcatgccactgtactccaaggcaacagcgtgagaccct

SEQ ID NO: 134863 - DNA, 601 bp, Human
gcttagagaacctctaccttgtgtctgatgtgttaagctcttttcatacatcatctcattcatcctagctataggttatgattagtagttatccccatatgcatgatgagaaaggttaatcagaatgcccaagaacagaccatgagtaaaaggcagatctgagacttgaacccagctagttagactcgatagcaggaattggcacactttttctgtaaagggccagatagtaaatgtgggtcatacagtctctatcacacctactcaactctactattagaacataaaagcagccatagayaacttacaaataaacgagcatggctatgttccaatgaaattttcttatcaaaaacaggcagtgggccagatttatactatgggctatagtcagtcaaccattgctctagagtcatacctggtacttgttgacatgtaaaatgttggaaggttttgattttcgtgtttctgaccccattttcaagcattttcttctgggaatcactactacttcctagactgctattattttcccctcattacacagtaatcagtttcatttcctccctaggcattttcctcctcctccatccatatttga

SEQ ID NO: 134864 - DNA, 601 bp, Human
tgtgggtcatacagtctctatcacacctactcaactctactattagaacataaaagcagccatagacaacttacaaataaacgagcatggctatgttccaatgaaattttcttatcaaaaacaggcagtgggccagatttatactatgggctatagtcagtcaaccattgctctagagtcatacctggtacttgttgacatgtaaaatgttggaaggttttgattttcgtgtttctgaccccattttcaagcattttcttctgggaatcactactacttcctagactgctattattttccyctcattacacagtaatcagtttcatttcctccctaggcattttcctcctcctccatccatatttgacttaaagccttactgacaagtcagctgatctgcaggcaaacattttacatttttctgtttttgtgagatgtatttaatgagtgccccctgggcaagagcccatgcatggttccattaactccagctcttaactagaaatggggattgcattttccacacctctcagtgaactgttaattctcttgtagccccctcttcatttccccagttccttagatctcaatgggaagaaag

SEQ ID NO: 134865 - DNA, 601 bp, Human
ttaactccagctcttaactagaaatggggattgcattttccacacctctcagtgaactgttaattctcttgtagccccctcttcatttccccagttccttagatctcaatgggaagaaagcaacgaaaaccattgctgcaactcttagcatcctgcccagaactgtatacctttaaaagatgcttctcaagggtcggacatggtggctcatgcctgtaatcccagcactttgggaggccgaggtgggagaatcacaaggtctggagtttgagaccagcctggccaacatggtgaaatcccrtctcaactaaagatacaaaaaatagcagggcacggtggctcacacctgtaatctcagcattttgggaggctgaggcaggcggatcacaaggtcaggagttcgaaactagcccggccaacatggtgaaaccccatttctactaaaaaaaaatacaaaaattagctgggcatggtggcaggcgcctgtaatcccagctactcgggaggctgaggcaggagaattgcttgaacccgggaggtggaggttgcagtgagatgagatcacaccactgcactccagcctgggcaacagagcatgact

SEQ ID NO: 134866 - DNA, 601 bp, Human
agaatcgcttgaacctgggaggcagaggttgcagtgagctgagatcgcaccattgtactccagcctgggcgacagagtgaaactccacctcaaaaaaagatgcttctcttctggctctaattttagtcctgcccgcccggatcagttggaatgggcagggaacagggttgatctaaggagttccaacagggccccatcttggacacaacctctgggaagatggttcacttcccacttggtcagtgaggtcgatccgtgactgcttccttgccctcttctgctgccttcaccctcttccatsctctaccctgccttccagggccaaaaacagattactgcataccagcccctctggaatgtctgcagttccttattttccagaacgtggcatgtggaacaagtctcctgtttctctcatggctccagttgcagagcctctctgtattttcaggtctgtttctttattctgttgccctcgtggagcatggtatgttcccttcctaagaaggtttagaactccccttgaggtaaaaagctgcctacatttctgtaccgtaccttacatttgggtggtttttctccccagtctctcctgactcaa

SEQ ID NO: 134867 - DNA, 601 bp, Human
gttagggggaaagacacacacacacacacgtagaacctacaaattacaattcacgttagggggaaagatatataatcccagcagtgaaaattcatacccagaccagaacaaggaaatagagctagggccaaaataggcttaagaatttcaagtcagaaaagcaactaaatttctacaagtgatcctgccctcctcagccattttctagataacaacaaatactggaattataaatgaaatggatcagtgcaattatctctactggcatttgggtccttccagattgaactgccaaaaattktagattactggtatacaagtacaactgcatttgattgggagacagactagttttcccctaaagccatacagttttgtaagtgacagcttcagaggaaaacttcaaaaaccattgaacctgaaatttaagtcttatgttctttgcccttaggccagagttcttcgggaaaccaagccaatccctaacctcatctttgccatagaacagtatgaaaaatttctcatccacctttctaagaagtccaaggtaaacattctcttattatgtgctaccattcccatttaccttcttgacagatct

SEQ ID NO: 134868 - DNA, 601 bp, Human
agcttcagaggaaaacttcaaaaaccattgaacctgaaatttaagtcttatgttctttgcccttaggccagagttcttcgggaaaccaagccaatccctaacctcatctttgccatagaacagtatgaaaaatttctcatccacctttctaagaagtccaaggtaaacattctcttattatgtgctaccattcccatttaccttcttgacagatctggcaaactgaagcagcacaactacaatggaggaaaagagactctgggccatttgtgtgtttgccatcccccctcccccccccccytttttttttttgagactgtgtctcattctgtcacccaggctggagtgcacattcaagtgatcctctggcctcagcctccagagtagctgggactacagtcatatgccatcataccccactagttttttgggtttgtttttgtagagatggggtctcactatgctgcccaggctggtctcaaactcctggcctgaagtgatccttccaccttggcctcccaaagtgctgggattacaggcatgagccaccacactcagcctctttgctgttcttgatctgatgacctgaaccccagcatac

SEQ ID NO: 134869 - DNA, 601 bp, Human
gtaccgcatccccatccctgcaccacctttgaaacagaacccaatgtttccttacttctagcacctaaaattttcatcttaggtttgtctaataagtagcaaatcagtagcccactcccatttcaaaactggaagtttacatacaagtgccctggatttcagaattttgaacatgcattcttcagatgatcacactccaggctctaatgtacctggccccatccactctctttacccacttggcagctgcactcaggagagtcatgtagcattttgatgtcaatggcttcttctcttgtcrttttgtcccataagtatcctcagtatagcaaaagtcctaaaaggaggtgccactgtcttattactctacactttggaggactccttcctcttcttcaacaacataattacctcctgtgagtgggaaagtggggaaagcatgactaacaaaggctttgatgagaagatagagtcttttttttccttctttttatttccactgccttggagcaggtttatcacgttagagcattaattctttccccttctagggcactgcatcagagcatgggggacagaacaaagaaccagccaagaagaa

SEQ ID NO: 134870 - DNA, 601 bp, Human
ctgcccaaaataattaatagctccccaaatagaaacactgttcaaatgacttttcagactaacttctcatgacgctattaggagagggggtaaaggcaccaaatcacggtgatcttaagtggcctcccgaaggtctcatgtacagcgctctactgtgattctctgcgtggcctttactgcctgacatttacttgggtatttgcttactgcctgtgatcttcccaccagaaagtgagtcccacataaacaggggtctagtcctaattcaacacatcagcgctccctacgtgagcacccagcmcgtaacaggacctcagaaaatgttcactgaaacaaactattaagctgggcccccatgcctgcttatgtccccaaccctgcccctacttaccaggccgagggggatatggccaccgccaatgtggggcaagttccctctgccaagcagacctccacgtcgaacaccagggcccgctcctcggggatggccacgggtacggcctccccctcggggccgtaccgggtccagccctccgcccaggcccaagccgggggcttcgggggcagctgggcctgcaacagcaagttggccgcctccagg

SEQ ID NO: 134871 - DNA, 601 bp, Human
aaggctgggggaaggaagcaatgtttctcaactaggggtggtcaaccagatgccacctcaagggggcgtctggaaacgttgccggcgggggcaggggggcgggggggggtgttggtctggcgtttatgggaaaggctggggatgctaaatgtcctatactgcctgggacagtcccacaaaagggagctttctactgcccaaaataattaatagctccccaaatagaaacactgttcaaatgacttttcagactaacttctcatgacgctattaggagagggggtaaaggcaccaaatcacsgtgatcttaagtggcctcccgaaggtctcatgtacagcgctctactgtgattctctgcgtggcctttactgcctgacatttacttgggtatttgcttactgcctgtgatcttcccaccagaaagtgagtcccacataaacaggggtctagtcctaattcaacacatcagcgctccctacgtgagcacccagcacgtaacaggacctcagaaaatgttcactgaaacaaactattaagctgggcccccatgcctgcttatgtccccaaccctgcccctacttaccaggccgagggggatat

SEQ ID NO: 134872 - DNA, 601 bp, Human
tactgccatcattgtttgaaaaagaaacttgggtagcacttagaaagttatttaaaaagaaaagagagattggatatacttgtttgggaccaaaatgcctgcttggaaggctgggggaaggaagcaatgtttctcaactaggggtggtcaaccagatgccacctcaagggggcgtctggaaacgttgccggcgggggcaggggggcgggggggggtgttggtctggcgtttatgggaaaggctggggatgctaaatgtcctatactgcctgggacagtcccacaaaagggagctttctacygcccaaaataattaatagctccccaaatagaaacactgttcaaatgacttttcagactaacttctcatgacgctattaggagagggggtaaaggcaccaaatcacggtgatcttaagtggcctcccgaaggtctcatgtacagcgctctactgtgattctctgcgtggcctttactgcctgacatttacttgggtatttgcttactgcctgtgatcttcccaccagaaagtgagtcccacataaacaggggtctagtcctaattcaacacatcagcgctccctacgtgagcacccagcac

SEQ ID NO: 134873 - DNA, 601 bp, Human
caggaggaaggtcccagcatgagcccaggccttaacaatgacttctgccatcaggtcaactaagcaatgccccgagtaccactggcaagaatggaatgagaatgagggcagagcagggaaggacagggagggaaaggagaggtaaaaagagagaaagaaggagaaagagaaaagaaaaggggacttgaggtaatttggcctaaaatgaccgacagatcaaaaaacaaatctttcttgtcactggtttcctaattttctttcagccaccaaagcctactttatcttttcaaatgatggccgrtattcccctttactttgaccatcaagttacatattctaagtagtgtgattctcattgtaactggaactcaatcaatgcagaatcatctagttttgctcttttcagccattaatgcctaccttatctatttagccatgttttcaccattttcaactgcatatttaacatttcgcagctttctttacaaagatgtagcttccaataggaataaagaaactgccaacttttttgctggccatgcctgaaagcattaaggttgtaaatagtattttaatcctggaatgaagaataaaaaaaggg

SEQ ID NO: 134874 - DNA, 601 bp, Human
ttttactgtgaatcttagaaaaatgctgatggccagagagacgtccctctagcctgatggccgaagcccttaccaacaccctttgggaagaagctgccctgtgggaggctcatagctgactaccgcttctcctcccattgtaaattgtgggctggtcaggtacctaatgttactcagctaaggggcaggggcatgcccaggttcaaagtggaccgctattagggcaccatgtggcacccacccccacccaccagtcagactcccaggaggaaggtcccagcatgagcccaggccttaacartgacttctgccatcaggtcaactaagcaatgccccgagtaccactggcaagaatggaatgagaatgagggcagagcagggaaggacagggagggaaaggagaggtaaaaagagagaaagaaggagaaagagaaaagaaaaggggacttgaggtaatttggcctaaaatgaccgacagatcaaaaaacaaatctttcttgtcactggtttcctaattttctttcagccaccaaagcctactttatcttttcaaatgatggccggtattcccctttactttgaccatcaagttacatattct

SEQ ID NO: 134875 - DNA, 601 bp, Human
agaaccagggaaagtgccagaatgagaaaatgtatgtgtatgtgacagggttggggtgggagggataggggatgagtgctgcctgttgggggcccgacactgattcaggaaaaggctgcagtttgctcaagatccacaaggctaggtgtaggggaatggccactgaggaaatgcctgttgcaagccacagattattctaaacaatcaaggcccactcagcatcaaagtgagtgacgaggccacgtgtggacaacacagctgcgaaggagctccttgcaacctttatggaagggaaaaagggagtatctgcctcaacagattcaacacacataaaactaacttctttcaaagagaaagcaaaaagaggttcctagttttaaacctgacaaaatcgaactcatactccaaatggtgaaaataagccaagggactgaaagaaatccccacccccccacattttaattcagcatgtcaaagcccttaaaacaacgcagacaaaaaggctaaagaatgccaaatctttgaggccatggtggtaacaggaactttggttacagtaaaaagccacactggtgtcaagatgcagctctgcagctgtgca

SEQ ID NO: 134876 - DNA, 601 bp, Human
accaggaatacctgagggaggtgagaggcaggcaggttcaccatggagacattaaacttccactccacaacaaccactgcacacctaccgccacatgccagatggtgcattggcagctggggacacaagtgagaccaaagggtgctcctaactcaaacagctacaggtcaggtgtggcagggtgggtgtgtgtgctggcgggcaagagctacaaaagcttctttaaacttctgcacataaaaatggaactactgggctattagacctacgtgcaggtattctattacagcctgggctatcraggtgtttgctaggcccagcgttcactgagtctgcatctagctctgaggttttatgaacattatcaacccctcacgtctacaggcacaaaccagctactgttcaaagtactagtaaaggagatagacaataacagaacccaaggtggagatttaattgaattggcaaaaaaaaaaaaaatgacaaatgctgctgcacacatgtacaggatgaatcatctcacggctgaaaagattctgggggacaaagagcaaatcacacaccttggagaagcaaccaccctcagtgagaaccagggaaa

SEQ ID NO: 134877 - DNA, 601 bp, Human
ataaaaaatatgtattatgttatcagtaaagcttctagccaacagcaagctattagtagttaagctctgagggagtcaaaagttacacccaaattttcctcccttcttttttctttccatatctttggtacaaatatacctgaattttcagcatacaagggtcacttcataagacagactcattaataaacataaccacgctgtatgtgaagcccttggctaaggatctagttagagaaggtgcacagtaaaccaggaccgtgcacatgacacacaagcacaactccatggccctcccctycagggcctctgtcaaatccagagtccagggcccagatggacaccactgaacagaagggctccattctttcagcctagaaaagctaaggtccccaacctgagatagaaccagcgccacctgattacagtgggcccgggtaccaggaacacactgacccccagagattcccacatgggctccccctcacctctccaagaagagcggtagctgctgctggaaaacctcatgggtggcccacacgtcctgggcacagtactgcatcaggtcctggcacaaggtgacaggaaggcgcaaggtggg

SEQ ID NO: 134878 - DNA, 601 bp, Human
gaaggaccccctcaatcacaggaccttcccagagacaacccctaccctaccctacctcccacccatgctccccaccttcctgatccatgggatcaccaggggccccagccccctcgatgggcaacttgctggctgtggctggttccttcttcaccttcttagctttcttctgcttaaattcttgcaggtcccactccaggtcccagagccaggggtcttctttgtacctacagagccagtccactagggcagggctaaggctaagccgaaggctaggccgcccacctgccagtcccctgcmtagatcctgcccacccaaggcctggctacctctctcctgagagcagctggcaggcatcattggccagatccatcaacgacttcttcatctcccgctggagctcctcataagtgccctgtgcctctgccaggtaacgctcccagttctggttgacaggcaggtaggagacacccatctccagcatgccggccagagtcactgggtggggacaccttggaggcaaacaccaggagctgccataaatgaccacaggaggcaagactggcccaatccctgagctggtttagcaagcctcaaccc

SEQ ID NO: 134879 - DNA, 601 bp, Human
ttgcaggtgcaaagctggcaccctgctgctcaccctggctgccctttttctcatctctgccaccctatgaggctcaaaggaaggggcaccttctcaaggaagccttcttgatttatttcccgaggcagagtcagaactctacctatggacactagctgcactggctggtctacgtgcctggctcctcctaggaaaaagaactactggaaaggaggagctatgctccagtgtgtacacccggtggctgccacgggccattgcacagcaggtgctcacaacactgtgctgaatgagtccagtragccggtccagagtgagcaaatgagaataggactggaagacagtgtgactgaatggcagcaggtcaataagtatacatgtgcatgatgcctctgtgccagaaccccagaccagggctgtcctgagaatggagcaagggtagactctagatacactgctgggggtgggcagggctcacccagggtgtccaggaaggtgctggggccgcttgggcaggagctctgtggtccccttcagcttctgcaagcaggcgcgggccatgacatcttgttgaaactcctcctcctcactgcaggggccg

SEQ ID NO: 134880 - DNA, 601 bp, Human
ggtgaccccagcctacagccgccatcccctcctctgggatgctttagccaggacccccatggaatcctctagaagaatatttcaaaagcaaagacactaagtcagtcccactggactagtcagaagccaggacacaaaagcataccctgacccagggcagggctccttcccaagctccatttcatccagggtaactgaccagaggagggagcagatctgccctccccacccctctagagaaacaccagtccttctgggtgctctcttgcaggctgttcaccagagttgagcccagggtgasactagcaaggcactcaggacacttgctctcagggtcttgcaggtgcaaagctggcaccctgctgctcaccctggctgccctttttctcatctctgccaccctatgaggctcaaaggaaggggcaccttctcaaggaagccttcttgatttatttcccgaggcagagtcagaactctacctatggacactagctgcactggctggtctacgtgcctggctcctcctaggaaaaagaactactggaaaggaggagctatgctccagtgtgtacacccggtggctgccacgggccattgcaca

SEQ ID NO: 134881 - DNA, 601 bp, Human
ggataaccattctagctcatgggactccttggggaacaaataagggaagcactgcttggcccataattatcactcaaattatatacacacacttttttaaaagcccatctccctgctacttgtaacagccctccgcatgttcctgtgaaggcagctatgcttctgggcccaagagtagggcctttagtcctccccactgtgaacatctcaacatactccctcccagagctctgagatccagagggtaagggtagccatggaagaaaaaccctgaacccagagagtgagtgagtgagagagwgagtgagtgagtgagtgagagagagagaaagagagagagagagagggtgtgtgtgtgtgtgtgtgtgtgttaatttttttcctgttttcccttcttctgaacccagactcttgaacccaaactctttccactagcctgagctgaccagccaggggaaggggtccctaggctccagccccttcctcccctgggcctaagccttacctgtaggggcagaccaccccagctgactccagggtggtacctgtcggcagcttggccaggttgtcccgccgcccaggcaccaagtagccccagcca

SEQ ID NO: 134882 - DNA, 601 bp, Human
atggggataaccattctagctcatgggactccttggggaacaaataagggaagcactgcttggcccataattatcactcaaattatatacacacacttttttaaaagcccatctccctgctacttgtaacagccctccgcatgttcctgtgaaggcagctatgcttctgggcccaagagtagggcctttagtcctccccactgtgaacatctcaacatactccctcccagagctctgagatccagagggtaagggtagccatggaagaaaaaccctgaacccagagagtgagtgagtgagwgagtgagtgagtgagtgagtgagagagagagaaagagagagagagagagggtgtgtgtgtgtgtgtgtgtgtgttaatttttttcctgttttcccttcttctgaacccagactcttgaacccaaactctttccactagcctgagctgaccagccaggggaaggggtccctaggctccagccccttcctcccctgggcctaagccttacctgtaggggcagaccaccccagctgactccagggtggtacctgtcggcagcttggccaggttgtcccgccgcccaggcaccaagtagcccca

SEQ ID NO: 134883 - DNA, 601 bp, Human
tgacaagatggccatgaggtctcacccaggctttctccttgctccaacacgtgtggggcctcccaggggcagggtggcatctccaacccccttaagacctggggaactctggctgggaagaactaggtgggcaagaggaagccctttccacccagcacccacctagagaacccaagccggcgcactgctcaccagagctaggggttgacctggcactgcagctcgcaagttctccatcttggcctcagcctccacttctaagtaatccagttcttctacctggagcagtccaaggaccaargtagtgaagcaggggactgggtaggccccaatccaccagcccctccctgcatggtactcagacactgcaggccagtctggggtgagccaccagtgccagcctcccacccaaaggctgccccttccctgggtggaatacagagacctcccctccccaaagctcaggttcagagcctgccctcaccgtttgccatatggcactattgtcagtgagcaggaactcctccgccaggccggcctcctggggcatcagctgctgcttcccctgttcgagacagtgcttcctgtacagggactcgat

SEQ ID NO: 134884 - DNA, 601 bp, Human
aaccagcagccagggatgtccacgtcgttgtaaggtccattgccatggtgatagctgggctgggtgtccttggggccaccacgggcagtctgtgagggccacacacctatatcaggccctgctccagcacctgcattcagcaagggccatggggtagggggtgggaaaagggcctgaaactgtcgtcatcagctgggaaatgacaagatggccatgaggtctcacccaggctttctccttgctccaacacgtgtggggcctcccaggggcagggtggcatctccaacccccttaagacctrgggaactctggctgggaagaactaggtgggcaagaggaagccctttccacccagcacccacctagagaacccaagccggcgcactgctcaccagagctaggggttgacctggcactgcagctcgcaagttctccatcttggcctcagcctccacttctaagtaatccagttcttctacctggagcagtccaaggaccaaggtagtgaagcaggggactgggtaggccccaatccaccagcccctccctgcatggtactcagacactgcaggccagtctggggtgagccaccagtgccagc

SEQ ID NO: 134885 - DNA, 601 bp, Human
gcaaaggggcttcccacattacagctattaccatcctggacagagcaaaggaagcaggggctggaggcaggtggcagacccctgggtggggaaccaacgtgagtacctgcactcctcccaacactgagcccagaacctcagcagtctgaggcaaatccctgattgtatcacgcacgcgcgcacgcgcacacgcacacacacacgtgcacacacatgccccctaagacacacagacacaagcaaacctggctccctgcataataacaaatcggaaaaacctatcacgtaccagatgtcgtaycaaacatacgacgtgccccatgtcatttaattccaccaccatgccccttgccacccgactttcattagaaaaacaaaagctgagagatgacagtatgtgcctgaaatcacactctgtcccactactagtcattcccacaaaaaggaaagtctcaggtgtgtcactctgaaggcctgctgtgggccttgagcagaatgaggaaacaccacaggacaggccatgacccaggacacaccttgtgaggcagcttgaaaaaccagcagccagggatgtccacgtcgttgtaaggtccattgccat

SEQ ID NO: 134886 - DNA, 601 bp, Human
gggcgttcctccagaaagaaatcattttgttgatttccagagcacggggcccactggcacctcctgggccagcctgcagggtgccatcctccatcttgggcaggaagtccttggcaaaggggcttcccacattacagctattaccatcctggacagagcaaaggaagcaggggctggaggcaggtggcagacccctgggtggggaaccaacgtgagtacctgcactcctcccaacactgagcccagaacctcagcagtctgaggcaaatccctgattgtatcacgcacgcgcgcacgcgcrcacgcacacacacacgtgcacacacatgccccctaagacacacagacacaagcaaacctggctccctgcataataacaaatcggaaaaacctatcacgtaccagatgtcgtaccaaacatacgacgtgccccatgtcatttaattccaccaccatgccccttgccacccgactttcattagaaaaacaaaagctgagagatgacagtatgtgcctgaaatcacactctgtcccactactagtcattcccacaaaaaggaaagtctcaggtgtgtcactctgaaggcctgctgtgggcctt

SEQ ID NO: 134887 - DNA, 601 bp, Human
ctcagccaagaactggggccctatgatacaccaatcaagagcataaaccatctgggaaccggccaggcctccgagcgagcttccgctcctctccggggggcatccatgaggcgctccttccaccaatgcctcttcctacacacaggcagacttcaccatcccaacacccactctgctcgccagtgtgctgatggccacaaccaccttggaaatggccttcaagatgaatacatttgccattccagactagaagacccagctcccagcccccaacagggcttacaggccaccagctctccayggtcctcagccatagcccacggctccagcagttacaccaagaagttctgttggagctacgaagggctctcatggtcctacagcaccattctttttacattaacagggaaactgaagctagaggggagacctgcccaaggtccatggcaccaggaccaaaagtagccaggcctctagaccatagtcaggctggccctctgtgggaatccagggttagtcaggggtccctgggtgggaagagaggggaaaggcatcccaggactcctcccatggtggcccacctgatacgtttatgggcgtt

SEQ ID NO: 134888 - DNA, 601 bp, Human
gcgtacatctgctgggccttctcagctgcctcctgctgtgtgagccggtggttaaactgcattagtaagcgctcagcaaagggctgcccagcaccatagatgcggccgtagttgaagattttggcatgctcacggctgatgcccacagtagtggctgtcttactgtgtagatcagtgcccctgctcttcctgccctgcagtgtcatccacccaaaggctgtgcagcctggaagacaagcaggagtgagaaaagcagctcaggaacattctgcccaatgttcatcagaactgtcaatatgccgaggggctgggctgccccaaccccggctcctgctcaccatgcatgccggcaaagtgggcgtctccaagcacagctgcaatccacagctcttgggagtccacatcagcacccacaagggtgtagccaggtggggcctgcaccatggctttcaactcactgcctactcggtcaggctgtgggaagagtgagatacccaaatgagactcttcctaccccattcctggagccagagttgactgagaaagagctagagcctttcctgaggggatggctttagagaatgccagacagcactgctga

SEQ ID NO: 134889 - DNA, 601 bp, Human
gcataatcagaattgtcaagatgctaccacttggtaacagtataccaaaagtatagctttactcccatgaggaaaaactgtttaaggctgactataaagcaaccaaatgtcacaataggacaaatcatcctggaaccaggttacacaggtgtggaaggagaggggctaggtgagagttcaagtaatgggcaggagatagaacagatgggagtactaaaggacagtaaagcaggcctcgggtcctgggtgttaaagtggatgggagagggaccctcaccagcggaggcccttggtggcagcrtacatctgctgggccttctcagctgcctcctgctgtgtgagccggtggttaaactgcattagtaagcgctcagcaaagggctgcccagcaccatagatgcggccgtagttgaagattttggcatgctcacggctgatgcccacagtagtggctgtcttactgtgtagatcagtgcccctgctcttcctgccctgcagtgtcatccacccaaaggctgtgcagcctggaagacaagcaggagtgagaaaagcagctcaggaacattctgcccaatgttcatcagaactgtcaatatgctga

SEQ ID NO: 134890 - DNA, 601 bp, Human
ccctcctgtcaactcctgtcttccacccactccatttgctctcattccctgtaggcatctgagtttgcaacccctgtattattgattatgcagcataatcagaattgtcaagatgctaccacttggtaacagtataccaaaagtatagctttactcccatgaggaaaaactgtttaaggctgactataaagcaaccaaatgtcacaataggacaaatcatcctggaaccaggttacacaggtgtggaaggagaggggctaggtgagagttcaagtaatgggcaggagatagaacagatggkagtactaaaggacagtaaagcaggcctcgggtcctgggtgttaaagtggatgggagagggaccctcaccagcggaggcccttggtggcagcgtacatctgctgggccttctcagctgcctcctgctgtgtgagccggtggttaaactgcattagtaagcgctcagcaaagggctgcccagcaccatagatgcggccgtagttgaagattttggcatgctcacggctgatgcccacagtagtggctgtcttactgtgtagatcagtgcccctgctcttcctgccctgcagtgtcatccacc

SEQ ID NO: 134891 - DNA, 601 bp, Human
tttctccagtatcaacatcagcctacatgctccagtttgccacagcgccctcctgtcaactcctgtcttccacccactccatttgctctcattccctgtaggcatctgagtttgcaacccctgtattattgattatgcagcataatcagaattgtcaagatgctaccacttggtaacagtataccaaaagtatagctttactcccatgaggaaaaactgtttaaggctgactataaagcaaccaaatgtcacaataggacaaatcatcctggaaccaggttacacaggtgtggaaggagargggctaggtgagagttcaagtaatgggcaggagatagaacagatgggagtactaaaggacagtaaagcaggcctcgggtcctgggtgttaaagtggatgggagagggaccctcaccagcggaggcccttggtggcagcgtacatctgctgggccttctcagctgcctcctgctgtgtgagccggtggttaaactgcattagtaagcgctcagcaaagggctgcccagcaccatagatgcggccgtagttgaagattttggcatgctcacggctgatgcccacagtagtggctgtcttact

SEQ ID NO: 134892 - DNA, 601 bp, Human
tctgctaaggccctgagcacacagtatgcagtacgatcagaggaaacaaattggagagctaggctaagtaacctggaggcctggtaatgctttctccagtatcaacatcagcctacatgctccagtttgccacagcgccctcctgtcaactcctgtcttccacccactccatttgctctcattccctgtaggcatctgagtttgcaacccctgtattattgattatgcagcataatcagaattgtcaagatgctaccacttggtaacagtataccaaaagtatagctttactcccatgagkaaaaactgtttaaggctgactataaagcaaccaaatgtcacaataggacaaatcatcctggaaccaggttacacaggtgtggaaggagaggggctaggtgagagttcaagtaatgggcaggagatagaacagatgggagtactaaaggacagtaaagcaggcctcgggtcctgggtgttaaagtggatgggagagggaccctcaccagcggaggcccttggtggcagcgtacatctgctgggccttctcagctgcctcctgctgtgtgagccggtggttaaactgcattagtaagcgctc

SEQ ID NO: 134893 - DNA, 601 bp, Human
tctggccctacctacaaacattggtaaggtccacagggagctctgccctgccctccctggggcccctctgcccatgctccaaaggtagcaagatacctcttcctggacagccgagggctccagggctcggctgatgcagcagcccagcaccggggtacgtggtatgtcagacgtagcaatgctctcaagcttattgaacatttctgactctgtgccccccttccatgcccgttcagcaaccacctcccacttcttccactgtgacctaagggaccagaaacagagggcagactttgtcttycagcatctcaaagctaaaaaacaaagcatccaagctcttctggggcaagcccagacccctccctccatccttaacacaaagaaggttcttacttccttgcagtttctctctggaccttgcgcagatcctgcagggaaatccagccaccctcagtcctgtccactgggaggttcaactccctcaccagccactcgccctcatccgacagccgatacctgggggcagtgttatcaccatcattccacgggagtgcttcctgtgccacgctagtgccttggcaaggaatgttcacatatcact

SEQ ID NO: 134894 - DNA, 601 bp, Human
gtagaagccccaagagaagcttcactctggccctacctacaaacattggtaaggtccacagggagctctgccctgccctccctggggcccctctgcccatgctccaaaggtagcaagatacctcttcctggacagccgagggctccagggctcggctgatgcagcagcccagcaccggggtacgtggtatgtcagacgtagcaatgctctcaagcttattgaacatttctgactctgtgccccccttccatgcccgttcagcaaccacctcccacttcttccactgtgacctaagggaccrgaaacagagggcagactttgtctttcagcatctcaaagctaaaaaacaaagcatccaagctcttctggggcaagcccagacccctccctccatccttaacacaaagaaggttcttacttccttgcagtttctctctggaccttgcgcagatcctgcagggaaatccagccaccctcagtcctgtccactgggaggttcaactccctcaccagccactcgccctcatccgacagccgatacctgggggcagtgttatcaccatcattccacgggagtgcttcctgtgccacgctagtgcct

SEQ ID NO: 134895 - DNA, 601 bp, Human
aggaattttactacaagaaaatacaactcaatatataaaatatataagatatttttaaaaatcacatttgagtgtccccattaacagtgttttctgttagcagtcaaataacaaacttttggcacttacttaagaaagaaaacatttatgggagaaagaaaaacaaacatctcaattttctatgaaatgagaaaaggcttctgtcatttgattttccaaatagaaaagcgtgagtaccacccttcggaacaattcccctaacctcactgcttccctcaatgatcagtcttggtatttcacrttttcaaacccaataactctttttttacgaattgaggctagtctttttaggacttctacaactttttaaaaattagaaataaataaataagctgaaacattcacttctagggggatgaaaagtcaaaactgaccagtctggcccaaggaacgctcacccaaagccccacataggagcacatggccaggctagaggccatgggccccgcatacctggtcaagaggttggtgatctgcaaggccagggcagcgcggtagcggtcctcctcccgcaccaggtagcgaacctcgtcatggatgc

SEQ ID NO: 134896 - DNA, 601 bp, Human
tgcactgaaaaaggcgactgactggggcaagtcattcagacccagcttgtaggcaaacatgcacctgaaagagacccaatctcctctcacagtcatgcccctcctgtgaacagatgcatcactcctggagcaatgaccccacaccccttagagcagggcttcccctggaccaacaccccatctgttcacttagctaagtcaagaaaggtgaaggtccagcactgttttccatccagcagcctaacctcccactgagatactgaaatgcaattatggactcaacatacttttttttttttttcccagtttggtacactttattaattaatatacgaaatcacttccaattgggccagagtttgaagcataaatgaggacttttagctttgttaagcataacctcccggagatgatgattaagagggcaatgggaacaatgttgaatattgtaaacatctgttatttacccaataatcaggatagatcatggttcccaaactggttctgagtggcagatcaacatggaacggtaatatttaattcatccatatgaactaggaattttactacaagaaaatacaactcaatatataaaatatat

SEQ ID NO: 134897 - DNA, 601 bp, Human
tagaatatagcctgagtcaagagtggattctctggggccccaagtttcctgttctccaagacccactttctagtccacctcagatcctatgtgtaatgaggaacaaatgtgttgtgctcaccctggggaatcccgtatctcctttccatcccagttgggttggaaggggttttacaatccatggtcacttccttcctgaggcaccggtcaatatcgactgcactgaaaaaggcgactgactggggcaagtcattcagacccagcttgtaggcaaacatgcacctgaaagagacccaatctmctctcacagtcatgcccctcctgtgaacagatgcatcactcctggagcaatgaccccacaccccttagagcagggcttcccctggaccaacaccccatctgttcacttagctaagtcaagaaaggtgaaggtccagcactgttttccatccagcagcctaacctcccactgagatactgaaatgcaattatggactcaacatacttttttttttttttcccagtttggtacactttattaattaatatacgaaatcacttccaattgggccagagtttgaagcataaatgaggactttta

SEQ ID NO: 134898 - DNA, 601 bp, Human; identical to SEQ ID NO: 35227

SEQ ID NO: 134899 - DNA, 601 bp, Human; identical to SEQ ID NO: 35228

SEQ ID NO: 134900 - DNA, 601 bp, Human; identical to SEQ ID NO: 35229

SEQ ID NO: 134901 - DNA, 601 bp, Human; identical to SEQ ID NO: 35230

SEQ ID NO: 134902 - DNA, 601 bp, Human; identical to SEQ ID NO: 35231

SEQ ID NO: 134903 - DNA, 601 bp, Human; identical to SEQ ID NO: 35232

SEQ ID NO: 134904 - DNA, 601 bp, Human; identical to SEQ ID NO: 35233

SEQ ID NO: 134905 - DNA, 601 bp, Human; identical to SEQ ID NO: 35234

SEQ ID NO: 134906 - DNA, 601 bp, Human
atgaccaagaaccccaaagcaaatgcaataaaaacaaagataaataggagagaggttccaagatggctgaataggaacagctccagtctacagctcctagcatgagcgatgcagaagaaaggtgatttccgcatttccaactgaggtaccaggttcatctcattggggcttgtcagacagtgggtacagggcagtgggtgcagcccacagagtgtgagccgaagcggggcaaggcatcgcctcacccggaaagtgcaagaggtcggggaattccctttcctagccaagggaagccgtgacrgatggcacctggaaaatcgggtcactcctaccctaatactgcgcttttccaacggtcttagcaaacggcacaccaggagattatatcctgcgcatggcttgaagagtcccatgtccacggagcctccctcattgctagcacagcagtctgagatccaaccgcaaggcagcagtgaggctgggggaggggcacccgccattgctgaggtttgagtaggtaaacaaagcagtctggaagcttgaactgggtggagcccaccacagctccaggaggcctgcctgcctctgtagactccacctc

SEQ ID NO: 134907 - DNA, 601 bp, Human
gacactctattcaaaaaaatggtgctgggatacttggcaagccacatgtaggagaatgaaactggattcttatctctcgcgttatacaaaaatcaattcaagatggatcaaggacttaaatctaagacctgaaactataaaaattctagaagataacctcagaaaaacccttttagacattggcttaggcaaggatttcatgaccaagaaccccaaagcaaatgcaataaaaacaaagataaataggagagaggttccaagatggctgaataggaacagctccagtctacagctcctagcrtgagcgatgcagaagaaaggtgatttccgcatttccaactgaggtaccaggttcatctcattggggcttgtcagacagtgggtacagggcagtgggtgcagcccacagagtgtgagccgaagcggggcaaggcatcgcctcacccggaaagtgcaagaggtcggggaattccctttcctagccaagggaagccgtgacagatggcacctggaaaatcgggtcactcctaccctaatactgcgcttttccaacggtcttagcaaacggcacaccaggagattatatcctgcgcatggcttg

SEQ ID NO: 134908 - DNA, 601 bp, Human
cacacagccaaagcaagattaagcaaaaagaataaatctggaggaatcacattacctgattttaaactatactataaaaccatagtctccaaaacagcatggtactggtgtaaaaacaggcacatagaccaatggaacgtaatagagaatccagaaataaacccaaatacttccagccaactgaccttcgagaaagcaaacaaaaacaaagtggggaaaggacactctattcaaaaaaatggtgctgggatacttggcaagccacatgtaggagaatgaaactggattcttatctctcgcrttatacaaaaatcaattcaagatggatcaaggacttaaatctaagacctgaaactataaaaattctagaagataacctcagaaaaacccttttagacattggcttaggcaaggatttcatgaccaagaaccccaaagcaaatgcaataaaaacaaagataaataggagagaggttccaagatggctgaataggaacagctccagtctacagctcctagcatgagcgatgcagaagaaaggtgatttccgcatttccaactgaggtaccaggttcatctcattggggcttgtcagacagtg

SEQ ID NO: 134909 - DNA, 601 bp, Human
accccacgctcatggatgggtagaatcaatactgtgaaaatgaccatactgccaaaagcaatctacaaattcaatgcaattcccatcaaaataccaccatcattcttcacaaaactagaaaaaaaatcctaaaattcatatggaaccaaaaaagagcccacacagccaaagcaagattaagcaaaaagaataaatctggaggaatcacattacctgattttaaactatactataaaaccatagtctccaaaacagcatggtactggtgtaaaaacaggcacatagaccaatggaacgtaayagagaatccagaaataaacccaaatacttccagccaactgaccttcgagaaagcaaacaaaaacaaagtggggaaaggacactctattcaaaaaaatggtgctgggatacttggcaagccacatgtaggagaatgaaactggattcttatctctcgcgttatacaaaaatcaattcaagatggatcaaggacttaaatctaagacctgaaactataaaaattctagaagataacctcagaaaaacccttttagacattggcttaggcaaggatttcatgaccaagaaccccaaagcaaat

SEQ ID NO: 134910 - DNA, 601 bp, Human
tcctagcttaaatcaggaagaattagataccctgaacagaacaatagtaagcagcgagattaaaattgtaataaaaaattgtcaacataaaaacgtccaggaccagacatattcacagccaaattctaccagacattcaaagaattcgtacgaatcctattgacactattccacgagacagaaagagggaatcctcctgaaatcattctatgaagccagtatcatccgaataccaaaaccaggaaaaaaacataaccaaaaaaggaaactacataccaatatccctgatgaacacagatgyaaaaatccttaacaatatactagctaaccgaatccaacaatgtatcaaaaagataatccaccattatgaagtgggtttcataacagggatggtttaatataggcaagtcaataaatgtgatacaccagataaacagaattaaaaataaatattacatgatcatctcaatagacgcagaaaaagcatttgacaaaatcaagcacccctttatgattaaaactctcaacaaaatcggcatacaagggacatacctcaatgtaataaaagccatctatgacaaacccacagccaacataatac

SEQ ID NO: 134911 - DNA, 601 bp, Human
caaccctcctagcttaaatcaggaagaattagataccctgaacagaacaatagtaagcagcgagattaaaattgtaataaaaaattgtcaacataaaaacgtccaggaccagacatattcacagccaaattctaccagacattcaaagaattcgtacgaatcctattgacactattccacgagacagaaagagggaatcctcctgaaatcattctatgaagccagtatcatccgaataccaaaaccaggaaaaaaacataaccaaaaaaggaaactacataccaatatccctgatgaacayagatgtaaaaatccttaacaatatactagctaaccgaatccaacaatgtatcaaaaagataatccaccattatgaagtgggtttcataacagggatggtttaatataggcaagtcaataaatgtgatacaccagataaacagaattaaaaataaatattacatgatcatctcaatagacgcagaaaaagcatttgacaaaatcaagcacccctttatgattaaaactctcaacaaaatcggcatacaagggacatacctcaatgtaataaaagccatctatgacaaacccacagccaaca

SEQ ID NO: 134912 - DNA, 601 bp, Human
tttccaaggtagaccactgataggccacaaatcaaacctcaataaatttaagaaaactgacattatatcaaacactctctcagaccacagtggaataaaactgaaaatcaaccctaaaaggaaccttcaaaaccatgcaaatacatggaaattaaataaccttctcctgaataagtcaacaatgaaatcaagatggaaatttaaaatgtttttgaaccgaacaacaacagtgacacaacctatcaaaacctctgggatacagcaaaggctctgctaagaggaaagttcatagccctaaatscctacatcagaaagtctgaaggtgcacagacaatctaaggtctaacctcaaggaactaaagaaacagaacaaaccaaacccaatcccagtagaagtgaaataaccaagattagagcagaactaaatgaaattgaaacaaacaaaaaatacaaaagataaatgaaacaaaaagctagttctttgaaaagataacataaatagaccattagcaagattaaacaagaagaaaaaagagaaaatccaaataagctcaattagaaatgaaatgggagctattacaactgacaccacagaaataca

SEQ ID NO: 134913 - DNA, 601 bp, Human
catttgcagctgggaggctggtagcctggggcaagttctcagccctgctcgcccaccacctaagttctcagccctgctcgcccaccgcctggaaacagactcagtgctgttgggtggggcacagagggagtgagactggccttttgggttgcatgggagctgggtgaggcctgtgactgtaggctttcccccacttccctgacaacctgcatgacaaagcagaggcagccataatcctcctgggaatataactccattgacctaggaatcccacccccatcccccacagcagttgcaacamgacccacccaaggacagtctgagcccagacatgccctagaaatgcccctatctgatggtccttccctactcaccatggtagctgaagacaaagggcatatactcttaggagttccagggcccacccactgcctgatcctccccatactaccacagctgatgctctattgaaaaggccacctccctgcagaatgccaaccagcacaaaaatagtgcattaaacaacaaaaagtaaggaccctcagagagtccatttcacccccctgccacctccagcagagcaggtgctggtatccacagc

SEQ ID NO: 134914 - DNA, 601 bp, Human
tgacagtgtttctaatacattccccaaaactttgtaagactattgtatatttcaccaagagccacatcattacacggatcctccccagatccttcctggatatccccaccttctttataccaagcttctggggagatggttgaggggacccatgaatcacatgcttaacctgttcagcaaaaggttgtcctgccaggtttctgtctttctctccagagcacacattcccaacactgagtttcctagttgtaacactctttacaatctggataggctgagaacctccaaaatcatcaagtgytggttcctttttccttacctgttcctttttaaatttatctctttcttctctcattttaatataggcagcgaggagaaaccaagcagcacttttaacactttgcttggaaatcttttcagctcatatccaagttcaccagtttcaagatgttttccacaaactgtagaaaccaagtcagccggtattgtatcactacataacaagggttacctttcttctagattccaatataatgtctctcatttccttccaagccatggccagaacagacttcaatgttcatatttctactgaaattct

SEQ ID NO: 134915 - DNA, 601 bp, Human
attctcccctgtccacctgtgaaactagaaaacaagttatgtttccaaaatgcaatggagagacaggcataggatggacactctaattcccaaaggaaaaaaatagaaggaataaaggggtcactggtcacaggcaagttcaaaatccagcagggcaaatttccattatgtttcaaagcctgagaataactctctgtggcctgatgcttcaccctctgtgctgcctgccatggttctgcttgcagagttattctttctttcttgaaagggcagcacaatgtttacagccaagtagctctatagtccatttcctgcctatagaattttggaagtccaacagccttctttcattttgtcttgtctctttcggtccaagctgacagtgtttctaatacattccccaaaactttgtaagactattgtatatttcaccaagagccacatcattacacggatcctccccagatccttcctggatatccccaccttctttataccaagcttctggggagatggttgaggggacccatgaatcacatgcttaacctgttcagcaaaaggttgtcctgccaggtttctgtctttctctccagagcacaca

SEQ ID NO: 134916 - DNA, 601 bp, Human
tctgctgagatggttgagtggattcatgaatcacaggtctaacctattcagcaagagaaatttattctctcatagttctggaggccaaaagtctgaagtcaaggtttgagcagagttaatgcaaaagattctaaaagctgccctttttttgttgggtgcatcattcaagccaccctctagcccccaaaagcccccaaaatccacctcccctacataaaatatatttccctttgccaacaacctccaaaaactcaaccaattacagcatcaattctaagtccaaaatctcatgtaaatatcrtcaacttcatttacaaattttatcatctaaatcatgtatgggtgagactctgggtatgatccatcctggggtaaaattctcccctgtccacctgtgaaactagaaaacaagttatgtttccaaaatgcaatggagagacaggcataggatggacactctaattcccaaaggaaaaaaatagaaggaataaaggggtcactggtcacaggcaagttcaaaatccagcagggcaaatttccattatgtttcaaagcctgagaataactctctgtggcctgatgcttcaccctctgtgctgcc

SEQ ID NO: 134917 - DNA, 601 bp, Human
acttaaaagttattccctcaatacatcactgctctaagcacttttggaactcttctggaatctcagaggccatttactggtaactcattattaatcactgaagagcaaacatccttgagaccatctaaaccagttctgcacctggtaaaaggtaagatattacctttgaacaacatttttgtttgtttgtttaagacagcatctccctttgtcacacaggctggagtgcagtggtgcaaacatggcttactttagcctgggaggtctcaagcgatcctcccactgcagccacttaagtagytgggactacaggcacatgccaccatgcccagttcactcttttggacaaagtttttttaaaggtaacaagctggcatttgcaattgttcacttgccttacaaaatatatggctcaaaataagtgtatttcttcaaaaaattctacccagagaaaacagttatttctacaaagggtgtttttatacgcactaaagagtttgacagtaattataagtggaatttcaaaaatattttcagtcagatcaacacaagtagaataactgcagttcagatgtacaaattaaggtatgcatactgtaaa

SEQ ID NO: 134918 - DNA, 601 bp, Human
agaaagttaatggatgctgggcttcatacctaggtgatagtttgatctgtgcagcaaaccaccatggcacacatttacctatgtaacaaacctgcacatcctgcatgtgtaccctggaacttaaaagttcaagtaaaaaaaaaaaaagtattcacttaaaagttattccctcaatacatcactgctctaagcacttttggaactcttctggaatctcagaggccatttactggtaactcattattaatcactgaagagcaaacatccttgagaccatctaaaccagttctgcacctggtaraaggtaagatattacctttgaacaacatttttgtttgtttgtttaagacagcatctccctttgtcacacaggctggagtgcagtggtgcaaacatggcttactttagcctgggaggtctcaagcgatcctcccactgcagccacttaagtagttgggactacaggcacatgccaccatgcccagttcactcttttggacaaagtttttttaaaggtaacaagctggcatttgcaattgttcacttgccttacaaaatatatggctcaaaataagtgtatttcttcaaaaaattctaccca

SEQ ID NO: 134919 - DNA, 601 bp, Human
cctgtgaaaaggagctacccactccatgtctcctctctagtgacagctgcgctcatcaagacgatctgccagcagaaaggagctaccaacttcagttctcctaagagctgtactgtctctcaataaagcacctctttgccttgctcaccttccagttgtctacatgcctcattcttcctgaacatgcaacaagaacttggaactcaccaaatggcaggactgaaagagctgtaacatgaacagggctgaaacacgtgccccactcaccacattgcaggcaatgaaaaggagagaagagctrcagccctttggggagcccagacctacaggctccctgagccagagctgtgacactcactctctttagggctgtgtggttcctggtatctccaagcttccaggtgccactgcattccaccacagtgcctgcagtggaagccacctgcagtatgcctggtcgagccacagtcttgtacaaagctggtgcctgtgccagtacctggagctgcccaccccactgcagctggcactcctggctgtgcgcagtggccggaccctgtgcttgctcacacactcaccgccgccctgcacctggctcccc

SEQ ID NO: 134920 - DNA, 601 bp, Human; identical to SEQ ID NO: 39045

SEQ ID NO: 134921 - DNA, 601 bp, Human; identical to SEQ ID NO: 39046

SEQ ID NO: 134922 - DNA, 601 bp, Human; identical to SEQ ID NO: 39047

SEQ ID NO: 134923 - DNA, 601 bp, Human; identical to SEQ ID NO: 39048

SEQ ID NO: 134924 - DNA, 601 bp, Human; identical to SEQ ID NO: 39049

SEQ ID NO: 134925 - DNA, 601 bp, Human; identical to SEQ ID NO: 39050

SEQ ID NO: 134926 - DNA, 601 bp, Human; identical to SEQ ID NO: 39051

SEQ ID NO: 134927 - DNA, 601 bp, Human; identical to SEQ ID NO: 39052

SEQ ID NO: 134928 - DNA, 601 bp, Human; identical to SEQ ID NO: 39053

SEQ ID NO: 134929 - DNA, 601 bp, Human; identical to SEQ ID NO: 39054

SEQ ID NO: 134930 - DNA, 601 bp, Human; identical to SEQ ID NO: 39055

SEQ ID NO: 134931 - DNA, 601 bp, Human; identical to SEQ ID NO: 39056

SEQ ID NO: 134932 - DNA, 601 bp, Human; identical to SEQ ID NO: 39057

SEQ ID NO: 134933 - DNA, 601 bp, Human; identical to SEQ ID NO: 39058

SEQ ID NO: 134934 - DNA, 601 bp, Human; identical to SEQ ID NO: 39059

SEQ ID NO: 134935 - DNA, 601 bp, Human; identical to SEQ ID NO: 39060

SEQ ID NO: 134936 - DNA, 601 bp, Human; identical to SEQ ID NO: 39061

SEQ ID NO: 134937 - DNA, 601 bp, Human; identical to SEQ ID NO: 39062

SEQ ID NO: 134938 - DNA, 601 bp, Human; identical to SEQ ID NO: 39063

SEQ ID NO: 134939 - DNA, 601 bp, Human; identical to SEQ ID NO: 39064

SEQ ID NO: 134940 - DNA, 601 bp, Human; identical to SEQ ID NO: 39065

SEQ ID NO: 134941 - DNA, 601 bp, Human; identical to SEQ ID NO: 39066

SEQ ID NO: 134942 - DNA, 601 bp, Human
acaaatatatttttaaggttttaattagattaaatattagtatataaatcttaataatttgggaaatgcaaattaaagcactccatgttgggaagacagtagtaacaaagcatagtccttcctctaatggccattatattcatacgcatgtgtgtgtgtgtgtgtgtgcatgtatgtgctctgaaagtgttaaataaacttgaggagatacagtaataagtgctatgaaatcattaaaacagaaaaatgtgatagtgtcatagcaacggcaggctagaggaacgggaacaatacagcacayaccagatacctgaatgaaaagtagtcaggtctcaaaagaaagagttaacagtattccaacaccatgctttgcactttgatctagtactgtatatattatcagtatgttgagtaaatcagatttcttaattgcaaattcttagcaaatattatacacattattgaagtatgtttttgttttttatccaagttttaaatttgtgccagatataaggcaaagaattatagacatcatacccccagaagagacagaatcccaatatatttttccacatgaaattcacatttgttaagttaaaaa

SEQ ID NO: 134943 - DNA, 601 bp, Human
aacttcaactcttacaagagaatgtccttataacagcataaaggaaatcgttcaggtaaagttgagtaaatctgactatatcacaagtaatatttgtaaaagatgtcataaacaatttttaaaaaaaatcagaagaccagaaatgcactaggagaagatactgcgaagtatggaagaaaatattagtattcaaaatatattaaaaacacctataaaccaatgagaaaaaaagaatctcaattcaaaaataggcaaaggctacggacaggcaatttacaaatatatttttaaggttttaatyagattaaatattagtatataaatcttaataatttgggaaatgcaaattaaagcactccatgttgggaagacagtagtaacaaagcatagtccttcctctaatggccattatattcatacgcatgtgtgtgtgtgtgtgtgtgcatgtatgtgctctgaaagtgttaaataaacttgaggagatacagtaataagtgctatgaaatcattaaaacagaaaaatgtgatagtgtcatagcaacggcaggctagaggaacgggaacaatacagcacataccagatacctgaatgaaaagtagt

SEQ ID NO: 134944 - DNA, 601 bp, Human
atacagacaagccgattttaaagttcacaagaagagacaaaggaattagattagctaaaacaattctgaaaaagaataacaaagctggaggactaacacaacctgatctcaaggctatcaaggtaaagtaatcaagcagtgtagtattgatgttgggacagacagatcaatggcacagaaaagcaaagccagaaatagacccatacaaatacagtcaattatattttacaagtggataaaggaaattcaatggagaaggacagtcttttaaacaaatgttaaaacaactagatatccatawgtagaaaaataaatctcaacatctatctcacaagttgcacaaaccttaaatggatcataaacctatgtgtaaacataaaactataaaacgcttagaataaaatctgaatgaccttgagattggtgatgagtttttagatataatacaaaaaatataatctataaacaaaaaaatgatgaactggacttaatcaaaattaaaaactcttcctctgcaaaacacattaagagaattacaagataattcacaaactggtagaatatgtttgtaaatcatgtatctcataaatgatttatatct

SEQ ID NO: 134945 - DNA, 601 bp, Human
aagaattcatattcagacaaatgcaccaatggaacagaatagagaactcagatgtaaatctacacatttggaaccaactcatcttcgacaaacatgccaggatcatacactggggaaaggacagtcttttcaatatgaaaactgaacaaccataatgcagaagaatgaaactaactagaccactatctctcaccatatacaaatatcaaatcaaaattgattgaagactcaaatataagacccaaaactatgaaacgactagaggaaaatattgaagaaatgctccaggacattggtctgrgcaaaaatgttttgtgtgagacttcaaaagcacaggcaacacaattaaaaatagacaagtggagttaacatcaagctaaaaatcttctacacagcaaaggaaacaatcaacacagtgaagagccaatccacagaatgggagaaaatatttgacaaatacccatctgacaagggattaatatcagaatacataaggaacttaaacataccctttatcaccactcctattcaacatagtcctgaaagtcctggccagagcaaccaggcaagagaaagaaataaaaggcatccaaatagggaa

SEQ ID NO: 134946 - DNA, 601 bp, Human
tcatgcctgtaatcccagcactatgggaggctgaggtggatggattgcctggggtcaggagttcgagaccagcctgaccaacatggagaaaccatgtctctactaaaaatacaaaaactagccaggcatggtggtgtgtgcctgtaatcccagctacttgggggctgaggcaagagaatcgcttgaacccaggaggcggaggctgcagtgagctgagattgcaccactgcactcaagactgggtgacagagcgagattctgcctcaaaaaaaaaaaaaaaaaaaaaagaattggttaactmcaaggcaggtcaatagaaattattcaaattgaatttaagaagaaaatgtagtagagaaagaaaggaaaaaatccaaaaagcaaacaacagcaagaaactgagcagaacactcaggagctgtgggatagtaccacacatgggaaacatcatgagtgtctaaagggagaaatatgcctcaggacaaagacaaagaggaaaggcaggactgccatccccagtcttggaaattctaactctgctctgtaacttgaagaggagagaacacctccaaattcattctaggaggccagcattacctca

SEQ ID NO: 134947 - DNA, 601 bp, Human
gagtcacaagtaaacttgatatagccaaagaaagaactggctggctgggtgcagtggctcatgcctgtaatcccagcactatgggaggctgaggtggatggattgcctggggtcaggagttcgagaccagcctgaccaacatggagaaaccatgtctctactaaaaatacaaaaactagccaggcatggtggtgtgtgcctgtaatcccagctacttgggggctgaggcaagagaatcgcttgaacccaggaggcggaggctgcagtgagctgagattgcaccactgcactcaagactggktgacagagcgagattctgcctcaaaaaaaaaaaaaaaaaaaaaagaattggttaactccaaggcaggtcaatagaaattattcaaattgaatttaagaagaaaatgtagtagagaaagaaaggaaaaaatccaaaaagcaaacaacagcaagaaactgagcagaacactcaggagctgtgggatagtaccacacatgggaaacatcatgagtgtctaaagggagaaatatgcctcaggacaaagacaaagaggaaaggcaggactgccatccccagtcttggaaattctaactctgctct

SEQ ID NO: 134948 - DNA, 601 bp, Human
tatgacctcctctctcagaactagaatgtctcatctttctctttcttcagtggacagatatcagagggcctcagaatcatatgctatatattcccaaccaatgtgccagatctaacgaagaaagatctctaggagtgacagcactttattatttaaaagaacactccaattggtgttggggtagagaatgagactgataatggaaaacaaaataatcttcaactttatttttaaagttttattacttcaattaaaaaataaacttgaaaagataaaatgttagctgtcaattctgggtagyatatacaaaaagtttattatttttaggctttttgtattagaaaattttctgaagaaaaaataaagcagaaggaacgagaatgataacagaagaaaaaggcacctgtgggaaggtgaacatttgaatacccaggacagataccaccaaatgctagtgaagctggtaaagatatttagctagaaatctataaagcttgctaaaggctaaatgtgggctaacgtgagagtgtgaagcccctggtagctccagacatagcaaggctgaaaccctcttgcacagggaagactggggaaggtcctg

SEQ ID NO: 134949 - DNA, 601 bp, Human
aactcgtcatctagcattaggtatatctcccaatgctatccctcccccctccccccaaagtataataataataaatgaaaaaaagaacagaaaaaaatgtaataaaaccaaaaaaataatttattgtatgtttcaaaacaaggaaaaataattttataagcattgtatccttattaaacagccacctagttatgacctcctctctcagaactagaatgtctcatctttctctttcttcagtggacagatatcagagggcctcagaatcatatgctatatattcccaaccaatgtgccagayctaacgaagaaagatctctaggagtgacagcactttattatttaaaagaacactccaattggtgttggggtagagaatgagactgataatggaaaacaaaataatcttcaactttatttttaaagttttattacttcaattaaaaaataaacttgaaaagataaaatgttagctgtcaattctgggtagcatatacaaaaagtttattatttttaggctttttgtattagaaaattttctgaagaaaaaataaagcagaaggaacgagaatgataacagaagaaaaaggcacctgtggga

SEQ ID NO: 134950 - DNA, 601 bp, Human
ttacatatgtgcaggttagtgtatacatgtgccatgctggtgcgctgcacccactaactcgtcatctagcattaggtatatctcccaatgctatccctcccccctccccccaaagtataataataataaatgaaaaaaagaacagaaaaaaatgtaataaaaccaaaaaaataatttattgtatgtttcaaaacaaggaaaaataattttataagcattgtatccttattaaacagccacctagttatgacctcctctctcagaactagaatgtctcatctttctctttcttcagtggacrgatatcagagggcctcagaatcatatgctatatattcccaaccaatgtgccagatctaacgaagaaagatctctaggagtgacagcactttattatttaaaagaacactccaattggtgttggggtagagaatgagactgataatggaaaacaaaataatcttcaactttatttttaaagttttattacttcaattaaaaaataaacttgaaaagataaaatgttagctgtcaattctgggtagcatatacaaaaagtttattatttttaggctttttgtattagaaaattttctgaaga

SEQ ID NO: 134951 - DNA, 601 bp, Human
caagttctactcttttctttttgggaccctaagccatcatgatgtgaagaatcatagtctaactcttggaagatgaaaggccatgtagaaaaagacaagaaactccagctatcagcctgaactgccacacaggtctgtcagaataatttgaatccccaagctctaatctagtactgaatgaccctcactgcatgaacaataccagcagaaaaagtgccccgactgtcaacccacagaataaagagaaacagtaagtcaatatttccttaagccactaaattttgagaagatttgttacaargcaattcagacacagacacagcatctaataaatgtgcatggaggaaagaaagaaggaagagatgacagattcctctaacaaatttctaattcaaagaatacctagtttcctcataaatagtagtaacttaagagattttcatcctctacaatcatatattactgctttcagaagttataagatagcttcaatcagcactaagaaacttaaattttggattccccatgtaagcagcaaagctatccccaggtaagcagcaaagctatggtatctaagcaactctaggaaaaaaaaaaaaaa

SEQ ID NO: 134952 - DNA, 601 bp, Human
cctaagctttgggggatgagcttgccatgaatccttaggtgtctattgtcccttgctgcctgtctgtgagtaataaagttgcttccctaaacttattgtgtgttctgtctcaccagactcatgccagtggattgatactggtacacagtattggcaaggtgtttacagtcctcccctgggattgataccagtgcacagtgaacctgcatcataaaattatcaaatatataaaacaaaattaagatactgaaataagctacttatcttctatcaccagtactaagcacagtgcccaaattayaggcatttgtggaagattattataaaggccacaaatgagtaactccttcccatgtccagactcctttgcaatgtgaccttgctacttctcaccaggaaattgagtctatttttccattcttttgaatctggctggccttgtgacttgctttgactaacacaaggtggcagaagtatcactgtatgagttcttgggcatagggcttaagaggtattgcaagttctactcttttctttttgggaccctaagccatcatgatgtgaagaatcatagtctaactcttggaagatgaaaggccat

SEQ ID NO: 134953 - DNA, 601 bp, Human
tcgctttctcacttgtaaatctcagaataactgtagaatgatgtgctggaaatgcaagaaatatgaaggaattgccagtaaagccaagctctgttcccatagctcctagaacaggatgtcttgcaatgctttagcacagctcatcaagttgctcctaggtataaaacccagggcagagcaggctttcagagttcctcagctgcggtgcaacatgaatgacgtgcacgtgagactccatccatcctggacagctatcctaagctttgggggatgagcttgccatgaatccttaggtgtctaytgtcccttgctgcctgtctgtgagtaataaagttgcttccctaaacttattgtgtgttctgtctcaccagactcatgccagtggattgatactggtacacagtattggcaaggtgtttacagtcctcccctgggattgataccagtgcacagtgaacctgcatcataaaattatcaaatatataaaacaaaattaagatactgaaataagctacttatcttctatcaccagtactaagcacagtgcccaaattacaggcatttgtggaagattattataaaggccacaaatgagtaactc

SEQ ID NO: 134954 - DNA, 601 bp, Human
ttgggaaaaattgagaattcttggcataagatgattagacaatataaaatgttttgagtgcacactctagacccatgactctctgtcctcttcttttatatttatcttttctgaaaacactttcatcaccatctaacataaatctgttttacatctcttgccactaaaattgaagttctctgagaataaggaatgtttctctcttattcactgctacatgaaccaatgcctggcacagaggcatccaaatatttatgaaattaatgacttaaatatgtaatcatttacaaactgtacacayacccacactttctctttacatctcactttacagataatctttatgtagattatgcaaatatctatatgccaacacactcaagaatatttaagattttccacttttactaaatagcaataactaactcaaaattatacaatgaacaattaaaattgagaatgtgaagaacactgagggaaaaaacacattttatatgatgttattgtagggcaagtccccaaaagatcttggcaacccagctcttcctcgctttctcacttgtaaatctcagaataactgtagaatgatgtgctggaaatg

SEQ ID NO: 134955 - DNA, 601 bp, Human
aataataaatatctgatcttttcctgttataacatgtcttcaatgagttaattaaacagaggatccaataacagacaagtttcaacaaaactgttttcctttttggggacccccaaaagatttgctaaaccaaaaatcctcttcacttgctggttgtctagatgtaggactagagtgctgccaaaagcaaacactggaaagtagtggcaaaggagacaaaaaaagttagtgccgtgaaatacctgataaaagttttctttgtttctcaatgattaaaatataccaaatgccacaaattaayatctgttcttgcaataaggggctacagttcactaaaacagagtggtctgaaatgtttatgatcagaattttagtacctttattttattctttctacaaagggcaaatattaaatgtactcctagagattacctcatcaaacaagagaagtcaccatattttattcaaaaggaagaaacctggatgaacacacataatagttttaaagttgttccagcttccagactgaaattcttgttggctgtactgcaaccattatcatttggcacatctcaaggggttagaaaacaactttaaccta

SEQ ID NO: 134956 - DNA, 601 bp, Human; identical to SEQ ID NO: 39067

SEQ ID NO: 134957 - DNA, 601 bp, Human; identical to SEQ ID NO: 39068

SEQ ID NO: 134958 - DNA, 601 bp, Human; identical to SEQ ID NO: 39069

SEQ ID NO: 134959 - DNA, 601 bp, Human; identical to SEQ ID NO: 39070

SEQ ID NO: 134960 - DNA, 601 bp, Human; identical to SEQ ID NO: 39071

SEQ ID NO: 134961 - DNA, 601 bp, Human; identical to SEQ ID NO: 39072

SEQ ID NO: 134962 - DNA, 601 bp, Human; identical to SEQ ID NO: 39073

SEQ ID NO: 134963 - DNA, 601 bp, Human
accaataccacaaatccgttttgaaggatacacaggaatttgtaaggtggtcaatgaggcaaagaatgtcccaggtaggaatgatgtgttgtggttcctaacacctgttctccaatgaactatgcatctttttcttcattaccatcattgtagttgtcatcaaaacagctgacatttgttgacagctcactctgtctcagtatgatgggcactgctggctggctaagttagcaccatacccaggccacttctcctttgcttcgttattagaaaagtaaacactagcttttctagcttcccrcgcagcctaaggtggccacatggcaaaatcctcaccaatgagatagaaaccagtctgctaaaatgttccaagaaggctttagtgaggataaatgtggttggtaccatccaccctgcctcttttggctttaaatacaggtaagaagtgagaaaaatgaactcctagtgtttagggccctgtgagtctggtatgatactacttaaagccaaaccggtcctatgtaataaagccaggcagtggtgtaagcactttacaaatattaacacaactagaattatttggggtctatggataatttaa

SEQ ID NO: 134964 - DNA, 601 bp, Human
aaaagctacactagaagaattatgccaatcctggcacccttcacccgtttcatccctggctcttataggcaaaattttctcccaaagtttcttctccatcctctagtatttcttcatgcaaaaactagaataggtaaatatatattctcatttcccctggtctcttacgcaaaaaaaaaaaaaaaaaaaaaaatacagacttgcttacagaatgccctgccaactttttgaaatctttctttctcagtttaattctgatctgtattcttcttattatgagtaaggaaagattgttattatrtatttaaagaccttaaattaaaaaggacagcagagttagcagacagcccagagtgggagaaaatcttcacaatctacacatccgaaaaaggactaatatccagaatctacacagaactcaaatcagcaagaaaaaaaaatcccatcaaaaagtgggctaagaacatgaattagacaattctcaaaagaagatatacaagtgggcaacaagcatatggaaaaatgctcaacatcactaagtatcagagaaatgcaaatcaaaaccacaatgcaataccacctcactcctacaagaatgggt

SEQ ID NO: 134965 - DNA, 601 bp, Human
aatttgctgtactttggagttaaagcagttgtctcctaaataaaaccaaactcaaattcagttatacaacttgagcatagtcatagtttttgaataatctttgcttgagtcccaagtcaaaaactatataaaaagctacactagaagaattatgccaatcctggcacccttcacccgtttcatccctggctcttataggcaaaattttctcccaaagtttcttctccatcctctagtatttcttcatgcaaaaactagaataggtaaatatatattctcatttcccctggtctcttacgcaaaaaaaaaaaaaaaaaaaaaaatacagacttgcttacagaatgccctgccaactttttgaaatctttctttctcagtttaattctgatctgtattcttcttattatgagtaaggaaagattgttattatgtatttaaagaccttaaattaaaaaggacagcagagttagcagacagcccagagtgggagaaaatcttcacaatctacacatccgaaaaaggactaatatccagaatctacacagaactcaaatcagcaagaaaaaaaaatcccatcaaaaagtgggctaagaacatgaat

SEQ ID NO: 134966 - DNA, 601 bp, Human
aaatgctcatcaatgatagactggataaagaaaatgtggcacatgtacaccatggaatactatgcagtcatagaaaagaatgagttcatgtcctttgcagggacatggatgaagctagaagccatcattctcagcaaactaacataggaacagaaagtgaaacactgcatgttctcactcataagtgggagatgaacaatgagaacacatggacacatgtggcctgccagggggtagggggcaaggggagagagagcattaggacaaataccttaagtatgcagggctcaaaacctagatratgggttgataggggcagcaaaccaccatggcacaagtgtacctacgtaacaaacccgcatgttctgcatatgtatcccagaacttaaagtaaaattaaaattaaaaaaagagcaaacttacaaaaaagaaaaaagtcattttaacacgtgagacactatctcattgtggttttgatttgcatttccctgacgattagtgatggtgagcatcactgttggccatctgtatgccttcttttgagaaatgcctattcaaattttttgcctattttaaaattagattattcattgttttgctg

SEQ ID NO: 134967 - DNA, 601 bp, Human
acaacagcaaagacttggaaccaacccaaatgctcatcaatgatagactggataaagaaaatgtggcacatgtacaccatggaatactatgcagtcatagaaaagaatgagttcatgtcctttgcagggacatggatgaagctagaagccatcattctcagcaaactaacataggaacagaaagtgaaacactgcatgttctcactcataagtgggagatgaacaatgagaacacatggacacatgtggcctgccagggggtagggggcaaggggagagagagcattaggacaaatacctwaagtatgcagggctcaaaacctagataatgggttgataggggcagcaaaccaccatggcacaagtgtacctacgtaacaaacccgcatgttctgcatatgtatcccagaacttaaagtaaaattaaaattaaaaaaagagcaaacttacaaaaaagaaaaaagtcattttaacacgtgagacactatctcattgtggttttgatttgcatttccctgacgattagtgatggtgagcatcactgttggccatctgtatgccttcttttgagaaatgcctattcaaattttttgcctatttt

SEQ ID NO: 134968 - DNA, 601 bp, Human
gatttgggtttttaagggccaatctcagaagaacaagaaatttaaatccaggacccacatccagatatccttatgcacacataaagtgctacacttatggtgaaaaggtgaattagaaaacaaaatgctctgcagtaacagcatagaaatttgtctacctcaccttggttcttggtggaggaagagtaagtctcccaaatgaattcatggcctctagcttattttcatatgggtttggagctggatttcatactatatttatagtccaaaaaacttagatttttgtatttaaagtgcaatkaaactagcagccctcttaggcttgagcagaaataaatgcaaatcctaatgaagaaatataagctcatttttccttaaagaagagggaacccatttattctaatatgtctctttaataaccaatggagctgagctattacctgaagctaaagaaattccaattgattggatctcagaagactggttgagatttacaatgttaaaatggtttataaacatgtttgggtgttcctaaggtgaaatgatacacactctgaaatttaaatttttcttaaaaattttatttttaattttcacgggt

SEQ ID NO: 134969 - DNA, 601 bp, Human; identical to SEQ ID NO: 39074

SEQ ID NO: 134970 - DNA, 601 bp, Human; identical to SEQ ID NO: 39075

SEQ ID NO: 134971 - DNA, 601 bp, Human
aaaatgaaaaaatttctaccttcaagaactttatatatagcctaataaaaaacagatataaaagcatcacaggataaatgtaaaactataactgtgctaagtatacgaatggattaatagttctgacatataatgtatgtatatgtgctgatataatttggatacttgtccccacccaaatcttacgctgaattgtaatccccaatgccggaggtagggcctgataggacgtgttgggtcatgggggcagatccctcatgtcttggtgttgtctttgtgatgtgacttctagcaagaccargctgcttaaatgtatggcacctaccctccaacactctctctcactcctgttcttgccatatgagatacctgctccctctctgccctctgctgcgaattaaagctcccagaagccaaacagatgttggcaccatgcttcctataaaccctgcagaactgtaagtcaagtaaacttcttttttttatgaattacccagtctcaggtatttctttatagcaaggtaagcatggcctaatacatgtgctatacccatacatgtatacatgtatgaagaatcacattatacacatatacgtgtgt

SEQ ID NO: 134972 - DNA, 601 bp, Human
tttacatttttatgttattgtaaataaatcattatcttccaaatagatcttgaaagaaaagcttttgatctttatcatgtcacttcaaacccattttattaaagccttttattatagctttctttgaggagtttcagttatacaatcttgtcacacaacacttttatttcctcatttctaacagttactccttttataataatattaaatcttaaggataattatattgatcatgttgtaattgtaatgcttccagagtttcatcattaaaaatgatgttttttgttgttttcagataaawagttacttattcatttagggaatatttatatttattgagtaccactaaaaccagggacataatggtaagagaaaaaatgaaaaaatttctaccttcaagaactttatatatagcctaataaaaaacagatataaaagcatcacaggataaatgtaaaactataactgtgctaagtatacgaatggattaatagttctgacatataatgtatgtatatgtgctgatataatttggatacttgtccccacccaaatcttacgctgaattgtaatccccaatgccggaggtagggcctgatag

SEQ ID NO: 134973 - DNA, 601 bp, Human
ccattttggccaggatggtcttgatctcctgaccttgtgatttgcccaccacgtgctcctcaaagtgctgggattacaggcgtgagccaccacgcccagcccccacgcgcacccccaacttttttgttttttttttttttgagatggagtctcgctctatcgcccaggctggagtgcagtagggcgatcctggctcactgcaacctccacctctcaggttcaagcgattttcctgcctcagcctcccaagtagctgggactacagacacgtgccaccacacccagctaatttttgtacatktagtagagacggggtttcaccatgctggccaggatggtctcaatctcctgacctcatgatccgcccaccttggcctcccaaactgctgggattacaggcatgagacactgtgcctggccaggcataactttttaaaaggatatgctgatttacacgtcctcagttaaattctagtttttatcaataggtattgagatattatttcatagtggttattattagggtatttacatttttatgttattgtaaataaatcattatcttccaaatagatcttgaaagaaaagcttttgatcttta

SEQ ID NO: 134974 - DNA, 601 bp, Human
gggaagggcatgctggtgggaggggttgatgaagagaggttagtcaataggtacaaacagttatctatacagttagatagaaggtataaattctactattcaatagcaaagtagggtgactatagttagcagcaatatattacataattcaaagtagctagaaaaaaagacttaaaatgttcccaacacatagaaatgataaatactgctagtgacggataccccaaatacactgatttcatcattacacaccttacatacataagaaaatatcacatgaatctcataaatatgtaaaatrttgtgtatcaatttaaaaaaccaaaaaactattttcttatgatcatgtaaataatacatacccatggttaaaagtttggaattcacagaagaacatgatgaaaaaaattaaaactacccattaaaccacatcacccattaatgccttaaattttgatatatttccttctgatcttctgcccatatttttacatgacataattctatattttttacttaacagaatcattatcttaagtcatatttataaacataattttcatgtcaataatactcgattgtgtgaatgtaaaatttataa

SEQ ID NO: 134975 - DNA, 601 bp, Human
acaccgccatgttctcactcataggtgggaattgaacaatgagaacacatggacacaggaaggggaacatcacactctggggtctgttgtggggtggggggaggggggaggaatagcattaggtgatatacctaatgctaaatgacgagttaatgggtgcagcacaccagcatggcacatgtatacatatgtaactaacctgcacattgtgcacatgtaccctaaaacttaaaagtataataataatgaaaaaaataaagaaattatacagatggcaaacaagtatataatgttcaacatyactaattattagataaatgtaaataaaagtgacacggaatatcattttaccccagttagaatggctatcattaaaaagataaaagaatagcaggtgttggtgaggatgtggaaaaaaggaactcttatagatagttgctgggaatgtaaactagtataaccacaatggaaaacactatggagattcctcaaaaatctaaaaactgaactaccatccaatccagcaatcccattatgaggtattttttgaaaggaaaagaaaccaacatctcaaagagatacctgcacttgcctgtttatt

SEQ ID NO: 134976 - DNA, 601 bp, Human
gtaacagttgtctatgcccgatgtcttacaagaaagtagagggcataaagaacaaatcactgaattacttaagaaatgtgaactactttggtttgtttactcagtgtagcactaatccttcaggtaggacaaactgctatcataataaccatgattggtatttgtagattcaacaaatcttttaaaaagtcaaaatactatgttcctatttttaattatgaatcttgaaacaggatgaattacaagaatagatctcaggcggcctaaagtctgtgtccaccaggctatgatacagctgcaratcatttttttacaagttacgtgcacctggtaaataggtagattagtttccagaaaagttgcaataggccaaaaaggtaaaaaatgaaacaaaacagaaacctagtgagagtgggaaatgcaagcttaagaatctagataggatatttatgcaaatcaggtggtacctgggtgtaggctgttgctactcataaggttcttttctgttagttgcaaaacagtaatacttctgagtatacgaaatgaataaaggtgttccctctctgcaggacaaattataaaaggatgtaacccttcctct

SEQ ID NO: 134977 - DNA, 601 bp, Human
tagaaaatctttgaatctgcctataacctggaaggcacctgcttccagatttcctgcctttccagatgtaccaaaccaatgtacatcttacatatatcaattgatgtcttatgtctccctaaaatgtataaaaccaagttgtagtttgaccacctcgggcacatgttctcaggatctcctaagggctgtgtcacaggccactggtcactcatatttggctccaaatgaatctcttcaaatattttacagaatttgacacttcatcaacacatatatgcaaatattctaaaatccaaaaaaytgaaatctgaaacccttctggtcccaagcattttggataagggacactcaacttgtaatgtgtaacagttgtctatgcccgatgtcttacaagaaagtagagggcataaagaacaaatcactgaattacttaagaaatgtgaactactttggtttgtttactcagtgtagcactaatccttcaggtaggacaaactgctatcataataaccatgattggtatttgtagattcaacaaatcttttaaaaagtcaaaatactatgttcctatttttaattatgaatcttgaaacaggatgaa

SEQ ID NO: 134978 - DNA, 601 bp, Human
tggggttcatcaaactcctgtggtgtgccacatgtagtacaaaatacatattacagcactttgggagcctgaggtgggtggatcatgaggtcaggagttcgagaccagcttggccaacatagtgaaaccccatctctaccaaaaatacaaaaattagccaggcatggtgatacacgcctgtagtgccaactactcaggaggctgaggcaggagaatcgcttgaacccaggaggcagaggttgtggtaagctgagattgcaccactgcactccagcctgggcaatagagcgagactgtctcaaaaaaaaaaagatacatattagtcataggagtaggacaacatattgattggcaacaggttaaggaaaaaatgttattctcttactatggatagtttaagaagtagtgctctagcacttgatgagggctatctctgaaaaaccacaggaaaaaaaaaagaagaaaaaaagaaattaacaaaaaaagatacgacggccccaggctttgctagggtccaagatgaaagcattatctgtggtcattctgatactgataagattttggcaaaagatatacccaccccctagtatctgtaggggga

SEQ ID NO: 134979 - DNA, 601 bp, Human
tataagtacagaaattaagtgttcaacaacttgcagtaatttgacatggccatgacatttgagcatgtatcagtctcatttcactgaacatggtataagccagcttggggttcatcaaactcctgtggtgtgccacatgtagtacaaaatacatattacagcactttgggagcctgaggtgggtggatcatgaggtcaggagttcgagaccagcttggccaacatagtgaaaccccatctctaccaaaaatacaaaaattagccaggcatggtgatacacgcctgtagtgccaactactcmggaggctgaggcaggagaatcgcttgaacccaggaggcagaggttgtggtaagctgagattgcaccactgcactccagcctgggcaatagagcgagactgtctcaaaaaaaaaaagatacatattagtcataggagtaggacaacatattgattggcaacaggttaaggaaaaaatgttattctcttactatggatagtttaagaagtagtgctctagcacttgatgagggctatctctgaaaaaccacaggaaaaaaaaaagaagaaaaaaagaaattaacaaaaaaagatacgacggc

SEQ ID NO: 134980 - DNA, 601 bp, Human
ggtaacacctctacaaaagccagaaggaaagagaaacggagaggttgaaaccacagctataaaatagtactgagaagacagagaccaaagtccaagtactatatagtactatatacactgtagactttcatttgagacccagtaaggccagatcctagaagtaagacacaaaaatagtagagccttcacaaagcctaaaaacaagcttcaacagaagcaagtgagcatctggcactgaggctaccagaacaaaccttagctctttgcttctacagcttttcatcaatttctggctctcacaaaaaaaaaaaaaagtcatgcaaagagaaaaggaccaaatattgaaatgaaacaggaaaaaaaaaaaaagacaataaaaaaccccaaagattacttagacaaggactttaaaataactatcaatatattttttaaaaagcacaaaaatttctaaaaagaaaaattttgacagaactaaaatctgtttaaaaagaatcaaagagatatttaaggtttttaaaatataatatttataattaagaactctaagaacttattgggtgggtttaattgcagactgtacgcagaagagacagggatt

SEQ ID NO: 134981 - DNA, 601 bp, Human; identical to SEQ ID NO: 39076

SEQ ID NO: 134982 - DNA, 601 bp, Human; identical to SEQ ID NO: 39077

SEQ ID NO: 134983 - DNA, 601 bp, Human; identical to SEQ ID NO: 39078

SEQ ID NO: 134984 - DNA, 601 bp, Human; identical to SEQ ID NO: 39079

SEQ ID NO: 134985 - DNA, 601 bp, Human; identical to SEQ ID NO: 39080

SEQ ID NO: 134986 - DNA, 601 bp, Human; identical to SEQ ID NO: 39081

SEQ ID NO: 134987 - DNA, 601 bp, Human; identical to SEQ ID NO: 39082

SEQ ID NO: 134988 - DNA, 601 bp, Human; identical to SEQ ID NO: 39083

SEQ ID NO: 134989 - DNA, 601 bp, Human; identical to SEQ ID NO: 39084

SEQ ID NO: 134990 - DNA, 601 bp, Human; identical to SEQ ID NO: 39085

SEQ ID NO: 134991 - DNA, 601 bp, Human; identical to SEQ ID NO: 39086

SEQ ID NO: 134992 - DNA, 601 bp, Human; identical to SEQ ID NO: 39087

SEQ ID NO: 134993 - DNA, 601 bp, Human; identical to SEQ ID NO: 39088

SEQ ID NO: 134994 - DNA, 601 bp, Human; identical to SEQ ID NO: 39089

SEQ ID NO: 134995 - DNA, 601 bp, Human; identical to SEQ ID NO: 39090

SEQ ID NO: 134996 - DNA, 601 bp, Human; identical to SEQ ID NO: 39091

SEQ ID NO: 134997 - DNA, 601 bp, Human; identical to SEQ ID NO: 39092

SEQ ID NO: 134998 - DNA, 601 bp, Human; identical to SEQ ID NO: 39093

SEQ ID NO: 134999 - DNA, 601 bp, Human; identical to SEQ ID NO: 39094

SEQ ID NO: 135000 - DNA, 601 bp, Human; identical to SEQ ID NO: 39095

SEQ ID NO: 135001 - DNA, 601 bp, Human; identical to SEQ ID NO: 39096

SEQ ID NO: 135002 - DNA, 601 bp, Human; identical to SEQ ID NO: 39097

SEQ ID NO: 135003 - DNA, 601 bp, Human
tgtagagcagaggtctcactgtgttgcccaggctggtctcaaactcatcagctcaagtgatcctcttgaattgacctcccaaagaggtgggattacaggtataaaccaccatgcctgacctaaattcttttttgttatttttgtctgactgggttaggtcaaaagactggttttcaagctctgaaattctttctcctgcttggtccagtctattgataaagctttcaattatattttgaaattccttaagtgatgcttctatagcctatgcatttctatcagctgattttactttgggctktgtggtttgacctacaagctagtagatagcccttatgagtaaaagccagctgaggccaacatggcagggtatatacttgatccttgttactgggataatctctctgttgtctcaggcaatgggctgatctgtggtgtgcacagtggtctggcctccctgctcagacatggtgggcaagatgggcagggccaggctgagcaggcctgcctacaggtaccccaacggcaggcacaagcaccaacactgagggagaatacagtgggcaaccaccaggtgtctagaggtgtgcctaggcatgga

SEQ ID NO: 135004 - DNA, 601 bp, Human
tgtacaattctgctctgattttagttatttcttttcttctgctagctttgaggttagttcattcttgtttttcctaattcctcttggtgtgatgttaagtcattattttgagatagttctaaatttttttgtttttgttttttgttttgagacgaagtcttgctctgtcacctaggctggagtgcagtggctgtatctcggctcactgcaagctccgcctcccgggttcatgccattctcctgcctcagcccccagagtagctgggactacaggcaccagccaccaggcccagctaatttktttttgtacttttagtagagatggggtttcactgtgttagccaggatggtctcgatctcctgacctcgtgatctgcccacctcggcctcccaaagtgctgggattacaggcgtgagccaccgcgcctggtgatagttctaaatttttgagataggtggttagcactataactctgaaaactgcttttgctgcatgccagagatcttcgtatgttgtttgttttcatttatttgaatttttattattgctgccttaatttcagtttacccaaaagtgatttcaaaagcaagttatttaatt

SEQ ID NO: 135005 - DNA, 601 bp, Human
ctttttcttggaattgccttggctatttgggctcttttctggttccatattaattttagaatagtattttccaattctgtgaataatgacattggcagtttgatatgaatagcattaaatctgtagattgtgttgggcagtatggccatgttaacaatatttagtcttccaatccgtgagcatggaatgtttacccatttgtttgcataatatatgatcactttcagcagtgtttagtaattatccttgtagagatctttcatctccttagttagctgtattcctaggtattttatttgtgtgtgtgtgtgtgtgtgtgtgtgtgtgtgtgtgtgtgtatggctattgtaaatgggactgcattcttgatttggctctcagcttgaatgttattggtctatagaaatgctactgattgctgtgcattaattttgaatcctgaaactttacttaagtaatttatcagttctaggagttgtccggtggagtctttagggttttctaggtgtagaatcatatcatcagtgaagagagatactggacttcttttactatttggatgccttttatttattgctcttgcctgattgctctaagactt

SEQ ID NO: 135006 - DNA, 601 bp, Human
ttctttttcttggaattgccttggctatttgggctcttttctggttccatattaattttagaatagtattttccaattctgtgaataatgacattggcagtttgatatgaatagcattaaatctgtagattgtgttgggcagtatggccatgttaacaatatttagtcttccaatccgtgagcatggaatgtttacccatttgtttgcataatatatgatcactttcagcagtgtttagtaattatccttgtagagatctttcatctccttagttagctgtattcctaggtattttatttgtgtgtgtgtgtgtgtgtgtgtgtgtgtgtgtgtgtgtgtatggctattgtaaatgggactgcattcttgatttggctctcagcttgaatgttattggtctatagaaatgctactgattgctgtgcattaattttgaatcctgaaactttacttaagtaatttatcagttctaggagttgtccggtggagtctttagggttttctaggtgtagaatcatatcatcagtgaagagagatactggacttcttttactatttggatgccttttatttattgctcttgcctgattgctctaagac

SEQ ID NO: 135007 - DNA, 601 bp, Human
actgcccgggccggcagcgcccgccggcctgagtgcagggcctgctgagcccacgcccacccggaactcgcgctggcccatgaacgtggcgcggagccctggttcccgcccgcgcctctccctccacacctccccgcaagcagagggagccggctccggcctcggacagcccagagaggggcccccacagtgcagtggcaggctgaagggctcctcgagcatggccagagcggacgccgagggcaaggaggtgctgagagtgagcaagggccaccagcacattgtcacctctcaatatgaygccttcagatttgttctttttcttggaattgccttggctatttgggctcttttctggttccatattaattttagaatagtattttccaattctgtgaataatgacattggcagtttgatatgaatagcattaaatctgtagattgtgttgggcagtatggccatgttaacaatatttagtcttccaatccgtgagcatggaatgtttacccatttgtttgcataatatatgatcactttcagcagtgtttagtaattatccttgtagagatctttcatctccttagttagctgtattcct

SEQ ID NO: 135008 - DNA, 601 bp, Human
cactgcccgggccggcagcgcccgccggcctgagtgcagggcctgctgagcccacgcccacccggaactcgcgctggcccatgaacgtggcgcggagccctggttcccgcccgcgcctctccctccacacctccccgcaagcagagggagccggctccggcctcggacagcccagagaggggcccccacagtgcagtggcaggctgaagggctcctcgagcatggccagagcggacgccgagggcaaggaggtgctgagagtgagcaagggccaccagcacattgtcacctctcaatatgmtgccttcagatttgttctttttcttggaattgccttggctatttgggctcttttctggttccatattaattttagaatagtattttccaattctgtgaataatgacattggcagtttgatatgaatagcattaaatctgtagattgtgttgggcagtatggccatgttaacaatatttagtcttccaatccgtgagcatggaatgtttacccatttgtttgcataatatatgatcactttcagcagtgtttagtaattatccttgtagagatctttcatctccttagttagctgtattcc

SEQ ID NO: 135009 - DNA, 601 bp, Human
gcccgggtgctacgcccctcactgcccgggccggcagcgcccgccggcctgagtgcagggcctgctgagcccacgcccacccggaactcgcgctggcccatgaacgtggcgcggagccctggttcccgcccgcgcctctccctccacacctccccgcaagcagagggagccggctccggcctcggacagcccagagaggggcccccacagtgcagtggcaggctgaagggctcctcgagcatggccagagcggacgccgagggcaaggaggtgctgagagtgagcaagggccaccagcacrttgtcacctctcaatatgatgccttcagatttgttctttttcttggaattgccttggctatttgggctcttttctggttccatattaattttagaatagtattttccaattctgtgaataatgacattggcagtttgatatgaatagcattaaatctgtagattgtgttgggcagtatggccatgttaacaatatttagtcttccaatccgtgagcatggaatgtttacccatttgtttgcataatatatgatcactttcagcagtgtttagtaattatccttgtagagatctttcatct

SEQ ID NO: 135010 - DNA, 601 bp, Human
ctaattcatcttgagttaatttttgtataaggtgtaaggaaggggtccagtttcagttttctgcatctcaggcatggcgggctgcgggtcccaagccctgacccagggggaggcagatgaggcagcgagaattcgagcacagtgctggcccagcgcaccctctgtagctgctggcccgggtgctacgcccctcactgcccgggccggcagcgcccgccggcctgagtgcagggcctgctgagcccacgcccacccggaactcgcgctggcccatgaacgtggcgcggagccctggttcccrcccgcgcctctccctccacacctccccgcaagcagagggagccggctccggcctcggacagcccagagaggggcccccacagtgcagtggcaggctgaagggctcctcgagcatggccagagcggacgccgagggcaaggaggtgctgagagtgagcaagggccaccagcacattgtcacctctcaatatgatgccttcagatttgttctttttcttggaattgccttggctatttgggctcttttctggttccatattaattttagaatagtattttccaattctgtgaataatgacat

SEQ ID NO: 135011 - DNA, 601 bp, Human
tgtttgtaggtgtgtggctttatttctgggttctctactctgttccattagtctatgtgtctatttttgtaccagtaccatgctgctctggttactgtagcctcatagtgtactgtgaagttgggtaatactgtgtccggaattggtgggttcttgatcacactgacttcaagaataaagctgtggaccctcgcggtgagtgttacagttcttaaagatggagtgtccagagtttgttccttctgatgttcagatgtgttcggggttttctccttctggtgggttggtggtctcgctggcytcaggagtgaaggtgcagacttttatggtgagtgttacagctctcaaaggcagcacggacccaaagactgagcagcagaaagatttactgcaaagagcaaaagaacaaacctcccacagcatggaaagggacccaagcgggttgccacggctggcttgggcagcctgcttttattcccttatctggccccacccacatcttgctgattggtccattctacagagagctgattggtctgttttacagagagctgattggtccgttttgacagggtgctgattggtgtgtttacaatccctg

SEQ ID NO: 135012 - DNA, 601 bp, Human
ttggttacaacacaggtgtatcatgtaatgctgaagttggggttatgactgatcccattacccaggtagttagcatagtaccagatagttttccaacccttccctgactttttccttccctctcccctctagaaatccccagtgtctcttgctgccatctttatgtctatgagtaccgaatgtttagctcccactcataagagagaacatgcagtgtttggtttcctgtttctgtgttagtttgcttggcctccagctgagtccatgttgctccaaaggggacgatttcatttttaatggstgcgtagtattccatggtgtatatatgcaccacattttctttaaccaatccaccactgatggacacctaggctgattctacatctttgctattatgaatagtgctgcagtgaacatacatgtgtctttttggtagaacgatttattttcctctggagatgtacccagtaatgggattgctgggttgaatggtagttctgttttaagttctttgaaacatctacaaactgctttccaaaggggctgaactaatttacatccccactaacagtgtatatgcgttccccttcctcctcagcct

SEQ ID NO: 135013 - DNA, 601 bp, Human
caggcagagatgctcctcacttcctagacggggtggcggccgggcagaggctgcaatctcggcactttgggagggcaaggcaggcggctgggaggtggaggttgtagtgagccgagatcatgccactgcactccagcctgggcaacattgagcactaagtgagcgagactccatctgcaatcccggcacctcgggaggccggggctggcagatcactcgaggtcaggagctggagaccagcccggccaacacagcgaaaccccgtctccaccaaaaaatacgaaaaccagtcaggcgtggyggcgcgcgcctgcaatcccaggcactaggcaggctgaggcaggagaatcaggcagggaggttgcagtgagccaagatggaggcagtacagtccagcctcggcttggcatcagagggagatgagggagagggggagggagaatacatttccttgtaaaaattacaactttttccaattaagcaattttagatgcaattatgcctaagataaatttaattaaatatatttttaaagaatttcagcttttattttagattcgagggtacacatgcagattggttacaacacaggtgtatcatg

SEQ ID NO: 135014 - DNA, 601 bp, Human; identical to SEQ ID NO: 39098

SEQ ID NO: 135015 - DNA, 601 bp, Human; identical to SEQ ID NO: 39099

SEQ ID NO: 135016 - DNA, 601 bp, Human
gtgagggcacttaagtaacaccaaaaacaggtctatgtggcaatggaatgaagcactctgctaaaagccagtgaaacactgaggactcctgcagtggcatgtaagtgagtcatcttagaagcttgtcctcctgctccagtgaagccttcggatcactgcaactataaccaaaatcttaaatatagccttataagagaatctaagatagaatcactcaggtaaattgctcctaaattcttgaacctcagaaactgttaagataaatgttcactgtttaccaccaagtggtaatttgttatayagcaataaatttatacttagctaatataaaaacaatttcataaaatattttggtttatgtttcttaagtattttttatctagataaacttatatattaacttagaaatacagacagttatgaaagactacttttatatacagaaatatatcctcttgaagtatactggtttataatcaataacaagaaatttaatgttgacttaaggcttaaaatattcttcagtgagataaatttacttagtttttcttaaataatcagggaaagaaaatgctgcttaattatgtgaccaaaaattgct

SEQ ID NO: 135017 - DNA, 601 bp, Human
gaaagaaaaactacaatgaaatgatgatttgattagacaatgattatcttttttcaatttttatatttccaacagatagcattttgggatccaaaattatttcttgtcatcatgattattgcacttcatatattacagtgtttttagtttgtggttctaatgatacttgggttttgaaaatctttgggacaatgaaaataatcatccatcctataaggaataaacaattattaaaagatagcacttctgaaagttatagaagaagcaactaaatcaagagaaagttatctgctagacacaytgaaacaactggggaaagggagtttgtgagcctctgaaagaatatacacacccagaaccgcttgagaagaaacagcaggcaaaagttaatttctcccaatagatgtaatagatcccaaacagctttttttttttttttttttttttttttttttgaaattttccggtctgcaggctactgagtaaagcctaaatgcattctgacatggtgtaatatgaaataaaaatgcttaatttaagaagtattatttattcttaacgtggtagctagtctccaagatggccccaacgatccccatct

SEQ ID NO: 135018 - DNA, 601 bp, Human
ctacttggagaacagaatcattagaagctccagcctcagcatcacacaatatgcccatgtaacaaatctccacatgtacccctggaatcaaagctaaaaataaataaagtcatattgaaagaaaaattttccctataactacttatcaaataaatacaaataagaagccatctttggccaggcacagtggctcacgcctgtaatctcagcactttgggaagctgaggcgagtggatcacttgaactcaggagtgtgacaccagcctggatgacatggcaaaacccgtctctacaaaaaaayacaaaaatttgctgggtgtgatggcatgcacctgcagtcccaagctgcccaggaggctgaggtgggaggattgcttgagcccaggagttgggtgctgtggtgagccgagatcacaccattgtactccagcctcaatgacagagcgagaccccgtctcaaaaaacaaaacaaaataaaacaaaacaaaacaaaaaaatttaaaaaaagaaactctctttgtttttaaattggcagaaagaattaggtataacaaaaatcaagactttcaacactgtgatgtgacagatcctctcaaaaact

SEQ ID NO: 135019 - DNA, 601 bp, Human
caggtactatgtttgctacttggagaacagaatcattagaagctccagcctcagcatcacacaatatgcccatgtaacaaatctccacatgtacccctggaatcaaagctaaaaataaataaagtcatattgaaagaaaaattttccctataactacttatcaaataaatacaaataagaagccatctttggccaggcacagtggctcacgcctgtaatctcagcactttgggaagctgaggcgagtggatcacttgaactcaggagtgtgacaccagcctggatgacatggcaaaacccttctctacaaaaaaatacaaaaatttgctgggtgtgatggcatgcacctgcagtcccaagctgcccaggaggctgaggtgggaggattgcttgagcccaggagttgggtgctgtggtgagccgagatcacaccattgtactccagcctcaatgacagagcgagaccccgtctcaaaaaacaaaacaaaataaaacaaaacaaaacaaaaaaatttaaaaaaagaaactctctttgtttttaaattggcagaaagaattaggtataacaaaaatcaagactttcaacactgtgatgtgacag

SEQ ID NO: 135020 - DNA, 601 bp, Human
ttcgcagcaacattggctcggctggaggccattattttaagtgaattaacacaaaaccagaaaatcaaatgctgcgtgttctcacttatgtgggagctaaacaatggatactcagggacacaaatatgggagtagacactggggactacaaaaggggatgggaagggagaaaggggggccacgagagttgaaaaactacctatcaggtactatgtttgctacttggagaacagaatcattagaagctccagcctcagcatcacacaatatgcccatgtaacaaatctccacatgtacccctggaatcaaagctaaaaataaataaagtcatattgaaagaaaaattttccctataactacttatcaaataaatacaaataagaagccatctttggccaggcacagtggctcacgcctgtaatctcagcactttgggaagctgaggcgagtggatcacttgaactcaggagtgtgacaccagcctggatgacatggcaaaacccgtctctacaaaaaaatacaaaaatttgctgggtgtgatggcatgcacctgcagtcccaagctgcccaggaggctgaggtgggaggattgcttgagccc

SEQ ID NO: 135021 - DNA, 601 bp, Human
gcgcaagacaaggatgccctctctcaccactcctattcaacacagtattgaaagttctggccagggtaatcaggcgcaagaaagaaataaagggtattcaaataggaagagagaagtcaaattacatttgtttgcagataacatgatcttatatctagaaaaccccatcatctcagcccaaaagcttcttaagctgataagcaactttagcaaagtctcaggatacaaaatcaatgtgcaaaaatctctagcattcctatacaccaacaacaagtaggcagagagccatcccattcacaaytgctacaaaatgaataaaatacctaggaatatagctaacaagggaagtatagaatctcttcaaggagaattacaaaccactgctcaaaggaaatcggagaggacacaaacaaatggaaaaacattccatgctcatggacaggaagaacgaacatcatgaaaatggccatactgccctaagtaatttatagattcaaagctattcccattaaactaacattgacattcttcacatatttagaaaaagtgattttaaaattcatatggaaccaaaaaagagcccgaatagtcaagccaatcc

SEQ ID NO: 135022 - DNA, 601 bp, Human
atacctcaaaataataaaagccatatatgacaaactcacagccaatatcatactgaatgggcaaaagctggaagcatttccccttgaaaactggcgcaagacaaggatgccctctctcaccactcctattcaacacagtattgaaagttctggccagggtaatcaggcgcaagaaagaaataaagggtattcaaataggaagagagaagtcaaattacatttgtttgcagataacatgatcttatatctagaaaaccccatcatctcagcccaaaagcttcttaagctgataagcaacttyagcaaagtctcaggatacaaaatcaatgtgcaaaaatctctagcattcctatacaccaacaacaagtaggcagagagccatcccattcacaattgctacaaaatgaataaaatacctaggaatatagctaacaagggaagtatagaatctcttcaaggagaattacaaaccactgctcaaaggaaatcggagaggacacaaacaaatggaaaaacattccatgctcatggacaggaagaacgaacatcatgaaaatggccatactgccctaagtaatttatagattcaaagctattccca

SEQ ID NO: 135023 - DNA, 601 bp, Human
gtcttcaagagatccatctcacatggaaagacacacataggctcaaaataaagagatggaggaaaatttacaagcaaatggataacagaaaaaaagctggggttgcaatcctagtttctgactttaaaccaacaaaggtcaaaaaagaatgttacataattgtaaagggttcaagaagaaataactatcctaaatatataggcacccaatacagaagcacccagattcataaagcaaattcttaagagacctacaaagagacttagactcccacacaataatagtgagagaccttaacacsccattaacagtattagacagatcatcgagacagaaaattaacaaaaatattcacgacctgaactcagctctggatcaagtggacttgatagatatttacagaaatctccaccaaaacccaacagaatatacattcttctcattgccacatggcacttactctaaaatcgatcacataattggaagtaaaacgttcctcagcaaatgcaaaataagtgaaatcgtaacagtctttcagaccacaacacaaattagaactgaagattaagaaattcactcaaaaccacacaactacatgaaa

SEQ ID NO: 135024 - DNA, 601 bp, Human
aaggaacttcgctaagctaaaggagcatgttctaacccaatgcaaagaaacgaagcactatgataaaacattacaggagctgtaaacgagaacaatcagtttagagaggaatataaatgacctgatggagctgaaaaacacaacataagaacttcacaatgcaaccacaagtatcaataaccgaacagaccaagcagaggaaaaaatttcagaacttgaaaactatcttgctgaaataaggcaggtagacacattaaacaaaaaagaatgaaaaggaacaaacaaaacctccgagaactayaggattatgtaaaaggagctgtgactgatggggtacctgaaagaaacagggagaacagaaccaagttgaaaaacatacttgaggatattcatccaggagaacttccccaatctagcaggaaaagacaacatttaaattcaggaaatgtggagaaccccagtaagatactccatgaaaagatcaaccacaagacatataatcatcagattctccaaggttgaaatgaaagaagaaatgttagggggcagccagacagaaaggctaggtcatccacaaagggaagcccatcagactaacagc

SEQ ID NO: 135025 - DNA, 601 bp, Human
ggattataaagacagagctttgatctcttcctgagacagagttcccagtgggagaagcggctaccatctctgcagttcggttgactcagctgttccactcagccggctctggagagtccaaacagtctgggtgagaaatgatccaccccaacacagcacacctgctccaccaacaagcagccagactgcctctttaagcaggtccctgatcccattcttcctatctgcataagatctcacaacaagggtctccagccacctgctataggtgtgtttgggctggcaataggtctgtaccccmctaggacagagcttccagaaggatctggctgccatctttgttgtttcacagccttcactggtgatacctctgggtacaggaaaaacagaagcaactagggtctggagtgaaccctcagcaaactgcagcagccctacagaagagcagcttgaccgttaaaaacaaacagaaagcaacaaaatcatcgtcaacaaaaaggactccagaaaaaccccattcaaaggtcagcaatctcaaaaatcacaggtagataagcccacaaagatgagaaaaaatcaaagcaaaaatgctgaaaattca

SEQ ID NO: 135026 - DNA, 601 bp, Human
gaaaggataattaatagaattaaaactctaagtgggtgggctcagtggctcctgcctataatcccagcactttgggaggctgaggcaggtggatcacctgaggtgaggagttcgagaccactctggccattatggtgaaactccatctctactaaaaaaaaaaaaaaaaaaaaaaaaaaaaaaaaaaaaattagctgggcgtggtgatgcacgcctgtaatcccaaccacatgcgaggctgaggcaggagaatcacttgaacctactaggaggtggaggatgcagtgagccgagactgcaycaccgcactccagcctgggcgactgagtgagactctttcaaaaaaacaaaaacaaaagaacaaaaaaccccctgcaaaactcttaagtataaaaattatgaagaaattttaaaagactgatagttctgatatagacattttttaactgtcaagaacatcacacactaatttaaatgatgtcaaaatgtaaagtgacatgcaaaatattgatctacaaaatgcttctatgggtcaatgattaaaatcctaacacttagaagcctgatattatctggcacctcattcttctgttatctcatc

SEQ ID NO: 135027 - DNA, 601 bp, Human
cctcaaggatctaaactagaattaatatttgacccagcaatcccattactgcttatatacccaaaggattataaatcatgctactataaagacacatgcacatgtatgtttattgtggcactattgacaatagcaaagacttggaaccaacccaaatgtccatcaatgatagactggattaagaaaatgtggcacgtatacaccatggaatactatgcagccataaaaaaggatgagttcatgtcctttgccgggacatggatgaagctggaaaccatcattttcaggaaactataaggayggaaaaccaaataccacatgttctcactcataggtgggaattgaacaatgagatcaattggacacagggccttggacacagggaagggaacatcacccaccagggcctgttgagggatgggggcctgagggagggatagcattaggagacatacctaatgtaaatgatgagttgataggtacagcaaaccatcatggcacatatatacctatgtatcaaacctgcatgttgtgcacatgtaccctagaacttaaagtataataaaaaaaaaaaagaaggcaatgagatgatatattcaaa

SEQ ID NO: 135028 - DNA, 601 bp, Human
ctggtattaaacaaccttaaactatataattaattctaataatttatatgtggctatgtatgtattttctgtgtaaacaacttggaatggcaactggaagataaatcaataaagattatacaatctggagaacagaatgtaaaaagactgaaaaaaatgaacagtttctcagagaaacgtgggacaccattaagcatgccaacatatgcattatagaagacccaggaagacaaggaaaaagaaacatagaagatacttttaaaaactactgaaaaattcccaattttgattaataacatartttacaaatttaagaagctcaatgtactccaataaggataaatgtaaagatatccacagccagacacaccagtcaaaatgttaaaagcaaaagctaaaatcttgaaaagaagagaaatgcttttttcactgtatacaaaagaatctcagtaacaataaaggctaacttcttatcagaaacaacagaagccagaaggcaatcagatgggggcgttccaagatggccgaataggaacagctccagtctgcagctcccagtgtgaccgatgcagcagatgggtgattcctgcatttccagctc

SEQ ID NO: 135029 - DNA, 601 bp, Human
tactgttccataaagccaactttgttataaatcaagtgttaatatatgcatggctctacttctgggttctctattcttcttccattgctctatttttctatccttgtgctgataccaaactgttttcaattacgtagttttatcaaagatcttgatatccagtaaagcaattatcactttttatgctttaagattattttagctactcttggtactttgaatttctggatgagtttttgaatctgcttgacaatttccacaaaaatttccagtgtttgatatttttcatactattgtaaayggtatatttatttaaactgcatttctcgtttgttgcagctcttagaaatataattaattattggacattgactggtattaaacaaccttaaactatataattaattctaataatttatatgtggctatgtatgtattttctgtgtaaacaacttggaatggcaactggaagataaatcaataaagattatacaatctggagaacagaatgtaaaaagactgaaaaaaatgaacagtttctcagagaaacgtgggacaccattaagcatgccaacatatgcattatagaagacccaggaag

SEQ ID NO: 135030 - DNA, 601 bp, Human; identical to SEQ ID NO: 39100

SEQ ID NO: 135031 - DNA, 601 bp, Human; identical to SEQ ID NO: 39101

SEQ ID NO: 135032 - DNA, 601 bp, Human; identical to SEQ ID NO: 39102

SEQ ID NO: 135033 - DNA, 601 bp, Human; identical to SEQ ID NO: 39103

SEQ ID NO: 135034 - DNA, 601 bp, Human; identical to SEQ ID NO: 39104

SEQ ID NO: 135035 - DNA, 601 bp, Human; identical to SEQ ID NO: 39105

SEQ ID NO: 135036 - DNA, 601 bp, Human; identical to SEQ ID NO: 39106

SEQ ID NO: 135037 - DNA, 601 bp, Human; identical to SEQ ID NO: 39107

SEQ ID NO: 135038 - DNA, 601 bp, Human; identical to SEQ ID NO: 39108

SEQ ID NO: 135039 - DNA, 601 bp, Human; identical to SEQ ID NO: 39109

SEQ ID NO: 135040 - DNA, 601 bp, Human
tgtgaaaacagactaccacacgtatcttaaattcttccaaaacgcttcccttttttgtggtttctgaattccttttctcattctagattcaacgtttaaaagactcagtttaatactttctttctgtgctgtgaattacaacagctgaggaagagaagtctgactactcactagacaagggtcataccgggggtgatgagaagcaggtatacctggcctgtagtataccgcaaattttgtttcctactttctaccctaatttagttaggactactttctctggctatgagctgtgaggccaaaaaaaaaaaaaaaaaaaaaccaacaaccaacaaaacaattttgggtgaaatttgctgagttaaaaactaaacttgaagagcaaaataagtacttaatggtgttgtactaagttgccaggtgttcctctctatatttttgacactgctcatcttagagaaatgtctttgcaagctagtagtctcaggcaaaaagaaagaaagaaaaaatgtaaagacacctaggaacttggaagactagagaagctgagtttggaaattagaaaaacttaaaaatcaaaggaaagattggatcaggacct

SEQ ID NO: 135041 - DNA, 601 bp, Human
tgaagaattccagactctattaagagatctgactgatcatggaaaaaacagcgattttttttttcacttcttataagattcatttgttaagtttttctcattaatgctattagtttgctgccttttctctaaatttgaaggactgatattagaagatggttatgactgagttttaggttcttttttgaggtgggtccagttgggagtgatggggagtatgttacagaaaagtgatttaggatcccacagaatccacatacgagccgatcaaaataaactttcctagaaggaaaatctttakgcaaaagataatgcataagaagcatgagaaataaacattataaacaatcttaaccaaattattacaggtaaatgtttatgcttcagtcaaggcaatggctatattctacaggaggtatcagacacaaagagctggaaataggtcagagggaggacaataaggagaaggaagtaaggacaataaggagaaggaagtattttttcctcattttctggataccaagtgatatggtttggctctgtgtacccacccaaatctcatgtctaattgtaatccccacgtcaggggaggggcctggtg

SEQ ID NO: 135042 - DNA, 601 bp, Human
ttttagtagagatggaggtttcaccatgttggtcaggctggcctcaaactcctgacctcatgatccacccacgttggcctgccaaagtgctgggattacaggcgtgagccaccaatgccggcctagctttcttaatcatttttgtcacctttaattatgaaattaatgctggttgtgcaataatgtcaatgtagtgacaatcatgtgaacaaagtcctgccaagggagaattttcccagatcaagtttcttccaggtgtttgtacagtgtttgggaattaggtgtaaccaggaatatttgyacaagttagtatatggtggtaaatctctcattgttatctcatttttgccagagtgtatgtacttttcccctttatctaaaaatcctttctactataccaaatgcctttgttatttttccaggatggttgcagaatattttaagtttgtatagcacacaatgaaaaagatgagcctgaggggtagttaacttttacagatgctagaatttataatctccttttgtttattcacctaaactatgaagacacaggaaattttccttcatcctagtcttctaacttcagagttagagctagtgt

SEQ ID NO: 135043 - DNA, 601 bp, Human
tttacacatgagtgaattcatgagttgaactgatttcttcaagacaaaaagcttatgataaactttttctttttcatgacatcagctttacctgaacctcatggtatatgcaccaatataaccaagcaggaaagacgtgaacatgagatttagatgggaaattccttaaagaatctgcttcagtttgctgttgtcctgaagctcccacttcagacttggcaagaaagctaacttactatctattggctttcttgtaattaaaaaaattaatgtctataatcaactaattataaattgatcratatatttttaaagttaattttaaaaaataaaaattcgttttccacttccaaagtggaaagaagaaaaaacagaacgcacctcaacagaataaacactgatataaacatcaacacactgatttctatttcttgtcttcataaattttttttgtaagaaagtaacctgccttttcattaaacatggttttctaagaacatgtctctgtctctataaatatcattttaaatggctggacattccagttgtttctggatttttctctattgcaaatgttataataaatattttcaagataaag

SEQ ID NO: 135044 - DNA, 601 bp, Human
attatgctggtacagggaaaagtctaagagcctgaatttgtgggggctggcctggcattgaggctgggcaatagcctggggcttctggggtaggcctggtggtggggtaggcctggtggttggacaggcttggaaactgaatctaccaggcagatttggagcttggggctacaggatctggcagctcagtcttctggtaccagcattaagttggggctgtgaggcctacctggctttgggttttactggggtgagcatggttttggggtccaaggcaaagtctgctgctcacttccctctmcttcccccaagggggtatctctccagctgtgctgtatcaggttgaggaaggagtaatgcatgtaatgtaaattatcctacactcttcaatgtgtctttcttatttctgtgctacactgcagtgctgtaacagcttacctcgttccttagtttttattaaggtagtttcatgtgtggagtggatagttgttcaaattgatgtttctgcatgggtatgagcaccggaatgtcctgttttgccctcttgctgatgttcagacctaactcagtcatcttttttttttttttttttttttttttt

SEQ ID NO: 135045 - DNA, 601 bp, Human
tcactgaagaacaggtaaaatttttgtgcaaaaaaacaattccaaattgaatataacccagggataacggtgttgttatataagatataatgtataccatattgtcattaaatgatcaaaatatcaattatgctggtacagggaaaagtctaagagcctgaatttgtgggggctggcctggcattgaggctgggcaatagcctggggcttctggggtaggcctggtggtggggtaggcctggtggttggacaggcttggaaactgaatctaccaggcagatttggagcttggggctacagsatctggcagctcagtcttctggtaccagcattaagttggggctgtgaggcctacctggctttgggttttactggggtgagcatggttttggggtccaaggcaaagtctgctgctcacttccctctacttcccccaagggggtatctctccagctgtgctgtatcaggttgaggaaggagtaatgcatgtaatgtaaattatcctacactcttcaatgtgtctttcttatttctgtgctacactgcagtgctgtaacagcttacctcgttccttagtttttattaaggtagtttcatgtgt

SEQ ID NO: 135046 - DNA, 601 bp, Human
tctattaactgacactatgagctaggcacagtataaaggggaaagagtggtgaaaaaaagatacagtaacccctactcctatattatctttgttgagcacaacgtgtggtataataaaaggtgctcagtaagtatttattgaaagcaatgaaatctagagatatttattaagggtataaaaaagactttatcaagagttggcaaactatggccagtaaaccaaatcaggtttatggtctatttttttaatagccctaagctaaaaatgatttttacactttaaaataattgttaaaaaaaataattttgacaaagaccacatgtgctctcaaatgaacattaaatacttactttggctccttaccaaaaaagtgtgataactcctgctttctactatggctcactgaagaacaggtaaaatttttgtgcaaaaaaacaattccaaattgaatataacccagggataacggtgttgttatataagatataatgtataccatattgtcattaaatgatcaaaatatcaattatgctggtacagggaaaagtctaagagcctgaatttgtgggggctggcctggcattgaggctgggcaatagc

SEQ ID NO: 135047 - DNA, 601 bp, Human
tctttgtcagatatatgctttgcaaagattttctcccagtctgtggattgtcttttcattctctttttcagtcatttacataaacccttttagtgtgaatattaacgcattctgcaatacaaatgatgtttaataaagggctttctcagatcctgctgggatatacgtcataatatatgatatgtgtactgtattaactttccaaacgaaaaacttctaaattctaaaacacatatggccctaagagttttagatgggagatgtgcatgtctaccctcttcctggaatgttccgtctgtgrtatgactaataacttcctattaattcttcaattttcttgaggtactatatcatctctaatgtcaatgctgacttcctcctacccacctctaccacagaactaagcatccctggctctgtgtgcataagccatcaagcacatctattaactgacactatgagctaggcacagtataaaggggaaagagtggtgaaaaaaagatacagtaacccctactcctatattatctttgttgagcacaacgtgtggtataataaaaggtgctcagtaagtatttattgaaagcaatgaaatctagag

SEQ ID NO: 135048 - DNA, 601 bp, Human
actcagcagtgcataatttaaaatgtaggatttgtttatttctggaatttcccacttaatatttttggactgtggttaaccatgggcgactgaaaccacagaaagcaaattcttcttctccccttttctccccttcctccccatccccttccttctcctcctccttcttattttgagacagggtctcactctgttgcccagcctggagtgcagtggcatgaccatggctcactgcagttgccacctcgtggggtcaactgatcctcccacctcagcctcccaagtaactaggactacaggygtgagctactgtgcctgcctacttttttgattttacatagaggtaggtcttgctatattgcccaggctggtctcaaactcctgggctcaagcagtcctcccaccttggcctcccaaagtgctaggattacatgtgtgaactaccatgcctagcctaagtgtaaatttaacgtttctaggaactgtccaattgttcaaaagtggttgtaccattctagatacccaatggaagtgaaaaacagctcctgttactccatatcctcaccaacacttgatatcgtcattctttttataaagttag

SEQ ID NO: 135049 - DNA, 601 bp, Human
atgctctctctttctctctgcctgactcctcttcattcttgcctgatgtgacctagagatggagcccttcctgtccaggatctgtaagtgataaatctttgaacttatttctttttgtggtggtgtattaaatttgcaccccccattggaagagccagggactatcccagaccaggttttctcgaggatgctggggagaacacaatgttgggttcccagtgtcaccgcgatgatcaggcaaacataaactggacatgggtcagacaagagccacacggacatctgtcagcataaacaagtytcctgtgtgagggaaactgggtctggggtcagacaactatgaattagaccatccaccaggtaaacgaagtatcccatgaaaggcacacagtaaacattcacatccagctgcctttcattcttcattagggcaaggtcactagccactccagtactggaactcaatttggctgggggttctcaaaacagcattgttcaaccgcttatctccaatacttgtccttatttttgtctgcttattccacctcaccaagtgatttctgtcactatagcttgtattatctagtgttttgtaacttat

SEQ ID NO: 135050 - DNA, 601 bp, Human
ggagggtaggaactgtctatttgtaatgggaatgacacagcaaggtagcataggttgctgcataggcattagaacatacccaaatgggtccagctggtagccaaagataagaacttagaggtacccttcctgcctagcaaactgggcttctgttgtcctgccttcccttcaaacagaccaaaagtgacccatgctctattcccttatatatactgctagttgcatgcatgctctctctttctctctgcctgactcctcttcattcttgcctgatgtgacctagagatggagcccttcctgkccaggatctgtaagtgataaatctttgaacttatttctttttgtggtggtgtattaaatttgcaccccccattggaagagccagggactatcccagaccaggttttctcgaggatgctggggagaacacaatgttgggttcccagtgtcaccgcgatgatcaggcaaacataaactggacatgggtcagacaagagccacacggacatctgtcagcataaacaagtttcctgtgtgagggaaactgggtctggggtcagacaactatgaattagaccatccaccaggtaaacgaagtatc

SEQ ID NO: 135051 - DNA, 601 bp, Human
acataatgatgaaacggtagtggcagatatagaaatgctgaattcctggcaaagcagtttgcacaaaatttaaaaagctgaaacaaagcatgaatgcttcttaaaattatatcttgaaaccatggcttttataagggtcaatataaatgttacagcctattttgctcattttctacactaccatagcactcttttatagcacttagaacatataatagtcactcattttcttgactatcttttctactggaatgagttttgggagggtaggaactgtctatttgtaatgggaatgacacascaaggtagcataggttgctgcataggcattagaacatacccaaatgggtccagctggtagccaaagataagaacttagaggtacccttcctgcctagcaaactgggcttctgttgtcctgccttcccttcaaacagaccaaaagtgacccatgctctattcccttatatatactgctagttgcatgcatgctctctctttctctctgcctgactcctcttcattcttgcctgatgtgacctagagatggagcccttcctgtccaggatctgtaagtgataaatctttgaacttatttctt

SEQ ID NO: 135052 - DNA, 601 bp, Human
taaagaagataaaatagaatctaaatcatgtatagttttagttttacataatacatgtgctattgtataactgtatttgtaaaagaagggataagtggagaggaaatgggcatttactcaatattctacaatgattttcccatttagtccttagcaaaaccccacaagggaggtaggattattcccttttgtaatgaggaaataaagactacaaatagcaaagaaacttatacaagatcatacggatagttggtggtacagaagggatttgcctcacaattcatatacagggctttccctytgcaaaacataatgatgaaacggtagtggcagatatagaaatgctgaattcctggcaaagcagtttgcacaaaatttaaaaagctgaaacaaagcatgaatgcttcttaaaattatatcttgaaaccatggcttttataagggtcaatataaatgttacagcctattttgctcattttctacactaccatagcactcttttatagcacttagaacatataatagtcactcattttcttgactatcttttctactggaatgagttttgggagggtaggaactgtctatttgtaatgggaat

SEQ ID NO: 135053 - DNA, 601 bp, Human
tatgaactgtgtatgatagaaaataatagtaaagaagataaaatagaatctaaatcatgtatagttttagttttacataatacatgtgctattgtataactgtatttgtaaaagaagggataagtggagaggaaatgggcatttactcaatattctacaatgattttcccatttagtccttagcaaaaccccacaagggaggtaggattattcccttttgtaatgaggaaataaagactacaaatagcaaagaaacttatacaagatcatacggatagttggtggtacagaagggatttgmctcacaattcatatacagggctttccctttgcaaaacataatgatgaaacggtagtggcagatatagaaatgctgaattcctggcaaagcagtttgcacaaaatttaaaaagctgaaacaaagcatgaatgcttcttaaaattatatcttgaaaccatggcttttataagggtcaatataaatgttacagcctattttgctcattttctacactaccatagcactcttttatagcacttagaacatataatagtcactcattttcttgactatcttttctactggaatgagttttgggag

SEQ ID NO: 135054 - DNA, 601 bp, Human
agttaatgactacaaaaagattgacagacacagaaagtacacattgtgggcattatgcctcagaagtggaaagccaaattttaaaaaatcaaataatttagccatggctttaaaatctgaacttagaaactcatatcaatattattttagcttagatttttagcaggtttcaggaatatttttcctaattataaaggtaatatcaattacaattaaaacataaattaggataaacaatatcagtttttgttatattttatattgacctcgttagactttttattacacagtaacatgtatyttttttgcattttggatagctagtgacattaatcatatgtagaattaaattatgactaagtatatggttttattgtttataagtaatacaaacaagtttgtaagttatttctactgccaaaagttgtctgtgaatgagaaaaaacaattttcactaatatgttagtggtacttcaaatataacatcaagaacatctttatgaactgtgtatgatagaaaataatagtaaagaagataaaatagaatctaaatcatgtatagttttagttttacataatacatgtgctattgtataactgt

SEQ ID NO: 135055 - DNA, 601 bp, Human
atgtctaggtatttccacagatcagatgcagccaagaaggagagcgatttggttttgttgttaccactgggtagtcatgtgtcctgccaatatggcaaccaggaggtatgaggagaccacaccaacataaccagggaactaaaggagagtgaagtacagcaatagagaacttttaagagtccgcagagagtgagttttaactactgcagagccagcaaagttacggtggaccaactcgagtacctgcggagaaagaatggaaagccttgtttgacatctctgtccttcctcctataaaaaacatgggagaaacagttcagtctcaaaggtaccaaactaaaattgattacaagtgttactttggcagaaaagatttttctaaagatttcaaatgagaagtctagcacaataatttggcattaaaggtgcataaataaagtatctaatattctctacaattaattaggaaaatctgagcagcatttgtctaattttggtagaactacaaagaaataaaggagaataattttgagactttttgtattcaaggtaagtaacagccaatactgagtacacacaaataatctgcagttaatgacta

SEQ ID NO: 135056 - DNA, 601 bp, Human
caactgatgtctaggtatttccacagatcagatgcagccaagaaggagagcgatttggttttgttgttaccactgggtagtcatgtgtcctgccaatatggcaaccaggaggtatgaggagaccacaccaacataaccagggaactaaaggagagtgaagtacagcaatagagaacttttaagagtccgcagagagtgagttttaactactgcagagccagcaaagttacggtggaccaactcgagtacctgcggagaaagaatggaaagccttgtttgacatctctgtccttcctcctayaaaaaacatgggagaaacagttcagtctcaaaggtaccaaactaaaattgattacaagtgttactttggcagaaaagatttttctaaagatttcaaatgagaagtctagcacaataatttggcattaaaggtgcataaataaagtatctaatattctctacaattaattaggaaaatctgagcagcatttgtctaattttggtagaactacaaagaaataaaggagaataattttgagactttttgtattcaaggtaagtaacagccaatactgagtacacacaaataatctgcagttaa

SEQ ID NO: 135057 - DNA, 601 bp, Human
cagcactttgggaggctggggtgggagaatcgcttgagtctaggagtttgagaccagcctgggcaacagtgagacctcgtctctgcaaaaaatttttttttaaattagctggatgtggtggccagcgctgtggtcccagctagtcaggaggctgaagtaggacgattgcttgaaactggcagattgaggctccagtgacctgtgagccgtgattgtgctattgcacttccgtctgggcaagagagaccctgtcacaaaacaaaacaaaacaaaacaaaacaaaaaggatctaacctgtatrgtagaaacattgtcaaatttcttaaaaactttcagctgcttatagtcacaaaacactacttaagggcattgacaactttagccatttaattccctgtccactgagacccagagtataaaagccagctagcagagcactacagctagacctagacaaattctaaagcaaatctctttccacttccatcaggtagcagaggtagtaatggtgacgagctctcattttacttcaggcactgttttttttttatttattatactttaagttttagggtacatgtgcacaatgtgcaggtttgtt

SEQ ID NO: 135058 - DNA, 601 bp, Human
tgtccaacaatcaccactagaaaacagaaagaagccaggtgtgatggcttacacctgtgaccccagcactttgggaggctggggtgggagaatcgcttgagtctaggagtttgagaccagcctgggcaacagtgagacctcgtctctgcaaaaaatttttttttaaattagctggatgtggtggccagcgctgtggtcccagctagtcaggaggctgaagtaggacgattgcttgaaactggcagattgaggctccagtgacctgtgagccgtgattgtgctattgcacttccgtctgggyaagagagaccctgtcacaaaacaaaacaaaacaaaacaaaacaaaaaggatctaacctgtatggtagaaacattgtcaaatttcttaaaaactttcagctgcttatagtcacaaaacactacttaagggcattgacaactttagccatttaattccctgtccactgagacccagagtataaaagccagctagcagagcactacagctagacctagacaaattctaaagcaaatctctttccacttccatcaggtagcagaggtagtaatggtgacgagctctcattttacttcaggcact

SEQ ID NO: 135059 - DNA, 601 bp, Human
ccaaggctatcacacaactaaaatctttcacatccctgatatattgtagtgataattacaattttttacacttcaaagttgtttatatttcaaaggagttctacactataccaactttttaatatccaccagccattttcaaatgccaaaatttgaagtacattgttaaaataatgagactgaaaatgtgtctatgatgtccatctgcatcacctgaatgtttccattttgtattatgtataatgcagtttttttctcccattttcaaaattgcttaaacaaatatggcaactgtgctccrtaattattttttcaaactattctcactatggactaaaaagttctatcatatttacaataaagttgaattttgttgaaggggaagcaatcagatgtcaaattagtatagttacttttgagttgttatatataatacatacttttaacatttttccaaaatgaacacctggggagtctagcactatcatgactgacacgtctttgactttctcttactcccaattcctgagctgaggtggttaaaccaatgtagcaggcagaactctgtccaacaatcaccactagaaaacagaaagaagcc

SEQ ID NO: 135060 - DNA, 601 bp, Human; identical to SEQ ID NO: 39110

SEQ ID NO: 135061 - DNA, 601 bp, Human
cttatctttgatcaaaatgattaatggttttccatcatagctcacattgggttcaaatctctaaaatggacattcaaagttctttacaatgtgcatctacaggagacagcttttgtttttgctcacctaacatctgttccccttctagtaacaacctggtattttggggggaatcattcctcctcccatctcattctatgaggtttaggtgggacagggcttcccaccagttctagaagtaggtatatgactcatgctgggttatcagagtcacagaaatcagttcagtttgggacacacmgctatagttggacccatgagtcagccttggaacttttattggtactgtttggaaagaggcaacttccttccactggaaacagtaaacttttacttacaaaagtctatcttaaaatggaggagacacagaaaacagtagacctaagagatggagaaagattgtttccacaccacatcacccagtggccaacaccaggtgtactcctggattctttagatatctgagacaatatattccttatgtatgtttctttttcgagacagggtctcactctgtcacccaggctggagtgcagcgttg

SEQ ID NO: 135062 - DNA, 601 bp, Human
aatattatgggtttcctgtgagaaaaggaactgagtatcaaggaaacagaggtgggagttttttttttcccagtgtatattcctttatttttttttgaaatttgaaccatgtaaatatttctttttcaaaatataaggttaaaaaatatacctaccttaaaaaacgttcatataaatgaccagaagcaactgaaaaaatgtttaggacatctttttcctttttgttttctttatgcaagcttactgtgaaacttggaataaaaaagtaattgacatttcttaaacatacatatggaaacaytgtatgcctaaatagtaaatataagcaatcaatatagaaatgtatttcaaaatagttaagctataaacactctataatatttacaaactaatattaaaatatttgacaatatcatttgaagctttatgagtttttttttaaatttgtaatgtggaatataactatattgtctttaggtgaatgggctggtatttttgaatttttgtgagttgccaaaggttgttttcagaacaaagaatgaattacagcttgacatggccatatctagtgtactgaaagtttaaacaggtcaatgaggga

SEQ ID NO: 135063 - DNA, 601 bp, Human; identical to SEQ ID NO: 39111

SEQ ID NO: 135064 - DNA, 601 bp, Human; identical to SEQ ID NO: 39112

SEQ ID NO: 135065 - DNA, 601 bp, Human; identical to SEQ ID NO: 39113

SEQ ID NO: 135066 - DNA, 601 bp, Human; identical to SEQ ID NO: 39114

SEQ ID NO: 135067 - DNA, 601 bp, Human; identical to SEQ ID NO: 39115

SEQ ID NO: 135068 - DNA, 601 bp, Human
tctcaaaaaaaaaaaaaaaaaagtatcttatgcaaaatagcatttaattttttataaataactttcttttattatatttattctttatttcagacacctgatctaagcccacagactttggattcagtcttttgctccaggttaattaaatttttatttttggttcaggggtacatgtacaagtttgctacataggtaaattgaatgtcatgggggtttagtgtgcaaattattttgtcacccaggtagtaagcatagtacctgataggtagtaaaaatgactaacttttatatattaatyttttatatattaatttatacttttatatattaattatatattaacctttgaccttgctataatcccttattggtacactgttttttgttttttttttggtcatttttttggattgtctaagtaggcatttgcaaacaaaggcagttttatttcttccttcccaatttgtataccttttatttccttttcttgtcttattgcattagccaagaccttactttggttttaactgtttttttcccctagtttctaggtagaagatgaggttgagatcttttttcttttctaatggaagttctt

SEQ ID NO: 135069 - DNA, 601 bp, Human
ggcacagtggttcacgcctgtaatcccagcactttgggaggccaaggcaggcagatcacgagttcaggagatcaagaccatcctggctaacatggtgaaaccgagtctctactaaaatacaaaaatacaaaaaattagctgggcgtggtggcaagcgcctgtagtcccagctactcaggaggctgaggcaggagaatggcgtgaacccaggaggcggagcttgcagtgagccaagatagtgccattgcactccggcctgggcaacagagtgagactctgtctcaaaaaaaaaaaaaaaaaagtatcttatgcaaaatagcatttaattttttataaataactttcttttattatatttattctttatttcagacacctgatctaagcccacagactttggattcagtcttttgctccaggttaattaaatttttatttttggttcaggggtacatgtacaagtttgctacataggtaaattgaatgtcatgggggtttagtgtgcaaattattttgtcacccaggtagtaagcatagtacctgataggtagtaaaaatgactaacttttatatattaattttttatatattaatttatact

SEQ ID NO: 135070 - DNA, 601 bp, Human
gaaagcattcagtctttgattattaagtatgatgttagctgtaggtttttcatagatgccctttatcaggatgaggaagttcccttccggttctagtgtgctgagagttttaaatcaggaaaggatactggagtatatcaaatgctcttttgcatataattagctgatcatgtatatatatggatatgtattttagtccttaatatagtgagttacattgattttctaatactgaatcagtcttgcattcctgggataaagttcatgtggtcacgattcatgatataagatcctttcttttaaatttttttagtatttattgatcattcttgggtgtttctcggagagcgggatttggcggggtcataggacaatagtggagggaaggtcagcagataaacttgtgaacaaaggtctctggttttcctaggcagagggccctgccgccttccgcagtgtttgtgtccctgggtacttgagattagggagtggtgatgactcttaatgagtatgctgccttcaagcatctgtttaacaaagcacatcttgcaccgcccttaatccatttaacccttagtggacaaagcacatgtttcagaga

SEQ ID NO: 135071 - DNA, 601 bp, Human
gggagaaagcattcagtctttgattattaagtatgatgttagctgtaggtttttcatagatgccctttatcaggatgaggaagttcccttccggttctagtgtgctgagagttttaaatcaggaaaggatactggagtatatcaaatgctcttttgcatataattagctgatcatgtatatatatggatatgtattttagtccttaatatagtgagttacattgattttctaatactgaatcagtcttgcattcctgggataaagttcatgtggtcacgattcatgatataagatcctttyttttaaatttttttagtatttattgatcattcttgggtgtttctcggagagcgggatttggcggggtcataggacaatagtggagggaaggtcagcagataaacttgtgaacaaaggtctctggttttcctaggcagagggccctgccgccttccgcagtgtttgtgtccctgggtacttgagattagggagtggtgatgactcttaatgagtatgctgccttcaagcatctgtttaacaaagcacatcttgcaccgcccttaatccatttaacccttagtggacaaagcacatgtttca

SEQ ID NO: 135072 - DNA, 601 bp, Human
ttagagaaatgcaaatcaaaaccacaatgagtggttttgataccatctcatgccagttagaatggtgatcatgaaaacatctggaaataacagatgctggcaaggatgtggagtaataggaacacttttacactgctggtgggagtgtacattagttcagctgttgtgaaagacagtgtggcaattcctcaaggatctacgaccagaaacaccatttgacccagcaatcccactactgggtatatacccaaaggatgataaatcattctactataaagacacacgcacatgtatgtttacygcagcactatttacaatagcaaagacttggaaccaacccaaatgcccatcagtgacagactggataaagaaaatgtggcagacatataccatggaatactatgcagctataaaaaagaatgagttcatgtcctttgcaggatatggatgaagctggaaaccatcatcctcaacaaattaacacaggtacagaaaaccaaataccacatgttctcactcataagtgggagttgaacaatgagaacacatggacacagggaggggaacatcacccactggggcctattggagggctggggga

SEQ ID NO: 135073 - DNA, 601 bp, Human
agatccagaatatccaacacaatattgaagaataaagtcagagggctgacactaccacacttgaagtcttactataaagttacagtaatcaaaacagtgtggtattggaaaaataagagacaaatacatcaatggaacacaataaagagcccagaaatagaaaattacccatactttctgctcattttttttgtaaacctaagactgctctaaaaaaataaagtccgttaatcaaagaaagaaaaaccttaactgtcccttctgacacccttagttccttggaatcccttccttaaataayctggcctaccatattatctaagctactaactcaaatggttatatactagaccaagtcttctatactttcaatttcatggtgccactctctgaccacctcttgatttttggctcactccactgagtactcagatatcaatatcctttgaccccttggaacctccaatcaactgattttaccactatttcactgtccctcattccttgatgtattcacccctatatagttattcttctgaatatactctcaactgtcttattcttctctcacttagttgtactttcttgacaaagtcatagt

SEQ ID NO: 135074 - DNA, 601 bp, Human
agagaaatacttaaacataaatctaataaaatatgttcctcaacaaaatgaaaactacaaaattctgaggaaagaaatcaaagaacactgaaatacatgaagagatattctatgttcacacataggaagactccatagtcaagataacagttcttcccagatttatctatagacttaacacaatcccaatcaaaggcttagcaagttattttgtggagattggccaactgattctaaagtttagggaaaaaggaaaagatccagaatatccaacacaatattgaagaataaagtcagaggrctgacactaccacacttgaagtcttactataaagttacagtaatcaaaacagtgtggtattggaaaaataagagacaaatacatcaatggaacacaataaagagcccagaaatagaaaattacccatactttctgctcattttttttgtaaacctaagactgctctaaaaaaataaagtccgttaatcaaagaaagaaaaaccttaactgtcccttctgacacccttagttccttggaatcccttccttaaataacctggcctaccatattatctaagctactaactcaaatggttatat

SEQ ID NO: 135075 - DNA, 601 bp, Human; identical to SEQ ID NO: 39116

SEQ ID NO: 135076 - DNA, 601 bp, Human; identical to SEQ ID NO: 39117

SEQ ID NO: 135077 - DNA, 601 bp, Human; identical to SEQ ID NO: 39118

SEQ ID NO: 135078 - DNA, 601 bp, Human
tacctctttcccaatttgataaaagaaatacttatatataagaaaaagatgttttttgttgaggtaattttcctttcttccttcttcctgctttctttccttctctccctcctccctttgtcatcctacttctctccctttaaaaaaagtcatatcataccacttacagaatattttcttatgaattgaaatagtatctttatctatactaaattattatacatacatgggtgtgtataatgaactttttgaacacaccaagaaaacttttttttttaaaggaaaacttttttttttttttaaagtcaagatgaaacaatttcacgtttatatgagacagtttatacataatcatttcggcttccctaaacagtaaagctgaggaaaatgagaactgtattctgaaccactgggaagaattattgagagtattagccaatataatctagtgaaagtctctaacacactgacccgaacacaataggagttcagggggttttttaagaaagagtgaagaatagggagacacaggcagcactgacagggaaagagaattacaggacaatcaagaagtttgtatcagctttaaaaaataaattca

SEQ ID NO: 135079 - DNA, 601 bp, Human
tcttcgaccaatcaatgctctccatactctggctccctccaaaacccttaaaaatcactagtcacaaactgctcagggacacagacttgagttttcattctgtttcctcatttggcagccctatgattaaacctctctctctgctgcaacctggacatatcagaatctctgggacacacttaaagcagtgtgtagagggaaatttatagcactaaatgcccacaagagaaagcaggaaagatctaaaattgataccctaacatcacaatgaaaagaacaagctaagcaagagcaaacgcayccaaaagctagcaaaagacaagaaataactaagatcagagcacaactgaaggagacagagacacaaaaaacccttcaaaaaatcaatgaattcaggagctggttttttgaaaagatcaacaaaattgacagaccgctagcaaggctaatgaagaaaggagagaagaatcaaatagatgcaataaaaaatgataaaggggatatcaccactgatcccacagaaatacaaactaccatcagagagtattatagacaactctacgcaaataaactagaaaatctagaagaaatggataaattc

SEQ ID NO: 135080 - DNA, 601 bp, Human
ggttaactattagtcaggcagcactttgacccacttccttgtaactgaaagttacttagcactagatactgaccatttgcatccccattgttcttgtggatgggatttctgacatcagaatcataaggcttttaagaattgcctaagcagatcgtgagttccagcagaacagctgacaccaaccagtttgaagatccccacaaagtaaccaattcagcatgagaatatagtttcttcatctccctataccacgacttcaccttgcactcttcgaccaatcaatgctctccatactctggcyccctccaaaacccttaaaaatcactagtcacaaactgctcagggacacagacttgagttttcattctgtttcctcatttggcagccctatgattaaacctctctctctgctgcaacctggacatatcagaatctctgggacacacttaaagcagtgtgtagagggaaatttatagcactaaatgcccacaagagaaagcaggaaagatctaaaattgataccctaacatcacaatgaaaagaacaagctaagcaagagcaaacgcacccaaaagctagcaaaagacaagaaataactaag

SEQ ID NO: 135081 - DNA, 601 bp, Human
attcagtatgatcatgggaaataaagatccatgtatagaaagtagtctttatgtacaagcaaccaccagtaagaagatattcttcaagagaaaaattccatttataacagtagcaaagaaaagcttaaactatatatatatataagctatatgattaaaatgttatgattcttgaggaaaactggacttgaatatatagaaagacaatgtattctgagacagtagtttccatgaagatgtcaattctctcaagccaactaattaatgtaatcctttctctgaccatcccacacagccccccaagaaaaacacagaaaattttctgaaactaagttgattctaaggcttgtatggaaaaaaaacaagaatacacagaaaaacaacaaaaaagaagagtaataaggaaaggctagccttacttgatattaaaacataatataagtccttaataattaaagtggtatgtacttggcacatgtatagacagagaccaatggaacggaataaaaagggccaaacaagacatcctaatattggaatttaatatatgataaagatggcaatacaaatgtgtggaacagaaattaatttcttccagtgt

SEQ ID NO: 135082 - DNA, 601 bp, Human
taaaaattcagtatgatcatgggaaataaagatccatgtatagaaagtagtctttatgtacaagcaaccaccagtaagaagatattcttcaagagaaaaattccatttataacagtagcaaagaaaagcttaaactatatatatatataagctatatgattaaaatgttatgattcttgaggaaaactggacttgaatatatagaaagacaatgtattctgagacagtagtttccatgaagatgtcaattctctcaagccaactaattaatgtaatcctttctctgaccatcccacacagmcccccaagaaaaacacagaaaattttctgaaactaagttgattctaaggcttgtatggaaaaaaaacaagaatacacagaaaaacaacaaaaaagaagagtaataaggaaaggctagccttacttgatattaaaacataatataagtccttaataattaaagtggtatgtacttggcacatgtatagacagagaccaatggaacggaataaaaagggccaaacaagacatcctaatattggaatttaatatatgataaagatggcaatacaaatgtgtggaacagaaattaatttcttcc

SEQ ID NO: 135083 - DNA, 601 bp, Human
tactcagtgtgttggcaagtttgctatctcctatggaattgtaatggcagaggtctcttgaagcttacctcattcccctgtggtgtgcactttttaatttaatttctccccagtattttatttactgagttgatggttcaggcttcaggataggagtggtatccctgggtaggaacctgttgtagctaaagcaggtggtaaatgtaatatccaatggtggacagaggtaccagccttgatgaaggtggctgagggagctctcaattagatgcactgatgtcttaacaaggggaagagtgasagccacctcagcttccttgccaggccaagcaagaaagctatccaactcccagactcactcttatcccagtggtccagctattcaggtatttttatctgtaggcatgttgatgttctaaggagagaggaattgtgactgcctcttgtgcaagcctgaacctggaggatacctctcctgcggcaatgcagtcaccctgaagtgttccaggaaggctgtctataggttcagccacactgagctcctgtgggagaagccccagctgtgtctgcagtggtggacaaggtgggaaaggtcttctcc

SEQ ID NO: 135084 - DNA, 601 bp, Human
gttatgtcctttatttcttttgcttgcctaattgctctggctaggacttccagtactatgctaatagttcgtacatgtaaaggtgttcatagtggtctcgaatgatcttttgtatttctgcagtattgtttgtgatgtctccggtttcatttcgaattgagcttatttggattttctctctttttggttagtctcactaatgatctatcaattttgtttatcttttcaaagaaccagcttcttgtttcattgttcttttttgtttgtttcaatttcatttagttctgctctgatctttgtkatttcttttctttcaatggctttgggtttagtttgttcctgtttctctagttccttgaggttgtctatttgtgctctttcagactttctgatgtaggcatttgatgctatgacttttcctcttagcactgcttttgttgtattccagaggttttgataacttgtgtcactattaccattcatttcaaagaatctttgaatttccatcttgatttcattattaatccccaaatcattcaggagcagattatttaatttccatgtatttgtatagtgtttacagttcctttgggagctgatt

SEQ ID NO: 135085 - DNA, 601 bp, Human
gaattagtttatcagaactaggatttttttggataagtctttagggttttctaggtagatggtcatatcactggtgaacagcactagtttgacttcctcttttccactttgttatgtcctttatttcttttgcttgcctaattgctctggctaggacttccagtactatgctaatagttcgtacatgtaaaggtgttcatagtggtctcgaatgatcttttgtatttctgcagtattgtttgtgatgtctccggtttcatttcgaattgagcttatttggattttctctctttttggttartctcactaatgatctatcaattttgtttatcttttcaaagaaccagcttcttgtttcattgttcttttttgtttgtttcaatttcatttagttctgctctgatctttgtgatttcttttctttcaatggctttgggtttagtttgttcctgtttctctagttccttgaggttgtctatttgtgctctttcagactttctgatgtaggcatttgatgctatgacttttcctcttagcactgcttttgttgtattccagaggttttgataacttgtgtcactattaccattcatttcaaaga

SEQ ID NO: 135086 - DNA, 601 bp, Human
ggaacgaaataggccggatgtggtggcccatgcctgtaatcccagcactttgggaggccaaggtgggcagatcacttgaggccaggagtttaagaccagcttgacctacatggcaaaacctcatctctactaaaaatacaaaaattagccaggcatggtggcacacacttataatctcacctagtcggaaggctgaggcacaagaatcacttgaacctcggaggcagagtttgagctgagactgcaccactgtattccagcctgtgtgacagagtgaaactgtctcaaaaaataaataaataaaataaacaagaaacaaagacttttttttaaaggggatactttttatgacactatagaatatatccaatataaatctttttcttggaaaacataatttgccaaaactgactccagaagctatataaagcctgaacagattaatttccacagaagaagcagacaaagcagtctactcccctaaaaagccccatgtcccactgctatgtaaactgttccagagcacaaaaaaggaatacaaagctcctaattctttttatgaagtggtggtaactttggtaacaatagaaaaataaatatt

SEQ ID NO: 135087 - DNA, 601 bp, Human
atcagtcttcattatacaactcttaggtcaaaggggtagaatcaactaaaactgagctaacacaatgtagaaaaacaggagaaaaataagagaaagcatgaatgtacaaaataaggaacgaaataggccggatgtggtggcccatgcctgtaatcccagcactttgggaggccaaggtgggcagatcacttgaggccaggagtttaagaccagcttgacctacatggcaaaacctcatctctactaaaaatacaaaaattagccaggcatggtggcacacacttataatctcacctagtcrgaaggctgaggcacaagaatcacttgaacctcggaggcagagtttgagctgagactgcaccactgtattccagcctgtgtgacagagtgaaactgtctcaaaaaataaataaataaaataaacaagaaacaaagacttttttttaaaggggatactttttatgacactatagaatatatccaatataaatctttttcttggaaaacataatttgccaaaactgactccagaagctatataaagcctgaacagattaatttccacagaagaagcagacaaagcagtctactcccctaaaaa

SEQ ID NO: 135088 - DNA, 601 bp, Human
acaatattatttgatctcaatacaataacaatagaaataacaaaatcagaaaacataaaggctctttcacataggaaaacatcagtcttcattatacaactcttaggtcaaaggggtagaatcaactaaaactgagctaacacaatgtagaaaaacaggagaaaaataagagaaagcatgaatgtacaaaataaggaacgaaataggccggatgtggtggcccatgcctgtaatcccagcactttgggaggccaaggtgggcagatcacttgaggccaggagtttaagaccagcttgaccyacatggcaaaacctcatctctactaaaaatacaaaaattagccaggcatggtggcacacacttataatctcacctagtcggaaggctgaggcacaagaatcacttgaacctcggaggcagagtttgagctgagactgcaccactgtattccagcctgtgtgacagagtgaaactgtctcaaaaaataaataaataaaataaacaagaaacaaagacttttttttaaaggggatactttttatgacactatagaatatatccaatataaatctttttcttggaaaacataatttgccaaaa

SEQ ID NO: 135089 - DNA, 601 bp, Human
cacacacacacatatacatgtatacatatgtatgtatgtaatagtatatatgtatatatgtatgtatgtatctatacttcggtaaagagaatgcatcttctctttaagaactcatgaaacattcataaaaactggtattaggccacaaagaaaacaacaatagattgtaaaaggaagaaataatacagacaatattatttgatctcaatacaataacaatagaaataacaaaatcagaaaacataaaggctctttcacataggaaaacatcagtcttcattatacaactcttaggtcaaasgggtagaatcaactaaaactgagctaacacaatgtagaaaaacaggagaaaaataagagaaagcatgaatgtacaaaataaggaacgaaataggccggatgtggtggcccatgcctgtaatcccagcactttgggaggccaaggtgggcagatcacttgaggccaggagtttaagaccagcttgacctacatggcaaaacctcatctctactaaaaatacaaaaattagccaggcatggtggcacacacttataatctcacctagtcggaaggctgaggcacaagaatcacttgaacctc

SEQ ID NO: 135090 - DNA, 601 bp, Human
tttcaacatcacttgactgccagttattacaaatagagtagtaagcaagtttattcttctactttttctccctttctattttttgttgttgtattattcctgccttattagactgtctaacatttatttatataccattgttatccttacatctatctttgatttagtcactgctcaccaccaaaataaataagcttatggaagccctaaaagcataatgaataaaatagaccttatatatacacacacacacatatacatgtatacatatgtatgtatgtaatagtatatatgtatatatgtatgtatgtatctatacttcggtaaagagaatgcatcttctctttaagaactcatgaaacattcataaaaactggtattaggccacaaagaaaacaacaatagattgtaaaaggaagaaataatacagacaatattatttgatctcaatacaataacaatagaaataacaaaatcagaaaacataaaggctctttcacataggaaaacatcagtcttcattatacaactcttaggtcaaaggggtagaatcaactaaaactgagctaacacaatgtagaaaaacaggagaaaaataaga

SEQ ID NO: 135091 - DNA, 601 bp, Human
caactttcaacatcacttgactgccagttattacaaatagagtagtaagcaagtttattcttctactttttctccctttctattttttgttgttgtattattcctgccttattagactgtctaacatttatttatataccattgttatccttacatctatctttgatttagtcactgctcaccaccaaaataaataagcttatggaagccctaaaagcataatgaataaaatagaccttatatatacacacacacacatatacatgtatacatatgtatgtatgtaatagtatatatgtatatatgtatgtatgtatctatacttcggtaaagagaatgcatcttctctttaagaactcatgaaacattcataaaaactggtattaggccacaaagaaaacaacaatagattgtaaaaggaagaaataatacagacaatattatttgatctcaatacaataacaatagaaataacaaaatcagaaaacataaaggctctttcacataggaaaacatcagtcttcattatacaactcttaggtcaaaggggtagaatcaactaaaactgagctaacacaatgtagaaaaacaggagaaaaat

SEQ ID NO: 135092 - DNA, 601 bp, Human
ggggactggcgggccgcggggccgggacagcgggtttggactaaggaaccgggccgcaggagtcggaggaggcggggtgcgggggcaccgggctacgacttcaggaagtcctgggacgcggagacttgggcagcctttgggtcctggcctcgcttgggaccctcgctgggcgcctggggacactgtcagtcattggtgctggctgggaggaggcactaaggtggccaaaagacttccttcgctctggagttcttgggtggggaaggagtgtcatgtccggctgggagttggaggggacagygttgactatttaaaaagtgtgtaaccatccccattaagatgcactgtcgtgtagagaaattgttagtttggtgcaatgaggagccgctgttggaattccatctcccggacggccaggcactgagtttgtggttttacaactcccaacatggtgtcattcaacgtatggctggcattacttttccaagttcgctgtaaaaaggttcccttaaaaagatacgaacgattaaatttcacttcagtcctgcagactggaatgttggctactccagaatagcgaaaatagagggctgtcctatct

SEQ ID NO: 135093 - DNA, 601 bp, Human
gcttctggcgcggttactgtgcgaaatattcgagtgtaatgacacatcacatgcactgatctattttcatccccataaaaagggctagttgtcaaggaggtcaaattaaacctttgagtattccattcaaagggagcgaggaactaaaaattgggaattgtttatagtgaattcttctgaaagttctcaacttttttttttaaagtagtactccccagtttttaggtgtcacccatagcaatgggcttttgcttttgcttcccctggtaaccatattttttgaaccccaaatcagaacacrtagtgtggcaacattgggacaaagaatttgacagtgaggctgcccccagaaaaatctaggggattggaatttgaaggtctgtaccactttaatatgggtcatatattctagttcttttgcattttcaaaagcttcattcctcctgcccccgcaccccaccatccctcatctgtagtatttatctccagttatcattaataatttattttggacacttaagagaaagttgcctatgttctgtttaatggtgatttttttttttaagttacagagatgcacaattttgaatgattgcttttc

SEQ ID NO: 135094 - DNA, 601 bp, Human
tggaatttgaaggtctgtaccactttaatatgggtcatatattctagttcttttgcattttcaaaagcttcattcctcctgcccccgcaccccaccatccctcatctgtagtatttatctccagttatcattaataatttattttggacacttaagagaaagttgcctatgttctgtttaatggtgatttttttttttaagttacagagatgcacaattttgaatgattgcttttcccactactttttagaattgctgttctgtatatgagtctgtaaggactcttaactcttcatttccytcctgtggtattttccataagaaaaccacatttgagagcttttctgtgtaggaggcactggtgacatttctcagaggagtgccagagtgtcttctttaggaccattgtctgtgtaaaatagcagggacttagtacaggtaacagaaaaaggaaagaaaggagcctttctgtaagccatatcttattcacgaaagcgtgtggtattcattcctactttacagaccagggaactgaggctccaaaggttttactaaagttcattttgtgtgcacgctggagacagaagttaagtagttgaca

SEQ ID NO: 135095 - DNA, 601 bp, Human
gagtgccagagtgtcttctttaggaccattgtctgtgtaaaatagcagggacttagtacaggtaacagaaaaaggaaagaaaggagcctttctgtaagccatatcttattcacgaaagcgtgtggtattcattcctactttacagaccagggaactgaggctccaaaggttttactaaagttcattttgtgtgcacgctggagacagaagttaagtagttgacaacatcatgtgagtccaagcacttttaagtgatggcagctgagaaaaaaaatcagcactttttttttttttttttttttgtaattaacaagaaggttatttcctgggaggtttaatacagtggttctcaaacttgagtgtgcatcagaatcgcacatggagggctttttaaaacagagtgctgtaccccacttacagagtttgattcattaggtcttgatgggacctgaaattttgcgtttctagaaagaccctggatgaccacacttgagaaccactggtgtaataaattatatagaggagttaaattaggtgtctgctatgtatttgacactggatttggtgatagggatataaaggtaagaactctgacttgaat

SEQ ID NO: 135096 - DNA, 601 bp, Human
tcactattgtaaccattttatgtgtgtatatctcataatactatgttgtaaacatcaaatatatacaatacaattcacttttaaaaaaagaaatgaaggagaatggttatgagagaagtgaatgtggaactaagagtggcacaggatggggaagagataacctagtgtttttctgattttgaaatatttgcctttgttttcttctagatttttctgttaattgtcatccagagacagaaagtatatatcatgaattgaaagtttgagtcttttggcaccctcccttctcaaaggcgtttgraagagtgaagtctaaagcactagatgagatcgaatttttggaatagaaagaaaactttagtagtatctgctttagtattctcatgttacagataaggaagttatttcatttctttgctaatggtttgtcctcttggtgacttgagtagcaacacagcctgggaacgaaaccttttttctcttatcatagttttatctctttttcttccttaacatgctatctggacccaatttttctttatttcattgagctgattaaaccatatattttggccatggggaaaagaatagttgaaaatat

SEQ ID NO: 135097 - DNA, 601 bp, Human
tggaggtgggcgcctgaaatcccagctacttgggaggctgaggcagagaattgcttaaacctgggaggcagaggatgaagtgagccgagattgcaccactgcactccagcctgggtgacagagcaaaactccatctcaaaaaaaaaaaaaaaaaaattacccagttccgggtatttctttatagcaatgtgagaatggactaatacagaaaattggtactgggagtggggcattgctataaagatacctgaaattgtagaaggaagcaactttggaatggggtaatgggcagaggttgggwcagtttggaggactcagaggaagacaggaagaggaacgaaagtttgaaacctcctagagacttgttgaatggttgtgaccaaaatgctgatagtggtatagacagtgaagttcaggctgaggagggctcagaatgaccgcagatgaggaacttattgggaactggagtaaaggccactcttgctatgctttagtaaagagactggtggcattgtacccctggtctatggatctgtggaactttgaacttgagagaggtgatttagggtatctggtggaagaaacttctaagcagcaaagt

SEQ ID NO: 135098 - DNA, 601 bp, Human
atataagcatgtactaacaatcccttaatcaactatcactcattcagacattacactcacatgacgaaactcgatccacatgaatatcgaccagtactggaaacccttgatattacatagtgcatacgttcattcactgacgtagtgtatttcagtcaagattaacctcgccaacatggatatcccctaccaagctttggtctgttaatctaccaacctccaagaaatcatcatccctctcgggcgtgttactctcctcgctctgggcccataacacttgggagtgactatactgaaactrtacctggcatctggttcttacctcagggccatgaaactaagattgaaactaagattgcccacacatttcacttaaataagacgtcttgatggactagtgactaccaccctattaaccagttacgggagcactgtcatgcatttggtatttttaacttttggggatgctgtcactcaccattgtggaaggccttctttgccttttttaaaaaaaaattttaaattgttgttggtttaaagtctgttttatctgatataagaatgtttactccagcttgctttttttcccagttgcatgata

SEQ ID NO: 135099 - DNA, 601 bp, Human
atagtatcttccaggtgccctgtgaatttctaatatctggatgtctgcatatctagcaagatcaggggatttttcctgttttatttcctcaaatatgtttttttaaaatttcttactttttcttttccttcacaatgcctgtaagttgtaggtttggttgttttacataatcccatatttttcaaaggctttgtttgattttaaaaattcttttaagattttaaaacaaattctttttttttgtctgactgggtaatttaaaagaccagccttcaagaagtttttttttttttttttttttaaagacatctgtctcttccttcatttcctagattgcttttctggttatttttgtgttggttttcaaccttctcttggttctcattgagcttctttacaattcccactttgaattctttctctcatttctgaattttcattttggttgtagtccattgccagaaagccagtgcagtctttttggtggtgtcacaacattcagatttttcatggtacctgaattcttaatgctggttttttctcatctagagaaactgacacttgttgttgtttgaatttacttcatttaaatggctttttt

SEQ ID NO: 135100 - DNA, 601 bp, Human
atttagttttaatctagccaatgatgtgaaaactctgcagaatttttagtataagtgcattttgaaggattgccctggcagcagcataggggctggatttgaaggaaggtaagatgagagctgggaacatctcagtgaggaggcacaatgcctcttatggggaaagaagggtctgcaccaccagctcttagactgtggcaagttctgttatggaaatgtgaccaaagcacaccaaaagaataataattaattctctctggatgattagagtgtaccatggaaattttgtagaggaagtgakattatcatataattaaatggaaattatgttgggtaaaattgtaatgtaataaagatctcagttttattctggaaagaagaaatgctggatactcattttatcctagaaggcaagagaaatttagtttgaagagtaactcaccctctggggtaagagtatgacatggcttgacatagcagttcaaataattttgcacatgtgttcttggcttccctttagatttcaggttcatcctgtgaggttgaaaatgattgtagctaaaatgttatgttaaatgataggttgagtgagtcaagcatg

SEQ ID NO: 135101 - DNA, 601 bp, Human
tgccatactgggaattcagtgttggtctccagcattggcagatcagatgctctgcagtagctttagccagatcagttttttcagttttagaaaggactaatctgtgtgtgtgtgttttttttttttttttttgagacagagtctcgcagtgtcgcccaggctggagtgcagtggcatgatctcagctcaccgcaacctccacctcgtgggttcaagtgattctcatgcctcagcctccccagtagctgggattacaggcatgcaccaccacatccagctaatctctgtatttttagtagakatggggttttgccacgttggccaggctagtcttgaattcctgacctcaggtgatctgtccgcctaggcctcccaaagtgctgggattacaggcatgagccaccgcacctggcctaatctgtgtttttgaacccattcataatctccatccctgccaccatggccactttgttcatgggtccattgcacaagcttagatatgatggagaaggaggttgagtgccacccatagagtatgtcattttatctacctgattattaagagcctctgcattgatgtgcccacctagtctctcatggt

SEQ ID NO: 135102 - DNA, 601 bp, Human
ggaacttagcactgcactgaagcccaaggccatgaccaaaccagtcctcgaattgcatctctgtgggcctgtctcctaggactgctcccaataccaattgtgtgtcactcatggtccgttgaggagagaccgaaatcatgtagttacttagaaaggggaagtttaatctaagaactgttaagttgtgataggagagtaactaaagatgtaaagagaactctaacggatattctaggactaagagcctcaaggaaggaccaacttgcaagaggggtcccctctaccaggctggggtttagakcttattggagaaggtatagctgtagcccaggtttgctggtggagaagattgctgtgtggctggtccatagtaattgggcaagcaggaaacaatcctttcatgtataggtgagcgaaggctggttagcctgtctacgaagggagtccaggtgcttctgtgggtgtgaaatctggagtgtgtgggctgaggttgccagatcactgaggaactggacccctgggcataagctgtggctaagtacccctggatgtcctcctcatccataccatgcagcaggaagtccaccccatgacagaccat

SEQ ID NO: 135103 - DNA, 601 bp, Human
gtgcttaataaatacttaaatattgtaacagtctctatgatgttcattaaaggtgagattctaccttcaaacaattttcattttattattcaaaatatttttactacttctgcattacacaacttccctttattttctggactggttacattcttttgactgattaggtcaagatgggtacattttttgtcttgtgctccatataatgaaatagggtttgtattttatgttacgttctttacatcatttttcagcttctgtgacttttctcatctgagtagatgactgagacagataactrtttttaatattatattttttagaattaaatcttagttcgtggaaagttaactgattgtttttaattttatttttaggtgctgaatgtggagtaaatgcagatgttgagaaacatcttgaattgggcaagaaattacttgcagctggacagctagctgatgctttatctcagtttcatgctgccgtaggtttgtatcatggaaccaaatcactcagtgtctgtcttagtgaattctagtaatagctctttttttaaaaataacatttaaaataaacattatttcatgtttaaataaaacat

SEQ ID NO: 135104 - DNA, 601 bp, Human
attgtttgaggccaggagtttgagaccaacctgggcaacatagcaagagctcgtctctacaaaagtaaaataaaaacaaaattagccaggcatggcagtgcccacctgtagtcctagctacttgggaggctgaggtggaaggattgcctgagcccaggagtttgaggaggcagtgagctgatggtgccagtgtgctctggcctggacaacagagtgaaaccctgtctccaaaataaagtgtcattttgttcaatgtgatctggcaagtagcagtgactctcaaatgggatacacatcatartttctttttctttttttttttttttttgagacggagtctcgctctgtcaccaggctggagtgtggtggcgtgatctcggctcactgcaacctctgcctcctgggttcaagcgattctgccttggcctcctgagcagcccgagcagctaggagtataggcatgcgccaccatgcccagctaatttttgtatttttagtagagacggggtttcaccatgttggcgaggatggtctcgatctcttgacctgatgatccacccccccttggcctccaaaaatgttgggattacaggcatgagcc

SEQ ID NO: 135105 - DNA, 601 bp, Human
ttgtctgctgccatgtaagatgtgcctttcgccttcggccatgattgtgaggcctccccagccatgtggaactgtcagtccattaaacctctttttttaaaaaaatacccagtcttgggtatgtcttcatcagcagcatgaaaacggactaacgcaccagtccagtgtgtttttcctatgcctctcactaccaccatttacaacatcatttgtaattggctttctgatgtgttttctccagatagtagttgtattgttttattctggctaattttctcatatttgaattgtttgatagttytaggattctgggtagaggttaaatccatctcccatgttcaagtttctaataagctagtataaggatttgaattatgtggtttaaaatgaaatatagtatttccatatttccacatgtagacttgcaaataatttacataatgaacaatattatatattggatggataataggaaaaatacttattttcaaggttatccagtcttgtattggtaaaaactaagcatgcatttctaaaccaattcttgtttcacttgctacttcatgcacagtgatgtaggaatggactctagttccattaa

SEQ ID NO: 135106 - DNA, 601 bp, Human
ttgtcattattttttattttggccattctcatagatgtgttactatattgtggttttaatttggatttctctgattactaatgatgttgaacatcgtttcctgtgcttatttgccatctgtaaatccttttcagtgaaatttctgttcatgttttctgctcatgttctaattggcttgtttgcttttttattgttgtgttttaaatgtcctttatatattttagatactttgttggatatgtagtttacaaatattttcccctcagtctgtagcttttcctttgatcctcttcacaggatrttttatagaacaaaatgtctaatttttaaattaatacagaatatttgtgcatatttatgtatttttgaggaacatgtgatgccttgttacatgcatagactgtgtgatgatcaagtcagggtattcagaatatctatcactgaatatttatcatttctgtgtgttgggaacatttcacgttctcccagctattttgaaatagacaatatattgttaactaccctactttgctattaaacattacctcttattcttctttgctgtgtgtttgtacccattaacctctcttcatccccgcct

SEQ ID NO: 135107 - DNA, 601 bp, Human
aacctctcttcatccccgcctcccactgacacaccctttccagtctctaatgtctatcatgtctgtcatcctactctctaactctgtgagagtaacttttttttttgctcccacatatatgtgagaacatgcaatgtttgactttctgtgcctggcttgtatttcactaataacctccagttccatccatgtggctgcatatgaacatgattttaattcttttttatggccaaatagtatcccattctcattcactcattctctctctctctctctctctttctctctctcttttccccckccctctccctctccccctcccactccctctccgcctccctctccctctccccctccccctccctctccttctccctctccctctccttctccctctccctgtccttttccctctccctctccttctccccatccttctccctctgcctatccttctccctctccctctccctctccctctctccatacacacacacataccccatacttaactttattaattcatctgtagatgagcacatttggtaagattccatattgtggaatagtgctgcaataaacatgaggatacaggtatccc

SEQ ID NO: 135108 - DNA, 601 bp, Human
gagtcctctgggaacatatggaagggtcatctaacttaactgggggaggaagggtctggattcaagaagggcattcctaaaggaggttacttgcttgaaatctgaattttaaaaggatgcatccgtgtaagcaaggtgggtaggaggaccatccagggcaaaggtgagagcctgtgtaagaatcagaggcaagcatgtgcctgtcatttaggaaatgtccagtaagctggagtatgagactcttgacaggcatgtgggggatcgtgattataaggaggacattatatagtgccaggaattsgctctttatggccattgaaggtttatgttggaagtattatgaacagttttttgcttagcgtgatcgactggttgctctgaagaatggattggaataagacaaggggagaagcagagagtctgctaaatgagactgttgcagtaaataagtaatccaagtgtaaccttacagtggtcaaagagtaggctaatgtaggtggggtagacgtttaggaggtcggctctagagagattcattggttggggtgataggaaaaaaaggaattatgatatccaggtttctggattgttcaaattgtcc

SEQ ID NO: 135109 - DNA, 601 bp, Human
atctcagtaacagggacaatgtggaattccgtttcccgtcttcgacccattgctacccctctcccatcaatctcttcaataaatggctgcactccagcctggtgacagtgcaagaccctgtctcaaaaaaaaaaaaaaaaaaaaaacccagaaaacaaaccccacagtttactcctgtatagaagggagataatctgatctgccctttaaggttttaggtttagcttagagtagtgcctggagcacagaaagctctcaataagtgttttctgctgtcatgattgatctccatcgtcatctrtagcatgggctttagagatagagaccttagtttgaatttaagcaagacttacagcaagttatataattattcaattttttttttttttgagatggagttttggtctgttgcccaggctggagtgcagtggtgtgatctctgcttactgcaacctctgcctcccaggttcaagcaattctcatgcctcagcctcctaagtagctgggattacagacctgcgccaccactcccagctaatttttgtattttttagtagaaatgatgtttctccatgttggccaggctggtctcaaactcctg

SEQ ID NO: 135110 - DNA, 601 bp, Human
agtaacagggacaatgtggaattccgtttcccgtcttcgacccattgctacccctctcccatcaatctcttcaataaatggctgcactccagcctggtgacagtgcaagaccctgtctcaaaaaaaaaaaaaaaaaaaaaacccagaaaacaaaccccacagtttactcctgtatagaagggagataatctgatctgccctttaaggttttaggtttagcttagagtagtgcctggagcacagaaagctctcaataagtgttttctgctgtcatgattgatctccatcgtcatctatagcrtgggctttagagatagagaccttagtttgaatttaagcaagacttacagcaagttatataattattcaattttttttttttttgagatggagttttggtctgttgcccaggctggagtgcagtggtgtgatctctgcttactgcaacctctgcctcccaggttcaagcaattctcatgcctcagcctcctaagtagctgggattacagacctgcgccaccactcccagctaatttttgtattttttagtagaaatgatgtttctccatgttggccaggctggtctcaaactcctggcctc

SEQ ID NO: 135111 - DNA, 601 bp, Human
gacttaagacatatattctagggccagttgaggaggctcacacctgtaatcccagcactttggaaggccaaggtgggaggattgcagcttgagaccaacctaggcaacatagtgaggccatgtctctacagaaaataaaataattaactgggtatggtgacacatacctgtagtcctagctacttgggaggtggaggcaggaggatcacttgaacccagggctctgaggtttacagtgagctctgatcatgctcctgcactccagccagagtgacagagggagaccctgtctaatttaacraaaaagacatatattctgctctttagcaatttacactttagttgcaggaaataagtcctaaacatgtatgtgcaagatgaacaatacagagaaacttgtgagaagttgacatatgagctgtctaggtaacaagataagattgagaactacataggagacccacttcagtttttctcttgattaactgtgtgatgttgggccagttgtttactgtctgtgagactcaggattttcacttataatgtgagagttaattggacaagatgatttcttaggatacctccattttgaagggtttct

SEQ ID NO: 135112 - DNA, 601 bp, Human
caattcattgaatatattttatgccaaagtctaattttattttgaattcagagaagtcaaagaaaggttctattattctaggaccttaatcactgtaactttaatacaagggacccagtttaagtgggctaatatctaatgcaatggaaaataaattgagcatctttttaaagtgtgtattagcactttttggagtacttgctatgtgttacatagagtatcttcttaatctctcagtgactgccctacaggatattggtattattatccctcttttattggtaaagaaaatgcagaaaasacataggtaattactgattgccaggaatggggtttaattaattcattcatctagactttatttaaaagcaatatctgtttggaaatattcacagcccggtcactgagaaatggtaaaacttccacactgtgttactcctgtgttggctatctgctgctagataacacattatccaacgttagcagcttaagtaacacacatttatatgatttcacagtttatggggttaggaatctggccatggtgtagcagggtctgctgcttactgcagggtcatggcctacagtcaagatgtgagat

SEQ ID NO: 135113 - DNA, 601 bp, Human
agccgggttattctgtttgttaaaaggagttaccaggtccacctcatgctccagaaaggcatgaataccatgaggcgaggatcactgggggccatcttagaaggctgcttaccacaactgccaacctggtgtttttatttgaggcgccagaagtagaggtgcagtcatacagaaggcagatcatctctttgaacaagcccccatcccgtagctattacgggttatttttccagaagctcagtgaccaggatacatagtgagaagtaaaaaatataaaatattgttacaggaagggatttgkcagaaagagtcagaaatgtgaaagccctaaggaagagaaaggatgtcaagaaacatgaaaaagggaagaatgagggaattgtcagcaagggccattctctacatgcaggtgtagagaaaacaagggggtgattgagaggagtcaacagcctcatggtaataataaaaatcttcatctcagacgggcacagtggctcatatgtgtaatcccgtgctttggaaggctgagacaggaggatcacctgaggcccggagttggagaccagcctaggcaacatagtgagacaaccctgtctctaca

SEQ ID NO: 135114 - DNA, 601 bp, Human
gcactttgggaggtcgaggtgggtggatcacttgaggccaggagtttgagactagcctggccaacatggcaaaatcctgtgtctaaaaaaaaaaaaaagaaaattagctgggtgtggtgtgcatgcttgtgatcccagctactcgggaggctgaggcgctcgaacctgagaagcagaggttgcagtgagccactacactgtagcctgggccacagagtgagactccgtctcaaaaaaaaaaaaaaaagttaataataataatggttgataggatccagagagttctagctagggaaacctragtctaggtttccttgcctctgaaggatttaatgacaactgatttccgaaggaagtctactgaaatattcaaatggaagcagtcgtaattcacatttatttgtgattttcacagtattttgatatacagtttcatttaattttggctctaaacttatgatgtatgtagaatgggcaatttgttgataattttacagaagatattgtgatatggtccagtagaattcatgttttactgggttattttgtttatgcttttttaaggaaatatagtttacatttttacattcccatagactat

SEQ ID NO: 135115 - DNA, 601 bp, Human
gagttctagctagggaaacctgagtctaggtttccttgcctctgaaggatttaatgacaactgatttccgaaggaagtctactgaaatattcaaatggaagcagtcgtaattcacatttatttgtgattttcacagtattttgatatacagtttcatttaattttggctctaaacttatgatgtatgtagaatgggcaatttgttgataattttacagaagatattgtgatatggtccagtagaattcatgttttactgggttattttgtttatgcttttttaaggaaatatagtttacayttttacattcccatagactatccattttgaacttagttcattgtccatgatatttatgtataatgttggttttgatatttttgtatatgtgaaaagtcgatacgactttagagcagctctaagaaatatgcaaagatacttccaccagccttattgatgagctcttgggtttatgatttgaagaatactattgtgtttcctaaacccttatggactttttgataaaataggaatggtgaagcctcaacctcctgccctctcacggtattttttctttctttctttctttttcttgatatg

SEQ ID NO: 135116 - DNA, 601 bp, Human
aaaaaaaatgttttctgtttgcaagtctgtccttttcaggtcctctggctagacagagcagacttctgcaggtttttgttattgtcgttctgtacctgttggcgtttctgcattgctggaatcttcagctccaagtctgggatatatgaaacaaaaaaaaagaacccagggaacgtcttaccatgttttcctcaggtcctgagtcactagctagtctgtctcttttcctcctttgaaagttttctattttaaaaaatatacatataatctctagggttttttagttgtgcttagctggagsacttgggacaaatacatctattccactttcccagaagctggcttttttgttttcttctttaagttccaggatgtatgtgcagaatgtggaggtttgttacataggtaaacgtgtgccatggtggtttgctgcacctatcaacccattacttaggtattaagccccacatgcattagctatttgtcctgatgctctccctccccttgctgcctgccccacacaggcctccgtgtgtgatgttcccctccctgtgtccatgtgttctcattgttcagctcccacttatgagtgagaatatgc

SEQ ID NO: 135117 - DNA, 601 bp, Human
ttgggaggccgaggtgggtggatcacctgaggtcaggagttcgagaccagcctggtcaacatggtgaaaccctgtctctactaaaaatgcaaaaattagccaggcatggtggtatgcatctgtaatcccagctactccggaggctgaggcaggagaatcacttgaactcaggaagcagaacttgcagtgagccgagatcacgccattgcattccagcctgggcaacatgagcaaaactcagtctccaaaaaattatctatatctatatctatatctatatctatatctatatctatatcttatctatatctatatctatatatcccacctctgcatcagcagtctcagccaccaacacagctgcgttttagtaagagtggtcaaatttaagatatttgttgaaaacactgattggtttctattccttatgagataaacatttttaacccaaaggagtctgaatagtggaacttcaggcaagtgcttgtgccatcaggtcaggcagcctatgagggaggtactggggcaacaggcctgcctcctgggcatgaaagagaccattccctctagcagatcagatttctcatggctgatgcttttt

SEQ ID NO: 135118 - DNA, 601 bp, Human
aggccgaggtgggtggatcacctgaggtcaggagttcgagaccagcctggtcaacatggtgaaaccctgtctctactaaaaatgcaaaaattagccaggcatggtggtatgcatctgtaatcccagctactccggaggctgaggcaggagaatcacttgaactcaggaagcagaacttgcagtgagccgagatcacgccattgcattccagcctgggcaacatgagcaaaactcagtctccaaaaaattatctatatctatatctatatctatatctatatctatatctatatctaatctatatctatatctatatatcccacctctgcatcagcagtctcagccaccaacacagctgcgttttagtaagagtggtcaaatttaagatatttgttgaaaacactgattggtttctattccttatgagataaacatttttaacccaaaggagtctgaatagtggaacttcaggcaagtgcttgtgccatcaggtcaggcagcctatgagggaggtactggggcaacaggcctgcctcctgggcatgaaagagaccattccctctagcagatcagatttctcatggctgatgctttttttcaa

SEQ ID NO: 135119 - DNA, 601 bp, Human
ggccgaggtgggtggatcacctgaggtcaggagttcgagaccagcctggtcaacatggtgaaaccctgtctctactaaaaatgcaaaaattagccaggcatggtggtatgcatctgtaatcccagctactccggaggctgaggcaggagaatcacttgaactcaggaagcagaacttgcagtgagccgagatcacgccattgcattccagcctgggcaacatgagcaaaactcagtctccaaaaaattatctatatctatatctatatctatatctatatctatatctatatctaatctaaatctatatctatatatcccacctctgcatcagcagtctcagccaccaacacagctgcgttttagtaagagtggtcaaatttaagatatttgttgaaaacactgattggtttctattccttatgagataaacatttttaacccaaaggagtctgaatagtggaacttcaggcaagtgcttgtgccatcaggtcaggcagcctatgagggaggtactggggcaacaggcctgcctcctgggcatgaaagagaccattccctctagcagatcagatttctcatggctgatgctttttttcaag

SEQ ID NO: 135120 - DNA, 601 bp, Human
ctacctgctggtttgggattagcacatttgctgaccatatcagctgggtaaaacattgtactccctctggtgccaactctgtgaacccatgagcgtaatatgtaggtgaggaagtaggaaacagttacaatagtcaagcagtattattcagaaaaagatacaaggcagatttccaaattatgaaaagcttaaagtgttggaagtaaaaagtgctaaggaaaaaggatcaagaaggtcactgcaggtgcatagctgggacagacgcttagaaagctgtggaggggtcctttgcctctcccarcagtgacaagacacatttgatttagtgcagagggtaggtttgaatagagaaagacagtcatagatacatgttcattttggctttttgttaattgacaagactgtaatttcctatgactaatgagtgtgatctcaagtaatgaagaggcttctttaagaaaggaaaaaaaaaaacaagatttttcatcatcttaaatagaaacagactaagtatatgaacgaaggcctatatttgtatctgcctactctagtgctttgaatagagttggtgatatttcttaagtgttgataaagtacagca

SEQ ID NO: 135121 - DNA, 601 bp, Human
gtgtttgaagtgtttacttgatcaatattactgtgattattgatatggttgtatgtaggtctgccattttactattgttttctttttgtccttttgtttttgaattttttgttcctctctttctgttgtcatttagattatttgaatatttctagtatcccctctggggtgcagtggttattcacaggtgtgattatattgcattgtagtcttaaacccctggcctcaagcagtcctcctgcctcagcctcccaagtagctgggactgtaggtgcatgtcctgcacttgactgtaacgackttttaaataaatttctaatattagtttaatagtttctaattattagttaccactataattgaaattaaaatatgtcttcctctagctcttgatttatcaattttaggcagtatcccttgtctgcctgctacagaagaggaagaactgagtagacctcactagttccttttgttctttctcaccttcagttttagttgagtatttgatcttttgcttatatttacagctttaatgtaatataaataagttttaatatacccaagtttctttcttaccctgtcacctttagatagcatctcg

SEQ ID NO: 135122 - DNA, 601 bp, Human
tttactgggaggtggcttagtgacagctttctctgtgaaaatgttttgtgtgggctttcctttttgagccaatgaaattcttttaaataggttagtttagcacatttgcattgatcgatatgacagatgtttggtcaacattctatcattctgttttgctgaaatctttttgcgatttggcctgtattttgtatacgctcctgatatttaggaaagtttgtatttttgtacttttaaaaatagttttattaacactattttggcaacatccattagtttcctactgtgagggaaaatttartgtacttcctcctcttcctcactgttcttccacctcttaataatttgttgaggaaattttttaggatttgcctttgtaatattactcaatttatcagtggctgatgttttctgattgcttcagctgatgtaggtgggaatgaatgaacttactccctcatcatccttcccctttcttttcccatgtttcgtcagctgtatcccttctgcaccatcagggcacacgctctgctctgtcgctgttagtcccctgctttgtgttagtcttggttctacgtgaaattcagtgtctactggtttt

SEQ ID NO: 135123 - DNA, 601 bp, Human
ggagctcagggcaggctgtaagtaaataggacctgttcactggagaacgtccccagtggcacttgcccagctgccccagtgagccctgcttcactcattttactgatcgggggtcagtaaaatgatctatttaactttggtctgggtgggaccgctttttgtttgttccaggtttgttgtagaggtttgcgtgtcctacaggggccctccacaggcacacctttcactctgcttatagtagggattaatgctgcagccagtggctccatatacaggggccagagcctgcccagccatcccrtagtcatctcacggactatcctgacagttgccttatagctacttcagcttgccaaagtgagggtcctcggccaaagataatggcttccagatctgctagggcctcttatagtgtgtgcttgcattgtggttctctctacttaggtttattactaatgtgctcctgcttcctatcttccagaaatttatcaaagttgctggtctgctgttgtcttcagtgctactatgattatattacttttcgtcacttcggtggcaaggagggtaggcaaacgtgtgtgcttacgtctcccatcctaag

SEQ ID NO: 135124 - DNA, 601 bp, Human
taggacctgttcactggagaacgtccccagtggcacttgcccagctgccccagtgagccctgcttcactcattttactgatcgggggtcagtaaaatgatctatttaactttggtctgggtgggaccgctttttgtttgttccaggtttgttgtagaggtttgcgtgtcctacaggggccctccacaggcacacctttcactctgcttatagtagggattaatgctgcagccagtggctccatatacaggggccagagcctgcccagccatcccatagtcatctcacggactatcctgacrgttgccttatagctacttcagcttgccaaagtgagggtcctcggccaaagataatggcttccagatctgctagggcctcttatagtgtgtgcttgcattgtggttctctctacttaggtttattactaatgtgctcctgcttcctatcttccagaaatttatcaaagttgctggtctgctgttgtcttcagtgctactatgattatattacttttcgtcacttcggtggcaaggagggtaggcaaacgtgtgtgcttacgtctcccatcctaagctggtgatttgcattgctcctcaaga

SEQ ID NO: 135125 - DNA, 601 bp, Human
tacttttcgtcacttcggtggcaaggagggtaggcaaacgtgtgtgcttacgtctcccatcctaagctggtgatttgcattgctcctcaagaatgtgaagggaatatagaagaaaagtaatttgggataagattttttagattcagaagttagaaaatgaattggctaatacgcaacatggtattctttatctagggctgatatatgtctggcttattctatttttcatagctgttcagtaatggtgggataaacattggatgtgtgtgtgtgtttttttttttttactttaagttctggkatacatgtgcagaatgtacaggtttgttacataggtatacacatgctatggtgatttgctgcacccatcaacccatcatctacattaggtatttctcctaatgctatccctcccccagccccctacctccccacgggccctggtgtgtgatgttcccctccctgtgtccacatgttcccattgttcagttcccacttatgagtgagaacatgcagtgtttggttttctgttcctgtgttagtttgctgagaacaatggtttccagcttcatccatgttcctgtgaaggacttgaactcac

SEQ ID NO: 135126 - DNA, 601 bp, Human
tttcttgtaaatttgtttaagttccctgtggattctggatgttagccctttgtcagatggatagatcgcaaaaattttctcccattcatggcaacaaaattctcccgtgtaggttgcctgttcactctgatgatagtttcttttgctgtggagaagctctttagtttaattagatcccatttgtcaattttggcgtttgttgccattgcttttgatgtttcatgaagtctttgcccatgcctgtgtcctgaatggtattgcctaggttttcttctagggtttttatggttttatgtcttasgtttaagtctttagtccacctcgagttaatttttgtataaggtgtaaggaaggggtccagtttcagttttccacatatggctagccagttttccaacaccatttattaaatagggaatcctttccccattgcttgttttttgtctattgggtgttttgttttgttttgtttttttagatgctctcttagagtgtggagtctgagaaagtataacttaaaatggtctgtctagttatatctgtgggaagtcttacatcatccatacttaggtttctaattagttttctgcaattgtgtgaa

SEQ ID NO: 135127 - DNA, 601 bp, Human
agagtctgcacaagtagcaaaatcatgtatattgaaacatcttcctattgtattccttcaaggtctgtttccttactaagctatgtgttgtgttatgggtgttcattgtaaagttaaaccttactactgtttatgatggttttgtttttatactaaactgggagaagttttttatgtccctgtgggttgggctatagtaacatttaatgtaatgatgcactgatgcgagaattcactttaggataaaagattgaagggtccccttccccagtgccacagggccaaaggtggtggtggttcrtttctgtacgtagtgtgtagcctgtcaaaatctgttagtcttgttgtaggactctttccttagttcagctaaagacagggggtccttgtcacacggccacgaaaaatgaggctcacagacaatttgaagagggcaggacttattgggtgaaaaggaaaagagggaaacaggactctctacaaggccagagtcccagctagtgtgcttcccaccttgcagattgaatcccaggttccatccaggaagaggagggaggggccaggcttcttcccgaggctccaccccagtgcacactcctcc

SEQ ID NO: 135128 - DNA, 601 bp, Human
ataaaaattggtgtgtgttaacaaagagactgcctatccaattctctatttctggccggagcgagtaaatctaaattagaactattctacaagggcaagtctacaaaggacggctcaagagcttcctgattcatatgagactagtctgaacccattctcagctggccaagaagaaactgcttcgacttggcaacagcgtgaaggcacgaggactcctgatgctgttacacaggtacacatacaatgagaaccccagaattactttgtacctcacaaatctccagtactaagggcatctatstattcccttaaaacagtcccaaatcaactccaacggcatcggtaagacagtcaatctcagggatccctccctggcaaggaaaacccagcgcaggtaatttatgttcttggcgtagagtctgttcccaatatccaggaagactcagcccgcagccccatcttactgagcaaggtgacgccctgaagtacacaccgacaatgtttaagtccaaggaaaatgaagttccagtcacttacagggaagggtctgtttccattgcctcacttctggtttattttgtggaataaaatgtctttcctc

SEQ ID NO: 135129 - DNA, 601 bp, Human
gcgccactgcactccagcctgggcgacagagagactccgtctcaaaataaataaataagtaagaaataaataagaaaaatttttaaaaaattggtatgtgttggccaggcgcggtggctcttgcctgtaatcccagcactttgggaggccgaggctggtggatcacctgaggtcaggagttcgagaccagcctggccaacctggtgaaacttcgtctctacgaaaaatacaacattagctggttatggtggcgggtgcctgtaatcccagctacttgggagactgagacaggagaatcgcygtgagccgagattgcgccactgtgctccagcgtgggtgacagagcaagactccgtcttagaaaagagtaaaataaaaattggtgtgtgttaacaaagagactgcctatccaattctctatttctggccggagcgagtaaatctaaattagaactattctacaagggcaagtctacaaaggacggctcaagagcttcctgattcatatgagactagtctgaacccattctcagctggccaagaagaaactgcttcgacttggcaacagcgtgaaggcacgaggactcctgatgctgttaca

SEQ ID NO: 135130 - DNA, 601 bp, Human
cctgtaatcccagcattttgggaggcaaaggcgagtggatcacctgagatcaggagttcaagaccaatctggccaacctggtaaaaccccatctctactaaaaatacaaaaaattagctgggcgtggtggtgatgcacaccagcaatcccagctactcaggaggctgaggcagaatcacttgaacccaaaaggcaaaggttgcagtgagccaagatcgcgccactgcactccagcctgggcgacagagagactccgtctcaaaataaataaataagtaagaaataaataagaaaaattttwaaaaaattggtatgtgttggccaggcgcggtggctcttgcctgtaatcccagcactttgggaggccgaggctggtggatcacctgaggtcaggagttcgagaccagcctggccaacctggtgaaacttcgtctctacgaaaaatacaacattagctggttatggtggcgggtgcctgtaatcccagctacttgggagactgagacaggagaatcgctgtgagccgagattgcgccactgtgctccagcgtgggtgacagagcaagactccgtcttagaaaagagtaaaataaaaattggt

SEQ ID NO: 135131 - DNA, 601 bp, Human
tctaggataatttgtgagcttatagaccccatactcatttttaaaaaatggttgtgttagactgggtgtggtggctcacgcctgtaatcccaacactttgggagtctgaggtgggcagatcacctgaggtcaggagttcgagaccagcctggtcaacttggcgaaaccccaaccctactaaaaatacaaaaactagccaggcgtagtggagtgtgcctgtaatcccagctactagggaggctgagacaggagaatcctttgaacccggggaggtagagattgcagtgagctgagattgcascatcgcactccagcctgggcaacaaaagcgaaactccgcctcaaacaaacaaagctgggtgcggtggcccacgcctgtaatcccagcattttgggaggcaaaggcgagtggatcacctgagatcaggagttcaagaccaatctggccaacctggtaaaaccccatctctactaaaaatacaaaaaattagctgggcgtggtggtgatgcacaccagcaatcccagctactcaggaggctgaggcagaatcacttgaacccaaaaggcaaaggttgcagtgagccaagatcgcgccactgc

SEQ ID NO: 135132 - DNA, 601 bp, Human
ggagtcccagctactcaggaggatgaagtgggaggatggcttgagcccaggaggtcaaggctgcagtgagctgtgttcatgccactgcactccagcttgggtgacagaggctctgtctcagaagagagaaaaagacagcaactgaatcgtagaaaatggggtacaacatggcagaaagaattatcacaatactcgtgaattttccacaccccatccataaactttggcaatcttcaccgtctttcctcagccaaggaactgagttcttatctgttttgaaaaggtggtgctcgattatcamggtaagtgttgagacataaaatcgttatgctaagatatgaaaaaatatcaaactaacaaacctgcctgctgccattttcaactttggcaaccaacaaacacaaacaaaaggctgaaaagtgagtttcaatgacagtttgccatcatgtgacgacatataatgcaaaaccccagatactatgcaggtggcatcaaagtagaatatatctggttcagggccaacacaggtacatcaatattcccatctcataatactattaaacaggccacaatgagaaagatctaggataatttgtgagct

SEQ ID NO: 135133 - DNA, 601 bp, Human
cagcccggggggcaagagcgaaactccatccaaaaacaacaaaacaaaaaacaccaagtcttagactccagggcagaggcaaagtattgaggatattgaggatacggacctctatgtgcactgctgagatgccaaaagaacgctggctttgagagtgtagtgtaaaagggtcagctctcaggtcagaatgcctaggttcaacttctgaaagtcatttattagttgtgtgaccttaagcaagttactgaatctatgagtgtttcctcctgtataaaatgggaatattttaataaatggagaycatattacttatctcactagattgtcctagacagtaagtgaaataaggtacataaagtactcaaagtacctggcacagaataaccagtcaataaacattagttattaatattctatacgcctctctaaaaaattcaagaaatttctctgtgtgacttcaaaaggacttggtgagggggagaacaaagattcagtacttagtacttgagatttgtgaggtacaaagtaattctgaggttatacagacaggccaggcgctggtggctcacgtctgtaatcccagcactttgggaggccgagg

SEQ ID NO: 135134 - DNA, 601 bp, Human
cctgccccaaagttaagggctgtagtgcactatgactgtgcctgtcaacagccactgcactccagtttgggcaacatagtggggggaaaaaaaaacaaaaaacacaaggccgaggtgggcggatcacctgaggtcaggagttcgagaccagcctggccaacatggtgaaaccccgtgtctactaaaaatacaaaaaaaaaaattagctgggcacggtggcacatgcctgtaatcccagctactcgggaggctgaggcaggagaatcacttgaacctgggaagcagaggtttcagtgagccragactgcaccactgcactgtagcagcccggggggcaagagcgaaactccatccaaaaacaacaaaacaaaaaacaccaagtcttagactccagggcagaggcaaagtattgaggatattgaggatacggacctctatgtgcactgctgagatgccaaaagaacgctggctttgagagtgtagtgtaaaagggtcagctctcaggtcagaatgcctaggttcaacttctgaaagtcatttattagttgtgtgaccttaagcaagttactgaatctatgagtgtttcctcctgtataaaatg

SEQ ID NO: 135135 - DNA, 601 bp, Human
actaaaaatacaaaaaattagccgggcatagtggcgggcgcctgtagtcccagctgctcgggaggctgagggaggagaatgacgtgaacccggcaggcggagctttcagtgagccgagatcgcgccactgcactccggcccggcgtgggcgacagagcgagattctgtctcaaaaaaagaaaaaaaaaacataaaaatgacacctaagccattccatataattttcacctatgcactgtgtaaacaaaatatactctgtaggctagatgcgatggctcacacctgtaatcccagcactttsgggaagccgaggcgagcggatcacttgaggccaggagttcaagaccagcctggacaacgtggcaaaaccccgtctgtactaaaaatacaaaaaaattggctgggcatggtggcgcatgcctgtaatcccagctatttgggagactaaggcaggagaactgcttgaacccaggaggtggagggtacagtgagctgagatcgcgccactgcactccagacggggcaacaagagcgaaactccctctcaaacaaaacaaaacaaaacaaataggccgggcgcggtggctcacacctgtaatcc

SEQ ID NO: 135136 - DNA, 601 bp, Human
gtgaaacacctctctactaaaaatacaaaaaattagccgggcatagtggcgggcgcctgtagtcccagctgctcgggaggctgagggaggagaatgacgtgaacccggcaggcggagctttcagtgagccgagatcgcgccactgcactccggcccggcgtgggcgacagagcgagattctgtctcaaaaaaagaaaaaaaaaacataaaaatgacacctaagccattccatataattttcacctatgcactgtgtaaacaaaatatactctgtaggctagatgcgatggctcacacctgkaatcccagcactttcgggaagccgaggcgagcggatcacttgaggccaggagttcaagaccagcctggacaacgtggcaaaaccccgtctgtactaaaaatacaaaaaaattggctgggcatggtggcgcatgcctgtaatcccagctatttgggagactaaggcaggagaactgcttgaacccaggaggtggagggtacagtgagctgagatcgcgccactgcactccagacggggcaacaagagcgaaactccctctcaaacaaaacaaaacaaaacaaataggccgggcgcggtggc

SEQ ID NO: 135137 - DNA, 601 bp, Human
ataaggcgcggtggctcaggcctgtaatcccagcactttgggaggccaaggtgggcggatcacgaggtcaggagctcaagaccatcctggctaacacggtgaaacacctctctactaaaaatacaaaaaattagccgggcatagtggcgggcgcctgtagtcccagctgctcgggaggctgagggaggagaatgacgtgaacccggcaggcggagctttcagtgagccgagatcgcgccactgcactccggcccggcgtgggcgacagagcgagattctgtctcaaaaaaagaaaaaaaamacataaaaatgacacctaagccattccatataattttcacctatgcactgtgtaaacaaaatatactctgtaggctagatgcgatggctcacacctgtaatcccagcactttcgggaagccgaggcgagcggatcacttgaggccaggagttcaagaccagcctggacaacgtggcaaaaccccgtctgtactaaaaatacaaaaaaattggctgggcatggtggcgcatgcctgtaatcccagctatttgggagactaaggcaggagaactgcttgaacccaggaggtggagggtacag

SEQ ID NO: 135138 - DNA, 601 bp, Human
tccagcctgggcaacagagcaagactctgtctcaaaacataaataaagtttaaaaaataaggcgcggtggctcaggcctgtaatcccagcactttgggaggccaaggtgggcggatcacgaggtcaggagctcaagaccatcctggctaacacggtgaaacacctctctactaaaaatacaaaaaattagccgggcatagtggcgggcgcctgtagtcccagctgctcgggaggctgagggaggagaatgacgtgaacccggcaggcggagctttcagtgagccgagatcgcgccactgcmctccggcccggcgtgggcgacagagcgagattctgtctcaaaaaaagaaaaaaaaaacataaaaatgacacctaagccattccatataattttcacctatgcactgtgtaaacaaaatatactctgtaggctagatgcgatggctcacacctgtaatcccagcactttcgggaagccgaggcgagcggatcacttgaggccaggagttcaagaccagcctggacaacgtggcaaaaccccgtctgtactaaaaatacaaaaaaattggctgggcatggtggcgcatgcctgtaatcccag

SEQ ID NO: 135139 - DNA, 601 bp, Human
agaggctgaggcaggagaatggcttgacccgggagggggaggttgcagtgagctgagatcgtcccactgcactccagcctgggcaacagagcaagactctgtctcaaaacataaataaagtttaaaaaataaggcgcggtggctcaggcctgtaatcccagcactttgggaggccaaggtgggcggatcacgaggtcaggagctcaagaccatcctggctaacacggtgaaacacctctctactaaaaatacaaaaaattagccgggcatagtggcgggcgcctgtagtcccagctgctcrggaggctgagggaggagaatgacgtgaacccggcaggcggagctttcagtgagccgagatcgcgccactgcactccggcccggcgtgggcgacagagcgagattctgtctcaaaaaaagaaaaaaaaaacataaaaatgacacctaagccattccatataattttcacctatgcactgtgtaaacaaaatatactctgtaggctagatgcgatggctcacacctgtaatcccagcactttcgggaagccgaggcgagcggatcacttgaggccaggagttcaagaccagcctggacaacg

SEQ ID NO: 135140 - DNA, 601 bp, Human
ctattaccaccctagcttctgtcccacgccttcaaaatgaagcacgttttatgcccccctccacccactagcgcaacaggtcggatgagcaggtaacaggaggcaccatcttatttccaagtgctggacccgaggtcctttcacacttacggatgcactccacccaggcacctactccccaagacaaactgtttcaccagttcctaccatccacagcatgaattccacagcctctcaaagataagaagttttccattttgcttcaaaagcccccacacctcagttatgttattaagattcrtatacatgaaatgcttatggagtacttagtatgccagtactgaatatggagtatcattccaacaaccctatgagatcagtattactatttccctccttcacagatgaggaaactgaagcagggaaaagttaaacaatttgcccaaagttacacaagcagtaagtggtaggtaaataaggcccaacccaggatccacagctcaagcttataacgactctcctaactcacactccttcagctgtgtcaacctgaaaggtttagctgttcaagagaaaaaaaactagtttcttgcaagcattc

SEQ ID NO: 135141 - DNA, 601 bp, Human
agcactttgggaggctgaggcaggaggatctctttatttttttctctatttttaaaaactgattaaccaatctttagggagacatctgttgaggccaggagtgcaagcccagcctgggtcatacagtgaggctgtagtgagctatgacggagccactgcacaccagcctgagcaacagggccatcagcagtctcacgctacctccagaagtggcttggcccagctgccagcctggcatgtagctcttcactacctcgagggagtatcacaaactattaccaccctagcttctgtcccacgycttcaaaatgaagcacgttttatgcccccctccacccactagcgcaacaggtcggatgagcaggtaacaggaggcaccatcttatttccaagtgctggacccgaggtcctttcacacttacggatgcactccacccaggcacctactccccaagacaaactgtttcaccagttcctaccatccacagcatgaattccacagcctctcaaagataagaagttttccattttgcttcaaaagcccccacacctcagttatgttattaagattcgtatacatgaaatgcttatggagtactta

SEQ ID NO: 135142 - DNA, 601 bp, Human
gattctgaacgtggagttaggaagtcacacaaacggaaatcaaaatcaatgcaaggagaggatatcctttcagcttctcggtacctgctcagcccgttacttctaagccttccaagcatttcaagcctcaggttacgaccatttttacaaggccactccctccctgaaggtttcatgaagaacacctgagggctctgtgggctaaaataggcccaatcacttctgacgggtctacaagagcgggccaggctctccttgatctcacagcactttctcttttcctttttttttttttttttttgagacggagtctccctctgttgcccaggctggagtacagtggtgcgatctcagctcactgcaacctctgcctcctgcctcctgggttcaagcaattctcccttccttagcctctcgagtagctgggattacaggcgcccaccaccacacctggctaattcttgtatttttaggaaagacagggttttgccatgttggccaggctggtctcgaactcctgacctcaagtgatcagccagcctcagcctcccaaagtgctgggattacaggcgcgagccaccacacccggccctcttttccc

SEQ ID NO: 135143 - DNA, 601 bp, Human
caacagaatcgccatgagcaactacgaccatctgtgaacacttccaaggtactctctccactggaagaaggaaggtaaccaccccctgccagccactgttaccatagcaggccgagcgaaatacattttggcggggaaagaacaaatgagactactaagccaagtcgctctgaaagatgagtgagagaaaacttggcagatcatctggcgcaaaggtaggaagcaggtttaattctcttcttggtcaaatgccacaatagcgtgaactgggctcactatgactttttttttttttttttttgaggcggagtctcgctctttcgcctaggctggactgcagtggcgccatctcggctcactgcaagctccgcttcctgggttcacgccattctcctgcctcagcctcccgagcagctgggactacaggtgcccgccaccacgcccgggtttttttttctgtatttctagtagagacggggtttcaccgtgttaaccaggatggtctcgatctcctgacctcgtgatccgcccgcctcggcctcccaaagtgctgggattacaggcgtgagccaccacgcccggccgtgactttctttttgtt

SEQ ID NO: 135144 - DNA, 601 bp, Human
tccaatttaagacactgaaaggggtgcgagtgccaggactgtcctctatggcaaacactcctcatgcaccaatagaagatgatcgcaaaagttccgagggcaggactggagaggggattttggttatgactgtagcagagcacggaggtgctatattctggagattctctttattgaggaggatcactgatggagaataattcctattcaagtctggtagtcaaggagattcatggctaccttgcctatcaccattaggctaattctgggtgatctttcaggcctatggagaaactgtttmggacagggtcagtgtgagcgcatagggacctacttagcactgcctggtcaagaaaactctagggcagagtggtaaggaggccacctgggcacccatggcttagaaatggttctgatcacagctgggtggagaaaagctcccttgctaaggtttacccaactacatgccaaggtgttctattagttgtccttttgggacagtggttggcaggtcagtgctcagttaagtgttgctaatttttatatttttagaagagatggggtttcaccatgttggccaggatggtcttgatctcttgac

SEQ ID NO: 135145 - DNA, 601 bp, Human
tccatctcaaaagaaaaaaaaaaaaaaagaatggcataggggccaggcacgatggctcatgcctgtaatcccagcactctgggaggccgaggcaggcggatcacgaggtcaggagatccagaccaccctggctaacatggtgaaaccctgtctctactaaaaatacaaaaaattagccgggcacggtggcgggcgcctgtagtcccagctactcgggaggctgaggcaggagaatggcatgaacctgggaggcagagcttgcagtgagccaagatcgcgccactgtactccagcctgggcracagagcgagacaccgtcaaaaaaaaaaaaaaatcattccactattggagagaggtaataagacacaatgttaactttggaagccaatgaaaagtccttccggtagaaagagtactgatgagtgccttctctttccatccaaatgaatgatgagaccatctgaaggagagccgtacatttttcatattacccaaagtccacctgtggaattcacagctgtcagcttaaaacagtgaacagcccagactcaggaatactggctgtctctccaatttaagacactgaaaggggtgcgagtgc

SEQ ID NO: 135146 - DNA, 601 bp, Human
tgtaatcccagctacttgggaggctgaggcaggagaatcgctggaacccgggaggtggaggctgcggtgagctgagatcgcaccattgcactccagcctgggcaacaagagcagaactccatctcaaaagaaaaaaaaaaaaaaagaatggcataggggccaggcacgatggctcatgcctgtaatcccagcactctgggaggccgaggcaggcggatcacgaggtcaggagatccagaccaccctggctaacatggtgaaaccctgtctctactaaaaatacaaaaaattagccgggcayggtggcgggcgcctgtagtcccagctactcgggaggctgaggcaggagaatggcatgaacctgggaggcagagcttgcagtgagccaagatcgcgccactgtactccagcctgggcgacagagcgagacaccgtcaaaaaaaaaaaaaaatcattccactattggagagaggtaataagacacaatgttaactttggaagccaatgaaaagtccttccggtagaaagagtactgatgagtgccttctctttccatccaaatgaatgatgagaccatctgaaggagagccgtacatttttc

SEQ ID NO: 135147 - DNA, 601 bp, Human
cctgggttcaagtgattctcttgcctcagcttcccaagtaactgagattacaggcggccaccacgacaccaaggtaattttttatatttttagtagagatgggggtttcaccacgttggcaaggctggtctcgaactcctgacctcaggtgatcccaccgacttcagcctctcaaagtgttgggattacaggtgtgagccactgcacccggccgcagcctccactttctaggcttaagcaattctacagtctcagcctcccaaatagctgggactataggcacaagccacccaccaacacmcagctaatttttgtattttttatttttactttattatcatttttttgagacagagtctcactgttgcccaggatggagggcagtggtgcaatcttggctcactgcaagctctgcctcccaggttcacgccattctcctgcctcagcctcccaagtagctgggactacaggcgcccgccaccacgcccggctaatttttttttgtattttttagtagagacggggtttcaccatgttagccaggatggtttcgatctcctgacctcgtgatccacccacctcggcctcctaaagtgctgga

SEQ ID NO: 135148 - DNA, 601 bp, Human
tctcaaactcctgacctcaagtgatctgaccgccttggcctccaaaagtgctgggatgacaggcgtgagccactgtgcctggtatgtgacagggtctcactctgctgtccaggctggagtgcagtggcgcaaactcagctcacagcaacctccctttctttcttttttttttttgagacggactcttgctctgttgcccaggctggagtgcagtggtgcgatcctggctcactgcaacctctctctcctgggttcaagtgattctcttgcctcagcttcccaagtaactgagattacaggyggccaccacgacaccaaggtaattttttatatttttagtagagatgggggtttcaccacgttggcaaggctggtctcgaactcctgacctcaggtgatcccaccgacttcagcctctcaaagtgttgggattacaggtgtgagccactgcacccggccgcagcctccactttctaggcttaagcaattctacagtctcagcctcccaaatagctgggactataggcacaagccacccaccaacacacagctaatttttgtattttttatttttactttattatcatttttttgagacaga

SEQ ID NO: 135149 - DNA, 601 bp, Human
gcctggctggtctcaaactcctgacctcaagtgatctgaccgccttggcctccaaaagtgctgggatgacaggcgtgagccactgtgcctggtatgtgacagggtctcactctgctgtccaggctggagtgcagtggcgcaaactcagctcacagcaacctccctttctttcttttttttttttgagacggactcttgctctgttgcccaggctggagtgcagtggtgcgatcctggctcactgcaacctctctctcctgggttcaagtgattctcttgcctcagcttcccaagtaactgrgattacaggcggccaccacgacaccaaggtaattttttatatttttagtagagatgggggtttcaccacgttggcaaggctggtctcgaactcctgacctcaggtgatcccaccgacttcagcctctcaaagtgttgggattacaggtgtgagccactgcacccggccgcagcctccactttctaggcttaagcaattctacagtctcagcctcccaaatagctgggactataggcacaagccacccaccaacacacagctaatttttgtattttttatttttactttattatcattttt

SEQ ID NO: 135150 - DNA, 601 bp, Human
ttaattttaattatatgtgagccactgcatccagccattattaattttaattatttgcttattgggatttttcttgtgtgtgaaagggtctttttttttttttttttttgaagacagagtcttgctctgtctcccaagctggagtgcagtggctggatgtcggctcactgcaacctccaccctctgtgttcaagcaattcttctgcctcagcgccccaagtagctgggatacaggtgtgtgccaccatgcctggctaatttttgtaatttcagtagagacacagtttcaccatgttggccwggctggtctcaaactcctgacctcaagtgatctgaccgccttggcctccaaaagtgctgggatgacaggcgtgagccactgtgcctggtatgtgacagggtctcactctgctgtccaggctggagtgcagtggcgcaaactcagctcacagcaacctccctttctttcttttttttttttgagacggactcttgctctgttgcccaggctggagtgcagtggtgcgatcctggctcactgcaacctctctctcctgggttcaagtgattctcttgcctcagcttcccaagtaactgagat

SEQ ID NO: 135151 - DNA, 601 bp, Human
caaaaacaaacaaacaaacaaacaaaaaaaccattagccaggcaaggtggtgcatgtctgttagtcccagcttctcgagaagctgaggtgggagaatcgcctgagcccagggagtcaaggctaccgtgagtcgtgatcatgccactgcattccagcctgggcaaaagagcgagaccttgtctcaaaaaacctaaaatccaaatgagttttgtgagtttttggctttgttgttgtcttgtgacagagtggtctggctctgtcacccaggcgggagtgcagacctcagctgagtgcaacctcyacctcccaggctgaagccatcctcttacctcagcctcctgagtagctgggcctacaggcacgcatcaccacgcccaactaattttttgtagtaatgggatttcgccatgttgcccaagccagtctcgaattcctgagctcaagttatccatctgccttggcctcccaaagtgctagtattacaggcgtgagccaccacgcctggccttggctttgttttttgagacaggagactccctatgtggcccaggctcatcttaaactcctgggtccagcgatcctctcaccttagtctcctgag

SEQ ID NO: 135152 - DNA, 601 bp, Human
cgtggtggtgggcacctgtagtcccagctgctagggaggctgaggcaggagaatggcatgaacccaggaggcagagcttgcggtgagccgagatcgcgccactgcactccagcctgggcgacagagcgggactctgtctcaaaaaaaaaaaaaaaattagccaggcatagtggtgcatgcctgcagttgcagctacttgggaggctgaggtgagagatcgcttgagcctaggagtttgtgagtacactgagccatgatcgtgtcaacgcactccagcctgggggaccgagcaagaccttgwctcttaaaaaaagaaaaaataaatgtttgaaaaaaaatgactgggcacagtggtttacgtctgtaatcccagcactttgggaggccaaggcaggaggactgattgaggccagtagttcaagaccagcctgggcaataaagtgagacccaatctcctaaaaaaacaaaaaacaagccgggcacgtggctcacacctgtaatcccagcactttgggaggccgaggcgggtggatcatgaggacaggagagcgagacttcgtctcaaaaacaaacaaacaaacaaacaaaaaaaccattagcc

SEQ ID NO: 135153 - DNA, 601 bp, Human
aaaaattagctgggcgtggtggtgggcacctgtagtcccagctgctagggaggctgaggcaggagaatggcatgaacccaggaggcagagcttgcggtgagccgagatcgcgccactgcactccagcctgggcgacagagcgggactctgtctcaaaaaaaaaaaaaaaattagccaggcatagtggtgcatgcctgcagttgcagctacttgggaggctgaggtgagagatcgcttgagcctaggagtttgtgagtacactgagccatgatcgtgtcaacgcactccagcctgggggacygagcaagaccttgactcttaaaaaaagaaaaaataaatgtttgaaaaaaaatgactgggcacagtggtttacgtctgtaatcccagcactttgggaggccaaggcaggaggactgattgaggccagtagttcaagaccagcctgggcaataaagtgagacccaatctcctaaaaaaacaaaaaacaagccgggcacgtggctcacacctgtaatcccagcactttgggaggccgaggcgggtggatcatgaggacaggagagcgagacttcgtctcaaaaacaaacaaacaaacaaacaa

SEQ ID NO: 135154 - DNA, 601 bp, Human
acacactgaggatccagagaaagaacatattacaaacgcttaaaattcctaagacacgagtgtgtatggtggccctacataccatagttcagaatggatttattctatgctgagattctaaaactcaaggaaaataaatgaacacagtcaaacaaaacgagtaaattcaaacaagagtcaaagtttctttaaaaaaaaaaaaatgagtcagggttttgctgtgtcacgcaggctggagtgcagtggcatgatcatagctaactgcagcctcagcctcaagcaagcctcccacccagcctcmcgaatagcttcaaatacaggcacacgccaccacgcccggctaatttttgtattttttgtagagatggggtttcaccacgttgcccagactggtgaactcccgggattgttaggatttcggcttccccaagttttgggatcataggtgtgggacaccacgacggagtctcgctctgtcccccaggctggcgtgcagtggcacaatctcgactcagtgcaagcttcgcctcccgggttcacgtcattctcctgcctcagcctcccgagtagctgggactacaggcacccgccaccatgcctg

SEQ ID NO: 135155 - DNA, 601 bp, Human
taggctgatcaggacgtgctctcatacttgatcaacgacgggggctttcactgcattctccaaatatgttctgtcgctaccccatttacagagcagtgtaagcctcaaggttctgttgcatgtttttttttttttgagaccaaatctcactgtgtcgcccaggctggagtgtagtggcgtgatctctgctcactgcaacctctgcctcccgggttcaagcgattctcccgtctcagcctcctgagtagctaggattacaggctcccaccaccatgacaagctaatttttttttttttttttgtatttttagtagagacggggtttcaccatgttggccaggctggtctcaaactcctgatctcaggtgatccacccacctcagcctcccaaagtgctgggattacaggtgtgagctactgcgcctggcctgcatctacttttcaacctcaggaaatgtagcaagctcttgtttttcatgggtccctgctgctgttcagaaggtggagagagcttgtgtctgcactgagctcacacattttttctcttcacatctagaatgtataattccgaagaagaaaaactatctcttgttgtggtttt

SEQ ID NO: 135156 - DNA, 601 bp, Human
tgcctcatacacatttagtcaagatttaatcagcaaaaaaaactctagaaaaaataaccccttctcttcacagcacaccaacatcacatttggaagctgaaacatcccctgggaagaaagatgcccatcactacagccccagggaaggatgaggaggccaggagactaggctgatcaggacgtgctctcatacttgatcaacgacgggggctttcactgcattctccaaatatgttctgtcgctaccccatttacagagcagtgtaagcctcaaggttctgttgcatgtttttttttttttgagaccaaatctcactgtgtcgcccaggctggagtgtagtggcgtgatctctgctcactgcaacctctgcctcccgggttcaagcgattctcccgtctcagcctcctgagtagctaggattacaggctcccaccaccatgacaagctaatttttttttttttttttgtatttttagtagagacggggtttcaccatgttggccaggctggtctcaaactcctgatctcaggtgatccacccacctcagcctcccaaagtgctgggattacaggtgtgagctactgcgcctggcctgcatc

SEQ ID NO: 135157 - DNA, 601 bp, Human
ggaattacaggcgcccaccaccacgcctggctaatttttgtatttttagtacagacagggtttcatcatatcggtcaggctggtctcaaactcctgatctcaggtgatctgcctgcctcagccttccaaagtgctgagattacaggcgtgagccaccgcacccagcatgtatggtttttttttttttttttttttagatcacctggctaatttttaaaaacattttttgtagagaccggatctcaccatgttgcccaggctggtttcaaacacctggactcaagcgatcctcccacctcakcctccgaaagtgctgggattacaggcgtaagtcacagcacctggccaaacatcagcctgttgtttttgcagctttattggaacacagcaagctcatctgttgttttatctatgatttccttcttgctacaatggcagagttgggacacagaatttaaggccctcaaaaacctttacagaaaaggtttgcagacccctgatctaagtaacaggtagtgtatctagggcccatcgacagtctttcaaattgatggaaacaaatgaggacaattcagccttaacaattcacctgcatcagaga

SEQ ID NO: 135158 - DNA, 601 bp, Human
ctacacaggggacatcacagaactggttttctttgctggcgcaaacccaggtgactgcttttctaggtccctactaccaaccagcagcacatcactgactgctaacatgccttgatccagacttgctttcagtgagctcagggcaggaagcacacacaaattcatacacacaaaaccagggaagagcaagtacagagaggcagcacaggagccttctcttccaacctcctaggctcaagcagttttcctacctcagcctcccaagcagctgagaccacaggtgcacaccaccacgcctggmtttttttttttttttttttgagatggagtttcactcttgttgcccaggctgaagtgctatggcacgatctcagctcactgaaatctctgcctcccgggttcaagtgattctcctgtcttagcctcccgagtagctggaattacaggcgcccaccaccacgcctggctaatttttgtatttttagtacagacagggtttcatcatatcggtcaggctggtctcaaactcctgatctcaggtgatctgcctgcctcagccttccaaagtgctgagattacaggcgtgagccaccgcacccag

SEQ ID NO: 135159 - DNA, 601 bp, Human
ccaatgaacaacaaagacttcatacaggacttgaagtactacaaggtagttaacctttctttccaagagggagacctcactacagcaaagagactgatgagtctcaccacagaggaactgttttactgtccaggctggtcctcagcctcctcatcctgtaacacattcttaggagcttcttacagctctgtgggatgggatttgagactgcactctgaatgtttaagaataaagacaacataggccaggcagggtggctcatgcctataatcccagcactttgggaggctgaggcaggcgsatcgcttgaggccaggagtttgagactagcctggccaatgtggcgaaatcccatctctactaaaaataaaaaaattagccaggcgtggtggtggatgcctgtaatcccagctacccgggaggttgaggcacgagaatcacttgaacccaggaggcagagtgagatcacgccactgtactccagcctgggtgacagagtgagaccttgtcttaaaaaaaaaaaaaaaaaaaggccaggcgcggtggctcacgcctgtaatcccagcactttgggaggcgaaggcaggtggatcacgaggtc

SEQ ID NO: 135160 - DNA, 601 bp, Human
atttcaaaattcaagttataaataggaaagaaaaatcctaatatgaattaccaatgaacaacaaagacttcatacaggacttgaagtactacaaggtagttaacctttctttccaagagggagacctcactacagcaaagagactgatgagtctcaccacagaggaactgttttactgtccaggctggtcctcagcctcctcatcctgtaacacattcttaggagcttcttacagctctgtgggatgggatttgagactgcactctgaatgtttaagaataaagacaacataggccaggcrgggtggctcatgcctataatcccagcactttgggaggctgaggcaggcgcatcgcttgaggccaggagtttgagactagcctggccaatgtggcgaaatcccatctctactaaaaataaaaaaattagccaggcgtggtggtggatgcctgtaatcccagctacccgggaggttgaggcacgagaatcacttgaacccaggaggcagagtgagatcacgccactgtactccagcctgggtgacagagtgagaccttgtcttaaaaaaaaaaaaaaaaaaaggccaggcgcggtggctcac

SEQ ID NO: 135161 - DNA, 601 bp, Human
taattcactaaagcataattcccaaagatcagatcagggaaggtgaggggtatcataccggggcggtggctcacgcctgtaatctcagcactttgggaggcagaggggagtgggtcacgaggtcaggagatcgagaccatcctggctaacacagtgaaaccccatctctactaaaaatacaaaagaaaaaaaaaagaaacttggtgtactagttttttttgaggcagagtctcactctgtcgcctagcctggactgcagtagcgcaatcatagctcactccagccttgacctcccaggctsaagccatcctcccatctcagtcactagagtatctgggactacaggcatgtgcaccacacttggctaattcttgtaatgatgggtttcaccatgttgaccagactagggtgtactacttcaaatacaaaggtgaaaccgagtgcttgccccagaactgttacaatctgacaatacaaaggaatgtactaatcagtgaatgtagtaataacagtagttctaacactactgatttcaaaattcaagttataaataggaaagaaaaatcctaatatgaattaccaatgaacaacaaagacttca

SEQ ID NO: 135162 - DNA, 601 bp, Human
ccaattcagaaacaaagtcagaactgtgcttccacctgttaattcactaaagcataattcccaaagatcagatcagggaaggtgaggggtatcataccggggcggtggctcacgcctgtaatctcagcactttgggaggcagaggggagtgggtcacgaggtcaggagatcgagaccatcctggctaacacagtgaaaccccatctctactaaaaatacaaaagaaaaaaaaaagaaacttggtgtactagttttttttgaggcagagtctcactctgtcgcctagcctggactgcagtarcgcaatcatagctcactccagccttgacctcccaggctcaagccatcctcccatctcagtcactagagtatctgggactacaggcatgtgcaccacacttggctaattcttgtaatgatgggtttcaccatgttgaccagactagggtgtactacttcaaatacaaaggtgaaaccgagtgcttgccccagaactgttacaatctgacaatacaaaggaatgtactaatcagtgaatgtagtaataacagtagttctaacactactgatttcaaaattcaagttataaataggaaagaaa

SEQ ID NO: 135163 - DNA, 504 bp, Human
cctccacctcccgggttcaagtgattctcctgcctcagcctcccacgtagttgggattacaggcgtgtgcccccacgcctggctaattttgtctttttcatagaaatggagtttcaaaatgttagtcaggctggtctcgaattcctgacctcaggtgaagagttcacccacctcgacctcccaaagtgctgggattacaggcgtgaaccactgtacctgggctcattctgattattagtattattttttgagacagagtctcgctctgtcgcccaggctggagtgcagtggctgcgatctyggctcactgcaagctccgcctcccgggttcacgccattctcctgcctcagcctcccgagtacctgggactgcagatgcccgccaccacgtccggctaattttttgtattttttttttttttagtagagatgggatttcacagtattagccaggatggtctccatttcctgacctcgtgatccgcccgcctggcctcccaaagt

SEQ ID NO: 135164 - DNA, 510 bp, Human
ctgcaacctccacctcccgggttcaagtgattctcctgcctcagcctcccacgtagttgggattacaggcgtgtgcccccacgcctggctaattttgtctttttcatagaaatggagtttcaaaatgttagtcaggctggtctcgaattcctgacctcaggtgaagagttcacccacctcgacctcccaaagtgctgggattacaggcgtgaaccactgtacctgggctcattctgattattagtattattttttgagacagagtctcgctctgtcgcccaggctggagtgcagtggctgygatctcggctcactgcaagctccgcctcccgggttcacgccattctcctgcctcagcctcccgagtacctgggactgcagatgcccgccaccacgtccggctaattttttgtattttttttttttttagtagagatgggatttcacagtattagccaggatggtctccatttcctgacctcgtgatccgcccgcctggcctcccaaagt

SEQ ID NO: 135165 - DNA, 601 bp, Human
atatacggagatgagataatggctatgccataactcaaatgatttttttttttttttaaagacagagtttcgcttttgttgcccaggctggagtgcagtggcacaatctcagctcactgcaacctccacctcccgggttcaagtgattctcctgcctcagcctcccacgtagttgggattacaggcgtgtgcccccacgcctggctaattttgtctttttcatagaaatggagtttcaaaatgttagtcaggctggtctcgaattcctgacctcaggtgaagagttcacccacctcgaccycccaaagtgctgggattacaggcgtgaaccactgtacctgggctcattctgattattagtattattttttgagacagagtctcgctctgtcgcccaggctggagtgcagtggctgcgatctcggctcactgcaagctccgcctcccgggttcacgccattctcctgcctcagcctcccgagtacctgggactgcagatgcccgccaccacgtccggctaattttttgtattttttttttttttagtagagatgggatttcacagtattagccaggatggtctccatttcctgacctcgtg

SEQ ID NO: 135166 - DNA, 601 bp, Human
ttctacaaaattaaaagtacaacattagccaggtacagtggaatgtgcctgtagtcccagctacttgggaggctgaggtagggggatcacaagcccaggagtttggggctgcagtgagctacaactgggcacccttgcttggggaacagagcaaagcctgatctcaaaaaaaaaaaagagaaaaacaaccaaaaacacgaatcttttctttacagatgattaggtttttggcagacaggttcaaatatacggagatgagataatggctatgccataactcaaatgatttttttttttttttaaagacagagtttcgcttttgttgcccaggctggagtgcagtggcacaatctcagctcactgcaacctccacctcccgggttcaagtgattctcctgcctcagcctcccacgtagttgggattacaggcgtgtgcccccacgcctggctaattttgtctttttcatagaaatggagtttcaaaatgttagtcaggctggtctcgaattcctgacctcaggtgaagagttcacccacctcgacctcccaaagtgctgggattacaggcgtgaaccactgtacctgggctcattctgattat

SEQ ID NO: 135167 - DNA, 601 bp, Human
tccaactcctgacctcaggtgatccgcccaccttggcctcccaaagtgctgggattacaggtgtgagccaccgtgcccagccagattctcttggatctaccctgcagaggaaaaccatgccaaaatctaaaacttttttttttacaccgggtacgctggcctgcacctgtagtcccagctacttgggagactgaggggagaggaacccttgagtccagggtttttttttctttttgagacactgtattgatctctcacccaggctggagtgcagtggcacaatcttgtctcattgcaaacyccgcctcctggagtcttgtgccttaggctcccaaggacctgggattataggcgcccgccaccatgctcagttaatttttgtatttttagtggagaccaggtttcaccacattggacagtctggtatgcaactcctgacttcaagtgatttgcccaactcggcctcccaaagtgctgggattataggcatgggccaccttgcccagctgagcccaggagtttgaggccttcctcagcagcacagtgaaactctgtctctcttaaaaaaaaaaaaagaggccagacgcagtggctcacacct

SEQ ID NO: 135168 - DNA, 601 bp, Human
cctttggaccatatcagatcttttttttttttttttttttgagacagcgtctcactctgttgccctggctagagtacagtggcatgatctcagctcactgcaacctctgcctcccaggttcaagtgattctcctgcctcagcctcctgagtagctgggactacaggcatgtgccaccacgccctgctaatttttgtatttatagtagagatggggtttcaccatattggccaggctggtcttgaactcctgacctcgtgatctgctcacctcagcctcccaaagtgctgggattacaggcrtgagccaccacgcccggctcagaactatctttaatgtacagattctctctcttttttttttagatggagcctcactcttgtcacccaggctggagtccagtggcgcaatctcagctcactgcaacctccgcctcctgggttcaagcgattctcctgcctcagcctcctgagtagctgggattactggcgcacgccaccacgtccggctaattttttcgcatttttagtagagatggggtttcaccatgttggccaggctggtctccaactcctgacctcaggtgatccgcccaccttggc

SEQ ID NO: 135169 - DNA, 601 bp, Human
tgctgggcaggcttgtctcgaactcctgacctcatgacccgcccacctcggcttcccaaagtgctggaattacaggcatcagccaccgcgcccagcctatattgtctttattcttaagcattcatactgcagtctcaaatcacatcccacaaagctctaagaggtgaagggtaggttgaaaagtggaccagccccaccccttgctgttaacacagaaccataccaatttctcaaaatgtggggcaaaacctgctgatgtgcctccagatcttttctttcagactttttttttttttttttwaatggagtttttgctcttgtcacccaggctggagtgcagtggtacgatgctggctcactgcaacctccgcctccaggattcaaatgattctcctgcctcagcctcccgagtagctgggactacaggcgcccgccaccacgcccagctgatttttgtatttttagtagagatggggtttcaccatggtgggcaggatggtctcgatctcctgacttcgtgatctgcctacctcggcctcccaatgtgctgggattacaggtgtgagccaccgtgccagcccttctttcagacttctaaggg

SEQ ID NO: 135170 - DNA, 601 bp, Human
ggcgaggtaggaggatcacttgagctcaggagttcaagaccagcctgggcaccatagtgaaacctcatttctacaaaaaataaaaaaattggctgggcgtggtggcgcacgcctataatctcagcactttgggaggtcgaggtgagtgaatcacgacgtcaggagttcaagaccagcctggccaaattggtgaaaccccgtctctactaaaatacaaaaattagccaggtgtggtggcaggcgcctgtaatcccagctacttgcgaggctgaggcagtgaactgcttgaacctgggaagasgaggttgcagtgagccgagactgtgccactgcactccagcctggccaacagagttacactctgtctcaaaaaataaaataaataaataaattagccaggcatagtagtgtgcgcctgtggtcccagctactcaagaggctgacatgggaggatcacttgagcccgggaggcagagattgcagtgagccaagatagtaccagtgcactccagcctgggcgacagagcaaaactgtctccaaaaaaaaaaaaaaaaaaaaaggattctgacatgccccagccaggctaggcaacaatagcaa

SEQ ID NO: 135171 - DNA, 601 bp, Human
agccccagccaccagactgattacttgtggttaatgcaggcagaaggaaaagtgtttttagcagtgtggaaaaacagagaatacagaaagtaaaagggattccagataatgatactttttgattaaaaaaggaaagtgataattattggaaatctcagctgtctctgcatgagcaatcccaacttcagtgagttagctactattccctttctttgtactcactaccctcagctttctgcctgctccgcaggccctgtccgaggagaagcagctttctccgtttttttttttttttttttttgagacggagtctctgtcacccaggctggatgacagtggcgtgatctcagctcactgcaagctctgcctcccaggttcgagcaattttcctgccacagcctcccgagtagctgggactacaggcgcctgccaccgtgcccagctaatttttgtatttttagtagagatggagtttcaccatcttggccaggctggtctcgaactcctgaccttgtgatccacctgccttggcctcccaaagtgcttggattacaggcgtgagccactgtgcctggccgccttctccccgctttagcatatg

SEQ ID NO: 135172 - DNA, 601 bp, Human
gaacatggagagtaagagtcagcctactgatatctctggaacagaagtctgcgcagggcccctggggcaccttacctcttcttttgagccttagggggccgatgcttcagggcattcagcacatagtacttaagcagcttctggtaggagaccctcactttcacaggctgcccggcaggacaatgctcccgatacctggaaaaataagcccaccagagtttggccatctcttcttccagacactctgctaaaggctgcaagccttgggttgtctaccatttttatgggaaaaaaaaaaaaagaatttaaaaaaaaggctacatgcccacctagttggagtcttttctcctacacatccactatcattccccctgccacagggaaaaaccttaccagttcttgacaaggggtatgtccagggcccgacgggtgcgaccagagcgtaggttgaagggccgcggggcccagagcagggcaatgccattggctgtattgtctgtatagaggggtgtgtccttcaggaagggctccacaaactccgggagctcaaattcctcatcatcatccggcaatggttcctggctctgaaaaaggaatccct

SEQ ID NO: 135173 - DNA, 601 bp, Human
tcacaactatgcttctgaggaatttccactcctgcaaatgcatgactgcctctcaaggccccagaaggaagcccaagaaatagaatactaggtcagactcatttcagaactggacctaaaggcaatccagtaggaagagtgctcatacaagagcagggaacagactcaaacaggggcaggtacttttgaagcaataacaggagaagttggacacagagaaaaccactcaccttcaaactgccgggccaggaggttgccaagccatcgctctaataaaggggtaatgccacgcatgaaaaasagccagactcgccaaccggcagcccagaagccacagccaggacccttccctacagggccctacgatcccaagcagaagttaagaatacaagttagcaatgcatttaaacaacaatagaaacctgggcagaggtggggcatatatgtataatatacatacagaggaatgtaggtatggcagtagaggggtaaaaagaaaaaaaaactctgggacctcaacatctaaaacaaaagggtaaatgagaaaccttaaggcaaaaaccaggaactaagatcgcccatgtgaatttaaaggagcagt

SEQ ID NO: 135174 - DNA, 601 bp, Human
gagtagcaaggcaggtctccagcaggttagaaatcctcttgcaagactagccccacaggaactatcattaccttccataaccaatcccactatgattccacgtattcatttggattgctttgactatgggcttttcctcagtttaacacgaacactacttccctttactaccacgcatcaagagagtaaaccaatcatgctacccagatgagatttttgacgtagaactaaattcctgccccgttcctcacagggcgatctcatgaaagttctaccttgacaccacttgtaaacaagcagyggaggtggttctgtgtctgcaggcttaatccagggtgggaacaggcggcgcttgtcggcttcataccacaggtactggtccaggtaagcatcagttatcttctccaggggctcaacatcatatactggaacgaggtggctatacagatccatgaactcaatgcccacctgtgggacaaggaggctggttcacaccaatccaccaactgctacctttggtagaaccaaaggcaactgctacctttggtagaaccaaaaagaaaacttgggaggcctcactcacctctttgaaggctctctg

SEQ ID NO: 135175 - DNA, 601 bp, Human
tcaagtcgatcttctcatacatcttctcaaagcgggattccagcatgacattgcactcgccttcactcgtctcccacacgtcctgcaggttattgatgcctgaggagtagcaaggcaggtctccagcaggttagaaatcctcttgcaagactagccccacaggaactatcattaccttccataaccaatcccactatgattccacgtattcatttggattgctttgactatgggcttttcctcagtttaacacgaacactacttccctttactaccacgcatcaagagagtaaaccaatcrtgctacccagatgagatttttgacgtagaactaaattcctgccccgttcctcacagggcgatctcatgaaagttctaccttgacaccacttgtaaacaagcagcggaggtggttctgtgtctgcaggcttaatccagggtgggaacaggcggcgcttgtcggcttcataccacaggtactggtccaggtaagcatcagttatcttctccaggggctcaacatcatatactggaacgaggtggctatacagatccatgaactcaatgcccacctgtgggacaaggaggctggttcacacca

SEQ ID NO: 135176 - DNA, 601 bp, Human
tatagttgatgacgacgttgttcttggctgtcatgtagtcggctatgttgtggtccacgatgaggcgcagcagcctgttgagcagagtcaagtcgatcttctcatacatcttctcaaagcgggattccagcatgacattgcactcgccttcactcgtctcccacacgtcctgcaggttattgatgcctgaggagtagcaaggcaggtctccagcaggttagaaatcctcttgcaagactagccccacaggaactatcattaccttccataaccaatcccactatgattccacgtattcatytggattgctttgactatgggcttttcctcagtttaacacgaacactacttccctttactaccacgcatcaagagagtaaaccaatcatgctacccagatgagatttttgacgtagaactaaattcctgccccgttcctcacagggcgatctcatgaaagttctaccttgacaccacttgtaaacaagcagcggaggtggttctgtgtctgcaggcttaatccagggtgggaacaggcggcgcttgtcggcttcataccacaggtactggtccaggtaagcatcagttatcttctccaggg

SEQ ID NO: 135177 - DNA, 601 bp, Human
catcaccaggccataatactgcacgatgaatgaggcaaactgcaggcctctgatgatcccatatgaattcgtatggttcatgtcctagaaagaaagaactacaattcttaagaatgtgagccatgccccaggattctccagagttaacctcttttgttctcccctcagcaaattctacttttttccactcccgaggcggagttgtgctcagtcacccaggctgagagtgcactggcgcaatctcagctcactgcaacctccacttcccgggttcaagtgattctcctgcctcagcctcccragtagctgggattacaggcgcccaccaccacacccaactaatttttgtatttttttaagtagagacggggtttcaccatgttggccagactggtctcgaactcctgacctcgtgatctgcccgcctcagcctcccaaagtgctgggattacaggcatgagccaccgcacccagcctcctcctcagcaaattctgagtcagtgggccagacaagcactccacacacaattccatgctactgcgcctgagacgcaccttatagttgatgacgacgttgttcttggctgtcatgtagtcggct

SEQ ID NO: 135178 - DNA, 601 bp, Human
aaagtcatttggcatctgagggggcccagccatctcactggcccggtgcaatcccaatacaagcaaatccatcaccaggccataatactgcacgatgaatgaggcaaactgcaggcctctgatgatcccatatgaattcgtatggttcatgtcctagaaagaaagaactacaattcttaagaatgtgagccatgccccaggattctccagagttaacctcttttgttctcccctcagcaaattctacttttttccactcccgaggcggagttgtgctcagtcacccaggctgagagtgcastggcgcaatctcagctcactgcaacctccacttcccgggttcaagtgattctcctgcctcagcctcccaagtagctgggattacaggcgcccaccaccacacccaactaatttttgtatttttttaagtagagacggggtttcaccatgttggccagactggtctcgaactcctgacctcgtgatctgcccgcctcagcctcccaaagtgctgggattacaggcatgagccaccgcacccagcctcctcctcagcaaattctgagtcagtgggccagacaagcactccacacacaattcc

SEQ ID NO: 135179 - DNA, 601 bp, Human
tcacctgaaaaaaatatggatgcgatcaatgtatctgcagaagagacggatggggtgggcagcctcagtggctatgtcctggaaactgagaaagtcatttggcatctgagggggcccagccatctcactggcccggtgcaatcccaatacaagcaaatccatcaccaggccataatactgcacgatgaatgaggcaaactgcaggcctctgatgatcccatatgaattcgtatggttcatgtcctagaaagaaagaactacaattcttaagaatgtgagccatgccccaggattctccagrgttaacctcttttgttctcccctcagcaaattctacttttttccactcccgaggcggagttgtgctcagtcacccaggctgagagtgcactggcgcaatctcagctcactgcaacctccacttcccgggttcaagtgattctcctgcctcagcctcccaagtagctgggattacaggcgcccaccaccacacccaactaatttttgtatttttttaagtagagacggggtttcaccatgttggccagactggtctcgaactcctgacctcgtgatctgcccgcctcagcctcccaaagtg

SEQ ID NO: 135180 - DNA, 601 bp, Human
aagcacatgcctcagtaccctgcaaggctaggaatccaggaaagccctcacctgaaaaaaatatggatgcgatcaatgtatctgcagaagagacggatggggtgggcagcctcagtggctatgtcctggaaactgagaaagtcatttggcatctgagggggcccagccatctcactggcccggtgcaatcccaatacaagcaaatccatcaccaggccataatactgcacgatgaatgaggcaaactgcaggcctctgatgatcccatatgaattcgtatggttcatgtcctagaaagaamgaactacaattcttaagaatgtgagccatgccccaggattctccagagttaacctcttttgttctcccctcagcaaattctacttttttccactcccgaggcggagttgtgctcagtcacccaggctgagagtgcactggcgcaatctcagctcactgcaacctccacttcccgggttcaagtgattctcctgcctcagcctcccaagtagctgggattacaggcgcccaccaccacacccaactaatttttgtatttttttaagtagagacggggtttcaccatgttggccagactggt

SEQ ID NO: 135181 - DNA, 601 bp, Human
acactaagcaaagaagagaaggaagcagccagcaggggacgaagtgaaaggggtgtgaaatgagcagaggacagcagaggacaagagggaagctgggcatgacggccctgtaccttggtgaaggtggtggacccagaggccatgagaatctgacgcacgcggttgtggaagcgctgcattgactcatcgtccacacgcaggaaacactgagctgtgcgctccttagtaacctaaaccacaaagtcaaggttaacatgtccgaggaactcccacagaagcaagagccaactgtgcccaccaytcaagtctttccacccaacaagactccggtgactgacccaggaagtgcaggcgcgttcatgtcactcccagccccgcccaggctgtacctcattctgcaggttccagaccccgtccttgtgggtgaactcctcatagctggtgcggcacttaggcaggatgcggcactcgaagccacacatgttgaacagcaggttggggttgtccttactgtacacagacacgaagctgttctcccactgaactgtagtcactgaccgtggcaagcggttcttgatgtcccagaataccgcccggcctc

SEQ ID NO: 135182 - DNA, 601 bp, Human
cacctgagaaaatgcaaaaataatgcttttctgttcaaaataataaatccaacttttactcttgccttaatttagaatcatcacaagtccacaagaaggaggctacacaatttctacaaggaacgctcagaaaataacgatgaagtgacctgacatactataagccactatggcacagagcatggaaactggcacactaagcaaagaagagaaggaagcagccagcaggggacgaagtgaaaggggtgtgaaatgagcagaggacagcagaggacaagagggaagctgggcatgacggccytgtaccttggtgaaggtggtggacccagaggccatgagaatctgacgcacgcggttgtggaagcgctgcattgactcatcgtccacacgcaggaaacactgagctgtgcgctccttagtaacctaaaccacaaagtcaaggttaacatgtccgaggaactcccacagaagcaagagccaactgtgcccaccactcaagtctttccacccaacaagactccggtgactgacccaggaagtgcaggcgcgttcatgtcactcccagccccgcccaggctgtacctcattctgcaggttccag

SEQ ID NO: 135183 - DNA, 601 bp, Human
taattttcatattttaagtagagatggggtttccccatgttggtcaggctggtctcaaactcctgacctcaggtgatccacctgcctgggcctcccaaagtgctgggattacaggcgtgagcccccgcgcctggcctgctctcatcatttttatctggacttcttcagtggtccccaaacctggtctcccatcctatcctttcaggtccatctttctcacagctgcaagagtgaatcatctaacacagaaatttgacaaagtctgcatctgtagtgtgggaagccaaaaaaaaaaaagaaaaaaaacacatctgacaaagtcactctgtgcttaagacccttatatgattcttcctaaggtgtgcgatgccctccatgatatggctctccactatttatccagcctcatctcttaacattcccaattccacaatttactccagcaaaccttgaactttccatggtcccatgtacacaagctagttacatcgccacacttctggctaaaggaatgctctccctcacctgtctcatcacatgctacttctttcaggaatcctttcctcttccacttccagactgggctagagcaatcactaac

SEQ ID NO: 135184 - DNA, 601 bp, Human
atattagccgggtgtggtggtgggcacctgtagtcccagctacttgggagctgaagcaggagaatggcgtgaacccgggagacggagcttgcagtgagcagagatcgcgccactgcactccaacctgagtgacagggcgagactctgtctcaaaaaaaaaaaaagagaaaggtccaaaattgataatctaaccttttaccttaacaaactagcaaagggatggcaatgataagagaagaaatcaatgcaacaaggccaggcgtggtggctcacacctacaatcccagcactttgggagccsaggggggtggattacctgagctcaggaattcaagaccagcctgggcaacatggcgaaactgtctgtatccaaaatacaaagaaaaatcagccaggcatggtggcatgtgcctgtggtcccagctacttgggaggctaaggtgggagggtctcctgagcctgggaggcagaggttacagtgagctgagactgcgacactgcacaccaacctgggtcatagagaccccatctcaaaaaaaaaaaaaatcaatgcaacaaaaaagagaaaaacgataaaaattaatgaaaccaaagctgtttc

SEQ ID NO: 135185 - DNA, 601 bp, Human
aaagaaaaaaaaaagcacaccagatggagctatacaaactagtgaagaacaccagaaatggtaagtatgtgggtaaaatgcaaaaaaatattttttctcattttgcaatttctacaaaagataaaggctgttcaaagcaaaaagagtaacaaagtattatagcacttataatacatgtacaattaaaatgttatgacaaaaatactactaagagtgggagtggaacttaaagtgtattattctaaggttcttgtactatatgtgaagtgatccgtagtagactaatggtcaaagtagatcmcagtaagtgagctatgtatatactgtaaaccttagagcaaacaataagaaaaaaaccatgtagccaaataagtgaaaagtggagataaagtcacaaaacaactaaattcagaagaaggcaggacaagagaaaagcagaaaaaataatttaaaaaaaaaagagtaagacggtagatttaaactgagctacattgccacattgatagttacattaaccttaattgaggtatttagaccatttgtaaggcaaacattgtcaaattggatttaaataaaaaggccgggcatggtggctcacacc

SEQ ID NO: 135186 - DNA, 601 bp, Human
tgggactacaggtgcatcccagcacactcggctaattttgttgtatttttagtagagatggggtctcgtcatgttggccagcctgatctcaaactcctgacctcaggtgattcacccaactcagcctcccaaagtgctgggattacgggcgtgagccaccacgcccggccccaagagttgatttttaactttaaggtcttaaactctcatgaaagtcaacagagttcccacccaatctataggctaaaaatgtgaaaatggcaaaaacctgacacaggatcttctcctaaccctaaacccrctcctcctccagcgatcttctcttcccgaggttcataccgtgtaagatgaaatagtcttgagccagtcgtcatagaggttgaagagaaccatctggggctcagtggctttaaggatgagatccccgaatttttccaccttgagacacgcctggaaagggagttggagctccgatcctttgatgacaatattggggaagtccagtaagtgcacctaagacaagatcaagtccaagatgagaaacagcctgaaggtctcaaggtctcttttctcctaccccaccccaccctcttacctccag

SEQ ID NO: 135187 - DNA, 601 bp, Human
agctgggatgacaggcacctgccaccacgcccggctaattttttgtatttttagtagagatggggtttcactgtgttagccaggatggtctcaatctcctgacctcgtgatccgccgcctcggcctcccaaagtgctgggattacaggcgtgagccactgcgcccggcctttttttttttttttttagacagtcttactctgtcgcccaggctggagtgcaatggtgccatctcggctcactgcaacctctgcctcctgggttccagtgattctggtgcctcagcctcccgagtagctggractacaggtgcatcccagcacactcggctaattttgttgtatttttagtagagatggggtctcgtcatgttggccagcctgatctcaaactcctgacctcaggtgattcacccaactcagcctcccaaagtgctgggattacgggcgtgagccaccacgcccggccccaagagttgatttttaactttaaggtcttaaactctcatgaaagtcaacagagttcccacccaatctataggctaaaaatgtgaaaatggcaaaaacctgacacaggatcttctcctaaccctaaacccgctc

SEQ ID NO: 135188 - DNA, 601 bp, Human
actcctgggctcaaaagatctgcccacctcggcctcccacagtgctgggattacagtcatgagccactgtgcccagcctggagtgcagtggggtcatcaaagctcactgcttgcgttcaagcaacctcatcctcctgagtagctgggactacagccacgttttttttggttttgtttttttagacggggtcttgctctgttgcccaggctggagtgcagtgatgcaatcttggctcactgcaagctccacctcacctcccgggttcaagcaattctcctgtctcaacctccctagtagctrcaactacgggcgcatgccaccatgcctggctaattttttgtatttttagtagagacagggtttcaccatattggtcaggctggtctcaaacccctgacctcaggtgatccacccacctaggcctcccaaagtgctgggattataggcattagccactgtgcccagccgagtgttgggattacaggcatgagccagcacgcacacctggtcaggaatttgtttctgaccatatctgttctcttccaaatactatcaggccaatactacaattactaccttctctcagctgccacagctttt

SEQ ID NO: 135189 - DNA, 601 bp, Human; identical to SEQ ID NO: 20467

SEQ ID NO: 135190 - DNA, 601 bp, Human; identical to SEQ ID NO: 20468

SEQ ID NO: 135191 - DNA, 601 bp, Human; identical to SEQ ID NO: 20469

SEQ ID NO: 135192 - DNA, 601 bp, Human; identical to SEQ ID NO: 20470

SEQ ID NO: 135193 - DNA, 601 bp, Human; identical to SEQ ID NO: 20471

SEQ ID NO: 135194 - DNA, 601 bp, Human; identical to SEQ ID NO: 20472

SEQ ID NO: 135195 - DNA, 513 bp, Human
aaatggtctgaaaagatgcaggaggggctgggcgcggtggctcacgcctgtaatcccaacactttgggaggccgaggcgggcagatcatgaggtcaggagatggagtcccatcctggctaacacggtgaaacccccgtctctgctaaaaatacaaaaaaattagctgggcgtagtggcgggcacctgtagtcccagctactcgggaggctgasgcaggagaatggcgtgaacccgggaggcggtggagcttgcagtgagcggaggtcgtgccactgcactccagcctgggcgacagagcgagactccgtctaaaaaaaaaaaaagatccaggaggaggttcctaggagaattgcaggggttggggaaaacacaagcccagatttcaaaaatgctacgggaaagagacctcagatcaattggatgccagctagcattccctggggtcttggcctccaccgctgtctcatccttgaatggattctgggtgggacaggcaacgggctgggggtgca

SEQ ID NO: 135196 - DNA, 531 bp, Human
aaatggtctgaaaagatgcaggaggggctgggcgcggtggctcacgcctgtaatcccaacactttgggaggccgaggcgggcagatcatgaggtcaggagatggagtcccatcctggctaacacggtgaaacccccgtctctgctaaaaatacaaaaaaattagctgggcgtagtggcgggcacctgtagtcccagctactcgggaggctgacgcaggagaatggcgtgarcccgggaggcggtggagcttgcagtgagcggaggtcgtgccactgcactccagcctgggcgacagagcgagactccgtctaaaaaaaaaaaaagatccaggaggaggttcctaggagaattgcaggggttggggaaaacacaagcccagatttcaaaaatgctacgggaaagagacctcagatcaattggatgccagctagcattccctggggtcttggcctccaccgctgtctcatccttgaatggattctgggtgggacaggcaacgggctgggggtgcagagcccaagctggtcccc

SEQ ID NO: 135197 - DNA, 601 bp, Human
ggggctgggcgcggtggctcacgcctgtaatcccaacactttgggaggccgaggcgggcagatcatgaggtcaggagatggagtcccatcctggctaacacggtgaaacccccgtctctgctaaaaatacaaaaaaattagctgggcgtagtggcgggcacctgtagtcccagctactcgggaggctgacgcaggagaatggcgtgaacccgggaggcggtggagcttgcagtgagcggaggtcgtgccactgcactccagcctgggcgacagagcgagactccgtctaaaaaaaaaaaaagatccaggaggaggttcctaggagaattgcaggggttggggaaaacacaagcccagatttcaaaaatgctacgggaaagagacctcagatcaattggatgccagctagcattccctggggtcttggcctccaccgctgtctcatccttgaatggattctgggtgggacaggcaacgggctgggggtgcagagcccaagctggtccccatcgacgtgacccctgccctctgccccaagctggtccccgtcgacgtgacccctgccctctgctgggtttcaggtttctggaggaacaagttt

SEQ ID NO: 135198 - DNA, 601 bp, Human
catcctggctaacacggtgaaacccccgtctctgctaaaaatacaaaaaaattagctgggcgtagtggcgggcacctgtagtcccagctactcgggaggctgacgcaggagaatggcgtgaacccgggaggcggtggagcttgcagtgagcggaggtcgtgccactgcactccagcctgggcgacagagcgagactccgtctaaaaaaaaaaaaagatccaggaggaggttcctaggagaattgcaggggttggggaaaacacaagcccagatttcaaaaatgctacgggaaagagacctyagatcaattggatgccagctagcattccctggggtcttggcctccaccgctgtctcatccttgaatggattctgggtgggacaggcaacgggctgggggtgcagagcccaagctggtccccatcgacgtgacccctgccctctgccccaagctggtccccgtcgacgtgacccctgccctctgctgggtttcaggtttctggaggaacaagtttgacccgagccttacccagagagactccttccacctggacgagcagttcacggtgcccgtggaaatgatgcaggcccgcacgtaccc

SEQ ID NO: 135199 - DNA, 601 bp, Human
ccagctactcgggaggctgacgcaggagaatggcgtgaacccgggaggcggtggagcttgcagtgagcggaggtcgtgccactgcactccagcctgggcgacagagcgagactccgtctaaaaaaaaaaaaagatccaggaggaggttcctaggagaattgcaggggttggggaaaacacaagcccagatttcaaaaatgctacgggaaagagacctcagatcaattggatgccagctagcattccctggggtcttggcctccaccgctgtctcatccttgaatggattctgggtgggacrggcaacgggctgggggtgcagagcccaagctggtccccatcgacgtgacccctgccctctgccccaagctggtccccgtcgacgtgacccctgccctctgctgggtttcaggtttctggaggaacaagtttgacccgagccttacccagagagactccttccacctggacgagcagttcacggtgcccgtggaaatgatgcaggcccgcacgtacccgctgcgctggttcttgctggagcagcctgagatccaggtcacccttggttgtccagcaggctgggcctgaggctgggaggtgg

SEQ ID NO: 135200 - DNA, 601 bp, Human; identical to SEQ ID NO: 20473

SEQ ID NO: 135201 - DNA, 601 bp, Human; identical to SEQ ID NO: 20474

SEQ ID NO: 135202 - DNA, 601 bp, Human; identical to SEQ ID NO: 20475

SEQ ID NO: 135203 - DNA, 601 bp, Human; identical to SEQ ID NO: 20476

SEQ ID NO: 135204 - DNA, 601 bp, Human; identical to SEQ ID NO: 20477

SEQ ID NO: 135205 - DNA, 601 bp, Human; identical to SEQ ID NO: 20478

SEQ ID NO: 135206 - DNA, 601 bp, Human; identical to SEQ ID NO: 20479

SEQ ID NO: 135207 - DNA, 601 bp, Human; identical to SEQ ID NO: 20480

SEQ ID NO: 135208 - DNA, 601 bp, Human; identical to SEQ ID NO: 25321

SEQ ID NO: 135209 - DNA, 601 bp, Human; identical to SEQ ID NO: 25322

SEQ ID NO: 135210 - DNA, 601 bp, Human; identical to SEQ ID NO: 25323

SEQ ID NO: 135211 - DNA, 601 bp, Human; identical to SEQ ID NO: 25324

SEQ ID NO: 135212 - DNA, 601 bp, Human; identical to SEQ ID NO: 25325

SEQ ID NO: 135213 - DNA, 601 bp, Human; identical to SEQ ID NO: 25326

SEQ ID NO: 135214 - DNA, 601 bp, Human; identical to SEQ ID NO: 25327

SEQ ID NO: 135215 - DNA, 601 bp, Human; identical to SEQ ID NO: 25328

SEQ ID NO: 135216 - DNA, 601 bp, Human; identical to SEQ ID NO: 25329

SEQ ID NO: 135217 - DNA, 601 bp, Human
gagtccctggggcaggcgtgccctccgctcccacactgaggtgaggtttcggggctcacttgaaaaagtcgtccttgcagtaaacgctctcccctcggctgaagcagcgctcggccagtggcgtgtggcagtcgctgcacttgagacacttgctgtgccagtggcggtccagagccttgaggatgaagcggtccaggatgtgctggtcacagccagcgcacagcgggatctctgtgggcacgaggaagttctgggtcacctcgtagaccaggaggcagtgaagccaccttcccaccccaaygcgagccagtctcccctccggcccacaggactcagggctgccgaggggtcctcctttccctacacaccctcttccccagccagcttaagtggccccgcaagttccgggagtgtgcaggcaccgcatcctatgtcaggagctaaggggaaactgacatcggtctaaaaatgtgtgtgagcaagaaagcagcccaggccatttcacgaggctgaatactcaattacaaaatgttgccagtgccaagaagggtgcatgtggagctcaaatgaaaaccccaccccagggggatctgctctctga

SEQ ID NO: 135218 - DNA, 601 bp, Human
ggccaggccacagggtgccctgcctgggtgacaggagtgggctgggattgcgagagacgcaggcttcgagggcctggccttggtgattgtgaggggaggagtccctggggcaggcgtgccctccgctcccacactgaggtgaggtttcggggctcacttgaaaaagtcgtccttgcagtaaacgctctcccctcggctgaagcagcgctcggccagtggcgtgtggcagtcgctgcacttgagacacttgctgtgccagtggcggtccagagccttgaggatgaagcggtccaggatgtgytggtcacagccagcgcacagcgggatctctgtgggcacgaggaagttctgggtcacctcgtagaccaggaggcagtgaagccaccttcccaccccaacgcgagccagtctcccctccggcccacaggactcagggctgccgaggggtcctcctttccctacacaccctcttccccagccagcttaagtggccccgcaagttccgggagtgtgcaggcaccgcatcctatgtcaggagctaaggggaaactgacatcggtctaaaaatgtgtgtgagcaagaaagcagcccaggccatttc

SEQ ID NO: 135219 - DNA, 601 bp, Human
ccgtaggggctgccgggacgcagctctcggtactgctctgggcctgccaggcctccatgctccagggagaagttgcccagggctcccgagggccggcccaaggcctgggtgggttcccccaagctcccgtagaggccattggccgggcccatttccgccaaggaaggctcatctgcaacagaagcagaggctcagtcagcgcctgccctccacctgcggcccctcagagtcccatcctgcaggcggaggcacccctgggtcggagaaagagtggctgccccacaccacatgacaggtcatmacaggccccttctactgttggagcatggctgcccctgcccctccactgccctcacccctgagtcagcccaggtgtctcaggcctggtgggatcagagtcaggaacagcccagccagggcccaggctttcaggaccagccccacagcagcctaggaagggggcacagataccaccacccacattttgcagacaaggatatttagttccagagtggctgagtgagtagcccgggtcacgaggcagcccaaaagagagtgtcttgtccacattctgaggatgggcatcaacagatggggacgc

SEQ ID NO: 135220 - DNA, 601 bp, Human
accgtaggggctgccgggacgcagctctcggtactgctctgggcctgccaggcctccatgctccagggagaagttgcccagggctcccgagggccggcccaaggcctgggtgggttcccccaagctcccgtagaggccattggccgggcccatttccgccaaggaaggctcatctgcaacagaagcagaggctcagtcagcgcctgccctccacctgcggcccctcagagtcccatcctgcaggcggaggcacccctgggtcggagaaagagtggctgccccacaccacatgacaggtcakaacaggccccttctactgttggagcatggctgcccctgcccctccactgccctcacccctgagtcagcccaggtgtctcaggcctggtgggatcagagtcaggaacagcccagccagggcccaggctttcaggaccagccccacagcagcctaggaagggggcacagataccaccacccacattttgcagacaaggatatttagttccagagtggctgagtgagtagcccgggtcacgaggcagcccaaaagagagtgtcttgtccacattctgaggatgggcatcaacagatggggacg

SEQ ID NO: 135221 - DNA, 601 bp, Human
ccagggaggctctgcggggcggcgggggatggggggacaccgtaggggctgccgggacgcagctctcggtactgctctgggcctgccaggcctccatgctccagggagaagttgcccagggctcccgagggccggcccaaggcctgggtgggttcccccaagctcccgtagaggccattggccgggcccatttccgccaaggaaggctcatctgcaacagaagcagaggctcagtcagcgcctgccctccacctgcggcccctcagagtcccatcctgcaggcggaggcacccctgggtcrgagaaagagtggctgccccacaccacatgacaggtcataacaggccccttctactgttggagcatggctgcccctgcccctccactgccctcacccctgagtcagcccaggtgtctcaggcctggtgggatcagagtcaggaacagcccagccagggcccaggctttcaggaccagccccacagcagcctaggaagggggcacagataccaccacccacattttgcagacaaggatatttagttccagagtggctgagtgagtagcccgggtcacgaggcagcccaaaagagagtgtctt

SEQ ID NO: 135222 - DNA, 601 bp, Human; identical to SEQ ID NO: 35436

SEQ ID NO: 135223 - DNA, 601 bp, Human; identical to SEQ ID NO: 35437

SEQ ID NO: 135224 - DNA, 601 bp, Human; identical to SEQ ID NO: 35438

SEQ ID NO: 135225 - DNA, 601 bp, Human; identical to SEQ ID NO: 35439

SEQ ID NO: 135226 - DNA, 601 bp, Human; identical to SEQ ID NO: 35440

SEQ ID NO: 135227 - DNA, 601 bp, Human; identical to SEQ ID NO: 35441

SEQ ID NO: 135228 - DNA, 601 bp, Human
cagcaaacctaagcactcttctgactattctttcattgaaaaaatattcaacagttatttattgaggtgtaattatgtgccagtcactgtactgttgacagaaacataggaccaatgaatacatacctggagagctccagtgagagtaaagcaaaatgctttttaaagatttcataggccagacgcggtggctcacgcctgtaatcccaccacttcaggaggccaaggcaggtggatcacttgaggtcaggagtttgagaccagcttggccaacatggtgaaaccctgtctctactaaaartacaaaagttagccaggcatggtagcacacacctgtagttccagctactcgggaggctgaggcacggaatcgcttgaacccaggaggtggaggtttcagtgagccaagatcgtgccactgcaccccagcctgggcgacagagcaagacaccatctcaaaaaaaaaaaagatcccaccagctagtaacatcagacatacttaatagctaggaggggtaaaacttgaaatcacagggtcagcataagtcctggctgtaccactattggttgtgtaacttgagaaaatctcttagcttctctg

SEQ ID NO: 135229 - DNA, 601 bp, Human; identical to SEQ ID NO: 35442

SEQ ID NO: 135230 - DNA, 601 bp, Human; identical to SEQ ID NO: 35443

SEQ ID NO: 135231 - DNA, 601 bp, Human
acagagggtgggggctccagaagtggccaaatgaggggctcatccttgaccttttggtcagacacaagcacaggcttggctgttgaacagagttcaagatcagaataatatgctcttggctatagaaaacatgtttctcaagcaggtggtgagtttccagagcatcaaatgcaacctctggtacagatggccccttctttctgtttcactggaaatgtgcattggtttgcccaagcattgtttacttgcatttcttgggatatctcctattagctaaggttagatgtgtctgtgccttaaraggctaggctggttcatcatttgatggttgacatgcaggcaaagacaagcaactggtatggctgcaatgaggattcagacagtagctgttccttcagtattccaaatggaaactgacttcctcctggtctttggtccaggatgagaaactcactttttttttttaatggggctgctagacttccaagagagccattaacgaaacaaaaaccaaggcagtctcaaagagtatggattccatttggaaggctttcaaatggcatactggagcatctgaagaaaataaacagatttaaggcac

SEQ ID NO: 135232 - DNA, 601 bp, Human
atgaggcttacagagactagatgaacactaggtgtggactcagtcaagcatcttatggggactaggattgactagagcagagcttctccagcattcacatcactgggcatcttgttgcattgcagattctggttaggtaggtctggggcagggcctgcctaaacggattctgcatttccagcaagttccccagtgatgctgatgctgctggtctggggaccacaccttaagtatctaggaataagggaacctattggtaattaggaatccatgaaattaatagctaccatttaaaaatackcagtgccaggcactgtgccaagggctttacatgtgttattttgtttaatgttgcttaataaataaacttggaagtacctgaaatagattatagcagatacaggaagcatggagatcagtcaagagctattaaaataatctagatagcaaagatattgaagatcctcatccagaggccatgggtattgagagggagatataaatgcaaggaacatcacagagataataacggaagttcttgcaatggattaaatatgatggctcggggggaagaaattgttagagatgattataagagtga

SEQ ID NO: 135233 - DNA, 601 bp, Human
gtatctaggaataagggaacctattggtaattaggaatccatgaaattaatagctaccatttaaaaatactcagtgccaggcactgtgccaagggctttacatgtgttattttgtttaatgttgcttaataaataaacttggaagtacctgaaatagattatagcagatacaggaagcatggagatcagtcaagagctattaaaataatctagatagcaaagatattgaagatcctcatccagaggccatgggtattgagagggagatataaatgcaaggaacatcacagagataataacrgaagttcttgcaatggattaaatatgatggctcggggggaagaaattgttagagatgattataagagtgatgtgaaaggctgtaatatcattaatagacaagcttagagacgtggctgatttgaaggggaaggtaatggcttgagttttagatagagaggatacttgcaaatattcactaagtgctcactatatgctaggcatggttccaaatacttgacatgtattaactcgtttacttctcataacaacccataaggcagctaccattattagcaccattttacaaatgtggaaacag

SEQ ID NO: 135234 - DNA, 601 bp, Human
gtggtcgaggccaggggtggtggctcacacctgtaatcctagcactttgggaggccaaggcaggcggatcacaaggtcaagagatggacaccatcctggccaacatggtgaaaccccttctctactaaaaatacaaaaattagctgggccttgggaggccaaacaggagaatcacttgaacccaggaggcgaaggttgcagtgagccgagattgcatcactgaactccagcctggcgacagagcaagactctgtctcacaaataaataaataaataaataaataaataaataaataaataagtggtagagttcaggtctacagccaggaaatctaattccaaagctttgatgtggtaggttttagagtttgtaaagttctttactgttgttagcttcttaataactcccaacctgtatatttatttttagcagcttacacttttagtgcttatataatcatttctcacagattcttgatcctctatgtatcaatttaacagatatttattgggtgtctcctatgtactaggcttggtgctggagatacaatgttgagcaaatacagttcatgcccccatggtgcttacagttaatgggagg

SEQ ID NO: 135235 - DNA, 601 bp, Human
ttgagcagtcgcaactggttggagagcagggaaaattctgcagtaccttctgtgagtttggccatgagaaagtctggttacaaggttccacaatcagctccctccccaaatccagccaacatattactcagttcctgtatcctgatgatgaatatgagatcttgaatgttatgtaagacatgagacactgaaaggaagggaaagcttaaatcaatggactggtatttattctgagaaaggcgtctctccctaggttatgaatataattgaatatttttcattattaattcaatttagtatyagcaaggtgatgtttgatcatgttatagcattcaagggcttcacaaaggacgaaatccatctcgttctattttaacattattatacaaagagcacaacctggacattttaaaaggaaggaaaatttatcccaaaaccccataggtattttcacgtttatattttctttcacccttctctatatgaagaaataatttttgcatagatggaatcacagctttagtatttaatattctactctttatttaatgttgtaaacgtttttttttttaattttgcttcatggccttcacatttgttc

SEQ ID NO: 135236 - DNA, 601 bp, Human
caccctgccattcattccatgtggctgtgtgccaggaactgtgcttcccttgtgttacttacctaagctggccatcccagaaaccctgaattgggtatgatcattttcttcatctcataaggaaatgggtgctcagaagtaaagagacttactctagggcacacagcaagtaagtgttgggactgggattcaaaccttggtgttgcttcataccaaaggccatgagctatctctaacagggagggcactttgattgcaaagaagctatccaaactggcagaatgagacacagacctcaatyagggattcaaagtgtcttaagatgtatttgcctcctaaacttcttgcccttctctatccctctgcagaaagacatgggttaaaagaaccaaagagagtcgaagagctatgcaacaagatcacaagcagtttaaaagaccaccagagtaagggacaggctctggagcccaccgagtccaaggtcctgggtgccctggtagaactgaggaagatctgcaccctgggcctccagcgcatcttctacctgaagctggaagacttggtgtctccaccttccatcattgacaagctcttcctggac

SEQ ID NO: 135237 - DNA, 601 bp, Human; identical to SEQ ID NO: 35444

SEQ ID NO: 135238 - DNA, 601 bp, Human
aggggcaccagtcatgggcgccgcagccgctgaggcgccgctccggctgcctgccgcgcctccgctcgccttctgctgctacacgtcggtgcttctgctcttcgccttctctctgcccgggagccgcgcgtccaaccagcccccgggtggtggcggcggcagcggcggggactgtcccggcggcaaaggcaagagcatcaactgctcaggtaggaccggtcggagccggccctaggtcttcccacccctccgttgccgcctccctcgtggtccctgcggtcggccgggctgggaaagaccmcgtcgtgggggtcccaggggtgggcccgagggtgagcgagggcggagggcagggcgcgagcgtgcggtgtggctttgggaccggcgctggggatgggagtggccgtgggtgcgtccgagtgtgtcgagtggctgggcgagggcggcccggcgtgtggggaggcggtggggccggggccggggccggcgaggctgagcggccggccggggctcccggtgtggtcgtgggtgtgctcgcgggagcgtgtgtttgtgttgtgaaggctgaggggagggagggcggccccaggcagggatctgt

SEQ ID NO: 135239 - DNA, 601 bp, Human
gtctcgggggtgggggtcgtgtggataaagggaacgggttgtcttgaggacgcggtttggcgatgcagagtgactgtgtgtgtgcgcgcgcgcgcgcgtgtgtgttctttgggttctgagatgggatctgggggcttagagtgacctcgggtctgtggatatgagcggggaaagtcccagggcccaggaagtgaccctgtgtttttgtgtgttgtgtgtgaagcctggggctcagttagtcaccctggggtatgcattgaagaggagggatgggtgccctatagcgaaccccatttatgtmttttcaaaggggaggaggcttgggagtcatcatcctgtgtagggtttggatgtagaaagaggaaattaggtctcagggaatgcccttgtgtagcaaggtgtaaccctgggttattaaagtgtggaaagagagaattgggtcccagggaagatgtcgtgcctgtgtgtgtgtgttttgcgggagggcctggattctggcagcagcggggagcaagggagtgacctctcccctctctccaaggccgcttgcccccccacagctgttggaaacaaagagcttgctgaggctttagtggataac

SEQ ID NO: 135240 - DNA, 601 bp, Human
ttgcatagttcaagttttaagaaaggaaataaaagaaatagagggatggatacccttgaggatgtgggttggtgatgcagagcgactgtgtgtgtgtgtgtgtgtgtgtgtgtgtgtgtgtgtgttctttgggttctaagatggaatgtaggggcttggagtgacctcgggtatgggcaggaaagtcccagggccggagaagtgaacctgtgtttttgtgtggtgtgtgtgcgtgtgaagcctggggctcagttagtcaccctggggtactatgcattgaagaggaggggtgggtgacatrcagtgtgggaaaaaggggactgatctaggggtcatggtccttgttaagcagctgtgtaatttggggcaagttacttaatttctcttagtttccattccttttaaaaaagagacttggatttagtaatatctgagtcttctttcaagcgtattcatcactgatataaatgtcaataaattaagctgatcaaataaaatgttttctagcagtaagatatacttgaataactgggtctaaagctagagttttaactaagtgatacttgtagattcttattgtaactttttaggatgaagattt

SEQ ID NO: 135241 - DNA, 601 bp, Human
tgtaatttggggcaagttacttaatttctcttagtttccattccttttaaaaaagagacttggatttagtaatatctgagtcttctttcaagcgtattcatcactgatataaatgtcaataaattaagctgatcaaataaaatgttttctagcagtaagatatacttgaataactgggtctaaagctagagttttaactaagtgatacttgtagattcttattgtaactttttaggatgaagatttgggaacgattcatatggaaaaaaaatttttttagttggtaagtttgagaaccatrttaatacagtctggacacacacatctgttaatgcagctcgaaattgtgcacagtttgtttagtagcttttattatctaggtatccccccacaaactgaagtttactctgtcatgtttttttttttgagatggagtctcactttgtcacccaggctagagtgcagtggcgcaatcctggctgactgcaacctctggctcctgggttcaggtgattctcctgcctcagcctccggagtagctgggactacaggcgcccaccaccatgccgggctaatttgtatttttagtagggatggggtt

SEQ ID NO: 135242 - DNA, 601 bp, Human
ggtgattctcctgcctcagcctccggagtagctgggactacaggcgcccaccaccatgccgggctaatttgtatttttagtagggatggggtttcacaatgttggccaggctgatcttgaactcctgacctcaggtgatccgcctgcctcggcctcccaaagtgttgagattacaggtgtgagccaatgtgcctggcctatttcgtttttttttttttttgagacggagtctcactctgtcacccaggctggagtgcagtggggtgatctctgctcacagcaagctccgcctcccgggttygcgccattctcctgcctcagcctccccagtagctgggactacaggcacccgccaccatgcccggctaattttttgtatttttagtagagatggggtttcatcgtgttagccaggatggtctcgatctcctgacctcgtgatctgccagcctcggcctcccaaagtgctgggattacaggcgtgagccaccgcgcccggcctatttcagttttaaaactaaatacagccctcgattccctgtagatattcatttttggttttggaccatcatttcagcctactgtgagctttctggagctg

SEQ ID NO: 135243 - DNA, 601 bp, Human
ccatgcccggctaattttttgtatttttagtagagatggggtttcatcgtgttagccaggatggtctcgatctcctgacctcgtgatctgccagcctcggcctcccaaagtgctgggattacaggcgtgagccaccgcgcccggcctatttcagttttaaaactaaatacagccctcgattccctgtagatattcatttttggttttggaccatcatttcagcctactgtgagctttctggagctgattcggtcaggctgtgcgtgttgggtcactcacaggtttttttcacttgcaaatrtgaagagcagttctatggcttcattaaattaatagaagttgtctagattgtgaaaaaggatggaaccctgcgacatattactggagactttctaccaacttggttgatgttgttacgttagtcaaccagatgttcaactagctatgcatcctgttagttgaatttaacagattttcgagcttctgctgttcaacattttcccattttgttcaccagcctattatttaaaagattctttcagattgtcttgttagattgttatgtgtatatatcatcctgtcatcctccctttttccattt

SEQ ID NO: 135244 - DNA, 601 bp, Human
gcctttttttttttttttttttttttgagatggagtcttgctctgtcgcccaggctggagtgcagtggcatgatctcggctcactgtaacctctgccttccaggttcaaccagttctcctgcctcaagcctcccgagtagctgggactacaggcgcacaccaccacgcccggctaattgtttgtattttagtagatatggggtttcactgtgttgcccattctggtctcgaactcctgagctcaggcaatccgcctacctcggccttccaaagtgctaggattacaggcatgagccactgygcccggcctgcatttctccttttttgaaatttgagcatgtgtttatttctatttatttgatttctggtcttctggcaccttgtcaaggtagcttagataatttgtggtagtttttaaggcagatgtaaaagttttttcagcatcatggagtgtgagttatttggatcagaaagcatattcttttgaactagctctgtattctgttactgtcccctacccatgccacttaccttagaagctggtttccttttatcagatttctgacctccctagcttgaagatcatgcttcttgatgaaga

SEQ ID NO: 135245 - DNA, 601 bp, Human
ccttagaagctggtttccttttatcagatttctgacctccctagcttgaagatcatgcttcttgatgaagatgaagcatagggaattggccctgttgtctcttgatattgcatcttccctaagcaatgggcctttggtttatctcttcttgttctcaacaagacttttttgtttgtttgtttgtttgtttgagacaggatctcattcctgtcgcccaggctggcgtgtagtgacgcaatctcagcttactgcagcctcagcttcttgggctcaggtgattctcagcctcctcagtagttcrgactacaggtgcgtgccaccacactcggctaattttttgtgtttttagtagagacagggcttcgccatgatgcccaggctggaacaagacttcttttgttgtcctcttgccccagttctccacttattctggactttagacttattgagattaaaagaaaaacttcgattttatatcttttttatttatgcttatttttttttaaagctaacttaacagaaagttcccagttatccaaagagaaaaaaagcttggaaatacatgacatatgtgaagaaagataaacttgaatttaggaga

SEQ ID NO: 135246 - DNA, 601 bp, Human
tgtgtatgtatctaggagtggaattgcttggtcatatggtaactctgtgtttcacattttgaggaattaccaaacggttttccaaagtggctgcaccattttacatttctaccagcaatgtttgaagatcctaatttctccagcatcttctccaacacttgttattgtctgtctgtttgattttggccatcctagtgggtgtgaagttatgtatcaatgtcgtttttatttgtattttcctaatggctattgatattaagcatcttttaatgaatgtattggctatctgtatatcttcttyggagaaatgtctattcagatcctttgctgggcttgattttgacatcttggagtaatcattcccttagtaaatcatactaatcagttcccacagcaagcacagagatgctcaaatgctaagttggctctcgtttgtcatttgatttttctgcttactaagcaagagtcagttgtatttgttttcaaacttatttataccagtggtaattatgagtataatttaataaatattactcaaatcgatgaaatatgaatacaaaaagttgtttttatgaaatgctttgaaaagacttgataaaga

SEQ ID NO: 135247 - DNA, 601 bp, Human
tgggaaatgaatgtataattatgtatttaagactaaaatggctaaaatagatatcattttaaatggtttctgccttaactgacttttttggttaatagatcaatgatcactcttgtatatgtttgaaaagaggatttccactgtacaaggtgccctgaggaagatacagatgtggtgtcatgggaatgtgtaattctgatttgtaggaatcaaaactggtttcatggagtaagtggcactcaagctgggctgtatggggagagtagaatatcacctagaaacaacagacgcacttttgccygaggcctttgctgttgatgttcctttggcttggaatcttcttgtcccagttcctacagttgtttgctctaatgtcaccttcagtggtgccttaaattacagccttctccaccttccatccacaatgtctctctcatatcctaatcttccttcgtgctttttcttgctctaggacaccttttcctgtgtgacatactatacgttttacttgttttctgtctctgtatgtagctctatgaaggcagagatttttatctgtttcgtttaccactgtattgacagtgcccagattggtgtctgg

SEQ ID NO: 135248 - DNA, 601 bp, Human
acgttttacttgttttctgtctctgtatgtagctctatgaaggcagagatttttatctgtttcgtttaccactgtattgacagtgcccagattggtgtctggtacgaagttaggttcccattacatatttatttgtggaatagattaatggctgaatgaacatagaagctgaacatagatgaatgaacatagaatacctcttaggaagggtattctaggctgaaggaatagctttaggaaaggcacaaaggtggaaaagagaagggagtcttttcgaaatactaaattgcggggattaagrcaggagattatgccaccacattaaggtcttcaaggcccatctgaagttttggcatttggttcaaagacatcaagaagcttttaaagggtttgagtgacattatggttttagaaaacaaagtctgaaattggtgaagatggaatggagaagggaagagcctggcggtacgatgaaagataatggtagaaatgggaagaattgagaggacttgtttagcctgcacaggttttttgtttatttatttatttatttttatttttaattgttgttgttttttgagacggagtctagctctgtcac

SEQ ID NO: 135249 - DNA, 601 bp, Human
gatgaatgaacatagaatacctcttaggaagggtattctaggctgaaggaatagctttaggaaaggcacaaaggtggaaaagagaagggagtcttttcgaaatactaaattgcggggattaaggcaggagattatgccaccacattaaggtcttcaaggcccatctgaagttttggcatttggttcaaagacatcaagaagcttttaaagggtttgagtgacattatggttttagaaaacaaagtctgaaattggtgaagatggaatggagaagggaagagcctggcggtacgatgaaagrtaatggtagaaatgggaagaattgagaggacttgtttagcctgcacaggttttttgtttatttatttatttatttttatttttaattgttgttgttttttgagacggagtctagctctgtcaccgggctggagtgcagtggcatgatctcagctcagtgcaacctccgcctcccaggttcaagcgattctcctgccttagcctcctgagttgctggtactgcaggcgcataccactacgcccagctaatttttgtatttttagtaaagacggggtttcaccgtgttggctaggatggtct

SEQ ID NO: 135250 - DNA, 601 bp, Human
aggagattatgccaccacattaaggtcttcaaggcccatctgaagttttggcatttggttcaaagacatcaagaagcttttaaagggtttgagtgacattatggttttagaaaacaaagtctgaaattggtgaagatggaatggagaagggaagagcctggcggtacgatgaaagataatggtagaaatgggaagaattgagaggacttgtttagcctgcacaggttttttgtttatttatttatttatttttatttttaattgttgttgttttttgagacggagtctagctctgtcaccrggctggagtgcagtggcatgatctcagctcagtgcaacctccgcctcccaggttcaagcgattctcctgccttagcctcctgagttgctggtactgcaggcgcataccactacgcccagctaatttttgtatttttagtaaagacggggtttcaccgtgttggctaggatggtctcggtctccttgtgatgtgcctgccttggcctcccaaagtgctggaattacaggcgtgagccactgcgcccagcctagcctgcacagttttttaaaaaagttacattggttgttagccattaaaaa

SEQ ID NO: 135251 - DNA, 601 bp, Human
acctctcctcatccagccctaggcaaccactgacgtactttttttttttttttttgaaacagtctctatcctccaggctagaggacagtggtgtgatcttggcgccctgcaacctccgcctccccggttcaagagattctcatacctcggcatgagattcaggtgcctgtcactgcgcctggctaattttgtatttttagtagagacggagtttcactgcgttggccaggctggtctcaaactcctgacctcaagtgatctgcctgcctcggcctcctaaaatgttgggattacaggcatragctaccaaccctggccatgatttactatcttttgctgtagatttgtctattctggacatttcatataaatggaatcatacaatatgaccttttataattggcttctttctcttagcatgatgtttttaaggttaatccatgttgtaggatgtatcagaatttcattccttttttttgactgaataatatttcattgtctcgataataccacattttgtttatccattcagtatccattcatctgttgatagacatttttttgtttttactttttgactattatgaataatgccaccatg

SEQ ID NO: 135252 - DNA, 601 bp, Human
tttaggggcttggcatacttctcatgtacttggaaattctatacttaaatctgaaaattctctccgtatatgcttttagtttattaggtaacttaatttattgtaattcctttgctactattcaaattcatctattttttaaaaagtatcatgtattttccatggctcagcagccttgtcattttttcagaagtcatttaaggttctaaagttcttaacgtattcttgtacctttaaaaactttggcaggttattatattttcaaccacagctcaatttctctctctctttttttttttttgcaaatattctgagtctgtcttttccatggattaaaaaagggaaaaaacccacaccttttttctttgttataagagcagtatataatctgtgtagaaaatttgaggaatatggaaaaatatgaagaggaaatctgggataattgccattctcttctttaatctcagtgtttatgctaaattatttcatttttcatcagaaaatttttgaacttgagttttgctctttttgcccaggctggagtgcaatgacgtgatctcggcttactgcaacctctgcatcccaggttcaagtaattctc

SEQ ID NO: 135253 - DNA, 601 bp, Human
agataattggtccgcctcgggctcccaacgtgttgggattacaggcgtgagccacagcacccggcctgaacttttaaaaaaatattcatgttgttttgctttgcattttctgtttatgctggagccactgttgttcagaggtcagatctccttctgggatgttttatttttattttttgagacaatgtctccctctgttgtcaaagctggagtgcagtggcatgatggcttactgcagccttgaccttccaggctcaattgatcctcctacctcagcctcctgagtagctgagaccacagrcgtgtgccaccatatccagctaatttttaaaaattatcttttgtagttacggagtctctctatgttgcccaggctggtctcgaactcctgggctcaagtgatactcccgcctcagcctctcaaagtacaagcatgaaccactgtgcctggctaggaatttttaagttcagtttatttttgccttgtcagctttcatttaatattgttttgcacgtgaaactaaactgctgatgttgctgtatcaattctgttgtttatagcccagttgatatatttagattctttattgttcacaagtca

SEQ ID NO: 135254 - DNA, 601 bp, Human
ggaactctttctaatgcaccagaattttgtgaagtctttaaaaaattatcttttaaaatcattaataccaggtttttcagtgccagtatgcaagttgctgtgtagattttcatctttgtgggtgatttccctgggttctggctacctcctattctacttagtgttgcagacactaagggatagtggttagaaatagaaccagaggacattgttcttgtgtttagattaattattgatttaaaaaacagtttaatgaaggaaatgtattgagtatacctgcaaaatcttatatatgtaaacmggcatatgtttcaaaataatgggattataactgtatgtatagttttacaatgtgttttttttcacaataggtcttagttgtcttttcatatcactacatgtgtttctaccaaagtctgtgtagtattatgtcaataatttaattcccaaaagatagacatttagattgttttctactttggttttacagaaagtgctgacgttaacaatcttggacataggtttttgtatgtttttcttttatatctgttatagtttcctggaaatgttgggtaaaaggataaagacaattaaaatggca

SEQ ID NO: 135255 - DNA, 601 bp, Human
tatgtaaaccggcatatgtttcaaaataatgggattataactgtatgtatagttttacaatgtgttttttttcacaataggtcttagttgtcttttcatatcactacatgtgtttctaccaaagtctgtgtagtattatgtcaataatttaattcccaaaagatagacatttagattgttttctactttggttttacagaaagtgctgacgttaacaatcttggacataggtttttgtatgtttttcttttatatctgttatagtttcctggaaatgttgggtaaaaggataaagacaatwaaaatggcaatgcatatggacacatgagaggttgtgccactatgtacttccacagttggtttgagtgctcatttttctatactttctccagaactggtgctaataaaaaacaatagtagcttacacttaatagagtacttattatgtgtattattattttgctctaagtgctttccatatctttaatcctccgtcagaattttgagataggtgctgttattgtccccattttgtagatgaagaaatggaggcataggtggtaaattactaagctcacacagctgtgataagtggtagagc

SEQ ID NO: 135256 - DNA, 601 bp, Human
gtaaactgcttttggttttgtatcataaaatattaggtaaagtttctttttcctcctcatatctttatactagaagataactaatatgattagtaaacaagttgaagaggatttaatttctaatttttctgatttcctgggacttgaagtcaacatttgctaaatctattgcttgattttataccctgaaatgtattttcagtgatttgtgtcattagaggtgcccctcagattggttgggagttgaagtcatatctgggaaaagaaaaaaagtgaatatttgttgtataactacttgttytaggcacgattgcttttgaatacattatctaatcattacaatatcaaaggaaagtattattctaaaaggagaactaccacgtgaacttggcccttcctgatatctaaacttatgcttcgtctgtggtatagcaaactgtctctggggttgtctttgaaatcacattgaggtttttttttttttccccattaaataataaccaatatagaaacttgaaaaggggagaaatcactcattgtttaactgctgtaacaggttactgttaccggttttgtttattcctggctggattatcttata

SEQ ID NO: 135257 - DNA, 601 bp, Human
tatcaaaggaaagtattattctaaaaggagaactaccacgtgaacttggcccttcctgatatctaaacttatgcttcgtctgtggtatagcaaactgtctctggggttgtctttgaaatcacattgaggtttttttttttttccccattaaataataaccaatatagaaacttgaaaaggggagaaatcactcattgtttaactgctgtaacaggttactgttaccggttttgtttattcctggctggattatcttatatgtatggtgtgtgtgtgtgtgtgtgtgtgtgtgtgtgtgtggatgtgtgtatgtgtgtatgtgtgtgtttgaaatgagtttcactatattgtcccggctgatcttcaactcctggtccttctgcttcagcctccaaagtagctgggactacaggcctgcatcacagtgcctggcaggtttttcatataaaatcatagtctgtgtatatagttttgtggtctgcattttcactttaacattaataagcttatttccatattctataatatacatctttaaatagctttataatattccatagttgtaccacaccatttcctggtgtgcaatatttcaaatatt

SEQ ID NO: 135258 - DNA, 601 bp, Human
tcacaaaaatgattcataagtgcatgtaacattttattttaacatacacatatttattaaatattttgaaagagggcctataatttttctttgagaatagtttctttccttttttttttttttttgagacagagtctcgctctgtagcccaggctggagtgcagtggcacgatcttactcactgctacctctgcctcctgggtcgcagttcaagcaattctcctgcctcagcctcccgagtagctgggattacaggctcgtgccaccacgcccagctaatttttgtatttttagtagagayggggtttcatcacgttggccaggctggtcttgaactcttgacctcatgatctgcccgccttggcctcccaaagtgctgggattgcaggcgtgagccaccgcacctggcctcctctttcttgaacaaaccacttgtataatgcattgataacaaactccagttttaatccctttaaaaaggaagctaaagacttgtggatgcagaattctaaatgcaactgtaggttttttttaaaaagtagctcaccttattcaagtctttgagtttagttttcatagaagtaatttattttcactcata

SEQ ID NO: 135259 - DNA, 601 bp, Human
aaatgcctccctccaagatttattccgggagtcaccaaattgtgtttgatgtgtgcccactaatgcattccactgctacatgacacctgtctttttcttcctgtgctgtttgctgcctctgcagttgcacgttggtacctcctgtcagatatcagaggtctgcctctttgcccgacactaccatctccttggtcttatgctatcctgctagatacattgctgatattcagggactgttgatgtgtcccagctcctttctccccatgtattatgtcttgtgtgagcatcaaagcagagcttrtcacttcgtttttagtgaaaatcattctttagtttctttgttgtagctcctctgtctctgttatgagttcttggagctgggctggaggagcaaaccaagtctttagaagggactgtgctcaggatcacttctcttgttcaaggctgtgtttatgccaagttcttttttttgagacagagtcttgctctttcactcaggctggagtgcagtggcacgatctcctcactgcagcctcctcctcctgggttcaagtgatcctcccacctcagcctcccaagtagctgggactacaggcatgta

SEQ ID NO: 135260 - DNA, 601 bp, Human
tgataggagggtttctcttgggcatttttatatcagccaccttctgccaagctttcttaggtagcttttggctggcttcagatccctgctgcctgttggctggagacatcatttctttgccaagagcacctttccatagagctctgcatagcatggaaggtgactttagccagaatgaaatgagaagtcggtgataatttgaactgttttccccctgaacctaatgtgtcatttttctctgactgctttcaagattttttccttactgtttttgactattaagtactgtggtatggttttycttgaacttatcatgcttggggttggcagaacttctgaaatctatttgttactcagtttaagaaatattttgtcattatttcttaaaattttttttctgcttattatttcttataatctgggacttccatgatgtgttagaccttttgatactgtctcaaggtccctgatactctgttcatttttttcccaaattttttcctgttctttacattagataatttttattgatctgtcttcaggttcactaatcctttcttctgtcatctccattcttcccatccagtgagtttttaattgt

SEQ ID NO: 135261 - DNA, 601 bp, Human
ggagacatcatttctttgccaagagcacctttccatagagctctgcatagcatggaaggtgactttagccagaatgaaatgagaagtcggtgataatttgaactgttttccccctgaacctaatgtgtcatttttctctgactgctttcaagattttttccttactgtttttgactattaagtactgtggtatggtttttcttgaacttatcatgcttggggttggcagaacttctgaaatctatttgttactcagtttaagaaatattttgtcattatttcttaaaattttttttctgcytattatttcttataatctgggacttccatgatgtgttagaccttttgatactgtctcaaggtccctgatactctgttcatttttttcccaaattttttcctgttctttacattagataatttttattgatctgtcttcaggttcactaatcctttcttctgtcatctccattcttcccatccagtgagtttttaattgtagattttttatgtttagaatttacagtttctgtttacctgctgggatttcctcttttcattcactgtaagcatattttccttgagcatagatgttattgcc

SEQ ID NO: 135262 - DNA, 601 bp, Human
catatgttttagagtgtgtgagttttgttatgttcctttgaagattattgttatttttgaaaccgttggctgaattcaaactgcagattctgccttacttgtggtgggcagcaacacaagtatcaattcatttcttttagcctcactggggctacttggagtctgccccatgtgtggtttaggggtctgccagaaacgtgctctgagtttatacgcggaaactgggactcccctcgaactctctcctttccgagatttccctctcactttttagtggctgtgattgtcctcaagtctgttwtctggttcattaaaagaaaggtggtgggttttgttgttgaagatttagtcatcctgtgtggggaagaccggggctgttctcctcttcagctgctgtgtttccttaggttaaattccttgaggtggaattgttgggccagtggatactcatgtgcagattaacattatcaccaatagcctcatatcagatgtcctgtttcccctcaaccttttgatagtggattttgttggtccttttaaatttacaaatctgaaaggcaaaaacaatttttatttgcatttgattactagagaaattgaa

SEQ ID NO: 135263 - DNA, 601 bp, Human
ggccagtggatactcatgtgcagattaacattatcaccaatagcctcatatcagatgtcctgtttcccctcaaccttttgatagtggattttgttggtccttttaaatttacaaatctgaaaggcaaaaacaatttttatttgcatttgattactagagaaattgaaaatgtgctgtatatttgttaccatttttttttgtgaattaatatttcatattctgtgtctagtttctggggtattttctttttccctcatgttgatttgtaaagacatgtgtatgcatatatacatactctgtrcaatacaatattggaatatatatatattgcttactatgctgagcatttgatattcattaactcataaactctcaagagaacctgctgctttgatttatttatttatttttatttatttattattattttttgagatggagcctcgctctgttgccaggctggagtgcagtggtgcgatcgtggctcactgcaacctccgcctcccgggttcaaatgattctcctgcctcagcctccctagtaactgggactgcaggtgcatgccaccacacccagctaatttttgtgtttttagtagaga

SEQ ID NO: 135264 - DNA, 601 bp, Human
agaagctttctgggacattatttaaatacattttaacagataacaggattttaaataaaaattcaaattgtttttttttttagtctgctaataagagctattatcttgccacacatataaacaaagccacttttgctaatttggtatatagaaacatgattaatactgcatctttccctgaaaactttgtatagagtacagtctatgactttttttcctgttttctttcttcatctttgttctggcattctctgaactatgtgtctttcttcctgtatttatcaatgtctgctcttgctasgtgccatgccctcttattagaccctttattagtcacagttctccagagaaacagaaacacacacacacacacacacacacacacacacacacgaatgtgagagcgagcgagcaataaggaattagctcatttgattatggaggctgagaagtcctacagtccgtcatctgtatactagcccaggaaagccagtggtacaagtccctatctgagactgaaggcctgggcaccaggagaagatcgatgtcctagcttaagcggtcaagcaaaaggagagaagaattctattcagttcttcag

SEQ ID NO: 135265 - DNA, 601 bp, Human
gtggtacaagtccctatctgagactgaaggcctgggcaccaggagaagatcgatgtcctagcttaagcggtcaagcaaaaggagagaagaattctattcagttcttcagtggattgaatagtgcccactcacactggggagggcagtctgctttacttgatccactgatgcaaatattaatctcatctagaaattccttcacagataaacccagaaatgatgtttagtctgggcaccatggggcccagtcaagttgacatagaaaattaatcatcacaaccttgttattattttctacttkctgtattcagcatagttcctgacacacagtaggtacacaataaatgcttgaatggatgcagttccagagtcgtacactgctccatctttctaaactacttgaaatagctggcaacatcatcacattcttctagctaaagaaaaggtacaggggagagttcttcctcccaacaagggtggcaatatagaggagcagactttaggttagacttagaatccaccatcagtgcataagtcagaaatcgcatgttgttaaaattgtccaaatcccataatttgtccattagcataattagaggct

SEQ ID NO: 135266 - DNA, 601 bp, Human
catttaccttgggactttgcctactagatgttttgaataatgatttttttctatttttatgattaggtttgaatgaataaatgaattttgataataataaaatgctattacataagtagcactctttacattgtcaataatttcctcttattaccttggtggtttttcatagcaagcaaatgaagtagatagagattttcattctcatttttttggatagttggtagttattttccttatgaatgtgaaaaaaggtatgaagaagtagcataattctttttaagccaaaaaaaaaaaaaaaccccagactattcagtagcgaagtatgtcataatgctatggtattgcattcatgaatgtgaaataaactattaatattcatgcctagttctgagaatttatttttgttgcttttgcagtgccatacaaattatattcctgtctgtggatcaaatggggacacttatcaaaatgaatgctttctcagaagggctgcttgtaagcaccagaaagagataacagtaatagcaagaggaccatgctactctggtatgtatgatattcttctgaataaattttggaaaatatggtggaatcattt

SEQ ID NO: 135267 - DNA, 601 bp, Human
ttgcctactagatgttttgaataatgatttttttctatttttatgattaggtttgaatgaataaatgaattttgataataataaaatgctattacataagtagcactctttacattgtcaataatttcctcttattaccttggtggtttttcatagcaagcaaatgaagtagatagagattttcattctcatttttttggatagttggtagttattttccttatgaatgtgaaaaaaggtatgaagaagtagcataattctttttaagccaaaaaaaaaaaaaaaccccagactattcagyagcgaagtatgtcataatgctatggtattgcattcatgaatgtgaaataaactattaatattcatgcctagttctgagaatttatttttgttgcttttgcagtgccatacaaattatattcctgtctgtggatcaaatggggacacttatcaaaatgaatgctttctcagaagggctgcttgtaagcaccagaaagagataacagtaatagcaagaggaccatgctactctggtatgtatgatattcttctgaataaattttggaaaatatggtggaatcatttctaaaagggggttttg

SEQ ID NO: 135268 - DNA, 601 bp, Human
cacaaaatgatctagaaattaaagaggaatatggaggttctttccagtctcaaattatgtttcacttatgaggagcatatgtctaagacagcaagtgttaacacctaatgttaaacattaggcagcaaagtggtagattgggagcactgtgctagggttacaagacctcgccttaacctaactccaacccttatttactgtgtgaccttggacaaatcactaagcctctctgagccccaattccttaacttgttaagtggatattatctcctggggttgttaaataaggattgaatgagcraagttataagctgctatattgattttattttctgagtgggcagtgttttatgttatttggtcttttgtggatcctattccttgaactagaaatactattctcttttccttatttgaaaactctttttcttatgcttaaggttggtcttaagccttttctcctctgtgaaatcttccttctgtgacatctcctggcagagtttgtttataccttgggtgtatttctatacatataccatattgtatttcattcatctgacataagtacctccagccaaatcagtgctttctcagtggggag

SEQ ID NO: 135269 - DNA, 601 bp, Human
attatgtatctaagcaatttatattttaagagcagcataaaataagtatgtaagaataaataagatatcaaaaatatgagaaaaggactctttgagaatggatatcacagttttatttttgataggaaattttattatttgataagatgaaatttccgggaaaaatgttcatattcattctttgtttttcttctcagataatggatctggatctggagaaggaggtaagtttcaagtacctcttaaaggatatttgcttttctttctttctttctttctttttcttttttttttttttttwaaatcagctttgagatataattcacataccatataatttgccacttgaagtgtacaaattcagtgacttttagtaaattcacagttatatattcattaggatattcagagttatatattcatcaccacagtcactcttagaacattttaataacctcaaaaagaaaccatgcactccttagccatcactcctaacccaactctccctctcagctctaggcattcttgtttcttgcatttttctctggaagtttattgtcatactaaggggaagatgttgtagtttctgttaaattgaggt

SEQ ID NO: 135270 - DNA, 601 bp, Human
gtggtggctcatgcctgtaatcccagcgttttgggagactgaggtgggcggatcacaaggtcaggagttcaagaccagcctggccaacatagtgaaaccccgtctctactaaaagtacaaaaattagctgggcatggtggtgtgaacctgtaatcctggctactcaggaggctgaggcaggagaatcacttgaacccaggaggcagaggttcaagtgattctccaggctgagattcatccaggctgagattgcgccactgcattccagcctgagactccgtctgaaaaacaaacaaacaacaaaaaaagacactccctgaatagtactctttttcaaaccaaattcgagggaaatcccttgaatgaactgaaatccttaagttgatttcagaactgatctccctggccagtttgagattatcaggatatgatccactctagttgagacccacaaagtgtaaggccctttcagtgtggaatgtgagctgagtttggggctggaggtatttagtgtttttatttttttcttttgcgttggagcataagagacctgcatacttttgtatctgcatatttttggctgtgctaagtgaccaagtag

SEQ ID NO: 135271 - DNA, 601 bp, Human
ctcatgcctgtaatcccagcgttttgggagactgaggtgggcggatcacaaggtcaggagttcaagaccagcctggccaacatagtgaaaccccgtctctactaaaagtacaaaaattagctgggcatggtggtgtgaacctgtaatcctggctactcaggaggctgaggcaggagaatcacttgaacccaggaggcagaggttcaagtgattctccaggctgagattcatccaggctgagattgcgccactgcattccagcctgagactccgtctgaaaaacaaacaaacaaaaaaaaaagacactccctgaatagtactctttttcaaaccaaattcgagggaaatcccttgaatgaactgaaatccttaagttgatttcagaactgatctccctggccagtttgagattatcaggatatgatccactctagttgagacccacaaagtgtaaggccctttcagtgtggaatgtgagctgagtttggggctggaggtatttagtgtttttatttttttcttttgcgttggagcataagagacctgcatacttttgtatctgcatatttttggctgtgctaagtgaccaagtagaaaaaga

SEQ ID NO: 135272 - DNA, 601 bp, Human
ttctccaggctgagattcatccaggctgagattgcgccactgcattccagcctgagactccgtctgaaaaacaaacaaacaaaaaaaaaagacactccctgaatagtactctttttcaaaccaaattcgagggaaatcccttgaatgaactgaaatccttaagttgatttcagaactgatctccctggccagtttgagattatcaggatatgatccactctagttgagacccacaaagtgtaaggccctttcagtgtggaatgtgagctgagtttggggctggaggtatttagtgtttttwtttttttcttttgcgttggagcataagagacctgcatacttttgtatctgcatatttttggctgtgctaagtgaccaagtagaaaaagaagaaaagtcctttacaaagagacccttttccattttaaaatttggagataagtatttttttttaaactctgaaattagtttttatgtagttagaaagacaagtatgaaactgatgtgaggaaaaggtgagagttacattcttttgtggtcaggcgcttatctgctgaccagctttgcacaggctgattgcaacaggagggtaatcacagga

SEQ ID NO: 135273 - DNA, 601 bp, Human
cagaaaatgttgggtgagttggttgaggggaagggacaaagttatttagagattaatcatcagtatgattatattgtggaaaggtatcatttacctggttctgtatcttttgtgtgttttcaaattttttttttgtttaatgctagtctattgacttttaaattgatataatactatggctatttaaatcagtttaagtgttataattttagaatgataatccatttatagttttctggttttatctatgcttttcttcctccctgtagttttatagttttatgtattttataccaagtgyttttctcactcatgttcagccttcattaaggtaggttttgtagctgacagcactgtctgtccaatttcccattcattccctgtaagaaatggtgttcttttttagaacagtaaggctgcagacatttatcaacagtcatgtttgatttttcctttcatcagtattcttatttatttccaatatcattcttctttcattttcctgtggtgctggctttttgcatatttgattctaaaagctttaatgttgactttaggacctgggagcataaatggatcttcttcacttcctcagttttca

SEQ ID NO: 135274 - DNA, 601 bp, Human
ataaataaataaataaataataaaaaatttatcttctagtctgatcctctcacttcaaagatgaaatcattgacgactaaagtcagagggtttgatgtgggtatattcttctaattaatagtacagtgcttttcttaccatctgcctctttctaattttcctttaaagaaaaaaattcccggaaggaatgttatcttctttttcctactttgaggactgctgcccagtgactttttttttttttttttttttttttttttaacaaaaacactgccctcttcatcagcctggtcccagctgkgatttctttacttctgtattaagtcttggtcactctgagtactagctgcttttaaattctgttagttcttagctggcatctagaaatcaaatgcctatttattgaatttcttaccagtgactttcagtcttttttgactacacttcatgtaaaaaatacatttgcattgttatccagcactcctgtttatatacacatggtactaataaatattaagtcaaacaaaattctgtggaatagtacttacctttattaaatgcaatgtactctaatattttctatcctactttcttataaaat

SEQ ID NO: 135275 - DNA, 601 bp, Human
atgtaaaaaatacatttgcattgttatccagcactcctgtttatatacacatggtactaataaatattaagtcaaacaaaattctgtggaatagtacttacctttattaaatgcaatgtactctaatattttctatcctactttcttataaaatactggcagtgaaccactaaattgacttcataatccactagtgattatgacctacagtttgaaaagtattgctctatagtaaactataatagatgtgtactgcatgtatttttttaggtgtaagtattcatttaaaattttattgtakgccagctgtggtggcttacatctgtaatctcagaacctttagaaggccaaggcaggaggattgcttgagcctgggagatctaggctgcagtgagccatgattgcgccactgtgctccagcctgggtgacacagcaagaccctgtctccaaaaacaaatgaacaaacaacccagaaaatcaaatgtactttgtcttttctcaatttgaaatgtctttcctgtcagaaaaaatgttatccaacctatctgatttgcaaagagcagctaaaatctttctcttgcttttaaaaattctttctct

SEQ ID NO: 135276 - DNA, 601 bp, Human
ttttaaatttagccatttaaatagaaattgatttaaatacattacatacttctttgccttcttaaacagaatatacagaacatgtttaacatactcttacaattacatatgtagtatattacagttttcagagcattttttacacataatatatttttaagctattctgagcagttctgtttggtagtagagcaaggaagtattatcctgatttttataggtgaaggtgagttcagaaaggctgaatggagaaccagaacataggtctcatgacaaggaatcagtctattgtgttgtgcaygcacatgtagaggcccatgatgtgtggttgtttcactgctgcacttaaggcttcatttagctttgtgttttgggttctatatctgttttttaaaaatgttttcttctctcttgtaaggctgttagctgctgcttctagatgctgtcagtgtgccttggcaatgagtttgactgtagatgccctcaatttttaatttgcttctctgcttccctggaataggaaacaaacactcgcagaaactgtatctaaagtaagaataagttctaaatgtaaaataagagtgtataggttcttctgagt

SEQ ID NO: 135277 - DNA, 601 bp, Human
tgccctctacaccttgtatatagctgtcatcccaggatctcccttcagtgtggtgtcttttccaacaacaatcgattttccaactctctgacactacctagatgtccaacaattcaattaaattctgacagtaactacttggagttagcgcagacccacggttaaggactcagtcccataagactgcccccgctttataaccagctgcaaatgaggtccccaggctacccccacttctgcccagatgaccataaattttggagttcccatgccctagctaatttgctaaaacacagaactygggaaagcactatacttattatttgtaaaggatacaaatgatcagccagatgaagaagtacataaagcaaggtccagaagggtcctgagtgcaggagcgtctgtccccatggagtcaagtgcaccaccgagatgtgctccctcaccggaagctcccgaaccccccgtattctgagtttttaaactgaagttttattatgtaatcgtgactggttaactcattggtcattggtgattgaacttaacatccaacccctgtccccttcccagaggtagaagaattggggtggggctgggaggc

SEQ ID NO: 135278 - DNA, 601 bp, Human
atgtaatcgtgactggttaactcattggtcattggtgattgaacttaacatccaacccctgtccccttcccagaggtagaagaattggggtggggctgggaggcagaagttctaaccctctaatcactgtggttggtttttctggtgacattaactccctgccccctcaccccatgagtcatctcactagaatataagaactctcctatcactcaagatatgtcaagggaactctataccaggaactgggaacaaagaccatgaatacttattattataccactaggatcttcctagaaawtcctttgtctctctctcctatatagggtactgtatttcttctatttttgcttctaacttcttggttttactctcctattttattacttcttttagcagcttcttatgaaaaggtgtgagattttaaaaacgtttgagaccttgtttgaagtgtttaggtatttttattccacacctaatattttattcagaactttgcaagtgcataattcgagctgtgagacaaatttccctgagaattaagaaagtgttgctttgttgtcttctagcttccagtgttgctgttgaagtctaaagccat

SEQ ID NO: 135279 - DNA, 601 bp, Human
taaaaacgtttgagaccttgtttgaagtgtttaggtatttttattccacacctaatattttattcagaactttgcaagtgcataattcgagctgtgagacaaatttccctgagaattaagaaagtgttgctttgttgtcttctagcttccagtgttgctgttgaagtctaaagccattctaattcttgatcttttgtatatgattttttttctctcttgaagcatgtagagtcttcttttggtctccagtgtagtgatatctcacaatgttatgccctttcctagatacttactgacttccattttgaaaaattttctttagttatttgatgatttcccttcctcttttttctatttttggtactcctgttacgtgaatgttgacatcctggtctagtctcattttatctttttttcccctgttttctgttttaagttttttttgctgtactttttgagaaatttcttcaactttatgagtttttcatttctgctgcaatttttaatttccaggagctcatttttgttttcagagtactcatttttagagcactttacttttataaagattgcagtctgttttggtacatatacgttatta

SEQ ID NO: 135280 - DNA, 601 bp, Human
tggtattctatctattgaaagagtgagattttcttttctatcaatcattcaggactcatggatttttcttttattcatttgtagtcaatgagttataattgttcttttgtttagtttttaatgttatgtggccttttaaaatgagttagggagtgtttttttctagtctctggatgactttgtgtaagagtgaaattatctacttttggccgggcatggtgcacatgcctgtcaatgctttgggagaccgaggtgggcagatcacctgagatcaggagttcaagaccagcctgggcaacayggtgaaaccctgtctctgctaaaaatacaaaaaaaaaaaaaaaaaaaaaaagggaaaaaaaaattagccgggcgtggtggcacataactgtaattccagctactctggaggctgagacacaagaatctctcaaacccgagaggcggaggttgcagtgagccaaaatcgcgccactgcactccagcctgggcgacagagtgaaactctgtcttaaaaaaaaaaaacaaaactacctactttgaaagattggaatggatgtgttcatgaattgtctttttaaaaaatgcctggatccggagg

SEQ ID NO: 135281 - DNA, 601 bp, Human
agattttcttttctatcaatcattcaggactcatggatttttcttttattcatttgtagtcaatgagttataattgttcttttgtttagtttttaatgttatgtggccttttaaaatgagttagggagtgtttttttctagtctctggatgactttgtgtaagagtgaaattatctacttttggccgggcatggtgcacatgcctgtcaatgctttgggagaccgaggtgggcagatcacctgagatcaggagttcaagaccagcctgggcaacatggtgaaaccctgtctctgctaaaaatacaaaaaaaaaaaaaaaaaaaaaaagggaaaaaaaaattagccgggcgtggtggcacataactgtaattccagctactctggaggctgagacacaagaatctctcaaacccgagaggcggaggttgcagtgagccaaaatcgcgccactgcactccagcctgggcgacagagtgaaactctgtcttaaaaaaaaaaaacaaaactacctactttgaaagattggaatggatgtgttcatgaattgtctttttaaaaaatgcctggatccggaggggaggagccaagatggccgaatagg

SEQ ID NO: 135282 - DNA, 601 bp, Human
attttcttttctatcaatcattcaggactcatggatttttcttttattcatttgtagtcaatgagttataattgttcttttgtttagtttttaatgttatgtggccttttaaaatgagttagggagtgtttttttctagtctctggatgactttgtgtaagagtgaaattatctacttttggccgggcatggtgcacatgcctgtcaatgctttgggagaccgaggtgggcagatcacctgagatcaggagttcaagaccagcctgggcaacatggtgaaaccctgtctctgctaaaaatacaaaaaaaaaaaaaaaaaaaaaaagggaaaaaaaaattagccgggcgtggtggcacataactgtaattccagctactctggaggctgagacacaagaatctctcaaacccgagaggcggaggttgcagtgagccaaaatcgcgccactgcactccagcctgggcgacagagtgaaactctgtcttaaaaaaaaaaaacaaaactacctactttgaaagattggaatggatgtgttcatgaattgtctttttaaaaaatgcctggatccggaggggaggagccaagatggccgaataggaa

SEQ ID NO: 135283 - DNA, 601 bp, Human
acagagtgaaactctgtcttaaaaaaaaaaaacaaaactacctactttgaaagattggaatggatgtgttcatgaattgtctttttaaaaaatgcctggatccggaggggaggagccaagatggccgaataggaacagctccggtctacagctcccagcgtgagccacgcagaacacggtgatttctgcatttccatctgaggtaccaggttcatctcactagggagtgccagacagtgggcacaggtcagtgggtgcgcgcacagtgcgtgagccgaagcagggcgaggcattgcctcaytcgggaagtgcaaggggtgagggatttccctttccgagtcaaagaaaggggtgacagacggcacctggaaaatcgggtcactcccacccgaatactgcgcttttccgacgggcttaaaaaacggcacaccacgagattatatcccgcacctggctcggggggtcctacacccatatagtctcgctgatggctagcacagcagtctgagatcaaactgcaaggcggcagcgaggctgggggaggggcacccgccattgcccaggcttgcttacgtaaacaaagcagccgggaagctcgaac

SEQ ID NO: 135284 - DNA, 601 bp, Human
ttgtagggctcaaaaaattttttaaatgaaagtggttattgcatgattttttctcctttatgctgagccttgaggaagaggaactgggaacaaaaaaaacgaagagaaatatggcctttccttggaaaattgagcagggaggttcacaattaatttaatacctcaagttttgtttaagtaatgggaaaagtttttgtacatttgtttaatataaaaagcattgtcactaattttggtaatgggcaagccatgatctttgagcctctgaccttttaggattacatttcttttaagtcttctsttgattattaactttatttctgagcacatgctgagattgttagtaagagcatgctaaatctaacctctttttcttttttggtagtgtgataagattgtggtaccagggctgagccttaactgtaatgtatatgaatctaagcaagataatcatcaatctggcttggtatacatgacataggaagtcaggtcagatgatagttgcaattctagctggttaacaacttttcttaaaaggtgttcagtaatggattcatttttctagaaacattaaggtaggtttcttagaatatgacatatg

SEQ ID NO: 135285 - DNA, 601 bp, Human
aattttggtaatgggcaagccatgatctttgagcctctgaccttttaggattacatttcttttaagtcttctcttgattattaactttatttctgagcacatgctgagattgttagtaagagcatgctaaatctaacctctttttcttttttggtagtgtgataagattgtggtaccagggctgagccttaactgtaatgtatatgaatctaagcaagataatcatcaatctggcttggtatacatgacataggaagtcaggtcagatgatagttgcaattctagctggttaacaactttycttaaaaggtgttcagtaatggattcatttttctagaaacattaaggtaggtttcttagaatatgacatatggctatgtttattttgttctagtcagtgcatttattgatgacttgtcaacattatgaatatgtcagtctgaagagatgttacatgatagaattagagtctaaaagatttcagcatgctgagatagataatctaaaatttgatagagataaatgtgaagtcctaaccctgggtttcagacaatagtggtgacatgttttgcaggccatacctacagagttgagtatattt

SEQ ID NO: 135286 - DNA, 601 bp, Human
ggaagtcaggtcagatgatagttgcaattctagctggttaacaacttttcttaaaaggtgttcagtaatggattcatttttctagaaacattaaggtaggtttcttagaatatgacatatggctatgtttattttgttctagtcagtgcatttattgatgacttgtcaacattatgaatatgtcagtctgaagagatgttacatgatagaattagagtctaaaagatttcagcatgctgagatagataatctaaaatttgatagagataaatgtgaagtcctaaccctgggtttcagacartagtggtgacatgttttgcaggccatacctacagagttgagtatatttaagaagttaagtatgtgtctaaagtttgatgtggttatcagaaaagttaatgcaatcctgcctgtgtttatgtaagcatagtgtccagaacagttaaggtaatagcttctctgtactgtagtccttgttttgttcttggcctcatattatgagatactgaatttggagggtgatgaggatgatataacaaatgaatcattgaattaacttcaggtgaaaacttatattcaatataatgattatctttgaatc

SEQ ID NO: 135287 - DNA, 601 bp, Human
gtgttcagtaatggattcatttttctagaaacattaaggtaggtttcttagaatatgacatatggctatgtttattttgttctagtcagtgcatttattgatgacttgtcaacattatgaatatgtcagtctgaagagatgttacatgatagaattagagtctaaaagatttcagcatgctgagatagataatctaaaatttgatagagataaatgtgaagtcctaaccctgggtttcagacaatagtggtgacatgttttgcaggccatacctacagagttgagtatatttaagaagttragtatgtgtctaaagtttgatgtggttatcagaaaagttaatgcaatcctgcctgtgtttatgtaagcatagtgtccagaacagttaaggtaatagcttctctgtactgtagtccttgttttgttcttggcctcatattatgagatactgaatttggagggtgatgaggatgatataacaaatgaatcattgaattaacttcaggtgaaaacttatattcaatataatgattatctttgaatctttaaatgatattttgggcttattacatgtagattcagaggccagagttagagtcaa

SEQ ID NO: 135288 - DNA, 601 bp, Human
tttgtagttttagtagagatggggtttcaccatgttggccaggatggtctccatctcttgaccttgtgatccacccgcctcggcctcccaaagtgttgggattacaggcgtgagcctctgtgcccggccagaaacagaattttagcagtacagtcgtctgtcagtatttggggggaattcgttctgatactcccctcaaataccaaaatctcaggatgctcaaagccctgcagtcggccctgaggatatggaaggcagactgtacttcagggcctcccatgtctctctctaattgcatctktctctcacccacatgctatactgcattttgcagaaattattcccttcctttctttatattttatcacatatgataggtcccttaatgatctataatctggcttttgattgcttttgtattttgtataaatggaatcatgctatatgcattcttcttgattttctcgtgcacagcattatgtttttgagattcatttatgttgatgcacatagctgtagttaattcagttttactgcttgttgaatttgattgtttgcctgtaccacattcttttacagtccattttactttcgacgtttg

SEQ ID NO: 135289 - DNA, 601 bp, Human
aggcagcgcgtctggagttgttcgttccttctggtgggtttgtggtcttgctggcttcaggagtgaagctgcagaccttcgcggtgagtgttacagctcataaaggtggcgcggacccaaagagtgagcagcagcaagatttattgtgaagagtgaaagaacaaagcttccacagcgtggaagggtacctgagcgggttgccactgctggcttaggcagcctgcttttattcccttatctgaccccacccacatcctgcagattggtccattttacagagagctgattggtccgttttacwgggggctgattggtccattttacatagcactgattggtccgttttgacagagtgctgattgctgcatttacaaacctttagctagacacaaaaggtctccaagtcccctacccaattagctacacacagagcgctgatgggtgtgtttataaacctttagctagacagagtgctgattggtgcatttacaaacctctagctagacacagagtgctgattggtgcgtttacaaacctttagctagacagaaaagttctccaagtcacctaccccattagctagacacagagcgctgattgg

SEQ ID NO: 135290 - DNA, 601 bp, Human
attggtccgttttgacagagtgctgattgctgcatttacaaacctttagctagacacaaaaggtctccaagtcccctacccaattagctacacacagagcgctgatgggtgtgtttataaacctttagctagacagagtgctgattggtgcatttacaaacctctagctagacacagagtgctgattggtgcgtttacaaacctttagctagacagaaaagttctccaagtcacctaccccattagctagacacagagcgctgattggcacatttacaatcctttagctggacataaaagytctccaagtccccacccgatctttaggtagacacaaaagttctccaagtccccaccggattagctagacacagagcactgattggtgtgtttacaaacctctagctagacacagagtgttgattggtgcgtttacaatcctttagctagacagaaaagttctccaagtccccacccgacctagaagcccagccggcttcacctctcaatggcacttgcctcgggaccttgcggcacctagcctgggcactctggcagcccagagggagcttgttccctgatgaagcccagcaggcaccag

SEQ ID NO: 135291 - DNA, 601 bp, Human
gacacagagtgttgattggtgcgtttacaatcctttagctagacagaaaagttctccaagtccccacccgacctagaagcccagccggcttcacctctcaatggcacttgcctcgggaccttgcggcacctagcctgggcactctggcagcccagagggagcttgttccctgatgaagcccagcaggcaccagccggccttgccaagtgcccacccgtgcctccccctccccacctccccgctagcagagggagctggctccggccttggccagccccagagaggggcccccacagtgcaktggcagactgaagggctcctcaagcagggccagagcggatgtcgaggccaaggaggtgctgagagcgggtgagggctgctagcacgttgtcacctctcactaccagcagaggatgagaattcccttagcttctcatccttgccagtacttgggttttgtccttgtttttgacttttgccaatttcgtgagtgtggatggtatctcattgtgattttaattttaagttttctgattcttaatgaggttgaatatcttttcacatatgttgttcttatatgtttcctcttttatttctattt

SEQ ID NO: 135292 - DNA, 601 bp, Human
cagtcttacgtttgatctcctaaatctttatagtttttgactttcacatttaggtcttcaattcattatgaattaaggaaatcatcaaacagaaaaggagaaaaatgatggacctctacccatttattcatcttcaaaagtctaattctgttacctttttttgggaagtatttaaagcaaatcccagcatcaagtcaccttacctgttaagatttcagttttgctgatattttttctgcttggtatatgagttgctgagagaggtgtgttaaaccctatcatggtggatttggcaatttcrttttttttttttttctttctttctttcttttttttttttttttgagatggagtcttacactgttgcccaggctggagtgcagtggcgctatcttggctcaccacaacttctgcctcccaagttcgagtgattctcctgcctcagcttcccaagtagctgggattacaggtgcctgccactacacccaactaattttttgtgtttttagtagagatgggtttcactacgttggccaggtgggtctcaaactcctcacctcgtgatctgcctgcgtcagcctcccagagtgctgagattgat

SEQ ID NO: 135293 - DNA, 601 bp, Human
aagatttgtcttaaatagaattatgttctaccttagcgcatagcaggtactatttcacttttagctataaacaatttggcttcagtattgcttttgaaaagtcagtttccctgttattcttacttcgctgaaggtaatctttctcttctttctggctgcttttaaaatattctttttctcattataaaattccactatgatatttcagtatgtggatccatttttagtaatcctgtttgggattcattgggcttcttggatatttagatgagtatcttttttagttttagaaagtttgaaragaagttgctgagaatattttcctgcctcattttcttaactcctggaatgctaatgagatttttgttagatcttctgactcttccatctctctctctctcttttttttttttttttttttttgagacagcatttcactcttgttgcctaggctggagtgcagtggtgtgatcttggctcagcgcaacctccgcctcctggcttcaagcgattctcctgcctcagcctcctgagtagctgggattacaggcatgtgccaccatgcctggctaattttgtatttttagtagagacagggtgt

SEQ ID NO: 135294 - DNA, 601 bp, Human
tgaccccacatttcccttccacgctgccctagcagaggttctccatgagggccccacccctgcagcaaacttctgcctgggcatccaggcatttccatacatcctctgaaatctaggtggaggttcccaaaccccatttcttgacttctctgtacctgcaggcttaacaccatgtggaagctgccaaggcttggggcttgtaccctctgaagccacagcccaagctctacattggtccctttcagccatggctggagcagctgagatgcagggcaccaagtccctaggctgcacagagcayggggatcctgggccctacccaggaaaccatgttttcctcctacaatgggaggggctgccatgaagacctctgacatgccctggagacattttccccattgttttggggattaacattcgactgcttgtaacttatgcaaatttctgcagctagcttgaatttcttctcaaaaaatgggattttcttttctatcacattgtcaggctacaaattttccgaacttttgtgctttgcttcccttataaaactgaatgcctttaatagcacccaagtcacctcttgaatgttttgctgcttaga

SEQ ID NO: 135295 - DNA, 601 bp, Human
agtaggttttatttacacaaggtctcatgtagtaaaggttggagcagaggctggattccaggtcccttgacttcaaggccactgctctttttgcttgttttcacatccattattttgtttgattcttataactgctctttgataggtaaggaccaatgggaagattgaggatcaatgaggttgtatctggttaactgaaacaggtctatatctttggccttctaggccaggacctctatataattgctgaattacaagtgcatcatctatccatttgtttggttgcaccattaaaagataygtgatctatcttttatacctaatttctaaacaatatgtaaaatgggagtgataatagtacctgtttcctagagtttcataaaaactaaatgagataatatatgttaagtgctttgaacagtatcggatatacttgtaagtgttcaacaaatggtagctgttatcattgagtaatttgttacttctcttacttgaatcatatgaaacctgagttagttataacccatgagctgctgaaatatgtctcctatgttgaaacaaaatgctgtatttaaaatagaaaatttcctgtattctcgta

SEQ ID NO: 135296 - DNA, 601 bp, Human
tattttgttctcacagcatttataggaggcccttagtaaatatccacgtctgcaacacacagccaagattgggtaggtaaggcagtgatctggggatggaggctacaaaatgaaaagcaggaacacagcaccagcaagaagctggaaagattggaagatagtgctcagtaagaaatgtcttttaaaacttagctcttagagaagagtgcttgtgaaatggagcatttgtatgtctagaatagctgctgaattagagcttttcttgggctgttggaaaacctgtggtaaatattgaaattgrggtgttagaagctctgttgtagatgttgaagtcataaaggatatgattgagcatgagttgtatgggagatgggtatgtggcatttagaaaacatgtatctatgatatgtaaacagaatagtataataaacctcatatatccagtacccaccttcagcagctgtcagcattgtcattctttgtctgtatacttccacccgtgtgattatcattattctcattttatggtttttaaaggtgtaatttatagcactgaaatgcacaaatcttgaccaatgaatatacttcacatataccacat

SEQ ID NO: 135297 - DNA, 601 bp, Human
atctgtttcctacacatctcctaggatagcttggagaaataatactgtaatggctaagagcttgctctctggagtcagacttggtctatatctaatagctgtgcgtgttgatttctgtgagcctcactgatcacatctgtaattagggacagtaatatctactacctaagatcactatgaatattaaacactatgttactgagttcattatcagtgttattatggttatttttaatacttttgtttcctagtttcatgttgagtaacctggctgtgctcaacagtctcaccattggtgagwtagttatctgtcttgttatttaatattatggttcataagtgacatcagtaggatattctttcatttaatagttattaattgagtgccctactatgtgccaggtgctttcacatatttatgttatttagtcctcataacaaccaagtttaccctcattttgcagatgaagaaactgaagctgcaggagttttgcccatatagaatggcagaacagcgactggaattcagcctttctgaccctaagtgctgctccttccctttgtaccatgattctagaattcttttctgcttccttgcttt

SEQ ID NO: 135298 - DNA, 601 bp, Human
aagtgattcttgtgcctcagcctcctgagtagctcggcttacaggtgtgcaccccattcccagttaatggattatgtactaaccttttaattggtcacctgatatatatatatggtcttcctagttcccctgccccattatcttgtatgctggtatccaattaattattttaatatctttattgagattccatttacatgccattaagttcatctgtttaaagtgtgcaattcagtggtttttagtatgtttacagagttgtaaaagtgttaatcataatctaattttagaacattttctrcacccctaaaagaacctccacacccattattagtcagtcactccccattcgcttaaccaccagctctaggcaactactctcaactaattttcatgtaaaacccggctttccctgtgctgctcttcaaaaggcctttagtgtcttccttgtccatacgatgaagaaaacatgtctcacctagaattcaaatttttccataatctagttttagcctacttttccaactttgacatatacccttcgccagtctgaatgtatcactctacctgggttgctactgtttattcttgagaatgccat

SEQ ID NO: 135299 - DNA, 601 bp, Human
cagtggtttttagtatgtttacagagttgtaaaagtgttaatcataatctaattttagaacattttctgcacccctaaaagaacctccacacccattattagtcagtcactccccattcgcttaaccaccagctctaggcaactactctcaactaattttcatgtaaaacccggctttccctgtgctgctcttcaaaaggcctttagtgtcttccttgtccatacgatgaagaaaacatgtctcacctagaattcaaatttttccataatctagttttagcctacttttccaactttgacrtatacccttcgccagtctgaatgtatcactctacctgggttgctactgtttattcttgagaatgccatgtgcattataccttccctttgccttccaccattcctctgtctaaatctatttatgctctgagtcttaacttaagtcctaccctatcaataaatcctttagcctacagtgaattctcctttcaatttgaacttccatagcacctagtgttataaaaccatcttttgccgtttaattgtaaactgccacatgggaccccttccccttgtgttattcagcttttcatgtgtatat

SEQ ID NO: 135300 - DNA, 601 bp, Human
agtatgtttacagagttgtaaaagtgttaatcataatctaattttagaacattttctgcacccctaaaagaacctccacacccattattagtcagtcactccccattcgcttaaccaccagctctaggcaactactctcaactaattttcatgtaaaacccggctttccctgtgctgctcttcaaaaggcctttagtgtcttccttgtccatacgatgaagaaaacatgtctcacctagaattcaaatttttccataatctagttttagcctacttttccaactttgacatatacccttcsccagtctgaatgtatcactctacctgggttgctactgtttattcttgagaatgccatgtgcattataccttccctttgccttccaccattcctctgtctaaatctatttatgctctgagtcttaacttaagtcctaccctatcaataaatcctttagcctacagtgaattctcctttcaatttgaacttccatagcacctagtgttataaaaccatcttttgccgtttaattgtaaactgccacatgggaccccttccccttgtgttattcagcttttcatgtgtatatgctgattttct

SEQ ID NO: 135301 - DNA, 601 bp, Human
ttaatcataatctaattttagaacattttctgcacccctaaaagaacctccacacccattattagtcagtcactccccattcgcttaaccaccagctctaggcaactactctcaactaattttcatgtaaaacccggctttccctgtgctgctcttcaaaaggcctttagtgtcttccttgtccatacgatgaagaaaacatgtctcacctagaattcaaatttttccataatctagttttagcctacttttccaactttgacatatacccttcgccagtctgaatgtatcactctacctrggttgctactgtttattcttgagaatgccatgtgcattataccttccctttgccttccaccattcctctgtctaaatctatttatgctctgagtcttaacttaagtcctaccctatcaataaatcctttagcctacagtgaattctcctttcaatttgaacttccatagcacctagtgttataaaaccatcttttgccgtttaattgtaaactgccacatgggaccccttccccttgtgttattcagcttttcatgtgtatatgctgattttctaaattgactataagcttcttgagggc

SEQ ID NO: 135302 - DNA, 601 bp, Human
aatcctttagcctacagtgaattctcctttcaatttgaacttccatagcacctagtgttataaaaccatcttttgccgtttaattgtaaactgccacatgggaccccttccccttgtgttattcagcttttcatgtgtatatgctgattttctaaattgactataagcttcttgagggcaaggaccatgcatgctttttttttttttttaatatcctctgtagcttagctgagcatgtagctatgtccagaaatagtatgtacgtttaatgggatgaataaagttggcattgagcggaatrttagactctgtgaattcggacgttgtcacaggattcaaagccttattagacatgttcatgttttatatagcctcactttgcctacagcttgataccacattctttcattaattcattcagtatatgtttattggtgccatacttttcttattaatttctcaaaaccttgtttttaatttggttaacttcctctgactgctttcacctagctgagttctcttatagctttcagctctgcattattcttgaaattccttgctgtttaaagaacttcttatggtagattagtacattaccaca

SEQ ID NO: 135303 - DNA, 601 bp, Human
ggataggactactgcagacagcccagttcactaaggaattcaagatggaaacctttattggataataattttgtcaatggaaaacaacaaagatacaatttataactgttttttctccctttaccaggagaaaattagaatttattcatttaacaaacatttgttgagcacggaacaatacttggtaatacttatttattaagtacttattgtttgccaggcatttttctaagttctgtacacacttacatacttaatacactaaatatattatctcatttaggcctcaaaacaaccctamaagaagtagacatcactgtcatcttcatttctcagattaaaaacctgagggccagaaatagttaagtaactgcctttgggtcacacagctagagagtgttgtaaccaggattcaaacctaggcagtctggccctagagctgtgtgcttagccattatatgtactacattctaaatgttaggagttatacagaaacgaataacacaagcagctagattattaaggagctcacagtcttatggtagaggctgacttaaaaaacccaaatagcaataaaacaggcagtattgtgagtgttata

SEQ ID NO: 135304 - DNA, 601 bp, Human
agcagcccaaaagagagcttgatttcttttgcaatggcagaattatagtatgggagctggaagagaccttataagccctttgatgacagaatatgttttcatttttgtattcccagcacctaacagagtacccagcatatacaaggtgatcagtagatgataaattagtgatctgttttgcactttccattatgatagctactaggctcgtgtggctattgagcacttgaaatgtggctagtcagaatttagatcttttgtgggtgtaaaatatcagaatttggagacttattttaaaaastaaaaatatctcaatttttaatattggtagtatgtgaaaatgatatttattggctatattggattaaaatatatgattaaaattaatttacttgtttctatttactttttaaaatctgggctactagaaaatataaaattacatatgtgtcttgtactatacctatgttgggtagtgctggtctcattcagttccctcagagagaagaagtgatttgaacgaggtcacaaagcagtaaagacattttttaaattgagaatttatatgttaggttccctgacttttaggtctattctcttt

SEQ ID NO: 135305 - DNA, 601 bp, Human
attaaggtttttttctgtctatatgtaaattttgatcctcagaaaatccgcgtttttggttctcagggtttttttacacttggcacctctattctcacttctcccttgatcttcctcttgatcttctccatacacatacatataactcactatttcattcctttttaatttgtttccattaacattaaaaaattttattaataccttttatttgtattttggggagataggccctgtgatgttacatgatgtgctatataaatagctggttgttttggtggtattgtacatgcatttgttrtctcctttagtcctctcaaaactgcatgaagtataggtcctattattctgaatttatagttatgaagtctcaggtttaagagggtagtatactgcaggtacggctgtagtgcacagagtctgttagctagaactgtgtaagatagaaatggcaggaagcctggggatttttcctgcacatggacaggcctgtaaatattgcggaattctgggtcctttgagcttaggattaatgtattggtgcatataccaaaaaaagtacaaaaatccattcccaaatttatttgtgtatgtgtgtgtg

SEQ ID NO: 135306 - DNA, 601 bp, Human
ttactgcatccatggaaaatgtgaattcatctattctactcagaaggcttcttgtaggtaagtcagcgcttccagatcagtggtgagcattttttttcatcaatggttgttgctctatagaagggaatgaaatgtagactaaatattaccagaaagtagtgtttatttgcagtagacaagtaaaaaacaaatcagcagcatcatttggaaaaaaaaactggcaagtaatatgcagaaaacaaaaatcttttttttttttagggcttaacattttaaatataatactatacatttttaatayaaaaaataaatgtgccacattccaacactattttggtttttaggcaatctgtcacaaggtggctgagggactaaagactgtattaagaacagagaacatgtaactcaaataaaatatgtgctaaaatagatttctaaaaataaggggatggggacgaagaaccaggtgtgaattgagagatgaaaatggaaagggcgtaaatcctcaaatccctgattccagagaggttatgtaacttgttcaaggtcaacagcaagttagaaatagagctgggaaaaaactaagtctcagactttccga

SEQ ID NO: 135307 - DNA, 601 bp, Human
gtcttgaactccttagctcattaaatctgcgtgcctcagactcccaaagtgctaggattacaggtgtgagccattgctcctggcccaggccaatttttaaactaaatcttatagtgggctcttcatgtttgtcctacagtggcatggatagcttgatagaagtttggatcttgtcctcttaggatggtgcgtctttcaagatacttaaatgaaggacgagagagaggatcatgttctggtaatgatgtgatacaaggtcattttctagtattttactaactgaaagtaagaggattgaatsgtgtacaggttaaaggctttgaaattggatacactgacctggccaattattagctgtgtgttctttggaagttacgtaaaatatctaagcctcattttcatctttctgaaagtagaatagtaatagtacctatctcatgttgttaaaattaagtgagataatatatgtaaagtgcttagcctgatacctggtatgtagtatgtacttaatgaatagcaattgatatcattatactctaagcccgttagtcaggggctctttgttttgttaaccactattttccctgtgcctagtatagga

SEQ ID NO: 135308 - DNA, 601 bp, Human
aaaagcagttgatctttttcttttgtctgagtctgtgcagtgtctataggaatcaggccatgatatcatgtgcacttctgctagtaggtaggtgtgtttgcatagcagtaaacaggcaaggataaacagcctttagccacagtcctattgttaggttaaaatcttctagcattatggtaccactgatttttcgttttgtttttgttttgagatgaagtcttgatctgtcacccagactggagtgcagtggagcaatctcggctcactgcaacctccacctcccaggttcaagcgattctcytgcctcagcctcccaagtagctgggattacaggtgtgtgccaccatgcctggctaatttttctatttttagtagagacagggttttgccatgttggccaggctagtctcgaactcctgacctcaggtgatccacctgcctcagcctcccaaagtgctgggattacaggcatgagccaccgcacctggcctgatttattttttgattgattgattggttgattgacttattaatgccaaattctccctgatattggggtgtcaaattcaactatgacagagatccagggatcttgccttta

SEQ ID NO: 135309 - DNA, 601 bp, Human
tgaagacatacatttgagaatcattccctctctagcatatccattttactttctacctagcaattcttctatcccactagccctcccatttattgatcctatcaccttttccgtgtccctccctggatattctcttcccctcgttagtgtaaattccatggccagtcattgtagttccctttgcatttgaatcccacattcctctattgcttcatcatactcacttgccaaaactgtagtcctggttcctcccagctctccacccactgcatacctatacatgcagttgatcatggctgtyggtgaaaagcacaccaccggttaactcgtctcactgacataccgatcggtctcaaggtgggccctttatgctgccctggcagtcattctacacctgcagtttatacattctcctcctctcctgtatgatttctttgtaccttctcctctctcctcagattagcagtacctcctctctcatcctcactcttgcctgttgatcttctttccaagttcactgagaaaatggaagcaatatgagaacttgcacactttcactatcacctaccagcaagcctctccctgtttctctgtatcatag

SEQ ID NO: 135310 - DNA, 601 bp, Human
agacagtgagtgcccccgccttttttcttttttcttttttcttttttttgagacagggtctcactctgttgcccaggctggagtgcagtggtgtgatttcaggtcactgcagcctccacctcctgggttcaaatgattctcatgcctcagcctcctgaatagctgggattacaggcgtgcaccaccacacctggctattttttgtatttttagtagagatagggtttcagcacgttggccaggctgatttttgcatttttttgtagacagtttcatcatgttgcgcaggctggtctcgaaytcctgacctcaggtgatccacctgccttggcctcccacagtgcagagtgaaccttttaaaataaaagtcagttcgtatcattcctctgctaaaatccttccagtggttccttcatctcactaagtgcagaaggccctacagttttgtctcttcacctctctgtctggctctcctctccctcaccccctcttctgcagccacacttgctgttcttgggcatgccatgcatgcatggatgctcccactttaggggacttgcactggctcttcctttgcctggtatgctgtcctccaattgtt

SEQ ID NO: 135311 - DNA, 601 bp, Human
tcaactgtcctccctccctccttccttccctccctctcttccttccttccttctccattggtgtttaatatatgcacagagttgtgcaaccatcaccacaatcaattttagtacattttcatctcctcaagaggacacctcataccctttagcttttactcccaaatcccctcatgctctctagctctaggcatccgctaatttattttctatctctatagacttacctattctggatagttcatgtaaattgaactatatagtatggggtctcctgtgtctagctttttttaacttagcrtaatattttccaggttcatccatgtcataacacatatcagtacttcattcctttttgtggctgaatactattccattgtatggatgacaccacatgtttttaatctactcatcatcagttgatgaaaatttaggttctttccactttatggttattatgaaaaatgctgctctgaatgatcatttgcaagtttttgtgtgaacgtgttttaatttcacttgggtaaagcttagtggtagaattgctgggccaaatggtaaccctgtgtttaacattttgaggagctgccagaccgttttc

SEQ ID NO: 135312 - DNA, 601 bp, Human
atggggtctcctgtgtctagctttttttaacttagcgtaatattttccaggttcatccatgtcataacacatatcagtacttcattcctttttgtggctgaatactattccattgtatggatgacaccacatgtttttaatctactcatcatcagttgatgaaaatttaggttctttccactttatggttattatgaaaaatgctgctctgaatgatcatttgcaagtttttgtgtgaacgtgttttaatttcacttgggtaaagcttagtggtagaattgctgggccaaatggtaacccygtgtttaacattttgaggagctgccagaccgttttccaaagtggctgcaccattttacacaccctacagtacctttgacaacacttgtaattatctgactttttgatttaggctatcgtagtaactgtaaaaactggcatatacggtggctttgatttttatttccatgatggctaatgatgttgagcatcttttcatgtgcttattggctatttgtatatcttctctggagaaatgtcagtacacatcctttgctcttttattttttggctattattgagttgtattagttatttatat

SEQ ID NO: 135313 - DNA, 601 bp, Human
tagcgtaatattttccaggttcatccatgtcataacacatatcagtacttcattcctttttgtggctgaatactattccattgtatggatgacaccacatgtttttaatctactcatcatcagttgatgaaaatttaggttctttccactttatggttattatgaaaaatgctgctctgaatgatcatttgcaagtttttgtgtgaacgtgttttaatttcacttgggtaaagcttagtggtagaattgctgggccaaatggtaaccctgtgtttaacattttgaggagctgccagaccgytttccaaagtggctgcaccattttacacaccctacagtacctttgacaacacttgtaattatctgactttttgatttaggctatcgtagtaactgtaaaaactggcatatacggtggctttgatttttatttccatgatggctaatgatgttgagcatcttttcatgtgcttattggctatttgtatatcttctctggagaaatgtcagtacacatcctttgctcttttattttttggctattattgagttgtattagttatttatatattctagatataagtcccttatcagatatatg

SEQ ID NO: 135314 - DNA, 601 bp, Human
aatgtccaatcaagctgattaacatatgcattacctcacattgttaccacttttgtggtgagaacacttaaaatcctcagcattttccaagaatacactgcattgttaactatagtcaccatgttgtacactacatttcttgaacctattcctcccatctaactgaaatttagtatcccctgaccaacatgtcctcaaagcacctcctaccacaccagtccctggtaaccactattctactctctacttctatgagatcaacttttttaggttccacatatgagtgggatcactcagtatwtgtctttctatgcttggcttatttcacttaatataatgttctggaggttcatccatgcaaatgataggatttccttcttttttatggctgaatagtattccattttgtatatatacctcattattttatccatttatttgttaatggacacttagattaaatccatatcttagctattgtgaataatgctgcaataaacgtggtagtgcagatatttcttcaatatactgattttatttcctatagttatatacccagtaatgagattgctggatcatatggtagttttatttttaattt

SEQ ID NO: 135315 - DNA, 601 bp, Human
gcaataaacgtggtagtgcagatatttcttcaatatactgattttatttcctatagttatatacccagtaatgagattgctggatcatatggtagttttatttttaattttttgaggaacttccatacggttttccataataactgtatcttatgttttttttcttcagagttttatagttttagctcttacgtttagatctgcgatccattttgaggcaatttttgtgtatgacacgaggaagaggtctagcttcatccttttgtgtgtggatatccagttagcaccatttgttgaagaracagttctttccccattgagttatcttagcacccttgtcaaaaccaattgaccatagatgtatgggtttatttctaggctctccattctcttccatgatccacatacctgcccactgcttgtttttttttgtttgctggaaagcgtagagcccaatgtgaaatgtactgggaagtgtctaggaacctcagggactggattggtagacttgcagcacccctggatttccctgtttccctcctcccacatttcttttttgttgttttaatgtgtgctttgcgataagctgcctcaaattctt

SEQ ID NO: 135316 - DNA, 601 bp, Human
tacctccttgactgcttgacattgtttctgttattaataacttattttcatcttccccttgcatcttacatgtttatattttatacactgaaaagtgtcttgaatataatttggtgctatgttcagaggactgtaaatgtttatacctattttttcaatagtcttaattttcaggtacttagccctaaggaataacactaaatatagaaaagcgcatattcaccaagatgtttaccacatctaatttataattgtgaaaaattgaaaataactgacatgtcttagaactgggaatagataatgctagctatattatagtcactggatggagtattatatttctgttttgaaattatatgtatctattttgaaaaaaatgctaagagagtagattttaagtgttctcaccacagacatgataactatatgaggtaatgcatatgttaattagcttgatttagccattccacaatgtctatacatttccaaatatcatgttgtacatcagtggtccccaacctttttgttgccagggactagttccgtacaagacagtttttccatggactggggattgggggtgggggtgatggtttgggga

SEQ ID NO: 135317 - DNA, 601 bp, Human
ctgttattaataacttattttcatcttccccttgcatcttacatgtttatattttatacactgaaaagtgtcttgaatataatttggtgctatgttcagaggactgtaaatgtttatacctattttttcaatagtcttaattttcaggtacttagccctaaggaataacactaaatatagaaaagcgcatattcaccaagatgtttaccacatctaatttataattgtgaaaaattgaaaataactgacatgtcttagaactgggaatagataatgctagctatattatagtcactggatrgagtattatatttctgttttgaaattatatgtatctattttgaaaaaaatgctaagagagtagattttaagtgttctcaccacagacatgataactatatgaggtaatgcatatgttaattagcttgatttagccattccacaatgtctatacatttccaaatatcatgttgtacatcagtggtccccaacctttttgttgccagggactagttccgtacaagacagtttttccatggactggggattgggggtgggggtgatggtttggggatgattcaagtgcattacatttattgtg

SEQ ID NO: 135318 - DNA, 601 bp, Human
agaactgtatacagtctttgaacactgtattctgggaaaataatgttagtagcaatcttttttttttttttttaagagacagggcctcactctgttgcccaggctggagtgcagtagcaattagagctcattgcagcctcaaattcctgggctcaagtggtcctccagagtagctgagactataggcgtgaaccaccctgactggctcagaatttctagaatgatctgcacatgcataggagatccatgcagaagatttttaagccctgcacaactgcaaggggttctgtgccctaagaaygtactttactcacagttagtatagtaagaaaggaagaaatcagaggctgaagatagttttattgtgatatcatggtgttaacattacttcattttcaggattgcagcgataagtaataagctttaaaattctgtattataaataaaattattcgtcataaattaaatgacttatttggagtgcagtggcataaaatgggtcttttctaaactgagtagaaatacataagtcagactgaactgggcctgagaaaagtcagagtaaatccagcaagttcgtgttgtctttgtgcttcccagt

SEQ ID NO: 135319 - DNA, 601 bp, Human
gccatctggagctgagatgataaatctagaaatgataaaaaagaaaaggttctccaagtaacagatatttttcataacacctaggcatgaaagtcagtgcgctttatttcacagaacagatgatctgcccttaggcaagactactgaatataaaattggacggtagatcaaagtagggacataatcatgtaacaaataatgataacagaaagagaagatagggaaaacacatttaacagcatgactggctgtagccatttaatatagactcagaggttaagtaatttgtctgtggtcatccgactagtaagtggaattgtctggatttggattcagtttgattcccattcattctttacactgaaaggttccatgttgagtcatcttgggaaacatgtttgcccagtatgaccattgcatgggagcagggttcaaacttgattttgtagcagtttagggtttttgagcaggggaaggacttggtataaaccatatttttcagagtattaatgagtcatctgaaaaattcattggagtagtgaacatatgaggtagggggaagaccatttaagtcattattagagttaaataggagtgaggt

SEQ ID NO: 135320 - DNA, 601 bp, Human
tctttaaaaggatgttcccactgacctgtttatcaagactgcatgagtcaatttttctttttttcttcttcttggaatcgcctttcatattttcagactcatagaatgacagattgtcaggaaccttgaacatcaccttaactaaacgccctgattttatggatttaaaaaccatggcactaggaaattggaatttttccaaggtcatggtgagttagtgacagtacaagagggttgcttgatctgtcagctagttttctcatttatgaaatggagatgattccaactctgtctacctcayacttttaaaatgaggattagtgaggtaaaaccatatacaaaatggaagtattgtcaacacttttagtcaaggcaaagctgtactctttgaaatcgaacgaaatgaggagtactcattgttataagactttctttccattaggttgtaaatttcttgctggcagagattttggaagctagtccaactcctaatttattttttacatataggagaattgaggttgcacagttagttattagcagagcccagaattcgtcttagcccccttattccacattgcatagcacagcatcttgtgtt

SEQ ID NO: 135321 - DNA, 601 bp, Human
tggtgagttagtgacagtacaagagggttgcttgatctgtcagctagttttctcatttatgaaatggagatgattccaactctgtctacctcacacttttaaaatgaggattagtgaggtaaaaccatatacaaaatggaagtattgtcaacacttttagtcaaggcaaagctgtactctttgaaatcgaacgaaatgaggagtactcattgttataagactttctttccattaggttgtaaatttcttgctggcagagattttggaagctagtccaactcctaatttattttttacatakaggagaattgaggttgcacagttagttattagcagagcccagaattcgtcttagcccccttattccacattgcatagcacagcatcttgtgtttgcaatctagtgtgcaggcacaagagcagttccaacccagtgagatttgtactgctgttgagaaacgtggtaaaatgagagcagagttaaagaatgtcccttatcctcagtgtggcagttccttatgggcttctgtggtttgccccaggagggtgtggacagcttcttttgagtcattgtctaaaatcagtagacattcctatgtat

SEQ ID NO: 135322 - DNA, 601 bp, Human
atggagatgattccaactctgtctacctcacacttttaaaatgaggattagtgaggtaaaaccatatacaaaatggaagtattgtcaacacttttagtcaaggcaaagctgtactctttgaaatcgaacgaaatgaggagtactcattgttataagactttctttccattaggttgtaaatttcttgctggcagagattttggaagctagtccaactcctaatttattttttacatataggagaattgaggttgcacagttagttattagcagagcccagaattcgtcttagcccccttaytccacattgcatagcacagcatcttgtgtttgcaatctagtgtgcaggcacaagagcagttccaacccagtgagatttgtactgctgttgagaaacgtggtaaaatgagagcagagttaaagaatgtcccttatcctcagtgtggcagttccttatgggcttctgtggtttgccccaggagggtgtggacagcttcttttgagtcattgtctaaaatcagtagacattcctatgtattcatagctgaggttaataagcacacttcttcctgatttctcccttcatctaagctcttcttgt

SEQ ID NO: 135323 - DNA, 601 bp, Human
tcaaggcaaagctgtactctttgaaatcgaacgaaatgaggagtactcattgttataagactttctttccattaggttgtaaatttcttgctggcagagattttggaagctagtccaactcctaatttattttttacatataggagaattgaggttgcacagttagttattagcagagcccagaattcgtcttagcccccttattccacattgcatagcacagcatcttgtgtttgcaatctagtgtgcaggcacaagagcagttccaacccagtgagatttgtactgctgttgagaaacrtggtaaaatgagagcagagttaaagaatgtcccttatcctcagtgtggcagttccttatgggcttctgtggtttgccccaggagggtgtggacagcttcttttgagtcattgtctaaaatcagtagacattcctatgtattcatagctgaggttaataagcacacttcttcctgatttctcccttcatctaagctcttcttgtcattttagagctgtcttctcataatgcacagggaaagtacataggccagagtcctttctcctgtcaggggtttcatgttatcagtcactgtgactag

SEQ ID NO: 135324 - DNA, 601 bp, Human
tcttgctggcagagattttggaagctagtccaactcctaatttattttttacatataggagaattgaggttgcacagttagttattagcagagcccagaattcgtcttagcccccttattccacattgcatagcacagcatcttgtgtttgcaatctagtgtgcaggcacaagagcagttccaacccagtgagatttgtactgctgttgagaaacgtggtaaaatgagagcagagttaaagaatgtcccttatcctcagtgtggcagttccttatgggcttctgtggtttgccccaggagkgtgtggacagcttcttttgagtcattgtctaaaatcagtagacattcctatgtattcatagctgaggttaataagcacacttcttcctgatttctcccttcatctaagctcttcttgtcattttagagctgtcttctcataatgcacagggaaagtacataggccagagtcctttctcctgtcaggggtttcatgttatcagtcactgtgactagggagtttctaggctggaggaagggtgggatatctgtcagggatgcatacatagtagcatagacactggtaatgagttttgcttgt

SEQ ID NO: 135325 - DNA, 601 bp, Human
cagagctcagagcctgggacccggggaccagccacaccgatggccggtggccgagagaagaggaaataagagacagcaaggtttccgagcaaggcctagagaagaggaaataagagacagcaaggtttccgagcaaggaagtagggatttccaaaaactgggggctcagtcaacatgtccagcgtttagtcagttggctaaaaggcgtctgttgtagagctgtgtttagctacgagtgcagcattatttgcagaagatctgtaagaaggaacacaaccaggatagtccctgtgcctcagtktctcctttgctgtgtgcctggcactgctacagggaatagggtggttctggaggggaaggtaaacagcaacttaacggatacatagcatcgcttcatgtactaagtggagtgaagataataaacagggtaaagggagagagggctgtggaatgcagaggtctggtggcttatgtgttagtaaaagcagaatctggactgtcatagggtaggcagacgttttttctttttaaagaaacctagttttaaagaggaaataacgtgtttttttaacttaggaaatgaaaagccatgttttagggt

SEQ ID NO: 135326 - DNA, 601 bp, Human
agagctcagagcctgggacccggggaccagccacaccgatggccggtggccgagagaagaggaaataagagacagcaaggtttccgagcaaggcctagagaagaggaaataagagacagcaaggtttccgagcaaggaagtagggatttccaaaaactgggggctcagtcaacatgtccagcgtttagtcagttggctaaaaggcgtctgttgtagagctgtgtttagctacgagtgcagcattatttgcagaagatctgtaagaaggaacacaaccaggatagtccctgtgcctcagttkctcctttgctgtgtgcctggcactgctacagggaatagggtggttctggaggggaaggtaaacagcaacttaacggatacatagcatcgcttcatgtactaagtggagtgaagataataaacagggtaaagggagagagggctgtggaatgcagaggtctggtggcttatgtgttagtaaaagcagaatctggactgtcatagggtaggcagacgttttttctttttaaagaaacctagttttaaagaggaaataacgtgtttttttaacttaggaaatgaaaagccatgttttagggtt

SEQ ID NO: 135327 - DNA, 601 bp, Human
agctcagagcctgggacccggggaccagccacaccgatggccggtggccgagagaagaggaaataagagacagcaaggtttccgagcaaggcctagagaagaggaaataagagacagcaaggtttccgagcaaggaagtagggatttccaaaaactgggggctcagtcaacatgtccagcgtttagtcagttggctaaaaggcgtctgttgtagagctgtgtttagctacgagtgcagcattatttgcagaagatctgtaagaaggaacacaaccaggatagtccctgtgcctcagtttckcctttgctgtgtgcctggcactgctacagggaatagggtggttctggaggggaaggtaaacagcaacttaacggatacatagcatcgcttcatgtactaagtggagtgaagataataaacagggtaaagggagagagggctgtggaatgcagaggtctggtggcttatgtgttagtaaaagcagaatctggactgtcatagggtaggcagacgttttttctttttaaagaaacctagttttaaagaggaaataacgtgtttttttaacttaggaaatgaaaagccatgttttagggttga

SEQ ID NO: 135328 - DNA, 601 bp, Human
gtcagttggctaaaaggcgtctgttgtagagctgtgtttagctacgagtgcagcattatttgcagaagatctgtaagaaggaacacaaccaggatagtccctgtgcctcagtttctcctttgctgtgtgcctggcactgctacagggaatagggtggttctggaggggaaggtaaacagcaacttaacggatacatagcatcgcttcatgtactaagtggagtgaagataataaacagggtaaagggagagagggctgtggaatgcagaggtctggtggcttatgtgttagtaaaagcagmatctggactgtcatagggtaggcagacgttttttctttttaaagaaacctagttttaaagaggaaataacgtgtttttttaacttaggaaatgaaaagccatgttttagggttgagaggaagtaacaaattatatttttaggttccagggaagaaacaaatggaagccaattgctggtagaggagacagggctacgggggggtgggggattggtggcacagcttctgagacaggaagaaagaaggtaagggtgtgtgtaaagataagtttctagatatgggctaaacttgtatggtgaca

SEQ ID NO: 135329 - DNA, 601 bp, Human
aggctgtttgaggggaagaagtcagggaactgaaatgagggttgttggaaattcacaaagacaatgtggggacatgaggtagaaaggaaaactgtgagccagtcagatgcctgtctacccgccaagtagctaagaaagaggaaagatattctttttttttgagatggagtttcattcttgttgcccaggttggagtgcaatggcatgatctcagctcactgcaacctctgcctcccaggttcaagcgattctcctgcctcagcctcccgagtagctgggattacgggcacctgccaccacrtccactaattggctttttttttttttttgtatttttagtagagatggagtttcaccatattggccaggctggtatcgatctcctgacctcaggtgatcctcccgcctcaagctcccaaagtgctgggattacaggcatgagccatggcacctggccggaaagatgtgcttatctaccttttaaaaatgatgatgaaactgagagccatataattcaggtgaattgcctgagctcgcagtaagcttatttacaaataggataataagcctatttaagaggtgcgctcatggaagtatgatc

SEQ ID NO: 135330 - DNA, 601 bp, Human
gtcttctctttgacagacttgctatctgaaaaataaaccaggacaccaattttctagcatataatagaggacatcccttcccagctataggaatgcttggtatccttccaagaactcctcctttagaggagcctcacagaagttgctgggtaaacatgggctcaaaccaaggaaagtcaggtaacctgggtggaggttatcccaccaccaatggcaggggacagcttgcaagtatttgggcttatagtctcccagcccacagcctctctcccttgctagtgttagagagatgctgatcacrtttactcttctcttattttctctgcgtatccccttaccttaactttttgaccatgttcttgagcctagagttcagttagtctcatttctccaggagtcctggagacagtgtccttccacctaccatgtgtggagtttacctgccaccccaatgcaaagatagtaagcctgagcataattgattctcgatttcttttgaattaataactggtatatataaccattaattccaattataattcacatgaaaatgtcagagcttctattgagagcaaaagcaaactttagcattagcctggta

SEQ ID NO: 135331 - DNA, 601 bp, Human
cctggagctgtccagaaacttggtagcaattgtaacataaacagttaattttccagttatttggaggcttggaaaattaacacaaactagtagtaatacctgaacagcaattggaaccatttttgtacaatatgggtgaattgtattcaaaatgccttttaatgcaaaaaaaaaaagtacaatgaggaaaacctccaagtagaaatatgcatcaaatggaagataagaaaagggataatgatattgtatcagttagtttttgctgcctgacaaaccaccccaaaatttagtggcttaaaaratttatactcacagttcttagatggacaatttgagctaggttcaggtgtacagttctgctgatcttctgggctctcccatgcatctgcaatcagatagagtgttaactggtgttggctggtgtctgggtgattgagaatggcctcactcacaggtctgcaggttgataggcaggtgctggttgtagcttaccagttctcctctacaagacctccaggaggctatcttgggctccttcagatggttgtcttacagttccacctgcaccaagagagataggtgcagagactcttgaggacta

SEQ ID NO: 135332 - DNA, 601 bp, Human
tatttctaccacattctactggtcaaagtcagcccagattcttttctttttttgtttttttgagacggagttttgctcttgtcacccagcttggagtgcaatggtgcgatctcggctcactgaaacctccgcctcctgggttcaagcgattctcctgcctcaacctcctgagtagctgggattacaggtgcacgccaccacacccggttaattttttttttttttttttttttagtagagacagggtttcaccatgttggtcaggctggtctcgaactcctgacctcgtgatctgccccckcttgggctcccaaagtgctgggattacaggtgtgagccactgcgcccggccacagtcagcccagattcaaggggtgcgtcaatagactctacctcttcgtggaaggagctgcaaactattgtgatcacgtttgcagtctaccacaaatgtattgctatatgttagcgctattctaatagctttatatgtgtgaactcacttaattgttacagcaacccagagaggtgagttactatttctaattatttctcagatgaggaagcagctactgagacgttgagtaacttgcccaaggttata

SEQ ID NO: 135333 - DNA, 601 bp, Human
tttttgtttttttgagacggagttttgctcttgtcacccagcttggagtgcaatggtgcgatctcggctcactgaaacctccgcctcctgggttcaagcgattctcctgcctcaacctcctgagtagctgggattacaggtgcacgccaccacacccggttaattttttttttttttttttttttagtagagacagggtttcaccatgttggtcaggctggtctcgaactcctgacctcgtgatctgccccctcttgggctcccaaagtgctgggattacaggtgtgagccactgcgcccrgccacagtcagcccagattcaaggggtgcgtcaatagactctacctcttcgtggaaggagctgcaaactattgtgatcacgtttgcagtctaccacaaatgtattgctatatgttagcgctattctaatagctttatatgtgtgaactcacttaattgttacagcaacccagagaggtgagttactatttctaattatttctcagatgaggaagcagctactgagacgttgagtaacttgcccaaggttatataggtagtggcagagctgaatttgagtccacgcagtctggttccagag

SEQ ID NO: 135334 - DNA, 601 bp, Human
actgagacgttgagtaacttgcccaaggttatataggtagtggcagagctgaatttgagtccacgcagtctggttccagaggctatactcccaaataataagctataccgcctcaaaagcaaggcggaagaactttatcacttgtttggagcagactgaataaggcttcagacttgtaaacattaagacaatttgctcatttggcaaacttggatatattgatgcatgttttatataagtaaaaatttgtaaagggaatgctagaatgagctatttctttacccgttcagtctcaaaactrgatttctaaatggatcaaagatacagctttttcttgtcttcgttgaataagcaactaaaccaaaaaatatctaaattgacgttcatggaaattgtaaccttttctctttgtagttcaagtattagaactttcagcagaaagagacttttggaggtcacaaaaagttgatatttaccaagttggatgatcgttttcagaatatccttgactgccgggtggcttggctgtgagcagggtgccatgttgctgtccctttgtttcaggtctctcaggcagctgcagagcttcaacagtactgta

SEQ ID NO: 135335 - DNA, 601 bp, Human
tagtagaaatggggtttcaccatgttggctaggctggtcttgaattggctggtctcaaactcctgacctcatgatctgcctgccttggcctcccaaagtgctgggattacaggcgtgacacaatgtttttttaagaggacaagggcatgaattattagagtcttttgggaccaacatatttcaaatgatgtgttctaaggggtgtttatacagtgagtaattatcttaggtccttcttcacaagtagcaaaaggaaattgttcacatttaaaagaaggaagcaatctatcaaatcttattktactttttaatggaaaatgttcatatttatggtgttaagataatagtcttatgttggcatagcatttttctttttacaaagcttccttcttccctcccctcccctcccctcccctcttcttcccttcccttccctccttctttccttccttctctttattaaattgagatggagtctcactctgtcacccatgctggagtgcagtggcacaatcttggctcactgcaacctccacctcccaggttcaagtaattctcctgcctcagtctcccgagtaggtgggactgcaggtgtgcagca

SEQ ID NO: 135336 - DNA, 601 bp, Human
gcttccttcttccctcccctcccctcccctcccctcttcttcccttcccttccctccttctttccttccttctctttattaaattgagatggagtctcactctgtcacccatgctggagtgcagtggcacaatcttggctcactgcaacctccacctcccaggttcaagtaattctcctgcctcagtctcccgagtaggtgggactgcaggtgtgcagcaccatgcctggctaatttttgtatgtttaggagagatgaggtttcaccgtattgctcaggctgttctcaaactcctgacctsaggtgacctgcctgcctcggcctcccgaagtgctgggattacagtcgtgagccactgcgcccggccttacaaagcactttcatgggtgctgctcattcagtggtgtggtttagatgtcttttgtattcacctgttactttcattttttttttgtttgagacggagttttgctcttgtttccaggctgcagtgcaatggtgcgatctcagctcaccacaacctctgcctcccgggttcaagcgattctcctgcctcagcctcactagtagctgggattacaggtgcccgccaccatgcccg

SEQ ID NO: 135337 - DNA, 601 bp, Human
cctcccctcttcttcccttcccttccctccttctttccttccttctctttattaaattgagatggagtctcactctgtcacccatgctggagtgcagtggcacaatcttggctcactgcaacctccacctcccaggttcaagtaattctcctgcctcagtctcccgagtaggtgggactgcaggtgtgcagcaccatgcctggctaatttttgtatgtttaggagagatgaggtttcaccgtattgctcaggctgttctcaaactcctgacctgaggtgacctgcctgcctcggcctcccraagtgctgggattacagtcgtgagccactgcgcccggccttacaaagcactttcatgggtgctgctcattcagtggtgtggtttagatgtcttttgtattcacctgttactttcattttttttttgtttgagacggagttttgctcttgtttccaggctgcagtgcaatggtgcgatctcagctcaccacaacctctgcctcccgggttcaagcgattctcctgcctcagcctcactagtagctgggattacaggtgcccgccaccatgcccggctaatttttttgtatttttagtagag

SEQ ID NO: 135338 - DNA, 601 bp, Human
tccacctcccaggttcaagtaattctcctgcctcagtctcccgagtaggtgggactgcaggtgtgcagcaccatgcctggctaatttttgtatgtttaggagagatgaggtttcaccgtattgctcaggctgttctcaaactcctgacctgaggtgacctgcctgcctcggcctcccgaagtgctgggattacagtcgtgagccactgcgcccggccttacaaagcactttcatgggtgctgctcattcagtggtgtggtttagatgtcttttgtattcacctgttactttcatttttttyttgtttgagacggagttttgctcttgtttccaggctgcagtgcaatggtgcgatctcagctcaccacaacctctgcctcccgggttcaagcgattctcctgcctcagcctcactagtagctgggattacaggtgcccgccaccatgcccggctaatttttttgtatttttagtagaggcagggtttctccatgttggtcaggctggtcttgaactcccaatatcaggtgatccacccacctcggcctcccaaagtgttgggattacaggcgtgagccaccgcgcctagctcacctgttgc

SEQ ID NO: 135339 - DNA, 601 bp, Human
aaatcacaatttctagctcccagaaactaacaggattaataaatgtctccatcactgacaccaataatctgggggaagcagaacagtgtagttggggtaaataggagcaagagtctaagatctcgttgcctcaacatacctactctgagggtaataagtgtgagtggtttctgaagtacttagccaagtgccttgtagatgggagttcaataaatggtaggtgtcattttttttaaaagtgtttatttcttcctcatcacatttacagtcaattattccattcctctctgaaatagatccyagttggccctaaagcaccaacagagtacctcagaaacagaattgttctgaatggcaaatggtgcaaatttagcccattaggatgaaaatgtaacatgtattcaacatttacaaataacaggctgggcgtggtggttcacgcctgtaatcctagcactttgggagcctgaggttggtggatcacctgaagtcaggagttcgagacaaacctgaccaacatggtgaaaccccatctctactaaaaatacaaaattactgggcattttggcagcgcatgcctgtaatcccagctgtgcaggag

SEQ ID NO: 135340 - DNA, 601 bp, Human
gggaaaataattcacaaatggtgttcctgagaaaggtaggacaacactttcataaattttttagttatgcaaatccctgaaccccacctctagaggtggagacatggggagagctgcagcagggtacatagaagtatagcaattgtttttccaaatcatcacttattgttccagatcaatttcattcaaagccttccctaatgtgattttcaagaaagttaaaccaggcatcctttattgcaagatccaggtaagacaggaaaaaaggtcaagaaatgccaatgtctggttgaatagacakttttgtttttttaacatgattaacccttattaaaaacttgagattactttcaagagggaaggtatttcaaacatactcaaggcttttccaaaacagttctgaatcaaatttaagcacaagtacctaaaattctgaaaagaggcacgcaacaataacttttagcctaactgaacatgagttacaccccacgtatgtgcaggcttcatgtacaaattctcttctgatacttctaaacgggtatcagcttgaaaattattcaagattgtattactaagaagaaatcacaatttctagctccca

SEQ ID NO: 135341 - DNA, 601 bp, Human
aaaaacacaaatctcttacaaagcagacattgtttaatactcacatgaaagaaaggcttgatcattttgcaaggcccacaccacgtggctgagaagtcaactactacaagtttatcacctgcagcgtccaaggcttcctgaaaagcagtctaacagcaaaagaaaagcttatattaaataaatagttaaatattaaaccttcaaaagaaagactcgacacaatgacacaaagcacattctggaggtcctcctttcaggacctactttttagccaaaaaaaaaaaaaaaaaaaaaaaaaaaatccccaaacaagccaaataaaactcagtttgaagaaattctatacattgttggtagtgttacttgataagatgaaacaagatatgtgtagagtatactgacattctcttcataactattttataaaatattgtgaactggctattttttctctacaccaaacaaaaggaaaataaaaatagacatttgtattaaaaatgtttccatgtcaaggctaggtatatggtagacattcattaaacacttatggattatgaaaggggtcacttgaagtcacaaaggcataggattttgcaattga

SEQ ID NO: 135342 - DNA, 601 bp, Human
agacataaattttctctaaatcaaatttttcttagtataaaacagcttggcatatcaaattctgaggctgggatttcaaataaggcccatgtttcaatgtggggaaaaaaagaactatttaagacaaaattaacttctaaaatttgttttcaatgggctacatgtatcaaacctaaattatttgttatactactacttttagaccaaagatccagccaaagaaatccccccaccgaaaccaaaatcctttaactgtctttctttcctaccactgtgaccaccaactcaaaaaacacaaatstcttacaaagcagacattgtttaatactcacatgaaagaaaggcttgatcattttgcaaggcccacaccacgtggctgagaagtcaactactacaagtttatcacctgcagcgtccaaggcttcctgaaaagcagtctaacagcaaaagaaaagcttatattaaataaatagttaaatattaaaccttcaaaagaaagactcgacacaatgacacaaagcacattctggaggtcctcctttcaggacctactttttagccaaaaaaaaaaaaaaaaaaaaaaaaaaaatccccaaacaag

SEQ ID NO: 135343 - DNA, 601 bp, Human
aaggccaatgtgaaaagctcagcagtatctcatatttccagctacatacctgacagtcatccacatctacttcaaggaatatcacgttggaatacttttcagagagggactggaaaatttaaaatgaaaaatccaaaaagatttagaactaggtaatggcaatcaacatacccaagcttcttaaatggaaacttaataaaagtagagactaattaaagatccaaaaatttagatctttggagacatagatctaagagacataaattttctctaaatcaaatttttcttagtataaaacagyttggcatatcaaattctgaggctgggatttcaaataaggcccatgtttcaatgtggggaaaaaaagaactatttaagacaaaattaacttctaaaatttgttttcaatgggctacatgtatcaaacctaaattatttgttatactactacttttagaccaaagatccagccaaagaaatccccccaccgaaaccaaaatcctttaactgtctttctttcctaccactgtgaccaccaactcaaaaaacacaaatctcttacaaagcagacattgtttaatactcacatgaaagaaaggct

SEQ ID NO: 135344 - DNA, 601 bp, Human
aaatacaaaattagccaggcatggtggtgcatgcctgtaatcccagctacccaggaggctgagacagaggattgcttaaacccgggaggcagaggttgcagtgagccgagatcatgccactgcactccaccccaggtgacagagtgaactccatctcaaaaaaaaaaaaaaaaaaaaaaaaaaaaaaaaaatcaagttgctatctgataggatcagtggcagttagaatttctctattccaggtgcaattttcccctagctaaattgaccttaataagactaagtttgattaaaacaaggrataaggatttttcacaaaaatgcaattacactctttttaaaaaaaaaaaaacaactctgggacacatctagaatagtaacttaacaaccatatcacattcatcattcattcattccacacctatactacatgcaaggcaggtgtgctaggtgaaggggcaaccaacgtgaattaagacagggtctctgatcctaggaatctactgagactaatggtaaaggacagacataaagatcattataataattgccaagattcactgggtacttagggcacacaaggcggtaagtggagaagggg

SEQ ID NO: 135345 - DNA, 601 bp, Human
ggaggttaccatttataaaataagtatcataaccctgttggctgtcagagaaataaggttggtctatcattttcaaaagggctactactcatacttttctatcaatctatggaggcaaagttaaagttcctcagtttgtcagagggtcacttcaaggttttaaaagacactttcaggccaggcacggtagctcatgcctctaatcccagcactttgggaggccaagacgggtggatcacttgaggtgaggagttcgagaccagcctggccaacatggcaaaatgctgtctctactaaaaakttgaaatttagcctggtgtggtagcggctgcctgtagtcccagctactcaggaggctgaggcagaagaatcgcttgaacccgggaggtggaggttgcagtgagcagagatggtaccactgcactccagcctgggtgacagagtgagactctgtctcaaaaaaaaaaaaaaaaaagatacattcagggtgatcagggtgcaccaagcagacatgaaggaggagctctgtcatacggaagtcctcgagtgctttgcacacctatagtaatgcaccatataacatttagatcgacaacagatt

SEQ ID NO: 135346 - DNA, 601 bp, Human
ggttccagtaagaggcacaaggacagtaatggctggaataaaaatggtgaatgtttattgaatgcatactattgaaaactcactccaagtaagggtcagagggaggttaccatttataaaataagtatcataaccctgttggctgtcagagaaataaggttggtctatcattttcaaaagggctactactcatacttttctatcaatctatggaggcaaagttaaagttcctcagtttgtcagagggtcacttcaaggttttaaaagacactttcaggccaggcacggtagctcatgcctstaatcccagcactttgggaggccaagacgggtggatcacttgaggtgaggagttcgagaccagcctggccaacatggcaaaatgctgtctctactaaaaagttgaaatttagcctggtgtggtagcggctgcctgtagtcccagctactcaggaggctgaggcagaagaatcgcttgaacccgggaggtggaggttgcagtgagcagagatggtaccactgcactccagcctgggtgacagagtgagactctgtctcaaaaaaaaaaaaaaaaaagatacattcagggtgatcagggtgc

SEQ ID NO: 135347 - DNA, 601 bp, Human
acctctaggatggtgggtggcactactgttgaggagttctttctaggtaatctttactttttcttttaatgctggacacctgctgagcatgaaagtacaggttccagtaagaggcacaaggacagtaatggctggaataaaaatggtgaatgtttattgaatgcatactattgaaaactcactccaagtaagggtcagagggaggttaccatttataaaataagtatcataaccctgttggctgtcagagaaataaggttggtctatcattttcaaaagggctactactcatacttttctrtcaatctatggaggcaaagttaaagttcctcagtttgtcagagggtcacttcaaggttttaaaagacactttcaggccaggcacggtagctcatgcctctaatcccagcactttgggaggccaagacgggtggatcacttgaggtgaggagttcgagaccagcctggccaacatggcaaaatgctgtctctactaaaaagttgaaatttagcctggtgtggtagcggctgcctgtagtcccagctactcaggaggctgaggcagaagaatcgcttgaacccgggaggtggaggttgcagt

SEQ ID NO: 135348 - DNA, 601 bp, Human
ttttaattaaaaactgatttgtgaggccaaggccggtgggtcacctgaggtcaggagttcgagactagcctggctaacacggagaaaccccatctctactaaaaatacaaaaattagccaggtgtggtggcacacatctgtcatcccagctactcaggaggttgagacaggacaattgcttgaacctgggaggcggaggttgcagtgagctgagatcatgccactgtattccagcctgggcgacagaatgagactatctcgggaggaaaaataaaaagactttgtgaattctcaaaccttgctgcagtatcagaattacctgaggggtactacaagtttccccatcaaccccatcttaaaccattacagttaaagtcgggcttcaggtgactctgatgctctaacctttgaaagccatcctactaagaaaatcgacaaattcctaacatcgcaaattgggctagttgatccgtattttctcctctcctagaagtggctgttaccacagctaaagatttttctacagctcaaaggtaattgaagtaacacacattcctcaactgtggaatgctaaatgagaactcttataataccccatgct

SEQ ID NO: 135349 - DNA, 356 bp, Human
cagtatgataatcttaactattcctcagaactagtacctcttatttcttgctcataatttttccagttttattatgaaggcagagtacacagaatgattatataaaggctaaaaagtctaaaaaaataaaaatcaattgttcaagaacaaaataatagtaatctaaaggaataaccccacactgggtttactgattattattatttttgagacagggtctggctgtgtcacccaggctggatggaatgcaggggcatagtctcagctcactgcaatctccacttcccagactcaagccatyctccctcctcagcctccccagtagctgggactacaggcacacgccaccacacctg

SEQ ID NO: 135350 - DNA, 601 bp, Human
ttgtcccttcttaaaaaactggaatgttggcatgcatttgacttcacactctgaagcaacatcctggtagggaaagtagcaaagggagaggattaaatacaagactgcgagtactgagctttgacagaagtaatccaaaaccagaaacttttccctgtcatgtaccccacatttccgcatgaggacatttttcagcatatgaaaattaatataatgaatataatggcagtacaaaagccaaaccggttatattctcaatgaagaagttttattaatatttacttcctttgacgggcacatyaacaggcagaatgttcagaatgttactagcatcagatactccagcgatccaatatgctctttaatccaatcaaattttcaactattttaagtatcatacaaagaagcaacaaaaaattctgctacaattggactcagtatgataatcttaactattcctcagaactagtacctcttatttcttgctcataatttttccagttttattatgaaggcagagtacacagaatgattatataaaggctaaaaagtctaaaaaaataaaaatcaattgttcaagaacaaaataatagtaatctaa

SEQ ID NO: 135351 - DNA, 601 bp, Human
cagtgatttattcacttatactgggtttcctattgcccagttagagttttaaaggtcagatgtacgtaccttttgtcccttcttaaaaaactggaatgttggcatgcatttgacttcacactctgaagcaacatcctggtagggaaagtagcaaagggagaggattaaatacaagactgcgagtactgagctttgacagaagtaatccaaaaccagaaacttttccctgtcatgtaccccacatttccgcatgaggacatttttcagcatatgaaaattaatataatgaatataatggcaktacaaaagccaaaccggttatattctcaatgaagaagttttattaatatttacttcctttgacgggcacattaacaggcagaatgttcagaatgttactagcatcagatactccagcgatccaatatgctctttaatccaatcaaattttcaactattttaagtatcatacaaagaagcaacaaaaaattctgctacaattggactcagtatgataatcttaactattcctcagaactagtacctcttatttcttgctcataatttttccagttttattatgaaggcagagtacacagaa

SEQ ID NO: 135352 - DNA, 601 bp, Human
ttgggggtaaaactgtacttttaagcattacagtagtgtgaagggactgcactgtttcattgacaagcataatgaaatattttaagtgtgtaactgcgtgtatttagtcagctgtaataggttggaagttcacgttatggttgttttctttatgttcttttattttcttttcttaatttttgtttttaaacacagttgtattttgcaggcttaatgtcaccctgggaaggggatttaaaaaattcctgatatgacatcaaagagcagactaggtgctgtcaggtgcccctgggaccccaartcacttgtttcagaacaattgtttctttaccatggagaaagcatatgccatatgagaagtatgggatgatgaagagaggtgttagatactattgaattaggctacccggggcactctttgagtaagacatggtgaaattaaagggtctaacaagctttttgctacttttttgggagggagtgtggggagttgttgcactgctttttaattctacctgatgggagtcatatatctcagcagcccaagaaggaagtagtaatctcaagcattcaaagtagcactctgcttttctttgagtat

SEQ ID NO: 135353 - DNA, 601 bp, Human
agtgtgaagggactgcactgtttcattgacaagcataatgaaatattttaagtgtgtaactgcgtgtatttagtcagctgtaataggttggaagttcacgttatggttgttttctttatgttcttttattttcttttcttaatttttgtttttaaacacagttgtattttgcaggcttaatgtcaccctgggaaggggatttaaaaaattcctgatatgacatcaaagagcagactaggtgctgtcaggtgcccctgggaccccaaatcacttgtttcagaacaattgtttctttaccatrgagaaagcatatgccatatgagaagtatgggatgatgaagagaggtgttagatactattgaattaggctacccggggcactctttgagtaagacatggtgaaattaaagggtctaacaagctttttgctacttttttgggagggagtgtggggagttgttgcactgctttttaattctacctgatgggagtcatatatctcagcagcccaagaaggaagtagtaatctcaagcattcaaagtagcactctgcttttctttgagtattaggggagaatggaaatctgaaaagttaagagtg

SEQ ID NO: 135354 - DNA, 601 bp, Human
gacatatcaggtggagatgttcctcaagtggggaaaacctaaaaatctccttattgagtagagaaataatagttcagaagaggcagtccatgctttgatgtattaaagagatggcatttagttactttgtatttggtaaacattcgctcattcattcaattcagtttaatatatgtgtaatatattgtgatatgcatgtatatacatatgtatgtgtgtatatatatgcatgtatatgtatgtattgtgtgtgtatgtgtgcacatgatttagggacacacaaaaatatttaaaatgaagtttttccttcgggttggtgaaaacaagaatgtaaggaaatcattataatacaagataataggacaggtattgaagagaaatggtgctattggagtttaaaaatggaagtgatttatctatttgggggatagtcaggaaggtttatgaagaaggtggtgtttactgtgatcttatctttggactttagggtctaaactaaatcaggctcctttttgcatatttttgggctcactatgaacgtagctccctcttagtagagccagtttttgagttgagaagccaaaggagatattagcactgt

SEQ ID NO: 135355 - DNA, 601 bp, Human
agtagagaaataatagttcagaagaggcagtccatgctttgatgtattaaagagatggcatttagttactttgtatttggtaaacattcgctcattcattcaattcagtttaatatatgtgtaatatattgtgatatgcatgtatatacatatgtatgtgtgtatatatatgcatgtatatgtatgtattgtgtgtgtatgtgtgcacatgatttagggacacacaaaaatatttaaaatgaagtttttccttcgggttggtgaaaacaagaatgtaaggaaatcattataatacaagatrataggacaggtattgaagagaaatggtgctattggagtttaaaaatggaagtgatttatctatttgggggatagtcaggaaggtttatgaagaaggtggtgtttactgtgatcttatctttggactttagggtctaaactaaatcaggctcctttttgcatatttttgggctcactatgaacgtagctccctcttagtagagccagtttttgagttgagaagccaaaggagatattagcactgtactcttccctatggatgtgtttacaatggatcaggtactggtggtccttcaaatca

SEQ ID NO: 135356 - DNA, 601 bp, Human
ttcattcaattcagtttaatatatgtgtaatatattgtgatatgcatgtatatacatatgtatgtgtgtatatatatgcatgtatatgtatgtattgtgtgtgtatgtgtgcacatgatttagggacacacaaaaatatttaaaatgaagtttttccttcgggttggtgaaaacaagaatgtaaggaaatcattataatacaagataataggacaggtattgaagagaaatggtgctattggagtttaaaaatggaagtgatttatctatttgggggatagtcaggaaggtttatgaagarggtggtgtttactgtgatcttatctttggactttagggtctaaactaaatcaggctcctttttgcatatttttgggctcactatgaacgtagctccctcttagtagagccagtttttgagttgagaagccaaaggagatattagcactgtactcttccctatggatgtgtttacaatggatcaggtactggtggtccttcaaatcaattcccatttacccagatgagttttcttaattggattctgcttggaaagtacatctggaatgaacatggggttcttgtccgaaaggaaaattat

SEQ ID NO: 135357 - DNA, 601 bp, Human
gtattgtgtgtgtatgtgtgcacatgatttagggacacacaaaaatatttaaaatgaagtttttccttcgggttggtgaaaacaagaatgtaaggaaatcattataatacaagataataggacaggtattgaagagaaatggtgctattggagtttaaaaatggaagtgatttatctatttgggggatagtcaggaaggtttatgaagaaggtggtgtttactgtgatcttatctttggactttagggtctaaactaaatcaggctcctttttgcatatttttgggctcactatgaacgtrgctccctcttagtagagccagtttttgagttgagaagccaaaggagatattagcactgtactcttccctatggatgtgtttacaatggatcaggtactggtggtccttcaaatcaattcccatttacccagatgagttttcttaattggattctgcttggaaagtacatctggaatgaacatggggttcttgtccgaaaggaaaattattggtagaaagaagtgggtgatcattttagaaatggcaaaagagccagccgccttggcctggactttaaatgtggaattggccttattcagc

SEQ ID NO: 135358 - DNA, 601 bp, Human
tttttccttcgggttggtgaaaacaagaatgtaaggaaatcattataatacaagataataggacaggtattgaagagaaatggtgctattggagtttaaaaatggaagtgatttatctatttgggggatagtcaggaaggtttatgaagaaggtggtgtttactgtgatcttatctttggactttagggtctaaactaaatcaggctcctttttgcatatttttgggctcactatgaacgtagctccctcttagtagagccagtttttgagttgagaagccaaaggagatattagcactgyactcttccctatggatgtgtttacaatggatcaggtactggtggtccttcaaatcaattcccatttacccagatgagttttcttaattggattctgcttggaaagtacatctggaatgaacatggggttcttgtccgaaaggaaaattattggtagaaagaagtgggtgatcattttagaaatggcaaaagagccagccgccttggcctggactttaaatgtggaattggccttattcagctacgctattctcaaatggccaaaatactttttgcagtaccaaactccttttttaatatt

SEQ ID NO: 135359 - DNA, 601 bp, Human
gatattagcactgtactcttccctatggatgtgtttacaatggatcaggtactggtggtccttcaaatcaattcccatttacccagatgagttttcttaattggattctgcttggaaagtacatctggaatgaacatggggttcttgtccgaaaggaaaattattggtagaaagaagtgggtgatcattttagaaatggcaaaagagccagccgccttggcctggactttaaatgtggaattggccttattcagctacgctattctcaaatggccaaaatactttttgcagtaccaaactycttttttaatattctaacccaagaaatgggaggaaaagtgaaaagtggatacaatctcatagtattgaagaatttaacaacatgttcaattcaaggacctttacgaactttctagatcactataattcggtttaacagacctctaatttaaggcacagcagaggcaaaggaattacagactctctggaagctggaaggactgggttactgctctacagccttaccaacagtgagattccgagaaagaatttcttaaaaagaaattttgttttccacagttgtaactttaggtggtatgct

SEQ ID NO: 135360 - DNA, 601 bp, Human
cccagatgagttttcttaattggattctgcttggaaagtacatctggaatgaacatggggttcttgtccgaaaggaaaattattggtagaaagaagtgggtgatcattttagaaatggcaaaagagccagccgccttggcctggactttaaatgtggaattggccttattcagctacgctattctcaaatggccaaaatactttttgcagtaccaaactccttttttaatattctaacccaagaaatgggaggaaaagtgaaaagtggatacaatctcatagtattgaagaatttaacaayatgttcaattcaaggacctttacgaactttctagatcactataattcggtttaacagacctctaatttaaggcacagcagaggcaaaggaattacagactctctggaagctggaaggactgggttactgctctacagccttaccaacagtgagattccgagaaagaatttcttaaaaagaaattttgttttccacagttgtaactttaggtggtatgcttttcagcttgtttatattagctgtctggggttgagttgacatttttcaaatattaaagcagtagaatgccttttgaggaaa

SEQ ID NO: 135361 - DNA, 601 bp, Human
attgcattcagttctttagagcatgcggcctgttaactgtagggggcttcaggggtctctggttggtaaatttaatgttggagaaaagagttgagattctcttgtctttgtttttcagattagtgttactttaatgactccccagtattttaaaatctgaaagatctacaaggaatatttttaaaacttaaaagaaatttcataaataacccttgttcattatagaaacatttcatagaaaaggaaaaataagaatgactagttactgcagtctacactttggcatttattctcttggacttttttttctatctatgtgtatgaagcatccaaaatgtgtgtaaaactaagtctatttcgttccctcttgtttcacttaccaatatatggcaaaatattcccaagtttatatatttctacattcatagtatcctcttccattgtatttatttaaatagaatcttaatgtttattaactttcactattgtgaatatttccgtgatgatcataccagttcctacattatcatgcatactatgcccttagattaaattccagggagcaaaaccacaggctttgaatgtccagttcttcttcact

SEQ ID NO: 135362 - DNA, 601 bp, Human
ttaccaatatatggcaaaatattcccaagtttatatatttctacattcatagtatcctcttccattgtatttatttaaatagaatcttaatgtttattaactttcactattgtgaatatttccgtgatgatcataccagttcctacattatcatgcatactatgcccttagattaaattccagggagcaaaaccacaggctttgaatgtccagttcttcttcactctccattctcttttcttccttctgaaaatagctttttattattgcaaaaaaaaaaatgacatatgctaatcaaaamattcaaaccaaagataaattcacaataagaatataaaactcactcaaagtcataccacccagagctaattactgttagttttttgggtactatctccatatttgtatgtacatgttattttacacactatatattgtattttgtaacttgcttttttatactctaccatatatcttggatatctttctgtagtagtacacataaggttacctattttttaacaaccgtggattttaatttgtaagaatgtagccatttacttaatgtcatattgagttttcaaacagtttccattttttt

SEQ ID NO: 135363 - DNA, 601 bp, Human
tcatgaaatatatccttaaaattttaatttgggtggccaggcatggtggctcatgcctgtaaccccactttgggaggccgaggcaagtggatcacctgaggtcaggagttcaagaccagcctggccaacatagtgaaaccctgcctccactaaaaatacaaaaattagtcaggcgtggtggtgcacacctgtaatcccagcttcttgggagaatcgcttgaacctgggaggtggaggttgcaatgagcagagattgtgccactgcactgtagcctgggtgacagagccagacttcatctcaaaaaaaaaaaaaaattaattaatttggggatcaaattattttcaaagttagccagaaaatagcaatattgtagaggttaggtaatcctggattgatagttgggttctgtgtatctaaacaatttaattccttgatgagttctaattttaattttaacctaatgtcttaagctgctatcacatattttataaactcattttatttatatagtctatagctatccagacctatatgaaaataataagaaaaatgtagtgatctgattaaattccagtctgagaaatagcttacttttgggca

SEQ ID NO: 135364 - DNA, 601 bp, Human
gggagaatcgcttgaacctgggaggtggaggttgcaatgagcagagattgtgccactgcactgtagcctgggtgacagagccagacttcatctcaaaaaaaaaaaaaaattaattaatttggggatcaaattattttcaaagttagccagaaaatagcaatattgtagaggttaggtaatcctggattgatagttgggttctgtgtatctaaacaatttaattccttgatgagttctaattttaattttaacctaatgtcttaagctgctatcacatattttataaactcattttatttayatagtctatagctatccagacctatatgaaaataataagaaaaatgtagtgatctgattaaattccagtctgagaaatagcttacttttgggcattcctgcattttcagttatcttttcaggcaaaattagtttttctttaggtttataaataattcttacatagcacctggttgtgttatatgcattgttgcagagaaatttaatctaattttttttagcttcctgtgcaatgcctaatcacaaaaggtggttgacttaaatttcctacatttgttaaaataattaagtctagaatctt

SEQ ID NO: 135365 - DNA, 601 bp, Human
atcaattttaatgacctcacaagtcatataagtcaatcagatttaacatatccttaacatagccttaataaatgcgcctatttatgcatcctgatattaagtgatagaatttagagctatgaaagttttatagtccaatcacttcattttacacataagctaactgaggccttggaagtgagtgactttcctgaagacagtagagtggagtcacagggagaagtcagatctacagattctctgtccgtaagttcttttcactaaaccacacgtgaacactaataatccacatttataaaattttttttttcttcagaatctttagtatatttcacatttttagctttgcttgtttttgttgggagcagtctggcaagggggagctgatggtataatgagcaggggttatttttctgtgtccaagaaatggtgacatgtgaatcatggtggtggggtttcttaccagttctctgccaaaggatattttgcaaatgctctcattttgattcccagtgcctacatagtacagctgcaagttttaaccactgtaatggttgtttgccttttatggactgtcttgtttgaaagcccttgctgggta

SEQ ID NO: 135366 - DNA, 601 bp, Human
ttcttcagaatctttagtatatttcacatttttagctttgcttgtttttgttgggagcagtctggcaagggggagctgatggtataatgagcaggggttatttttctgtgtccaagaaatggtgacatgtgaatcatggtggtggggtttcttaccagttctctgccaaaggatattttgcaaatgctctcattttgattcccagtgcctacatagtacagctgcaagttttaaccactgtaatggttgtttgccttttatggactgtcttgtttgaaagcccttgctgggtaactaaacyttttcttatatatctttacatctctgactcttatagcattgtccttataaataataggtgctcaaaaaatgtctgacaatgaaagtatttttcatcagtagggataagctctcatttgctcctaagttttatgaaagatttcgggtaattaaattacaatgcaattttcttcttgtgcttcttctttgtttgcactgatattcccattatgtatttgcttaattatttggaagttgcaagaacagcatgaaaagcaacttataatggctggcgaagtgtcatttctcctacctaagcctt

SEQ ID NO: 135367 - DNA, 601 bp, Human
ttgagattagtcttctttggacagaccattagccccaggtggagctgctgatcacaacccctccctgtaccactcccaaggctgttgtcatcatcacttaccctaagccagttacttttcatatagtatgctttaggatgtcccataaacactatggacaaagttggtgttattatccttaatttacgagtgaggaaatcaattgttgttaaccaatttgcccatggctggatagcgagtcagtggcagaggcaggatggatgtctgactggtgggcctgtgcagcaaactgcagctcctrggccaaatctagcttcagctgttgtttttgtttgtttgtttgtttgtttgtttgagatggagttgcgctcttgttgcccaactgggagtgcaatggcgcgatcttggctcactgcaatcgccacctcctgggttcaagcgatcctcctgcctcagcctcccgagtagctgggattacaggtgtgcaccaccacgcccagctaattttttgtatttttagtagagacggggtttcaccatgttggccaggatgatctcgatctcttgaccttgtgatccatcctcctcggcctcccaaagt

SEQ ID NO: 135368 - DNA, 601 bp, Human
gtgcagcaaactgcagctcctgggccaaatctagcttcagctgttgtttttgtttgtttgtttgtttgtttgtttgagatggagttgcgctcttgttgcccaactgggagtgcaatggcgcgatcttggctcactgcaatcgccacctcctgggttcaagcgatcctcctgcctcagcctcccgagtagctgggattacaggtgtgcaccaccacgcccagctaattttttgtatttttagtagagacggggtttcaccatgttggccaggatgatctcgatctcttgaccttgtgatccrtcctcctcggcctcccaaagtgctgggattacaggcgtgagccatcgtgcccggccaagcctcagctgtttttaagtatagcccgtgagcgaagatggttttcccatttttaaatgattgaaaaaaaatcaaaatcaatgtttcatgacacatgaaaatgatacgaaattcaaattcagcatcgacaaacaaagttttattggaacacagctatggtcattcatttatatgttttccatggctgctctttgctcgacagctgtcgagttgagtagttgcgccagagcccctatgtcccac

SEQ ID NO: 135369 - DNA, 601 bp, Human
ctaagttaaattgtattaaaactaacaagaacgtggccagtgtggcagcatacctaagtgtggggattttgcagcccctttttggcttagtgactttttttcttcctggttgtttctatgtaaatgtaacaatttccttgaaatgatgaatgaacccacatctccagtgttttcctcttgtactggacagagtggaggaaactggaattgcctgtttttgtggcagaggaggtagatggggatggaaatgaatttccttttaaagcaatgaattctttttttttttgtttttttctgagayggcgtatagctctgtcacccaggctggagtacagtggtgctatctcagctcactgcaacctccgcctcccgggttcaagtgattctcctgcctcagcctcccaagtagctgggattacaggcgcccaccaccacacccagctactttttgtatttttagtagagatggggcttcactgtgttggccaggctggtgttgaactcctgacctcatgattcgcccgcctcggcctcccaaagttctgggcttacaagcatgagccaccgcacccggcctaaaccaatgaattctttctcggct

SEQ ID NO: 135370 - DNA, 601 bp, Human
acagtttatttaccccttcctgtacccgaaacacctttgccatttgaaaaaaaaaaatcacaaactctgcatatacctaaaaagaggacttggataaggagtttgtttagatcaattcaacaaaggtttttgtttgtttgtttgcttttttcattcagggtcttctatgtggcccagtctggcctcaactcttgggctcaaacatcctcctgtgtagctgggattacagccagtgccactgttcccggctcaaataatacatttttgatctattgttatgtttaagacatcatgctgggtrgaaataggcagaaatgcatttgactttactcttccagtgattagccatgtggccttggaaaatctacttaacctctagcttcggtttcttcaccttctaaataaaaagactgacactcattcacgaggtctttatgaagattaagcaaggtcatatatgtaacatgctttggccagtgcttggcattcatttattcaacaaatatttatgagtgcactttatatttgaggtactttgctatagtactctctctataaacatacatttgcttcactcttcctttccttccagcccttaagg

SEQ ID NO: 135371 - DNA, 601 bp, Human
gtatctgaagcttaagagaccttacttgtgttttctaagaacttcctttttcttaccaagattaatactgtagctattgcttgtgattgcaataggtgaataaatggaatatatcatatctcatacttttaggtgttttttggattgtggaaactccaggaaatctagaggttaatagttaaacaagtatatcatatcaaccaggtttatagacacactgtaattatataagcaagctgttggttcaataatcaacgtctagctgggtcagggaatattttccagagcttggccacggctrtaattttcattttttataacctgctaacatgccaacctgccttttccatttctttttgtttttctcgaatcatctgaaatcagtgtaagagaaggaaacctgttcaatgtacttttgaattctcattttatttacctcaagtaaaatagtgttctggaaagttcttcgtattaccaaattgactttctcaagcatgatactggatattagcaagggagttcataatttattttctatttttaatttcagaaaaatacagttctaagagataaaaagataaacatataaaaataaaaagga

SEQ ID NO: 135372 - DNA, 601 bp, Human
tgcatttcttcccctgtatactcatagcccagactttgccttcatgttcacatggcattctgcctgtctgtgtctgtatccaaatttcccctttttataaggaagccagtcatattaaagttagggcccgccctactccagtatgacatcatctgtcatcaagtaagatcccattcagagatgctgagggttagctgagggttaggacttcagtatattaattttaggaggacatagttcaacccataacatggcaggcaaacatggtcagcaaactaatgatactctgtgtgaaatgcaygtaagttctggtataagatacgagtaggataccaaagaaggtgggtgcataactcagcctgggaagatcaggagtctgttggtagaggaaggaccttaagttggtatagcagaacttgcagtgtggttctcaggagaataaggaagtaaaacaagagacttcccatctggtccttgaacggacagactacctgccctttcttctgtttttgtttttgttttttttttttttaattgttaatgacagactggatggttctaaactggggtgtgttaaattagagaacacacacacacacac

SEQ ID NO: 135373 - DNA, 601 bp, Human
tttttttaattgttaatgacagactggatggttctaaactggggtgtgttaaattagagaacacacacacacacacacacacacacacgttgttgtattgattcccaaaactgaatttgtgtttagtggtaatgagacctacacaacactccctgtggttgtcacaggcagctttgatgtacagatacagggacaggacttggtggttgggagaaaggatcatccttcccattgtaacaaatggtcctagtcctactgggacaaagtttcagagggagagagtgggctgggctggtggctyatgcctgtaaaccccagtcaggctggaggctgagacagaaggatcacttgaggctaggagttttgagaccagcctgggcaacatagtgagactctgtctctacaaaaagtgaaaaaaaaaaaaaaaaattagccgggcatggtggtgcatgcctatagccctagatgcttgggaggctaaggtgggaggatcacttgggcccaggagttcaagtttgcagtgatcattccactgcactccagcctgggcaacagggtaagaccttgcctctaaaaggagagtgagagagagagagtaaga

SEQ ID NO: 135374 - DNA, 601 bp, Human
tgtacagatacagggacaggacttggtggttgggagaaaggatcatccttcccattgtaacaaatggtcctagtcctactgggacaaagtttcagagggagagagtgggctgggctggtggctcatgcctgtaaaccccagtcaggctggaggctgagacagaaggatcacttgaggctaggagttttgagaccagcctgggcaacatagtgagactctgtctctacaaaaagtgaaaaaaaaaaaaaaaaattagccgggcatggtggtgcatgcctatagccctagatgcttgggaggmtaaggtgggaggatcacttgggcccaggagttcaagtttgcagtgatcattccactgcactccagcctgggcaacagggtaagaccttgcctctaaaaggagagtgagagagagagagtaagaaccaagccatggcaaagctgatttttagataaggcctgtaagtcttaaaaaaaaaagtattcatgtgttaccaagctcttgcaatattgattattaacaaaggtcttttcaactatgtgtatatttcctagagctaatatgcagctttattttctttatgtgatctgggtaccttta

SEQ ID NO: 135375 - DNA, 601 bp, Human
gcagaggctcagcagaaagtcaagaattagatgagtcaatgtggaaggggaagaaagaaataataaaataggccgggcacagtggctcatgcctgtaatcccagcactttgggaggctgaggtgggtgagtcacttgaggtcaggagttcgagaccagcctgtccaccatggtggaaccccgtctctactacaaacatattaaaaaagtaaattagccaggcgtggtggcacatgcctgtaatctcagctactcgggaggctgaggcatgagaatcgcttgaacctgggaggtggaggttrcagtgagccaagatcgtgccactgcactccagcctgggtgaaagagcaagactctgtcaaaaagagaaaaaaaaagaaagaataaaatagagaagccaattggaaaccaggaatcagagattgaagagattcaagaaactatgctgcagaatccaggcaatcatgtgagcttttattccatattagttctgcctgaaagaaatgattatacatctctgattctttcagcttcagcagcaatctttgttcatctagctattatgtgaagatgcactcataagaagcctgagtaggtagggt

SEQ ID NO: 135376 - DNA, 601 bp, Human
cagcagaaagtcaagaattagatgagtcaatgtggaaggggaagaaagaaataataaaataggccgggcacagtggctcatgcctgtaatcccagcactttgggaggctgaggtgggtgagtcacttgaggtcaggagttcgagaccagcctgtccaccatggtggaaccccgtctctactacaaacatattaaaaaagtaaattagccaggcgtggtggcacatgcctgtaatctcagctactcgggaggctgaggcatgagaatcgcttgaacctgggaggtggaggttgcagtgagcyaagatcgtgccactgcactccagcctgggtgaaagagcaagactctgtcaaaaagagaaaaaaaaagaaagaataaaatagagaagccaattggaaaccaggaatcagagattgaagagattcaagaaactatgctgcagaatccaggcaatcatgtgagcttttattccatattagttctgcctgaaagaaatgattatacatctctgattctttcagcttcagcagcaatctttgttcatctagctattatgtgaagatgcactcataagaagcctgagtaggtagggtgtagaagga

SEQ ID NO: 135377 - DNA, 601 bp, Human
agcagaaagtcaagaattagatgagtcaatgtggaaggggaagaaagaaataataaaataggccgggcacagtggctcatgcctgtaatcccagcactttgggaggctgaggtgggtgagtcacttgaggtcaggagttcgagaccagcctgtccaccatggtggaaccccgtctctactacaaacatattaaaaaagtaaattagccaggcgtggtggcacatgcctgtaatctcagctactcgggaggctgaggcatgagaatcgcttgaacctgggaggtggaggttgcagtgagccragatcgtgccactgcactccagcctgggtgaaagagcaagactctgtcaaaaagagaaaaaaaaagaaagaataaaatagagaagccaattggaaaccaggaatcagagattgaagagattcaagaaactatgctgcagaatccaggcaatcatgtgagcttttattccatattagttctgcctgaaagaaatgattatacatctctgattctttcagcttcagcagcaatctttgttcatctagctattatgtgaagatgcactcataagaagcctgagtaggtagggtgtagaaggac

SEQ ID NO: 135378 - DNA, 601 bp, Human
atattaaaaaagtaaattagccaggcgtggtggcacatgcctgtaatctcagctactcgggaggctgaggcatgagaatcgcttgaacctgggaggtggaggttgcagtgagccaagatcgtgccactgcactccagcctgggtgaaagagcaagactctgtcaaaaagagaaaaaaaaagaaagaataaaatagagaagccaattggaaaccaggaatcagagattgaagagattcaagaaactatgctgcagaatccaggcaatcatgtgagcttttattccatattagttctgcctgwaagaaatgattatacatctctgattctttcagcttcagcagcaatctttgttcatctagctattatgtgaagatgcactcataagaagcctgagtaggtagggtgtagaaggacacacagaaaaagagcaacagaaactagtttggggcttgtttcaaacaagcccggacttatcttccatgctgagtacctgtacacagctctctaagtgggaccaatggagtcagaggaaaacaggaagcagtgaatcagctggactgtcaagccacttcgtttaagacagaaaccagctactggttt

SEQ ID NO: 135379 - DNA, 601 bp, Human
aatgaagccggaaaccatcatcctcagcaaactaacacagaaacagaaaaccaaacaccacatgttctcacttataagtgggagctgaacaatgagaacgcatggacacagggagaggaaaaacacacatcggggcctatcgggaggggtgggggagggagagcatcaggacaaatagctaatgcatgtggggcttaatacctaggtgatgggttgatgggtgcagcaaaccaccattgcacacgtttacctatgtaacaaacctgcacgttctgcacatgtatcctggaacctaaaattaaaaaaaaaaaaaaaaggatcttggttattacagatgcatctccttggatttgcttatattctttgtgaggggaagagactcagaccatatacactatgatttgttctgttgctgattacttttataacaagaccactggaacagtaaaaagggctacaataccctctggtgaacaaactgaggcaatgctcttgaaccaagagaaccagaaaaggcacattgatgctctctaatggttaagtgacaagtacaagcttaattgtccaatgatgtgacagttgcccaatgatatgtggtaca

SEQ ID NO: 135380 - DNA, 601 bp, Human
ctataattatttttgttttataatagtgattgtacagtaaatattttttatatagttttacaaaaatacctatatgggagtttgtgctttggttatttaaaccttggaaagaattttaagaattttaagaattttctatcttgtttacaatgttttatcctcagattcaggctcggtgcctggcacgtagtaggtggtcaacaagtacctttagaataaataaattatttttatcagtatccagggcgagccttatgcaaacttataaagtggactaagttggtttttgctaaattcatcytcccttttctagtctttcctcttccttcttctcataggagaatatcttgtcacacctgcagaatcctcatgtgtcctctatatagttgaccctgaacaatgtaaggattagggacactgacccccccatgcagctgaaactttgcatataatttttttttctctctctttcttctttttttcttttcttttcttttatttatttttttttttagacactgtctcactctgtcacccaggctgctggagtacaatggtatgatctcggttcactacaacctccatctcccaggttcaagtg

SEQ ID NO: 135381 - DNA, 601 bp, Human
ctcagattcaggctcggtgcctggcacgtagtaggtggtcaacaagtacctttagaataaataaattatttttatcagtatccagggcgagccttatgcaaacttataaagtggactaagttggtttttgctaaattcatcttcccttttctagtctttcctcttccttcttctcataggagaatatcttgtcacacctgcagaatcctcatgtgtcctctatatagttgaccctgaacaatgtaaggattagggacactgacccccccatgcagctgaaactttgcatataatttttttytctctctctttcttctttttttcttttcttttcttttatttatttttttttttagacactgtctcactctgtcacccaggctgctggagtacaatggtatgatctcggttcactacaacctccatctcccaggttcaagtgattctcctgcctcagcctcccaagtagctgggactacaggttgctgccaccaggcccggctaatttatttttatttttagtagagacggggtttcaccatgtaggccaggctggtctcaaacttctgacctcaggcgatcctcccaccttggcctccca

SEQ ID NO: 135382 - DNA, 601 bp, Human
tacctttagaataaataaattatttttatcagtatccagggcgagccttatgcaaacttataaagtggactaagttggtttttgctaaattcatcttcccttttctagtctttcctcttccttcttctcataggagaatatcttgtcacacctgcagaatcctcatgtgtcctctatatagttgaccctgaacaatgtaaggattagggacactgacccccccatgcagctgaaactttgcatataatttttttttctctctctttcttctttttttcttttcttttcttttatttatttwtttttttagacactgtctcactctgtcacccaggctgctggagtacaatggtatgatctcggttcactacaacctccatctcccaggttcaagtgattctcctgcctcagcctcccaagtagctgggactacaggttgctgccaccaggcccggctaatttatttttatttttagtagagacggggtttcaccatgtaggccaggctggtctcaaacttctgacctcaggcgatcctcccaccttggcctcccaaagtgctgggattacaggcgtgagccaccgtgcctgcctgtatata

SEQ ID NO: 135383 - DNA, 601 bp, Human
atataatttttttttctctctctttcttctttttttcttttcttttcttttatttatttttttttttagacactgtctcactctgtcacccaggctgctggagtacaatggtatgatctcggttcactacaacctccatctcccaggttcaagtgattctcctgcctcagcctcccaagtagctgggactacaggttgctgccaccaggcccggctaatttatttttatttttagtagagacggggtttcaccatgtaggccaggctggtctcaaacttctgacctcaggcgatcctcccrccttggcctcccaaagtgctgggattacaggcgtgagccaccgtgcctgcctgtatataacttttggctcccctaaaacttaagtgtcaatagcctactgttgaccagaagccttaccaataacatacacaattgattaacatatattttgtatgttatgtgtattatatactatgttattacaataacctaagctagagcaaagaaaatgatattaagaaaatcatcaggaagagaaaatatatttactaagcggaaatggatcatcataaaggttttcatcctcatcgtcttcacatt

SEQ ID NO: 135384 - DNA, 601 bp, Human
tctttggattcacctattctagatattcctataaatggaattatacaatgtatggccttttgtgtgtgacttctgccacttggcaaaaagtcttcaaggttcatccatgttgtagcatgtatcagtggttcatcccttttatagctgaataataattctgttgcattgctttaccacattcttctctttatatttcctatgaaaacctagtatctggagagccgctgaaaaagtagccaataaattacacgtaagtgtagctaatagaaagtgagttgagaactcatccaggggaatgtgygttgctcctgtggtggaatctcagggatgaggaaacctttccgagggggacaggagactttctggtgccacatgaatggctgacttgttgtaaagctaagtctaccaatagctatgggactggaaaaagcattgcattgagtagatggacacacaggttttgattctggtttagatgtaactaattgggttgcctgcatttccatgggtccaatgtttctgcttgttgttttggttaccttgggtttggctttctatcaggccttctgctaagctcatttacatgcattatctcatttaa

SEQ ID NO: 135385 - DNA, 601 bp, Human
tgtggttttgctctgtcacccaggctgtaatgcagtggcaccatcttggctcacttggcctcccaggctcaagccatcctaccacctcagcctcccaagtagctgggactacaggtgcaccaccacactggactaatttttattttattttatttttgtagaaatggggtcttactatgctgcccaggctgatattgaactcctcggctcaagaggtctttccaccttagcctcccaaagtgctgggattgcaggcatgagccaccgcgcccagctggtacattttaaaatgctttacacragtcaaaagaatattttatgaacctgaaaattacatggagtttaagtttcagtgtctataaataaagttttattggaacacagccctacttgcatagctctgtgtttgtactgcaatgatagagttgagttattggcacagaaactctttggttcaaaagctctaaatatttactatctggccctttaaagaacatatttgctggttatcattcataaaatggaggcagagaaagaattaagtcattcctcaggtccctttcaacttaaatgttctgagaattgcagagaaaattgctta

SEQ ID NO: 135386 - DNA, 601 bp, Human
tgaaaaatgtgctgaatccttctagcctccattgtttctgattagaaatctattgttactcaacttattttctcttgatacataatgcactgtttctttctggctactttcaagattgttttctttagttttctggttactatgatatgttttcattaaatttctttgagtttaaactatttggagtttgcacagcatgaatccataggggcacatgcgtgagtgtgtatatatgtgtgtgtgtgtgtatgtgtgtgtgcagataatatatacctttctcaaatgtcagccattacattcrtgtgttatgtgactataggtatagtaaacatatggcattatacttttatggggccacccttgtgtatgtaggacagaaatgtcatgatgtggggtgtgactgtatttttgtttgtttgttttttagtccctcaattaaccaatgaagattgtatgtctttgaatacttttcagcctcaaattctttctcttcttcttttgagatttcaaatgttatatctgttgttatagtttcatatgtccctgaagattttttttcaggtctattttctctctatttttcaaattgggtaatttctat

SEQ ID NO: 135387 - DNA, 601 bp, Human
atgctcgttgatggctgccttaaaattcttgtcaggaaattctcacttctgtgtcgtttcaatattgattgtttttcttattcagtttgagatgttcctatttcttggtatgacaagtgacttttgattgaaatctggacattttgtgatatccgattcttacttaattcttatgattcttacctaaaccttatgatttagaagatctcctctgacactaacctggtggctgaaagggggtgctgcctccttactgccaggtgggtgtagacatctagattctccacggggcctctgttgrcacctggagagaagggactccctgttactgataggtgggggtgcttcaggcttcctcctaggcctccactgacagttctctggctgggagggagaaaggcacttggtttctactccccatctggcctccactgatgctgtagagagggtggttttgctaccactgaacagtggtagaggtcttgattttttactaggtcttatctgacactctccctgtggggagaggaagtaactttcttctggacattttctttgatttgtgctatctgtacttattgaaaatccatttagttacctt

SEQ ID NO: 135388 - DNA, 601 bp, Human
tgcttgattttccaaggtgttttattgtctcttcccacccagaccatccagtttatattcagcttgtttttcacacccaaacatgcattctttcctctagtcagcctcttatctttatttaccttgaatttattgtacctctctcataccttatgtttattcttagaatgtccatttcccctccttccccttcaaatcccatccatgcatttgtcaggcctcagcacaagtgctggagtcttctgtggctgttcccttctgtcctgatctcttcctctgtgaacttcctttgaacttggastaaccaagcaatagaccatggcagtgtaaggcgccatggaggctgtgtagttcttcccatttggccaggttacaagcttcaggaaggttatccgacctgtttgtggtagtgttagaccctgccctctctacgtcatataaaatattctctgaatcctatacactttgttatattattgaccattcagttgataaaaatctgagcggttattctacagtagttctctgaggtagttactgaagaaagaaagatgggtaaggaccagttttatgtacttgcatgaagtttgtgccctaggtg

SEQ ID NO: 135389 - DNA, 601 bp, Human
gttaaaagaaacgaattcttaccaattttggcaagaaaaagaatccatcaaaagaatttggtgtagctcactccacagggccagagaactagaatcagaagcaatccagctggagtgaagccccgaaacatatcgaaggaaggggtctggtgcaatataacacagctaccaccagttcaccaaactgctgccaataaagcctccccaaccggatggagctgctgctatcattgtcaagtcccaaaatggatcctttgcagtctctccatgtctgcatcactggggactgattctgaggttkcagtggttgcccagggcccacactttagctgcaatgaatgctgggagatgagtatccagcactttaagcttctataagggatagcagactctgcctcaagaggtggaagagtcaccaaacataaaagggaatgaagatggcaaatgcatgacaaacgtccactgaactctccaagttggctgttgcatacatgccactaactttcatttactggagacttactggaaatccaaagcacattttcttttatttttatttttattttttgagatgaagactcactcttgttgcccaggctgg

SEQ ID NO: 135390 - DNA, 601 bp, Human
ataagggatagcagactctgcctcaagaggtggaagagtcaccaaacataaaagggaatgaagatggcaaatgcatgacaaacgtccactgaactctccaagttggctgttgcatacatgccactaactttcatttactggagacttactggaaatccaaagcacattttcttttatttttatttttattttttgagatgaagactcactcttgttgcccaggctggagtgcggtggcacgattttggctcacagcaacctctgccacccgggttcaagagattctcctgcctcagcctcycaagtagctgagattacaagtgtgcaccaccaggcccggctaatttttgtattttcagtagagatggggtttcaccgtggtggccaggctggtctcaaactcctgacctcaggtgatctgcccacctcggcctcccaaagtgctgagattacaggcataagccaccacaccagccccaaagtacattttcatcagaaagaaattttaccaactccgaggtagaggaaggaaacttgactcagggaagttaagcagtggagagaaaactcttgggtcttagattacttcctgacctcaaaa

SEQ ID NO: 135391 - DNA, 601 bp, Human
taaaaagttaacaaagaagaatacatatttttcttgttttgtagatgggaaaacttctgcatatttaaaggaagtaacgtgttttgggcttacatgactaccagttggtgaacccaaggctaggaccgaatctctccattttttttttaaatattcttctcactgaaccatgagtatttccctataagaattctctttgggtaacaatgaattgtttctaaagcctgcgtcattaagaatactaaaagagctcctgatttatgtgtaataattgggttgacaggacatacacactaccttyatttctcattaatagttatttagatgagagatatggtgcatttctctaatctggcttggaaaagtaaagcttgtgcaggtctctttttcttattttgagatatttatactatcagcttcagtttcaaatgcatcaatcttaggtttagttccaatttacttcaatttattaaaatatgtattgaacactgcataagaaatcaaatgggtacacatacacctaaggagttaagggttttaagcaagaaaagaagtgcttattttttaccctgcaataaaggtattttgggtatgcagcatg

SEQ ID NO: 135392 - DNA, 601 bp, Human
aagcctgcgtcattaagaatactaaaagagctcctgatttatgtgtaataattgggttgacaggacatacacactacctttatttctcattaatagttatttagatgagagatatggtgcatttctctaatctggcttggaaaagtaaagcttgtgcaggtctctttttcttattttgagatatttatactatcagcttcagtttcaaatgcatcaatcttaggtttagttccaatttacttcaatttattaaaatatgtattgaacactgcataagaaatcaaatgggtacacatacacytaaggagttaagggttttaagcaagaaaagaagtgcttattttttaccctgcaataaaggtattttgggtatgcagcatgttgttttaccagctgctaccttagcgttatatttacttttattgctgtagtctcttctggtgattaatagacaccaggatgggggagggtggatctatcatttggcctaagaatatcaagaatcaagccaataattgacagttttccattaagcaacagaactctagcattctgctagggaatgggaacacaatacaaggatacagcctggatttacatt

SEQ ID NO: 135393 - DNA, 601 bp, Human
tcagaagtaggactggctgagctaagccattttctgtacctcagtttctccaccaatgttgatagatatttactgtattccagagctctcatgtgtatcagctcattgctccttcactactaacctattaggtatgtgttgtttcttcctttcacaggtgaggaaaccaaagttcagggaggttaagtaattttctctgaagtcacagaagtagttaattgcagagtcgggatgccaacttcgatcaggggcactctagagccactcagtctcattgcttctgcttaccctgccttttggrtatcatttgagtaccccccacagacgccaaagtacatgcacgaacgcctcctccacccttttacaattgctgtgctttgagcttattgcagaatgggtactggaaaacacaattgctagacttaagaataaggttttttttttttttaaaggtattgaattatgcaattatctgaagtggtcattcattggaccacttgatgttgtggatgatttatataactttgtattttattataacctctgtttcttttttttttttttttttgagacggagtttcactcttgttgcccaggctgg

SEQ ID NO: 135394 - DNA, 601 bp, Human
atcaggggcactctagagccactcagtctcattgcttctgcttaccctgccttttgggtatcatttgagtaccccccacagacgccaaagtacatgcacgaacgcctcctccacccttttacaattgctgtgctttgagcttattgcagaatgggtactggaaaacacaattgctagacttaagaataaggttttttttttttttaaaggtattgaattatgcaattatctgaagtggtcattcattggaccacttgatgttgtggatgatttatataactttgtattttattataacctytgtttcttttttttttttttttttgagacggagtttcactcttgttgcccaggctggagtacaatggcatgatctcagcacactgcaacctccgcctcccaggttcaagcaattctcctgcctcagcctccctagtagctgggattacaggcatgcgtcaccacgcctggctaattttttgtatttttaatagagacggggtttcactatgttggccaggctggtttcgaactcctgacctcaggtggtccacccgcctcggcctcccaaagtgttggaattacaggtgtgagccaccac

SEQ ID NO: 135395 - DNA, 601 bp, Human
tttcactcttgttgcccaggctggagtacaatggcatgatctcagcacactgcaacctccgcctcccaggttcaagcaattctcctgcctcagcctccctagtagctgggattacaggcatgcgtcaccacgcctggctaattttttgtatttttaatagagacggggtttcactatgttggccaggctggtttcgaactcctgacctcaggtggtccacccgcctcggcctcccaaagtgttggaattacaggtgtgagccaccacacccagcctaacctttgtttcttacatacaaaayagtttcatgtagaagtaggtttgggaattggatttttttaatgtcatttttatatttttgagatggagtcttgctctgtcgcccagattggagtgcagtggcatgatcttggtttactgcaacctctgcctccgaggttcaagtgattctccagcctcagcctcccgagtagctggaattacaggcacccgccaccatgcctcgctaatttttgtatttttagtggagacggggttttaccatgttgaccaggctggtcttgaactcctgacctcaagtgatgtgcccatcttggcctcc

SEQ ID NO: 135396 - DNA, 601 bp, Human
atttttttaatgtcatttttatatttttgagatggagtcttgctctgtcgcccagattggagtgcagtggcatgatcttggtttactgcaacctctgcctccgaggttcaagtgattctccagcctcagcctcccgagtagctggaattacaggcacccgccaccatgcctcgctaatttttgtatttttagtggagacggggttttaccatgttgaccaggctggtcttgaactcctgacctcaagtgatgtgcccatcttggcctcccaaagtgctgggattacaggcgtgagccaccrtgcccggctaggaattggaatttgatgattgcatggaaggcagttgagtaaaaggcattggaggaggaaggagatgaagaaagaaagaaatagagcaatggcttagtttgggccattggggcattcagaagggtgagcattagtgggccagggaagagacagttaatgaaggtgtactaggagtgagcaggagctgagggacgcttattcctagcggggagcctgtgctggggagacttgctgaaggagagactgggctgagtccaggggagtgcagaactgccagactgttgaggtcag

SEQ ID NO: 135397 - DNA, 601 bp, Human
cagggctgtttcaacccgaaattgagaggctgcatctggaatacagcagaaagaggactgagccgttcttggggtagagatgaagggaagtcagcccgttagcctgggactgaaacagggaggcatctttaaatgcctcttctatcaataaaccctgacagactcacctaaatattgttacagcgtttccctaatttgtcttgttgtttctaatgtatatccccaggaccccttaccccactagcaatggctcaattatctagccctgtagggaaatattgtaatatggttttgtttttgttttttttttttttcaaattcaagtttagttttctgagtgcagaggcctaatttgactctgtttttcactggactctttctaaaaaatcactgtcttttttttcttgtcacttaaatgtagtctaactttttatttaggaaacacagtcattttgctggtctgcagtgcatggagagtccgttaaggttgctaaggtgcggacctttctgttcccagcccgaagctggaggtctgtggttcccccatggctgtcttgctgcttgctgccgagtctgcccatcactgccttggcctcactcc

SEQ ID NO: 135398 - DNA, 601 bp, Human
cagcgtttccctaatttgtcttgttgtttctaatgtatatccccaggaccccttaccccactagcaatggctcaattatctagccctgtagggaaatattgtaatatggttttgtttttgttttttttttttttcaaattcaagtttagttttctgagtgcagaggcctaatttgactctgtttttcactggactctttctaaaaaatcactgtcttttttttcttgtcacttaaatgtagtctaactttttatttaggaaacacagtcattttgctggtctgcagtgcatggagagtccrttaaggttgctaaggtgcggacctttctgttcccagcccgaagctggaggtctgtggttcccccatggctgtcttgctgcttgctgccgagtctgcccatcactgccttggcctcactcccagttgcagccggccctggccagggctcttttcattctccattgtattttctttctgcttttttttttctcagccacatctccactcttgaccccctgtggctcactcttttagccatccccaggtaatgagaaggctccttctccctggtcagtgaactgattgtttgcggggccggat

SEQ ID NO: 135399 - DNA, 601 bp, Human
gtaggtttgcatgagtcagacagggaaaggaaacatactctagacagagaaaacagcgtgaataagggcacagaacctcagcgcatcctggaggtctgagatttgcaagaatttgtcatggctgaagcgaaggcaaacaattagagttaacaatagcgaatggtcaggggctatcagtggtgtgctcaagctggcttgtgtctggcttatgggaactgggtattaaatagccagtcattttgcaagccggttgcaagccggtggtagctggagatcaacagtggtggaaatatttgcaccrtggaaatcagcaaatgctacacattagggccttctctccccaccccacaaaccaaagagctgctttcgcagcagatcactgattgtgaccccttgatgcgactctaaaaattattttaggactcttcagtgcaggcgatgagaagtgaatgtggaaaggttggcagggaagaaacatggtcaggtttgtaatctagaaagacagctctctgtttttggtcttgcccttcaggaaagagacccaagaggggagatttgcatacaggaagtttactggggagtgttcttgggaccagcattt

SEQ ID NO: 135400 - DNA, 601 bp, Human
aacagattcacctggtcccacagggaagctttggaggtggagtggccctatccagagaggcagagaggtcaggcctttatacccctgtgctgagcatgactggatacaggctgcccctgcagaggggcacataaccatagtgaagtggttctctttccctgagggcagttcctggagaaggctcagcaactagaggagagagtgcctcaggctgaaggtgattctggtggtgcactccagcatgcactgcacaccgctggcagtctggagaatgtatgagatccctggaggtgggtggcarggaggctgttgggagtgtactgtaatagtccatgttgaagatgatgaaggcctgagctaaagtagcagcggtggggatggaggcagtaggaatgcggcaacaagagtgtaggtagagtctatggacaagttcccctaacgcagtgcttctcaacggagggtgggaggttacccctagggtacatttacaacatctggaagcagtttaggttttcataactggggtagggggagggtgttactggcatctagtgtgtacaggccggggatgctgctgagtatttgatactgcccaggacca

SEQ ID NO: 135401 - DNA, 601 bp, Human
aatttttgttattaaggcaacataggacaattcaaaaggtaaattcaaggactatttgataaaaatatgtggaaattcatttgaagatatagatatgggtataataatattttgcaggtaggaacattttaaagggatcttatggcattttgcttacaaacatcgttcttttcgttttacaaatagaaggtctaatcttatgacactgaattgctcaagcatttaataggctaaatttcaaagacttagtgctttctttcctaagcaagagttggagagtcattcttactattattatttktttttttttttggtggaggggaggtaagggtacaatgttctgaagaattttccagctaggagcaaactatttttaatgcctattgcaacttcccaagctccattatattggagatatgagagttgcttcatttagtgagggataatggaaagagattaggattctgtccactgcatgtaaacaaacacccaacaaaagtggttgcaacaatagggatttattacaccctttatgaagataactggatttatactgttccagggctgattaattcagtagtttagccatgccctggtgagg

SEQ ID NO: 135402 - DNA, 601 bp, Human
cactgctgctgactatcttcctacaacacatctgtccccacgcttccgttttaaagttgtccctgctgcttcctttggacacttccatttgactgataaatgccagcttcttagcttggacgccctacctgacctactgcttcacggccgtgcatacggaatcctctcacaacccacgtttttgcatatgctgttcccttctagaacatctccttttccttgtggaaccatcctctctgatctaaatcaaatgtcttctctgtgagacctcctcagcaagagttcctaccccagagagacytcagcatctctctacaatggtggtttcttctgttgaaggatgcagcttgggatttagcagatcaaagcatggcccctgctagtccttctaattacctttgtgcattaacaggaagcatttgaggaaggactcccacgccagcaccattacactattttccctgtcttatctgatgcctgtggacacgtttatcccctaggttgagtggtatttacctggaaatcttcagtgtttggcccacagttggtatttgtatgaatgtctgaatgaacataggagctcaagttggaattttcatag

SEQ ID NO: 135403 - DNA, 601 bp, Human
tcctacaacacatctgtccccacgcttccgttttaaagttgtccctgctgcttcctttggacacttccatttgactgataaatgccagcttcttagcttggacgccctacctgacctactgcttcacggccgtgcatacggaatcctctcacaacccacgtttttgcatatgctgttcccttctagaacatctccttttccttgtggaaccatcctctctgatctaaatcaaatgtcttctctgtgagacctcctcagcaagagttcctaccccagagagacttcagcatctctctacaayggtggtttcttctgttgaaggatgcagcttgggatttagcagatcaaagcatggcccctgctagtccttctaattacctttgtgcattaacaggaagcatttgaggaaggactcccacgccagcaccattacactattttccctgtcttatctgatgcctgtggacacgtttatcccctaggttgagtggtatttacctggaaatcttcagtgtttggcccacagttggtatttgtatgaatgtctgaatgaacataggagctcaagttggaattttcataggggatcctcttcttatta

SEQ ID NO: 135404 - DNA, 601 bp, Human
cttctagaacatctccttttccttgtggaaccatcctctctgatctaaatcaaatgtcttctctgtgagacctcctcagcaagagttcctaccccagagagacttcagcatctctctacaatggtggtttcttctgttgaaggatgcagcttgggatttagcagatcaaagcatggcccctgctagtccttctaattacctttgtgcattaacaggaagcatttgaggaaggactcccacgccagcaccattacactattttccctgtcttatctgatgcctgtggacacgtttatccccyaggttgagtggtatttacctggaaatcttcagtgtttggcccacagttggtatttgtatgaatgtctgaatgaacataggagctcaagttggaattttcataggggatcctcttcttattaaagtctgtccttccctgggggcttgctactccaagtatggtccctggacttgcagaccagcagcctggcaacatcagggagcttgttagaaatgcaggcttgcagctgggtgcagtggctcacacctgtaatcccagttctctgggaggccgaggcaggaggatcacttgagctaaaaa

SEQ ID NO: 135405 - DNA, 601 bp, Human
agcaagagttcctaccccagagagacttcagcatctctctacaatggtggtttcttctgttgaaggatgcagcttgggatttagcagatcaaagcatggcccctgctagtccttctaattacctttgtgcattaacaggaagcatttgaggaaggactcccacgccagcaccattacactattttccctgtcttatctgatgcctgtggacacgtttatcccctaggttgagtggtatttacctggaaatcttcagtgtttggcccacagttggtatttgtatgaatgtctgaatgaacawaggagctcaagttggaattttcataggggatcctcttcttattaaagtctgtccttccctgggggcttgctactccaagtatggtccctggacttgcagaccagcagcctggcaacatcagggagcttgttagaaatgcaggcttgcagctgggtgcagtggctcacacctgtaatcccagttctctgggaggccgaggcaggaggatcacttgagctaaaaacaaacaaacaaacaaacaaaaattagctgggcacggtggcctgtgcctggaatctcagctattcaggaggctgaggc

SEQ ID NO: 135406 - DNA, 601 bp, Human
tgaatgaacataggagctcaagttggaattttcataggggatcctcttcttattaaagtctgtccttccctgggggcttgctactccaagtatggtccctggacttgcagaccagcagcctggcaacatcagggagcttgttagaaatgcaggcttgcagctgggtgcagtggctcacacctgtaatcccagttctctgggaggccgaggcaggaggatcacttgagctaaaaacaaacaaacaaacaaacaaaaattagctgggcacggtggcctgtgcctggaatctcagctattcagraggctgaggctggaggattgcttgagcccaggagatagaggctgtggtgagctatgatcacactactccagcctgggtaacagagtgagatgctgtctcaaaacaaaaccaaaaccaaaacaaaacaaaagaggcaggatctccaatctcaccccagagctgctgcatcaggatctgtcttctagcaatgtctgcagaagattcctgtgcacattaaagttcgggaagcactgctctaggctggtctcaaattatggcccattactacctataacacaataccttagaattaagggagtc

SEQ ID NO: 135407 - DNA, 601 bp, Human
tccctggacttgcagaccagcagcctggcaacatcagggagcttgttagaaatgcaggcttgcagctgggtgcagtggctcacacctgtaatcccagttctctgggaggccgaggcaggaggatcacttgagctaaaaacaaacaaacaaacaaacaaaaattagctgggcacggtggcctgtgcctggaatctcagctattcaggaggctgaggctggaggattgcttgagcccaggagatagaggctgtggtgagctatgatcacactactccagcctgggtaacagagtgagatgctrtctcaaaacaaaaccaaaaccaaaacaaaacaaaagaggcaggatctccaatctcaccccagagctgctgcatcaggatctgtcttctagcaatgtctgcagaagattcctgtgcacattaaagttcgggaagcactgctctaggctggtctcaaattatggcccattactacctataacacaataccttagaattaagggagtcctaacaaaattgcaactgcctttcttccttccttccttctgtccctccttctttctttcatttttttcttggaggcagaatcttgctctgtcgcc

SEQ ID NO: 135408 - DNA, 601 bp, Human
tggcaacatcagggagcttgttagaaatgcaggcttgcagctgggtgcagtggctcacacctgtaatcccagttctctgggaggccgaggcaggaggatcacttgagctaaaaacaaacaaacaaacaaacaaaaattagctgggcacggtggcctgtgcctggaatctcagctattcaggaggctgaggctggaggattgcttgagcccaggagatagaggctgtggtgagctatgatcacactactccagcctgggtaacagagtgagatgctgtctcaaaacaaaaccaaaaccaaamcaaaacaaaagaggcaggatctccaatctcaccccagagctgctgcatcaggatctgtcttctagcaatgtctgcagaagattcctgtgcacattaaagttcgggaagcactgctctaggctggtctcaaattatggcccattactacctataacacaataccttagaattaagggagtcctaacaaaattgcaactgcctttcttccttccttccttctgtccctccttctttctttcatttttttcttggaggcagaatcttgctctgtcgcccaggctggagtgcaatggtgccatc

SEQ ID NO: 135409 - DNA, 601 bp, Human
gggagcttgttagaaatgcaggcttgcagctgggtgcagtggctcacacctgtaatcccagttctctgggaggccgaggcaggaggatcacttgagctaaaaacaaacaaacaaacaaacaaaaattagctgggcacggtggcctgtgcctggaatctcagctattcaggaggctgaggctggaggattgcttgagcccaggagatagaggctgtggtgagctatgatcacactactccagcctgggtaacagagtgagatgctgtctcaaaacaaaaccaaaaccaaaacaaaacaaaaraggcaggatctccaatctcaccccagagctgctgcatcaggatctgtcttctagcaatgtctgcagaagattcctgtgcacattaaagttcgggaagcactgctctaggctggtctcaaattatggcccattactacctataacacaataccttagaattaagggagtcctaacaaaattgcaactgcctttcttccttccttccttctgtccctccttctttctttcatttttttcttggaggcagaatcttgctctgtcgcccaggctggagtgcaatggtgccatctaggctcactg

SEQ ID NO: 135410 - DNA, 601 bp, Human
ctattcaggaggctgaggctggaggattgcttgagcccaggagatagaggctgtggtgagctatgatcacactactccagcctgggtaacagagtgagatgctgtctcaaaacaaaaccaaaaccaaaacaaaacaaaagaggcaggatctccaatctcaccccagagctgctgcatcaggatctgtcttctagcaatgtctgcagaagattcctgtgcacattaaagttcgggaagcactgctctaggctggtctcaaattatggcccattactacctataacacaataccttagaattmagggagtcctaacaaaattgcaactgcctttcttccttccttccttctgtccctccttctttctttcatttttttcttggaggcagaatcttgctctgtcgcccaggctggagtgcaatggtgccatctaggctcactgcaacctccgccttctgggttccagtgatcctcgtgcctgagcctcccaagtagctggggctacaggtgcccgccatcaagcccgctaatttttgtattcttagtagagatggggtttcaccatcttggccaggctggtctcaaactcctgtcctcaagtga

SEQ ID NO: 135411 - DNA, 601 bp, Human
gagctatgatcacactactccagcctgggtaacagagtgagatgctgtctcaaaacaaaaccaaaaccaaaacaaaacaaaagaggcaggatctccaatctcaccccagagctgctgcatcaggatctgtcttctagcaatgtctgcagaagattcctgtgcacattaaagttcgggaagcactgctctaggctggtctcaaattatggcccattactacctataacacaataccttagaattaagggagtcctaacaaaattgcaactgcctttcttccttccttccttctgtccctccytctttctttcatttttttcttggaggcagaatcttgctctgtcgcccaggctggagtgcaatggtgccatctaggctcactgcaacctccgccttctgggttccagtgatcctcgtgcctgagcctcccaagtagctggggctacaggtgcccgccatcaagcccgctaatttttgtattcttagtagagatggggtttcaccatcttggccaggctggtctcaaactcctgtcctcaagtgatctgcctgtctcggcctcccaaagtgctgggattccaggcgtgagccactgcaccct

SEQ ID NO: 135412 - DNA, 601 bp, Human
ctgcctttcttccttccttccttctgtccctccttctttctttcatttttttcttggaggcagaatcttgctctgtcgcccaggctggagtgcaatggtgccatctaggctcactgcaacctccgccttctgggttccagtgatcctcgtgcctgagcctcccaagtagctggggctacaggtgcccgccatcaagcccgctaatttttgtattcttagtagagatggggtttcaccatcttggccaggctggtctcaaactcctgtcctcaagtgatctgcctgtctcggcctcccaaartgctgggattccaggcgtgagccactgcaccctgccgctccttctttcttaaaatgtacattcaaggacctgccctctacctactgaatcagaatcccagtggggagggccactgtattttaaacaaatacctcaggagattcttatcaccctgaagtataaggaccacattccagggcaaattttaactctttagttgtctctgattttccccaaaaccgtggactgaagatgctcaccttcaaaattagtgttaactctgttgtggtctatacccatctacctttccagtttccctgt

SEQ ID NO: 135413 - DNA, 601 bp, Human
actgaatcagaatcccagtggggagggccactgtattttaaacaaatacctcaggagattcttatcaccctgaagtataaggaccacattccagggcaaattttaactctttagttgtctctgattttccccaaaaccgtggactgaagatgctcaccttcaaaattagtgttaactctgttgtggtctatacccatctacctttccagtttccctgttgctgttaatagcactatcgttctcctactgtccctagatttctacctggctttcattcccattattgaaatactcttacctygtgcagtgtctccacgtttcaggaaagaaaagaagaagtttttgttagcatctgtggccttttctagtaattgtcctgtttctttgcaggtgttactttcctgtcaagttcatggtgtgtcgcccctgtcctcgttctctgttgtagtctgccttctcttcccacttctccaccaaaactcttctctcaaaagtcaccagggacttccttattttcaaattcactgaccttttggagcacattaaagcaaacctcttagaggttggcaaccttataaaaaaatttgtatttggttctaac

SEQ ID NO: 135414 - DNA, 601 bp, Human
tactcctcaaaaatgagagatcagtaagaaaaccagtgcaaaagtctagctaagacttgttagaccagggcacagtattttgttgttgttgttgggatagggtcccaatgtgtcaccctggaatgcagtggcatgatcatggctcactgcagccttgacctcctgggctcaagtgatcctcccacctcagcctcccaagtagctggaactacaggggtgtgccaccacccttggttaattttggtgtttttgtagagagggggtgtccccatgttactcaggctgattttgaattcctggrctcaagagatccacctgccttggcctcccaaggtgctgggattacaggcctgagccaccatacctggttggggtgcagtattaagaagtgacatagagtggtagaaacctggagaataggttgccgtgggtgagccgcacggggaaagaataggctgaagacagaatcaacctttgatcaggaggagtgaaggaagagctccttagagaagtaggatgtgatacagattcaaaacactcaatatccctttctgactaacaagaaagtcctttttctactataaaaagcatatagtaaaag

SEQ ID NO: 135415 - DNA, 601 bp, Human
ttaagtctcggcctcatttctgggcctctcctgcactgttctcctttttcacactccgggcgtcagctagatgttctgcaaagcccttggattttccaccttcatgctcttgttcttgctgctttccttccccttgcccttagaatgcccttttctccatatttgcctttaagaagtcatgtttttggccgggcatggtggctcatgcctgtaatcccagcactttgggaggctgaggcgggcggaaaacgaggtcaggagatcgagaccattctggccaacacagtgaaaccccatgtgmaagaggcccagcaatgacttgtctttttttttttttttttgcctttcatgggcagcacgcagggtgctttctggctgataaatccatacggtcaggattggctgactccttcacggtaatgggagatgtatttgacactgctgcccctgctgacctgtgggtgcaccagccaccgggacacctccatgagacacagtgttagaggtttatggctaagaaactgatttgaagtgtgtgaacgtgtgccaagaaaaaatgattcggcttttgttattttataatgttcagataatcaatatg

SEQ ID NO: 135416 - DNA, 601 bp, Human
cctctcctgcactgttctcctttttcacactccgggcgtcagctagatgttctgcaaagcccttggattttccaccttcatgctcttgttcttgctgctttccttccccttgcccttagaatgcccttttctccatatttgcctttaagaagtcatgtttttggccgggcatggtggctcatgcctgtaatcccagcactttgggaggctgaggcgggcggaaaacgaggtcaggagatcgagaccattctggccaacacagtgaaaccccatgtgaaagaggcccagcaatgacttgtctttttttttttttttttgcctttcatgggcagcacgcagggtgctttctggctgataaatccatacggtcaggattggctgactccttcacggtaatgggagatgtatttgacactgctgcccctgctgacctgtgggtgcaccagccaccgggacacctccatgagacacagtgttagaggtttatggctaagaaactgatttgaagtgtgtgaacgtgtgccaagaaaaaatgattcggcttttgttattttataatgttcagataatcaatatgaagcatttttttacattttgcttt

SEQ ID NO: 135417 - DNA, 601 bp, Human
ctgggtcttaggttcctcatctgtcaaatggagacagtaatagttgattacataattttcatgaagattaaatgagttattgcacgtttagtatagtgctttccccttataaacactcactacttatttttattttttattttttacttttgagacagagtcttgctcttttgtccaggctggagttcgagtccaggctggagtgcagaggcacgatttcagctcacttcaatctccacctcccaggttcacgtgattcttctgcctcagcctcttgagtagctgggactacaggcgtgcrccgccacgcctggctaatttttgtatttttagtaaagatgaggtttcactatgttgcccaagctggtctcaaactcctgacctcaagtgatccgcccatctcagtcccccgaagtgctgggattacaggtgttagccgccgctacttatttttgtaagatgtccttttatctttgatagattatgtacttatttatttatttgagacagagtctcgctctgttgccccagctggagtgcagtggtgtgatctcagctcactgcaacctctgtctcccgggttcaagcaattctcctgctt

SEQ ID NO: 135418 - DNA, 601 bp, Human
ttttacttttgagacagagtcttgctcttttgtccaggctggagttcgagtccaggctggagtgcagaggcacgatttcagctcacttcaatctccacctcccaggttcacgtgattcttctgcctcagcctcttgagtagctgggactacaggcgtgcgccgccacgcctggctaatttttgtatttttagtaaagatgaggtttcactatgttgcccaagctggtctcaaactcctgacctcaagtgatccgcccatctcagtcccccgaagtgctgggattacaggtgttagccgccrctacttatttttgtaagatgtccttttatctttgatagattatgtacttatttatttatttgagacagagtctcgctctgttgccccagctggagtgcagtggtgtgatctcagctcactgcaacctctgtctcccgggttcaagcaattctcctgcttcagcctcccgagtagctgggattacaggcacgtgccaccacgcccggctaatttttgtatttttagtagagactgggtttcaccatgttggtctggttggtctcgaactcctgaccttgtgatccctccgcctcggcctcc

SEQ ID NO: 135419 - DNA, 601 bp, Human
cccgcattcctagattgcttctcctgtgatagtgttctcagttgttacctgctatttccctagaaggacctttagtgtaattcagagttccttctccccatctctaccatcactaatccaatccaggcccttctcatccttcatttgagcctctgctgtaatctctcaattagttttcctgactccagtttcatcctctatttgacccactctccatctgccaccagaatgactaaggaagtaattcaacaaccatttacgagccaattactcttttcaggctgggataacacagccaacraatcactgtttctgctctcgcaaaacttagtttctagtactgaaggccaataaagctgtgtacgcaaacataactaatgtgtttataaactgttgcaaaggaaacaaaccaggatttgaggtggaggatgaaagggaaggtatcctttgcgtagggttgatgaacaagggctgtccttgatgatgacatcgaagctgagttcgaaaaggtgcgaagaaactagaagaggaatgaagggagccaggggtgtccaaaggagagaatacagttatgggttcttagtttctgtttctggttggg

SEQ ID NO: 135420 - DNA, 601 bp, Human
aggggagagtggaaagtgggtaaggattaaaaatattacctactaggcgcaatgttcactattcgggtgatgggtacactggaagcccaaacctcatgattatgcaatacacctatgtaacaaactagcacgtgtacccttgaatctaaaataatagaatacaataaaataaaggaaaacaaaaaaacccaaaatagcaaataaaaaattccataaataattcatatgttaaaaaacacaacaaagtgtcagctttaaatctgtattattctgtaggctgtaaagtctgtgagagaaaagrttatggttcagccctccttgtattgtcagtacttgacacaaaatataaagcctgtagaaagtattaaaatgtttagatgaatgatttcgtatgatttaaaaattactatctgtttctagaagctgcagtatctagcacatcttccccgcggggatgtccttctgttctgattggcctttagagaaagtagtctgataccaccctgatttttatctctttatccatttcagaggccttgggttattctgagcatgttgatttcaagtcctgtaaagctgagtgacttaacatatcgttctt

SEQ ID NO: 135421 - DNA, 601 bp, Human
tattcatctttcttaaatgtatgcatagcccactttcacttcagtgttaatattagatgtgtcttggtctttatttagaaatctggttattttttgtgatcagaaatatgccgtaggaaacttattcttgtttatattaattagcctgtggtaaaattgatttcattatatgttgttttgcttaaagtcacagttttcaagaaactgttgaaaatgttaagtgagtacttaactgtattttgagtggaataatttgcaactgaaaaaagtttacaaaaataggattaatttctgcagaaartgttcacagtaaaatgccaagggataaaaatggtattaaaaattatatacacagtatggtcttaattttaggagaaaattctatatctatgcaagcatatatagttataggtttgtgtacaaaaatggctgtaaagtaatacaccaaaatactaatagcagttttgcctgggtagtggaatttgggtaatttcagctttcttccttatacctttctttattttctaaattttataataaatattttctttttgaactcaggaaatctatggtatttatttttcaaggtaaatttttcttt

SEQ ID NO: 135422 - DNA, 601 bp, Human
agtcttctgattcctgccctcaaagcagagtgtaataaatgagattgagaaaacacttgtattttctgaattagggtttaagttcctggaaacctcttgttcttgtttaatttaagattgaaatctgtgttttttttttttttttttttttgagacggagtctcactgtgtctcccaggttggagtgcggtggcgcgatctcggctcactgcaagctccgcctcccgggttcacgccattctcctgcctcagcctcccaagtagctgggactacaggcgcccgccaacacgcccggctaatttttttgtatttttagtagaaacggggtttcaccgtgttagccaagatggtctcgatctcctgacctcgtgatccgcccgtctcggcctcccaaagtgctgggattacaggcgtgagccaccgcgcccggccctgtgtttgtttaaaaatgaaaatggttctaaacttttcttgggtcactgagccctctgagaaaatgatgactgaggattttctcctctcacgtgtgtacacacaaagaacattttatatataacttcagaagtcttatgttgcctattccactctggattgtaggtt

SEQ ID NO: 135423 - DNA, 601 bp, Human
gagataaattaggagtgttacataaattgtgtcccatgcacacactacactccaaagggtctaatgaggaaaatgcaggctttgaacaagccacacctggctccactcttatctagttgtaatactttggtttatttacctgactattctaaagttcagtttctcgtctgcacaatgaggatatcaactcgttatgcaactgggagagttagcagatgtgacatctgttaagttcctgctttgggcctggtattgactatgcaaagcagcagatgcacagataactttctagtcttgtagrtggaagggaagggaaggagatagtggatgagggacgggttcataggaagagggcattggacaaaaatgcaggaaaaagaactcttcataaacagagagtggtgtgcatgtgttacagggagagaggacaggtaaaggtgttaaaggtggcaagattagtatggtcaaagtagagtccagaccaagattgggtgtgttccaggaaatagcgggacttccatttgagtgccttatagttatttcttaggagtggacacagaagacagcacagctggggtaggcgcttgaacgccagtttgaa

SEQ ID NO: 135424 - DNA, 601 bp, Human
ctcgttatgcaactgggagagttagcagatgtgacatctgttaagttcctgctttgggcctggtattgactatgcaaagcagcagatgcacagataactttctagtcttgtagatggaagggaagggaaggagatagtggatgagggacgggttcataggaagagggcattggacaaaaatgcaggaaaaagaactcttcataaacagagagtggtgtgcatgtgttacagggagagaggacaggtaaaggtgttaaaggtggcaagattagtatggtcaaagtagagtccagaccaagaytgggtgtgttccaggaaatagcgggacttccatttgagtgccttatagttatttcttaggagtggacacagaagacagcacagctggggtaggcgcttgaacgccagtttgaatagtttgaattatacttggtaggcagcctagaaggagctatagacaacttctccaaagactggaaattcaaccaaagaggccagtttgctttctagtttccccattccctcagctcattcaggccacgcaggaagttaccattgcatatgtgtccttcttgtagcctctggggatatcactgtgtaa

SEQ ID NO: 135425 - DNA, 601 bp, Human
aatgtttcttggcttcatgctgcttaggaccccatgggaaatcttggcagaacaccctgttatacatctatactgagtgcctctcacagcttcccttcacatcagatttttctgtttgtcacccgcttttgccccttttccttcttgtcttaaagagagacatccttcactcctgtctctgaggctacctgtctcctgtgttcttgatcccacgttgtcccttgggacactgcttcatcatttctgtgtacctctctggcctcttttgaccctttccctcatgggctttttttcttggctygacagttgctcaaatttcccatcattttttaagaaagtagtaacaaatgtacaaaaagtcccaagcatcaaaactttccttagatgtttatgtctttctcaatagactacaatctttttattttctcacagtcaacttttttttgaaaagtctgtgtattttcctatttccatttatgtaaactttgaatgaagagaccagagttacaaagcaaagagccttgtgctaaaattaagtctagaacatatcatacttggaagcattctgcatgtgaaggagaagtggggtggccacaaggag

SEQ ID NO: 135426 - DNA, 601 bp, Human
ttagtctagtctgagactgatgagtgttctaccaggaagtgagaagcatcaggttgagaatatcattgggataaggtgagcagggaatccattaagggactaagagccctttactttgatattgagaggggacattgccacacatgatacaaacagcactgatcttgctcagcatctgcaaataaggatcgcagacacaacttttcaaatagtcacttcagccttacccttctgctaaagtaatttatgtcaagtagggaataggcttttcaatgtcatccaaaccccctgcttagggaaggggcattcgtttgtaaacacactacagagctattgaagaatacaaaacttggtgaccttatctgtaaagctggtgtggtacccttctcaaacaccagagcaccgtttagtgagaaaatcagctagtcgattgcccaaacgttttccattttagcatcagaggaaccaaagtccaggaaggtgaaaatatgttgggcaaaggtcgtggcaatttagttttttgattgagtctagatctccctggatagacctgggtcgtgtcaaaacagtttctggtaaacagttttataacctgcctctg

SEQ ID NO: 135427 - DNA, 601 bp, Human
cgaacccttagccagaagtgtcaccagtgggaaatgcgctaagccaggaaagtatgtagccgaacaaaaggcaaaggctactgtgttcttttgctaggctatggtttgcaaaacatgactctcacaaacgtccagcttctctggaaagaaaggtaactagacattgcagaaacagccatggggcaaaggattaaactgaggttttccaggttgcaggatttgagttacagggtaaagaatcttgccatatattttctattattttggccgcggtttctttaccctcttgtttcttgttggyagggaacatgaagagtttcagaattcatgaggaatttcaggcctggggaaagagctgcatttcttccttatgctttttcctccaagatggcgttgagttagaaagacctggaagggggtcagcctctcctccttccttgctccactgaagagcaggaggggactcctctgctaatatccattctttatagtttgcagttaatttctcaactttggttgttttgccttcttatattgtcaaatggagactctgtagatgtttcttgagtccagggattagccagttctttgtttctgtcgc

SEQ ID NO: 135428 - DNA, 601 bp, Human
ttacccaagtattaagcctagtacccattagttatttttcctgatcctctccctccccctccttccaccctctgataggccccagtgtgtgttgttccctcatgtgtccgtgtgttctcatcatttagttctcatttatataagtgagaacatgagataatctggttttctctttctgtattagtttgctaaagataatatcctccagctccacccatattcctgcaaaggatgtgatctcgttctttttttatggctgcatagtacttcgtggtgtatatgtaccacattgtctttttttcttccttccttccttccttcctttcttccttccctccttccttcttttttttgacggagtctcactctatcgcccaggctggagtgcaatggcaccatcttggctcactgcaacctctgtctccagggttcaagcaattctcctgcctcagcctcctgagtagctgggattacaggcacgtgccaccacgcccggctaatttttgtatttttagtagagacgtggtttcaccatgttggccaggctggtcttgaactcctgacctcaactattctgcccgccttggcttcccaaagtgct

SEQ ID NO: 135429 - DNA, 601 bp, Human
atatgtgtatgtgtctttatggtagaatgatttctattcctctggatatagacccagtaatggcattgctgggtcaaatggtagttctgtttttagctctttgaggaatagccacactgctttccacaatagttgaactgagttacactcccaccaacaatgtataagcattcctttttctctgcaacctcgctggcatctgttattattattattattattattattattattcacttttgaataatagactttcagactggtctgagatgttatttcaccgtggttttgatttgattcrgactggtctgagatgttatttcaccgtggttttgatttgattcggactggtctgagatgttatttcactgtggttttaatgatcagtgatgagctttttttcacatgcttgttagccacatgtatatcttcttttgaaaagtgtctgtttgtgtcctttgcccactttttaatggggctgtttgcttttttcttgtaaatgtgtttaagttccttatagatgctggatatgagacctctgtcagatgcatagtttgcaaaaattttttcccgttctgtaggttgtctgtttattcataat

SEQ ID NO: 135430 - DNA, 601 bp, Human
aaagaattctcttaaagtgaggatcaaatgaagatgtctacatgaatatttcatatatgttttggacatgtcagccaatgaacttatacaaaagaataagaggcttaaatattaaaaagttgtgtacaattcatttggaaacaagtagacagattaataggtgatattggaagaactatctagccattggggaagcggaaagaatgtttttaccttatgaaaatgcagagaacataaaagaatgtaaaaatttaaaattttatataaccaaaaaggaaaaaaaacagtgtatgtgtttgtktgtgtgtgtgtgtgtgtgtgttgcaacactaactacaaaaggggcaatgccttcttttacaaagaaaacaataataataacctgttataaaaatgagcagatgacttgaacagggagttcacagaaaaatgaatacagatgacagtggatatataaaaaatactcagctgcagctgggcgtggtgtctcacgcctgtaatcccagcactttgggaggctgaggcaggcagatcacctgaggtcaggagtttgagatcagcctggccagcatggcgaaaccccgtctctactaaaaataca

SEQ ID NO: 135431 - DNA, 601 bp, Human
aataagaggcttaaatattaaaaagttgtgtacaattcatttggaaacaagtagacagattaataggtgatattggaagaactatctagccattggggaagcggaaagaatgtttttaccttatgaaaatgcagagaacataaaagaatgtaaaaatttaaaattttatataaccaaaaaggaaaaaaaacagtgtatgtgtttgtgtgtgtgtgtgtgtgtgtgtgttgcaacactaactacaaaaggggcaatgccttcttttacaaagaaaacaataataataacctgttataaaaaygagcagatgacttgaacagggagttcacagaaaaatgaatacagatgacagtggatatataaaaaatactcagctgcagctgggcgtggtgtctcacgcctgtaatcccagcactttgggaggctgaggcaggcagatcacctgaggtcaggagtttgagatcagcctggccagcatggcgaaaccccgtctctactaaaaatacaaaaataagctgggcatggtggtgtacgtctatagtcccagctacttgggaggctgagaaaggagaatttcttgaacccgggaggcagaggttgc

SEQ ID NO: 135432 - DNA, 601 bp, Human
ctgggcgtggtgtctcacgcctgtaatcccagcactttgggaggctgaggcaggcagatcacctgaggtcaggagtttgagatcagcctggccagcatggcgaaaccccgtctctactaaaaatacaaaaataagctgggcatggtggtgtacgtctatagtcccagctacttgggaggctgagaaaggagaatttcttgaacccgggaggcagaggttgcaatgagctgagatcgtgccattgcagtccagcctgggggacagagtgaaactccatctcaagaaaaaagaaaaaaaaaatatatatgtatactcagcttcattaaatatttttaaaatgtgattcaaaacaatgagacaccccttgtacccttgtacccatcaaattgacagagatgaaaatgttaatttgctgagggattatttatatttattcatttttccttttttcattaagagtttaagttagcttgctaggttgcataaaattaagcaatttagcataaattaaaagtaagtgaggccacctgcaaagtagtcttgccaaacaatctgatcaagttgaatctgatcaatttctaaccaacagagggatgtgtga

SEQ ID NO: 135433 - DNA, 601 bp, Human
atactcagcttcattaaatatttttaaaatgtgattcaaaacaatgagacaccccttgtacccttgtacccatcaaattgacagagatgaaaatgttaatttgctgagggattatttatatttattcatttttccttttttcattaagagtttaagttagcttgctaggttgcataaaattaagcaatttagcataaattaaaagtaagtgaggccacctgcaaagtagtcttgccaaacaatctgatcaagttgaatctgatcaatttctaaccaacagagggatgtgtgagtcaataayaagggataagagcagcagaatccagtggaaaaaactacaggacacatggcctgcatttcttcaacaaaataattgcatgaagttgcaggaggagaggaaagggagaggcaaaaagaaatggagggaggtcaggtgcagtggctcacgcctgtaatcccagcatgttgggaggccaaggcgggcagatcacctgaggccgagagtttgtgaccagcctggccaacacggtaaaacctcatctctactaaaaatacaaaaattagctgggcatggtggcacatgcctgtaatctcagctact

SEQ ID NO: 135434 - DNA, 601 bp, Human
ttcaccatgttggccagggtggtctcaaactccagacctcaggtgatccactcgcctcagcctcccaaagtgctggaattacaggcttgagctactgcgcctggctattttggtaaatttcaaacatattcaaaagtggactgtattataactgccaggtatctagcactcagctttgacaatgaccagctcatggccaatcctattttatctgtatctctatcccccactctgcctttttttttgaagcaaattctagaataatatcatttcactcgtaaacatttcagtattatctctaaaaaaaaaatacttattttttaaaacctaaccaaaacccagtgtgtattttgaaaagctcgagcacgccactaaatttctttgcaacccattgccattttttattttaaagtgatgtttttaacacccttatgactacatttccttgcgatcaatgctaatgagtgaagcagcccataaatgaggaaggagatgaaccgagacagtaggagttccctactgcctgcctcctgccttttccctgggcctagaacataactcagggcattggctgtgatttgcttttaggttcttttaagaa

SEQ ID NO: 135435 - DNA, 601 bp, Human
atcctattttatctgtatctctatcccccactctgcctttttttttgaagcaaattctagaataatatcatttcactcgtaaacatttcagtattatctctaaaaaaaaaatacttattttttaaaacctaaccaaaacccagtgtgtattttgaaaagctcgagcacgccactaaatttctttgcaacccattgccattttttattttaaagtgatgtttttaacacccttatgactacatttccttgcgatcaatgctaatgagtgaagcagcccataaatgaggaaggagatgaaccsagacagtaggagttccctactgcctgcctcctgccttttccctgggcctagaacataactcagggcattggctgtgatttgcttttaggttcttttaagaacatcttagtcaacaccaaattgttaacatgacataaaaggtctactaggacttttttttttttagctttaatcacatgaagctgtaataaaacccatttgagcacttttattctcttaaaatggggccatttcccaattagcggatggacaggctggctcattcttctttgacaggaacgtaattctttgtgtccttca

SEQ ID NO: 135436 - DNA, 601 bp, Human
tgccttttccctgggcctagaacataactcagggcattggctgtgatttgcttttaggttcttttaagaacatcttagtcaacaccaaattgttaacatgacataaaaggtctactaggacttttttttttttagctttaatcacatgaagctgtaataaaacccatttgagcacttttattctcttaaaatggggccatttcccaattagcggatggacaggctggctcattcttctttgacaggaacgtaattctttgtgtccttcaccgattcttcgaaatgttcttagcttggctgrctgccttcccttcttttttttttttttttgagagggagtcttgctctgtctcccaggctggagtgcagtggtgcgatctcggctcactgcaacctctgcctcccgggttccagcgattctcccgcctcagcctccagagtagctgggattacaagcgtgtgccccacacccggctaattttttgtacttttagtagagatggggttccagcgattctcccgcctcagcctccggagtagctgggattacaggcgtgtgccccacgcccggctaattttttgtatttttagtagagatggg

SEQ ID NO: 135437 - DNA, 601 bp, Human
ggcaccgcacctggccaccttctttcattcttcttgtttccctgtctgtctcaggcaactttctacctctctgtttgtcattcccagatctactcatttcctcctgtccctctcttaagctccatttgcctgcttgaattctgccatgcgtcccgtccctgcagcatcttatacttaatacatctgacttggaactcatgatctgccctttccccactggccacccccactgacctgactttcctctttcacttaacttcatttgggggtggaaaagccagatgacgagcatcatttttaytaccactactattactagtagcaatacttctactattactattactacttccagtactactactatgcttctgttcctttgttcctcttatgcagtaagtgaccagagcctatagattttgcctctgcaaaattcaagcagcttatttgtgagccagattgctgtggtctctacctcttatttttgggtctagtgcttaaactctgtacataggtaagaagacatgggccctgacttcaaagggcttgcatttttagtggaagacatggatgaacagatgggttcacttaatcagcatag

SEQ ID NO: 135438 - DNA, 601 bp, Human
tgtggtagacaagggctacttaactgtggctgatttctcagacacttgtgaaacttaaaaaaatatatggatcctgaagcctcactctatcaacttagctggtaactactgtccccagtagctgagagacctggacaaaagggcatcagcaggggacccacctgcatgggtccttttggggcagtttcacccatagggataggattgcaagtgtggcttcagtgacacaactacaatgtgagattttaagactttttagcacttagagactctgtatggcacccagcacgcctggaagccccacacacacacctggaagccacacacacacacacacacacacacacacacacacgtgcacgcagagagagagagaagggaccactgagccaatgtctttattgggtacagggcgttatccagtttcctgcagggagctttaattgctgggtttaaagcaagcaggcactagttctaggaggtcacagcgtgactgagaggtggtcaccttacgtttgtgggcaaatgtctgcatggtctgtttaaagggagtggcaggaaagtagggaggccagcctgctaggcaggagagatgtctcta

SEQ ID NO: 135439 - DNA, 601 bp, Human
tggacaaaagggcatcagcaggggacccacctgcatgggtccttttggggcagtttcacccatagggataggattgcaagtgtggcttcagtgacacaactacaatgtgagattttaagactttttagcacttagagactctgtatggcacccagcacgcctggaagccacacacacacacctggaagccacacacacacacacacacacacacacacacacacgtgcacgcagagagagagagaagggaccactgagccaatgtctttattgggtacagggcgttatccagtttcctgcrgggagctttaattgctgggtttaaagcaagcaggcactagttctaggaggtcacagcgtgactgagaggtggtcaccttacgtttgtgggcaaatgtctgcatggtctgtttaaagggagtggcaggaaagtagggaggccagcctgctaggcaggagagatgtctctaagtttcatgtctggccgctgctttggagccactctggtggagtgtggtattagacaccgtgttaagagtgactgagccctgcttctgatatgagatagtttaacttaggtttaaaaatggatactgaggca

SEQ ID NO: 135440 - DNA, 601 bp, Human
atgcagaggtttgtgcaatttccattccattcttggttgttcattttgtttgtttgttttttgaagagctctgtacaaatgttcaaaacagttgagaaaagaataacaaacattcagtcaacaaatatttatgatgtgcaggtgctgggcaaaatcattggccatcatggaacttatattctagtggagaaaggtagataaacaagtaataaataaatgcagaagtaaataaataaatacaaaaataaaataattctagattgtgagaaaaggtttgcgggaaatgagtggaagatggtcrtggagatctattgtagagagagtggacatttttcaactaaaatatcaaagtttcagggaagctgctttgagctcatattgtgttgcaggctgagtgtaaggtgccagaatgtgaaagcaggaatgtgtggatagtaatccttagattgtgttcaggaagctctgggaaggttctatgagggaggttttgaatttggaaggttgagttcttgtctgcaagacagctagagccctccaggtagaaggaacagtatgagcaaaggtaaggtcttaggagattcattctgactctgaaatcaaa

SEQ ID NO: 135441 - DNA, 601 bp, Human
tcagagaacacagtcatgcgggtaacagggtctgatgcaatatagtgctgcatatgcccaatcaggccgacgaggcttaccctttgcagactgtgccaataagcagtcgaggcttgttgcgatctgcagaaatctacagaattctctgtttccgagaaggcttgttgctagcatatgacatcatagaaagcctttttttttttctgacattttttctgctttgctttagaatatcaaaggcaaagactgttgaacatagttggccacttagctttattattcatagtgctccctcccatgtttttttttttttttttttaacagtgttcaatgttagcgtcaggtgttggctgccttcctgggggaacagattgctgtgaagtaaacacagctggaaactgaccacatattgtttttctttcttttaagaaatcaaagaggcatttatagaaaagctgcagaacatggtactgtccagatttatagatttattcctccaagtctggttaatgattaatgtcacgcctgggtgtccacatagacccacttcccttctcccttcctgaagctgcaatttcctcggaacaatgagcttgcagag

SEQ ID NO: 135442 - DNA, 601 bp, Human
gtctgtttggctgaggtgcatggatgggaattgttggaattaggccatatatctatttggattctcataactgggtccagcacctagcatagttcctggtacataggaaagctctatgcgatgtcaataactgactaatttagtaacatccttaacagctgtttgagttccaagagcaggaaagtgaatggtgagttttgaaccttataaaatacataagtaaacccaaatgaggagagaattgagaaagcctcttattctgaaggtggtcctaaaaggctttctctaggctgattactgygaagcatattttttcctggctatatacaacttggcagaattgatctgattttggattctgaaggaattgaaaaatttcattatacattatagtgggctataatgatgtggccagttctcttcattaattttttaaatgactttaaaaaaaatgagacagtactgattgtttccctaaatgaatctaattaacagctacttaaggtatcttaatgttttttcatatatgttatctgctttgattctcatatcagtccagtgaggtgagtatggttgttacttcctcattttacaattgaga

SEQ ID NO: 135443 - DNA, 601 bp, Human
ttctgcttcctgagctggcatttctcagtctgttcttttttactcatcaacaaaagtattcgagccaaattctcttgtaatttcagcccaggtgtgatcaacatcaagttacctttccatttggcccaagaagaagttataacttccttgcataagctcatctgttatcttaatcctttctggaacagggaaaatgtaaataagtattactctatccctctcttaagtttttcaaattacagcaggtggttgggaaaaggggagggcagaacagtggaaaagcattttttattctacttcyattgctaactttgtagtagttaacagatcgatttagaaaatagtgggttactaagataagggtgaccaccctttactaacactaaaaagaaaaaaaaaaagctataaccaagtgtctgccatcaccattatagtgtaaaagaaaaaaaaaacaaaaacaaaaaacaaggccaggcatggtggctcatgcctgtaatcccagcactttgggagaccaaggtcagcggatcacctgaggtcaggagttcgagaccagcctggccaacagggagaaacccccatctctactaaaaatataaaa

SEQ ID NO: 135444 - DNA, 601 bp, Human
ataagctcatctgttatcttaatcctttctggaacagggaaaatgtaaataagtattactctatccctctcttaagtttttcaaattacagcaggtggttgggaaaaggggagggcagaacagtggaaaagcattttttattctacttccattgctaactttgtagtagttaacagatcgatttagaaaatagtgggttactaagataagggtgaccaccctttactaacactaaaaagaaaaaaaaaaagctataaccaagtgtctgccatcaccattatagtgtaaaagaaaaaaaaamcaaaaacaaaaaacaaggccaggcatggtggctcatgcctgtaatcccagcactttgggagaccaaggtcagcggatcacctgaggtcaggagttcgagaccagcctggccaacagggagaaacccccatctctactaaaaatataaaaattagccgggcatggtggtgcatgcctgtaatcccagctcctcaggaggctgaggtaggagaatcgcttgaatccaggaggcagaagttgcagtgggctgagattgtgccactgtactccagcctgggtgacagagtgagactctgtctca

SEQ ID NO: 135445 - DNA, 601 bp, Human
ttacagtcaaatatgtggcctacttttactacctgtataggaatttatgggatatacttttaaaactttttattttgaaataattgtagattaacaggaggttgcaaagaaacgtacagggaagtcccatagatccctttccccaggccatgccaaactcccccgccatcccaagttaacatcttacacaactataatacattatcaagatcaagaatgtggcagtagtgcaaatcatagaacttaattttgccagctatgcaagtattcctttgtgtgtgtgtgtgtgtgtgtgtgcacrtgtagctctataaagtttatcacattgtgtaagtcttgcataagtactattataatcaagatacttcactacagcaacattacaagactcttttatgctcccctcttataatcaaacccacctcttctccccatctccgtccttaatccccagcaaccgctaatctgttctcctttgccattttgttatttcatgattgttatataaacaaaatcatgcatctctttttgagatttttttttgttcaatgtaattttattgaggttcatgtaaataattgcatgtattgatagtttgttc

SEQ ID NO: 135446 - DNA, 601 bp, Human
atatgtagattatgttgattcatttttatgtactcagctagctttgcataccccaaatgaatcccagttagttatggtatatatatttttgtgcattgttggattcgatttgctaaaattttgttgaggatttttgtttctaggcttttgggagatgttggtctgtggtggtttatttattatttctcttgtgctattattttctagttttagtattaaggtaataatggcttaataaaaatgaattggtaagtgttgcttctattttttggtagacattgtataatattggtgctaattmtttggatgtttgctaaaattctccaatgaaagaaaatgagcctggattttttttttctgggactttttaatcacaatctcaatttctttagtagttataggactattcagattatctgtttcatcatggctgagttttggtagtatgtggttttgaggagttggtccatttcttccaagttgtcacatttatgagagtaaaattgttcatagtgtttcctgcctatcctttaaatggctgcacaatctgttgtgacatcctttttttttttccctgatactgataatttgtgtcttcttt

SEQ ID NO: 135447 - DNA, 601 bp, Human
cctcgtatggtattaataaggtatactgtgaatatacttatctgtttcactgtgtgaagcaaaaagtatcacttcattattgtagagtataccgctgtagctcaaagagtctcgttgttattactttaatgccaaggcttaaatttgtactcctaaagaagtagctcccacattttgtgtttttcttggcaatttttgaaggctggcttggtgatttcttcccattcataccctgcctccttctgctgcgcttcacaaaaataaataggccttgacaaagctccattctcccgagttcaaygtgtgtggcccctctgtttgagctctttctttgagctaccgatgccagtgtgagctgtcccttcccttgattgatagtgaccaattctaaatcagttcgatgctagttcatattatttcatttaaccaccacaagaaactcagaggcagtgtttgttactctcacttgacatgtgaacaaacagaacgatgcaacggtcaggtgcattgctccaagctgttgagcatagcttcatgggtaagagttcagggtctggagccagaacacttaggtttatatttgggatctaaacttcactag

SEQ ID NO: 135448 - DNA, 601 bp, Human
tgagccactgcgcccggcctgagtgttcttaaattatttagtcactttcaatattaattgttgaaagaggtattaatgaggtattataccttgatttcaattcataccctattctatttcaatagaggtaataacacctctgagagttgtaaaaattaaggaagctattttatgtaaatggtctcacgcagtctcttgcccaaataggtgcttaataaatatttctgaatcaatgaatagtgattgcgatagtaaccagtgaactgattcctcatgtaaaattataaatgaataattatcrtactaaaccgaagctggttgttcatataaaaaaatgaatactaggtgacctttggaagacctttggtcttccaggggaagaatttttgtaataagcttggttctttccccagaggactaaaatattgaaaaagtgacagagaacatccacccacagtataaacttcctgcagaatcgcaatgcccctggcaaactaatatgcccagccctggagagaacacagtgtcaactaatccaatctgatttgtcagtcttggccccatcatttgatatttttggcccacttgatgagcccaaggg

SEQ ID NO: 135449 - DNA, 601 bp, Human
attacagctgtgagccaccgtgcccggccagcatttgctatgtttattgtactactgttggtacatttctttcaggaaaatgcctttctcagctcctagttgtgtgcacagccagagccaaacatttttctcttaagtagattgataccacctgagagatcattgaagtggtagaaataaatactcaggaagtgactatagaaacaaaatcagcaaacctctggctcttaagaagaccccagaattgtatatgtgctgtgcacagaagaaatattgctgggcttgataagacagcctggtwgagtagagaggatgcagaactggatatcaggagacctggggcagctgtgggctgggaggagtcactttacttctctggaccttctgtccatctataaaagaagggacgagatttgaaattcttatgttctatgaattttgtgagttaacagaatatatgccattactatttgtttcttaaaacaattgtgagacatgtggtgaaataattacatatattggtgctcttgggtgaaagaaaaagcttgagacttactgctgtagcacaatgacctatatcagcggtccccaacctttttgg

SEQ ID NO: 135450 - DNA, 601 bp, Human
ggtacatttctttcaggaaaatgcctttctcagctcctagttgtgtgcacagccagagccaaacatttttctcttaagtagattgataccacctgagagatcattgaagtggtagaaataaatactcaggaagtgactatagaaacaaaatcagcaaacctctggctcttaagaagaccccagaattgtatatgtgctgtgcacagaagaaatattgctgggcttgataagacagcctggtagagtagagaggatgcagaactggatatcaggagacctggggcagctgtgggctgggagsagtcactttacttctctggaccttctgtccatctataaaagaagggacgagatttgaaattcttatgttctatgaattttgtgagttaacagaatatatgccattactatttgtttcttaaaacaattgtgagacatgtggtgaaataattacatatattggtgctcttgggtgaaagaaaaagcttgagacttactgctgtagcacaatgacctatatcagcggtccccaacctttttggcaccagggactggttttttgaaagacagtttttccatgaactgggtggggggatgattt

SEQ ID NO: 135451 - DNA, 601 bp, Human
tgccattactatttgtttcttaaaacaattgtgagacatgtggtgaaataattacatatattggtgctcttgggtgaaagaaaaagcttgagacttactgctgtagcacaatgacctatatcagcggtccccaacctttttggcaccagggactggttttttgaaagacagtttttccatgaactgggtggggggatgatttcgggatgattcaagcacattacatttattgtgcactttattattattacattgtaatacatcatgaaataattatacaactcaccataatgtagaatcratgggagccttgagcttgttatcctgcaactagatggtcccatctgggggtgatgggagacagcaacagatcatcaggcattagattctcataaggagtgcacaacatatatcccttgtatacacagttcacagtagggtttgtgctcctatgagaatctaatgccactgctgatctgacaggagatggagctcaagtggtaatgtgagcgatggggagctactgtaagtacaggtgaagcttctctccttcacccaccactcatctcctgctgactggtattagtccatggcttggggg

SEQ ID NO: 135452 - DNA, 601 bp, Human
gctaagcattttacttgtattgtctcttttaatactcactcctgcttcacaatataggtatattaatatccccatgttaaagaagaaagggagccccaaagagattaagtgatttaaacccaaatgtgatttatttcaaatcccctcttattcacactcataggctgctttagtttactcatgaacttccactttcttcttaaggaaaaaatatcctcagtggtgtgtgatttgggaaggacataattgactcaatagcttatgtttcttcttttcccccttatctttcttagaccacctmgagatttagactccaaggcttgcatttctattggaaatcaggtaagaaaaaatcatgtctgccacctaatacgttggccattttatatgtatgctttctgactgaaaaatttattttccctagcatgctgtcaggggatgagtcaaaaaaagtttgcatttaaagggaagtggtatgcaaagtttttgctattttgaaagaatgttgaattgaaatcaggctattgtggttttgatggaaggtatttgaatagagtagatggttctcttgggagggcatttctcaaagctcagacataat

SEQ ID NO: 135453 - DNA, 601 bp, Human
tataggtatattaatatccccatgttaaagaagaaagggagccccaaagagattaagtgatttaaacccaaatgtgatttatttcaaatcccctcttattcacactcataggctgctttagtttactcatgaacttccactttcttcttaaggaaaaaatatcctcagtggtgtgtgatttgggaaggacataattgactcaatagcttatgtttcttcttttcccccttatctttcttagaccacctcgagatttagactccaaggcttgcatttctattggaaatcaggtaagaaaaartcatgtctgccacctaatacgttggccattttatatgtatgctttctgactgaaaaatttattttccctagcatgctgtcaggggatgagtcaaaaaaagtttgcatttaaagggaagtggtatgcaaagtttttgctattttgaaagaatgttgaattgaaatcaggctattgtggttttgatggaaggtatttgaatagagtagatggttctcttgggagggcatttctcaaagctcagacataatctagttgccatcagtcaatagtgggttacagacacaatgaagggtcatggct

SEQ ID NO: 135454 - DNA, 601 bp, Human
tcctttgataaagttcatctctttcacctggagtccgtctctacccccagtcccccatgggtggaagtagaattgactcaggcaagagaactaaggggctttcctttgagattggatagcaaaccatataagtagtattccttatcatggctgaggacataagaagaagacgtgatctttgtcttacatccaaattgaatataaacacttgttagcaagcagagctatgagatcatatcattgagaattttagagaatatgataaaaattgatcttgtactggccatcacatgagagcttgttggaaaagaatcatgggtctcaagatcaaatgaattggaatttgcattttaacaagatttccgggtgattcttgtgcacatgaaagtgtgaaaaactctggtataaagtagagccctttcagacaacaggaggcaggatataatgatttatctcttcctctttccttttcttccttcttattggcctgttatctcttcaaccagccattcatccatccatccattcattcattttctatccccccattcatccatttattcatcttttaaaatcacttttaaaatgtaatagatcccct

SEQ ID NO: 135455 - DNA, 601 bp, Human
ggagggcggatcacctaaggtcaggaatttgagaccagcctgcccaacatggtgaaaccccgtgtctactgaaaatacaaaaattagttaggtgtggtggtgggtgtctgtaatcccagctacttgggaggctgaggcaggtgattgtagtgattgtggtgattgtagtcagggaaacttctgggaagagataaccagaaccctgtctttgggaagaataatggaatgtattggtaagtaagagggccttgtggtttggataattcttaaactctctgagcctggaaataatgtaaaatgycttccacagtgtgcctattattgttagttgttattattaaaaattggaaaaataggatgaaggaagatgagaagaaaataggaaggaatacagataggaaaaagactgtagattattcacaactttgaaattaacattaagggttatttcaccattatgaaatatgtaattcatattagagaaaatatgtaaggtataaaaataataaaatgaaatttgtgtatcttctagcttaaagggaaaattataaaggataatttttaaagcttttgtaataatcttttacttccaattttatgg

SEQ ID NO: 135456 - DNA, 601 bp, Human
taaggtataaaaataataaaatgaaatttgtgtatcttctagcttaaagggaaaattataaaggataatttttaaagcttttgtaataatcttttacttccaattttatgggtgttatgaaaagtatcacaaagggaaaaattagctgtaatttcaaatgttattatccagagataatcgtagttccattttttgggcatatgggcgggtgggttaaatttttctagtcaaaaggattcgtttaaaatctggtctgtaatactgcttcttcagtaacctgccctgtggtctggaatacctrggtttatgatcctttacactatgtgacctctgacacatcgctagcagaggtttcaatcaaaatctgttgctttgggccaggcttggtggctcacacctgtaatcacagccctttgggaggtggggtgggaggactgcttgaggccaggagtttgagaccagcctggtcaacaaagagacatcctgtctgtcaaaaaaaaaaaaaaaaaaaagttagctgggcatggtggttcccacctgtagtccaagctactcaggagactgaggcgggaggatgatttgagcccaggagtttgaggct

SEQ ID NO: 135457 - DNA, 601 bp, Human
ttgggcatatgggcgggtgggttaaatttttctagtcaaaaggattcgtttaaaatctggtctgtaatactgcttcttcagtaacctgccctgtggtctggaatacctgggtttatgatcctttacactatgtgacctctgacacatcgctagcagaggtttcaatcaaaatctgttgctttgggccaggcttggtggctcacacctgtaatcacagccctttgggaggtggggtgggaggactgcttgaggccaggagtttgagaccagcctggtcaacaaagagacatcctgtctgtcaaaaaaaaaaaaaaaaaaaagttagctgggcatggtggttcccacctgtagtccaagctactcaggagactgaggcgggaggatgatttgagcccaggagtttgaggctgcagtgagctatgatcacaccactgcacaccggttgagtgacagagtaagaccttatcttgaagaaaaaaccaaaccaaacaaaaacaaaggttgctttggtcatatttggtgtatcattgtgtcacagtctgcctttttgttctttgttttattactcctacgttaaatatcaatagatcattttgaattg

SEQ ID NO: 135458 - DNA, 601 bp, Human
ttgaactttgccttgtgtttcctgctgtctatccacaaatgaaacgtgggtgattccctaaagcagccctgttgaaactgttgtctccttttttcttcttttctccagattgagttggccatccttcgatttccctatgattcatggggaactccatttcagcagctcaaacaggtggtagaggagccatcgccacaactcccagcagacaagttctctgcagagtttgttgactttacctcacagtggtaagacagcctcacctcccaagtgtcagtgtgaaagaagaagatgagttctyatgaatttcttccattggggttgaatccatcatgcatacattcattccgaaagcatttgtggagtatgccctctctgctggagaagcaaagatgaccgtatcacactccctgccctcactgggcccaaagtcaagtagagaagtctcataaatgaataattatagtataatgtggcaagtccagtgatagagataggggcataggcgatttaaggaactcagagggaagacctcaggataggcttttctggaggagataaatctggagctgcgatcacgagaggaattttccagacaaaa

SEQ ID NO: 135459 - DNA, 601 bp, Human
tgaaactgttgtctccttttttcttcttttctccagattgagttggccatccttcgatttccctatgattcatggggaactccatttcagcagctcaaacaggtggtagaggagccatcgccacaactcccagcagacaagttctctgcagagtttgttgactttacctcacagtggtaagacagcctcacctcccaagtgtcagtgtgaaagaagaagatgagttctcatgaatttcttccattggggttgaatccatcatgcatacattcattccgaaagcatttgtggagtatgcccyctctgctggagaagcaaagatgaccgtatcacactccctgccctcactgggcccaaagtcaagtagagaagtctcataaatgaataattatagtataatgtggcaagtccagtgatagagataggggcataggcgatttaaggaactcagagggaagacctcaggataggcttttctggaggagataaatctggagctgcgatcacgagaggaattttccagacaaaagggaaataggaaaggaaacatattccaaacagaaggaacatcattcacaatgtcacaaaagcaagaaactcc

SEQ ID NO: 135460 - DNA, 601 bp, Human
tgctaggattacaggcttgagccactgcgtccggccaatttttctaattttaatgtatgcacacatatatggaagttccagataccggcatcattgctcttcatataatgactgccctgtgccttctctctccttataacacccatagtgccttcatggctgcctgcaaagatatccccttctctctcattttcttttaattttaatcccagctaccacagttcattaattaaaaaattttgagccgtagacatgtctcagctttcctgaaactgttaattctattaatactgtttgctcrgtgtcatgtcatttctactcaagtaagtcagtttgtcttatatctgggtatattaaaaacaataccctgtctctacaaaaaatacacaaattagctgggtgtggtggtgtgcacctggggacccagctacttggaaggccaaggtgggaggatcgcttgagcttggaaggctgaggctgcagtgagccataattgtcccactgcactccagcctgggtgacagagcaagatcctgccaaaataagataaaattaaataaataacaaaatgcaatataaaataaaataaaatatgaaacta

SEQ ID NO: 135461 - DNA, 601 bp, Human
ctccatgttttttatatttttattatgtaggctatggtcctcccagacttctcagaaaggccgctctatgtgctaagtggggaagggagactacggatttcaaaagtgaaatatttaatctcaaatttcaagatagatacatctatgtttttattgcctacatctgtctttggtatgcagaaaaagaacccattatacccgcagcctaggtaactgtcagagtatttgtgaacttgtgtatcctacctaagcatccgatgtcacaaagctactaggtatcatacacctgcctaggtatcayacccgtgccaaggaatcaacttggcacgatgccatcaccatgttgcaaggtaccataattctgtatccagggaattgatttggtagccactcttgtctggcccatcagtactgatcactgcttgttagttgacagtaaatcacttagtttgtagggtgaagtagaaaagctctaacaggctatcatcaccacacccaaagttagacctagagtccagagttccagtttttgcatttcttttgcagtaacatctgacaaatgttatcttgaaggagaaggaagaattaaccatatgaacgt

SEQ ID NO: 135462 - DNA, 601 bp, Human
tgtcagctatggtcagaagcgtgtgttgtggcatttggaaaaggaattagggcagttagctaattgcacgcttgaaaatgagaagctctttgaaaattcaaaagtctgattccagttcaaaaagaaattggtgttgctttgaactccaaagttgttattgtatactgaatttcaagtacttcctactaaacatggaaaatttgctttccccccaaccttatcctgagtgtattgctattcttagcccatgttttgaagtgttcttgatttaaaagatggagagaatgggttatatcagttmcattaatttaataaacagccttgctttgcggtgtaagtattttccatctatattctgcagtagtgtttggggtagattgtgagctttctaatcaggggccatgagtcaaggaatagcctattgaccagttagtcttggaggtttcaggaatccttaacactttatgatggatcaactagggtactttccccatattttctttatacagagttaacaaaaatctggagattttttttttcttttttgatacagtctcaccctgttgcccaggctggagtgcagtggtgcaatctcagctca

SEQ ID NO: 135463 - DNA, 601 bp, Human
taacagcatttattgcctccggtatcaaatgttattaaatgtctgtgtcaatggagagcagaataaccagaagtcacctgacaatagcgcatgaccataaagtatttctaacaagaataattgctgtcactgagtgcgctctctcttttatcagctgtcataaacaggtcttattacctttgtcataaacaagtagtattaccttagaaatgttatggggggttgggcacagtggctcacacctgtactcccagctctttggaaggctgaggcaggtggatcacttgagcctaagacttcragaccagcctgggcaacatggtgaaaccctgcctctacaagatacaaaaattagccaggcatggtggcacgtgcctgtaatcccaactactcaggaggctgaggcaggaagatcacctgagcctagggaggtggaggctgcagtgagccgagattgtatgcccctgcactccagcctgggcaacagagccagcccctgtctcaaggaaaagaaaataaatattaggggtttattgcttctatctcaggcaggtttggttaggactatataaaagcaaattatacattcatgggaaacaga

SEQ ID NO: 135464 - DNA, 601 bp, Human
tgtgtatacaatttatatttttgaatttaaaagatatgagaagcctcatattactaagataaaattaaggaaagtatgatttaagagatttcaatactgaggaaaacttaaatgctctttgactgatcaatttttgatcaaatatctgggctaaattagatgaacaactttttggggggtagctaaggaggaaaaaaaattttgctttttgttttcactttggtggaaaaaagtaagacaaagcatgattagtttaaattatactccctcagcattcacagtttatcacttgctgtgtctrtaaaaagcaagagtgaagaaagtaatatcttagcattgtttgttgtattaaaataacgtttcttaaattgtggtaactataggccgggcatggtggctgttcatgcctgtaatcccagcactctggtaggccgagttgggcagattgcttgagcccaggagttggagaccaacctgggcaacatgacgaaaccccacctctacaaaaagtacaaaaaattagccgggcatggtggcatttgcctgtagccccagctactcaggaagccgaggtggcaggatcacttgagcccaggaagtt

SEQ ID NO: 135465 - DNA, 601 bp, Human
aatggacttgccttttaagactataactgttccctgctttcctgtggaactgaggttttcaaacggaaaatctgagtccaaactccctgactttagcattgggaaaacacttgctgagaggcaattgtttagattttaggagttggtgaggaagtatgaaggaaaaaaataatcctttttccaggtgaaggacagtttaattaaggccttaacctagacatgtccctcttatagaaatcccaaatgtttctctccctaacacggattgaagggtgtgtattctttaagatcatgtcatttkcttcttctctcaaatgtcactggggagtatgactcagtagaatttgttcttctaaagtaggtagcagccaacgatttctgtaaaggactaaatagtaagtattttagtctttgtaggctatacagttgctgtttacaatggcttaattcagtgttgcaatgtgaaagcagccatatccgatgtgttaaaaaaaaaatggggtgtgtgtggctgtgttccaataaaactttatttaaaaaaacaagcagtgggctaaatttggcctctgggtcataggtagctgatccctgtcctagatga

SEQ ID NO: 135466 - DNA, 601 bp, Human
tatgttcacggatctccatgttttcttcaggcacatcagtgagactaaatggtgtaaagtcctcccttcttgtctccctggctcctcttttgggaaacccagcctggtattatagtctgagtattattcatagtccctcatttgtcaatttcctggttgctgcccttgctaatcttaatccattgcttataggagggactgggttccctcttaaccttttacagcctcaaaacccacacaagaaggcaagtcacactttccatttgtcatgcctacccgttttcccctccccctgcccttytggctctcatagcattttctcaacctgggaataaatggaaagatgcctagcgattttctttttttttgattaaagacttcaagtcaggttatttaattcatttgcagactcaggcaacatctactgagctaatagccactagcagaacaaaaggcaaggtggggctggcaggtgttggaagcagtcaccaagataatctgaggtttggcatgtcctgttttgatagtaaaaagcttttaagtacattaaaagatttccaaatgtccagaggatgtgggaaagctaataagcatgatggta

SEQ ID NO: 135467 - DNA, 601 bp, Human
ggtgactaatcagaagtatggctgctatttagtttttgagggagctcaggaggaaggacctggcactcagagcttcagttgatttcatgagtgtaaggatcggagccagcactcaacctgtgtcctcagatgggcaaagggagaaaatctcttttccattttctgagtcatgatacttaatcgcgaccagctatcttctttggggtttttatttctttgttcctttcccatttgcattgtttcctagagtttccatgagcaggaactcagttttccacggagctgactcatccaaccctcygctgtcaggtttaaaacaaatataattagaaaacctacagctgggcaacataaaggttgtaaactaaactccctaaagtcaggggaaacagagtgagtcacttatgtgtctggatgtaaaaatgcttacatttagctactcaactggtcattgaaaatagactaccaggcaatcaagggagtgagcatgggaggtgagacacgtgggactaagttctacctgtaagaattatccatttggggtaggtttggttggttctatttccactataagaactgtggctcatgacctgatatatct

SEQ ID NO: 135468 - DNA, 601 bp, Human
acctgtaatcccagctactcgggaggctgaggcaggagaatcacttgaacccgggaggcagagtttgcagtgagccaagatcgcaccactgcactccagcctgggcaacagagcgagactccatctcaaaaagaaaaaagtacatacacctatgaattgtcttattatcttactactatattagcctaaaatgaccttgtggggcccagggctatttgtaaatcagagtttgggttgttttttgtcaatctttgtattttgctgtagatgagacttacgtagcataattacactttttttwaaaatttaatatagtggaaacctagagatatcaagatggaaagagtgacaactaagagatatctttaaaatgtttgcatcactagatgtgtgcttgattttggaaagggtaggaaaagcccagcctagctctgatagggatacttaatccctgtaccaagcagatctattcatttgctaatctcatatattgattgtcagtaagacattaataccatgttttttctttttcttttccagcaacatccatttttcaccctacatgaatccaaaggaacagatgtggcatcttttgtaaaac

SEQ ID NO: 135469 - DNA, 601 bp, Human
ttatctgccatggctatagtttctttttaattctaaaactaaggttaacaaatatgattgtggctgggagcggtggctcactcctgtaatcccagcactttgggaggcggaggtaagcggatcacccaaggtcaggagtaggagaccagcctgggcaacatagtgaaaccccatctctactaaaaatacaaaaaaattagccaggcgtggtggtgggcgcctgtaatccgagctacttgagaggctgaagcaggagaattgcttgaacccaggaggtggaggttgcagtgagctgagatcrtgccactgcactccagcctgggagacagagcaagactctatctcaaaaaaaaaaaaaaatatgtgtgtgtgtgtgtgtgtgtgtgtgtgagattaaataaacttaaaaggtcttatacaaacctaggtgaaaatatttttctaaggcaagctgaactgagtattttttaattctatgcaacaaaaccacaaaaacctgttatagacatctttagactatcagagtttaagtttaaaacactaatgacagtttttaaaataaattttatataaagcaagatcaaaccaaattgtgtgaaaa

SEQ ID NO: 135470 - DNA, 601 bp, Human
attgatgggaaattttttaattttatgaaatatgacagtgaaaaaaatttaatataattttatgactttatgcataatgaaataaactaaatattagaagtagaaaaatatatagacaagcctaatctgaaaaagagataaatatctttattttctgacttccacagtaattacttagaagaaatccttctaagagaaagtcatgaatatttattaagtgttgaaatgggatatcacccactatgaacatattattccctgaaattacaagtctatgtaaaatactctttgcagtttttaatttgcccattttacccacagcaagcatcttttatgcatattaacaattttctattgtttattctataggtttcttctatcttatactatgttctaaagtctcagataatgtgacataaacacgtagatgatattaatatacgcatgcatgtttgattattgactaacatttttggcttagtaagcttttaaaatgagccataatgttttcatgtcatcattattaaatataaaatctatatgtaaaaaataaagcatgtataataataatagtcaaataccacatctgatttctttttct

SEQ ID NO: 135471 - DNA, 601 bp, Human
ggccgaggtgggccaatcacttgaggtcaggagttgaagaccagcctgaccaacatggtgaaaccccgtttctactaaaaatacaaaaaattagccaggcgtggtggtgggtgcctgtaatcccagctactcaggaggctgaggcagaagaatctcttgaccctgggaggcggaggttgcagtgagcctgtgagccaagatggtgccgctgcacaccagcctgggtgacagagggagactccatctcaaaaaaaaaaaaaaaaagtatgggattctatgacaaaaacacaccataaggatygatgggaaattttttaattttatgaaatatgacagtgaaaaaaatttaatataattttatgactttatgcataatgaaataaactaaatattagaagtagaaaaatatatagacaagcctaatctgaaaaagagataaatatctttattttctgacttccacagtaattacttagaagaaatccttctaagagaaagtcatgaatatttattaagtgttgaaatgggatatcacccactatgaacatattattccctgaaattacaagtctatgtaaaatactctttgcagtttttaatt

SEQ ID NO: 135472 - DNA, 601 bp, Human
actactagtaaactttagatttgggactaaccctttaaaaacatgtatgggaccaggcgcagtggttcctgcctgtaatcccagcactttgggaggccgaggtgggccaatcacttgaggtcaggagttgaagaccagcctgaccaacatggtgaaaccccgtttctactaaaaatacaaaaaattagccaggcgtggtggtgggtgcctgtaatcccagctactcaggaggctgaggcagaagaatctcttgaccctgggaggcggaggttgcagtgagcctgtgagccaagatggtgcygctgcacaccagcctgggtgacagagggagactccatctcaaaaaaaaaaaaaaaaagtatgggattctatgacaaaaacacaccataaggattgatgggaaattttttaattttatgaaatatgacagtgaaaaaaatttaatataattttatgactttatgcataatgaaataaactaaatattagaagtagaaaaatatatagacaagcctaatctgaaaaagagataaatatctttattttctgacttccacagtaattacttagaagaaatccttctaagagaaagtcatgaata

SEQ ID NO: 135473 - DNA, 601 bp, Human
gtttctataaagtgtcatatttagtaagtttactgaaaattttgtggtgattttttttttaaagcttggacattgaaaggcatcagatttatgtttctcaattcaaacttaatcagaattaaagtttccttctaagtagaattatgtgggaattagctggaaaacacaggcactactagtaaactttagatttgggactaaccctttaaaaacatgtatgggaccaggcgcagtggttcctgcctgtaatcccagcactttgggaggccgaggtgggccaatcacttgaggtcaggagttsaagaccagcctgaccaacatggtgaaaccccgtttctactaaaaatacaaaaaattagccaggcgtggtggtgggtgcctgtaatcccagctactcaggaggctgaggcagaagaatctcttgaccctgggaggcggaggttgcagtgagcctgtgagccaagatggtgccgctgcacaccagcctgggtgacagagggagactccatctcaaaaaaaaaaaaaaaaagtatgggattctatgacaaaaacacaccataaggattgatgggaaattttttaattttatgaaatatgacag

SEQ ID NO: 135474 - DNA, 601 bp, Human
gaaatacctgaaaacccattttagtcctgattctacgaaaactattataagaatttggaatggtttctataaagtgtcatatttagtaagtttactgaaaattttgtggtgattttttttttaaagcttggacattgaaaggcatcagatttatgtttctcaattcaaacttaatcagaattaaagtttccttctaagtagaattatgtgggaattagctggaaaacacaggcactactagtaaactttagatttgggactaaccctttaaaaacatgtatgggaccaggcgcagtggttyctgcctgtaatcccagcactttgggaggccgaggtgggccaatcacttgaggtcaggagttgaagaccagcctgaccaacatggtgaaaccccgtttctactaaaaatacaaaaaattagccaggcgtggtggtgggtgcctgtaatcccagctactcaggaggctgaggcagaagaatctcttgaccctgggaggcggaggttgcagtgagcctgtgagccaagatggtgccgctgcacaccagcctgggtgacagagggagactccatctcaaaaaaaaaaaaaaaaagtatgggatt

SEQ ID NO: 135475 - DNA, 601 bp, Human
tagtccagagaaggagaagaaagatttaaaagaggaataaatagggaatatggtagtggaaaaaactgacttttttcccagcggtaatgaggccagcgttactaccagtgtggaaggttatttagcatacacattttaaaatatgtaagtggtgtgtacctgaagtaccaacattgtttctgtaggtaaagaacaatattgggcaggggaataaaaaggagatttagaataatataaaaggcaatgcaaagaaatacaaaataacacaaaagagaaaaaacaaaaactctaggaagcagcraacagaaaagaggaaggtcaattgactagagaagatacagaaaagaagaaaagttaataaacaggtgaaaaaaaaagcagtggttatataattagcaagaaggcagtgtagatgattgaagtaggcaaaatgaagttgggggtggggggagatgattgaagtagatgaaagaagcaacggcaaaatgctgctctgttgtggctggcctgtgtttgtgagtgcagggagacagtaaagaggagcttgctttctaaaatggaggaccagaaggaaccatcctttcaaattcatttacctttc

SEQ ID NO: 135476 - DNA, 601 bp, Human
gcagttcctacccattattcttatagattacaaaaaaaggcggggggacttctttagaaaatgttattctcttcagaacttcattttaaaaatctgttttaatgctatgcaaagcatcagaaaatataagccatgaattgtctttagccaaaaatgtttcctcttttgtgactttgcttaaaataaggaaaccatacggttcctcttttcagttagctgaaaaaggcattagagaaggacagggcccaaacaggaacataattttaaacccaggttagtttgtaagatcaattttgatagkctcctatcctctactgtcagtagtaagctggtggaaccctccatgtatgagattttcacttgtcagttaacggttatggcaatattaaaaccaaattccattttttgcctatcctaacactttctaccactcttcagttagctttttatcctcctaggatctgccacatcagagtactagaaactgtattagaattctatgatggcaattcagtgtagtccagagaaggagaagaaagatttaaaagaggaataaatagggaatatggtagtggaaaaaactgacttttttcccagcggt

SEQ ID NO: 135477 - DNA, 601 bp, Human
ggagcacagtaaacatttaacctgtattgggcttcttgattcctttccattttagtttttgctttttactagtacttctaccagaaaataagcagaggcagtgaaatctgagttaataaattctgctttttatccattttgcaaaagatttaaaagggaaaatttgaacacttttggcatagatatagggatttgaataatctctggatggtcatcatccatgcagttcctacccattattcttatagattacaaaaaaaggcggggggacttctttagaaaatgttattctcttcagaayttcattttaaaaatctgttttaatgctatgcaaagcatcagaaaatataagccatgaattgtctttagccaaaaatgtttcctcttttgtgactttgcttaaaataaggaaaccatacggttcctcttttcagttagctgaaaaaggcattagagaaggacagggcccaaacaggaacataattttaaacccaggttagtttgtaagatcaattttgataggctcctatcctctactgtcagtagtaagctggtggaaccctccatgtatgagattttcacttgtcagttaacggttatg

SEQ ID NO: 135478 - DNA, 601 bp, Human
tagctgggattacaggtacacatcaccacgcctggcctatttttgtatttttagcacagacggggtttcaccgtgttggccaggctgctcgagaactgacctcaggtgatctgcctgccttggcctcccaaagtgctgggattacaggtgtgagccaccacgcctggcccaattacaataatttgataagctttctcataaaagtatgcaggagatgtacagagaagttaacctagcctggaaaggcttcagtgaagtaaagcttgaactgaattttaaaagtctataaaaactaattaartttccagccagggagagcaacaatgtgggcacaggaaaataaggcacatatgaaagtttggcagatagggctttttctgggatgtggtagatgctaaaacttggagagttaagtttcagttctacttctcccatctaactacctgtctaaccatgagaactagttgcttaacctttcctgttctcaattgcctttcctctaaagtgaagagttctactgagacaatttgcaacttttggtataatatacttgttttgcacatcatcaaacacaatggcaactatttggttatctcttaac

SEQ ID NO: 135479 - DNA, 601 bp, Human
cagcctccaagtagctgggattacaggtacacatcaccacgcctggcctatttttgtatttttagcacagacggggtttcaccgtgttggccaggctgctcgagaactgacctcaggtgatctgcctgccttggcctcccaaagtgctgggattacaggtgtgagccaccacgcctggcccaattacaataatttgataagctttctcataaaagtatgcaggagatgtacagagaagttaacctagcctggaaaggcttcagtgaagtaaagcttgaactgaattttaaaagtctataaraactaattaagtttccagccagggagagcaacaatgtgggcacaggaaaataaggcacatatgaaagtttggcagatagggctttttctgggatgtggtagatgctaaaacttggagagttaagtttcagttctacttctcccatctaactacctgtctaaccatgagaactagttgcttaacctttcctgttctcaattgcctttcctctaaagtgaagagttctactgagacaatttgcaacttttggtataatatacttgttttgcacatcatcaaacacaatggcaactatttggt

SEQ ID NO: 135480 - DNA, 601 bp, Human
atccaggagagagtctgttgcaaccccacaagagggcagcaagccattaccttgcacctttctaaaatgggaagccagctgtcaccagttctggcagtttcaacagtcaaagctctttctactgttgaaacagaattggcctcctttaacttgcacccactggtcctgatttgactcttcgcagctctgcagaatacatcttccaaaatttcaagacagttccctttcacacaggctctcttgccctcaggccagaatctcttacctcctggtatgtcttctctggacttaaaaaaacagygcccagaatggaagttgctactctagctgtggctggccagggaagggcctagaagctctgacaccattctagttctagaacttgctatttctcttcccacagcccaagatccctccagccttggctcaccaccctggggccccacattgtccttagaatctgctaaactcccaggtcttcctcagttaatggctggcagaccctgtctcactgcatcctatggggtttttaaaaaacctttcttattcaaaattccagtagaacgaataaaataactcatatttatctatcaaccagcac

SEQ ID NO: 135481 - DNA, 601 bp, Human
aaaaaatctataatagttctttttcccctctctatctcccttgctatttatttattgaagaagctggatactttctcttggagaattgcacattttctagattttgctgactgtattccagtggtgttgtttaacatgttcctccgttccctatatttcctggttgttaaatctagaggcctgatcaaattcagggacattcaataggtatgctatatattttctgtggtgtcacatcaggaagtacataatgatttggtgaggtgtgtgtgtgtgtgtgtgtgtgtgtgtgtgtgtgtggatgtggtgtttatgtataagattggtcaatgggttcagtccaatcggttcatgtgtagtctgttttttaaaaatctggaataagtttgtgtgtatcctgttaaatgtcatcttatttgctttagcccatcatcccattgtttggttcccatgtctgccaccaaatgtctccttcttagattcatatcatctgaaaatttgttaagcctgttaactttgtattcatccaaatccacataaacatgttgaacaggatagagctgaggacagagccctgtggcatgctactaaagactttcct

SEQ ID NO: 135482 - DNA, 601 bp, Human
agctagaagggggcaggtaggctgggtgtgtgggcgaagctcagataaatggaggtacaaagaaaatgtcccccatgttgtcacagtagtagaacaagacagagggtcaccttcaaaccagagagaatcgggaaaggatggcaagggttggggaaggccaggtttgggggaataagttctgggataaagggaagcttttcccagggaactgagaacacagggtctctggctgggttcctgttgtattttttgttttgtttttcaatccattgttaattctggaaaagctgggctggcaggkcctgtggtgaatatgttggggctgtggcctggggttcttgtgggaggccaaggcatccatcctcatagccaggcggggctgtcattgccagtacaaagccagctgcagtcgccacttcatctcagaggatgcgcaggagcggcaggacaaggaggtcttccagcagaacatgaagcggcggctggagtcctttaagtccaccaagcacaacatctgcttcaccaagagcaagccacgaccccgcaagactggccgcaggaaggcatgtcttccctcagggactcctcttgggagctggag

SEQ ID NO: 135483 - DNA, 601 bp, Human
ttttgctcttgtcatccaggctggagtgcagtggtgcgatctcagctcactgcaacctctggctcccgggttcaagcaattctcctgcctcagcctccctagtagctgggattacagacgtgcacccccacgcctggctaattttcatatttttagtggagatggggtttcaccatgttggccaggctggtcttgaactcctgacctcaggtgatccacccaccttggtctcccaaagtgctgggattacaggcgtgagccaccatgcccggcctattcttttctttttttttttttttttaaatgccattcttgcattgctataatcttttttttctttttcttttttttttttgagacaggatctcactctgtcacccaggctggatcatggattgcacaatggcatgatcatggctcactgcagccttgatctccagggctcaagtgatcctcccacctcagcttcccgagtagttgggactaccggtgtgcactagcacacccagctgttgtttttttttttttttttttttttgctacggggttttgctcttgttgcccaggctggagtgtaatggtgtgactcaggtcatggcaa

SEQ ID NO: 135484 - DNA, 601 bp, Human
gctggagtgcagtggtgcgatctcagctcactgcaacctctggctcccgggttcaagcaattctcctgcctcagcctccctagtagctgggattacagacgtgcacccccacgcctggctaattttcatatttttagtggagatggggtttcaccatgttggccaggctggtcttgaactcctgacctcaggtgatccacccaccttggtctcccaaagtgctgggattacaggcgtgagccaccatgcccggcctattcttttctttttttttttttttttaaatgccattcttgcattrctataatcttttttttctttttcttttttttttttgagacaggatctcactctgtcacccaggctggatcatggattgcacaatggcatgatcatggctcactgcagccttgatctccagggctcaagtgatcctcccacctcagcttcccgagtagttgggactaccggtgtgcactagcacacccagctgttgtttttttttttttttttttttttgctacggggttttgctcttgttgcccaggctggagtgtaatggtgtgactcaggtcatggcaacctctgcctctcgggttca

SEQ ID NO: 135485 - DNA, 601 bp, Human
ccacccaccttggtctcccaaagtgctgggattacaggcgtgagccaccatgcccggcctattcttttctttttttttttttttttaaatgccattcttgcattgctataatcttttttttctttttcttttttttttttgagacaggatctcactctgtcacccaggctggatcatggattgcacaatggcatgatcatggctcactgcagccttgatctccagggctcaagtgatcctcccacctcagcttcccgagtagttgggactaccggtgtgcactagcacacccagctgttgkttttttttttttttttttttttgctacggggttttgctcttgttgcccaggctggagtgtaatggtgtgactcaggtcatggcaacctctgcctctcgggttcaagtgattcttctgcctccgcctcccgagtagctgggattacaggcatgcgccaccacacccagctaattttgtatttttagtagagatggggtgtctccatgttggtcaggctggtttcgaactcctgacctcaggtgatctgccctcctcggcctcccaaagtgctgggattacaggcatgagccaccgtgctca

SEQ ID NO: 135486 - DNA, 601 bp, Human
ggctcacacctataattccagcacttcgggaggccaaggtgtgcagatcacctgaggtcaggagtttgagaccagtctggccaacatggtgaaaacctgtctctactaaaaatacgaaaaaaaaaaaattagctaggcatggtggtgggcacctgtaatcccagctactctggaggctgagatgggagaatagcttgaacctgagaggtggagactgcagtgagctgagatcgtgcctctacactctagcctaggtgacagagcaagactccatctcaaacaaacaaaaaaacaaaaaacytcgcctcatcaattatttggttactttgaggtacagttcacccagtaaatgcttgattctttcatttatcagttttcagaccaaagaattcattccctagcagcctgtaaaggtgaataccaaaggttttttgttttacactttttgttgttgttatcgcattttaatattccaggtctttcaagagataccattttacttttaatcatagcatcaatacatttcacacatgtactcaaacagaagcttattgggctgctcaggactttatcgatgaacagatacaggctgtactgtact

SEQ ID NO: 135487 - DNA, 601 bp, Human
agttcatgtgtactctctgtccccaggaagccttgaggtgtgcccaagcccacgaatcattcccccctccccaacctgtgcagaaaaggagctcccctggaagagtgggcagggggacctggcagtgtacgtgtcctcggaaaccaccaagattgtgcctgtggacatgcagacgggttggaaccagagcatctcatccctggagagcctagcgtcccctccctgtaaccaggccccaattctgacctgcctgcctccccatccacggggcactgaagagccccaggtccctctccacctrccttctgatccacgctctagcttcgccttcccaccgagcctggccaaggctggccgctctcgcagtgagagcagcgctgacctcccccagcagcaggagctgcagcccctcatgggccacaaggaccacacccatctcagcccaggcaccgctacctcccactggtgcatccagttcaacagaggcagccggctgtagctcaaggcctcggggaggagcaggaggtggaatccctgtgggaagtgctccctgggtgatgggtagagccctcgaaacttgacatggggccagaagggcctg

SEQ ID NO: 135488 - DNA, 601 bp, Human; identical to SEQ ID NO: 22572

SEQ ID NO: 135489 - DNA, 601 bp, Human
caggcgtatctggcgcacgacaccttcaaacagcgcctggacattgtggtgcaatgccgctgatgtctcaatgaacttgcagtcaaagaccaccgcgcaggcccggccctctgtgtgggtggggaaaggcaggcaccagtaaacaaagggtgggtgaatgaggagtcccctccaacagtggccacccatggaagctgccactcgagaatttgcaaggtcctccccgaaaacacagagaccccagctcctgtactgagggtactgggcactgctgcgtcacccagtaggcagagtgcctgcrtttaaggagcccccaaaacagtggccctcaaaaggagatccatttattgaaataatttgaagcctgatatttaaacaaagtacgacagtagtaaacacaggaaaatgagaactatgttggacaacttagtattttattttattttattttatttttctgagatagagtctcgctgtctcccaggctggagtgcagtggcacaatctctgctcactgaaagctccgcctcccgggttcacgccattctcctgcctcagcctcccgagtagctgggactacaggcgcccgccaccacgcccg

SEQ ID NO: 135490 - DNA, 601 bp, Human
gccgcatctgacctcatgtgacaggtcacagtcaacacatagtcagaactttgtttcatgcacaaaatcattaaaaatattcgcccaggagcagactcacactgggctcttggccactcaaggattctgtcggaatttcacctctgtactgtcagctccttctggccatagcctccccagctcgcaaatcccaaagtggtaatcccagcactttgggagcccaagacgggcggctcacctgaggtgaggtgttcaagaccagcctggccaacatggcgaaaccctgtctctactaaaaatmcaaaaaaaaaaaaaaaaaattagccaggagtggtggtgcatgcctgtagtcccagctactcaggaggctgaggcaggagaatctcttgaacccaggacgtggaagttgcagtgagctgagaacatgctactgcactccagcctgggcgacaagagcgaaacttcgtctcaaaagaaaaaaaaatgtataacgttaccttcaggctatgtgtataagatgtatatgaaacataaatgaatttcctatctagatttgggttccattccccaagatatctcatgatatatatgcaaatattcc

SEQ ID NO: 135491 - DNA, 601 bp, Human
aactggacactgaccaagcacccccagcctgcatccctggctcccccttcatatcacctcagcctgggcttctctgtccagctctctggtcacgtagaggtttccctctgcattcacttcaaagggtcccgggggatggctctccaggtgatagtgcacatcacccccactccagtgtacctgggggggacaccccgggccaaggggcaggaacaatccatgtcagcctttgcgccccatctgatttctcgttgaggagcctgagcccaactgtgtgacccaggcaaggtgctgccctccmtgggcctggagtccaggtgggatccttctgttcagggcacatgttgttagtggccttgccctgatccaagcctggaccctgcccaaagtgcttgagtgaccatgttactttattttctgccctctcagcctgggcctgaccccagggcattcctagaagaggcctgagacattcctggcccggggtgacaatccccatggcagcaagagatggcagctgttctctctgaggaagccctgggcaagttcaagaggtcagagcacagagtcacgcctgctagaggatggcagagcaggcgag

SEQ ID NO: 135492 - DNA, 601 bp, Human; identical to SEQ ID NO: 28905

SEQ ID NO: 135493 - DNA, 601 bp, Human; identical to SEQ ID NO: 28906

SEQ ID NO: 135494 - DNA, 601 bp, Human; identical to SEQ ID NO: 28907

SEQ ID NO: 135495 - DNA, 601 bp, Human; identical to SEQ ID NO: 28908

SEQ ID NO: 135496 - DNA, 601 bp, Human; identical to SEQ ID NO: 28909

SEQ ID NO: 135497 - DNA, 601 bp, Human
gactaatttcaggttacttcctctgggggtgactggcaatgcctaattctccttgggtctgggaaccaggcttgtggtcctcctgtgtctgggttccagcacagccagtttcaacgacctcttcctgaccttgtatgactgggtttgggggctatcattgtagtgagtggcggccctgggactgatagcaaggacagtggtgagctcagttcactcccactgggcccaacaacactggacacccggccactgcagtcttctgccctgctggacagcagcagcagcagcagcagcagcagcagcagcagcagcaacagtaacagcagcagttcgtccggacccaacccttctacctcctttgagcccatcaaggcagaccccacaggtggtgagtacctgccccctgggggcagagagagagagtctagcctcagtccagtcctaggtcagaaaacagaattggggatggaacccagatctcctgtcaaccctgctggacacgagagctctctgccagcacctctgggtcagtgctggtgccccctctagcaccccatcctaggctaacacagaactccctgccgtctctcaagccctttcc

SEQ ID NO: 135498 - DNA, 601 bp, Human
acccccccagccccagtgttacagcggtgttactcttgagaagctgccgaaggcctgccgagcccagcagcctccagcgtgttttgctggtgctctcttggtctgtgtcaatattctttcctcctttggcatcatgatgccagcttttggctctcctatctcactggcttcttgaactcttccctggcgtgtccttaaacattgctgtttttgagggctctgtcccattccactcctggagagggctgcagctctgggtgaacgaatccccagcctccgcctggcctagatcttttcccartctgcacacttcggtgtccacctgccgtcctgtgtacatccaatggacactttattcctgcatgtcctcaactgaacttagtttcctcccgaagcttgctttccacctctgcgcacccagccgtcagccctagttatccaggcctgacccttggctctcactctagttctagttccttatccctcctccttctgctgcccaccccatgccagctaactgaggtctgtcccagatgtcccctcctatcctctggtatcctcagcactcaggatgacccctggccacctctgtcctggattc

SEQ ID NO: 135499 - DNA, 601 bp, Human
accctcttttaaatatagttttatactcaaaacacccttttggatccagtttcatactttttttgtgtgtgtttgttttgcagtgtgtttttgtacccgtttctatcaacttactaaattaattttctaagtgtcatcatgaatagcataacctgccacatttatgtaaaatgtgagaaatgtctaaatattcctttgagaaatatttaatttaatcttgtgtgtatatatatatatacacgtatatatgtgtatatatacgtatatgtgtgtgtatatatgtatatatgtgtgtgtatatacgtatatgtgtgtatgtatatacatatatatgtatatataaaatgaattttttgttttctccaattctgtagaattagatttgatcttttgtgcgtgacaaaacaatctttggattagaaaagggaaaacagattataagatttaaaaaaatgagtactaagcaagcagtttgctttcctgtgtattagcttgtttgcttggaaaattaaaagtgaatgttccagattttactatttggtaattcttacacaatatataaggaagaatttgagaagtccttgtacgattattggttttt

SEQ ID NO: 135500 - DNA, 601 bp, Human
gcacttactttgaatggagcttgcaggactggaagttgctctgggtcagtcagttgagtaagtggtgaatgaatgtgattctgtagattatataaacatagtatgcttaggccgcactaaatctataaaaattaagcaattgcactgcaatgttaaaatggctatgatgtcactaggcaataggaatttttcagattcattataatcttacaagaccactgtcatatatgtgatccattttaggctgtaacgttgttaaagcaatacatgaatgtattaaaaagatatgtttttaattctrttaggaagagtgatagaactatgcaggctatcaggaaatgtacattttattaatactggttttagaagtttttttttctgtgaagggacaaatgtaaatgttttcagttttgcaggctttcagtctctgtcacaactactcatctctgtaactctgctgttgtggtgtgaaagggaccctagacaatatgtaaacaattgagtgtggctgtgttccataaatggtgacactggtagaaatcagtatctttccctcagatgtaaatctgtaaatgtttatgcataggtcatgtatttctca

SEQ ID NO: 135501 - DNA, 601 bp, Human
aggcataagctgagatcatgccactgcactgtagcctgggcaacacagcaagactctgtctcaataaataaataccatttgaaatgtcttcaatgccatgtgtggaaactatttaaaaaaataaaacgtgcctcttggcagtattgctgtgctttcaggactctaatgcaggctgtacctaagagggaaagggctgagtctggggatggttggcaggttgtttttgtggatgaaaaaccttttacccatgtatgcagtcagtactgagcctttttgtgttttaaaacttcagatgtaaagrcaggttaatcttcagattaaaacaaaaggatggcctagaaacttgtgacttcgacatttacattagaagaatgtagatgttttcaaataaacaaatctgcccatatcatagatgttcaaagtttgttccatataataacaatgatagtttctaataatcgtgtggccctgtttgcagaacagtgttctaagtaatgagccatttgggagaaccctttaaattttttttttaggatatttattcacaccagctttttagtcctgagtttctatccatccctttgctatccagaacatttct

SEQ ID NO: 135502 - DNA, 601 bp, Human
aaacaaaaggatggcctagaaacttgtgacttcgacatttacattagaagaatgtagatgttttcaaataaacaaatctgcccatatcatagatgttcaaagtttgttccatataataacaatgatagtttctaataatcgtgtggccctgtttgcagaacagtgttctaagtaatgagccatttgggagaaccctttaaattttttttttaggatatttattcacaccagctttttagtcctgagtttctatccatccctttgctatccagaacatttcttggccatttttttactgggycaggtgccgtggctcgtgcctttggtcccagtgctctggaaggccagggcgggtggatcgcctggggttaggagttcaagactagcgtggccagcatggtgaagccccgtctctactaggaatgcaaaaattggctgggcatggtggtgggtgcctctggtcccagctgctcgggaggctaaggcaggagaatcacttgaacctgggaggcagagggtgcagtgagccaagatcgcgccactgcactccagcctgggaacaaaattccatctcaaaaaaaataaaaataaaaatgcagaa

SEQ ID NO: 135503 - DNA, 601 bp, Human
acaaatctgcccatatcatagatgttcaaagtttgttccatataataacaatgatagtttctaataatcgtgtggccctgtttgcagaacagtgttctaagtaatgagccatttgggagaaccctttaaattttttttttaggatatttattcacaccagctttttagtcctgagtttctatccatccctttgctatccagaacatttcttggccatttttttactgggtcaggtgccgtggctcgtgcctttggtcccagtgctctggaaggccagggcgggtggatcgcctggggttasgagttcaagactagcgtggccagcatggtgaagccccgtctctactaggaatgcaaaaattggctgggcatggtggtgggtgcctctggtcccagctgctcgggaggctaaggcaggagaatcacttgaacctgggaggcagagggtgcagtgagccaagatcgcgccactgcactccagcctgggaacaaaattccatctcaaaaaaaataaaaataaaaatgcagaaattggtcaggcgtggtgtcgcatgcctctggttccagctacttgagagaggctggggtgggagagttgctt

SEQ ID NO: 135504 - DNA, 601 bp, Human
ccttgagtcctggaaatcaaggttgcagtgagctgtgttcataccacagagcaagatgctatctcaaaatgagtcctggaaatcaaggctgcagtgagccgtgttcataccacagagcaagatgctatctcaaaaaaaaaaaaaagaaaaaaagagaaagaaaactttacagttcttttcctcaacccgtctccccccacaaaataatcactatcctgattgatgtatttgttcccttacttttctttgtcattttatttcctgtgcatatatctctaaataacgcattgtttagtttttwaaaaaaatgaaactaggaagcacacacttcagggcagtgtaaacaacggactctaatgtcactttctctctttttttttttttttttttttggtgagaggagtcttgctctgtcacccaggttggagtgcagtggtgcgatctcggctcactgcaagctccgcctcctgggttcacgccattctcctgcctcagcctcccgagtagctgggactacgggccccctcaccaccacacctggctaattttttgtatttttagtagagatggggtgtcactgtgttagccaggctggtctcga

SEQ ID NO: 135505 - DNA, 601 bp, Human
gattacagttgtgcgccaccatgtccaactaatttttgtatttttagtattgattggatttcaccatgttggccaggttggtctccaactcctgacctcaagtgatccacccacctcagccttccaaagtgccgggatcacaggcgtgaaccaccacgcccgaccaacagttctttttttatatattcagctcttcctcattaaaaactttaagttaatgagcagtgctattgtagtgctggaatctctttttgggtgggtgaaataaatctttttgaactcatcatatatccccactgcycttataagcatttcctgcacatagttaacaggtaataaacatttgtggaataggtggatcttttcaaatggaaattattataggaaacttacaagaaaaaaattctagattctagctgttttctgttcttctattaatcagtatttaaatatttactgagaacctaaggagtaatgaatgatcacaccctcttacgttttcttaatacgtcagtttatagactagagccaccagtgtttaagctctaacaacttattacagagaatcgagatatcctttccaatcgaaagggattttttg

SEQ ID NO: 135506 - DNA, 601 bp, Human
gtttcagttgtaactaaagactatttcccttggtccaaataggaggagaaatggaaccttttgtattttggttattttccaatataagtagaaattggttcattgtggtttattgcagcccttagcagaaatgattgggttcagtagtgaaggggaatgacacaaatatgtaccaggaaagcataaatttttatttattttttatttttttgagacagagtcttgctcagtctaccaggctagagtgcagtggtgcgacctcagctcactgcaacctctgcctcccaggttcaagcgattmtcctgcatcagcctcccaaggagctgagactacaggcacacacacccacgcccagttaatttttgttatttcttgtagagacagggtttcatcatgttgtcccagctgatcttgaactcatgacctcctgccttggcctcctaaggggctaggattacaggcatgagctgctgcggccagccagagggtataaattctataagtactattttaaaggtatctcagaggtaatttttttatcatgtttataattattggcagtcagttattgttattaaacatctctaaaaacaaaaagaa

SEQ ID NO: 135507 - DNA, 601 bp, Human
ttgtaactaaagactatttcccttggtccaaataggaggagaaatggaaccttttgtattttggttattttccaatataagtagaaattggttcattgtggtttattgcagcccttagcagaaatgattgggttcagtagtgaaggggaatgacacaaatatgtaccaggaaagcataaatttttatttattttttatttttttgagacagagtcttgctcagtctaccaggctagagtgcagtggtgcgacctcagctcactgcaacctctgcctcccaggttcaagcgattatcctgcmtcagcctcccaaggagctgagactacaggcacacacacccacgcccagttaatttttgttatttcttgtagagacagggtttcatcatgttgtcccagctgatcttgaactcatgacctcctgccttggcctcctaaggggctaggattacaggcatgagctgctgcggccagccagagggtataaattctataagtactattttaaaggtatctcagaggtaatttttttatcatgtttataattattggcagtcagttattgttattaaacatctctaaaaacaaaaagaatccaaga

SEQ ID NO: 135508 - DNA, 601 bp, Human
aattatgtgttttgtttgtttatttgtttttgagacagagtctagctttgtcacccaggctggagtgcagtggcacgatctcagtttactgcaacctctgcctcctgggttcaagcgattctcctgtctcagcctcccaagtacctgggattacaggcacccgccaccatgcccagctaatttttgtatttttagtagagacggggtttcactttgttgtccaggctggtctcgaacttctgatcttgtgatccacccgcctcagcctcccaaagtgctgggattacaagcgtgagccacygtgcccagccctaaaattatgtttttaaaagtaactattaggttagtgtggtattaggagtgggaagattgtagaaactgtaataaatttctcttatattgtttatctctatcacaataaaatattcacctcaggatgatagaattaacaccgtcctttctgggtggatagttactcttgggaacaattgtattttgagccaatatgagaattaatttggtgatcaaaaatgatctaaatttgggtatgatgtatacctaaagcaatttttattctagagttatttatttacttgaaaaa

SEQ ID NO: 135509 - DNA, 601 bp, Human
cactttattagtctcttatttatatctgtatctaatatttttctgaagaatatatagatttttcaatatggtcttgtttttctttttttttcttttttttttccagacagagtcttgctctctcaccccggctggagtgcaatggcacaatctgggctcacctcaacctccgcctcctgggttcaagcgattctcctgcctcagcctcctgagtagctggggttacaggcatgtgccaccatgcccggctaattttgtatttttagtagagacggggtttctccatgttggtcaggctggkcttcaactcctgacctcaggtgatctgcccgcctcagcctcccaaagtgctgggattacaggcgtgagccaccatgcccggcctcttttttctttttttttttttagcgacagagtcttgctctgttgctcaggccagagtgcagtggtacaatgacagctcactacagcctcaagctcctgccgtgcttggctaattttttttatcttttgtagagatgaggtcttaccatgttggccaggctggtcttgaattgctggcttcaaacgatcctcctgccacagcctcccaaagcactag

SEQ ID NO: 135510 - DNA, 601 bp, Human
atatatatagttgtagatttagacaataaataaagacacaatttaaatacagtgaagagagaattactacaacaagagtggtcgaatattctgtgtatgctctatgacagaactgctaagcctttattttccacatggatttaatttacacccagccatgttttatgatgaccccacctggctacgttgtgcaggttgtggtatagactttggagtaacagactagtagtataacaagtggctggtggggacgggagaattgaaaaccttatcctacccgaacctgaatggagttggttgytcctagccatttgagcctactttgtgggtaagcacgtggtttttattagcaggtgccctttatgctgtccttgaaagggaggtgttagattgcagcaggaaaggatcaggataatactggtaattgctgattgtctttccattttaccatttgttaaagtgtgaactctgttcactgcacatatgtctcacatgtcattagaaaataccaagacaagctgggcacggtggctcatgcctgtgatcccagcactttgggaggttgaggcaggaggatcacttgatattgggagttcaagac

SEQ ID NO: 135511 - DNA, 601 bp, Human
cataaaatttctagttgtgttaaaatatatttacttagaatacatttaaaaatcaagcctatttggtggttagtgtatgaaataaattgtgtgtgtgtgtgtgtgtctctgtgtgtgtctctgtgtgtgtgtgtgatggagtctcattctgtcgcccaggctggagtgcagtggcacaatgtcggctcaccgcaacctctgcctcccgggttcaagcgattctcctgcctcagtcttctgagtagctgggattacaggttcctgccagcacgcccggcaaatttttgtatttttagtagasacgaggtttcaccatgttggtcaggctggtctcaaacacctgacctcgggtgatctacctgcctcagcctcccaaagtgctgggattacaggagtgagccaccgtgcccagacttgaaataaaatttaatatcttttttttgggtggggggtggggggagatggggtctcactctgttgcccaggcagaagtgcagtggtgtgaacatgattcactgtagcctcaacctcgtgggctcaagcagttctccctccttgacctcccaaagtgctgggattacagatgtgaaccactgcaccc

SEQ ID NO: 135512 - DNA, 601 bp, Human
taaaatctgccaggagagattaagaaccgttttgcctggaatagaaaaggctgaggcagaaaagaaaaataatggttctagtgggtggtcctgatgcctgactggagaggagggccagagaacagtggtaactcatgggtggcagcaagtcagtaaacggcctgtggaagcttgagatcctagcagcacagaggtttagggatgtcctccactgtttggataacttctgaggcctccagccctgccatgctaaacttgtaacagtggtgctcgtgagtatttaatctatgtgtaaggttawgattactaaggggggaagcagaactccaagtggttggtggcccaaggggttttgattttcaacagtgtcttttaacctgaaactagttataaaattccttgagcattcttccatttcaccatgtgtaaaatttagaaagttttcgatccttcatgataggatttagtgttttctttttctcatttttctggaacagcctatttcagtagtacaatattttctttacctttcagaggtaatggcagattatcattaacttgaaatgagaaactatagtgaaatgaagaagcattgtttatg

SEQ ID NO: 135513 - DNA, 601 bp, Human
aggatttagtgttttctttttctcatttttctggaacagcctatttcagtagtacaatattttctttacctttcagaggtaatggcagattatcattaacttgaaatgagaaactatagtgaaatgaagaagcattgtttatgttagtaacctttaccaaatactcttgtcattgatatacattaaaatgatatacataaggtacacagtactgtgtataatatcttactctctgggtatttttcctactctgtgggtaatttttgtttaaatgtgcatagtcattctctagtagaatatstaagaaactggaactagaaactatgggggagaaccaggtacctgggggacaaaataagcaaattattatttttcactgtgtatcttctgtaccttatgaattttgtatcattaattatttagaaaaaaataaaatttgctttcagtattacacagaataatgaaaacagaagattctagaccttgctatctctattctctggcatataggctgttttttatgtgaaacccttcctccatttgaaattgtatacagagccccactgtataaaacagtttttttaaaaggcactgctctggg

SEQ ID NO: 135514 - DNA, 601 bp, Human
gcaaagccagggtagggattgttctggtctccctctggtgtccctgggggtgtttttacggaacccagtgggtggcagaacataatgaggactctggatgtagtggaatgagcacaaggttttgcatcccggctccactacttgttgccatatagcattgagaaagttgcttattctcattgagcctcatcagtaaaaactccctcccaggttgttgcagagctcagtatctgaggcttagaatggggactcagtggaagccagtttctttaccccttctttctgtgtacttggctcacartatatctggagtggcaggaaaacagtaaaagtagtcatatcctaactttagactatgaaagtcgaagatactattttgccaagccattttagattctggtgttttttgtttggttggttggtttggttttttaaaacaaccagtaaaggattttggacttttcttggctctgttggaggctaccagttactgtggggattgagtagtgactagaagtgggtatgaagagaacttcccatgttctggtaatgttagttcttgacctgggtgctagttaggtgggtgtgttcgctttgtgaa

SEQ ID NO: 135515 - DNA, 601 bp, Human
tgaggactctggatgtagtggaatgagcacaaggttttgcatcccggctccactacttgttgccatatagcattgagaaagttgcttattctcattgagcctcatcagtaaaaactccctcccaggttgttgcagagctcagtatctgaggcttagaatggggactcagtggaagccagtttctttaccccttctttctgtgtacttggctcacaatatatctggagtggcaggaaaacagtaaaagtagtcatatcctaactttagactatgaaagtcgaagatactattttgccaagcyattttagattctggtgttttttgtttggttggttggtttggttttttaaaacaaccagtaaaggattttggacttttcttggctctgttggaggctaccagttactgtggggattgagtagtgactagaagtgggtatgaagagaacttcccatgttctggtaatgttagttcttgacctgggtgctagttaggtgggtgtgttcgctttgtgaaaattcttcattacatacttaacaatttgggcactattctgtacttgtataaaaagaaggcttttaaaaataaaaaataatcacag

SEQ ID NO: 135516 - DNA, 601 bp, Human
gatctttaaatgctcttgtaagttacctcttcattttgaggaaccgaggctaagagaggataagaaacttgcctaaggtgacatagctgaagtggtagggccatcatggtccaagcccagaaatgcagattattcccactatttcattttaaaatgttactttatatttgaagttttccttaggttgcatactttgtaagaactatattttttgacatgcctgttggaacagctctcgcagtctgcttatctgacagatgtttataattgtctgctgacttttttttaccctttttaaaawttttttttaattttactttaagttctgtgatacatgcgcagaatgtgcaggtttgttacataggtatacctgtgccatggtggtttgctgcatctatcaacccatcatctaggttttgttgttgttgttgtttgtttgtttgtttgtttgttttttgaggcagagtttcgcctttgttgcccaggctggagtgcaattgcacgatctcggctcaccacaacctccacctcccgggttcaagcgattctcctgcctcagcctcccagtcatctatgttttaagccctgcatgcattaggta

SEQ ID NO: 135517 - DNA, 601 bp, Human
aatgctcttgtaagttacctcttcattttgaggaaccgaggctaagagaggataagaaacttgcctaaggtgacatagctgaagtggtagggccatcatggtccaagcccagaaatgcagattattcccactatttcattttaaaatgttactttatatttgaagttttccttaggttgcatactttgtaagaactatattttttgacatgcctgttggaacagctctcgcagtctgcttatctgacagatgtttataattgtctgctgacttttttttaccctttttaaaattttttttwaattttactttaagttctgtgatacatgcgcagaatgtgcaggtttgttacataggtatacctgtgccatggtggtttgctgcatctatcaacccatcatctaggttttgttgttgttgttgtttgtttgtttgtttgtttgttttttgaggcagagtttcgcctttgttgcccaggctggagtgcaattgcacgatctcggctcaccacaacctccacctcccgggttcaagcgattctcctgcctcagcctcccagtcatctatgttttaagccctgcatgcattaggtatttttcct

SEQ ID NO: 135518 - DNA, 601 bp, Human
ttattcccactatttcattttaaaatgttactttatatttgaagttttccttaggttgcatactttgtaagaactatattttttgacatgcctgttggaacagctctcgcagtctgcttatctgacagatgtttataattgtctgctgacttttttttaccctttttaaaatttttttttaattttactttaagttctgtgatacatgcgcagaatgtgcaggtttgttacataggtatacctgtgccatggtggtttgctgcatctatcaacccatcatctaggttttgttgttgttgttgtttgtttgtttgtttgtttgttttttgaggcagagtttcgcctttgttgcccaggctggagtgcaattgcacgatctcggctcaccacaacctccacctcccgggttcaagcgattctcctgcctcagcctcccagtcatctatgttttaagccctgcatgcattaggtatttttcctaatgctctccctccccttcccccctaccccttgacaggcccctgtgtgtgacattcccttccctgtgtgtgatgttcccctccctgtgtccatgtgttctaattgttcaactcccacttat

SEQ ID NO: 135519 - DNA, 601 bp, Human; identical to SEQ ID NO: 135499

SEQ ID NO: 135520 - DNA, 601 bp, Human; identical to SEQ ID NO: 135500

SEQ ID NO: 135521 - DNA, 601 bp, Human; identical to SEQ ID NO: 135501

SEQ ID NO: 135522 - DNA, 601 bp, Human; identical to SEQ ID NO: 135502

SEQ ID NO: 135523 - DNA, 601 bp, Human; identical to SEQ ID NO: 135503

SEQ ID NO: 135524 - DNA, 601 bp, Human; identical to SEQ ID NO: 135504

SEQ ID NO: 135525 - DNA, 601 bp, Human; identical to SEQ ID NO: 135505

SEQ ID NO: 135526 - DNA, 601 bp, Human; identical to SEQ ID NO: 135506

SEQ ID NO: 135527 - DNA, 601 bp, Human; identical to SEQ ID NO: 135507

SEQ ID NO: 135528 - DNA, 601 bp, Human; identical to SEQ ID NO: 135508

SEQ ID NO: 135529 - DNA, 601 bp, Human; identical to SEQ ID NO: 135509

SEQ ID NO: 135530 - DNA, 601 bp, Human; identical to SEQ ID NO: 135510

SEQ ID NO: 135531 - DNA, 601 bp, Human; identical to SEQ ID NO: 135511

SEQ ID NO: 135532 - DNA, 601 bp, Human; identical to SEQ ID NO: 135512

SEQ ID NO: 135533 - DNA, 601 bp, Human; identical to SEQ ID NO: 135513

SEQ ID NO: 135534 - DNA, 601 bp, Human; identical to SEQ ID NO: 135514

SEQ ID NO: 135535 - DNA, 601 bp, Human; identical to SEQ ID NO: 135515

SEQ ID NO: 135536 - DNA, 601 bp, Human; identical to SEQ ID NO: 135516

SEQ ID NO: 135537 - DNA, 601 bp, Human; identical to SEQ ID NO: 135517

SEQ ID NO: 135538 - DNA, 601 bp, Human; identical to SEQ ID NO: 135518

SEQ ID NO: 135539 - DNA, 601 bp, Human
ccgaaggcacagaattcactccccacagtgcttggcatcttaccacagacctaagtgaggaattctagccctgaagctgcatataacccagctcagagaaacaaaaactttcctaaaactcagggcgtcggttagctgattggcaaatacagtaacgcacacatcccaaacgggacttggcaaaacggtgtgcatctggattaactgtcatacagtctccacgtcactcttccacgaggccggacagaagcgggcagaagtgagcagcagcaggttcaggggaaggggtagggtggccggratgaatgggaggccagcgaactgacctacggcggggagggacaaaggatcagggagcgcacgctgggcggggaggccgggaggaataccccaggcggaggagccgggctcgggaccaggctgcgaactggtgacaaagtcggttatcgtggagggccctaagtaccagcgaggggccccgcgggggtcctctctgcctcgggagctgggctcaaccactcgccccgcggagggggcatcgcccggccgggggcacccgggagccgcagacccgaggcaggtactgggggcaaaggcccag

SEQ ID NO: 135540 - DNA, 601 bp, Human
ccactatgtaccatctttttctctagatctcattactgcttctaatctctagagaggacacagcatagtgtagcaaagagaaccttctggagccagggtacctggattcaaatcccagtttggcacttattgaaagccctaacaacaaattatttaacctcactattcctcagtttcctctcccataccacgagaatatataccaacttcacatgattgttatgagaattaatgagttaatatttacaaagtgcttagaacctggcctaccacatagtaagcattacataggtgttatttwaaaaatggataaaatactatcaacttgaactccatcactctcttatctctctgcctcttaaaactgctccagtgtttctcgttttggttgtgttgtgctagtggagataggcgaggagcggagggtctgacattactgagggatcccagtgccccttcccactggtcagagcctcaatgagacacaggaaaagggaaggagagtgtcagatatattcatcactgctccgttagccatgcgaaggtgaagaaaatagggatgtttatttaaccagcataacaggaatccagggacatgtgt

SEQ ID NO: 135541 - DNA, 601 bp, Human
tgagacttttggtttttcctttcctatatttattccttttatttcttctccttgtcatattacactggctagaatttccagtgcagtgctgagtagaagcatagcaggcaccccactctggtttctggctttaaaggaaatgtttattttaaatttgactgttgctatgatgttaagtaaaagttttctgtagatactctatcaggttaaggacactttttcctaacactagttccctaagtgcttcttatcattattagaagctgaatttagttgaatgctttttctgcatcattgttakgaaaatacatcttttataatctgtgaatgcaaaaaaaactatacacatttttctaatattgataaaatcttgcattcttagaataaggccagtaacccaggacttttcacttggagagtcagaagaagctagatgataccagaatagaaactgtctactttaaaccgtatagtgccagtcctacttgtttacctcaaaaccctgcctcctccatgacatcactgctgactcatccatgccttctctgagcttttagagtatgtaccattgatgatgttcatttgacactttgcatgtgct

SEQ ID NO: 135542 - DNA, 601 bp, Human
ataattctttccagtcttgttttgtacatatagatacttaaatacacagttttacaaaattgagattaaacttcactttccttatcatataaaaaataagactagctaacatttgttaagcacaacagtaccaggcactagcctatgtgttttacatgtatcaattcttttaatgcttgcttctccagcatctaataggtacatactattattaccctaattttacagatacaaaatctgaaatttgaagaagttaagtatttgcccgaggtcacaaagccaggggagctacctacactcytaatcactacaccgtctctcttaccttccaggattatgttaaggatcaaggaaaagacaactagcaagagtgctttgtaaatcataatatgccaaatacaatcttaactatagttctgcaaaaataggaatgatattaaattgagagtcataacttggagttgccctgacaccagagtctagagaacacctaaatgaaccagagaagagggcagaaaaggcatcccttggggaagaaagaagatctggtgtactaaagaactctgctgtggaataaaagaataagaattagggtttactt

SEQ ID NO: 135543 - DNA, 601 bp, Human
caaccattcaggtaaacaacagatctcccaagaagcctaaagatattattcctcagcagtcccaggagaagcccaagttaaagaagagcatatatcaaagagacttgtgggtgtgggcttttgtctagtagaatgaattcaatatgactcacaggagaccaacaaaatttttaagataatcgtattggcagaaacactatcagcttggactaaaagggaatacatctttgtatgaaaagaagctttcataccagcccctgctccaaacttccataagcagggaacaggctgagaaatctaygcagctgcaaacatgagctacaattcatgtaaaataatgacttagagggcagaatcaagagccatgaactattcccaggacttgagtcttaatcaaggaactggcaacatttgcccaggaggagttcagaataccataaaccagtggctcctattttttttccatttttgaacaggactgtatagcagttattctatactttctattttctcattttttgaacagaagagtctatagtagtcatcctaaagctgaaagacgttacacttaaggaactactacatacaagaagtctctcct

SEQ ID NO: 135544 - DNA, 601 bp, Human; identical to SEQ ID NO: 28647

SEQ ID NO: 135545 - DNA, 601 bp, Human; identical to SEQ ID NO: 28648

SEQ ID NO: 135546 - DNA, 601 bp, Human; identical to SEQ ID NO: 28649

SEQ ID NO: 135547 - DNA, 601 bp, Human; identical to SEQ ID NO: 28650

SEQ ID NO: 135548 - DNA, 601 bp, Human; identical to SEQ ID NO: 28651

SEQ ID NO: 135549 - DNA, 601 bp, Human; identical to SEQ ID NO: 28652

SEQ ID NO: 135550 - DNA, 601 bp, Human; identical to SEQ ID NO: 28653

SEQ ID NO: 135551 - DNA, 601 bp, Human; identical to SEQ ID NO: 28654

SEQ ID NO: 135552 - DNA, 601 bp, Human; identical to SEQ ID NO: 28655

SEQ ID NO: 135553 - DNA, 601 bp, Human; identical to SEQ ID NO: 28656

SEQ ID NO: 135554 - DNA, 601 bp, Human; identical to SEQ ID NO: 28657

SEQ ID NO: 135555 - DNA, 601 bp, Human; identical to SEQ ID NO: 28658

SEQ ID NO: 135556 - DNA, 601 bp, Human; identical to SEQ ID NO: 28659

SEQ ID NO: 135557 - DNA, 601 bp, Human; identical to SEQ ID NO: 28660

SEQ ID NO: 135558 - DNA, 601 bp, Human; identical to SEQ ID NO: 28661

SEQ ID NO: 135559 - DNA, 601 bp, Human; identical to SEQ ID NO: 28662

SEQ ID NO: 135560 - DNA, 601 bp, Human; identical to SEQ ID NO: 28663

SEQ ID NO: 135561 - DNA, 601 bp, Human; identical to SEQ ID NO: 28664

SEQ ID NO: 135562 - DNA, 601 bp, Human; identical to SEQ ID NO: 28665

SEQ ID NO: 135563 - DNA, 601 bp, Human; identical to SEQ ID NO: 28666

SEQ ID NO: 135564 - DNA, 601 bp, Human; identical to SEQ ID NO: 28667

SEQ ID NO: 135565 - DNA, 601 bp, Human; identical to SEQ ID NO: 28668

SEQ ID NO: 135566 - DNA, 601 bp, Human; identical to SEQ ID NO: 28669

SEQ ID NO: 135567 - DNA, 601 bp, Human; identical to SEQ ID NO: 28670

SEQ ID NO: 135568 - DNA, 601 bp, Human; identical to SEQ ID NO: 28671

SEQ ID NO: 135569 - DNA, 601 bp, Human; identical to SEQ ID NO: 28672

SEQ ID NO: 135570 - DNA, 601 bp, Human; identical to SEQ ID NO: 28673

SEQ ID NO: 135571 - DNA, 601 bp, Human; identical to SEQ ID NO: 28674

SEQ ID NO: 135572 - DNA, 601 bp, Human; identical to SEQ ID NO: 28675

SEQ ID NO: 135573 - DNA, 601 bp, Human; identical to SEQ ID NO: 28676

SEQ ID NO: 135574 - DNA, 601 bp, Human; identical to SEQ ID NO: 28677

SEQ ID NO: 135575 - DNA, 601 bp, Human; identical to SEQ ID NO: 28678

SEQ ID NO: 135576 - DNA, 601 bp, Human; identical to SEQ ID NO: 28679

SEQ ID NO: 135577 - DNA, 601 bp, Human; identical to SEQ ID NO: 28680

SEQ ID NO: 135578 - DNA, 601 bp, Human; identical to SEQ ID NO: 28681

SEQ ID NO: 135579 - DNA, 601 bp, Human
cctaatattcaagatgaggaaactgaagcacagaaaggttgatcaagttccaaaatcacatagttagagcaagaatcaagatactttgtattatattttctccgggggagtagttcaacatatggcaagccttttgtaaaaggaaagagtattttagtattgtaagtaatcagttcctactgtgagcattttatacatagctatatccatatatacaattaatcttgatttccattaacaggtgtgcttaaagcaaggccaagcaactgggtactataaatattaaaacaaataaataaamttccaccggatgttaacagaaaaagaaaaaaagatacaagatttctctctccagtaacttgcggttacttcttctgtaattgttacccttgtctaaataacattctaaaattggtctgctcctgagcccgggcaagtacaagttggttcatccaataaatatcttcatgaaaaggtacatcaaaacattttaaaaagctattaaaaattaaacgatgccatcaactcttcagttatccacaggacaatcacatgtgacccagcatcagcagctattgatcaagatatattgaacgaatga

SEQ ID NO: 135580 - DNA, 601 bp, Human
aactaaataattcctggtgatcactgtaacactgacatagatcagtatcaattttttcaaactatattttcattgccaaaatttaatattaagaagtatcttaaattcaatacctaagctaaatatccaaagtaatctctcatttcctattcactccaatttttttttttttttcttgaggcagagtctcactcagtcacccaggctggagtgcagtggcgcaatctcggcttactgcaagctccgcctcccgggttcacgccattctcctgcctcagcctcccgagtagctggcactacrggtgcgtgccatcatgcccggctaattttttgtatttttttagtagagacagggtttcatcatgttggccaggatggtctcgatctcctgacctcatgatccgcccacctcggcctcccaaagtgctgagattacaggtgtgagccaccgcgcctggccgatttttaagtgtcaatcatcaaatcgattcatcccatggatgatacagtgtaacacagtgaacactataatagatacgaaaagacttagattctgctattgcccaactttagcaacttaggcaggtaaatcacttcactt

SEQ ID NO: 135581 - DNA, 601 bp, Human
atggtgctgggtttggatatatctgactacataacattacaaaagaatagctagggggatatgtgcacacacatgaataaagtgagtgaggccaggcgcgttggctcacgcctgtgatcccaacgctttgggaggcccaggcgggtggatcacctgaagtcgggagtttcagaccagcctgaccaacaaggagaaaccccatctgtagtaaaaatacaaaattagccaggcatggtggtgcaggcctgtaatcccagctactcaggaggctaaggcaggagaatcacttgaacccaggagrcagagattgaggtgagctgaaatcctgccattgcaatccagcctgtgcaacaagagcaaaactctgtctcacaaaaaaaaaaaagaaagaaaaaagtgagtatgtagagaactttttaacctgttaaaacgcaataaccccatcaggaaataaccaaagaacaaaagtaggcaatttataaaagacacatggccgggctcagtgatgcatgcctgtaatcccagcacttcgggaggccgaggtgggtggatcacgtgaggtcaggagttcgagaccagcctgactaacatggtgaaaccc

SEQ ID NO: 135582 - DNA, 601 bp, Human
gcaaatcttaaggattgtaaggttgagattacccaactaacactgatttgacaggtgagaaatctgaagatcagagaaagtcaataattcctctaatatcacaaaattgtggcaaaatgggaaaaactaatgttttctgcaatgctttgcagctttctcagcaagcagtgaactaggaggagctgagatgttcagtgagagcacacattaaaaccacctgaggagctttctcctcatccatacacctgcaactgctccaggtggaaggggaaaagccagcatgtggcatcgtgaggagggytgatctttttggaaataaatattatatgtaggacttaagaaaaagtaccgcagaatataaagcgaaaaatctcctcgcccttcttctccagctgctacccagttacactcccagaaggcaaccaaagttactagtttctagagtgtcctttagaaatatcctacacatacatacactcacactttttcccctatgtaaatggtggcatactagaaacacactgttctgtatcttgcttttattacttaatacatcttggttggccaggcgcggtggctcacacctgtaatcccagcactg

SEQ ID NO: 135583 - DNA, 601 bp, Human
cgggcgcggtggctcacgcactttaggaggccagcgcaggcagatcacgaggtcaggagttcaaggacagcctggccagcatggtgaaacctggtctctactaaagatacaaaaaattagccacgcatggtggcgcgtgcctgtaaacccagctgctcgggaggctgaggcaggagaatcacttgaagctgagaggcagaggttgcagtgagccaagatggcaccactgcactccagcctgcgtgaggggtccagactccgtctccaaaaaaaaaaaaagaactttaaaaactatgtggtmccatgtaatatataaatattttaaataaatataccatcctcctcctgatgtcatgtttcctgctgttgtgaaagctgaccaggagaagagtcagaagactgaccagctgaccctcagcctgttttttccctgctcccttcctgaggcatggagatcagcaaatcttaaggattgtaaggttgagattacccaactaacactgatttgacaggtgagaaatctgaagatcagagaaagtcaataattcctctaatatcacaaaattgtggcaaaatgggaaaaactaatgttttctgcaat

SEQ ID NO: 135584 - DNA, 601 bp, Human
gtcaagactgcagtgagccgtgattgtgccactgcactccagcctgggtgatacaatgaaactctgactcaaaaaataaaagaaaaacgtatagaaagaactttaaggccgggcgcggtggctcacgcactttaggaggccagcgcaggcagatcacgaggtcaggagttcaaggacagcctggccagcatggtgaaacctggtctctactaaagatacaaaaaattagccacgcatggtggcgcgtgcctgtaaacccagctgctcgggaggctgaggcaggagaatcacttgaagctgrgaggcagaggttgcagtgagccaagatggcaccactgcactccagcctgcgtgaggggtccagactccgtctccaaaaaaaaaaaaagaactttaaaaactatgtggtaccatgtaatatataaatattttaaataaatataccatcctcctcctgatgtcatgtttcctgctgttgtgaaagctgaccaggagaagagtcagaagactgaccagctgaccctcagcctgttttttccctgctcccttcctgaggcatggagatcagcaaatcttaaggattgtaaggttgagattaccc

SEQ ID NO: 135585 - DNA, 601 bp, Human
cctcaggaggaccctgtagtacattctgatgacaaatctgctttcttagtctctgagaggaccgttttatcccatcctttcctatttttctttaaacctcttacacccataaccttggtctactctgatatgattatttcacctcatactttatttttcacaaggtaaatcaatctcttacaaactcttcctatgataaagtcttccttcctaactaccatcccttccttcctacctactatacaaatcttcctaccatcaatttcttaaaaagagagaggtctttatcttggccctcacycaagacatgccaagttatctggccagcttaaaactcagccacaacttgggagtataaatataggtcttaccccagaaattctagagaattggtaagttttctatttatcatcaactcctatcatgaaaagcaaagacaagttcaactcctgaaatcagcataaagccacagtaagaagacagaaataattaattcccaatctttggttccttgtctttgtaaatagctcttgcaacttaaaaaaaaaaaagataaatttggtggtttctgtcccacatgtgtattaaataggaaaagtaa

SEQ ID NO: 135586 - DNA, 601 bp, Human
ccgtgttagccaagatgatctcgatctcctgacctcatgatctgcccgcctcagcctcccaaagtgctgggattacaggcatgagctaccacgcccagccaacactccctgaaagaatttctaaaggacgtacccagcaagaaaaattaagagtaaggagtgaaataaaagtaacaacagtgtactgcagcttccaggtataagcaggtaacactgctcagaattaccttcccacagtcaacagctaaaaaattcaaagaaatgtagaaactattttcagaaactgaataataggcagcasagggcttgatcgctgagagaaatgaagcaaatgaggtaagccctacctaccatactctaggccctctgcctaaaggcaatttccaaactgcagccatgggaagggaacctaaatcatgtcccacaatcacagtcgttgaagaagcaaccgtacaaggtttggataagccataggaactgaacttccagaagttagtttcaaagagaaagatttcctaaactctgaatttgggatcccttaagcctatgcctgaattctagtctgtaaatgaataaggagaaatatcacaggctgggctaa

SEQ ID NO: 135587 - DNA, 601 bp, Human
acccaggaggtggaggttgcaatgagccaagattgtgccactgtacttcagcctgggcaacagagtgagactctgtctcaaaaaataaaaaaaaaatttattaaagaatcaaagaaactaaaaactgaatcactgaaggtaaacaatagttgaacacacagaagtgaaaagtaaatgaaagctaagagagaactgaggaattctctcagtacccagtaaagcacaaagacatagaaaccacaggaaaaaagttaaaaatgggagctacagcaaaaagttccaacatcccatatccacaggyaagagacaggattctgaaaaataatagaacagcatttctctgaaattagaaaaaacatagtcttcagatttaaaagggcttaaggaaaaaactggatgtattttttaaattaatccatactggacacatgaaaatattaaaaaaacaagaataaagtgaaactttattataagtttgatgaaataaaaaagtttcctacaaagttagaaggatcataataaaagcaggcttctcattagcaacactgaatagaagcaaacagcaaataatagcatatttcaagttcagaggaaaataacg

SEQ ID NO: 135588 - DNA, 601 bp, Human
ggaggctgaggcatgagaattgcttgcacccaggaggtggaggttgcaatgagccaagattgtgccactgtacttcagcctgggcaacagagtgagactctgtctcaaaaaataaaaaaaaaatttattaaagaatcaaagaaactaaaaactgaatcactgaaggtaaacaatagttgaacacacagaagtgaaaagtaaatgaaagctaagagagaactgaggaattctctcagtacccagtaaagcacaaagacatagaaaccacaggaaaaaagttaaaaatgggagctacagcaaraagttccaacatcccatatccacaggcaagagacaggattctgaaaaataatagaacagcatttctctgaaattagaaaaaacatagtcttcagatttaaaagggcttaaggaaaaaactggatgtattttttaaattaatccatactggacacatgaaaatattaaaaaaacaagaataaagtgaaactttattataagtttgatgaaataaaaaagtttcctacaaagttagaaggatcataataaaagcaggcttctcattagcaacactgaatagaagcaaacagcaaataatagc

SEQ ID NO: 135589 - DNA, 601 bp, Human
taaaattatgctgtccaggataaaacagagggtagataagccattgagagcccttctctataagttatgagtaaaaaataactcatagtctaagaagaaatctcagatataaagttgaaaacataaaaaaaccatttaaaaaactttttcagcctggcacagtggctcatgcctgtaatcccagcactttgggaggccaaggcgggcagatcacaaggtcaggagtttgagaacagcctggccaacacagtgaaaccccatctccactaaaaacacaaaaaattagctgggcgtggtggcrtgctcctgtaatcccagctactcaggaggctgaggcaggagaatcacgtgaacccaggagggggagggtgcagtgagctgagatcgtaccattgcactctagtccaagcaaaagtgcaagactccatctcaaaaaaaaaaaatttttttttcaaaggcaccaaaacaaaaaggaatttacatccaaggaaataggtaaaacagtaaataaaagtaaaaaggacctagaaaatattaataatagcctcaaaaagaatcaaataggccaggtgctatggctcacacttgtaatcccagcact

SEQ ID NO: 135590 - DNA, 601 bp, Human
taatgaatatattaaaagctgctatattatatactttaaaatggtaaattttgttatatgaattctgtgtcaacaaaaagttttaaaaatcataaacagataaaattatgctgtccaggataaaacagagggtagataagccattgagagcccttctctataagttatgagtaaaaaataactcatagtctaagaagaaatctcagatataaagttgaaaacataaaaaaaccatttaaaaaactttttcagcctggcacagtggctcatgcctgtaatcccagcactttgggaggccaargcgggcagatcacaaggtcaggagtttgagaacagcctggccaacacagtgaaaccccatctccactaaaaacacaaaaaattagctgggcgtggtggcatgctcctgtaatcccagctactcaggaggctgaggcaggagaatcacgtgaacccaggagggggagggtgcagtgagctgagatcgtaccattgcactctagtccaagcaaaagtgcaagactccatctcaaaaaaaaaaaatttttttttcaaaggcaccaaaacaaaaaggaatttacatccaaggaaataggtaaaa

SEQ ID NO: 135591 - DNA, 601 bp, Human
acacccattaggatgcctattaccaaaaaaagtcaaaagataacaaatattaatgagggcatgaagaaaagagaactcttgtacactgctggtggtaacgtaaattagtacaaccattatggaaaacagtatgaaagttcctaaagcaattaaaaatagaactaccacatgaccccacaatccttcttctggatatatacccaagggaaatgaaatcaccatcttgtaaaggtaaatgcactcccatgttattgcagctaattattcacaatagccaagatataaaaacaatctaagtgtytgtcaatgaatgaatcataaagaaactgtggtatatatacactatggaatattattcaaccctaaaaaaaaatgagatcttgccatccacaacatggataagcctgaaggacattatgctatgtgaaataaacctgacacagaaagtaaaatattgcatgatttcgcttatatgtggaatcttaaacaaaaaaaaaaaaaaaaaaaaaggaactatacaaagagaacaaaacagtgctaacagtggttaccaggggcagggggtggaaagaaaatggggagacgaaagtcagaggatgta

SEQ ID NO: 135592 - DNA, 601 bp, Human
tgggcagaagatctgaatagacatttctcaaaagaaaacgtaaaaatcaccaacaggtatatgaaaagatgttcagtatcattagtcatcagggaactgtatattaaaagcactatgagatattctcacacccattaggatgcctattaccaaaaaaagtcaaaagataacaaatattaatgagggcatgaagaaaagagaactcttgtacactgctggtggtaacgtaaattagtacaaccattatggaaaacagtatgaaagttcctaaagcaattaaaaatagaactaccacatgacyccacaatccttcttctggatatatacccaagggaaatgaaatcaccatcttgtaaaggtaaatgcactcccatgttattgcagctaattattcacaatagccaagatataaaaacaatctaagtgtttgtcaatgaatgaatcataaagaaactgtggtatatatacactatggaatattattcaaccctaaaaaaaaatgagatcttgccatccacaacatggataagcctgaaggacattatgctatgtgaaataaacctgacacagaaagtaaaatattgcatgatttcgcttatat

SEQ ID NO: 135593 - DNA, 601 bp, Human
tcaaaacaatatggtattggcataaaaatagacacactgatcagtagaaaagaatagaaagcccagaaataaatctaaacatatggccgcctaacttttgacaagggaaccacagcaacacagtggggaaagggtagtctcttcaataatgctgggaaaactagatatccagatgcaaaggaatgaaattagacccttgttttacagcatatacaaaaatcaactcaaaatggataaaatacttaaatataagatcagaaactataaaagtcctgcaagagaacgtagggagaaaagctcygggacaccgaccttggcaatgattttttgcatatcaagaggtcaggccacaaaagcacaaatatataaatgggactacatcaaactaaaaagcttctgaaaacaacaaaatgagtcagcagcctgtagacacagaaaacatatttgtaaactatgcatctgctaaggaattaatatccagaatttataaagaactcataaaactcaatagcagaaaaacaaataacctgattttaaaatgggcagaagatctgaatagacatttctcaaaagaaaacgtaaaaatcaccaacaggtatat

SEQ ID NO: 135594 - DNA, 601 bp, Human
ctcaaaaattacaataattgggggaagggaaaccagtcctttcttattaaaaggtatgttttcagtaagattttactttttgcttttaagaataatgtaataaaatgtatacatatatttatgcttttttgttcaatgatctactactactaattgtcataacttaatccagagtaaaacttttaaacactcagggcctaaaatcacagaaaacttaaataaatttattttattttacttatttattttttttgtttgagacggagtctcgctctgtcacccaggatggagtccagtggcrcaatcttggctcactgcaagctccgcctcccgggttcatgccattctcctgcctcagcctccagagtagctgggactataggtgcccaccaccacgcccggctaatgttttgtatttttagtagatgaggtttcaccgtgttagccaggatggtctcaatctcctgacctcgtgatccgtccaccttggcctcccaaagtgctgggattacaggtgtgagccacagtgcccggcccaaaatttctatatgtatttgtagtagaaatatatgaaagtgatcagtaaaatgctattaagaat

SEQ ID NO: 135595 - DNA, 601 bp, Human
gaggctgaggtgggcggattacttgaggtctggagttcaagaccagcctggccaacatggcgaaaccctgtctctactaaaaatacaaaaagtagctgggcatggtggcacacgcctgtagtcccagctactccagaggctgaggcaggagaactgcttgaacccaggaggtggaggttgcagtgaaccaaggttgtgccattgcactccagcttgggtgacagagtgagactctgtctaaaaaaaaaagaaagaaagaaaatgtgatgtgtgtgtgtatacatatatatgtatgtatgtrtgtatgtgtgtgtgtgtgtgtgtgtgtgtgtgtgtgtgtgtgtataaatattattcaactttaaaaaagaaaaaaatcctttcataccataacatggatggaccatgctgaaaccacgctgaaataagccaggcacaaaaataaaaatattgcatgatctcccctatatatggaatattaaaaaaaaaaaaagcactcaaatacacagggatagagaatgaaacagtggttcactggttggggatagagaaataaggagatggaggtcaaaggatacaaaatagcagatgtgtgggatga

SEQ ID NO: 135596 - DNA, 601 bp, Human
ttgggaggctgaggtgggcggattacttgaggtctggagttcaagaccagcctggccaacatggcgaaaccctgtctctactaaaaatacaaaaagtagctgggcatggtggcacacgcctgtagtcccagctactccagaggctgaggcaggagaactgcttgaacccaggaggtggaggttgcagtgaaccaaggttgtgccattgcactccagcttgggtgacagagtgagactctgtctaaaaaaaaaagaaagaaagaaaatgtgatgtgtgtgtgtatacatatatatgtatgtrtgtatgtatgtgtgtgtgtgtgtgtgtgtgtgtgtgtgtgtgtgtgtataaatattattcaactttaaaaaagaaaaaaatcctttcataccataacatggatggaccatgctgaaaccacgctgaaataagccaggcacaaaaataaaaatattgcatgatctcccctatatatggaatattaaaaaaaaaaaaagcactcaaatacacagggatagagaatgaaacagtggttcactggttggggatagagaaataaggagatggaggtcaaaggatacaaaatagcagatgtgtggg

SEQ ID NO: 135597 - DNA, 601 bp, Human
aaagaatcagccgggcatggtggcatgagcctgtagtcccagctactcgggaggctaaggcaggagaattgcttgaacccaggaggcagaggttgcagtgagccgagatcacgccactgcactccagcctgggcaacagagcaagactccgtctcaaaaaaaaaaaaaaaaaaaaaaagaatagaataaaataaaatgaaataaaataaaaactcatgttccttgactcataaaacaataatgctactttaacaatagaaaataggaggccaagtcattcaagatacttgtaattctttcygtgaatcccacttttctaagtttttgacaatagctgtatgtcttttcttatttataaaagggtaaatttttagcctgtttgaaaaatatgtttttgttcattttttagatattaggggacaagtaagctgaattctctctccaaacttaaccaagaaatgtattatataataattttaggctgggagtggtggctcacgcctataatcctagcactttgggaggccgatgcaggtggatcacctgaggtcaggagtttgagaccaggttggccaacacggtgagaccctgcttctactaa

SEQ ID NO: 135598 - DNA, 601 bp, Human
ggcgggcgtggtggtgcgcgcatgtagtcccagctactcgggaaactgaggcaggagaatcgcttgaacccaggcagaggttgcagtgagtcaagatcacgccactgcacaacacaacagtctgggtgacagagccagactcatttgtcttttaaaaaaaaaaaaactctgtaggcttgcagactttgtaaagttccccattttactgacttttgtcatctcgtaacaccatctttaaacatctttaaaacaaattaaaattacaaaacacatttaaataactatactttatcattcgaaytttaaagaattttaaagcagtctgatttcttgctaaaagagaatattccatactcaatgtttttcttaattttcctgtgccctggttgccggatgtagtggctcacacgtttcccatcactttagggggccaaggcaggaggatcgcttgatgctgggagtttgagaccagtccaggcaatatagcaactctgtctctacaaaaataaaaaatttgtcaggcacaatgccatgcgcctgtaatctgagctactcagaagactgaggcaggaggatcacttgaacccaggagtttagagac

SEQ ID NO: 135599 - DNA, 601 bp, Human
ggcaaaaaaaaaactattagagctaacaaataaatacatcgaagttggaggatacaaaatcaacacacaaaactaagttgtattctatacactagcattaaacaatccaaacatgaaacttaaaaaacaatacatttatgctgggtgcggtggctcacacctgtcatcccagcagtttgggaggccggggcgtgtggatcatctgaggtcaggagttcgagaccagcctgaccaacatggagaaaaacccatctctactaaaaaatacaaaattagtcagacatggtggtgcacgcctgcwatcccagctactcgggaggctgaggcggaagaatcgcttgaacccaggaggcagacgttgaggtgacccgagatcatgccattatactcctgcaggggcaacaagagcgaaactccatctcaaaaaaaaaaagcaatacatttataagagcacccaaaagaacatagctaggaataaatatgaccaaggaggcttatgactttaaacactgaaaaccacaaaacattgctcgaagaaataaaagacttaatacatagtaagaaatctcaaattcatatgttggaagataatgtcattaaa

SEQ ID NO: 135600 - DNA, 601 bp, Human
aaagaattggcaaaaaaaaaactattagagctaacaaataaatacatcgaagttggaggatacaaaatcaacacacaaaactaagttgtattctatacactagcattaaacaatccaaacatgaaacttaaaaaacaatacatttatgctgggtgcggtggctcacacctgtcatcccagcagtttgggaggccggggcgtgtggatcatctgaggtcaggagttcgagaccagcctgaccaacatggagaaaaacccatctctactaaaaaatacaaaattagtcagacatggtggtgcwcgcctgctatcccagctactcgggaggctgaggcggaagaatcgcttgaacccaggaggcagacgttgaggtgacccgagatcatgccattatactcctgcaggggcaacaagagcgaaactccatctcaaaaaaaaaaagcaatacatttataagagcacccaaaagaacatagctaggaataaatatgaccaaggaggcttatgactttaaacactgaaaaccacaaaacattgctcgaagaaataaaagacttaatacatagtaagaaatctcaaattcatatgttggaagataatg

SEQ ID NO: 135601 - DNA, 601 bp, Human
ttccattatcttaaaattcagagtgacatcacaaaaaacttcaggaatgggaaacttcaggaacaagacaaagatgactgcattcaccatttatattcaatatggtattggaaattactttcagagcactaggaaagaaaaagaaataaaaggtatccaaatttaaaaagaaataagcatttttattcaagacaacatgattccatatgtggcaccctaaagaattggcaaaaaaaaaactattagagctaacaaataaatacatcgaagttggaggatacaaaatcaacacacaaaactmagttgtattctatacactagcattaaacaatccaaacatgaaacttaaaaaacaatacatttatgctgggtgcggtggctcacacctgtcatcccagcagtttgggaggccggggcgtgtggatcatctgaggtcaggagttcgagaccagcctgaccaacatggagaaaaacccatctctactaaaaaatacaaaattagtcagacatggtggtgcacgcctgctatcccagctactcgggaggctgaggcggaagaatcgcttgaacccaggaggcagacgttgaggtgacccgagat

SEQ ID NO: 135602 - DNA, 601 bp, Human
tgtattatatatttaaaaattgctacgagtggattttaaatgttcttaccaccaaaaaaaaactatgtgaggtgatgaatatgttaattagcttgatgtgtttcccaatgtatacatacatcaaaatatcacactgtataaatatcatcataaatataaatatcaccataaatatacacaatttttattccacaataaaactgggggagggtcgttatctccaagttacaggattacaggtaacttttttcctctttattttcccagttttctataagtatgtattacttacataaattargaacaattttcttttgtatagaacttatatgcacaattcaaccttacctggatgtgttttctcccatatagcagttaataaactgctactaaatttaagggacttgtttaaaatttaattaagatttaacaaaactagtagtcttgagtacctctgaccacattttatagccagcaagccagtaaaaaaatgcttgagcattatttaatagaaattcttctttatgggagcagtcttcttggactgttttcacttaccgaaaaggcaaaagtgctcactttagcagtctggagcactcat

SEQ ID NO: 135603 - DNA, 601 bp, Human
tcagggaagaaagggcaattaggcataaaggttaataaacacagaaaaaagatttgatggcagtaaaaacattttaaacttcagtatgctttaaaaaaagaaaaactgaaacaaaaagacactgggaaaaatattagcgtatgttggtaaaaaggttaacactttactgttaagagtttttaaaattaatttattctttctatgacaaatatttattctgtatctactaagtgtcaggcacttcctaatctgcagaattaataataagcaaagcagagttgaaaaaggtaaacataggccsggcacagtggctcatgcctgtaatcccagcactttgggaggccgaggtgggcagatcacgaggtcaggagttcaagagaccagcctggccaacacggtgaaaccctgtctctactaaaaatacaaaaattagctgggcatggtggtgcgtccctgtaatcccagctactcgggaggctgaagcaggaaaattgcttgaaccaggacccgggaggcggagattgcagtgagccaagatcgcgccactgcactccagcctggggtacagagcgagactccatctcaaaaaaaaaaaaaaaga

SEQ ID NO: 135604 - DNA, 601 bp, Human
aagaatcaacatgaaaatgttaataacttttaaatggtaaactgtaggtaattttttctttcaagcttatttaactcttctataaatgatatacctaggcttaacatttaacaaaaaatctaacaaatgttagttctttttaaatccttacttctggaggtgggcagttgggagagaatggggagagggagatggaaggagaagtattagttagtagaagtagtcatggtttacactttaggggaaaaaaagcaggactagagtcggggtcctgggttaatttcaactcaggagttactaacctaggtcacttaatttttctgaacacccagtttctcaactataacatggaaatgggtcacactacaacacaacacgtcccattttaatgaatgagtttttaagacacttttctgctaaaaaacaaaattctatagttacaaattacatttgtggtaatgtattcagccatggaagatgacctttattcactatatttttaaatttcttttttttaatgcagcagaacatttcttataaaccccacagactactgtatgataaagatgattcacatgataaggtgggtcacaaaacacct

SEQ ID NO: 135605 - DNA, 601 bp, Human
ccgggtgcagtggctcatgcctgtaatcccagcactttgggaggcctaggcaggtggatcacctgaggtcgggagttcgagaccagcctgactaacatggagaaaccccatctctactaaaaatacaaaattagctgggcatggtggcgcatgcctgtaatcccagctactaagaaggctgaggcaggagaatcacttgaacccgggaggtggaggttgcagtgagtcgagataacgccactgcactccagcctgggcaacaagagcaaaactctatctcaaaaaaaaaaaaaaaaaaaaagattttaattctgacaaacttaaagcaaaataataagagaagttaaatttaatgaaggtactctacatacctctatcacaatgacctttgacagcactgaaaaaacactcttatatgttatagatacacagtatacattaatatttgctgggcagaatatggtagaaaggagatcaagggttaacccttaactcagcatggcaccatgccaccctcaacacccaatcttcatgtgttacagtgctccggtcaaagggcaatcaacaaaattacaaaaatatagactattggtgtgtgcaa

SEQ ID NO: 135606 - DNA, 601 bp, Human
agtcctcaaatcccagtgaggcaaccacagaattcactaatattgtaagacaaggctcattaataaatccattaataattattaccaaatccaatttatttgaaaaataattcatactaaaaaagaaacattttataaaacttaaaaaaaaaaactatcaaatctccatttgtatcaccactaattcctatttattttatccctgaggtcacagtcacaaactggccatggagcccatgagcccacaaaagtgttttgcagctatgcagaggactttttttttttaaaaaaacaaatcagagatttcacataaaaccccattattttgggcttttcttaaacaagggagcaactgtatatcctggaacacagcccccatcttaggcatggtcacctccttcccttcctttactggatttatcttcatgtagactgctgtggccatacaataaattggactaatattgaacccagccaagaaaataatattaattgcccatatttttacctgcccataacacttaccattaccgtaagtatatttctgatgactctcagttatctacttgatacatgtatatctaaatccaagatcattcct

SEQ ID NO: 135607 - DNA, 601 bp, Human
gctgttaatgagctaattttctagttacaaggaatccttagtaatagctgaacaacaaagaaaaccgctaatttgaattattcaaagtgctcagtagttaaaaaatgctgaattatatgtatttgtaatatgctatttcctttttttttttttttttttttttttatttgagacagggtctcactctgtcgcccaggctgggacacaatggcacgatcatagctcactgcagcctcaacttcctggactcaaataatgcccccatctcagtctcccaaagctctgggattacaggtgtgasccacagcacccagttgctattttcaaaagtaaaataatccagaccaaagtgttacctagcaaaaatcttcccttgctaagattaatctatcaatattttggcaacaaaaattttaacttaagaccctcatatgttcgtaatacaatttgtattctaagtctacagatagaagtaaataattcttcaacatatgttcggtatgttctatgtgccaagcactcactagacactaagaaaataatgaataagataagccttcccaccacaggaagatgaggggtcttgaaagtcttcctagag

SEQ ID NO: 135608 - DNA, 601 bp, Human
tttttaatgattgccattctaactggtatgagatggtatctcattgtggcaaaacctcctaacttttagattccctgagtaactgttaatcccatctcctgtcactcccataatacagtttataaatccattgtttcccataagtatatttatgcacagatttttaatttcaaagtattaatactccctaatactagggagtattaaccattgtcactattttaacagtaacattcaaagagctttctaattctgttcttaattctcattctgcctggaaggattaaatagctgctcaagyaaaaacaagctcagggtgatgtttctgcaaaggtctgcaaaggtaaccaagttcactcatcattactttaaacttcatctcaagctacatctctgctcagctacatctctcttatcccaaaataaatggatcatattccatcttatcccaagaaaaactaccaccaaaaattaaaaaaaaaaatcactggaaatgaaaaaatttacttaccagttcaacttttgggccaagaccttcaaaaattttatgagcttcttctgcttttttctagagataaagacattgttgtatcatataatt

SEQ ID NO: 135609 - DNA, 601 bp, Human
ctatgaagagacaaagaaacataattttaatgtaagcacaggtaaagtactaatggatctacacaataacatgccctaccaaaacctccaaacttttatttttttatttacttatttttttaaattatactttaagttctagggtacacgtgcacaacgtgcaggtttgttacatatgtatacatgtgctgtgttggtttgctgcaccaattaactcatcacttacattacgtatttctcctaatgctatccctcccccatgccccaccccctgacaggccccggtgtgtgatgttccccrccctgtgtccaagtgttctcattgttcaattcccatctatgagtgggaacatgcagtgtttggttttctgtccttgcgacagtttgctcagaatgatggtttccagcttcatccatgtccctacaaaggacatgaactcatccttttttatggctgcatagtattccatggtgtatatgtgccacattttcttaatccagtctatcattgatggacatttgggttggttcccagtctttgctattgtgaatagtgccgcaacaaacatacgtgtgcatgtgtctttacagtagcatgatt

SEQ ID NO: 135610 - DNA, 601 bp, Human
taaaattattcaaattcaattgttttcatgcatactaccatgcaaattatatttgccaccagttctgcaaagtagtcaataattgcacatactctcagttaagaaatttttaaaaagaaaaaaataaatatatatatataaaataaatagcaatgtgctcattagtaaccatactagtaaataattatgttctgcttatacttaataaaacatataaagtagaaatatcacatttttgtcacaaactaagaataatgcacctaaaattctcttaaagtataatttttttttaaaaaaaaaagatatctatctagcttcctctcttacttcaatcagatcaagaaattagattttcttttcacttattttcttattccaaaatctgcatccataaaggcctggtactaggatgagcaaggctaagcaaactacattctggagcagcctcgtcacccacaaggtgactgagcgcttccaaggcaccaggacattaaatggcagaagggtctacaaataccgtcattagcaagagtcatggaagggatttccctagaataggattttgaataatgataaaatgatccgtggcacttctactttg

SEQ ID NO: 135611 - DNA, 601 bp, Human
aacaaaagttaaaattattcaaattcaattgttttcatgcatactaccatgcaaattatatttgccaccagttctgcaaagtagtcaataattgcacatactctcagttaagaaatttttaaaaagaaaaaaataaatatatatatataaaataaatagcaatgtgctcattagtaaccatactagtaaataattatgttctgcttatacttaataaaacatataaagtagaaatatcacatttttgtcacaaactaagaataatgcacctaaaattctcttaaagtataatttttttttwaaaaaaaaagatatctatctagcttcctctcttacttcaatcagatcaagaaattagattttcttttcacttattttcttattccaaaatctgcatccataaaggcctggtactaggatgagcaaggctaagcaaactacattctggagcagcctcgtcacccacaaggtgactgagcgcttccaaggcaccaggacattaaatggcagaagggtctacaaataccgtcattagcaagagtcatggaagggatttccctagaataggattttgaataatgataaaatgatccgtggcact

SEQ ID NO: 135612 - DNA, 601 bp, Human
caatactaggactgacctgtctgacttccatcaccttaggctccccctaattactaaaaccatatggctatcttgctcacctttgcagaataatatatgggacagagtacacagccaagtgatatttaagcaaatcggtgaaaatacaaaccttacagtgtttgcatcaccagtgaacttatttagtgagtaccagaattacaacaaaattacttggaaaggaaaaaaaaatacatgagctaatttcttacttgatatttatatgttcttggcaaaaaaaaaaaaaaaaaaaaaaaaaaamcaactcaagaccagtaatttaagacagtatctgatcagactggcaaattagaacattagacgttttccaccaaataaagctgctgactcttgagctttacaactcaaactgtcaggtcattaactttaggcacaaagttcatttttgatgtcgatttaaagagtagcatttatttagcagacacttcagtttaaatgtattaacagtgtatctgtaaaattagtataaacatattatgaaaataaaatcactggcattatattttctataatttaattcccatgaaaattatataaccac

SEQ ID NO: 135613 - DNA, 601 bp, Human
ttttttggaaccaagtttcactcttgttgcccaggctggagtgcagtggcgcgatctcgctcactgcaacctccgcctcccgggttcaagttattctcctgcctcagcctcctgagtagctgagtttacaagcatgcgccaccacgcctggctaattttgtatttttagcagagacggagtttctccatgttggtcaggcgggtctcaaactcccgacctcaagtgatctgccctccttggccttccaaagtgctgggattacaggcgtgagccattgcacctgccccgctaaatgcaaaytcttaaaatgcaaacccaaacattatgcaacctccaggacagtatacaacctggctctggcttccctcagcagcctcatttctcaccacactgccagctcagtctacactccctctggctcccagaccttcacttaagccactccctctgcgtatacaagtttgcagagaattggttttcccctgaaatgtcccctcataattcctatctgccttaggtgtcctcctcagtcatccgtagtccatgaccacggtgtgatccaatactaggactgacctgtctgacttccatcaccttagg

SEQ ID NO: 135614 - DNA, 601 bp, Human
tctgaaacatgtgctgggtccattaagggttaaatggattaagggcagtgcaagatgtgctttcttaaacagatgcttgaaggcagcatgctcgttaagagtcatcaccactccctaatctcaagtacccagggacacaaacactgcagaaggccgcagggtcctctgcctaggaaaaccagagacctttgttcacatgtttatctgctgaccttccctccactattgtcctatgaccctgccaaatccccctctccgagaaacacccaagaatgatcaatacatactaaaaaaatttttwaaaaaaagaaacaataaatatttgaagaaaaatatcacagtcattaaacatcaaactactcaccgctgaaatctttcttgctgttctctttgttttcgaatttctggaaactgcttttcatagtattcccttgttttgctttctttagctttcctccgaggattattttctattctgtccacttttttctcccatgcctccatgagctgatcataacgctggcagattttttgttcctattaaatatccgtagcaaattaataataattaaactaaactctgattctgacaaacctaata

SEQ ID NO: 135615 - DNA, 601 bp, Human
ggagtcacattctattcttcctctttctcatctcccacatcccatccatcttggcctgtccattctacctttctattacactcgcctatacatccctaccactgttgccctgattcagaaccttatttttatcctaacagcctcctcacctctctccaggtctccttgctgccaaagccatctttgtaaaattccagtatgatcgtgtgactgcctcgtttaaaaaccctttaacagacactcaaatctttgacagtctaaactctagcactcaattaagttcccacatttacatacaaawaaacccttagctcctacagagttaaaatgctttaataattaacgaattaacttgaattaaatttattttcttacctcctgctcagagagcccatcaataatttcagaaatctcatgctcactcctagcaatggtggctgaaagaccagctcccctctgcccaactctaaacatgagggagaaattaaaaatatatttaaagaccttatataaagacatatcaattaaattaactatagattacttttctgaatggaactttttaaccaagttaagagaagaaacataaaatactattgag

SEQ ID NO: 135616 - DNA, 601 bp, Human
taaactaattttagatgcttacaaatgtttcctcatggaatcagtcaaagagcaaataaagaaatttaacagagatttactcatcattgtagaaataatggctacatattccaagggctgaatgtcatttcaatcatgtacttacagatgtttcctcatggaatcagtcaaagagcaaataaatttaacagagatttactcgtcattgtagaaataatggctacatattccaagggctgaatgtcatttcaatcatgtactttagaggtaattttaaaagcaatatagagtaagtggttaygttttaaagctcttgattatactgctacaaaagaaatgaaaaattgctgggcacagtggctcacgcttgtaatcccagcacttttggaggccaaggcagaaggactgcttgagcccaggagtccaagtctaatctgggcagtatagtgagaccccatctctacaaaataatttttttaaattagctaagtgagaggctgggtggggtggctcacacctgtaatcccagcactttgggaggccaaggcaggtggatcacctgaggtcaggagtttgagaccagcttggccaacatggcaaa

SEQ ID NO: 135617 - DNA, 601 bp, Human
cattaatcacatgagactcttcgcagtctttttaaaatcggttctagttaactacttatatgtgtcagagcacaagaatttcaaagtaacaaccatcacaaacctacaaacactcccaatgcaaaccatgtcttaccttcctctccaagtatgatgcaattagtccaaagttttttggatgctggataaacctgagtgaaaacgaaaacaaaaacacacttgcgtacaaatatttcaacaactaaaaaaaaaaaaacttgggaaaagaaagactatgtataggctgggcgtggtggctcaygcctgtaatcccagcactttgggaggccgaagaaggtggatcacttgaggtcaggagttcaagaccagcctgaccaatatggcagaaccccatctctactaaaaatacaaaaattagctggggatggtggcacatgcctgcagtcccacctactcaggaagctgaggcaggagaatcgcttgaacccaggaggcagaggttgcagtgagccgagatcacaacactggactccagcttaagcgacagagcgagactccgtctcaaaaaaaacagaagagaaatactatgtatagggctttc

SEQ ID NO: 135618 - DNA, 601 bp, Human
ctttctgattacatacatgcaaatttttaaaatgtctttaaatattttgttcaaaaacattaaaatcaactttatattaaatatggaatgattcacaaatttgcttgtcatccttgcgcagaggccatgctaatctctgcatcgttccaattttagtattatgtgctgctgaagcgagcacgagactgatattttaattagaaatttaatgaggctccaaaagcattgtaatctatgtgttttagggaaataaacatcaggtcatctttcattaaccatttagttctgtgttctgtgttamgatttctctaataattgtaattatcattacattaatcacatgagactcttcgcagtctttttaaaatcggttctagttaactacttatatgtgtcagagcacaagaatttcaaagtaacaaccatcacaaacctacaaacactcccaatgcaaaccatgtcttaccttcctctccaagtatgatgcaattagtccaaagttttttggatgctggataaacctgagtgaaaacgaaaacaaaaacacacttgcgtacaaatatttcaacaactaaaaaaaaaaaaacttgggaaaagaaag

SEQ ID NO: 135619 - DNA, 601 bp, Human
ggctgggcgcggtggctcatgcctgtaatcccagcaccttgggaggccaaggcaggtggatcatggaagtcaggagattgagaccatcctggccaacatggtgaaaccccatctctactaaaaatacaaaaacttagccgggcgtggtggcaggcgcctgtagtcccagctactcaggaggctgaggcaggagaatcgattgaacccaggaggcggaggttgcagtgagccaagatagcaccactgcactccagcctgggcgacagagcgagactctgtttcaaaaaaaaaaaaaaaaaaraaagaaagaaagaaattaaactatctgaactccacaaatgaagttaatatgaaacaaaatcaggttccaggtttttgtaaagaatctctaatcaaggtaccatgttgtatttctctcccttactctacctgacccctcctcagataaacagactggctaaagatagtgtattaaaagtattaatggcttcatatttaattacatgattattgctgacactgaaatgcatgactcagatgacagaatggtataaaacttttctaattaattttatcatagtagaaacttaaaatatatttg

SEQ ID NO: 135620 - DNA, 601 bp, Human
tctaggctgggcgcggtggctcatgcctgtaatcccagcaccttgggaggccaaggcaggtggatcatggaagtcaggagattgagaccatcctggccaacatggtgaaaccccatctctactaaaaatacaaaaacttagccgggcgtggtggcaggcgcctgtagtcccagctactcaggaggctgaggcaggagaatcgattgaacccaggaggcggaggttgcagtgagccaagatagcaccactgcactccagcctgggcgacagagcgagactctgtttcaaaaaaaaaaaaaagaaaaaaagaaagaaagaaattaaactatctgaactccacaaatgaagttaatatgaaacaaaatcaggttccaggtttttgtaaagaatctctaatcaaggtaccatgttgtatttctctcccttactctacctgacccctcctcagataaacagactggctaaagatagtgtattaaaagtattaatggcttcatatttaattacatgattattgctgacactgaaatgcatgactcagatgacagaatggtataaaacttttctaattaattttatcatagtagaaacttaaaatata

SEQ ID NO: 135621 - DNA, 601 bp, Human
gtctccttacaaactattctcaacagagcaaccagagtaatcatgtcacaactgaaatctggcagccctcttttgctcaaaaccccagtggcttcttctctcacctggtatcagctcaaaaggccttcagttttacacagagagcccttaaactaacaccacctaatttctgaaaagctgcccctctattttgacacaaataaatggaataagtatacaaacaattaagaaacaatggtaaatctggtggcatgagatgatggtctaaattcatttaactcacacctctcccaaattcccmgtgaaacaaccagagaaatgtaaaattggaggaaaaatcttcaaagcaataacttaaaagctaatgagggcagagctagcctaccagaagtgctgaccaacccaaaactgagcctacctgggggtaagcaacctaaggctcaggtcaaggtgagggtatacatggcaattctcacatctgcaaatacattctgagacaggtactttgaaacatgcaacaagaatgtacagaagagaacaccaacatggctggatcttaacaaggatcggtgtgccacagagaggagtgaaactgtgtccc

SEQ ID NO: 135622 - DNA, 601 bp, Human
gcgtgagccatcgcacccagccacacactatacatttatctgctgaataaaaattacttcctacaaaaaggaggctgggagtagaggatagggagagtaatcaaactcatattgacaggatcaagcataaacttcagcagaactttaaagaatctttaagtaaacatgccataatggctgtgagatcacctgagctaaaccctcctgactagagcttggttacatagcagagaagtaaagtgattttcaaattagttggatctctgtatccaccagggtaaaatcaagggagttgatacayagattttgaaaatcttaaccttgcaattcaattctgtttttaaaaagaagtattctaaccttttttctatatagcaaattctatatctttaacccagatctttttcctacactccagacttatatgtctaactatccactttacttggacctcatttggatctctgcttagacacctaataggtatttcatattcagccatgtcctgattttcccctcaaaacctgctcctccttcagtcatgcctgtcacagcaaatggcaactccacaggtcaaaacttgttttccttgattattgtc

SEQ ID NO: 135623 - DNA, 601 bp, Human
aaataccgtttcactactggacaatattttctttaaaaatatacttcgggaaataaacagacaatatcttaagcctatcttatcaaaatttattaacaattagtgctcctaagccaactgaatttcagactaacttcctgaagagtgaaagctgtcaatcaccaaaaaacacactgtggcaatggcaataaagataacagtggctaccatttattgggcactctctgtgcctgactctgcactccagggactttacacacatacccagttcttattaaccatgcaacctaagtatcactgwccccactctcatgaatgtggaaaccaaggctcaccaagtgaaaggacccacctagagtcacataggtacaattgggcagagcactctggggctagagttcttgctgatataataaacttcttaacttgtctaaaataatctttctatctagtgactagctaacagtttagtcagaaaattcctccaatttcaaaattgctatatttacctaagtatatgcttctgaatacctttagggaataaaaacacactggcataaaggggaaaatggtgttagcataaaagaagggcatgaattcc

SEQ ID NO: 135624 - DNA, 601 bp, Human
ttttttaatttttttgtagaaaatcaaatttttcagttttttaactttttgtataaatttttaaagtttttgtccaggctggtctcaaacctcccaggctcaagcaatcctcctccctcagcctcccaaagtgctgggattactagtgtaagccacaatgcttgacctggtaagtgtatttcaacataatttaagaacaggattcagtttcatatgggtcccctttggcaagatcaaataatagtttatgctaagattcattactactatatataaatgaatatctaactatatatatgtkctaattatatttgttttaaatgttcaccttttttagaaaagagaaacagacaagttcccactcaacagaaaataagttgccaaaaaacgaaattactaaatttaataacaagcagcaattgtaaataaaaatttacacgaggaagaaaatgaaataccgtttcactactggacaatattttctttaaaaatatacttcgggaaataaacagacaatatcttaagcctatcttatcaaaatttattaacaattagtgctcctaagccaactgaatttcagactaacttcctgaagagtgaa

SEQ ID NO: 135625 - DNA, 601 bp, Human
gagttgctgcattagagtctagagaagtgtttggtacctgtccagcagaacctctcacccctctgtatactgaccaggcagtggtgagcggagaggaagtgcagtcagcagcaactggaggacctcacctttgtgcaatatgcataaagacctatcataacaactgccactgacattcaagagagtaaggaattacctctaatttaaacaagagatgcttggaactacttttgtttcaggcaaatctgtaaagagaagtgccagtcaatccacatggtctaggatgaaggttacaagttacatccctcaactccacagggtggctggagcaaaagaggtccaccccttcaaaagaaacccttctaaaagttccctacacagacacaaatattcgcaatggctcgttgtccaggtttttccttttctccccttctttaaactcaatacttgagagccaataaaacaagtttaattctgtcagggagttaatataacatgaaacatttctgtcaaataacaagctattcactatgaatgaatattctagaacacatataaaacaaaatgaaaattcaaagaaaaaagtaaaagttaagtgtat

SEQ ID NO: 135626 - DNA, 601 bp, Human
ttgggtaacacatgctaatcttatttccccaatacttttctgcttctaatgccaatcagagcttcaaagtaatcccacgcattccctgctgtctaaaatccaaccaacagataacttcactcccctttccctggtgctagggaataagaaacaactgcagcacctgcttaaaccaatcagtgtaaagaaggaaacagctcctggctctgcatagtgtggaaatgatccaaagaaatggacagagttgctgcattagagtctagagaagtgtttggtacctgtccagcagaacctctcaccmctctgtatactgaccaggcagtggtgagcggagaggaagtgcagtcagcagcaactggaggacctcacctttgtgcaatatgcataaagacctatcataacaactgccactgacattcaagagagtaaggaattacctctaatttaaacaagagatgcttggaactacttttgtttcaggcaaatctgtaaagagaagtgccagtcaatccacatggtctaggatgaaggttacaagttacatccctcaactccacagggtggctggagcaaaagaggtccaccccttcaaaagaaaccc

SEQ ID NO: 135627 - DNA, 601 bp, Human
catgtgtatatgtgtatgtatatatgtgtatatgtatatatacgtgtatgtgtatatatacacgtgtgtatatgtgcatgtatatacatatgtgtatatacacacgtgtatatatctgcatgtatatatacacatgtgtatatatgtatgtatatatacatatgtgtatatatgtatgtatacatacatatgtgtatgtgtatatatacatatatgtatatatgtgtatgtgtatatatacatatatgtatatatgtgtatgtgtatatatacatatatgtatatatgtgtgtgtatatayacatatatgtgtatatatgtgtggagatatatatatatatctctcatagtatattagggttcggtactatctgtggtttcaagcatccactgggagtgttggaacatatcccctgtgaataagggggaactgctttattttgcttttaagagacaacatctcactctgtcacccaggctacagtacagtggcatgatcatagcttactgcagcctcaaactcccaggctcatgcaatcctcccacctcagtctctcaggtagctggggctacaggtctcaaactcctgacctcaagtgat

SEQ ID NO: 135628 - DNA, 601 bp, Human
atatacatgtgtatatgtgtatgtatatatgtgtatatgtatatatacgtgtatgtgtatatatacacgtgtgtatatgtgcatgtatatacatatgtgtatatacacacgtgtatatatctgcatgtatatatacacatgtgtatatatgtatgtatatatacatatgtgtatatatgtatgtatacatacatatgtgtatgtgtatatatacatatatgtatatatgtgtatgtgtatatatacatatatgtatatatgtgtatgtgtatatatacatatatgtatatatgtgtgtgtrtatatacatatatgtgtatatatgtgtggagatatatatatatatctctcatagtatattagggttcggtactatctgtggtttcaagcatccactgggagtgttggaacatatcccctgtgaataagggggaactgctttattttgcttttaagagacaacatctcactctgtcacccaggctacagtacagtggcatgatcatagcttactgcagcctcaaactcccaggctcatgcaatcctcccacctcagtctctcaggtagctggggctacaggtctcaaactcctgacctcaa

SEQ ID NO: 135629 - DNA, 601 bp, Human
tatatatgtatgtatgtatatatacatgtatgtatatatgtatgtatatatacatgtatgtatatatgtatgtatatatacatgtatgtatatatgtatgtatatatacatgtgtatatgtgtatgtatatatacatgtgtatatgtgtatgtatatatgtgtatatgtatatatacgtgtatgtgtatatatacacgtgtgtatatgtgcatgtatatacatatgtgtatatacacacgtgtatatatctgcatgtatatatacacatgtgtatatatgtatgtatatatacatatgtgyatatatgtatgtatacatacatatgtgtatgtgtatatatacatatatgtatatatgtgtatgtgtatatatacatatatgtatatatgtgtatgtgtatatatacatatatgtatatatgtgtgtgtatatatacatatatgtgtatatatgtgtggagatatatatatatatctctcatagtatattagggttcggtactatctgtggtttcaagcatccactgggagtgttggaacatatcccctgtgaataagggggaactgctttattttgcttttaagagacaacatctcactc

SEQ ID NO: 135630 - DNA, 601 bp, Human
tatgtgtgtgtatatatgtatgtatatatacgtgtatatatgtatgtatgtatatatacatgtatgtatatatgtatgtatatatacatgtatgtatatatgtatgtatatatacatgtatgtatatatgtatgtatatatacatgtgtatatgtgtatgtatatatacatgtgtatatgtgtatgtatatatgtgtatatgtatatatacgtgtatgtgtatatatacacgtgtgtatatgtgcatgtatatacatatgtgtatatacacacgtgtatatatctgcatgtatatatacayatgtgtatatatgtatgtatatatacatatgtgtatatatgtatgtatacatacatatgtgtatgtgtatatatacatatatgtatatatgtgtatgtgtatatatacatatatgtatatatgtgtatgtgtatatatacatatatgtatatatgtgtgtgtatatatacatatatgtgtatatatgtgtggagatatatatatatatctctcatagtatattagggttcggtactatctgtggtttcaagcatccactgggagtgttggaacatatcccctgtgaataagggggaactg

SEQ ID NO: 135631 - DNA, 601 bp, Human
atatacatgtatgtatatatctgtatgtatatatacatgtatgtatatatctgtatgtatatatacatgtatgcatatatgtatgtatatatgtgtgtgtatatatgtatgtatatatacgtgtatatatgtatgtatgtatatatacatgtatgtatatatgtatgtatatatacatgtatgtatatatgtatgtatatatacatgtatgtatatatgtatgtatatatacatgtgtatatgtgtatgtatatatacatgtgtatatgtgtatgtatatatgtgtatatgtatatatacrtgtatgtgtatatatacacgtgtgtatatgtgcatgtatatacatatgtgtatatacacacgtgtatatatctgcatgtatatatacacatgtgtatatatgtatgtatatatacatatgtgtatatatgtatgtatacatacatatgtgtatgtgtatatatacatatatgtatatatgtgtatgtgtatatatacatatatgtatatatgtgtatgtgtatatatacatatatgtatatatgtgtgtgtatatatacatatatgtgtatatatgtgtggagatatatatatatatctc

SEQ ID NO: 135632 - DNA, 601 bp, Human
tctgtatgtatatatacatgtatgtatatatctgtatgtatatatacatgtatgtatatatctgtatgtatatatacatgtatgtatatatctgtatgtatatatacatgtatgcatatatgtatgtatatatgtgtgtgtatatatgtatgtatatatacgtgtatatatgtatgtatgtatatatacatgtatgtatatatgtatgtatatatacatgtatgtatatatgtatgtatatatacatgtatgtatatatgtatgtatatatacatgtgtatatgtgtatgtatatatacaagtgtatatgtgtatgtatatatgtgtatatgtatatatacgtgtatgtgtatatatacacgtgtgtatatgtgcatgtatatacatatgtgtatatacacacgtgtatatatctgcatgtatatatacacatgtgtatatatgtatgtatatatacatatgtgtatatatgtatgtatacatacatatgtgtatgtgtatatatacatatatgtatatatgtgtatgtgtatatatacatatatgtatatatgtgtatgtgtatatatacatatatgtatatatgtgtgtgtatatatac

SEQ ID NO: 135633 - DNA, 601 bp, Human
caaatcaaagtttatcataggtgtgtgtgtgtatatgtatatatctgtatgtatatatacatgtatgtatatatctgtatgtatatatacatgtatgtatatatctgtatgtatatatacatgtatgtatatatctgtatgtatatatacatgtatgcatatatgtatgtatatatgtgtgtgtatatatgtatgtatatatacgtgtatatatgtatgtatgtatatatacatgtatgtatatatgtatgtatatatacatgtatgtatatatgtatgtatatatacatgtatgtatatrtgtatgtatatatacatgtgtatatgtgtatgtatatatacatgtgtatatgtgtatgtatatatgtgtatatgtatatatacgtgtatgtgtatatatacacgtgtgtatatgtgcatgtatatacatatgtgtatatacacacgtgtatatatctgcatgtatatatacacatgtgtatatatgtatgtatatatacatatgtgtatatatgtatgtatacatacatatgtgtatgtgtatatatacatatatgtatatatgtgtatgtgtatatatacatatatgtatatatgtgta

SEQ ID NO: 135634 - DNA, 601 bp, Human
gcctaatatacaaatcaaagtttatcataggtgtgtgtgtgtatatgtatatatctgtatgtatatatacatgtatgtatatatctgtatgtatatatacatgtatgtatatatctgtatgtatatatacatgtatgtatatatctgtatgtatatatacatgtatgcatatatgtatgtatatatgtgtgtgtatatatgtatgtatatatacgtgtatatatgtatgtatgtatatatacatgtatgtatatatgtatgtatatatacatgtatgtatatatgtatgtatatatacatrtatgtatatatgtatgtatatatacatgtgtatatgtgtatgtatatatacatgtgtatatgtgtatgtatatatgtgtatatgtatatatacgtgtatgtgtatatatacacgtgtgtatatgtgcatgtatatacatatgtgtatatacacacgtgtatatatctgcatgtatatatacacatgtgtatatatgtatgtatatatacatatgtgtatatatgtatgtatacatacatatgtgtatgtgtatatatacatatatgtatatatgtgtatgtgtatatatacatatatgta

SEQ ID NO: 135635 - DNA, 601 bp, Human
ctattacagtatattgctataactctattttattatttgttactgttaattccttactgtgcctaatatacaaatcaaagtttatcataggtgtgtgtgtgtatatgtatatatctgtatgtatatatacatgtatgtatatatctgtatgtatatatacatgtatgtatatatctgtatgtatatatacatgtatgtatatatctgtatgtatatatacatgtatgcatatatgtatgtatatatgtgtgtgtatatatgtatgtatatatacgtgtatatatgtatgtatgtatatatacatgtatgtatatatgtatgtatatatacatgtatgtatatatgtatgtatatatacatgtatgtatatatgtatgtatatatacatgtgtatatgtgtatgtatatatacatgtgtatatgtgtatgtatatatgtgtatatgtatatatacgtgtatgtgtatatatacacgtgtgtatatgtgcatgtatatacatatgtgtatatacacacgtgtatatatctgcatgtatatatacacatgtgtatatatgtatgtatatatacatatgtgtatatatgtatgtatacatacata

SEQ ID NO: 135636 - DNA, 601 bp, Human
ctttctgtggtttcagttacctggagtcaactgcagtatgaaaatgggtaagtgtagtagcgtacagtatgatatttgaaaaaagaccacactcatgtaacttctattacagtatattgctataactctattttattatttgttactgttaattccttactgtgcctaatatacaaatcaaagtttatcataggtgtgtgtgtgtatatgtatatatctgtatgtatatatacatgtatgtatatatctgtatgtatatatacatgtatgtatatatctgtatgtatatatacatgtatgyatatatctgtatgtatatatacatgtatgcatatatgtatgtatatatgtgtgtgtatatatgtatgtatatatacgtgtatatatgtatgtatgtatatatacatgtatgtatatatgtatgtatatatacatgtatgtatatatgtatgtatatatacatgtatgtatatatgtatgtatatatacatgtgtatatgtgtatgtatatatacatgtgtatatgtgtatgtatatatgtgtatatgtatatatacgtgtatgtgtatatatacacgtgtgtatatgtgcatgtatatac

SEQ ID NO: 135637 - DNA, 601 bp, Human
acagtagcccccaccatatcaggagtttctctttctgtggtttcagttacctggagtcaactgcagtatgaaaatgggtaagtgtagtagcgtacagtatgatatttgaaaaaagaccacactcatgtaacttctattacagtatattgctataactctattttattatttgttactgttaattccttactgtgcctaatatacaaatcaaagtttatcataggtgtgtgtgtgtatatgtatatatctgtatgtatatatacatgtatgtatatatctgtatgtatatatacatgtatgyatatatctgtatgtatatatacatgtatgtatatatctgtatgtatatatacatgtatgcatatatgtatgtatatatgtgtgtgtatatatgtatgtatatatacgtgtatatatgtatgtatgtatatatacatgtatgtatatatgtatgtatatatacatgtatgtatatatgtatgtatatatacatgtatgtatatatgtatgtatatatacatgtgtatatgtgtatgtatatatacatgtgtatatgtgtatgtatatatgtgtatatgtatatatacgtgtatgtgtatat

SEQ ID NO: 135638 - DNA, 601 bp, Human
catttgcaaaacctgtgactctaaaagaaaaaagtgaaactaagtgtgcaatgaatgctactacagtagcccccaccatatcaggagtttctctttctgtggtttcagttacctggagtcaactgcagtatgaaaatgggtaagtgtagtagcgtacagtatgatatttgaaaaaagaccacactcatgtaacttctattacagtatattgctataactctattttattatttgttactgttaattccttactgtgcctaatatacaaatcaaagtttatcataggtgtgtgtgtgtataagtatatatctgtatgtatatatacatgtatgtatatatctgtatgtatatatacatgtatgtatatatctgtatgtatatatacatgtatgtatatatctgtatgtatatatacatgtatgcatatatgtatgtatatatgtgtgtgtatatatgtatgtatatatacgtgtatatatgtatgtatgtatatatacatgtatgtatatatgtatgtatatatacatgtatgtatatatgtatgtatatatacatgtatgtatatatgtatgtatatatacatgtgtatatgtgtatgtat

SEQ ID NO: 135639 - DNA, 601 bp, Human
ctatggtcgttactaagactgaagtaatttggaaaaatactaaagctataataaggtgaaaagaagtaaaatgcttaaatatttctaagctaagcagtcacactaggaatccttttatctctgatgtctcatttgcaaaacctgtgactctaaaagaaaaaagtgaaactaagtgtgcaatgaatgctactacagtagcccccaccatatcaggagtttctctttctgtggtttcagttacctggagtcaactgcagtatgaaaatgggtaagtgtagtagcgtacagtatgatatttgaraaaagaccacactcatgtaacttctattacagtatattgctataactctattttattatttgttactgttaattccttactgtgcctaatatacaaatcaaagtttatcataggtgtgtgtgtgtatatgtatatatctgtatgtatatatacatgtatgtatatatctgtatgtatatatacatgtatgtatatatctgtatgtatatatacatgtatgtatatatctgtatgtatatatacatgtatgcatatatgtatgtatatatgtgtgtgtatatatgtatgtatatatacgtg

SEQ ID NO: 135640 - DNA, 601 bp, Human
aggcaggagaatggcgtgaacctgggaagtggagcttgcagtgagccgagatcatgccactgcactccagcctgggcaacagagcgagacgccatcacaaaaaaaaaaaaaaaaaaaaactatacttttgcagcaacatggatcaaactaacggctatcatcttaagtgaaataactcagaaacagaaggtcaactatcacatgttctcacttataagtgggagctaaataatgtggacacatggatatagagagtggaataagagacactagagattcaaacaggtgagagggtgcgagrgggtgggtgaggtataatgggtataatgtacactatttgggcgatggtacactaaaagcacagacttcactactatgcaatatatccatgtgacaactgtactccctatatctacaaaaataaaaataaaataaaaataaacatttaacttattatataactaattatttaactcacttggagtcttctttttcatctttttcctcttcatctttcttttcttcttcttttttttctgttttttctgctttatcctcttctttttcttctactttttcttcttgcgagggtcgagcaatt

SEQ ID NO: 135641 - DNA, 601 bp, Human
cagagaagtagcctcgacctcttcttaatctgccaaagcacttaactggtcgtctgttgacttcttactgccaggcttttatttcttaaagtaatacttgtactttacctacttttcccctactaaatcatgaactacctgggaatagtatacatcttacgtattttcacattctccctaagacctagctcacatagataataaataaaagcttgttaaatagtttagaaattttaacaaaaaaataaaatcaagttatgacagagttccatgtgagaagaaccactggctacatggcccraaaaatgtttaacccaaactaaaagaaaaaaatatattcccttagaggtatcttcctcaggtataaaattacaatgagaagaatatctgtctcttttaaaacatggcaagtgactagctactttagcttccacaaaactaggtaaatcttaaacagttccacaaggactatagatataacataataaatattaaaaaggaacaaactactgatacattcaacaacctaagtgaatctcaaaggcattcatgctaagtaaaagaagccatacatactgtatgatttcaatttttatgtaat

SEQ ID NO: 135642 - DNA, 601 bp, Human
cttgcaaactgcaaaatcaaatgacctcttctcaattttccccgcaagtctttctgttacaactgacgctgcagttaattcttctttttatatcacttgaaactcagcttttgaaatatccctgctgctactctggctttccttcaagggacagacctttctcctctcatcctttcttttgggtttctgttttttgtctttgagaaagtgtctcactccgtcacccaggctgaagagcagtggcgcgaacacagctcactgcagcctcaatctcttgggctcaagtgagcctcccacctcrgcttctcgagtagctgggactacagacacgtgccagcatacctggttaatttttgtattttttgcagagacagggtgtcaccatgttgcccagggtagtcatgaattcctgtgctaaagcaattctcccaccttggctgggattacaggaatgagccactgtgctgggttcctctcatccctttcatacggggatttcccaaggctctcccctagagccttagagctatgtaaggttacccattctcataagttctaccgggaggactccaatctctatctttggactcacaccccaact

SEQ ID NO: 135643 - DNA, 601 bp, Human
cagtttgctattattcaagctaaaactccctcaggatataaagtgcttaccatcgtctcaggcatgtagaaacatggtggttcctattaatagcaacagtactacatgtaatactggaagaccattttctgtactacttacctcccatggttgttatatttaaggaaacgtactcaatgtacatttttgcaaatgaatggatagatggcaatactcaaagactcaattattcttgcttaatggaagatgctgatttttttcaaaaataattctctccccttcagtcctaaattgaagtacracatagtcctttccctttacttacttattcccttataaagctggcttctattctgaagcctcctgttaaaagatgttttctcaaaagtcaccaatgacttgcaaactgcaaaatcaaatgacctcttctcaattttccccgcaagtctttctgttacaactgacgctgcagttaattcttctttttatatcacttgaaactcagcttttgaaatatccctgctgctactctggctttccttcaagggacagacctttctcctctcatcctttcttttgggtttctgttttttgtctttga

SEQ ID NO: 135644 - DNA, 601 bp, Human
gctgcggctgcagcactggcagctgcagcttcgtttgtcatggacctggtgatccggcccttacggcggccctgactgttggcagtctttcgcccccggggtgtggcttgctctctttcctcagtttcttctgctgtaccatctatcttgtccttttccttggtattttctctggacacaaaagcaaatgaaaacttgtgtgattccaaagtatacatacatcgaagaaggttttagttttgaatattatctaaatagaaattgaataaaactacctaatctctcactcaaaaaaaaaaaattatcaacaattctgccataccatagtttttaaaagttttgaccagctaaaattaagatattttataagacctattttacatactaatggacttaaaatttaaacacatttcaaaccaactgatttagaaaccagaactactccatgagaaagtaacaaatgacagcagaaaagccctagacctgcaatccagagacaacagcctacaccaaaaggcaggaattctggggttttatttgcctttagtctaggttgcctcatgtatgaaatgaagaagctaaaatagatgatcttcatgat

SEQ ID NO: 135645 - DNA, 601 bp, Human
taacaatgatacctctgaatcattaacagtggtactctatcattaatctagcctttttataaactaatgagacaatacttaatgagagagagaaagatgctttgactattagatccagtattcccttgcctaagaatttattccatgacaaataatttaacataaaatactatgtgaataaagatttttttattacagtgctatatacattggtttaaaagcagggaagagggcagacaacctaatcattcagcaataagagaatggttaaagaagtcatgcctcaatattacacagccaytaaaaaataaaaatggtaattattagaaattagaaaatatttatggcacactagcataacaactaaataaaaaacagctatattggggtggcaagactgggtgatgttctttttcaaaaaactttgacattaaagtttaaaaaatttaaagaccacacttcaggattatttctaggttgtcaatattaaaagtcctttctaccctatcctagcagtgaaacagaatcccgaacaaaattatggcctgtttatgccaattgtttccactcactgggttctggtggcggtggcagaggtggt

SEQ ID NO: 135646 - DNA, 601 bp, Human
ttgcttcaggaaaaaaacaaaacaaaacaaaacaaaacctgagaacatcaggcctgatatgagctcctgccatattccctttctcaatttatagtaccagcattcacccagtcactcaagttaccaataggctccttagactgatagactaatttttgaatcttgcctcccatttaccactcacatccaatgacatgcatcaactctgaatccatcccctccttgcttgggccactgcatacatgctgggccctctgcctccagcctttattctgtctaaactgacctccacaattgctaycagttaacttccaaagacacaaatctaatcacagcattcctctatttaaaaacctctgcaagttccccacttcataatcaaagcaaaatacatttcaaacaaggcccatcatgacctgccccaacctatctttcctcctcctatctagttagtgcccctatctcattcttgccattccctaaactgcattttctttcatacttcagtaacaatgatacctctgaatcattaacagtggtactctatcattaatctagcctttttataaactaatgagacaatacttaatgagagagagaa

SEQ ID NO: 135647 - DNA, 601 bp, Human
aaaagtttgtatttttcaaatccagcctacagtaattcaagagtatttaattccctttactacaaatagaaacttcggaggaggaaagataagctggggcaggtcatgatgggccttgtttggactgttaggaatacaaatagaaactttactccttgagcaataaatagagaaacagctagcctatactaaaaatttagcataccttttacatataagtgcaataaataaaaatataagatacaaaaaggtttctcttaaaaccaatctctggagctcagaaaaaaaaaaaaaaaaaaaacatcaaggctagatgcagtggctcacacctgtaatcccagcactttgggaggctgagacaggtggatcacctgaggtctggagttcgagaccagcctggccaacatggtgaaacactgtctctactaaaactacaaaaattagccaggcatggtggcgggcgcctgtagtcccagctactcgggaggctgaggcaggaaattgcttgaatccgggaggaagagtttgcagtgagccaagattgcactgctgcactctagcctgggtgatagagtgagactccatctcaaacaacaacaac

SEQ ID NO: 135648 - DNA, 601 bp, Human
aaggtgtgaagctcatggttagagaaacatattttccaaaattctcattttttgcttgaaaactcaaaattttaaagtggcaacaaacactatcagttattttatttcaaagacagcctcattcactaattttcaagaaaatgtctcccaaaatcccagtctgaaaacatagtttgtctgtcattctttcaatctaaaatgacattccatgaaaaaggggaggctggtgcaacttagaactcaaacaattgccaaagtgcttttccctgagagaaccatcatattttggtatagagcagagctttatgtttacttcccattacatgacacgaagtataaaaagacatactcaatgggtgagatttaataaaattaacttttactgcgtcatcaaggacattcttaagtgacattttaagaaaaaactgcaaatgctcagcgatgaaaaatacattgagtactagcaccgtttggttccctgccaagatttatgcttaggcatcagcaattttatctaccacagctttgacaccataaatgcaaatgtcatatactgaaaaaaagtaaataacatttgattgatatttttatgaaaacagtc

SEQ ID NO: 135649 - DNA, 601 bp, Human
gtaatgagaaggtgtgaagctcatggttagagaaacatattttccaaaattctcattttttgcttgaaaactcaaaattttaaagtggcaacaaacactatcagttattttatttcaaagacagcctcattcactaattttcaagaaaatgtctcccaaaatcccagtctgaaaacatagtttgtctgtcattctttcaatctaaaatgacattccatgaaaaaggggaggctggtgcaacttagaactcaaacaattgccaaagtgcttttccctgagagaaccatcatattttggtatrgagcagaactttatgtttacttcccattacatgacacgaagtataaaaagacatactcaatgggtgagatttaataaaattaacttttactgcgtcatcaaggacattcttaagtgacattttaagaaaaaactgcaaatgctcagcgatgaaaaatacattgagtactagcaccgtttggttccctgccaagatttatgcttaggcatcagcaattttatctaccacagctttgacaccataaatgcaaatgtcatatactgaaaaaaagtaaataacatttgattgatatttttatga

SEQ ID NO: 135650 - DNA, 601 bp, Human
taacaactatcgcatttgctattattaccactgatctcatcagaaaatctgtaatgagaaggtgtgaagctcatggttagagaaacatattttccaaaattctcattttttgcttgaaaactcaaaattttaaagtggcaacaaacactatcagttattttatttcaaagacagcctcattcactaattttcaagaaaatgtctcccaaaatcccagtctgaaaacatagtttgtctgtcattctttcaatctaaaatgacattccatgaaaaaggggaggctggtgcaacttagaactcraacaattgccaaagtgcttttccctgagagaaccatcatattttggtatagagcagaactttatgtttacttcccattacatgacacgaagtataaaaagacatactcaatgggtgagatttaataaaattaacttttactgcgtcatcaaggacattcttaagtgacattttaagaaaaaactgcaaatgctcagcgatgaaaaatacattgagtactagcaccgtttggttccctgccaagatttatgcttaggcatcagcaattttatctaccacagctttgacaccataaatgcaa

SEQ ID NO: 135651 - DNA, 601 bp, Human
actttaataattctcaaattttttggtctaaggatgcaacactcttaaaaagtattaaaggccgcagagaacttttcttttttttcttttgagacggagtctcactctgtcgcccggctggagtacagtggcgcgatctcagctcactgcaacctccgcctcccaggttcaagtgattctactggcctcccgagtagctgggattaaaggtgcacaccatcacacccagctaatttttgtatttttagtagagacagggtttcaccacgttggccaggatggtcttgatctcttgaactcrtgatctgcccgcctcggcctcccaacgtgctgggattaaaggcgtgagccactgcacctggccaaagagcttttctttatgggagaaatatagacagccagatagacacttactatatcagaaactaaaactaagaaaacttcaaaattttaaattattaaaaacaatataaactcataaattattatttatttatttattttgagatggaatctcgctctgtcgcctaggctggagtgcagtggtgcgatctcggctcactgcaagctctgcctcctgggttcacaccattctcctgcc

SEQ ID NO: 135652 - DNA, 601 bp, Human
gttcaggccattctcctgcctcagcctcccgagtagctgggactacaggtgcccgccaccatgcccggctaattttttgtacttttagtagagaaggggtttcaccatgttagccaggatggtctcaatctcctgacctaatgatccacccaccttgacgtcccaaagtgctgagattacaggcgtgagtccccacacccagccaacatttatattttaaatacatatctgactcattttttacttcactttttctcaaaacattttggatgttacctcctgaagtcaagtctttatcttrtcagtagactttttcatgttttggttgctacagcatatttttaactctcacattcttattattaacctaaaggccgctttgtatacacacttttaaatcagtcaatgttatactttgtatactcttaataaattcaaatcttattagctttactatcacactttaataattctcaaattttttggtctaaggatgcaacactcttaaaaagtattaaaggccgcagagaacttttcttttttttcttttgagacggagtctcactctgtcgcccggctggagtacagtggcgcgatctca

SEQ ID NO: 135653 - DNA, 601 bp, Human
cacatctcgctcttcacgaggttttcgtgaagtctaaaggaggaaagagtattatttgatttaaataactaaaaagaaaaaaaaattcatttctgaaataatgtagaacattgataagcacacacacacaccagacaaggaggtcacatgtttgacaatagttctggttaaagtgcagataaatacctctccataatcactaactggccaaattttgtgtagatggctcgcctttatcaaactaagcaaaagttacatctgatccacttttggaattactcaccactatacatgtataaawagccaaaaatcacatacctccatgctttttactcactccagataatgttatctaataaaaacaatatatatatattttttctaaagataatatataccttgaaatgtggaagacataacactacaaaaatcactgctcattattccaacagtaagagatcctaaatataccggtacatttcctttcaatctttcagaggcatatacatgaatataaatatttatgtatacatgtaaacacaaccaggaaagccctatgtaattacatattcacttttttaacataatgtagccatgagca

SEQ ID NO: 135654 - DNA, 601 bp, Human
aagacaacaagaataatctataggaaaaaaaaaacatggaatctaatattactaaacctggaggatgtacaacttttaaagcttatacaaaataaagaccctacacagaaaagagatacaactctaattacacaaactttaaacaaaagtaattgaaaaggaaaacaaaaagaaaatgatggaaaaaattatctgcatatacaaaacatgaacatgtttaatttataatatatgaagagctactaaaagcattataaaaatccccacatcagaagcaatttccaaaaaaaaaaaaaaaaaatccacagaaactttaatcagagtgtaaactgaaataaattaggtatcttttttcttaccaaaaaaatcaagaaaacatttacctttccatgaacttgtcattagtttaaatgacaaagatacattatttcttaaatttccttaagtttcgtgttttttttttctatcggtgcttctaaggtcactaattctttttacgtaaaaacattactacagtacatataaatctctgtaaaaatatgaaaataaatcaaacttaagccaataaaataaagagaaatgtaaccaactatactaactg

SEQ ID NO: 135655 - DNA, 601 bp, Human
acgaggcctttaaggagatgactaaggttaaatgagattataacagtgggctctaatccagtaggagttgtcttcatatgaggaagagacaccaggagtgcgcacacccaaaggaaaggccatgtaaggacaaagtaacaaggcggttagccatctgcaagccacaaagacagccctcatcagaaagcaactgtgccagcaccttgaccttgcacgtacagcctccagaaccgtgagaaaattaatttcagttgctgcagccacccaatctgtggtattttgttatggcagcccaaggagrtttattaacctccagccttcattaacatttataaccccagggaatactagccaccagaaacaaacccattaaaaccaagagactctgacaacctctctagaagtgccattaacacaccaaactaccttccctgtttgcagcactcttaccctaccctcgggtgggacttctctaatactctctctactcttgtaaagatgacctcatttttcacaaaccctcccaaaaacaagtttaaggttaggggttgttcaaagccaaaacccatttcaatacaagtttaagtttaaaagacaacaa

SEQ ID NO: 135656 - DNA, 601 bp, Human
tgggcctccccaagtgttggggttacaggcatgagccactgcgcccggcccagatagacatattaataccagacttgggctttgttatggactgcattgtgcccctccccaccaaaattcttctgttggagccctaccccccaatgtaactgtatttgaagacgaggcctttaaggagatgactaaggttaaatgagattataacagtgggctctaatccagtaggagttgtcttcatatgaggaagagacaccaggagtgcgcacacccaaaggaaaggccatgtaaggacaaagtaacraggcggttagccatctgcaagccacaaagacagccctcatcagaaagcaactgtgccagcaccttgaccttgcacgtacagcctccagaaccgtgagaaaattaatttcagttgctgcagccacccaatctgtggtattttgttatggcagcccaaggagatttattaacctccagccttcattaacatttataaccccagggaatactagccaccagaaacaaacccattaaaaccaagagactctgacaacctctctagaagtgccattaacacaccaaactaccttccctgtttgca

SEQ ID NO: 135657 - DNA, 601 bp, Human
attactgaaagatcctaccaaagcattgaaaagctaacaaaaagcccaacttaaccttcatttctgtttatatagtggtagaaagccccaaatccaagggcaaactaacaaggcatttatcttcaaaatattagaagacatgttagtggttatacagcagatgatatcatttgacataagcacttttccaattttcttcttccaagccacaaaagagtaggaaggtttccaaggcataatgtttcaccaagcagtagccaaacatgagtatctttttttttcctaaaaatacaaaaaaaaaccttaaagaatgatgtagaaaaagagaacaagagcaaatccaaattttggtgaagtttggtctgatttaattcttctaatcatgaaagatactcaaacactcagatgtgttttaggaaaacagatagaggaaccctcccttcagcagctgccttcgttcttcaattggcaagagacttgccacacaataaacagtgcatctgtgctgtctcattgagattaggaataagtatgagatcacaggtcacatgagctgcatttatgttctcttcttgacactttccaaatgaagctaagtcaa

SEQ ID NO: 135658 - DNA, 601 bp, Human
aaaaagtacattagtcaggtgtggtggtacacgcctatggtcccagatacttggggggatgaggtgggaaaatcgcttgagcctgggagtttgaggctgcagtgagccacgatcgagccactgcactccagcctaggtgacacagcgagacctcatctctaaaaataaataaaaagaatggaacaaaaagaagcaagagactaatcaaaaaactactgcaatgagggctcctcagaagcagggtaggagcaatggagacaaggatccaattctaaagagactaaagaaaacctaatttatygatatagtgaaagaccagagggaaaagcagcttgtggtggtagagacacatgagtttgctttggctgttaacaacaagatggctcttaggcatccaaatggaaatactgtaggtgatcaaatatatgagcctggagttcacatgagagttcaagtctccaaaaaacaaacaaacaaacaaacaaacaaacaaagacagacaagcaaataattcagaagagtacctcacatgtagtaaggttttaatatatggcagccatggccaggcgcggtggctcatgcctgtaatcccagcactttg

SEQ ID NO: 135659 - DNA, 601 bp, Human
cctcataaattgcagtaaggccttgggtctttatttttactgagatgggaaagtattacagaatttggactagagaagaaacatgatttgattcacattttggaagaattacttgggctgctgtggaagaaaaaacagaatggaccttgtctctacacaaaataaaaaagtacattagtcaggtgtggtggtacacgcctatggtcccagatacttggggggatgaggtgggaaaatcgcttgagcctgggagtttgaggctgcagtgagccacgatcgagccactgcactccagcctagrtgacacagcgagacctcatctctaaaaataaataaaaagaatggaacaaaaagaagcaagagactaatcaaaaaactactgcaatgagggctcctcagaagcagggtaggagcaatggagacaaggatccaattctaaagagactaaagaaaacctaatttattgatatagtgaaagaccagagggaaaagcagcttgtggtggtagagacacatgagtttgctttggctgttaacaacaagatggctcttaggcatccaaatggaaatactgtaggtgatcaaatatatgagcctggag

SEQ ID NO: 135660 - DNA, 601 bp, Human
actgatgctgtcattcacctgggtctccacactttcatcttcagctggttttgtacttggaactgctaaggagggagatgtactgggtgcagtttccgtggtgggctcaagctcaaccgcaggttctgtgtttcctcgagaagtagcattttcaggactgtcctcgctgggcttgacagcttcaactggtgaaggagaaggagcactttctgtatcagaactattttctgcaccttaaagataatgatacagcataaaaatctgataatgaacatgtttcaggtggtgatagaaaccatgyttgaaagtagttgtttaggatgaattctactcctttgatgacctcattgaagtatttacagccattgagaaggctaaagtttcctacagagtataaaagtgaaagatcaaattatcttgaccttctgaaactaaaagcataaaggattttaatgtctgaaaataatttatatgaaattgaaaaagaacgaacaataaaactaaacaaaaaacattcctataaatgatgacattctggtgtatttctagaagcctcttcctgtgaatttccttttacccagctgaactgacactctagaac

SEQ ID NO: 135661 - DNA, 601 bp, Human
tttgcatttaaattatgctttctaaaaattttcagaacactgaacatgtctctcttttcagcattttcttctacctaataagtaggggctggtaggccttgttttgaggttgcactgccttagagaagcgggagtgcctcaatgcctctagcctccaccttcttctaccacatcccactgctgccctcctcaggcacaacagttatctgtggtttattcacaactttattagttgaaattccctgttatgctatcatacagaatacacgtaacaagacagatataggagaaatgtataatytgtttcattaaaatgatcatacaatagtttgtggttatttaaacagaacagtatcagcccaatattaaaattgtacagactacctataacgtgccaatatttacataggagacatgtctgcagccagcaccaccctgtgattcagtcaccaaccagcagagtaagcacggggaggacttatggaacgagcctcacctctgcctctctggctctccatccacatcctcatcagcgctgcacgtggcactggaatcattgtctgactggggctcgggcctttgggcatttatttgctgagct

SEQ ID NO: 135662 - DNA, 601 bp, Human
agaaaaaaaacttgtaaattaatctgcattatacctgatattttaaattacaaatatgaacaatctaaaatgttaactgatacaaaaaagtggtcataattatcattactttgcatttaaattatgctttctaaaaattttcagaacactgaacatgtctctcttttcagcattttcttctacctaataagtaggggctggtaggccttgttttgaggttgcactgccttagagaagcgggagtgcctcaatgcctctagcctccaccttcttctaccacatcccactgctgccctcctcrggcacaacagttatctgtggtttattcacaactttattagttgaaattccctgttatgctatcatacagaatacacgtaacaagacagatataggagaaatgtataatctgtttcattaaaatgatcatacaatagtttgtggttatttaaacagaacagtatcagcccaatattaaaattgtacagactacctataacgtgccaatatttacataggagacatgtctgcagccagcaccaccctgtgattcagtcaccaaccagcagagtaagcacggggaggacttatggaacgagcc

SEQ ID NO: 135663 - DNA, 601 bp, Human
tgaacttgcaatcctcttgcctcagcctcccaaatagctgggaatacagggctgggagtactgttgggcaccaccatgcccagcaagggctggaactttcagctccatccagctcaccccacccccaaccctccagggagaggagaggggctaaaggttcatgcacccatcaccaatggccaatgatttaatcattcatacctatgtgatgaggccttcataaaaaccccaaatgatggggttttaagagtttccaggctggtgaacacgtggagttgctgggagggaggcagacctagayaggagacagaagctccacaccccttctgcacaccttgcccgatccatctcttccatttggctgtttctgagttatatcccttataatgaactagtaattataagtaaagcattttcctaagttctctgaggcattttagcaaattatggaacctgacgaggagagtcggaggaatccccagtctgcagcctagtcagaagcgtgagtaacctggggacccaatacctatagaactggcatcagaaatgggggtagccttgtggtactgagcccttacacttgtggtattagatgattacg

SEQ ID NO: 135664 - DNA, 601 bp, Human
tcccctctcccctctcccctctctcctcccctttccatggtctccctctcatgccgagccaaagctggactgtgccgctgccatctcggctcactgcaacctccctgcctgattctcctgcctcagcctgccgagtgcctgcgattgcaggcgcgcgccgccacgcctgactggttttcgtatttttttggtggagacggggtttcgctgtgttggctgggctggtctccagctcctaaccgcgagtgatccaccagcctcggcattctgaggtgccgggattgcagatggagtctcgttmactcagtgctcaatggtgcccaggctggagtgcagtggcgtgatctcggctcgctacaacctccacctcccagccgcctgccttggccccccaaagtgcagagattgcagcctctgcccggccgccaccccgtctgggaagtgaggagcgtctctgcctggccgcccaccgtctgggatgtgaggagcccctctgcctggctgcccagtctggaaagtgaggagcgtctctgcccggccgccatcccacctgggaagtgagcagcgcctcttcccggccgccatcccatctaggaagtga

SEQ ID NO: 135665 - DNA, 601 bp, Human
ctcccaaaagtgttgggattacaggcgtgagccaccacgcccagcctctttgccttattatgcagaccggtccatacgttttttgaaatcagaggctataatatataaatactctccacaatattaagaacattatcttaaactaatcactcaataaatgtccatttgaatgagtcagtgaatgaacaaatgtttaatgatctttttgtggtaagtacacaattaaaaacttttaccacttattatttgagatagaaaacacatttttgaataaagcaagagctttaaatatttgaataamtagaaaataactaaagaaaagaacaaggtcattttctggtgcctaaagaaaaattgagagtgttggaggtgttcaaacaagagtgactccggctcccctcccctctcccctctcccctctctcctcccctttccatggtctccctctcatgccgagccaaagctggactgtgccgctgccatctcggctcactgcaacctccctgcctgattctcctgcctcagcctgccgagtgcctgcgattgcaggcgcgcgccgccacgcctgactggttttcgtatttttttggtggagacgggg

SEQ ID NO: 135666 - DNA, 601 bp, Human
ttaagaagacactccctcttctccaaaacatccatagtattttttaacctaatagagcatcgcattttaattcattttaacctttacgataattttttttaatgccttttttttgagacagtgtctcgctttttcacccaggctagagtgcagtggtgccatctcacctcaccacaacctcaaactctcgagctcaaggaatccttccacctcagcctcccaaccacaggcgcatggcaccatgcggagctaatttttttttgtttttttttggagagacagggtttcgctatgttgcccragctggtcttggaactcctgcggtcaagtgatccacccacctcggcctcccaaaagtgttgggattacaggcgtgagccaccacgcccagcctctttgccttattatgcagaccggtccatacgttttttgaaatcagaggctataatatataaatactctccacaatattaagaacattatcttaaactaatcactcaataaatgtccatttgaatgagtcagtgaatgaacaaatgtttaatgatctttttgtggtaagtacacaattaaaaacttttaccacttattatttgagata

SEQ ID NO: 135667 - DNA, 601 bp, Human
gttatataacaataccgaatgctccttccttaactttacaaccacagcaaggtagacgtgtactattattttcattttacagatgagaaaactaaagctatgaaaggttaagtgacttgcctgtggccacacagctggcaaatgccaaggtgaaggcttagccagcgtctgattggaaatatccactacacaaagttgtgtctctcatctaccagagaatgtgaatattacactgtaatacttgaaggtgatttgcttcaaggacaggacaacaattctcactctgaaaattcagatgaayggaacataaagcataactttatttataatgtcttccagcacaaagatgaatatcagaaaattcacattaactagaatgctattaaaaatgttactggcatcctttagtagttaataatactaacatttcttcatagtttaaggtcaatttaaggaactgtgtctgttaggacaaatataataatcagttgggaggctgacaacttacaaagcacaatggacactgcttttgggtttagctttatttcccttcataaaagttctcttggtgatagctctatctacctaccttcccactctc

SEQ ID NO: 135668 - DNA, 601 bp, Human
ataatgcagagccacctgttatataacaataccgaatgctccttccttaactttacaaccacagcaaggtagacgtgtactattattttcattttacagatgagaaaactaaagctatgaaaggttaagtgacttgcctgtggccacacagctggcaaatgccaaggtgaaggcttagccagcgtctgattggaaatatccactacacaaagttgtgtctctcatctaccagagaatgtgaatattacactgtaatacttgaaggtgatttgcttcaaggacaggacaacaattctcactttgaaaattcagatgaacggaacataaagcataactttatttataatgtcttccagcacaaagatgaatatcagaaaattcacattaactagaatgctattaaaaatgttactggcatcctttagtagttaataatactaacatttcttcatagtttaaggtcaatttaaggaactgtgtctgttaggacaaatataataatcagttgggaggctgacaacttacaaagcacaatggacactgcttttgggtttagctttatttcccttcataaaagttctcttggtgatagctctatcta

SEQ ID NO: 135669 - DNA, 601 bp, Human
cagtattctgatattctaagcatatcgtagcatataagtagactataaactcattcttaaccagaaacatgtgccaattcttctaaccatgtcagaagaatgtattaaaacataaaaaccacccctttcttctttttttaaagaaagtaaaagtgtatcacacaccaactaaaacagcaacggaccaactcaaatccatcacttgaaataaaaacagtgatgtaacaatgaaaacaggtacctccatagtatctactgtgtatatacagtactaatacactaattaatatgtaataacgtrctacattatacataaaataatgcagagccacctgttatataacaataccgaatgctccttccttaactttacaaccacagcaaggtagacgtgtactattattttcattttacagatgagaaaactaaagctatgaaaggttaagtgacttgcctgtggccacacagctggcaaatgccaaggtgaaggcttagccagcgtctgattggaaatatccactacacaaagttgtgtctctcatctaccagagaatgtgaatattacactgtaatacttgaaggtgatttgcttcaaggacag

SEQ ID NO: 135670 - DNA, 601 bp, Human
tatgaggttaaatttaaaccatttttgtcaaacattctagacacaagcatcttaactgcaaacatttaaatgttatttgaaaggttatcctatacactgaactacaggatagactcaaggaaaaacttctggtacttgttaaacaaattacaggatgaatacactagggagattagctaaaacaaaacaacctttggataaacttgccctactttgtagagcatcaccttcgaccaaactgtaaaattcttaatgtcatactaatcaaaagtataattacaatttgattttaagatgactraattatgattaaaaattaggataccactgagatctaaaccacgtgtagtaatgtgactaacacagagaaatacaattcacagtttggagtctcagaatttggggctccagcctggttcagtttcttcagttcccaaatacaactcattttataaagcagaccaataaaagatattgaggctttaaaattatgatatccatatttaaatgacccagatattactaacaatgatgttatgccttgtcataagttcaacaaatgataccatctgaatgtcatttttctaacttttactacttc

SEQ ID NO: 135671 - DNA, 601 bp, Human
catatttaagactttaaaatatatagtttctttttaaaatgaaacatctgtaatttttgaaaatcaaaaaagcacaaagtaaaactcatttgtaaccctgaccacttagatttgtagcattttaatgtctgtcagaataaattcccactcattttatttattattttcattacctagttgtatccatttatctttccaagtaaatctaaatttaaaatcattgagtacttcctctcaaaacaaagaataaatagaattttcattagacttgtattaaatttatgaataaacaggtgatgayattttataataatgagttttctagttgagaaatcttgtttttgtcagatagttccatcccttgcttgttaaaaattattcctagatatgtcatattggtaagaaaaccatctcttttatatatatgagtttatataaataaacctgattactgcagacatacaggaaagatgcggatttctgtgtaataattttttctgaaaaacctaatgaactttccttttagctctaataacttttcagttgattcttttaggctttctaggtgaataatcttatcctgtaaataatttgtcttttc

SEQ ID NO: 135672 - DNA, 601 bp, Human
aatgcagtcatatttaagactttaaaatatatagtttctttttaaaatgaaacatctgtaatttttgaaaatcaaaaaagcacaaagtaaaactcatttgtaaccctgaccacttagatttgtagcattttaatgtctgtcagaataaattcccactcattttatttattattttcattacctagttgtatccatttatctttccaagtaaatctaaatttaaaatcattgagtacttcctctcaaaacaaagaataaatagaattttcattagacttgtattaaatttatgaataaacasgtgatgatattttataataatgagttttctagttgagaaatcttgtttttgtcagatagttccatcccttgcttgttaaaaattattcctagatatgtcatattggtaagaaaaccatctcttttatatatatgagtttatataaataaacctgattactgcagacatacaggaaagatgcggatttctgtgtaataattttttctgaaaaacctaatgaactttccttttagctctaataacttttcagttgattcttttaggctttctaggtgaataatcttatcctgtaaataattt

SEQ ID NO: 135673 - DNA, 601 bp, Human
ttcagggagattagttatcacttgatgtggagcaggctgaaggacttttaaaaggaaagaaaaatgattttaaactagtccatttcctagtttacaacatgttacctctctcagtcattcctgaatttttaaatcactaattaaaaaatgtaagatgaaaccaacaatgaacatttctattttaaatttctcattcacgtaagcctgtatacatatttgtcacaaatactatttgtggggttgaaatattcaactccctttcaaaccacagctttcaagctgatgcttatttcaaacttcygcttagcatagcaaacatcagtcttcaaaaattttttctctctcgccaatcactcttagggtacttcttaaaaacagctgataacactacttcagagaatgcgcagacatgactgacaaccagttatacatcctttttgcatcttgcatattgagaaacacttactgattctggctctcacagaacacttgaattttggggatggggagatctcaagacttttacaaattcatgtactcttcttaaaggaagagccagtcaatgtcacagtataaatgtgtgaacacaaatttcccagtg

SEQ ID NO: 135674 - DNA, 601 bp, Human
atctcaattttttaaaaagtaatgaaccagaaaaaagatttagtggccaaagtcagaataaattataatactaaccacctacaatttaatattttgagcctttaccatatgttagtgaacaaatattctactgtttgaaactaagtttaaaacttggtaagtttagagtgatgtaaattaaaccaagtggtatgccaagtgccaagtgtaattaaatgggtggtatgttatgaccactcaatctgggtacataactcactgaaagttctgatttgtggcaagagtacagtgactgctgcawcttctggtcattatctcttgaaacttcatattcagacagattattatttattacaactctgacaaatcagtgcgaggagggaggacaagttttaacaaagccatattcaacaagaaatctactgtaaagagaagtcgtttcacctgtgagatggagcctcccattataaaagatggtttttctgaagccactgtggttttggatgacgggatgagagggggcggtggcctggttggtcgagttgtcggaagccgaacgccttcagggagattagttatcacttgatgtggagcaggctga

SEQ ID NO: 135675 - DNA, 601 bp, Human
taggatatgtcttctaaaattaccatacattacatgtaaatagtatttactattaataaattacataaataaagcacttatatgttgcaatcaaaatgtaagctactattattaatattcattccgactaaaaatgctatggagagtggtatcagcaaatacagcaaagtaataaggacttccaaaaactctcttccataaaagcaacaagaaaacctggaaaaattttaagaatcaacctttttttttcttttcttttcttttgttttttttgttttctttttgtttttttttttgagayagagatttgctctatcacccaggctggagtgcagtggagcaatctcggctcactgcaacctccgcctcccagtctcaagcaatgtaagaatcgacttttaaagaaccctggaaattaaccaaaggcttgtagaaatctggaaatatttatttaaaaaaaaaaaaaaagctgaatctaggtaaaaacaggtaaaaacaatgggctttgtggcattttaacttgttccattctcattctcctgatcaaactctatggaagtgttgaaaaccaaaagcactcaatcatagtgcaaacctatgg

SEQ ID NO: 135676 - DNA, 601 bp, Human
gggagtaggatatgtcttctaaaattaccatacattacatgtaaatagtatttactattaataaattacataaataaagcacttatatgttgcaatcaaaatgtaagctactattattaatattcattccgactaaaaatgctatggagagtggtatcagcaaatacagcaaagtaataaggacttccaaaaactctcttccataaaagcaacaagaaaacctggaaaaattttaagaatcaacctttttttttcttttcttttcttttgttttttttgttttctttttgtttttttttttgagacagagatttgctctatcacccaggctggagtgcagtggagcaatctcggctcactgcaacctccgcctcccagtctcaagcaatgtaagaatcgacttttaaagaaccctggaaattaaccaaaggcttgtagaaatctggaaatatttatttaaaaaaaaaaaaaaagctgaatctaggtaaaaacaggtaaaaacaatgggctttgtggcattttaacttgttccattctcattctcctgatcaaactctatggaagtgttgaaaaccaaaagcactcaatcatagtgcaaacc

SEQ ID NO: 135677 - DNA, 601 bp, Human
tacatagacattaaaatagttttattaaggagtatttaatattatcaagattatcagaatattatctaccttctaattctttttgtttgtttgtttgagacagactctcgctctgtcgcccaggctggagtgcagtggcccaatctcagctcactgcaagttctgcctcccgggttcacgccattctcctggctcagcctcccgagtagctgggactacaggcgcccgccaccatgcccggctaattttttggtatttttagtagagacagggtttcaccgtgttagccaggatggtctcsatctcctgaccttgtgatccgcctgcctcggcctcccaaagtactgggattagatagtagataggcgtgaaccaccgcgcccagcctatctaccctctaattcttaattcataaaacatgaatctcttcaaaataaaagtattccattaaagttcaacaaaggctctttacctaagctaaactgactgaccacagtcgacaatcttagctaccacctatgggacatttaatatgagctctgcgttgttaattactttttatcgactaagctgttattcacaaaattctcatgagacaagt

SEQ ID NO: 135678 - DNA, 601 bp, Human
agggtgatggaaaaatcagtcaaggagtgacgtggtacacactttgaatatgggtgagactgaaggtagggagatgagttaggtggctgctgggttaaagatgatggtgacagtggtgaatacagagtaatggatggattctagacactttaggaaaataaacagaaatggcttagtgatttggtggatgtggaaagaaacagaggtgtgtagacttctgatatggacaacgtacattattaatttcttaaccccaaaaacaaaatgtgaatcataatatgccagacgtgtaaaggagagkgaaataagaatgctatcaagcattttgcagcatctggcactatgtacgcacatactttatttctttgtattggaagagaaagcatagctcatgactactccaaggtcacagagtcaggtgcaaataagaactcaaattcactcaaaactttggctaatatttctatcacatttgagtcattcttataaaatactactactgagaaaatataacaagaatacatctaaaaaaatgtacatagacattaaaatagttttattaaggagtatttaatattatcaagattatcagaatattatc

SEQ ID NO: 135679 - DNA, 601 bp, Human
atttcatgagctgttcttggactcctagtcccttctcgggcattcttaatatctacagaatacacaaacaagacttgctcagacggagcacatggtatacaatgtacagtaaataggttagtttcatagtctatcttataaaaataataatattaaaacttgtcttaacctacaataaaatatgtgtagatgattcatgaaaatattttcactcattcaaatgtgtttattgatgcctactgtgtgctaggcataagctaggcttgcaggtaagattaacaaattaagtccctttctgcaygaaacttacacaataatgtaggtacagattatgtagtaaaataagctatgaaaggagaagtataatgtgctatgaaaatgctaggagagaaacctaacacctccaggttcagataagcctgctcagaggaagcaatgtgtaagctgagaatgaaggatgaataagagttgttcaagtcaaaggtaataggaggaaaaagtacaggcagtgtgaacagtgaacacgaagaccccaaggtgagacagagaaaggtacaataaaagaacgtaagcgtggtaaccggctaatgtgtagagtgga

SEQ ID NO: 135680 - DNA, 601 bp, Human
cctctaacggtgctgatacaggagactccctcattgacatcccttgctttatatttccttccactgattcatagcttctctttaaactgatttcatgagctgttcttggactcctagtcccttctcgggcattcttaatatctacagaatacacaaacaagacttgctcagacggagcacatggtatacaatgtacagtaaataggttagtttcatagtctatcttataaaaataataatattaaaacttgtcttaacctacaataaaatatgtgtagatgattcatgaaaatattttcaytcattcaaatgtgtttattgatgcctactgtgtgctaggcataagctaggcttgcaggtaagattaacaaattaagtccctttctgcacgaaacttacacaataatgtaggtacagattatgtagtaaaataagctatgaaaggagaagtataatgtgctatgaaaatgctaggagagaaacctaacacctccaggttcagataagcctgctcagaggaagcaatgtgtaagctgagaatgaaggatgaataagagttgttcaagtcaaaggtaataggaggaaaaagtacaggcagtgt

SEQ ID NO: 135681 - DNA, 601 bp, Human
acatgtatcaaaataacattctgaaaacaatgctttaccctctaacggtgctgatacaggagactccctcattgacatcccttgctttatatttccttccactgattcatagcttctctttaaactgatttcatgagctgttcttggactcctagtcccttctcgggcattcttaatatctacagaatacacaaacaagacttgctcagacggagcacatggtatacaatgtacagtaaataggttagtttcatagtctatcttataaaaataataatattaaaacttgtcttaacctacwataaaatatgtgtagatgattcatgaaaatattttcactcattcaaatgtgtttattgatgcctactgtgtgctaggcataagctaggcttgcaggtaagattaacaaattaagtccctttctgcacgaaacttacacaataatgtaggtacagattatgtagtaaaataagctatgaaaggagaagtataatgtgctatgaaaatgctaggagagaaacctaacacctccaggttcagataagcctgctcagaggaagcaatgtgtaagctgagaatgaaggatgaataagagttgttc

SEQ ID NO: 135682 - DNA, 601 bp, Human
tatactgaatgctgttcttaaagtctatgtttttgataaatgctctatgaaggaaggaatgtcaatttaagtttgtgaactatccagaagtacctaatatgacatcacacagtcctttgtaaatattttcctaaataaaaaatggccaccaaaggcatctaatgaaaggttgaaaaggaaagataccttcaaagttaaatctaaaatcccaacacttctttatcaagaggaaagaagatacaggattggaaaccattgcttagctttgaaatatacttgtgataaagggaaaacgggaaatatggataccataaaaatagggaaaatgtattaaatgaaacatgcaaattgaaacgaaagagttgtaaataacctcctaagaagcttcacattattgttgctgataaatataaatcaagggttagaaataaccacacatatttacagtaaaagtgtgtgtttttaacatagagaaaaatacagctcttagaaaattacacaggacttaccctgcttttagtatttcatctagcttaaaattggttgaggcaggttaagatttaaacaaagtgggccattaacaaaacaaaatcatactgat

SEQ ID NO: 135683 - DNA, 601 bp, Human
ctccgtgcactggtgtcatcataaatcccagggctcagttgtgctttgggagcttcatgcagtgtggacctaagaacggaggggccagagcttaccactgacgtgtgccgggaacgcacggtctcgcctgctttcacatcctcatattttccccgttctaccacttttatgttctctggcacaatttccagcggaggcattccacgggatagtttgctaggccccgtgattaaggatttgacattgtgtttgatggcagattgacctgagttgttgtcaaactttattggtgtgccctaawgggaaagaaacaaacattacaggtagcaaagtcatctggctacttttctatctcaggtctatgtctggcccatggcagttacagttcactgtggtgatcttttttggtctgtttacaaatctcaatcacaaccccactgatcccaagctgcatactttcccacattccacactctatgctatagacataagaaaacctgatgataagaagtacacaaggccaggcatggtggttcacacctgtaatcccagcgctttgggaggctgaggtgggcagatcacctgaggtcaggagttcgaa

SEQ ID NO: 135684 - DNA, 601 bp, Human
tccccacatgtagtaaacttcagttttctctcattgcctgtgttatgcaacctccttcctacccattaatcactagtttcactaattttttccttgctctgttcttccacaatgactttctcattacttcaccaatatctatcacctccctactccagcctctcttctcttaaatgatgttattcaggatggtcagattgtcccaccaataaatatatattcaaacacttattagccatcatcctcaatttttttttttttttttttgagatagagtctcgctgtcacccaggctggagtrcagtggcgtgatcttggctcactgcagtctctacctcctgggttcaagcgattctcctgtctcagcctcccaagtagctgggactacaggagcgcgccaccatgcacggctaattgtttttgtatttttagtagagacaggatttcaccatgttggccaggatgggctcaatctcctgacctcatgatccgcccgccttggcctcccaaagtgctgggattatgggtatgagctgctgcacccagccaccctcaattttttttaactgtggtgaaatatacataacataaaatttacaat

SEQ ID NO: 135685 - DNA, 601 bp, Human
tgcagattataacagcccagccaagcctctctgtaccaaccgatgtgactgctcctctcccctccctgtgtaaaacacaatgccctctgcccagcagactgctctctagaaacctgcacatctgcacctatcagattctgtctaccaatgtcagtggtgttctgaagtttcttccagctgtacttgttactagaattatgtaacttaatgacataatttgtaaatcaaggaagaatgaagagtggtttctctgaaaactaacagctttggaaagagttgatacagaagttgaatcaggtgyggactagacaacttcaaaggctggaaaaaaaatctagaaggattctgtatttagattgcttggaagtgtctttacttggaagttctagctttacttaaaaaaaagaatttcttttatataagacagtgagacttaatcacttgtttatgaaaaagccttggcattagatcagagttctggtaaatgaacgtctatttatgctgtaagttaacatgtttaggtatgcctctgtcattttaaaataattattcacattaatccactttttcaactagtttcaccaagtgccatcagataaga

SEQ ID NO: 135686 - DNA, 601 bp, Human
taaaggtacagaaccatacatgactttggattttgtctatctctgtgaatcaagggtaatttgtacataatataaataaaaatgtttactatcatcattactttttaagacattctttaaagaaggatattaaagactgtacttcacatcagtaacctcaaagtatgggcagattacagagagcaaatttgtaagccatggattacaaatactcagcacaaggatttggtttagttaatttcagtattcaccaaaacaccttgtctcaatgtatgtctctgggctaaaaagtctacgggargaaggatatagtattcttttctttctttctttccatcattcattcaacaagtatttactgagtacctaagaaacactaggtaaacataataaattctacgaaatctgaaatgcaaagacacacacctctcgttgctgggtatgggagacccagtggctgctctcttggggagagtcctctggccacatctggacgcaagttcacttgcatctgttgtgaggtaatgtaatcatttaagattgtctgtcttgtgttctccattgcgtaaagctgatactgacttgggtaacctggagttgg

SEQ ID NO: 135687 - DNA, 601 bp, Human
gtgattctgtccatgggaggagtgcttgttccccctggatgaggcactaaaattgttggaggcatattggtcaggtcaatgattcctatccaaaagacaatacaatttatgttaagtgttattctaaaggtacagaaccatacatgactttggattttgtctatctctgtgaatcaagggtaatttgtacataatataaataaaaatgtttactatcatcattactttttaagacattctttaaagaaggatattaaagactgtacttcacatcagtaacctcaaagtatgggcagattamagagagcaaatttgtaagccatggattacaaatactcagcacaaggatttggtttagttaatttcagtattcaccaaaacaccttgtctcaatgtatgtctctgggctaaaaagtctacgggaggaaggatatagtattcttttctttctttctttccatcattcattcaacaagtatttactgagtacctaagaaacactaggtaaacataataaattctacgaaatctgaaatgcaaagacacacacctctcgttgctgggtatgggagacccagtggctgctctcttggggagagtc

SEQ ID NO: 135688 - DNA, 601 bp, Human
ggagatggaggttgcagtgagctgagatcacaccactgcgctccagcctgggcaacagagccagactctgtctccaaaacaaaaacaaaaaaaaaacaagaaaagagaaaaagaagtttgttttattaagagtcctggataagaactgaagcataacataagcttttaaggcattcctaaggtatctagtgacagctggcacataagaactactattaaatgttaaaagaaaaacaagaaaccaaatgaggaaaaattgcccaagataccttaaaaggctatgttgtaaaaatgtaaacaygatggttctattagagaggtgtgtaactgtacaatctcacctggagacatggaagcagagttgtacggcctgggagggaaagtaatctgtgtaccaggaatataagtgattctgtccatgggaggagtgcttgttccccctggatgaggcactaaaattgttggaggcatattggtcaggtcaatgattcctatccaaaagacaatacaatttatgttaagtgttattctaaaggtacagaaccatacatgactttggattttgtctatctctgtgaatcaagggtaatttgtacataat

SEQ ID NO: 135689 - DNA, 601 bp, Human
ggtcggccaggctgttctgagcctgcagaggtgaaaaagagaaagaaacaaagacataaggaggaagccagagacaaaaggaagcaatgcttatggattgtttatttcctaacatacctaaatagaaaaaagaaaaacaagataagaaacttgatagtctactttctggcctttccagaaatatgttctaaaagtgtccaaataaagatgcaataaaaccgcagcagtaacttgaaacaaaacatcagccatcatttactgtcatttccatttctctgataaatttcaatcttgattccakaaataaaacagcaccaacaagaagtactactacaaatcatataagttcatctttctgatttttcctcaaactctagtgtgtatatgatttccaaaatctaatcaggcacaactttctaagcatcataatgaaaataatataccactgctacactagggtttgagactgtttcattcaaccacagtttgccctgcttcacttcttcactgtccccttcacaggtgactctttctctcagcaagctctctcttttgaaatgaaatcattcacattatcttcccacaaaacacttggctccca

SEQ ID NO: 135690 - DNA, 601 bp, Human
aaagtgctgggattacaggcgtgagccaccacgcccggccttctcagcattcttaaatttatttccctttgtgcttgttaactataatttaacatttgctaatatttagtctaccactttgaagcaagaatcctgtgtccactttattttaaccaaacacagaatatcaggtaagaagatatgctctttatcagagagccctggcatataacatgtttccactcatgatgccactattggcttccctttcctttatttaaggtcaccttaaaatatatatgtgtgtgtgtgcatatatatrtgtgtgtgtatctatacatacatatatacatatatatatatataaaattattcactgacagaagtctgaggcctagaataaaatataaatgcagaagcaagcaaacaaacaaacaaaaaatatataaactttttttttgtagagatgagatctcactatgttgcccaggctggtctcaaattcctgggctcaagcaatcctcctacctcagcctcccaaagtgctagcattacaggtataagccactatgtctggccaatatcaccttcttaaacttctactgatgctgacccagtagaa

SEQ ID NO: 135691 - DNA, 601 bp, Human
cttatttatattcttctatctgctctttgctcactttgatgggttggtaggtaggctggagaatcacttctgctacaaatttctctttttcaggctctgagccatggcttccattactctggctcatgtgtcctctatgtcttcaggtatttgccagaatctttgatctgcccatatctcagtcttgttctcagcattctttttatcttttttttttttttttttttttgagacggagtctcgctctgtcgcccaggctgcagtgcaatggcatgatctcgggttcaagtgattcttccgmccaggttcaagcgattcttctgcctcagtgtcctgagtagctgggattacaggcacctgccatcatgcctggctaattttttttttgtatttttgtagagacggggtttcaccatgttggccaggttggtcttgagctcctgacttcagatgatgcacccagcttggcctcccaaagtgctgggattacaggcgtgagccaccacgcccggccttctcagcattcttaaatttatttccctttgtgcttgttaactataatttaacatttgctaatatttagtctaccactttgaagcaa

SEQ ID NO: 135692 - DNA, 601 bp, Human
agcttatttatattcttctatctgctctttgctcactttgatgggttggtaggtaggctggagaatcacttctgctacaaatttctctttttcaggctctgagccatggcttccattactctggctcatgtgtcctctatgtcttcaggtatttgccagaatctttgatctgcccatatctcagtcttgttctcagcattctttttatcttttttttttttttttttttttgagacggagtctcgctctgtcgcccaggctgcagtgcaatggcatgatctcgggttcaagtgattcttcygcccaggttcaagcgattcttctgcctcagtgtcctgagtagctgggattacaggcacctgccatcatgcctggctaattttttttttgtatttttgtagagacggggtttcaccatgttggccaggttggtcttgagctcctgacttcagatgatgcacccagcttggcctcccaaagtgctgggattacaggcgtgagccaccacgcccggccttctcagcattcttaaatttatttccctttgtgcttgttaactataatttaacatttgctaatatttagtctaccactttgaagc

SEQ ID NO: 135693 - DNA, 601 bp, Human
aatcacatttcttttctttttttggttttgttttggctgaaagggaataaatgtgctttcatcttatccttaaggttatccagctgcgtctaatgactaagtccgagatttgcttcaaaattatccagtttgggggtcggggcaagcggggatgaaaatgaaacaaaactcgtcatacactgaggattaccaaaattgggtgatggatacctagaggtgtattatacttgttctctctacttttgtatgtatttgaaaacttccacaataatttttttttttaaagaagaccatttagcttatttatattcttctatctgctctttgctcactttgatgggttggtaggtaggctggagaatcacttctgctacaaatttctctttttcaggctctgagccatggcttccattactctggctcatgtgtcctctatgtcttcaggtatttgccagaatctttgatctgcccatatctcagtcttgttctcagcattctttttatcttttttttttttttttttttttgagacggagtctcgctctgtcgcccaggctgcagtgcaatggcatgatctcgggttcaagtgattcttccgccc

SEQ ID NO: 135694 - DNA, 601 bp, Human
aatcccattactgggtatatacccaaaggaatataaatcattctattataaagacacatgcacatgtatgttcactgtagcactattgacaacagcaaagacatggaatcaacccaaatgcccatcagtgattgactggataaagacaatgtggtacatatacaccatggaatactatggagccatgaaaaagaatgagctcctgtccttttcagggacatggatggagctggaggccattatccttagcaaactaacgcaagaacagaaaaccaaataccacgtgttctcacttataagygggagctaaatggtgagaacacacggacacatggaagagaacaacacacactagggcctattggaggatggagggtgggaggagaaggctcaggaaaaaataactaatgggtaccaggcttaatacctgggtgacaaaataatctttacaacaaacccccacgactcaagtttacctatataataaacctgcacatgtactcctgaacttaaaatgaaagttaaataaataactaaaatgaaaatcagttgatgctgttttctaacaccacagattgtgcaaacattttcatcaggaatg

SEQ ID NO: 135695 - DNA, 601 bp, Human
cagatatgggggcaggagcctgtaatcctagctacttaggaggctgaggcaggagaatcacttgaacctgggaggtggaggttacagtgagctaagatcacaccattgcactctagcctgggcaacagggcaagactctgttttaacaacaacaaaaaaagagtaagtgccaatcaaaaccaaaatgagacaccatctcacaccagtcagaatggctattaaaaagtgaaaaaataacagatcctggcaagactgtggagaaaatggaacacttatacactgttggtgggagtgtaaattrgttcaaccactgtggaagacactgtggaaattcctcaaagacctaaatgcagaactaccactcaacccaacaatcccattactgggtatatacccaaaggaatataaatcattctattataaagacacatgcacatgtatgttcactgtagcactattgacaacagcaaagacatggaatcaacccaaatgcccatcagtgattgactggataaagacaatgtggtacatatacaccatggaatactatggagccatgaaaaagaatgagctcctgtccttttcagggacatggatggag

SEQ ID NO: 135696 - DNA, 601 bp, Human
aagaagacatatatgcagccaagaagcatatgaaaaaaaaagctcaatatcactgatcattagagaagtgcaaatcaagccaggtgcagtggctcatgcctgtaatcccaccactttgggaagctgaggtgggtagatcagctgaggtcaggagttcgagaccagcctggccaacatagtgaaaaaccctgtctctactaaaaatacaaaaattaaccagatatgggggcaggagcctgtaatcctagctacttaggaggctgaggcaggagaatcacttgaacctgggaggtggaggttrcagtgagctaagatcacaccattgcactctagcctgggcaacagggcaagactctgttttaacaacaacaaaaaaagagtaagtgccaatcaaaaccaaaatgagacaccatctcacaccagtcagaatggctattaaaaagtgaaaaaataacagatcctggcaagactgtggagaaaatggaacacttatacactgttggtgggagtgtaaattggttcaaccactgtggaagacactgtggaaattcctcaaagacctaaatgcagaactaccactcaacccaacaatcccattact

SEQ ID NO: 135697 - DNA, 601 bp, Human
catacaccctcctaaaactgaaccaggaaaaaactgattccctgaacagaccaataacatgctctgaaattgagtcagtaataaatagcctaccacccaaaaaaagcccatgaccagacacattcactgctgaattctaccagatgtacaaaaagagctggcaccattcctactgaaaatattccaaacattaaggaaggactcctccctatctcattctatgaggccagcatcatcctgataccaaaacttggcagagacacaacaataaaaagaaaacttccggccaatatccttgatkaacatgaatgcaaaaatcctcaacaaaatactggcaaaccaaacccagcaaaatattaaaaagcttatccaccacaatcaagtagatgttatccctaggatgcaaggttggttcaatatacacaaatatcaatagatgcagaaaaggctttcaataaaattcagtaccctttcatgttaaaaactctcagtaaactagatattgaaggaacatacctcaacataataaaagagccatatatgaaaacccacagccaacatcatactgaatgggcaaaagctggaagcattcctcttgaaa

SEQ ID NO: 135698 - DNA, 601 bp, Human
ttccagcctgaacaacaagagcgaaactccttctcaaaaaataaataaataaataaaataaacaaaacggaagctgaactgaaggagattcagacacaaaaaaacactcaaaagatcaacaaattcaggatctggtttttgttttgttttgagatggagtctcgctttgtcgcccaggctggagtgcggtggcgcgatcttggctcactgcaagctccgcctcccgggttcacgccattctcctgcctcagcctcccgagtaactggaactacagatagatgccggccaccacgcctggcwaattttttgtatttctttttttttttttagtagaaatggggtttcactgtgttagccaggatggtctcgatctcctgacctcgtgatctgcctgcctcggcctcccaaagtgctgggattagaggcatgagccacggcacccggcctcagaatctggtttttagaaaaaattaataaaacagactgctagctaagactaatagagaagattcaaataaacacaatcagaaatgacaaggaatattaccactgaccccacagaaacacaaacaatcataagaaaatattatgaacaccttt

SEQ ID NO: 135699 - DNA, 601 bp, Human
aagatttattgcatcacatccttttctagaactacagagaaactcctctgtgttttgcttataaaaatcactccatacaattacatggaaattcaataacctgctcctggagtacataatgaaataaaggcagaaagcaagtttttttaaactaatgagaacaaagatacaacgtaccagaatctctgggacacagctaaggcagtgttgacagggaaatttatagcactaaatatccacatcaaaaagttagaaagatctcaagttaacaagctaacatcacaaccaagagcaaacaaaycccaaagctagcagaagacaagaaataaccaaaactgcagggggcgcggtggctcacacctgtaatcccagcacgtggggacgctaaggcaggcggatcacctgaggtcgggagtttgagaccagtctgaccaacgtggagaaaccccgtctctactaaaaaaatacaaaattagctggggtggtggcacatgcctgtaatcccagctactcgagaggctgaggcaggagaattgcttgaaccaggaggcagacgttgtggtgagctgagatcgcgccattgcattccagcctgaacaac

SEQ ID NO: 135700 - DNA, 601 bp, Human
atcctctcgccttggtctcccaaagcactgaaattacaggtgtcagccactgtgctggcttgcctattttaattttgtccattttgcctttacatagcatacttcagccttttatattttcttttttaaaaatgaagaaattagcacacatacccttacttctccatctctttcctatgcaaccctcacctcccaatatctgtcagccatttttaagatttattgcatcacatccttttctagaactacagagaaactcctctgtgttttgcttataaaaatcactccatacaattacatrgaaattcaataacctgctcctggagtacataatgaaataaaggcagaaagcaagtttttttaaactaatgagaacaaagatacaacgtaccagaatctctgggacacagctaaggcagtgttgacagggaaatttatagcactaaatatccacatcaaaaagttagaaagatctcaagttaacaagctaacatcacaaccaagagcaaacaaatcccaaagctagcagaagacaagaaataaccaaaactgcagggggcgcggtggctcacacctgtaatcccagcacgtggggacgcta

SEQ ID NO: 135701 - DNA, 601 bp, Human
aatggtctcaaactcctgacctcaagtgatccacctgcctcagcctcctgaagtgctgggattacaggcgtgagccaccacacccggccctgctaaaattttttgacatagcgattatgcatatgaaagccacctgtgactttcaacatctggaattatgactattagactaaagcaaaattataatatgatttgttatggcctttctcaatcagcccatccagttgttcaagatagccactttttttttaagttgttttgctgtttacctccaaaactctgtaaataatcttaaacatgatttttttatttataaaacttgaaacagtatctgttaactctcttccatgaaagatgaagaatttgatttgccttctctgttgttgcccattttatttttatttttatttttatttttgagacagggtctccctctgtcacccaggctagagtgcagtagtacaatcactgcttactgcagcctcaacttctgcgctcacgtgatcctcccacctcaggctcccaagtagctgggactacaggtgcatgccaccatgcctgggcgattttattttttagtttttttgtggagatggggtct

SEQ ID NO: 135702 - DNA, 601 bp, Human
atcaggtgagtcaacataggttctagttacactatattatggcagaggggttctctgcaattttatattttttctctggataccatttggtaagaataatataagatagacacactgtttagctcccacccatttatcattttttttttttttgagacagagtctggctttgtcacccaggctggagtgcagtggtgtgatcagctcactgcaacctctgcctcccaggttcaagcaattctcctgcctcagcctcccgagcagctggaattggaattataggcatgcgccaccatacccsggctaatttttgtatttttagtagagacggggtttcaccatgttggctaggcctcctgacctcaggtgatccacctgcctgggcctccaaaagtgctaggattacaggcctgagctaccgcacctggcccatttatcttattattaaaatttttattttttagagacagggtcccgctcgttgcccaggcaggagtacaggagtgcaatcatagctcactgcagcctcaaactcttgggctcaagtggtcctctcacttacatctcccgagtaactgggattacaggcatgcgtcaccat

SEQ ID NO: 135703 - DNA, 601 bp, Human
tccttagtccaggtgaaacctcaagggttttcctacctattttgagtcgactgaccagttctttcatcgtcaagttaaagataaaggacttcagtactaaactgacacccaagaagttttatcaggtgagtcaacataggttctagttacactatattatggcagaggggttctctgcaattttatattttttctctggataccatttggtaagaataatataagatagacacactgtttagctcccacccatttatcattttttttttttttgagacagagtctggctttgtcacccagsctggagtgcagtggtgtgatcagctcactgcaacctctgcctcccaggttcaagcaattctcctgcctcagcctcccgagcagctggaattggaattataggcatgcgccaccataccccggctaatttttgtatttttagtagagacggggtttcaccatgttggctaggcctcctgacctcaggtgatccacctgcctgggcctccaaaagtgctaggattacaggcctgagctaccgcacctggcccatttatcttattattaaaatttttattttttagagacagggtcccgctcg

SEQ ID NO: 135704 - DNA, 601 bp, Human
gattttccaggcctactattgtaatatgtgaaatattagattgtgtttcaaaggctaacctgggacttacctaaacagaaacttgttaactcatgacttcattcaggagaaggagcaaaagctgccaatttctatcagaaaaaaagttgcctcaggtattcactatatacatagttaaaacaaacaaacaacaacaaaaaaaaccactgtgttactgccacttgacccatgcgcgccccgtggatccaggagtcacgtcatcagacagtgctgcccgggcagcagcagtggcagaagctgmgtccttgaggctccgcatgtccttcaacatcagacaccatctcacccttggctccttagtccaggtgaaacctcaagggttttcctacctattttgagtcgactgaccagttctttcatcgtcaagttaaagataaaggacttcagtactaaactgacacccaagaagttttatcaggtgagtcaacataggttctagttacactatattatggcagaggggttctctgcaattttatattttttctctggataccatttggtaagaataatataagatagacacactgtttagctccca

SEQ ID NO: 135705 - DNA, 601 bp, Human
aaggtgataggaacaggaataagacatggtccctgtcctcaaaacactcataaacgtaggggaaagatgtaaatgtataattaaattgaacatcactccctctccaaaaatggattttcttcatttcattgaaaagtagcaatatctgtttagctccctaagaataaatgcaataaattaatagcaacactttgtaagaaaggcactagcaatttggagttagaaaggccttcgtttaaaactggcccttccccattagtatcagtacgaccatgagcaagtgacatgtctggctttcagygcatcagtggagggttcagcactaggcaaactgcacgactatggacagaaaggaattcagggaacaataagcaacatgatttggacagagattccagtgtagggatgatgcagagggaagtgaagctgaatgcgcagcatacacctggtcatgccaggaactcagatgccatgcaaaagactgggtgctggattctgcatgagttttagacaaatcactcaggtggaggtatggagactgactggaaaggagccaactcaaaggcatctagtcaaatggggataatttaataattaatag

SEQ ID NO: 135706 - DNA, 601 bp, Human
tattttttgagacagagactcactttgttgcccaggctggaatgcagtggcacaatcttggctcactgcaacctctgcctcccaggttcaaatgattctcatgcttcagcctcctgagtagctgggattacaggtgcacgccaccatgaccagctgtttatatttttagtagagacagggtttcaccatcttgcccaggctggcctcaaactcttgatctcaggtgatcaacccgtcttggccttgcaaagtgctgggattacaggcgtgagccaccacacccagacaatttaaaaaaaawttttttttttttcttgagacatctcactctggcttaggctgcagtgcagtgatgcgatcgtagctcactgtagcctcaacttcccaggctcaagcaatcctcccacctcagcttcccatgtaaataggactacagggatgtataccaccgcacccagctaattttttatattttgtagagatggggtctccctgtgttgtccaggctaatctcgaactcctgggcccaatcaatcctcccgccttggcctcccaaagtgttgagattccaggccaatgttttatttttacacggttagtt

SEQ ID NO: 135707 - DNA, 601 bp, Human
ttactgattttatatttttattttattaatttattattttttgagacagagactcactttgttgcccaggctggaatgcagtggcacaatcttggctcactgcaacctctgcctcccaggttcaaatgattctcatgcttcagcctcctgagtagctgggattacaggtgcacgccaccatgaccagctgtttatatttttagtagagacagggtttcaccatcttgcccaggctggcctcaaactcttgatctcaggtgatcaacccgtcttggccttgcaaagtgctgggattacaggygtgagccaccacacccagacaatttaaaaaaaatttttttttttttcttgagacatctcactctggcttaggctgcagtgcagtgatgcgatcgtagctcactgtagcctcaacttcccaggctcaagcaatcctcccacctcagcttcccatgtaaataggactacagggatgtataccaccgcacccagctaattttttatattttgtagagatggggtctccctgtgttgtccaggctaatctcgaactcctgggcccaatcaatcctcccgccttggcctcccaaagtgttgagat

SEQ ID NO: 135708 - DNA, 601 bp, Human
agtctgtttcctcatctacaaaatggagataattgtaatatgtagggttgttgtgaggattaaatgagactatatctacacatgcttagaatagagcctaccacatagtacgctagataaccttttgctaccattattactgattttatatttttattttattaatttattattttttgagacagagactcactttgttgcccaggctggaatgcagtggcacaatcttggctcactgcaacctctgcctcccaggttcaaatgattctcatgcttcagcctcctgagtagctgggattayaggtgcacgccaccatgaccagctgtttatatttttagtagagacagggtttcaccatcttgcccaggctggcctcaaactcttgatctcaggtgatcaacccgtcttggccttgcaaagtgctgggattacaggcgtgagccaccacacccagacaatttaaaaaaaatttttttttttttcttgagacatctcactctggcttaggctgcagtgcagtgatgcgatcgtagctcactgtagcctcaacttcccaggctcaagcaatcctcccacctcagcttcccatgtaaataggac

SEQ ID NO: 135709 - DNA, 601 bp, Human
ggtggacctgctccagcagctggtgctgcaccagtgggatcctgcccactccactgctgctgctccagctgagaagaaagtggaagcaaacaaagaagaatctgaggagtctgatgatgacatgggcttttggttgttttgactaaatttcttataacgtgttcaatacaaagctgaacttaagaaaaaaaaaaaaagaataaaccagactatggtctacccaaagtctctctatcaaggggactgaggaaaagactgataagactggggggatagttagtacaagtgagtgctgagagarcacgaggaggttctgattaatacttgcatatcaacccagaggaaaaaggttctgccacagaacattagctagaatatttaccaacaatctggttaagatgctatgagtatggaactgttagaagccagttggtccatcattagcaacatggactctggagttggaatgcctgggtttgaactgcagcctcattacttactagatatgtaacctgtgccaactcttaaacctgagtctgtttcctcatctacaaaatggagataattgtaatatgtagggttgttgtgaggattaaatgag

SEQ ID NO: 135710 - DNA, 601 bp, Human
gccggatacagtggttcacgcctgtaatcccaacactttgggatgctgaggtgggtggatcacctgaggtcaggagttcgagaccagcctggccaacatggataaaccccgtctgtactaaaaatacaaaattagccggatatggtggctggtgcctgtaatcccagctactcgggaggctggcccaggagaaacacttgaacccgggaggcggaggttgcggtgagccgagatcgtgccactgcactccagcctgggccacagagtaagactccatctcaaaaaaaaaaaaaaaaaaaaagaaagaaagaaaggctatctgtaagcctgataacaattctggtcagcattctaaaatatttgtcttttattttgttgccacctaaacagaacctagtaattaagagcgaggacaagttcagaaacagtggtgacactggctcatccttttttccttggtgttcaacatttattaatcacaagagtgacacagatctaaacaaacatccaccaggcagttcacagtgcaaggcccccactttcctttcttttgacaggatcaggagactagtagatggtagatcacagaaataaagcagat

SEQ ID NO: 135711 - DNA, 601 bp, Human
agttcaaacatggcatttccctgtcaaagagtttcccactttaagggtaagacaaagactacagaatgagcagaccacacaaaggtgaaatgatttgcatctcagttcctggctgctctgagatctctagctctccgtgctcacacagattcatctctgagtgccaagagaaattgaaaacaagagtatatttttgttggtgacacttgaggagctgtaaataatagattaaactgttgaagactggagacagaaaatagtaataacaatattttttgaaaaggtggccggatacagtggytcacgcctgtaatcccaacactttgggatgctgaggtgggtggatcacctgaggtcaggagttcgagaccagcctggccaacatggataaaccccgtctgtactaaaaatacaaaattagccggatatggtggctggtgcctgtaatcccagctactcgggaggctggcccaggagaaacacttgaacccgggaggcggaggttgcggtgagccgagatcgtgccactgcactccagcctgggccacagagtaagactccatctcaaaaaaaaaaaaaaaaaaaaagaaagaaagaaagg

SEQ ID NO: 135712 - DNA, 601 bp, Human
tatttgactgaattgttaagattaccttattgatcaaaaatggtcagatgaagacaatttcctataagttaaccaatgataatccttagatactgcacttgcaggataacccttcctttgctaatggagcttacagtgcagtgtggtacttgctaaggccatacaaattagaatcacctgggtagcttagtaaattttctacattcctggggctccataattcaactatttaataagcaatccaggtgactggtacctactgttgagcaagaatgtggtaactgctcagaaattagcagartggaaggtagacatgtgaaagccactgtggaggccaacttgacaggaggagctgactcccatcaggaggcagagagaccaggatagtaatggccagagtaatggtaactgttaactgtggtagggaaggaggaggaactttttgtatggggaggtagaacatggattcaattttagatatttaaggagccagtaagttagtcaagaagtaatgaggtctgcaaagatatgtaagtagagcttagtaggaaaagctgggctacagatacaaatttgggagttttcagcatacaagcgacca

SEQ ID NO: 135713 - DNA, 601 bp, Human
aggtgtgagccaccgtgcccggccagaatgtgaaatttctaatgagaccacagaaggatggactcttacccaagggctgagcacatgagaggagggaagagtgcatgtgcctagaaacaaacttggttgattagggaggctttaaactgacaaagagaggagaaaagtcctcagaagaactagaaaacaatggccatggatgacagtcttcttacttatgggccaggtgacaaggtaaataaattgagcctgaaacagcagagccctgttatcatgaagtgtgtggaacaggagtcattcctttgatagatatttaattgagcagttatttgactgaattgttaagattaccttattgatcaaaaatggtcagatgaagacaatttcctataagttaaccaatgataatccttagatactgcacttgcaggataacccttcctttgctaatggagcttacagtgcagtgtggtacttgctaaggccatacaaattagaatcacctgggtagcttagtaaattttctacattcctggggctccataattcaactatttaataagcaatccaggtgactggtacctactgttgagcaagaatg

SEQ ID NO: 135714 - DNA, 601 bp, Human
tgctgggattacaggtgtgagccaccgtgcccggccagaatgtgaaatttctaatgagaccacagaaggatggactcttacccaagggctgagcacatgagaggagggaagagtgcatgtgcctagaaacaaacttggttgattagggaggctttaaactgacaaagagaggagaaaagtcctcagaagaactagaaaacaatggccatggatgacagtcttcttacttatgggccaggtgacaaggtaaataaattgagcctgaaacagcagagccctgttatcatgaagtgtgtggaayaggagtcattcatttgatagatatttaattgagcagttatttgactgaattgttaagattaccttattgatcaaaaatggtcagatgaagacaatttcctataagttaaccaatgataatccttagatactgcacttgcaggataacccttcctttgctaatggagcttacagtgcagtgtggtacttgctaaggccatacaaattagaatcacctgggtagcttagtaaattttctacattcctggggctccataattcaactatttaataagcaatccaggtgactggtacctactgt

SEQ ID NO: 135715 - DNA, 601 bp, Human
ctgggttcaagcagttctcctgcctcagcctcccgagcagctgggattataggccccccgccaccatgcccagctaatttttgtatttttagtagagacggagtttcaccattttggccaggctggtctcgaactcctgacctcaggtgatctacccacctcagcctcctaaagtgctgggattacaggcatgggccactgtgctcagccagaatgtgaaattaattaatttattaattaatttatttttaagacggagtctcactctgccgcccaggctggagtgcagcggtgcgatctyggctcactgcaagctctgcctcccaggttcacgccactctcctgcctcagccccccgagtggctgggactacaggcgcccgccactatgcctggctaattttttacatttttagtagagatgggatttcaccgtgttagccaggatggtcttgatctcctgacctcgatatgcccgcctcggcctcccaaagtgctgggattacaggtgtgagccaccgtgcccggccagaatgtgaaatttctaatgagaccacagaaggatggactcttacccaagggctgagcacatgagaggaggg

SEQ ID NO: 135716 - DNA, 601 bp, Human
gactgtgtttccctgcatggctaactggaaactcaggatatttgctggaaaaaacaaaagactctgttgatccttttcattcctgctgactgtgcaacttgtaatctgcagtttgaatgataacagcataagacctgggaaccgcctataataaagcagtgtgccagaaaggggaagaatttgggacataaattggtgtttccgtcattcccaacttgacgctaagaattttaaagagaaaaaaagaatgcagaaagcaagtgggcagccaaatgatgtgtcccaaagaatgtgaaagttcttttttttttttttttttttttttcctttgagatggtggtgttttattcttgtcacccaggctggagtgcaatggcgtgatctaggctcactgcaacctctgcctcctgggttcaagcagttctcctgcctcagcctcccgagcagctgggattataggccccccgccaccatgcccagctaatttttgtatttttagtagagacggagtttcaccattttggccaggctggtctcgaactcctgacctcaggtgatctacccacctcagcctcctaaagtgctgggattacaggcatgg

SEQ ID NO: 135717 - DNA, 601 bp, Human
tttcatgatctcaacctttatttctcacccattaagtgaagataaaatggaagtattttttttttttgagacagggtctcactctgttgcccaggctatttttaaagggaaatcaggaaataggtaaggtaggaacatcaaaagaagagcaataagctgtgtgcagtggtgcactcctagtcccccagctactcagcaggctgaggcggtaggactgcttgagcataggaatttgaggccagcctgggcaacacagtgagactctcccatctgtttaccaaaaataaataaataaataaawaaagaagcagtgtaacccagaaaagggaaaggaactttgcactgctggagaaaaacaaataggaaaatgctgttctcagaacaggaaccaaggctttctgacgaagaagaaaccttggactctgggatgaccgccacaaataccaacaggtttgaggcagcctgggatgtgatccagaggaaagccaccacagtgaatactatgaaaatgactgtgtttccctgcatggctaactggaaactcaggatatttgctggaaaaaacaaaagactctgttgatccttttcattcctgctgact

SEQ ID NO: 135718 - DNA, 601 bp, Human
accttccttcactaaattatttatttatttttccatattagagcagtcactcccctggtatacagttggtactcagtacatatttgttggactgactactgctgtgccaattttgtattggtaaataatgtcttttcaatcttacctgacgtagtaactgctggcagattaaagatctcagttcctggctgagcagctgctatatttaagcaaacattcaagttaattaagatgtgataatcatatataccaaactaaagtctcaaaaaattcctataataaaattaatctttttattttycatgatctcaacctttatttctcacccattaagtgaagataaaatggaagtattttttttttttgagacagggtctcactctgttgcccaggctatttttaaagggaaatcaggaaataggtaaggtaggaacatcaaaagaagagcaataagctgtgtgcagtggtgcactcctagtcccccagctactcagcaggctgaggcggtaggactgcttgagcataggaatttgaggccagcctgggcaacacagtgagactctcccatctgtttaccaaaaataaataaataaataaaaaa

SEQ ID NO: 135719 - DNA, 601 bp, Human
attgccccatcagcccactgaatacacacagcacttggcaagtgacctagaacaataccaggacccaccacacagagacctttttttttggagacagagtctctctctgtcgcgcccaggctggagtgcagtggcgcgatcttggctcactgcaacctccgcctcccagattcaagggattctcctacctcagtctcccaagtagctgggactacaggcacccaccaccacaccaggctaattttttgtatttttaggagatggggtttcaccatattggtcaggctgatctcgaattccsaacctcaggtgatccgcccgccttggcctcccaaagtgctgggattacaggcgtgagccaccgcacccagcccagagaccatcttaatccacagataactccttaaggaaatttgtttcccaagtgaatcagtcacccacacttctattaaagttactcaacaattttctcagttccctagttttgacagtgttctttaatagtttcattctttttgttcatttatcttttcaataggtatttactggatctcagttcctttctgtgctactgggtaaaccttccttcactaaattattt

SEQ ID NO: 135720 - DNA, 601 bp, Human
catgacaactccatgatcctcaactttgtcatcaaagcttcccatgagagccttcctgataatgtcttccagcccaagattactggcaggatcagcaaaagaatggcctctagagctaactgagcctgaaagagaatcaaaaacatttccacttatttctgaaaggccaatcaggaaacaaacatgcattgccccatcagcccactgaatacacacagcacttggcaagtgacctagaacaataccaggacccaccacacagagacctttttttttggagacagagtctctctctgtcgcrcccaggctggagtgcagtggcgcgatcttggctcactgcaacctccgcctcccagattcaagggattctcctacctcagtctcccaagtagctgggactacaggcacccaccaccacaccaggctaattttttgtatttttaggagatggggtttcaccatattggtcaggctgatctcgaattcccaacctcaggtgatccgcccgccttggcctcccaaagtgctgggattacaggcgtgagccaccgcacccagcccagagaccatcttaatccacagataactccttaaggaaatt

SEQ ID NO: 135721 - DNA, 601 bp, Human
ggctcaagtgatcttcccacctcggcccccacaagtaactgggactacagcgtgagccaccacacccagctaatttttgtaatttttgtagagacggggttttcatcatgttgcccaggctggtctcaaactcctgagctcaagtgatccacccaacttaccctcccaaagtgctatgattacaccttttttcctactctttttttatggcttacgattattttattttattgtgtgtgtctgtgtatgtatgtattttgagacggagtctcactctgtttccaggctggagtgcagtggygtgatctcagctcacagcaacctccgcctctcgggttcaagcaattctcctgcctcagcctcctgagtacctgggattacaggcacacgccatcatgcccagctaatttttgtatttttagtagagatggggtttcaccatgttggccaggatggtctcgatctcttgaccttgtgatccgcccgcctccgccccccaaagtgctgggattacaggcgtgaaccaccgcacccggctggcttatgtttcttttctactgagcctaatttttacagttaaatcacttttattcaaaaacat

SEQ ID NO: 135722 - DNA, 601 bp, Human
ttgtcacctgggctggagtgcagtggtgcaattgcagctcactgcaacctctgcctcctgggctcaagtgatcttcccacctcggcccccacaagtaactgggactacagcgtgagccaccacacccagctaatttttgtaatttttgtagagacggggttttcatcatgttgcccaggctggtctcaaactcctgagctcaagtgatccacccaacttaccctcccaaagtgctatgattacaccttttttcctactctttttttatggcttacgattattttattttattgtgtgtgtstgtgtatgtatgtattttgagacggagtctcactctgtttccaggctggagtgcagtggtgtgatctcagctcacagcaacctccgcctctcgggttcaagcaattctcctgcctcagcctcctgagtacctgggattacaggcacacgccatcatgcccagctaatttttgtatttttagtagagatggggtttcaccatgttggccaggatggtctcgatctcttgaccttgtgatccgcccgcctccgccccccaaagtgctgggattacaggcgtgaaccaccgcacccggctggc

SEQ ID NO: 135723 - DNA, 601 bp, Human
caggaaaataaatctaaactaaaacagaaatactgctgaacttcaggtaattttgaaaagcacaagagatattctcaaaatattaagaaaaaggttgtaagattaaagcttaggattattatggtttttttgtgtgcttgtttttaacagaatgtataaaatctcattctagcaactcttatctggctatccagagacatgtctgaaacaatgcttatcagatacaagcattagcattccggatgatgtgatctgaagaactgtttctttttcttccctttttcctactctttttttttttccttttttgagacagggtctcactttgtcacctgggctggagtgcagtggtgcaattgcagctcactgcaacctctgcctcctgggctcaagtgatcttcccacctcggcccccacaagtaactgggactacagcgtgagccaccacacccagctaatttttgtaatttttgtagagacggggttttcatcatgttgcccaggctggtctcaaactcctgagctcaagtgatccacccaacttaccctcccaaagtgctatgattacaccttttttcctactctttttttatggcttacg

SEQ ID NO: 135724 - DNA, 601 bp, Human
atgaaataaaatactacaggcatacctcagagatactgagggtttagtaagtcacaattattttgctggtggatggtcttgcctccatgttgatggctgctgactaatctgcatggcggttgccaaaggctgggatggctgtggcaatttcttttcctttcatgaaagacttatttgtagcatgcaatgatagcattttagccacagtagaactttcaaaattggagttgatccctcaaacccttctttattaactgggtttatgtaatgtagtattctaaatcctttgttgtcatttcarccatgttcacagcatcttcaggggcagattcaatctcaagaaaccactttctttgctcatccctaagaagcaactcctcatccatttcaagtttgatcatgagattgcagcaattcagttacatcttcaggctccactactagttctcttgttcttttttttttttttttttttttaaggcagggtctcacctctgctgcccaggctgcactgcagtggcacaatcacggcttaccagctcactaaagcctcaacttcttgggctcaagcaatcctcccacctcagacccaagtagctgg

SEQ ID NO: 135725 - DNA, 601 bp, Human
cgtgagccactgcacctggccaaaaattctttatattttataacactggctcattcagagtacatgtgaaagtttgttttgggatgttgcccaggtttgattatcattaaaaatacttttatctatgaagaaaaaaaaacttataaagaaaatgattaactttctctttgcttcttagtctgatgaccgggattccaagcgggattcccttgaggagggggagctgagagatcactgcatggagatcacaataaggaactccccgtatagaagagaagactcaatggaagacaggtgagcrgatgtacagatgtgcaagacccagctgtacacagccctggcctggccagtccttcctagggtcactgtgacaactgtgtgctattgtaactattaaggtttactctttcctagagttaccgtgacagggcgtgttgtagctgttgtactactgagattactctttcctaaggttaccgtgacagggtgtgctgttgtaactattgaggtttactctttcctagggctactgtgacggggtgtgctgttttaactattgaggtttactcttccctagggttacgtgacggggtgtgctatt

SEQ ID NO: 135726 - DNA, 601 bp, Human
aattctttatattttataacactggctcattcagagtacatgtgaaagtttgttttgggatgttgcccaggtttgattatcattaaaaatacttttatctatgaagaaaaaaaaacttataaagaaaatgattaactttctctttgcttcttagtctgatgaccgggattccaagcgggattcccttgaggagggggagctgagagatcactgcatggagatcacaataaggaactccccgtatagaagagaagactcaatggaagacaggtgagcagatgtacagatgtgcaagacccarctgtacacagccctggcctggccagtccttcctagggtcactgtgacaactgtgtgctattgtaactattaaggtttactctttcctagagttaccgtgacagggcgtgttgtagctgttgtactactgagattactctttcctaaggttaccgtgacagggtgtgctgttgtaactattgaggtttactctttcctagggctactgtgacggggtgtgctgttttaactattgaggtttactcttccctagggttacgtgacggggtgtgctattgtaactattaaggtttactctttc

SEQ ID NO: 135727 - DNA, 601 bp, Human
ctattaaggtttactctttcctagagttaccgtgacagggcgtgttgtagctgttgtactactgagattactctttcctaaggttaccgtgacagggtgtgctgttgtaactattgaggtttactctttcctagggctactgtgacggggtgtgctgttttaactattgaggtttactcttccctagggttacgtgacggggtgtgctattgtaactattaaggtttactctttcctagggttactgtgacagtgtgctcagtgtgctgttgtaaatactgaagtgtactcttttttttttgagacggtgtctcaagagtcttgctcacccaggctggagtgcagtggcgccatctcggctcactgcaagctccgcctccctggttcacaccattctcctgcctcagcctcctggctaacacggtgaaaccccgtctctactaaaaatacaaaaaattagccaggatggtctcgatcttctgacctggtgatccgtccacctcggcctcccaaaatgctgggattacaggtgcgagccacgacctaggattactgtgacagggcatgctgttacaactattgaggtttactctttcctagg

SEQ ID NO: 135728 - DNA, 601 bp, Human
ctggctaacacggtgaaaccccgtctctactaaaaatacaaaaaattagccaggatggtctcgatcttctgacctggtgatccgtccacctcggcctcccaaaatgctgggattacaggtgcgagccacgacctaggattactgtgacagggcatgctgttacaactattgaggtttactctttcctagggttactggtgaaagcctgtctctactacaaatacaaaaattagcctggcatggtggtgtacacctgtagtcccagctactcaggaggctgaggcaggagaattgcttgaaygtgggaggcaaaggttgcagtgagccaagattgtgcctctgtattctaccctgggggacatagcaagattctgtctgaaaaaaataataataagtccgggtgcgatggctcatgcctgtaatcccagcactttgggaggctgaggcgggtggatcatgaggtcatgagtttcagatcagcctgaccaatatggtgaaaccccgtctctactaaaaatataaaaattagctgggtgtggtagcgcacgcctgtactcccagctactctggaggctgaggcaggagaattgcttgaacctgg

SEQ ID NO: 135729 - DNA, 601 bp, Human
cagggcatgctgttacaactattgaggtttactctttcctagggttactggtgaaagcctgtctctactacaaatacaaaaattagcctggcatggtggtgtacacctgtagtcccagctactcaggaggctgaggcaggagaattgcttgaacgtgggaggcaaaggttgcagtgagccaagattgtgcctctgtattctaccctgggggacatagcaagattctgtctgaaaaaaataataataagtccgggtgcgatggctcatgcctgtaatcccagcactttgggaggctgaggcrggtggatcatgaggtcatgagtttcagatcagcctgaccaatatggtgaaaccccgtctctactaaaaatataaaaattagctgggtgtggtagcgcacgcctgtactcccagctactctggaggctgaggcaggagaattgcttgaacctgggacaggaggcagaggtttcagtgagccgagattgcgccgctggactccagcctgggcaacagagcgagactccatctcaaaaaaataaatacaggccgggcgtggcggctcacgcctgtaatcccagcactttgggaggctgaggcg

SEQ ID NO: 135730 - DNA, 601 bp, Human
aaggtggaggttgcagtgatccgagatcgcgtgtctacactccagcctgggtgacagagcgagactccgtctaaaaaaaaaaaaaaaaaaagatgcctgaagttggagaattaatgtaattttttaaatgatgtttcagcttcgttcctatctgaatcatgcatttttctgggttgaaaaaacctcataatagcctgatgcttttccgcactttctcaagcatgacgcagtgctgttgtgttttatttcagaggagaagaagatgattctttggccatcaaaccaccccagcaaatgtctyggaaagaaaaagttcatcacagaaaagatgaaaagaggaaagaaaaatgtaggcatcatagccattcagcagaagggggtacagaagcatttactttctttgacatcatgttcaagtgtggtttctttcctgttcctactcttctgccttccccagagcaccactgaaaaaccagagaaagcaaactgtagctgaaagcataatggtgtcacagaccgttcagaagggctatagagagaatagctgaaagcatgcatgtgtcacagaccattcagaggggctatagagagcaaactctag

SEQ ID NO: 135731 - DNA, 601 bp, Human
actccagcctgggtgacagagcgagactccgtctaaaaaaaaaaaaaaaaaaagatgcctgaagttggagaattaatgtaattttttaaatgatgtttcagcttcgttcctatctgaatcatgcatttttctgggttgaaaaaacctcataatagcctgatgcttttccgcactttctcaagcatgacgcagtgctgttgtgttttatttcagaggagaagaagatgattctttggccatcaaaccaccccagcaaatgtcttggaaagaaaaagttcatcacagaaaagatgaaaagagraaagaaaaatgtaggcatcatagccattcagcagaagggggtacagaagcatttactttctttgacatcatgttcaagtgtggtttctttcctgttcctactcttctgccttccccagagcaccactgaaaaaccagagaaagcaaactgtagctgaaagcataatggtgtcacagaccgttcagaagggctatagagagaatagctgaaagcatgcatgtgtcacagaccattcagaggggctatagagagcaaactctagctgaaagcatgtgtgcgtcacagaccgaaaaccagaga

SEQ ID NO: 135732 - DNA, 601 bp, Human
ctattcaggtgttttttttaaaaaaaaaaaagagcttggaaactttagaaaggctgagtgtgtgcacgtgcaggcaatgtgtgtatttgtatctacactcgggagaggttcatccggccacactcatgtttacatctgtaccacccttgaaagatgagggtactactagaaattctcagagacaattccacacctcttgctaacagtgagttccaggagctcacaaaatttattgtggagaagttaaatttttaactaacatttattcactgtctgtgtgctccaagtattatgctaagcrttggaaatacaatccaaacccaaatagagcctgcaaactagtagagtatttctctgcaggctcatctgtggtcctctgtgccagagaacatttgccttcacctgaaatctacacagtgcagctgaatttccaccagtcctcaagtatagcctcccacagccaaccggaagaaaacatgacaaaacatttcacatgattcgcccagcctcagtcaggctcagttagaaagaactaagttccaggaagaaggtgattgagaaaggggagtagctgcagtaagctctatcatgcaggaaggcc

SEQ ID NO: 135733 - DNA, 601 bp, Human
ttacctcttcttgtgggccactgactctaccagcataggtgtgtgattgtgccatttcccctgaaatgaatcattcaagagtaaattcattcatttaagcagatttgtcaacatcactatgaaaagatgataacagttttccatgccagtttgcactgactcaaaaaagcactgcctatcgttgacagaatcaatgtctcatctgagctgggaaagcggcatggagattgctttgaaatgacatttccaagagtatttatttcatgtctacaacttgaactattcaggtgttttttttaawaaaaaaaaagagcttggaaactttagaaaggctgagtgtgtgcacgtgcaggcaatgtgtgtatttgtatctacactcgggagaggttcatccggccacactcatgtttacatctgtaccacccttgaaagatgagggtactactagaaattctcagagacaattccacacctcttgctaacagtgagttccaggagctcacaaaatttattgtggagaagttaaatttttaactaacatttattcactgtctgtgtgctccaagtattatgctaagcgttggaaatacaatccaaaccc

SEQ ID NO: 135734 - DNA, 601 bp, Human
cttacctcttcttgtgggccactgactctaccagcataggtgtgtgattgtgccatttcccctgaaatgaatcattcaagagtaaattcattcatttaagcagatttgtcaacatcactatgaaaagatgataacagttttccatgccagtttgcactgactcaaaaaagcactgcctatcgttgacagaatcaatgtctcatctgagctgggaaagcggcatggagattgctttgaaatgacatttccaagagtatttatttcatgtctacaacttgaactattcaggtgttttttttawaaaaaaaaaagagcttggaaactttagaaaggctgagtgtgtgcacgtgcaggcaatgtgtgtatttgtatctacactcgggagaggttcatccggccacactcatgtttacatctgtaccacccttgaaagatgagggtactactagaaattctcagagacaattccacacctcttgctaacagtgagttccaggagctcacaaaatttattgtggagaagttaaatttttaactaacatttattcactgtctgtgtgctccaagtattatgctaagcgttggaaatacaatccaaacc

SEQ ID NO: 135735 - DNA, 601 bp, Human
tcttacctcttcttgtgggccactgactctaccagcataggtgtgtgattgtgccatttcccctgaaatgaatcattcaagagtaaattcattcatttaagcagatttgtcaacatcactatgaaaagatgataacagttttccatgccagtttgcactgactcaaaaaagcactgcctatcgttgacagaatcaatgtctcatctgagctgggaaagcggcatggagattgctttgaaatgacatttccaagagtatttatttcatgtctacaacttgaactattcaggtgttttttttwaaaaaaaaaaagagcttggaaactttagaaaggctgagtgtgtgcacgtgcaggcaatgtgtgtatttgtatctacactcgggagaggttcatccggccacactcatgtttacatctgtaccacccttgaaagatgagggtactactagaaattctcagagacaattccacacctcttgctaacagtgagttccaggagctcacaaaatttattgtggagaagttaaatttttaactaacatttattcactgtctgtgtgctccaagtattatgctaagcgttggaaatacaatccaaac

SEQ ID NO: 135736 - DNA, 601 bp, Human
aggccctgctaattttgtattttcagtagagacagggctttaccatcttagctaggctgctcttgaactcctgacctcaggtaatccacccacctcagcctcccaaagcgctgggattacaggcatgagccactgcacccggcacataccgcattgttgattcaaagttttcataaagtctctgggcaattttaacatttaattaaattatagattgtatgtgctcacatcttgataaagctgtaagtgccttctctactcttacctcttcttgtgggccactgactctaccagcataggygtgtgattgtgccatttcccctgaaatgaatcattcaagagtaaattcattcatttaagcagatttgtcaacatcactatgaaaagatgataacagttttccatgccagtttgcactgactcaaaaaagcactgcctatcgttgacagaatcaatgtctcatctgagctgggaaagcggcatggagattgctttgaaatgacatttccaagagtatttatttcatgtctacaacttgaactattcaggtgttttttttaaaaaaaaaaaagagcttggaaactttagaaaggctgagtgt

SEQ ID NO: 135737 - DNA, 601 bp, Human
ttctcctgccttagcctcctaagtagctgggattataggcatccgccaccaggccctgctaattttgtattttcagtagagacagggctttaccatcttagctaggctgctcttgaactcctgacctcaggtaatccacccacctcagcctcccaaagcgctgggattacaggcatgagccactgcacccggcacataccgcattgttgattcaaagttttcataaagtctctgggcaattttaacatttaattaaattatagattgtatgtgctcacatcttgataaagctgtaagtgcyttctctactcttacctcttcttgtgggccactgactctaccagcataggtgtgtgattgtgccatttcccctgaaatgaatcattcaagagtaaattcattcatttaagcagatttgtcaacatcactatgaaaagatgataacagttttccatgccagtttgcactgactcaaaaaagcactgcctatcgttgacagaatcaatgtctcatctgagctgggaaagcggcatggagattgctttgaaatgacatttccaagagtatttatttcatgtctacaacttgaactattcaggtg

SEQ ID NO: 135738 - DNA, 601 bp, Human
ttgatataatacttttggaaagaaaatatgttttccaatatgctagagtattgtaattatacacacatcttatgaaccagtcattccagtgttagaaatttatcatgaggcagtcttctaaaatattggagggtagggggcaccagaaaagcatacccatgcttcagtattgaagcattatatctaaaaggggaaaactcgaaaaaaccaaattgtctaacaattgggaattggttaagtaaattatgatataacaaattaatgaaatattctgtagacattagaaattaatgcctaatgktaacatgaaatatgtgagacagtgttgaaaatatctacaatatgtcacaggaaaaaactcttgtgcaccctaattataattgcatacaatgtctgcatgtggatatgttagggtgatgggagtgacttttcttcctttcaaaaatgttattttcaaatatattttctttaatgatgctatttgtatcttaaaaccattatataaaaataaatatacaaacaaggattcaatatcctatcagtaatgtagtagtaaataagaatagttcaggccttattatttctgggaatggtgatagtt

SEQ ID NO: 135739 - DNA, 601 bp, Human
cccagcattctctctgagtttcccctgagtccccccagcttgctgcactcacttcttcttgtagccctccagcacctcctgcacatggttgagctctgaggccagcctcccgctgtcggcctccacgcactcggcctcccgccgcagagtctcgatgtagccactgaacagtggctccaggttgctctcgcagcagcgctggttctggtagaactgccacttggtctccagcagcttgttctgctgctccaggaagcgcacctgccattcaggtggaaagaagaagtcagagggagcctgsggggaggcacctggtcccccacagtctctctgccctcgggtgctggctgaatgggctgagccataaagctgagtgtctgcggctcaaggggcccattcccaggcccccagggaggcagttgtgggtgtgagggaaagcagtctgactcaaagccaaaggtctgtttcgagccccagttttgatactttagagagcaagttgtttaacctcctggggctcagttttctcctttccaaaatggagcgaatagtgtctgtcttagcactgttgtgaagcttgaacaagttaatgcatatcaag

SEQ ID NO: 135740 - DNA, 601 bp, Human
tatttgaatcctccacagaccccacctggcacttggcattctcaatctcggccgtcagcctctggatcatgcggttcagctcgttgatctcctccttggtgcggcgcagggtctccccatgcctgatcaccgtggccttcatctcctcacactggaggaagtagagatgctcatgaggctcagggtggggccccccatccattcaggacaccacagatgactatacaggttgtacggtgctcagcctgtgcaaccacacatggcagtcctgccctgccacttcaacctgagaactactggmttttctcatactgtcctcatgggtcagaatccccaggcaagagaaatcttttctaatagatgcctaacttccctcccactgccatgcttagcaggcaggtgtcctgtgccactcaccttgctacggtaccaggactcagcctcggcccggctgcggctggcaacatcgtcatactgagccttgatctcagcgatgatgcagtccatgttcaggtctcggctgttgtccatcttgactatgaccgaggtgtctgagatgtgggcttggagaacgcggatctcctgtggggccaacagccag

SEQ ID NO: 135741 - DNA, 601 bp, Human
ggctgctttgagccgaaactggtgaccgtttcccaaccccgtccaggagtccgacgcctcttttctccaggccaacttcaagtgaggtgtatcaactctatccgcacaaaatttcttgccacgagagcagaagattatgatctctgatgctgccttagggctgaagacactcccaactcggcgacgcttagcaatcatcgacttcctcctcctcttggctgcctcggagatcctgttccggggcagaggtctccccgccccgcccctcgtctcctccaagatggcgagcggcggcagcggkggggtgtcagtacctgcgctgtggagtgaagtgaaccggtatggccagaacggcgacttcacgcgcgctctcaagaccgtcaataagagtaagtgtcggggtgggcactggggcgggcccaggccggctggaggatgcggcctgtttccggcgcgcgagaccacctcgcgcgggaggcacgggaaggggagacccccgaaacccccccgtctattgtccgcccggctcgggccctagcgcccggaagacgcaggtctcactcctcggcttcaccaggccagcctggggtccctggttgct

SEQ ID NO: 135742 - DNA, 601 bp, Human
ttctttaatcagcaaagattgtcaacttgtttaccagtatgttttcttaattggtagaaattcttgtgattctttgagaattggacttctgtagttgcacaggagcaagagtaactatgatcctggtcattttaacaccgaacagttgttagcgttgaaacttgccacctgagttcttccttatactttggtcatcttagttgaaaaggggaaattttaatgatttttggaaacgttgccagcaagataaattgcctttgtattatactttataagatttttccaaaatattcatttcatrttgtcagtaaccttattaaataggtaatgcttttctaatcattttgtagctaagaaaactgagatttggctgttaagtgatatgcccaatacctcaaagcatttagtggcaagcttgcaccaaacctaggtcatttgcttccaaattctacctgaactttttccctgtgaagtaatgaactatgtagaatgtagcatgcatttcaagatgaaatatctggagaaattgcttctttcttctttatttcactgcacttttttggtacatgtatattgggaatctttatctcattgaaaattt

SEQ ID NO: 135743 - DNA, 601 bp, Human
gtaaaaatgtgaaaaggaaatggatttaaaaatgacttttcctaaaattgttctctagtactacagatcaacaaagatgacgtaactgccctgcattgtaaagtggtatgccttatccagaatggaagtttcaaggaagctttgaatgtcatcaatactcacaccaaagtgttagccaagtaagtgattcagttagttgcttgtacagttattagaaacacttactatagctataatctcttccatgttttttcccaactatttgctgattttttttaacgtttttttccttcctttttttccccccttttgcttgtcaataatgtttctgaactggaaggaatactagtaacttctgtttttttcagccttagagagtttttttttttttttttaaccactgtgtttcctttgaaccgctaaggaggtgaaccatagagagttgtggggcataattatgagtcgttggaggatgtagcaagaataactcagtcgaagtttctttactgttatacctaggctccaaaaaaatatgtattgaaattaagtttgaagcatattaatgggatactggtttataaggtgcagaacaatatatatt

SEQ ID NO: 135744 - DNA, 601 bp, Human
attgtaaagtggtatgccttatccagaatggaagtttcaaggaagctttgaatgtcatcaatactcacaccaaagtgttagccaagtaagtgattcagttagttgcttgtacagttattagaaacacttactatagctataatctcttccatgttttttcccaactatttgctgattttttttaacgtttttttccttcctttttttccccccttttgcttgtcaataatgtttctgaactggaaggaatactagtaacttctgtttttttcagccttagagagtttttttttttttttttaaccactgtgtttcctttgaaccgctaaggaggtgaaccatagagagttgtggggcataattatgagtcgttggaggatgtagcaagaataactcagtcgaagtttctttactgttatacctaggctccaaaaaaatatgtattgaaattaagtttgaagcatattaatgggatactggtttataaggtgcagaacaatatatattatacttccttttacaagaggaggaggatataaaaatttatatatgcatttgcctgtatttgcaaaacaaacagtataaagagaaacaatgaata

SEQ ID NO: 135745 - DNA, 601 bp, Human
ttatgagtcgttggaggatgtagcaagaataactcagtcgaagtttctttactgttatacctaggctccaaaaaaatatgtattgaaattaagtttgaagcatattaatgggatactggtttataaggtgcagaacaatatatattatacttccttttacaagaggaggaggatataaaaatttatatatgcatttgcctgtatttgcaaaacaaacagtataaagagaaacaatgaatagtcatttgtgggaggcctaagagggcggatcacgaggtcaggggtttgagaccagaccgascaatatggtgaaaccccatgtctactgaagatacaaaaaattagctgggtatggtggtgtgcacctgtattcccagttacttgggaggctgaggcaggagaatcacttgaacccaggaggcagaggctgcagtgagctgagatcgtgccattgcactccagcctgggtgacggggagactccgtctcaaaaaaaaaaaaaagtcatttgtaggaggtaataggaacaggttagatttgggtagcagtgggaataaagcctcttagtgtatctctttttctttttatatttgaggcgtata

SEQ ID NO: 135746 - DNA, 601 bp, Human
tattcatatttagtatttaactggtattttgtcccctgacaggagaacctgggcctccaagaaggcacacatgagctgtgctacaacactgcatgtgcactgataggccaaggccagctgaaccaggccatgaaaatcctacaaaaagctgaaggttggaagtttgttaaacttatctgtaaatataatgtgcatataactttgtagagtatcttctaaaattgcatttgacttctgtgaaattattaaatggaagttattgatgcagtgacaatttctccaagttcctgtcgtctttctytctcttttttttttttatggagtgggacagaatcttaccctgttgcccaggctggagtacaatggcacgatctcggctcactgcaacctctgtctcccgagttcaagcaattctcctgcctcagcctcccgagtagctgggattataggtgcgcgtcaccacacccagctaatttttgtatgtttagtagaaatggggtttcaccatattggccaggctcatttcaccctccgcctcccaggttcaagcaattcttgtgcctcagcctcccaagtagctgggatcacaggcgcatgccag

SEQ ID NO: 135747 - DNA, 601 bp, Human
gctgggactacaggcacccgccaccatgcctgtctaatttttcgtatttttagtagagacggggtttcaccatgttagccaggatgttctcattctcccgacctcgtgatccgcccacctcagcctcccaaagtgctgggattacaggcgtgagccaccgtgcccggccaggaacactctaatggaaaaagctttatttttctttctttctttttttttttttttttgagactgtcacccaggctggagggcagtggtgcagacatgactcactatagccccagacagtcctcccaagtasctgggaccacaggtacacaccaccatgcccggctaatttaaaaaaaaatttgtagagacagagtcttgccatgttgcccaggctggtctttaaactcctgggctcaacaaatcctcctgcctcagcctcccaaattgctgggattccaggggtgagcgaccacacccagcctggaaaaacatttcaaggtcacaattgaaatccaagtcagtggaaagtaagaaaagtaacatttgaacatacaatttatcttgatataccatgtgatttttcaagtaccaccttatttcttcctctcaa

SEQ ID NO: 135748 - DNA, 601 bp, Human
ttagtagagacggggtttcaccatgttagccaggatgttctcattctcccgacctcgtgatccgcccacctcagcctcccaaagtgctgggattacaggcgtgagccaccgtgcccggccaggaacactctaatggaaaaagctttatttttctttctttctttttttttttttttttgagactgtcacccaggctggagggcagtggtgcagacatgactcactatagccccagacagtcctcccaagtagctgggaccacaggtacacaccaccatgcccggctaatttaaaaaaaaawttgtagagacagagtcttgccatgttgcccaggctggtctttaaactcctgggctcaacaaatcctcctgcctcagcctcccaaattgctgggattccaggggtgagcgaccacacccagcctggaaaaacatttcaaggtcacaattgaaatccaagtcagtggaaagtaagaaaagtaacatttgaacatacaatttatcttgatataccatgtgatttttcaagtaccaccttatttcttcctctcaataatctttttaggtggtagtccttatctctgtaggagtataatctgaga

SEQ ID NO: 135749 - DNA, 601 bp, Human
gttctccatttctttaaagcagttcacttgttaagcctttttatacctaggaagcctcctttgagaaggctttaaaaggagtgggggtagattctgggataactatatgtacatgagtagatttgaattgcagagattcaaaaagagtagatttgaattacttctgtgaatcaggataaatttatatgcatcttattagcttaggcaccccaatcaggtagatagattcaagctctcctgctgtatctatataaagttaatagaaaaaggaataagttgaaatctgagattctgttaatgrtagataaacttttctttgttaggaccaaaatgtctttgactccaagaagaaagtgaaattaaccaatgcggaaggagtagagtttaagctttccaagaaacaactacaagctatagaatttaacaaagctttacttgctatgtacacaaaccaggtgggtaattacctttggtgtcatggctaaaccttttgtaatatggtatatgaggagtaatagggatattagtctaatctttttatagtttttgtttgtattttgtcttcaactcataaatatatttttttgccttcctcaaaata

SEQ ID NO: 135750 - DNA, 601 bp, Human; identical to SEQ ID NO: 94618

SEQ ID NO: 135751 - DNA, 601 bp, Human; identical to SEQ ID NO: 94619

SEQ ID NO: 135752 - DNA, 601 bp, Human; identical to SEQ ID NO: 94620

SEQ ID NO: 135753 - DNA, 601 bp, Human; identical to SEQ ID NO: 94621

SEQ ID NO: 135754 - DNA, 601 bp, Human; identical to SEQ ID NO: 94622

SEQ ID NO: 135755 - DNA, 601 bp, Human; identical to SEQ ID NO: 94623

SEQ ID NO: 135756 - DNA, 601 bp, Human; identical to SEQ ID NO: 94624

SEQ ID NO: 135757 - DNA, 601 bp, Human
ttatgcataacactccataggctggatgtgccttcctttaccttttagttattgttgtacatttagtacatcatttagtatatgatttcttttgctgatttgaagaaaaggttagtcggcttcatctacttaaaagaagtcagattttgacttgtttcttccatcgtcatcttaaaaatatagttagcagagacctacagtaaaatgttttaagattttacttttgactcaggatgaatagagcatggaaaagataaaacatttccttagctttgtgacttttataagtttttgctacttyctccttttttgaatgccttttgaaatctaaatttttccctaacttaaaaaaaactcagcaacaatgactgatttctttctaacaaactctgcatttcataaaaagcattgttgttctcataataacttccaaaacttttaataaggaattggagtctcaaagaggttacattgttccgaattccatttcatcttacaattataaattcagtctgggttcttaaatggattttcaattaaagtatgtttactatttttttcttccccaaacagggttgagtaactactaaggacacgcagt

SEQ ID NO: 135758 - DNA, 601 bp, Human; identical to SEQ ID NO: 121912

SEQ ID NO: 135759 - DNA, 601 bp, Human; identical to SEQ ID NO: 121911

SEQ ID NO: 135760 - DNA, 601 bp, Human; identical to SEQ ID NO: 121910

SEQ ID NO: 135761 - DNA, 601 bp, Human
tttttagaggctctccacagtttactgagtatgtgtgttttgtgtgtccgtttttgtggctgttaacagttgctgttgcaacttttctgtaaaccccaaagtattctaaaattaaaaggttattttttagaaaaacttgtatcaacaaactttcttaggctattgtttactcagccctggtaacttgaattgtggatatcgaaggtgatgactaggtttctaaacaaggtgtcagagaggaaattgggtggcaatcttaagtctagccagtgacacttactagttgttgtactctggggcktctgttagtagttagttgtttgaagatttttatttaaaaatgcagtgcatataacaagtgcaaattttaaaattattttggttgtttaataaaaccaggcaatattaccttttccgtatgcatttatttaatttcttttttaatgttagttacaaaatatttcagacttacaaaaagttattaagaacaatgtaataaacatttgtatattcatcacccagattaagaaacaaaacaatcattgctggagccccccttttccctctccatcccttttcctccagccactgttaaccatta

SEQ ID NO: 135762 - DNA, 601 bp, Human
tcaacccgacacctaccattcgactgtcttatgattttgactactctaagtacttcataaagtggagtcataatacagtatttatccttttgtgacttgctcattccacttaggcataatgtcctccaggttggaccatgttgtagcaaatgtcagggttttcttcctttttaaggctgcatagtatttattatatgtatataccacattttgcttgtcccttcatatgtcaatggatacttgagttacttctttttttgttgttgttgtttttgagaccgagtctcgctctgttgcccakgctggagtgcagtggcgcggtcttggctcacactgcaagctccatctcccgggttcacgccattctcctgcctcagcctcccaaggagctgggactacaggcgcctgccatctctcccggctaattttttgtatttttagtagagacggggtttcaccatattagccaggatggtctccatctcctgaccttgtgatctgcccgccttggcctccctaagagccgggattacaggcgtgagctacggagcccggccttgagttacttcttacttttagctattatgaataatgttgctat

SEQ ID NO: 135763 - DNA, 601 bp, Human
ctccctaagagccgggattacaggcgtgagctacggagcccggccttgagttacttcttacttttagctattatgaataatgttgctatgaatatgggttttcaattcttttgggtatttacccagaattgtaattgctggatcatatgataattctattttaaagtttttgaggaaccgacaaactattttccacagtggctggaccattttacattcctaccaacagtgcataagggttccaatttctccacatcctcaccaacgtttattttctgtttcttttttttttttcaagtaaccatccattgggtgtgaggtgctatctcattgtagttttgatttgtatttccctaatgattaatgatgttgagcatcttttcatgtgtttactggccattttgtgtatctttggagaaatgtctgtttaagtcctttgcccatttttaaattggtttgcttttttgttgttgagttttaggaattttctatatattttggatattttcagatacataaacggcaaaaattttttccccattactgtgggttgcctttttactcattgataccgtgtggtcttttcctttctttttctttt

SEQ ID NO: 135764 - DNA, 601 bp, Human
ctttaaatatagtatcttgctttattgcccagacttgttgtgaactcctggactcaaatagtcctcctacctcagccttccaggtagctgggatcacagggatgctgtcttttgatacacaaacattttaaatttttatgaagtccagtttgtctttttgtttttgttccctgtatctttggtgttatatccaagaaatcattgccaaatccattgttgtgaagcttttgccttatgttttcttctaagagttttatagctttaggtcttacatacatttttgatccattttgagttaatwtttgtatattgtgttagataagggtccaacctcattcttttgcatatggatatttagtttcccagcaccatttggtgaaaagcttgtctttttctgattgaatggtcttggcaaccttattaaaaatcatttgctcatatgtaagagggcttatttctaagtgctgttatgttccattggtctataagtctgtctttatgtcagtaccacatggttttgattattgcagctttgtagtaagttttgaaatcaggaagtgtgagtcctccagctttgttctttttcaagattgttttggct

SEQ ID NO: 135765 - DNA, 601 bp, Human
tttttttttgagatggagtctcgctttgttgccaggctggagtgcagtggcgcgatctcggctcactgcaacctctacctcccaggttcaagcaattctcctgcctcagcctcccgagtagctgggactacaggcacacgctacgacgcccagctaatttttgtatttttagtagagacggggtttcaccatgttggccaggatggtctcgatctcttgacctcgtgatccacctgcctcagcctcccaaagttctgggattacagccgtgagccactgtgcctggctttttttttttttwaattaactattgaacttctgtttattattattattattatttatttatttattattttttgagatgaaatctcggtctgttgcccaggcgggagtgcagtggtgtgatctcggctcactgcaacctccgcctcccgggttcaagcaattctgtgcctcagcctccggagtagctgggattataggcgctcgccaccatgcccggccaatttttgtatttttagtagagatagggtttcatcatgttggtcaggctggtcttgaactcctgacctcgtgatccgcccgcttcggcctccca

SEQ ID NO: 135766 - DNA, 601 bp, Human
ctcctgcctcagcctcccgagtagctgggactacaggcatgcgcccatgcctagctaagtttttgtagttttagtagagacagggtttcactatgttggcaaggctggtctcaaactcctgacctcaagtccccttggggttcctgaagtactgggattataggtgtgagccaccacgcccggccagattttctatataaaagatcatataatctgcagacagataattttactttttccttttctttctttttttctttttttgagatggagtctcgctctgtcgcccaggctggagcgyggtggcgccatctctgcttactgttacctctgcctcctgggttcaagcagttctctgcctcagcctcccaagtagctgggattacatgcacatgccaccacgcccagctaatttttgtatttttagtagagatgggagttcatcatcttggctaggctggtcttgaactcctgacctcgtgatccatccgccttggcctcccaaagtgctgggattacaggcatgagccaccgctcttggccctcaaccttttccttttcaatttggatgccttttatttttatttttcttccttttttt

SEQ ID NO: 135767 - DNA, 601 bp, Human
tggtctcgatctcctgacctcgcgatccgcctgcctcagccttccaaagtgctgggattacaggcgtgagccaccatgcccggcccttgtttttctttcttgcctaattactctagctagaacttacagtattatgtcgaatggaagtggcaaaagtgggcattgggcatccttgtcttgctcctgttcttttatttgttagtttgtttgagatcctcctgcctcagtttcctgagtagctgggactatagacacactactacacccagctaattaaaaaaataattttttttttttttttagagatggggtctcgctatgtttcccatgctgatcctgaactcctggcttcgggtgatcctctactcttaccctcccatagtgctgtgattacaggcatgaaccactgtgctggccctgttcttgtttttagaggaacattcttcagtctttgaccatcaattatgtttgctgtgggtttttcatatgttgcttttattttgttgaggtagtttcactctattcctagtttgttgagcatttttatgactaatgggttttgaattttgtcacatgcttttcctgcatcgattgacatgat

SEQ ID NO: 135768 - DNA, 601 bp, Human
caatagtagaatgtgatcctgtacgaaaagaagttagtgtacgaactggaggattggctgacaagagctcaaggaaaacatacacttttgatatggtaacatatggtgcaatttctttattatccactaatgtaaaataattttaatatacatattttacctggaaaatggtgtatacttagaaatttcagttgtctctgaattgtcagatggcttctagtgggctgaattatgaattagttaacatacgaaaaacaaaattattaaaatgagtaattttgaggttgatttttttttttttaatttttttcgttaggtgtttggagcatctactaaacagattgatgtttaccgaagtgttgtttgtccaattctggatgaagttattatgggctataattgcactatctttgcgtaagtaaaagggtgttttttctgatttatgaaaaagcttaaatgcttgtgttttttgttgttgtttgtttgttttttgagacggagtttcactcttgttgcccaggctggagtgcaatggcgcgatctcggctcactgcagcctctgcctcctgggttcaagcaattctcctgtttcagcctccca

SEQ ID NO: 135769 - DNA, 601 bp, Human
gaattttttttaatttttttttttttttttaaattttaaagtgatggggtcccactgtgttccccaggccagtcttgaactcttgggcttcaggagtcctcccacttcagcctcctgagtagctgggattagaggcacatactaccttgcccagctaattttccaaattattgacagttgggtagaacctttcttctagtggttacataattgagtcattaacttactttacatatatagataataaagttatgaaattgttaccataggagatatggaataggcttaaagcatagtttcrctgggcagaattattgaacttggcgttttttttttgagacggagtctcgctctgtcgcccaggctggagtacagtggctcgatcttggctcactgcaacctccacctcccgggttcaagtgattctcctgcctcagcctcctgagtagctgggactacaggtacataccaccaagtccggctaatttttgtatttttagtagagatggggtttcaccgtgttggccgggatggtcttgatctcctgaccttgtgatccacctgccttgacctcccaaagtgctgggattataggcgtgag

SEQ ID NO: 135770 - DNA, 601 bp, Human
tagaaaaagcaatggattgcaattagatatttgcgtgtagtctcagtttcgcggttaattcagtatgtgactttttgtaaataagtgaatttatctgcttatcagtttctctgagctacaaaattattgttaggattagaagtcttatttcttttctggcttgtagttgaaaatttctataaaatgccataacaattacagttgcaactctaaaaaagtttgcatttaaagaaagaagaaaaatataacataaaagtgattaagatcatggaattttggatgatttcaaaattttaattarattttcacttaatggctttccaataaaatggaaattttattctgtggttgattataacttaatttcatgtagaattttgagaactgaactaaagactaggtaaaatttctttaggtacatttcactaaagtataaaatttctatttttccttttttcttgtatgtagacttgtataaaggtcactttttatgaaggtatgtgacaaagaggagaagctaattaattcagttttcccaaattagagctaacttcaatgcttatttgtattaattgcctaatctggattaggaatgggtaga

SEQ ID NO: 135771 - DNA, 601 bp, Human
tgtatgtagacttgtataaaggtcactttttatgaaggtatgtgacaaagaggagaagctaattaattcagttttcccaaattagagctaacttcaatgcttatttgtattaattgcctaatctggattaggaatgggtagataatggtagaaaaacatgagatgaatagtattattattattattattatttttgagacagagcctctctctgtcccccaggctggagtgaagtgatgcgatctcggctcactgcaagctctgcctcccgggttcacgccattctcctgcctcagcctcytgagtagctgggactacaggtgcccaccaccacgcctggctaattttttgtatttttagtagagacggggtttcactgtgttagccaggttggtctcgatctcctgacctcgtgatccgtccacctcggcttcccaaagtgattacaggcgtgaggcaccatgcccggtggagatgaatattataattcagatctatagtttacatttatgtttttccttaggtcttcctccttttctgtaattttaaataatttaaataattttataaaaatgatacttggctgggcgcgatggctgac

SEQ ID NO: 135772 - DNA, 601 bp, Human
cagaatcctcccataatatcttttcaggtgcagactgctcatgagttttcccctggtgaaatcttctttctccagtttttcttccaggactgtcttcagatggtttatctgatgatagacattagccaggaggttctcaacaatagtctcattccagccagtgctagatgaatcttgtctgaaaatagcaaagatgttctggagcatctcatagatggtcaatgcggcgtcctccttctggaactgctgcagctgcttaatctcctcagggatgtcaaagttcatcctgtccttgaggcartattcaagcctcccattcaattgccacaggagcttctgacactgaaaattgctgcttctttgtaggaatccaagcaagttgtagctcatggaaagagctgtagtggagaagcacaacaggagagcaatttggaggagacacttgttggtcatgttgacaacacgaacagtgtcgcctactacctgttgtgccagagcaaaggcttcgaaaggttgcagttagaatgtcctttctccatgggtatggcctatttatatgagatggtcctctctctattcagaggaatttcccactttcact

SEQ ID NO: 135773 - DNA, 601 bp, Human
ggtggaaggtccttagaatcacgtttaagtccttttctctgtctacactctctccacacatgagcactttcatttctgggattttgcttgccacatatgaactcccagcaattgcattccttataatttgcaaactcacatatccaactggcaatagacagtttctaccacatgttgtatcagtcaacttatagaggatatctgtttatttttatttcctcacatgtttcagtttacctcctgccgaaagaaatcattgttcattcctttttctccttatagtattcaggataactgataytaagtatgattactatttttagttttattccatacaaaaatcaaacatgcaagagagtaggaagtagatttattgtattcacctttataacttgagtacaacatacaacctggtttagagaaaggtcatttttacttacatctctcatataataatgatgagtaaataaattataccctttattctctcatcaggttgcacagtcaggctaggaattttgtattaaagaatgaacacatacaggaagttcctatagtaaaagtttaatgaacaacataaaataatgaattgagtagatat

SEQ ID NO: 135774 - DNA, 601 bp, Human
tccttccctttaaaggtggaaggtccttagaatcacgtttaagtccttttctctgtctacactctctccacacatgagcactttcatttctgggattttgcttgccacatatgaactcccagcaattgcattccttataatttgcaaactcacatatccaactggcaatagacagtttctaccacatgttgtatcagtcaacttatagaggatatctgtttatttttatttcctcacatgtttcagtttacctcctgccgaaagaaatcattgttcattcctttttctccttatagtattyaggataactgatactaagtatgattactatttttagttttattccatacaaaaatcaaacatgcaagagagtaggaagtagatttattgtattcacctttataacttgagtacaacatacaacctggtttagagaaaggtcatttttacttacatctctcatataataatgatgagtaaataaattataccctttattctctcatcaggttgcacagtcaggctaggaattttgtattaaagaatgaacacatacaggaagttcctatagtaaaagtttaatgaacaacataaaataatg

SEQ ID NO: 135775 - DNA, 601 bp, Human
ctattgaagggaaaggatcaataacacatgggtcccataaatccaaatttacacaagagaacaattcaaacaaatgatcttctcctgatgacctgcatttggaaaggaagaaataaagataaatttttacctttagttcttgaccagacactacaagcagaaattcagaactgaacttggtaaaaattcttacctttactggcaagctctttatcagcattttacctggacctcatcagtaggtgagtcaggtgcttcaggcatcccatcttcatcaccacaactataggggtagaaatartgtgatctctttccttcctatcaaaagggtcacagctcacacgcctaaaacaaaagacagcttaacaagagagaagcataacacatttatttaatcacaggtttatataactacggaagccttcaaaatgaagacccaaagtacaggaaaaaactatccatttttatgcttatgttccatgaagaatggccagctgtgtagaaatgtgattagacaaaaagggcatcatctaatgctaatattctgagtaggggaaacccaacaaggcctttctggtcagatacttcttggcccctccat

SEQ ID NO: 135776 - DNA, 601 bp, Human
attgtgagcagaatttaagagatcccttggactgcattggtcccatgaataattttccctgcactgtgatgacgtgctaggttctagggagaaaacaaaagtttgcatctggaagtgggttaaccctcatccctcgctgtactctgcaggctgctgtggtgtccctgttacccatgccatggacactgatgttggccacagctcaacagaactctgttctcagcatccactttaatcttctctccttctgataggaatgatctgaacagttgacttaatgctgctcgttggtattattccrtctcctgagtacctgacactgatgtctatgctttaaacatctctgtcctccttccacgttctcaggctgctgctggctcttccagcttattccagtgcatgatgtgcactttcattgtttgaacaaatgagagtcctgtgcctggtgcagtctcttcctgaaggactcagaacttcgaagcttctaaacagagtcacagatgagctcctgcattctttatcagctcaatggacatagaggtataggcaggactcccttcatttactgcattttgatgccagactggacatcagagggtct

SEQ ID NO: 135777 - DNA, 601 bp, Human
tagaaggacattaactcaacatgataagggctattatatgaaaatcccacagtaaacatcatgctcaactgtgaaaaattacacgtttttattctaagttcaggaaaaaggcaagaatgtgctcttacaactagtatttcaaatcctggccagagtatttaggcaacaaaaataaataacaagcatccaaattataaaggaaaaagtgaaatgatctctgttggcagatgacatattcttatatgtagaaaaacctaaagattacacacacacacacacacacacacacacacacacacasagagagagagagagagagagagagagggagacagagagaaaagagagagataacttataaatgaattgagcaaagttgcagtatacaaaatcaataaacaaaaatcagcggcatttctatatactaacagtggataatcttaataggaaattaagaaaatactctaatttacaatagcatcaaaaaacataaaatatttaggaataaacttaacctaggatgtgaaagacatggacactagaaactaccaaatactactgaaaaaattaaagatgacaaaaataaatgggaagacattta

SEQ ID NO: 135778 - DNA, 601 bp, Human
ctagaaggacattaactcaacatgataagggctattatatgaaaatcccacagtaaacatcatgctcaactgtgaaaaattacacgtttttattctaagttcaggaaaaaggcaagaatgtgctcttacaactagtatttcaaatcctggccagagtatttaggcaacaaaaataaataacaagcatccaaattataaaggaaaaagtgaaatgatctctgttggcagatgacatattcttatatgtagaaaaacctaaagattacacacacacacacacacacacacacacacacacaccgagagagagagagagagagagagagagggagacagagagaaaagagagagataacttataaatgaattgagcaaagttgcagtatacaaaatcaataaacaaaaatcagcggcatttctatatactaacagtggataatcttaataggaaattaagaaaatactctaatttacaatagcatcaaaaaacataaaatatttaggaataaacttaacctaggatgtgaaagacatggacactagaaactaccaaatactactgaaaaaattaaagatgacaaaaataaatgggaagacattt

SEQ ID NO: 135779 - DNA, 601 bp, Human; identical to SEQ ID NO: 93207

SEQ ID NO: 135780 - DNA, 601 bp, Human
aatggaaagctatgcatataaaaattaattcatgtccttttccaggtcctactttacttctctccttcatttcatgatgaggcaggataggtagtcaaggaagtaaccatatcatcaggatgtcacaaccttggtgaccataccatcaccacaataagctttagcattaacattgtaattgaactcattcaagcaaagctgtagttcccctgtagagagaatgcacattttgattttacctgtcctcagagtgaccctttgctcattataatagtaaagaataaacccgtgggtagaagayttaagatgctaatgagacatacggtgttacaacaagcatatgcagttactgcacatgtgcacccagaggacaaccaagaacatgcttactagtaacgcctcttcccacctccttatggataatcatggaagattcccataaaaggagtctccctagtactagtctttactttctcatccttactagcagcctgccctgaatcctgtctgtctcagggtgtactgtctattctgcacctggatttcaaaatattcgttttcttttttttggcaataaattactccatgctgcatctccacc

SEQ ID NO: 135781 - DNA, 601 bp, Human
ttttctggtcaagtgctgtatggctgcttctgaattactttctattttatcttaaggtaaataccaacatagggaagtacaaatggaaacataaagagctcatatcattattttctatcattttcaatacatccttttattctttctccaaattaatgtttttataaattgtcattgcatttggatatgttgaagagaaaggaagacaaatgcaaatctgaatatgataaacatgaaagaaggaaagtgactccccaggccaaaaaatggtaataggaatttttcttttttttttttttttaacctttccacctactccaatatagtttctgcttgtaaattctaccaagtcaccttcactaaggtcaccaattccatctgtttttctactgtagtagatgatttcaatccatagagcagtttactgacagtcaagatagtattaaccaaaataatgatgttatcattataaataatttgatatgtcataatttaaaataaatattaattatactagtatgatttttcaataatcaaatccatgaaatctatctatagacatacatatttccaaaaatggaaagctatgcatataaaaatt

SEQ ID NO: 135782 - DNA, 601 bp, Human
cttcaaggagaactacaaaccactggtcaaggaaataagaggggacacaaacaaatggaaaaactttccatgctcatggtaggaagaatcaatatcatgaaaatggcaatactactcaaagtaatttacagattcaattctgttcccattgaactaccattgacattcttcacagaattagaaaaaacctagtttaaaatttatatggaaccaaaaagagcccatgcagccaagacaatcctatgcaaaaaggaaaaagctagaggcatcatgctacctgacatcaaactatactgcaagkctacagtaaccaaaacagcatggcacttgtaccaaaaatgacacatagaccaatgaaacagaatagagatctcagaaataaggccagacatctacaaccatttgatcttcaacaaaccttacaaaaacaaacaatggggaaaggatttcctcttcaataaatgagaaaactggctagccatatgagaaaactgaaaactggaccccttccttacacattatccaaaaattaactcaagatggattaaagacttaaatgtaaaacccaaaactataaaaaccctagatgctggggaggatg

SEQ ID NO: 135783 - DNA, 601 bp, Human
tttctgctgagaggtccactgttagtcggatgggcttccctttgtaggtcacctggcctttctctgtggctgcctttaacattttttccttcatttcaaccttggagaatctgatggttatgtgtctttgaaaccaatgagaataaagagacaacatatcagaatctctggaattcagctaaagcagtgtttagagggaaatttatagcactaaatgtccacattagaaagctggaaagatctcagatcgacattctaacatcacaactaaaagatatagaaaagcaagagcaaacaaatmcaaaagctagcagaagacaagaaataactaaaatcaaaggaaattgaaggatatagagacacaacaaaaccttcaaaaaccaatgactctaggagatgttttttgaaaaaatttaataaaattcactgctagctagactaataaagaagaaaagagaggataatcaaatagacacaataaaaaaatgataaagggcataccaccactgaccccacggaaatacaaacaaccatcagagaatattataaacacctctatgcaaataaactaaaaaatctagaagaaatggataaatttctc

SEQ ID NO: 135784 - DNA, 601 bp, Human
agatgataggagcaaaaatttatgttcagtgtgtgagcgtgggcaggggttgggtaaattatcctttgcaaaatttttatgttgaatagcaaaattaattttatttttccaaatgtggattatatctacgttgaattcaattcattaaattgctgaatactttttatgctttaagtttctaagctggccacaggggattttatgatgattttgcttccatcagattacattgttctcattggtttcaaagaacttcttgatttctgccttaatttctttatttacccaggagtctttcagragcaggttgctcaatttccatgtaattgtgtgggtttgagttagtttcttaatcttgagttctaatttgattgccctgtggtctgagaaactgtttgttatgatttcagtttttttgcatttgctgaggaatgttttgcttccaattatgcggtcaattttagaggcagtgctacgtggcactgagaagaatgtatattctgttgatttggggtggagagttatgcagacatctgtcaggcccacctgatccgaactgagttcaagtcctgaatatctttgttaattatctcgatgatct

SEQ ID NO: 135785 - DNA, 601 bp, Human
ttaagctgaagcaaaagtcaaaaattataaaatcccaactttgttagtaacaactatcattcactgcttttgtgcatatcttatgctaatcgctttatattatttccttacaaatctgatataaatagaattattaatgatcacacccaacctgatagatgtatgacaaagctgaagttttagagagttaaacttaccccacaatctttcggcagttgtttataatcggttgagctggggatggcacatttatgtagttttaaaatgtcctgtaggagcttactgcctttatagtgagaamaaaataattttgattacaaaaatctgaacatgagtgaaatgtgtttgctttgcaggccaactacataaatattactgtaagcaagtgggaaagaaatttaagtctggatttatctgaataaaaatggaatctgtttttctaaatacatgtgcatttgataattagaaaaaaacaccttatgattttttaatatatacagctttttaaaaaataagagaaagtcatgataataggagtctttggaaggtggatttattttcattatccagcttttagcctaaggtctggcatacttgaaaa

SEQ ID NO: 135786 - DNA, 601 bp, Human
gaactgcaaagatttcctttgaaatagttactgaacacagttctgctaaaaatgcatatggtataatcctggaaatattttttaagaccctaaaaaagctaacactacatgattccgattttacttagcatttatcatagggtagtagctatgggcaaagttttatgtaagaatattacatcttgctttattatggtgaaaatttatggtagacatttaaatatctacacataaggaaatggaataatttggcatgttcatggaatgaaatattgtatagacgctgaacactttcaaagamcaatagcctgaaaatcattaagctgaagcaaaagtcaaaaattataaaatcccaactttgttagtaacaactatcattcactgcttttgtgcatatcttatgctaatcgctttatattatttccttacaaatctgatataaatagaattattaatgatcacacccaacctgatagatgtatgacaaagctgaagttttagagagttaaacttaccccacaatctttcggcagttgtttataatcggttgagctggggatggcacatttatgtagttttaaaatgtcctgtaggagcttac

SEQ ID NO: 135787 - DNA, 601 bp, Human
tcacagtcacatgggcatctccatggagctatgtggtatgtgctcacaacatggcagctggcttgtactagaggaagtgatagaagagagataaacatggaggaagtacacaattttttatgacctagtctataatttaaacaccattgtttcattgtattcattagatgggaatcactaaatccaacacatagtcaaaaggaggaaagaaacgagcatgagaaaatttgtgaatatattttaaaacaaccacaactagaattcataatgtgagtatcccttaatgtagaaagggtgtttyacagatgataagtaggcatggttatgacagatgatgaaactacagatatcaaaaggaaagtgactttggatttgggggctgagtttcaatggatctccttgatctcctataggcattcccaaatggtagccatgaacctgttgcaagtggctagactatctactaagtaagtggtaagggtgaatgggaagtgtagatattgcagcccaagaagtgaacaaagtagacataccaatggaatccataacttattccccttgcaggataaagtatagctagtccagggcatgggagagatta

SEQ ID NO: 135788 - DNA, 601 bp, Human
ggtttctattgtttggtgaggatggagcgggtacttaaatctttacagtaaaagtcaggtcttactcaaaccctcaaagagatacaaagtgcccttaaacctttaatctgctttcaaatccaaaaggaacattaagtctatttattcataaatcgttttaaatatctctgctccaggcaatttacttgtcactgtgaaaatattggtaagttaaataaagactttattttcttcagtggagcactcttcctgagaagacagctctaaacaataagtaggtaggtaggaatcctagggccaygaaggagatgaacaattcacatagattataccagctgaagtgaattcagttttacttatgtttcttagataagtcatatctgatgaccgttgattcagtttcagcagttgcatgaactagaaactaaagtgaaatacggaatcatccaccttgaaacttcaaataagtagcaaataccttttatttgctggctctgtggatggtgctagttacaatgaaagaaagtagacacattctctgctttcagggaatgacagagcttccagtctggtgggatgtgggcaagtgagcatttaatta

SEQ ID NO: 135789 - DNA, 529 bp, Human
gcatatgcgggtaagtcactgaaagtgacagaactataacaactggacgactcaaccggggggattggagattaatgccaccgttatctacagattataagctgtggctcttgtaaagaaaggtggaagaaatcaaacctagtgtattagccacttaaaagagaaatgcagagaggtgaggaaacatgtatttcagtgcagtttaagaagtaaaaatgtccaagatcawacctctaagtatacttattagaattttaaaagagacatagattgagactcagataggttgttatttcaacattgagcctcatttggatgggtatttcctattagattgagagttttgccattttctgagtgtgtttaatttccattgtcataatacaaaagaagtgttgaggtcatgacattatctgagacccataaatagaagagaaagtgaacaaagtagaaataaagttgagataagtacaaaaactgaaaaccctaatctggttatgtaagaatctcacaacaagaaagtgctgag

SEQ ID NO: 135790 - DNA, 601 bp, Human
atttttttatttttattttgttattatcatactttaagttttagggtacatgtgcacaacgtgcaggtttgttacatattctttacagaacagaaaagcctgccctccatagacttggtgcacgtctttgccagtaggtggctctcatcctctgtaaatatttcaacggcctccagagtaaaatggatcttgcattctatttcctttttccacagggatggttacattattgtaatggggatattccttcttttccaaaactattcaccaggagggaagtaaaaaaaaaaaaaaaaaaaamaacaggccagtgatttggatgtttctgaaacacctagaactctcactcaacttttgctttcagctgatggctttgtactcttatgggaaaattgacagccagaaattacaatggaacaggaagcagctgtatgaatggcagtgcaggttaatggtgagtgaatgaggagagcaccctgggatttctacgctggggagggaggaaactaatgtcatacagaaatgaaagaatgggatcctccagtaagtaggggggaagggagagtgtggcagccatcagaatcagcaaagtattgtgatt

SEQ ID NO: 135791 - DNA, 601 bp, Human
aagcctcttcctactatctaagtaattctcacacacactcctgattaacttcttcaattacactatttgcagatcactttaatacttcccaaattctacacaaatagataccttctcttgatatcatttggcaagaattgtatcctctgattcctttacaaatgtctttgctctcttttactactgagtaaaaagcacaagggatgcaagttgactcatcattgaaaataacagaaaatgttttaattataaagttgggacatgacctaaggagtgaatgtgtaaaattagcaacttactrttaagaaagagctaatgtaccttaaccaggagatttttcttgatttcccttgtagttctacacctacattggcaggttgtactgattcccagtctagcacaaaacatagagggagggacaagtcaagaggctggaggcaagggacacgttctgaccctttctctctccacatagctgcccattgttcaaagaacatgtgcttcctgaatctgggagtgttttctctctctgtgatacaaaagctaagaaaatgggcttcttccaatattagggttaattctttccgagaaagatggcctt

SEQ ID NO: 135792 - DNA, 601 bp, Human
gtttctctcctctcccatttgaaaagtgcaatctgaaaggttgggtctgtaacctgagcaaagaataagaaattcctcctaaattgaagcctcttcctactatctaagtaattctcacacacactcctgattaacttcttcaattacactatttgcagatcactttaatacttcccaaattctacacaaatagataccttctcttgatatcatttggcaagaattgtatcctctgattcctttacaaatgtctttgctctcttttactactgagtaaaaagcacaagggatgcaagttgastcatcattgaaaataacagaaaatgttttaattataaagttgggacatgacctaaggagtgaatgtgtaaaattagcaacttactgttaagaaagagctaatgtaccttaaccaggagatttttcttgatttcccttgtagttctacacctacattggcaggttgtactgattcccagtctagcacaaaacatagagggagggacaagtcaagaggctggaggcaagggacacgttctgaccctttctctctccacatagctgcccattgttcaaagaacatgtgcttcctgaatctggg

SEQ ID NO: 135793 - DNA, 601 bp, Human
aaatcaggctgcattatgacccgaattatgacatgcctcggattgcattggccctatgcctaactttccctgcactctgatgacttgctgggtcctagggaggaaacagaagtttgcaacggacactggagtaacccttgtcccttccaatactctcaggctgctgtggtatcagtgttatccatggtggggacactgacgttggccatgtctccatgggaacactctgtggtttcagcatccactttaatcttctctctgatcagaataatcttaagtagttgattcagtgctcccattkgtattgctccatctcctgaggacctgccgctcttccagtcaatgtgttaagtatctctctcttccttccaagttctaaagctgctgcttgccttttcttcttcatgtttcataatgtgggctctgcttttttcaacaaatgagagtcctgagcctagtgtagtctcttcctagaggaatcagaacatagaagcacctgaacaggggcacagatgaacttctgcattctttaccaacacgttgggtataatcacgtgggaaagattctctctattgactatgtttttgtgcctagcagtat

SEQ ID NO: 135794 - DNA, 601 bp, Human
gaaggatgtacttttcttgttttttggaccctcatcctcagaaagtgtccaaattctaactttaactgtgccaactgagtgcagaatgcacccactggaaaaaaagctaaaggagaattgaccgaccaacgtcctctttccaaataactaagttaaataaataaactagtacattttggcaaagatcttcgctgtcattagaaactgtgatttttcaaaacaaacattaccttatatcagtcctgctgggatgtctctgacccagttactgttaattctactcaaataactgctgtatccyttttgtttaattgttgtttcatttgttttatctttaaatcaggctgcattatgacccgaattatgacatgcctcggattgcattggccctatgcctaactttccctgcactctgatgacttgctgggtcctagggaggaaacagaagtttgcaacggacactggagtaacccttgtcccttccaatactctcaggctgctgtggtatcagtgttatccatggtggggacactgacgttggccatgtctccatgggaacactctgtggtttcagcatccactttaatcttctctctgatca

SEQ ID NO: 135795 - DNA, 601 bp, Human
cttgtgtgaaagggtctgttagacaagtgaagaatagatatgaacaaaggcaacaggtatgtgttacaagtcaatggaacttactgactaaattctaagtagaacattgtttaaaaagttaaaagggagtggatttttcctcccaactgaaaaacaaagtctaaagtttaatgaatgatttctgcaataaaatatggtaaaataactattaatctatcagttgtagacccttggaatcttatttatttttaactcttgagcttttttgtgagcttaagaatatacagaaagcacccagcartttttattctactgatggtacaaccatatcaggcctgtcttatctccttcaggacctcactaattccacaagagaccttcttctgtccagcctgttgtttttattccaaatgatgacaacactgtttctcacctccagcccagaccgacattcatcttgtgtactgatagagtccagagaagaatctcttttctgtctttccatccaatagttgaattttgagcgctgaaaagaccttttatatgaccaagatgagagaatattatgcacttcctgcacagaagtgaaaggttttgaaga

SEQ ID NO: 135796 - DNA, 601 bp, Human
aggtaaaagacctctgcaaggaaagctagaaaacacaaataaaagaaattgaagaggatacaaacaaatagaaaaacattccatgctcataggttgaaataattaatattgttaaaatgtccatactgcccaaagcaatctaaagatttaatgcaatccctatcaaaatgccaataataatcttcatagaaaaaagatactaaaatttgtatggaatcatgaaagaccctgaatagctgaagcaatcctgagcaaaaagaactacactggcgatatcacactactggacctcaaaatataytacaaagctgtagtaatcaacacaccatggtactgacataaaaacagacacatagacaaatgcaacagaatagataacaggaaaattaatccacatatcaataacaactgatttttaattaaagtgccaagaatactcactgaggaaaggatagtatcttcaataaatggtgctgggaaaactgaatacccatatgcacaagaatgaaattagaccccctcctctcacactatacaaaaaaaaaaaactcaaaatggaagagagacataaatctaatacctgaaactttaaaattactag

SEQ ID NO: 135797 - DNA, 601 bp, Human
gattacaggcgtgagccaccgcgcccgcacactttcatttttcaatactcaaaactattgaacacttgttaggtttgacctttctgagctggtcacaggggagtcaaggttgatgttgtctcttgttagcaactaatatgacagaaactagtgactttcaattgttcatccagtcagtgtttctttggggttctttgttcctgggtctctgccttgctctaacagtgtagggcagttagggccaggctattctgtcaagaagaaataggcttctttcttttacctgtatgtgtttttttaktttaattttttgtacttttttgcactagtgatttctgggcaagctttgtcttgccattaatgcattacattctcattcatgatgaagtaacaaaaattaagggaagtaaaagacaggcaaaggggccacaactttttttctatgatttccatgatttctgttgcgggaagtcaggaaccccgaacagagggattggctgaagccatggcagaagaacataaattgtgaagatttcatggacatttattagttccccaaattaatacttttataatttcttatgccggtctttactgcaat

SEQ ID NO: 135798 - DNA, 601 bp, Human
cgcccggctaattttttgtatttttagtagagacagggtttcaccatgttagccaggatagcgtcaatctcctgacctcgtgatccacccgcctcggcctcccaaagtgctgggattacaggcgtgagccaccgcgcccgcacactttcatttttcaatactcaaaactattgaacacttgttaggtttgacctttctgagctggtcacaggggagtcaaggttgatgttgtctcttgttagcaactaatatgacagaaactagtgactttcaattgttcatccagtcagtgtttctttgsggttctttgttcctgggtctctgccttgctctaacagtgtagggcagttagggccaggctattctgtcaagaagaaataggcttctttcttttacctgtatgtgtttttttagtttaattttttgtacttttttgcactagtgatttctgggcaagctttgtcttgccattaatgcattacattctcattcatgatgaagtaacaaaaattaagggaagtaaaagacaggcaaaggggccacaactttttttctatgatttccatgatttctgttgcgggaagtcaggaaccccgaacag

SEQ ID NO: 135799 - DNA, 601 bp, Human
agggaaaggtctttttctttgagccaaaataattaatgctccaagatctttgcccttgcccttagagtgtttgtgtgaaggatttggcttctcaatggtgatctcctcctgtccagggtctgtgtcctcagggatcaaatgtgtgcacagtgctcggatgttgatagcaagtttccttttatacaaataggtaaaggaagtattcaattgccataattttaactttagcaagcaagtaacttttattttgacaattagagcttttatcagtcaatcagtcaactctttcatttttcttctytttttttttttttagacggagtctcgctccgtcacctaggctggagtgcggtggcacgatctcggctcactgcaagctctgccttccagcttcacatcattctcctccctcagcctcccgagtagcctgcactacgcccggctaattttttgtatttttagtagagacagggtttcaccatgttagccaggatagcgtcaatctcctgacctcgtgatccacccgcctcggcctcccaaagtgctgggattacaggcgtgagccaccgcgcccgcacactttcatttttcaatactcaaa

SEQ ID NO: 135800 - DNA, 601 bp, Human; identical to SEQ ID NO: 93208

SEQ ID NO: 135801 - DNA, 601 bp, Human
ttccctctctttaatggtggaaggtcctcagaatctagtttaagtcttattttcttctctacattggctcctcacatgacagcctccatttttaggcatttggttgccagttatgatcctccagacattgtattccttggatattgcaaactcatgtatctgactagcaatgcacattcgcaattacatgtttaaaagtcagtttagagaggctagctctgcttttatttttctttctggacgtgcctctatctgcgttctgctgagagcaattcactgttttttttcctagctcacattrtagcatttaacataactcatattaatcataattattgttgttaaatttctggcaaaaatcaaagatacaagggaacaggaattgtatttattatgttcacttaagaaaaatcttcctttacttaaaatttgaataaaataatgataggtaactgaactgtaccatctgtttttaatcaagttatacaatcaggcttggagtttcattttaaagaataaacaaacaattaatagtaaaaatctaatgaacaaagcaaaataatcagttgacaaaacataaagaacatattttattatatta

SEQ ID NO: 135802 - DNA, 601 bp, Human
ctaagtacatttattttctaaatacatttttatcatcattccctcttgtccttctaatgtttaaggtattccacctctgtttcctttgtgtctctcctcttccctctctttaatggtggaaggtcctcagaatctagtttaagtcttattttcttctctacattggctcctcacatgacagcctccatttttaggcatttggttgccagttatgatcctccagacattgtattccttggatattgcaaactcatgtatctgactagcaatgcacattcgcaattacatgtttaaaagtcartttagagaggctagctctgcttttatttttctttctggacgtgcctctatctgcgttctgctgagagcaattcactgttttttttcctagctcacattatagcatttaacataactcatattaatcataattattgttgttaaatttctggcaaaaatcaaagatacaagggaacaggaattgtatttattatgttcacttaagaaaaatcttcctttacttaaaatttgaataaaataatgataggtaactgaactgtaccatctgtttttaatcaagttatacaatcaggcttggagt

SEQ ID NO: 135803 - DNA, 601 bp, Human
aactatgtagataaaaaatagtacacattctttttcaagtccaaccttatttcccccctccatttccatggcaaacatgtcacaattatttcctacatatggttatcactgatttctcttctctgattcactcttccacctactccagtatggtttgtactgattaattctgccaatccagctctcaccaagatctccaccgccatctatttttctgatgttctgggcagttttaatccacatttcccataagtctattgattcttcttctaagtacatttattttctaaatacatttttrtcatcattccctcttgtccttctaatgtttaaggtattccacctctgtttcctttgtgtctctcctcttccctctctttaatggtggaaggtcctcagaatctagtttaagtcttattttcttctctacattggctcctcacatgacagcctccatttttaggcatttggttgccagttatgatcctccagacattgtattccttggatattgcaaactcatgtatctgactagcaatgcacattcgcaattacatgtttaaaagtcagtttagagaggctagctctgcttttatttttc

SEQ ID NO: 135804 - DNA, 601 bp, Human
acatgtaagcagaatgtaatttcaatgtaaaattctttatttttatttacacctgaggtataagctttgtattcaggatttctgtaataattattacatctcctcttactactgagttatatgcaactctctgccgcactctgaatttctctttggttcacgtattttcagctggttttggccaaaagtataaagagattctctcatccagtttcccattttatttcatgagggaagtttgtcattttttcctgacatgtaacatagtattaatcaaaataataataaattattatgcaartaatattatgatttaaatacataaaatattaaacatattaacatgacttgccaatagattgaatccacgaactctattttcaaaaaagaaaaactatgtagataaaaaatagtacacattctttttcaagtccaaccttatttcccccctccatttccatggcaaacatgtcacaattatttcctacatatggttatcactgatttctcttctctgattcactcttccacctactccagtatggtttgtactgattaattctgccaatccagctctcaccaagatctccaccgccatcta

SEQ ID NO: 135805 - DNA, 601 bp, Human
catgtagttgagcggttttgagtgagtttcttaatcctgagttctagtttgattcatatttcaaaatgttgtccatgaaaattttcccaacctcactagtgaggccaagattcaaattcaggaaatgcagagaatccctgcgaaatgctacagaaaaagactttccctagcacacgtagtcatcagattctccaaggtctaaatgaaagaaaaaatgctaaaggcacctagagagaaggggcacatcacctacaaagggaactgtgtcaggctaaaagcagacctgtcagcagaaactgtrtaaaccagaagagattaggaacaatattcagttgtcttaaagaaaacaatttttaaccaagaattttatatctggccaaactgcactttataagcaaaggagaaataagatcctttacagacaggcaaatgttaagggaatttaccactaaatctgacttacgagagtttctctagggagtgctaaatatggaaaggaagtacacagaccaatgacactataaagaaatcacatgaaggagtctgaataataactatataacaacattatgacaggatcaaatccacacttaccaatact

SEQ ID NO: 135806 - DNA, 601 bp, Human
tctacacactgctttgaatgtgtcccagagattctggtatgttgtgtctttgttcttgttggtttcaaagaacatcgttatttctgccttcatttcattatttacccagtagtcattcaggagcagcttgttcagtttccatgtagttgagcggttttgagtgagtttcttaatcctgagttctagtttgattcatatttcaaaatgttgtccatgaaaattttcccaacctcactagtgaggccaagattcaaattcaggaaatgcagagaatccctgcgaaatgctacagaaaaagacyttccctagcacacgtagtcatcagattctccaaggtctaaatgaaagaaaaaatgctaaaggcacctagagagaaggggcacatcacctacaaagggaactgtgtcaggctaaaagcagacctgtcagcagaaactgtataaaccagaagagattaggaacaatattcagttgtcttaaagaaaacaatttttaaccaagaattttatatctggccaaactgcactttataagcaaaggagaaataagatcctttacagacaggcaaatgttaagggaatttaccactaaatctgactta

SEQ ID NO: 135807 - DNA, 601 bp, Human
ctacaaacatccacactagttctacagcaatggttcctaaccaggctaagatggctgaattgacagaaatagaattcagaatatggataggaatgaagatcatcgacatataggggaaagttgaaacccaatccaatccaaggagtctaaggattacaataaaacgatacaggagctaatagatgaaatggtcactataagaaagaatcaaactgattgatagagctgaaaaatactgtacaggaatttcataatgcaattgcaagtattaacagcagaattgaccaagctgaggaaagamtctcagagcttgaaaactggctcttccaaataactcagtcagagacaaataaagaaaaaacaataagaataaacaaaacttccaaggaatataagattatgtaaagagacccaatctatgacttattggcatgcctgagagacagagagagaaaccaagcaacttggagaacatatttcttttttttttctaaaggatgtatttttactatgatctattattcttaattattttcacaaaattgctggtaatccttaaaaagttgtattttgttgctgattaatgccgtcaactgaacta

SEQ ID NO: 135808 - DNA, 601 bp, Human
aggaataacaactatataaatatttgaacccattatatttataaaaaaactgagctcctgcagcctctgcactgtgctgccaccactgccactgtgaatgcctacatggagtccaacacccctgcactcaccagtgccccactgcagtcaatgagcatttgccttcccaagctgctgacacatgcaaatgaggaaggatcccactgccaccactctatgaatcactgtggctggcaccacctatcagagtgttctgaccagtggttcaggagcaaattaggccccttcagcatggcaggtkgcgaatctccaggggccccagaatgaagcttcaggcctgatagtagacacccacagtaggatcatgcagttcagggctcctaagctgagccttggcccacttaaatccccatagattaagccaattgactgaacccacattatagcaaaactaaaccccaaagaatgttacataggataaaagaaataaaagcaatccaaaggttagcaacttcaaagattgaaggaccatcagcccacaaagatgagaaagaaccagttcaagaactctggcaactcagaaaaccagagtgacttctta

SEQ ID NO: 135809 - DNA, 601 bp, Human
atgcgcattgctctgcagataaatctcctgccagaagacagacttctgcataaacagaaaagcctggtctccacagacttggttgcggtcttggtgcattttcgtcatcagtggctctcttcacctaaaaatgttttaatagcctcagagtaaaatggaacagccttttattttctttttgctaagctaatgttacatcattataacagggacattccctcttatccagaaatatttataagaaaagaaaaacagcctttcatataagagtttctgaaaaacctagaactttcattcaacrtctgctttaatttgtggttttgtactcttaaggggaaattggtggacaaaacccacaagagaactgagaacagctgtatgaagaggcaatgcaggttaatgaagagtgaagagaagagaacagtgcggatttctagaagaagaggaaggaaattattgtgatatgggagttaaaaatgggatccagaaaaacagggaggaaagggggaagtgtgccaggtctcagaaccagcaaaggttgctatgtatatttcacttcagtttaggagactaactttatatggaagtatattctggaatt

SEQ ID NO: 135810 - DNA, 601 bp, Human
ttgtcttatctctttagtctcctttaatctgtaacacgtgcccagtctttcctagtctttcatgatcttgagacttttaattaaaattggtcaattattttgtagaatgtccactgatttgaatttgtatggtattttctcatgactagattgaagttatagatttaagggaagaatacaatgtcattgccaagatgttgacctgcctgcctatgtgcacaaatatgtatgactcacacagacacagagtcacatggagccttttccacaggtcccagactgcacattgagtcagtgtgtraaaccaccctaatgctctggcaggactcccggtccaggtgtcttggtggctatctaaaaagttggtgtggtgtcctagcatcatcagtgcaacatgtagcttgcttcacatggaatcacagtaatttgagctcattataaccctttgaacaggcttagctggaatttccatttatatgaggttttatttgaatgtgtctttgatctttaaaggtttcataatcaccagcttcatgattaactgtgacaagctgttatatgacagacctttagatactcacattaatgactaatgattcaa

SEQ ID NO: 135811 - DNA, 601 bp, Human
agttacattatcagcttctctggttctgtggggagcttcagactttgagtgagccacactaccagcatcccagggtctccagcttacagatggcatgtggcatgggaggggcttttcagacttcataactgcatgagctaatccctctaatgatgtatttgaaggattagctcgtgcagttacgaagtctgaaaagctttttaacttaaaaagatttgagggatcacaataaatgataaaatgtaattccactgattttgtctcactggaaaacacctgagtaatggaaaacacctgagtmatacagtgaccaaagcagacagtgaagtttctattattatatccatttatagaaaaaaaagacagaagtgcagggagctattgaattgtggagccactgtctgaatccagaaaatctgactgaatcgtcaggtcttacatgctccctgggaatattttggccataaaaaccagatgtgatttctagactgatcagtgcttttccagtagagtcttgcctaagtaatgacaggctctttctcttcagccattattctttttcttcactgtaaagtctcatttgcttatgccagtcatgtta

SEQ ID NO: 135812 - DNA, 601 bp, Human
atttcaaaacactaatgaaagaaatttaagaggatataaacaagtagaaagacatctcgtactcgcagcttggaagaattaatattgttaaaatgagactaccactgaaagcaaactacagattcaatgcaatgcaatccctaacaaaataccgatgacattttctatagaaatgaacaaattctaaaaattttatggaaccacaaaagaccactaatagacaaagaatcctgaggaaaaagacagtactattcagccataaaagagagtgagattcagtcatttgcagtaacatgaatgracatttatccaaaggaaagaaaatcgttatatataagagacatctgcatccccatgtttattgaagcattcttcctgatagccaagatgtgaaattaacctagtttgccaacaacagatgaatggataaacaaaatgtggtacatataaagaatgaaatactattcagccatgaaaagaatgaattcctgtcatttgtggcaacatgaatggaactgaggacattatgtttagagaaatgaggcaggagcagaacattaaatactgcatgttttaactcatatctggaagctcaaaaaaa

SEQ ID NO: 135813 - DNA, 601 bp, Human
aaatagctgctcttaatgtaacactgagttttattgcatgcttaatatggaccatccagtgttctaaagtctgggacactaaggtcccagcactaggcacggtgctgctcagccagcctgctggtgaatctgatataggtagcccaaggggctgttttgcagacccaagacctgggtgcagggcatccaagttagaaagaggaagtcaaattgtctctgtttgcagatgacataattttacttatagtaaaacctaaagatttgggtgcagggcgtccaggttggaaaggaagaagtcaarttgtctctgtttgcaggtgacataatcttatatctagaaaaacctaaagatgctaccaaaataacccttagaactgataaatgaattcagtaactttgcaagatacaaaattaacatacaaaaatcagtggtgtctctgcacatgaaaaactagctggaaaaaaaatcaagaaggcttcctgatttcagtagccataaaaaagtaataaaacgcccagtaatatgtctaaaccaggaagttaaagagctccagaagctaaatttcaaaacactaatgaaagaaatttaagaggatataaa

SEQ ID NO: 135814 - DNA, 601 bp, Human
agactatacaaatatctttgattctaatccagcacaataaggttaattctagcctttccattttcattatttgaaacttctttttccaactctgagatacttggtttttgttagtaacaatatttttacctatttactcaagtctaataatacacataatgtttcggaactactaactagaatttctgtgagaaacaattctaccaactagcatacagtgtttgtgtacaacccttttgtgtttcaccttaaagtatctagtcaccacatggctagacagagtatttgtcactttcagagwggttatgtcatacatcaattacattaatttgtcatcatctagattcaatcctggtatctactgccaatgtggttgagtttttaaaaatttacatacagtaaaattcacaccttttggtgcatagttccacaggttttaacaaatggacagaattatagttcatttatttttacctcaagttttcctgtaactttaaaggtgaacaaaaagtttttgccattgtataccgtgaaaattgccttggtatacagaatctgttgttttaaatgacaggatctcattctttttatggctttatag

SEQ ID NO: 135815 - DNA, 601 bp, Human
gtatccttgtatttccatgacacagaccaagaatcagtcatttctccaagatgtattaatgccttttattggagattggtattttagaagacaagatctgagagctacatgtgcttagcagtactaggatgtcactgcttttaggtcctctcagtgacagagataggaatataagtagtacatatacgtatactaattttttatatacacatacctatatttatttctgtccacacctatatctaagtaaagactaaagcaaacatgagactatacaaatatctttgattctaatccagcrcaataaggttaattctagcctttccattttcattatttgaaacttctttttccaactctgagatacttggtttttgttagtaacaatatttttacctatttactcaagtctaataatacacataatgtttcggaactactaactagaatttctgtgagaaacaattctaccaactagcatacagtgtttgtgtacaacccttttgtgtttcaccttaaagtatctagtcaccacatggctagacagagtatttgtcactttcagagtggttatgtcatacatcaattacattaatttgtc

SEQ ID NO: 135816 - DNA, 601 bp, Human
ggcatatgaaattttacatcttttatggaaaaatgggaatttaatgatgatttcaattaatgaaatacactagtaaaaatttaaatcatctgtataagaattttggactttttaacttttattttgaaacaattttagatatgcagagttgtaaatgtagtacagagagtcctctattcccttcactcacttctcctaaggttaacagcttacatagccatggcacaactatcaaaactaagaaatcaagattggtgtactaaccctaattaaacttcagacttcactcagatttcctcarttttttattgatgtctttttcctattcaaggaatctctccaggatcccatattgcatttcattgtcatttctctttattcttctctaatctgccatacacgctcagtctttcctgactttcatgaccttgaaactttttaaagaatattagtcaattatttttgtagaatgcccatcaatttggatgtgagtgcattttctcattattatattaaaattatagatgtaaaagatgaatacaatagagtgaatcttgtcacatcaagtgatataggagatatatatcaatatgttgcctta

SEQ ID NO: 135817 - DNA, 601 bp, Human
gaaaaaatatcttaatggaaaaaaataatgatgaaatagaatttacctacattaattccagtcacgatggaaattaaaggaaggggaagagcagaagcaaaattgtggaagagatgtagatcaaagggagcaaatgagcatgggctggaagaatagtaatcattcctggtcaggggtgtgttttcagctttgctgaatccagccttcacagagagtcatgggacacacaccaaccacaagagtttatacataaaaaaggcaaaaatttgagagtacaatatactctctgcataataggtargtgatgatgtaccaagttctcccttagtgtataaataaactcaagagatcaatatttttcttatcacatctcttacaagaaacaagggaattgataatgtcaaaggacactttctgcaacctagtaaagttcgataataaaaatagtgattaaaaggaaccaaatacctaaattgttgaatgtgtttatttttagtcagacattgttcttagcacttacaaaattgatgctccctttaccaataatgaatactcttatttttcatattaactgaacacctaccatgtgtctacccccatt

SEQ ID NO: 135818 - DNA, 601 bp, Human
caaacgtgtatctaaatgtgattaaaatgttaaaaggaaaaaatatcttaatggaaaaaaataatgatgaaatagaatttacctacattaattccagtcacgatggaaattaaaggaaggggaagagcagaagcaaaattgtggaagagatgtagatcaaagggagcaaatgagcatgggctggaagaatagtaatcattcctggtcaggggtgtgttttcagctttgctgaatccagccttcacagagagtcatgggacacacaccaaccacaagagtttatacataaaaaaggcaaaawtttgagagtacaatatactctctgcataataggtaagtgatgatgtaccaagttctcccttagtgtataaataaactcaagagatcaatatttttcttatcacatctcttacaagaaacaagggaattgataatgtcaaaggacactttctgcaacctagtaaagttcgataataaaaatagtgattaaaaggaaccaaatacctaaattgttgaatgtgtttatttttagtcagacattgttcttagcacttacaaaattgatgctccctttaccaataatgaatactcttatttttca

SEQ ID NO: 135819 - DNA, 601 bp, Human
aagagtgattctttgaaagtattttctcacagccaggatggagtccacattcctcaggggagtctcttccactccaaccttctacatcacacaggcttccaggtcattcagctgctggtaaagttcagtgtagaatttgtctaaaagggtcgcatcccaagtatcagatgagtcctttgtgctgaagaggttgaaggtctgctgcatcatctcatggaaaaggaagatagcttgaaccttctggaagtggttgccatgaaacacctgatgatggaaaatcaaagtcatgtctgtccttcargtaagaaaaaggagagattctcctcatttgtgtcaggagtatgaaggccctcctgttacccacgctgtgggcctgaggcagatcacagcccagaggcagatggacttgcagctgagcaccatcatagccatcagtaaactaaagggcaagtccattggggatgtttcagatgctactgggctggctgagagagtgactctgaactctggattttaggttatctgaagaccttattttgtacgtaaccttaaatagggaacacactagtttctattttctgaatgccccctctcttatttt

SEQ ID NO: 135820 - DNA, 601 bp, Human
gtatttgttttttcaattttatatcctgaaggcaacatacaacatacaatctggtatagaaaaatctattttgacttataaccaataataggtaactgaatcgtataatctattttttaatcaggttaaataatcaggcttggagtttcattttaaagaataaacaaatacaaggagttttccatagtaaaaatttaatgaaaaaagcaaagtaatatattgactaaatataaagaacatgtattgttatattaaccacaaagtaaaaatacatgatacatgaaaagaagattttaaataktataaatagttaaataattatttagacaaatagataaacagatccatcagcatgatcatccgtaaggaactagtgcctgtacagctgaacatgatgctgcttaacattcctgaaaacattttaaaattttgattcaactcatgtcatggatatagcaaaaatgagaaatggcagaattcatgaacgtgtgagatgatgtattaatcatggaaatgtttctcatttccatgttgaaccagttttcattccttcctccttaatctttcctgcaagttcgttcataaagagaaggatctcatg

SEQ ID NO: 135821 - DNA, 601 bp, Human
attattgtttataagtttctttcctcacaaaaatcaaaggtacatgagaacaggaaatgtatttgttttttcaattttatatcctgaaggcaacatacaacatacaatctggtatagaaaaatctattttgacttataaccaataataggtaactgaatcgtataatctattttttaatcaggttaaataatcaggcttggagtttcattttaaagaataaacaaatacaaggagttttccatagtaaaaatttaatgaaaaaagcaaagtaatatattgactaaatataaagaacatgtrttgttatattaaccacaaagtaaaaatacatgatacatgaaaagaagattttaaatagtataaatagttaaataattatttagacaaatagataaacagatccatcagcatgatcatccgtaaggaactagtgcctgtacagctgaacatgatgctgcttaacattcctgaaaacattttaaaattttgattcaactcatgtcatggatatagcaaaaatgagaaatggcagaattcatgaacgtgtgagatgatgtattaatcatggaaatgtttctcatttccatgttgaaccagttt

SEQ ID NO: 135822 - DNA, 601 bp, Human
cattgccagttatgaaccttcaggcattgtatttcttgaaaattgcaaattcatatatctgactggaaatacacatttgcaattgtatgtttagaagtcaatttattgaggatattgcttcttttatttttatttctggaatgcctaaatccatcctcttctatgagaaattcattgttttttttttcctatctcacattatagcatttaacataactgatatcaattgagaacgattattgtttataagtttctttcctcacaaaaatcaaaggtacatgagaacaggaaatgtatttgktttttcaattttatatcctgaaggcaacatacaacatacaatctggtatagaaaaatctattttgacttataaccaataataggtaactgaatcgtataatctattttttaatcaggttaaataatcaggcttggagtttcattttaaagaataaacaaatacaaggagttttccatagtaaaaatttaatgaaaaaagcaaagtaatatattgactaaatataaagaacatgtattgttatattaaccacaaagtaaaaatacatgatacatgaaaagaagattttaaatagtataaat

SEQ ID NO: 135823 - DNA, 601 bp, Human
tctcttatatcccctctctttaaaggtggaaggtcctcagaatcaattttaggttcttttttcctttacttttctttttcctctccacatgactgcctctatttttgggctttccattgccagttatgaaccttcaggcattgtatttcttgaaaattgcaaattcatatatctgactggaaatacacatttgcaattgtatgtttagaagtcaatttattgaggatattgcttcttttatttttatttctggaatgcctaaatccatcctcttctatgagaaattcattgttttttttttcctatctcacattatagcatttaacataactgatatcaattgagaacgattattgtttataagtttctttcctcacaaaaatcaaaggtacatgagaacaggaaatgtatttgttttttcaattttatatcctgaaggcaacatacaacatacaatctggtatagaaaaatctattttgacttataaccaataataggtaactgaatcgtataatctattttttaatcaggttaaataatcaggcttggagtttcattttaaagaataaacaaatacaaggagttttccatagtaaaaat

SEQ ID NO: 135824 - DNA, 601 bp, Human
aatacatttattttcaagacacacatttatcaccattaagtctttccttcactaatgtacagttttccacccttgcttcctttgtgtctcttatatcccctctctttaaaggtggaaggtcctcagaatcaattttaggttcttttttcctttacttttctttttcctctccacatgactgcctctatttttgggctttccattgccagttatgaaccttcaggcattgtatttcttgaaaattgcaaattcatatatctgactggaaatacacatttgcaattgtatgtttagaagtcartttattgaggatattgcttcttttatttttatttctggaatgcctaaatccatcctcttctatgagaaattcattgttttttttttcctatctcacattatagcatttaacataactgatatcaattgagaacgattattgtttataagtttctttcctcacaaaaatcaaaggtacatgagaacaggaaatgtatttgttttttcaattttatatcctgaaggcaacatacaacatacaatctggtatagaaaaatctattttgacttataaccaataataggtaactgaatcgtataa

SEQ ID NO: 135825 - DNA, 601 bp, Human
gtattctgttaatttggggtggaaagttctgcagatgtctattaggtctgcttggtccagagctgagttcaagtcctgaatatccttgttaattttctgtcttgttgatctgtctaatattgacagtggggtgttaaattctcccactattattgtgtgggagtctaaacctctttgtaggtctctaagaacttgctttatgaatctgggtgctccagtattgggtgcatatatagttagaatagttagctcttcttgttgcattgatccctttaacattatgtaaagcccttctttgtcktctttttctttttgatctttgttggtttaaagtctgttttatcagagaccagaattgcaaccccagctttttttttttttttttttttttttttgctttccatttgcttggtaaatattcctccatccctttattttgagtttatgtgtctttgcatgtgagatgggtctcctgaatacagcacaccgatgggtcttgactctatccaatttgccagtctgtgtcttttaattggggcattttgcccatttacatttaaggttaatattgttatgtgtgcatttgatcctgtcataatga

SEQ ID NO: 135826 - DNA, 601 bp, Human
ttgtggtctgagagactgtttgttttgatttccattcttttgcgtttactgaggagtgttttatttccaattatgtggtcaattttagaataagtgtgacgtgatgctgagaagaatgtgtattctgttaatttggggtggaaagttctgcagatgtctattaggtctgcttggtccagagctgagttcaagtcctgaatatccttgttaattttctgtcttgttgatctgtctaatattgacagtggggtgttaaattctcccactattattgtgtgggagtctaaacctctttgtaggyctctaagaacttgctttatgaatctgggtgctccagtattgggtgcatatatagttagaatagttagctcttcttgttgcattgatccctttaacattatgtaaagcccttctttgtcttctttttctttttgatctttgttggtttaaagtctgttttatcagagaccagaattgcaaccccagctttttttttttttttttttttttttttgctttccatttgcttggtaaatattcctccatccctttattttgagtttatgtgtctttgcatgtgagatgggtctcctgaatacag

SEQ ID NO: 135827 - DNA, 601 bp, Human
ctctgatggtagtttgtatttctgtgggatcagtgatgatatcctctttatcattttttattgtgtctatttgattcttctctcttttcttctttgttagtctggccagcggtctatctattttgttaatctgtccaaaaaaccagctcctggatttactgattctttgaagggtttttcgtgtctctatctccttcagttacactctgatcttagttatttgttgttttctgctagcatttgaatttgtttgctcctgtttctctagttcttttaattgtgatgttagggtgtcgatttyagatccttcctgctttctcctgtgggcatttagtgctataaattttcctctaaacactgttttagccgtgtttcagagattctggtacactgtgtctttgttctaattggtttcaaagaacttatgtacttctgccttaatttcattatttatccagtagccattcaggagcaggttgttcagtttccatgtagttgtggggttttgagtgagtttcttaatcccgagttctaacttgattgcattgtggtctgagagactgtttgttttgatttccattcttttgcgtttactgaggag

SEQ ID NO: 135828 - DNA, 601 bp, Human
tttaacagcctcagagtaaaatggagcctattgtggaagactgagtgctggtggcatggggctcaaaggatttaccaagacagttgtaggtaaaggaaggcagaaaatttattaggaaaatatgttgccagagagacaacaggcagccagtggaagagaagctgactgccaggagagaaaggcttgctggagattttataggataaaatctatgctgtctgttgaagagggctttgtgtggtattgataacacaaaggttgcagtgagctaacttgcagatgtctactgatagctgggtayagaaatattatgaatgatttgagcaggaggactgtgtgtcccagactataaagaaaagcaagcttgttttctacctgcttcctctttttgctttctcctgctcccaccagccctactcttttttccgaattaagactccacagaacctgccttttatttcccctttgcaaagctactgttacatcattataaaagggacattccctctttttccagaaatattcctaagaaaagaaaaacagcctgttatataagagtgtctgaaaaaactagaactttcactcaaggtcggctttaatt

SEQ ID NO: 135829 - DNA, 601 bp, Human
gaaatctcctgccagggacacacttctgcataagcagaaaagctgctcctcacagacttggccgctgtcttggtgcattttggtcatcggtggctctcttttcctgtaaatgttttaacagcctcagagtaaaatggagcctattgtggaagactgagtgctggtggcatggggctcaaaggatttaccaagacagttgtaggtaaaggaaggcagaaaatttattaggaaaatatgttgccagagagacaacaggcagccagtggaagagaagctgactgccaggagagaaaggcttgckggagattttataggataaaatctatgctgtctgttgaagagggctttgtgtggtattgataacacaaaggttgcagtgagctaacttgcagatgtctactgatagctgggtacagaaatattatgaatgatttgagcaggaggactgtgtgtcccagactataaagaaaagcaagcttgttttctacctgcttcctctttttgctttctcctgctcccaccagccctactcttttttccgaattaagactccacagaacctgccttttatttcccctttgcaaagctactgttacatcat

SEQ ID NO: 135830 - DNA, 601 bp, Human
gtctctaatctgaggtagagatttgagcgatctctgcgaagttgaaaccctgcgttactgtctggggaattcacacctgggcaatttacacacacttactgattaacttcttcagttaacaattttgagcagattacctcagtatgcttcaattctacccaaataggtagcaaacaggtgtcaattgggagtcattatagtctctgaaatctctttacttatggcagtgctctaactcagagtcaaggtggaattgatccaagctcatttgttattcaaagtgagagtgagaattttctcmtgatagtaaagtcaagggacagaatctgagaataggaaagaatttctaaaactgacaacttacttgtaagaaagagctaatgtgccttcaaatgagattttttttcctgatttccattggagttctgcacccagattggctggctgtactgattccttatataacagaatacatagagggagggatggaacaggaggcccttggaggctggccaggctggaggtaaggaacacatcctgacccttttttccccacatagccatccattgccaaaaaaagttaaaatgtgcctgaggctgg

SEQ ID NO: 135831 - DNA, 601 bp, Human
tcagagcactctaacccatcaataggagaaaaggaatttaaaattgggtctctaatctgaggtagagatttgagcgatctctgcgaagttgaaaccctgcgttactgtctggggaattcacacctgggcaatttacacacacttactgattaacttcttcagttaacaattttgagcagattacctcagtatgcttcaattctacccaaataggtagcaaacaggtgtcaattgggagtcattatagtctctgaaatctctttacttatggcagtgctctaactcagagtcaaggtggaaytgatccaagctcatttgttattcaaagtgagagtgagaattttctcatgatagtaaagtcaagggacagaatctgagaataggaaagaatttctaaaactgacaacttacttgtaagaaagagctaatgtgccttcaaatgagattttttttcctgatttccattggagttctgcacccagattggctggctgtactgattccttatataacagaatacatagagggagggatggaacaggaggcccttggaggctggccaggctggaggtaaggaacacatcctgacccttttttcccc

SEQ ID NO: 135832 - DNA, 601 bp, Human
aacaacagcaaccaaataatggaaggggttatcacatttgaaatgtgttagggaatcacaattgaaaggtgttagggaatcacaaagacagagtcaggtttatcaaaaaatatgcatgtcaccctgctcctatcctggtttcccaacaagtgattgaagaggaaagaaaagataggaacaaacattgtttaatatgtaaatcagagcactctaacccatcaataggagaaaaggaatttaaaattgggtctctaatctgaggtagagatttgagcgatctctgcgaagttgaaaccctgcsttactgtctggggaattcacacctgggcaatttacacacacttactgattaacttcttcagttaacaattttgagcagattacctcagtatgcttcaattctacccaaataggtagcaaacaggtgtcaattgggagtcattatagtctctgaaatctctttacttatggcagtgctctaactcagagtcaaggtggaattgatccaagctcatttgttattcaaagtgagagtgagaattttctcatgatagtaaagtcaagggacagaatctgagaataggaaagaatttctaaaact

SEQ ID NO: 135833 - DNA, 601 bp, Human
gaaaaattttaaatctacctataacctggaagcccccatgcttcgacctgtcccacctttctggactgaaccaatgtatttcttaaatgtatttgattaaagtctcatgtctccttaaaatatataaaaccaagctgcaccccaacctcctcgggtatatgttcttgggatctcctgagccaagtgtcacaggcaatggtcactcatatttggctcagaataaatctcttcaaatattttatgaaatttgactcttttcattgacaatagctccaggatataaaaaatatatggctgtagsttactgttccaggacaagatatcagtgtggagccaagtcataaaaaatttgcatccagaaaatataatgaaagtaagttacattaaaaaaacaacagcaaccaaataatggaaggggttatcacatttgaaatgtgttagggaatcacaattgaaaggtgttagggaatcacaaagacagagtcaggtttatcaaaaaatatgcatgtcaccctgctcctatcctggtttcccaacaagtgattgaagaggaaagaaaagataggaacaaacattgtttaatatgtaaatcagagcactc

SEQ ID NO: 135834 - DNA, 601 bp, Human
ttctctctgaagcctgctacctggaagcttcatctgcataaaattttggtctctacaacttattgcaacccaggctttcctttctattaataataactctttcaaccaattaccagtcagaaaaattttaaatctacctataacctggaagcccccatgcttcgacctgtcccacctttctggactgaaccaatgtatttcttaaatgtatttgattaaagtctcatgtctccttaaaatatataaaaccaagctgcaccccaacctcctcgggtatatgttcttgggatctcctgagccmagtgtcacaggcaatggtcactcatatttggctcagaataaatctcttcaaatattttatgaaatttgactcttttcattgacaatagctccaggatataaaaaatatatggctgtagcttactgttccaggacaagatatcagtgtggagccaagtcataaaaaatttgcatccagaaaatataatgaaagtaagttacattaaaaaaacaacagcaaccaaataatggaaggggttatcacatttgaaatgtgttagggaatcacaattgaaaggtgttagggaatcacaaagacaga

SEQ ID NO: 135835 - DNA, 601 bp, Human
gatacctgcctttatgtcttctgttcaggtgttgtttcattttgttttgtttttaaacgaagtctccattgtgaccagaattcatgagatgtcttggatttcattggccctatgaataatttttcctgcactgtgataacttactgagtcctagggaggaaacagaattttacagctgacactggaataacccttgcccctttcaatactctcagtctgctgtggtatcagggtaacctatgctgaagacactgatgttggccacatctccatgaggaaactctgtgctcttagcaaccamtttaatcttctctcctaattgcaatgatctgaacagttgacttagtgctcccactggaattgttccagctcttgagtaccttcttcaagttaatgttgtgagctttagatttttaaacaaatgagagccctgggtcttctgcagtctcttcaagtggaattagaatttggaaacttttgaatagaagcacagatgagtttttgcattcctaccagctctttgggtgcagatctgtgggcagggtgctttccactaaccatggttgtgctgaattggacttccttgggttgtaacccttgt

SEQ ID NO: 135836 - DNA, 601 bp, Human
tttgctgcattcgaaattgtgatcttgcaatgtctacattaatcacatctttccttatgggagatacctgcctttatgtcttctgttcaggtgttgtttcattttgttttgtttttaaacgaagtctccattgtgaccagaattcatgagatgtcttggatttcattggccctatgaataatttttcctgcactgtgataacttactgagtcctagggaggaaacagaattttacagctgacactggaataacccttgcccctttcaatactctcagtctgctgtggtatcagggtaaccwatgctgaagacactgatgttggccacatctccatgaggaaactctgtgctcttagcaaccaatttaatcttctctcctaattgcaatgatctgaacagttgacttagtgctcccactggaattgttccagctcttgagtaccttcttcaagttaatgttgtgagctttagatttttaaacaaatgagagccctgggtcttctgcagtctcttcaagtggaattagaatttggaaacttttgaatagaagcacagatgagtttttgcattcctaccagctctttgggtgcagatctgtggg

SEQ ID NO: 135837 - DNA, 601 bp, Human
aagctgtaaccaatctagctgtttttgtagctcacttctgatttctgtacgtcattttactttttttgtctataaatttgttctgactacaaggcaaccctggtgtctttctgaatctgctgtgattctgggggctacccaattcatgaatcgttcgttgctcaattaaactcctttcaatttaatttggctgaagtttttcttttaacaaccttaatcctcaggaagggtttctaattctaaatgtaactacttagtgcaaagtgcaccaactggaaagaaaataaagataattaaagtrtcattgtcttctcaactaagttaaatgaatgaattttgcaaaggtctttgctgcattcgaaattgtgatcttgcaatgtctacattaatcacatctttccttatgggagatacctgcctttatgtcttctgttcaggtgttgtttcattttgttttgtttttaaacgaagtctccattgtgaccagaattcatgagatgtcttggatttcattggccctatgaataatttttcctgcactgtgataacttactgagtcctagggaggaaacagaattttacagctgacactggaataacc

SEQ ID NO: 135838 - DNA, 601 bp, Human
cgatctttggactccagggcttaaaccagaagcccttcggttctcaggactttggcctgggactgagaatttcattatccacttcccttattctgaggccttcagacttgaactgagccacactaccagcatcctagggtctccatatttattatatgtaattattatatatatttattacatctatatacatatatatactgattttgtcttgctggagaaccgtgagtagcacagtgaccaaagcggacagtggtaagttatattattattcctatttacagaagaaaatacagaagtrtagggagttattgaattgtggagccactgttggaatgcagaaaatctgactctgaatcctcagctcttacatgctcttgggacatgttttggtcaaaagaaccagaggtgatttctagactgatcaatgcttttccagtagagtcctgcctaaggaataaaaaagtcattctcttcagctgttatgcttcttcactgtaaagtcccatttgcttatgccagatgtgtttcataatgaatatattgagccctattttacttacacatgttctatcctagttttgtctccttgagaatttat

SEQ ID NO: 135839 - DNA, 601 bp, Human
tgggaatataaaatgatgtagcatagttgtaatggaaaacagtgtgatgttccttaaaaacttaaaaatagaattactatataatccaaaatttccacttctgggtatatatcccaaacaatttttcaaagcagggtttgaagaaatatttatataccatgtttataaaagctttctttactgtagccaaaaggtagaagtaatccaagtgctcatcaatggatggatgaatagataaataaaatgtagtgtatacatataatggaatattattaagccttatatgcattccattaaacayatcatggaatattattcagctttttacaatggagtattatttttcataatattattcagtaaaatgtggtatatacatataatgaaatgttattcaatcttattctgacacatgctgcaacatggatgaaccttgagtacattatgctaagtgaaataagccagtcacaaaatagcaaatactgtatgattgcacctatatgaagtatctagagtagtcaaattcataaaaacagatagtagaatagtggttgccagaggcttagggatggcaggagctggaaggagtggagagatgtta

SEQ ID NO: 135840 - DNA, 601 bp, Human
taaaaatggaagaaaatatttgcaaataatacatctaataaggggtaatggccagaatctataaggaacttctacaatcaacaacaaaaagcatttaacttaatttaaaaagggaaaagatttgaatagacatttatttaaagaagacatacaaatgaccaactagtatatttctatggtctgaatgttcctcctaaattcttatgctgaaatcctaacactgaagtgatggtattagaaggtaggcattttggcagcagattaaaccatgagggcagatccctcattaatgggattagcrcccttataaaagagaccccagagagccaactttccttccagcatgtgaggatacctcaagaagacaccatcatttgagccaagaaatgggccctcagtggattcagaatctgcaggggccttgatgttggactttccagcttccagaactgtaagaaataaatttctcttatttgtgaattaccaagttgatggtacttgttatagcagctctaacagactaaggcacatatggaaagatgctcaacctcactaactgttaggggatacaaatcaaaatcacaatgagatatcacttcac

SEQ ID NO: 135841 - DNA, 601 bp, Human
cctcctcagtcttttataactgagatcaggacaaggaagacaagcctaaggaaaaagagaaatgcagggggaaaaggcaggctgaactattggctgctctgcaatagaggctggagctctccaactccctccaggttgccctaaggacattccttcacgtaactgccactggtgtggcaatccaggccactagaagacaaactgccccggtgggataaatgggaaaaagccatgtgcagcttgccctctctgccacaagcttggccactggaatgagactgccccaagggctgaagggtcygaggaagggatcccaacctttgatggccttgagccaaaggggctctctgctatgactggcttccaaatcagaaagcatcatcaacagaacaaagccaagggcaactctggaggcagaaagtaacattgtacatttcccttttgggttcaagagctgcctactctgtgctaatatccttctctgagcaactctcctccaaatgctactgagtaatgggaaaaaatggcacctccttcatccaaaagaaaagattcgcacctctttggggaaaaatatactttcaagttggatgcctactta

SEQ ID NO: 135842 - DNA, 601 bp, Human
attgctgggacagacactaattggaactctggctctgtcggctacttatgacttaccatatgtttttgttcctgttatgccccagggacaagttttccagtggcccttgaagcaatctgtccacctgcataaggcctcactctgtggccccacttgctttttctgagttagcacccctttgggaggaggagatagtctttctttgtcatttgtgagttcttaccccaagctccaactcttctagaggttactactttatgtcaagagggcaaatagacattgccctcttgaatccaagggyttttggtttggggaacatacgaaggctttccatgagtgttcctctttcttcctcctatttcttcctgtagcctccatttctcaaatcactttcacacccttctcagtatgcttcaagacctttatggtcttatttgaagggtgggggaagtctagctcccttgtggcagttagctgaaaagcaggcttcttgtctacttgaacatgagaaatgggaatctgagaaaagaaataatcattttgttgataaaatgctctgagcaaaagttactataacatcatggagacaaggataggtcag

SEQ ID NO: 135843 - DNA, 601 bp, Human
actttgcatgccacataacttcttaaacacacactccttgttatttgggcacctgtggctcttgctgcatttgggtgggagcaaaaacatgggctaccttgtggatatcctctgagatttatgtttgtttttaccctaccagctcagatgacctccaacccttcccctgtctgctggcacattgctgggacagacactaattggaactctggctctgtcggctacttatgacttaccatatgtttttgttcctgttatgccccagggacaagttttccagtggcccttgaagcaatctgtycacctgcataaggcctcactctgtggccccacttgctttttctgagttagcacccctttgggaggaggagatagtctttctttgtcatttgtgagttcttaccccaagctccaactcttctagaggttactactttatgtcaagagggcaaatagacattgccctcttgaatccaagggcttttggtttggggaacatacgaaggctttccatgagtgttcctctttcttcctcctatttcttcctgtagcctccatttctcaaatcactttcacacccttctcagtatgcttcaagacc

SEQ ID NO: 135844 - DNA, 601 bp, Human
gtagacctgagacactaaacatcttcctggacaggaggcttatgagagtggtatggtgaaatcctgagaccatgcaatgtctggggtttcctctgctttttcacctaaaatcagctctttcccccaaaccttaattgcctattctcctgttttctctgtgtatattctgaaatgaccttgcatatctctgaccatctgccttgggggaagtctgactttttgctttcactttgcatgccacataacttcttaaacacacactccttgttatttgggcacctgtggctcttgctgcatttgsgtgggagcaaaaacatgggctaccttgtggatatcctctgagatttatgtttgtttttaccctaccagctcagatgacctccaacccttcccctgtctgctggcacattgctgggacagacactaattggaactctggctctgtcggctacttatgacttaccatatgtttttgttcctgttatgccccagggacaagttttccagtggcccttgaagcaatctgtccacctgcataaggcctcactctgtggccccacttgctttttctgagttagcacccctttgggaggaggagata

SEQ ID NO: 135845 - DNA, 601 bp, Human
agatattggataatagtctactcagggctgtgacacaggggtaaagaataaaataactccttcagttcaaaaattaacctttctttcttccagaaagtttgggcaagggaaaaaatggaagcatcagggcttccagataaccagtccatgggtctgaggcatgcacttgatctctcaagtcaccttctcggccctcttctaagtgtactttatttcctttcattcctgctttagagcttttaaataaacttttactcctgctctaaaacttgcctcagtctctcattctgccgtgtgcccytcagttgaattgtttattctgaggaggcaagaattgaggttgctacagactcatgtggatttgctgctggtaacatactttggtgccgtgacttggatacattctgctaataacataatttgttgctgcgtgattcagatatgttccccagttgtaagatactgcgatggctcaccttctttggctggaggtgttaaaccccagtacatggttctcttctccctttttgctctaatgctcactaaccaacccctagaattacttttctcagccgcaagtggctgttcctctgttcctcca

SEQ ID NO: 135846 - DNA, 601 bp, Human
gggtgataatcaggcaatctaggtagatatcaatataaactctcatataagaaagtaaaatcttgatggaatacaggattgacttaagatttggttataaaaagaaaattaacacagtacaggtttcaggtatgatgcattaagaaggctggaccatgtcctactgcctttaacaagtacagaactgtcaaaaaatgtataaagtaccaatttacagatattggataatagtctactcagggctgtgacacaggggtaaagaataaaataactccttcagttcaaaaattaacctttcttycttccagaaagtttgggcaagggaaaaaatggaagcatcagggcttccagataaccagtccatgggtctgaggcatgcacttgatctctcaagtcaccttctcggccctcttctaagtgtactttatttcctttcattcctgctttagagcttttaaataaacttttactcctgctctaaaacttgcctcagtctctcattctgccgtgtgcccctcagttgaattgtttattctgaggaggcaagaattgaggttgctacagactcatgtggatttgctgctggtaacatactttggtg

SEQ ID NO: 135847 - DNA, 601 bp, Human
tgttttataataacagtgaaagcaatttgacaaagggtaagattaggcaaccagattgttaaaatatataatatctgaaattattttactatcatggtaataggatttaggagaaagtttgtatcaattttcaataaaatgtttatagggtgataatcaggcaatctaggtagatatcaatataaactctcatataagaaagtaaaatcttgatggaatacaggattgacttaagatttggttataaaaagaaaattaacacagtacaggtttcaggtatgatgcattaagaaggctggaycatgtcctactgcctttaacaagtacagaactgtcaaaaaatgtataaagtaccaatttacagatattggataatagtctactcagggctgtgacacaggggtaaagaataaaataactccttcagttcaaaaattaacctttctttcttccagaaagtttgggcaagggaaaaaatggaagcatcagggcttccagataaccagtccatgggtctgaggcatgcacttgatctctcaagtcaccttctcggccctcttctaagtgtactttatttcctttcattcctgctttagagctt

SEQ ID NO: 135848 - DNA, 601 bp, Human
tggcaggctgtactgaatcctagtgcagctcaatacataaaggagggatgagtcagggggctgaagtcaagggacacattcttaccctttctctctctacatagctgtccactgcccaaaggacatgtcctgcttgaagctgggagtactttccttctctatgataaaaaaaatgaaggaaatgggcttcttccaatataaggttcagctctttctgagaaagagtcctttttacctatgaagaaaattctgcaaagggacagaattctttatagaaaagaaaagctgactctccacagasttggtgtatgtctttgtcatcatggccagtaggtggctgtcatcctctgtaaataactgaacagcctccagagtagaataaatcttgacatttcctttttctttagagaaagttacatcattttaacaaaagtattcattcatttccaaaatttttcaccaggagggaaaaaaaaagacctctgatatggatgtttatgaaaaacctagaactctcacttaacttttgcttttatttgatgactttgtgctcttaggggaaaactgacagccaaaaaccacaagggaacaggaagcagct

SEQ ID NO: 135849 - DNA, 601 bp, Human
ttcttcaaatacaccatttcacagatcactttaatgtttccccaattctacccaaattgatacttctactgggtatcatttggcaagaattgtatcttctgatccctttacagatctctgttctctctcttactactgagtgaaaatagaagggatgcaagttgagtcattattgaaaataacagagaatgttctccttattatgaatgtaagtgacatgatctaaggaatgaatttgtaaaattagcaacttactattaagaaagagctaatgtaccttcaaacaggagattttaatggmtgtccattacagttctacacccacattggcaggctgtactgaatcctagtgcagctcaatacataaaggagggatgagtcagggggctgaagtcaagggacacattcttaccctttctctctctacatagctgtccactgcccaaaggacatgtcctgcttgaagctgggagtactttccttctctatgataaaaaaaatgaaggaaatgggcttcttccaatataaggttcagctctttctgagaaagagtcctttttacctatgaagaaaattctgcaaagggacagaattctttata

SEQ ID NO: 135850 - DNA, 601 bp, Human
attctcatgacagtgtcttttgcaaagcaggagttttaattgtaataaaatccaatgtatcacttttttaaatgaatcatgcttttggtattttatctaaagttatcatcaaacactaggtcatctagatttccatgttttcaaaaggacacatttttgaaaaacatatcttcttttcttactaggtatgactcttacagttggtgccaatattcgtaatgcaaatcctagttatattcaggtataatgggtgtgggaatttcaattacaaaaccaacattatcttcatccttttcacagyaccatctcacctcagaatactgaggtttcacgtctctagtgacaccctctgttctgaagtgacaaaatgtagcttgattaatatgcatatagccatgtgtcctgacctccaactctccctgactcaaccccctttggtagggcatgggttaattctgtcagtaagatattcctttattgggtagtctcaagtgtccccaaaataatcccccaacattcttctcattgcctaagcactactcctatttaccaagtgtgaatataactgagaaagtagctaactgagaaagtagcgagatgt

SEQ ID NO: 135851 - DNA, 601 bp, Human
gattaaggaatggggaagaacagaagcaggaaagtagaacggatgtagatcaaaggcagcaaatgggcatgggctagaagaaaagtaatcattcctgaacaagggtgtgttttctgcttttctgaatacagccttcacagagagtcatgggacacacaccaaccgctagagtttatacacaaaaaaggcaaattttaaagactacagtatattatccacataatgggtaagtgttatttcccaagctctcccttaatgtatacataaactcaagaggtcaatgtttttcttatcatgtctyttagaagaaagaaaggaatcgataatttcaaaggacacttctcccaacttaataatgtgtgtgttttcaaatttttggattttagcctttctaatatgtatgtagtggtatcccattattgttttaatgtgcaattccctaataatgtgtgatgctgagcatattttcatatgttatttgccatctttgtatctagtttgattaggagtatattcagaggttttgcctaatttctaattgggttgtttgttttcttattgctgagttttaagtattctttgaatatatatatatatacat

SEQ ID NO: 135852 - DNA, 601 bp, Human
agaaattcctccaatcacagcacccatttgacataggtttgtaacgctgatcttatataccttgtgtgtatcttccatgaactcaatgtcagtacttttcatgtgatacacaagataacccaatggaaaaaaagtactaaggaataaggttttgtcagatagagttgagttttagagtgctaccaatcaccgaaatacccaagatttgtcaacacactcaaaaataacttttacacttttgggagcaatatcatactgaaggagtatatgtagttaagaaaaagccattaatttgattaarcaaatttttggccctaaaattcaaatttccaaaggacctgcagatgttccaattctagttgatttttatcaaactaaaggaaaccctttttgtcctaaatgtccataatgggatgtaaatgtgataacataaatgtgttgtacaattgtttcacatgcaggacaccagaaacctttatttctcattttcattttcatttttattgaaaacaaaggttgtcactttttgcatcctaaagaactgggacaaaagaaaccccaaaacaaatgtatatctaaatgtgataaaaatgtaaaaagg

SEQ ID NO: 135853 - DNA, 601 bp, Human
gccacctcagatgttatgactttgatgtctagtaaaccttagaaattcctccaatcacagcacccatttgacataggtttgtaacgctgatcttatataccttgtgtgtatcttccatgaactcaatgtcagtacttttcatgtgatacacaagataacccaatggaaaaaaagtactaaggaataaggttttgtcagatagagttgagttttagagtgctaccaatcaccgaaatacccaagatttgtcaacacactcaaaaataacttttacacttttgggagcaatatcatactgaakgagtatatgtagttaagaaaaagccattaatttgattaaacaaatttttggccctaaaattcaaatttccaaaggacctgcagatgttccaattctagttgatttttatcaaactaaaggaaaccctttttgtcctaaatgtccataatgggatgtaaatgtgataacataaatgtgttgtacaattgtttcacatgcaggacaccagaaacctttatttctcattttcattttcatttttattgaaaacaaaggttgtcactttttgcatcctaaagaactgggacaaaagaaacccca

SEQ ID NO: 135854 - DNA, 601 bp, Human
gctgcacctatcaacttgtcatctaggttttaagcacaatttttaaaaatcccatctatcattgatgggcatttgggttggttttgtgtctttgctattgtaaatagggctgcagtaaacatacacgtgcatgtattttcataatagaatgacatatatttctttgggtattactcaggaatgggattgctgggtcaaatgctatttctggttctagatccttgatgaattaccacagtcttccacaatggttgaagtaatttacattcccaccaacagtgtaaaagctttcctgtttttycacagcttcaccagcatctgttgtttcctgactttttaataatcaccattctgaggggcatgagatggtatctcattggtgttttgattttcctttctctaatgatcagtgatgttgagcttttttcatctttatgggccacataaatgtctccttttgagaaatgtctgttcatgttttgccactttttgatgtttttttttctaaatttgtttaagttctttttacattctggatattagacctctgtcaattggatagactgcaaaaattttctcccgttctgtaggttgcctgttc

SEQ ID NO: 135855 - DNA, 601 bp, Human
atacctgatgtgtaaattttgaattgggatttgcttaataattattaatctcgttttttcctcatttatacacaaccatctcctgctctctgaatttccttggttcatgttgtattttcagctgattttgaccaacttgctctctctctttctttcttttttttttttttgattttgctttaagttctggaatacatgtgcagaacctgtagatttgttacataggtatacatgtgccatggtggtttgctgcacctatcaacttgtcatctaggttttaagcacaatttttaaaaatccsatctatcattgatgggcatttgggttggttttgtgtctttgctattgtaaatagggctgcagtaaacatacacgtgcatgtattttcataatagaatgacatatatttctttgggtattactcaggaatgggattgctgggtcaaatgctatttctggttctagatccttgatgaattaccacagtcttccacaatggttgaagtaatttacattcccaccaacagtgtaaaagctttcctgtttttccacagcttcaccagcatctgttgtttcctgactttttaataatcaccattct

SEQ ID NO: 135856 - DNA, 601 bp, Human
agccaccatttcctgactaagtgtaagtaggactttgaaatgaggtgagacaatttttcagcctctttagaattcatgatagaattctgtttttttaggctgccaaaaaaatatatatgcaaccagaatggaatttcaatgtaaaataagttattgttatttatacctgatgtgtaaattttgaattgggatttgcttaataattattaatctcgttttttcctcatttatacacaaccatctcctgctctctgaatttccttggttcatgttgtattttcagctgattttgaccaacttkctctctctctttctttcttttttttttttttgattttgctttaagttctggaatacatgtgcagaacctgtagatttgttacataggtatacatgtgccatggtggtttgctgcacctatcaacttgtcatctaggttttaagcacaatttttaaaaatcccatctatcattgatgggcatttgggttggttttgtgtctttgctattgtaaatagggctgcagtaaacatacacgtgcatgtattttcataatagaatgacatatatttctttgggtattactcaggaatgggattgct

SEQ ID NO: 135857 - DNA, 601 bp, Human
ctgagagccaggaaacaaatgttccaggtgccagaatcagttaaccatcaacacgtgtattctgcacttcaatctagatgctgctcctctgtcaggtatttatagaagccaccatttcctgactaagtgtaagtaggactttgaaatgaggtgagacaatttttcagcctctttagaattcatgatagaattctgtttttttaggctgccaaaaaaatatatatgcaaccagaatggaatttcaatgtaaaataagttattgttatttatacctgatgtgtaaattttgaattgggatttscttaataattattaatctcgttttttcctcatttatacacaaccatctcctgctctctgaatttccttggttcatgttgtattttcagctgattttgaccaacttgctctctctctttctttcttttttttttttttgattttgctttaagttctggaatacatgtgcagaacctgtagatttgttacataggtatacatgtgccatggtggtttgctgcacctatcaacttgtcatctaggttttaagcacaatttttaaaaatcccatctatcattgatgggcatttgggttggtttt

SEQ ID NO: 135858 - DNA, 601 bp, Human
aaacctaaaccaaggaaactaagaatcacaatcaaaagagagaagagttgacagccaaatagccagtatgaaaaagaacctaacggacctagtagatgtacacactacaagaatttcacaatgcaatcacaagtattaacagcagaatagaccaagctgaggacagaatctcaggacttgaagactggctctctgaaataagacaatcagacaaaaataaagaaaaaagaatgaagagcaatgaacaaaacctccaagaaatagggggtggtataaagaggccaaatctaggaatcacttscatcctttaaagagacagggagaaaacaaacaacttggaaaatgtatttcaggatatagtctatgaaagcttccacaatcttgatagagagatcacaaatcaaattcccttgaagttctacacccagattgaccggctcttctcattcctagtctagcacaatccatagaggaagggataagttaggaggtcccggggaggctgggcaggctggaggaaagggacatatccagaccctttctctttccccatagctgtccattgccccaagaggacatgtcatgcctgaagctgggagta

SEQ ID NO: 135859 - DNA, 601 bp, Human
agtctctttattgattgaactcaagctacactcccatatgcagagatgagaaagaaccaatgcaagaactacagtaactcaaatggacagagcatcttatgtcctccaaataatcacactagttctccaacaagggttcttaaccaaaatgagttagctaaaatgacagaaatataattcagaatagggatagaaaggaattccattgagattcaggaaaacagtaaaacctaaaccaaggaaactaagaatcacaatcaaaagagagaagagttgacagccaaatagccagtatgaaaargaacctaacggacctagtagatgtacacactacaagaatttcacaatgcaatcacaagtattaacagcagaatagaccaagctgaggacagaatctcaggacttgaagactggctctctgaaataagacaatcagacaaaaataaagaaaaaagaatgaagagcaatgaacaaaacctccaagaaatagggggtggtataaagaggccaaatctaggaatcacttccatcctttaaagagacagggagaaaacaaacaacttggaaaatgtatttcaggatatagtctatgaaagcttcc

SEQ ID NO: 135860 - DNA, 601 bp, Human
atattgaatattattatgcaaagaattaactttcagagtggtcctgaactctggctctacttttttttttttttttgcataagtaggccctatagatactgaacccttaaatggaatgaagtctgctttagcaaatcagctatttagtaagtggagtttttactagtttctcattttttcttctactggaaagggttcaagaatgaagccattttgcttcctcatgcacatatttgctgggattataatagataatgacaaaaatttccattcagcttttactgagagtcaataatgcccrtttagtttactgctaaaaccactgggattccagtttttttaaagtgcatgtagatctggggattcaagttgcaagagcagcataatatcatcctttgcctagcactatattaactatttatgacttcatctctaatctgtcctctactttgtgataatagaaaataagtagcctggtgtcaaatacagagtcacatatctaaattcaaactctccaattcacacagtttataggaatcagacaatttactattcccaaaagtatggaataatagcctctctcccccaaataatcctacag

SEQ ID NO: 135861 - DNA, 509 bp, Human
tctgaaataagacagtcagacaaaaataaagaaaaaagaatgaagagcaatgaacaaaacatccaagaaataggggatggtataaacaggccaaatctaggaatcacttgcatcctttaaagagacagggagaaaacaaacaacttggaaaatgtatttcaggatatcatctatgaaaactaccacaaccttgatagagagaccaaaagtcaaagtcccttgaagttctacacccagattgaccagctgttctgattcctagtctagcacaatccatagaggaagggataagttaggaggycccggggaggctgggcaggctggaggaaagggacatatcctgaacctttctctttccccatagctgtccattgccccaagacgacatgtcatgcctgaagctgggagtattttctctgtctaagatacaaaagttaaggaaatgggctaattccagtactgtgatagttctttcttgggaagagcctctttttagctatgaagataaa

SEQ ID NO: 135862 - DNA, 601 bp, Human
ggggcaacagaaagcctgtctaccactgcctctgcagtggtactaccccagctaccttggaacttatgaaggagcagagaccccaagtgccttatccatacctccaacaagctgcagtcaacccaagagaagaggccagtctgtctcccattggtcaaccacccacccgtcacatcaccaggcagggaacccctgtcttgggcccacagcacagacacccccattccaggctgaaagcactgaatgattgctcacctgcatctctggggtggagcccccaggagacaagcaaaagaccctsagttaaaactactactaaggtctcttccttccatgcctccaaggtgaggagaaaacattaaccctgagatcaccccagaactgttgtgtgcagcctggtagtgccaagacaaaagctacagtcagcagtcaagtgggagaggagcccacactttcatagcattgagacggagcaggctgcaaccatgaggaaatgtatgggagccacatgactgagcaagagcctgacaactgaccactgcacctaagagtcacctactaggtcatgcccaaagcttcaacactaaaaaaatctcactaa

SEQ ID NO: 135863 - DNA, 601 bp, Human
catccctattcttcaggaggcagggcccccagcccatgactgcaaaacagtcaccctacacatggctgagcacatccactggtagttgcctggagtttccctggggagaggctcccagagccatcctacctctgccactgccacagcagcagttttatccatgctgccttgggtctggggaagaaacaaagagtctgaagctctttgtttacaagcttacagcacgccacagtcacctgaacttaaaacacgctgcagttaccatatggtgaggagaatagtctctactcctggtaagatwgtcgccttctgtttcccaaaatgtgaagccccaagcttacaccagcagtgcagccaccccacccctctggctaaacactcccattaacatggcttcacatttctagaaggtggagaccccaggggcaacagaaagcctgtctaccactgcctctgcagtggtactaccccagctaccttggaacttatgaaggagcagagaccccaagtgccttatccatacctccaacaagctgcagtcaacccaagagaagaggccagtctgtctcccattggtcaaccacccacccgtcacatcacc

SEQ ID NO: 135864 - DNA, 601 bp, Human
gcccctcttccctgagaatccccatccctattcttcaggaggcagggcccccagcccatgactgcaaaacagtcaccctacacatggctgagcacatccactggtagttgcctggagtttccctggggagaggctcccagagccatcctacctctgccactgccacagcagcagttttatccatgctgccttgggtctggggaagaaacaaagagtctgaagctctttgtttacaagcttacagcacgccacagtcacctgaacttaaaacacgctgcagttaccatatggtgaggagaayagtctctactcctggtaagattgtcgccttctgtttcccaaaatgtgaagccccaagcttacaccagcagtgcagccaccccacccctctggctaaacactcccattaacatggcttcacatttctagaaggtggagaccccaggggcaacagaaagcctgtctaccactgcctctgcagtggtactaccccagctaccttggaacttatgaaggagcagagaccccaagtgccttatccatacctccaacaagctgcagtcaacccaagagaagaggccagtctgtctcccattggtca

SEQ ID NO: 135865 - DNA, 601 bp, Human
accactactgttgcagtgggacagccccagcagccctctggctggggaaggaacaaagggcctagtcactacactctcacctccagcacatcatagccactgtatgaagaggagtccagcccctcttccctgagaatccccatccctattcttcaggaggcagggcccccagcccatgactgcaaaacagtcaccctacacatggctgagcacatccactggtagttgcctggagtttccctggggagaggctcccagagccatcctacctctgccactgccacagcagcagttttatccmtgctgccttgggtctggggaagaaacaaagagtctgaagctctttgtttacaagcttacagcacgccacagtcacctgaacttaaaacacgctgcagttaccatatggtgaggagaatagtctctactcctggtaagattgtcgccttctgtttcccaaaatgtgaagccccaagcttacaccagcagtgcagccaccccacccctctggctaaacactcccattaacatggcttcacatttctagaaggtggagaccccaggggcaacagaaagcctgtctaccactgcctctgcagtg

SEQ ID NO: 135866 - DNA, 601 bp, Human
ctccagcacaggcacccttcccctgcctcatctcctcaatcaggcagtccagcatttctccaaggaagaaatcccacagtcaacccacaacccatccaccactactgttgcagtgggacagccccagcagccctctggctggggaaggaacaaagggcctagtcactacactctcacctccagcacatcatagccactgtatgaagaggagtccagcccctcttccctgagaatccccatccctattcttcaggaggcagggcccccagcccatgactgcaaaacagtcaccctacacatrgctgagcacatccactggtagttgcctggagtttccctggggagaggctcccagagccatcctacctctgccactgccacagcagcagttttatccatgctgccttgggtctggggaagaaacaaagagtctgaagctctttgtttacaagcttacagcacgccacagtcacctgaacttaaaacacgctgcagttaccatatggtgaggagaatagtctctactcctggtaagattgtcgccttctgtttcccaaaatgtgaagccccaagcttacaccagcagtgcagccaccccacc

SEQ ID NO: 135867 - DNA, 601 bp, Human
gagtctccagcacaggcacccttcccctgcctcatctcctcaatcaggcagtccagcatttctccaaggaagaaatcccacagtcaacccacaacccatccaccactactgttgcagtgggacagccccagcagccctctggctggggaaggaacaaagggcctagtcactacactctcacctccagcacatcatagccactgtatgaagaggagtccagcccctcttccctgagaatccccatccctattcttcaggaggcagggcccccagcccatgactgcaaaacagtcaccctacmcatggctgagcacatccactggtagttgcctggagtttccctggggagaggctcccagagccatcctacctctgccactgccacagcagcagttttatccatgctgccttgggtctggggaagaaacaaagagtctgaagctctttgtttacaagcttacagcacgccacagtcacctgaacttaaaacacgctgcagttaccatatggtgaggagaatagtctctactcctggtaagattgtcgccttctgtttcccaaaatgtgaagccccaagcttacaccagcagtgcagccaccc

SEQ ID NO: 135868 - DNA, 601 bp, Human
tttcttcacctgattccctgatgctgcttctcctcagtgggcggcatatccccaccggggtctccagccacctcgcgcaggtatgttccagcaggcaacaggttgtacctctctggaacagagctcccagagggaggggcaggcccccatcttcactgtttcgtagccttcactgttgataccttgaggaactgaaaaatgcgaggtgactatggtctggattggacccctagcgtattgcagcagccctgtggaaaagtggtcagactgtgtgttatgttggtccgtgatcccctatctsctcactgggtgggtctgccaggcctggaactgcagccaccagcagggactatcgagccaatagcagctctgcaactccctagaacagagttcccagtgagaagggtgggtttccatctttgctatctcacagctcttgcccttgctgtctccagactctggagagtttgcagggaacagtggctggtccagatccctagcacagagcaactaactcacagaagagtggacagactgttctccatgctgttcctggttgtcacctcgccacaatgtgcagggccacctgaccagagtctcc

SEQ ID NO: 135869 - DNA, 601 bp, Human
gtttcttcacctgattccctgatgctgcttctcctcagtgggcggcatatccccaccggggtctccagccacctcgcgcaggtatgttccagcaggcaacaggttgtacctctctggaacagagctcccagagggaggggcaggcccccatcttcactgtttcgtagccttcactgttgataccttgaggaactgaaaaatgcgaggtgactatggtctggattggacccctagcgtattgcagcagccctgtggaaaagtggtcagactgtgtgttatgttggtccgtgatcccctatcwgctcactgggtgggtctgccaggcctggaactgcagccaccagcagggactatcgagccaatagcagctctgcaactccctagaacagagttcccagtgagaagggtgggtttccatctttgctatctcacagctcttgcccttgctgtctccagactctggagagtttgcagggaacagtggctggtccagatccctagcacagagcaactaactcacagaagagtggacagactgttctccatgctgttcctggttgtcacctcgccacaatgtgcagggccacctgaccagagtctc

SEQ ID NO: 135870 - DNA, 601 bp, Human
actgtttcttcacctgattccctgatgctgcttctcctcagtgggcggcatatccccaccggggtctccagccacctcgcgcaggtatgttccagcaggcaacaggttgtacctctctggaacagagctcccagagggaggggcaggcccccatcttcactgtttcgtagccttcactgttgataccttgaggaactgaaaaatgcgaggtgactatggtctggattggacccctagcgtattgcagcagccctgtggaaaagtggtcagactgtgtgttatgttggtccgtgatcccctrtctgctcactgggtgggtctgccaggcctggaactgcagccaccagcagggactatcgagccaatagcagctctgcaactccctagaacagagttcccagtgagaagggtgggtttccatctttgctatctcacagctcttgcccttgctgtctccagactctggagagtttgcagggaacagtggctggtccagatccctagcacagagcaactaactcacagaagagtggacagactgttctccatgctgttcctggttgtcacctcgccacaatgtgcagggccacctgaccagagt

SEQ ID NO: 135871 - DNA, 601 bp, Human
cattcttgcaaatgccattcttttgtgctgggggtggtagcagacccccagcacagcacagctgctctaccaaaaagtggccagactgtttcttcacctgattccctgatgctgcttctcctcagtgggcggcatatccccaccggggtctccagccacctcgcgcaggtatgttccagcaggcaacaggttgtacctctctggaacagagctcccagagggaggggcaggcccccatcttcactgtttcgtagccttcactgttgataccttgaggaactgaaaaatgcgaggtgactawggtctggattggacccctagcgtattgcagcagccctgtggaaaagtggtcagactgtgtgttatgttggtccgtgatcccctatctgctcactgggtgggtctgccaggcctggaactgcagccaccagcagggactatcgagccaatagcagctctgcaactccctagaacagagttcccagtgagaagggtgggtttccatctttgctatctcacagctcttgcccttgctgtctccagactctggagagtttgcagggaacagtggctggtccagatccctagcacagagcaacta

SEQ ID NO: 135872 - DNA, 601 bp, Human
attcacgtcaatcccaaatcctgtttcttttcaccaggtgaaatctctccactggggtctccagtcacctccaccactgttttctggcagacagcagtttcaaatgtccctgggatggcgctcccaaagggaagggtgggttgccattgatgctgtttagcagccttagccattcttgcaaatgccattcttttgtgctgggggtggtagcagacccccagcacagcacagctgctctaccaaaaagtggccagactgtttcttcacctgattccctgatgctgcttctcctcagtgggcrgcatatccccaccggggtctccagccacctcgcgcaggtatgttccagcaggcaacaggttgtacctctctggaacagagctcccagagggaggggcaggcccccatcttcactgtttcgtagccttcactgttgataccttgaggaactgaaaaatgcgaggtgactatggtctggattggacccctagcgtattgcagcagccctgtggaaaagtggtcagactgtgtgttatgttggtccgtgatcccctatctgctcactgggtgggtctgccaggcctggaactgcagccaccag

SEQ ID NO: 135873 - DNA, 601 bp, Human
ctagggagtccaaggcagctagggactggagcagccaccctgcacagcccagcagctctacagagaagcagtcagactgcttattcacgtcaatcccaaatcctgtttcttttcaccaggtgaaatctctccactggggtctccagtcacctccaccactgttttctggcagacagcagtttcaaatgtccctgggatggcgctcccaaagggaagggtgggttgccattgatgctgtttagcagccttagccattcttgcaaatgccattcttttgtgctgggggtggtagcagacccccagcacagcacagctgctctaccaaaaagtggccagactgtttcttcacctgattccctgatgctgcttctcctcagtgggcggcatatccccaccggggtctccagccacctcgcgcaggtatgttccagcaggcaacaggttgtacctctctggaacagagctcccagagggaggggcaggcccccatcttcactgtttcgtagccttcactgttgataccttgaggaactgaaaaatgcgaggtgactatggtctggattggacccctagcgtattgcagcagccctgtggaaaagtg

SEQ ID NO: 135874 - DNA, 601 bp, Human
acatggagctcccagcggcagggtgtgggctgccatctttactgtttcacagccttagctattggagcctctgggttctagggagtccaaggcagctagggactggagcagccaccctgcacagcccagcagctctacagagaagcagtcagactgcttattcacgtcaatcccaaatcctgtttcttttcaccaggtgaaatctctccactggggtctccagtcacctccaccactgttttctggcagacagcagtttcaaatgtccctgggatggcgctcccaaagggaagggtgggtygccattgatgctgtttagcagccttagccattcttgcaaatgccattcttttgtgctgggggtggtagcagacccccagcacagcacagctgctctaccaaaaagtggccagactgtttcttcacctgattccctgatgctgcttctcctcagtgggcggcatatccccaccggggtctccagccacctcgcgcaggtatgttccagcaggcaacaggttgtacctctctggaacagagctcccagagggaggggcaggcccccatcttcactgtttcgtagccttcactgttgatacct

SEQ ID NO: 135875 - DNA, 601 bp, Human
caggagggtcatgttccaggcagcagaggagcactctgtggggaagaggctgaagatctgctgaagcatctcatggaggacagacagggccggggccttctgcaactgactgccatccacatctccagggggaacctgaagtctcttctgtccttgagacacaagaaagtggagattctgcacatttggcccagaagtgccaaggtgttcctgctaagtaggccatggttctgaggcaggtcccagctcagagatccaacagggccacagtggcaaagcggcagggccacgagtagaggargcaggaggaccattgggaaacgagggtgctgctggcctagctgagctggggtctggatgaaccttggacttcaggttctctgaaggcattcctgctatgcatggctcttagttggaaaaaaatagctttcagggttggtcaagatggccaacgagaagctgctagtgtgtgccactctcaagtagagaaatggaaggggcaagtacatacagcaccttcaactgaaacatccaggtacacacattgggactcaagaaaacaacttgaccagtggagaacagagtaaagcaaggcaggatg

SEQ ID NO: 135876 - DNA, 601 bp, Human
actgaccactcctcctaagtgctctttgaccttcacagactctccttctctgccctaccaatgactgttgaggatctgcaggactaagtttagatcctgtctcatcgttccctcaatttataactatgttaggtgacagattccctaatatccattctcatgtcctcaataccagacatgcagtaaagaatcccaaattaatacctttgcccatggcatttgttgttcattctagacccatattcccagctgccaataagattctggaaatactgtttcccttggtatctgtgggattttkgttctaagactccacacctgtcctccagatacccaaatctgtgaaaactcaagtcctgcagtccccttcatatatgcgagtttcacatcccacaaatgctgtattttctatccagtttagttttacatgcagaaaatacagatatggaaggtgaactgtattggaaaaaaaaaaacctgtataagtggacccatgcagttcagaagttcaatcccatgctgttcaagggctacctgtacatataccccaagtaccttaagaaggacatctaacattgttttccctgcctggcatcatttg

SEQ ID NO: 135877 - DNA, 601 bp, Human
acaagtttcccaccataattttttatgcatagaacacccaaatacccttattgtatttcttcttcaacccactcccatcaagtttctgtcccattcattttactaaacctagatccacctaaggtcactgatggcatctgtttttgagtccgttaggacaggtcagccttcatcttccctgaaaacaccactgtctacccctcgcttgtctctccctcattctttgctatttctccttccagctgcactgaccactcctcctaagtgctctttgaccttcacagactctccttctctgccytaccaatgactgttgaggatctgcaggactaagtttagatcctgtctcatcgttccctcaatttataactatgttaggtgacagattccctaatatccattctcatgtcctcaataccagacatgcagtaaagaatcccaaattaatacctttgcccatggcatttgttgttcattctagacccatattcccagctgccaataagattctggaaatactgtttcccttggtatctgtgggatttttgttctaagactccacacctgtcctccagatacccaaatctgtgaaaactcaagt

SEQ ID NO: 135878 - DNA, 601 bp, Human
aaattgtaaaacttaattgaaaaaagaatttaaattagcaagtaaatgggttactattgaaatttactaccaggtagtattaattagaataatgataaattacctctcagccaaataaataagcaacattttaaataaaaaatacaattaataggttaaataaatgaaatattaaagatgttcagtacagcatggaataataatgcattgtatacttgaaatttgctaagggagtagatattatatgttctcaccatgcacaataaaatattataactatgttaggtgaaggatgtgttatcttgattgtcagaatcattacaacaaggcataattaaagcaaaacactatgttgtacaccttaaatccataaattttaatttctcaactatatatcaacaaaaaatgtttaaagattttgttcgaattcatctattctttgaaaatgattttcagaaaacactaacaaaatatgcatgaagatcttaacccacattcttctacaagtatcatcttatttccctactccacaaacaagtttcccaccataattttttatgcatagaacacccaaatacccttattgtatttcttcttcaac

SEQ ID NO: 135879 - DNA, 601 bp, Human
tacatggtagaagcatatcactaaatagcagcctacactcaagtctctaatctagtttccctcattcatttttatgttatcttacattcttggtgatatcatgtaattagccattttaggattcacaaatgtttatgatttcctgaagccagtgctctctatcttagaacaactctaaatttaatcaggaaataatgcaagcaataatattaaaatgtataaagggattcttgaacttaggtagctcaatcagaagaattaaatgagttttaaaatatcagaagtaatataagtgtagcartttgtaagtttagcaaccatattaatacagaaaaaaaaaacagaaaaagttgtattatcagaattaacgagatttacggtagagctgcatctattgttaataacaaagaaaataaaattgcaatagaatgttgtgcaataattgcttgtcactctaacaaaaattaatttggattctcatagcatattaaaaaaactctaatatattacataattaaatgtaaaaacatatttacaagaacagaaactgaatatgtgtaaatcaaaagacttaaggaggcatgtggctctatgttctaga

SEQ ID NO: 135880 - DNA, 601 bp, Human
tgtaatgaatcaaaacaaagaaatgaacattggggccatattactaactttcagattttactaagatttcctcagatttttaaaaactgatgttttatcttatttcaagaatcagtccaaattgattcttgatttggattgatttttgtcaatccaaattgttggattgttgtcataccttcagtctcctccaatctgtaacgcatgctcagtctttctttggctttcatgacattgaaacttttgaagaatattggtcacttatttcatagactgttcaccaatttggatttgtctaatktttactcaggattatgctgaggttgtatgtttaaagggttgaaaccacagagtttatctgatcgtctcatcacacaatatccaaggtacatgatattgatatcttttattacatatcttttattactgctgatgttaacttaatcacttggttaagatggtgtttgccagacttctgtcctataaagttactatttttgccctctacacactacatggtagaagcatatcactaaatagcagcctacactcaagtctctaatctagtttccctcattcatttttatgttatcttacattc

SEQ ID NO: 135881 - DNA, 601 bp, Human
tttagacagttacattatagatagaattttctgtcttctgaaaaaaattaggaatctaatgaatgatttaaatcaactaaatacataaacaaattttaaaccagtaaggtctagaatcttgaaaatctattcatttttaactttttactttcaaacaattttagatttacaaagaattgcaaagatactataaaattttgcttatgcccttaacccagcttcttctcatgttaacaacatacatgaccatgttgtaatgaatcaaaacaaagaaatgaacattggggccatattactaacattcagattttactaagatttcctcagatttttaaaaactgatgttttatcttatttcaagaatcagtccaaattgattcttgatttggattgatttttgtcaatccaaattgttggattgttgtcataccttcagtctcctccaatctgtaacgcatgctcagtctttctttggctttcatgacattgaaacttttgaagaatattggtcacttatttcatagactgttcaccaatttggatttgtctaatgtttactcaggattatgctgaggttgtatgtttaaagggttgaaaccac

SEQ ID NO: 135882 - DNA, 601 bp, Human
tccgccaccatgcctggctagtttttttgtttttttagtagcgatggggtttcaccatgttagccaggatgatcttcatctcctgacctcgtgatctgcccacatcggcctcccaaagtgctgggattacaggcatgagccaccgcgcctggcctagaatactttttaaaaatgagattcaaagatacatttttacatccatcttcataacaatagccaaaagttggaagcaacccaagtgtccattgatggatgaataaacaaactgtgatatatacatataatggaatatcattcagcstcatatatatttcattaagcatataatggactatattattcagtcttataccatggatgattattctgacttatcatattattcaggaaaatgtggtatatacagataatggaatgtattcagcataattctgacatatactacagcgtgaggacctaatgtaagccaggcacaaacagacaaatgtaatatgatttcaatcatatgagttatctagagtagataaattcatagaaacagaaagtaaaacggttgtcaggggtgggggtccaggggagaggagataaggagctgttgttt

SEQ ID NO: 135883 - DNA, 601 bp, Human
caaaaaagatatacaaatggccaacaagcatatttctctggcctgaatgtttgtgccctgccaaaattcatatgttgaaaccctaactcttagggcgatggtgttaggacatgcgcctttttgggatgtgattaattccattgtggctcattgtgaaataggacacgggccacaatcacacaccaaatctgctggtaccttgattcttgggctttccaccctccagaactgtgagaaataaatttatgttatttataaactacctaattgatgatatttcattatagcaacctgaatgaamtaaggaacataggaaaagatcctcaacatcactattagggaaatgcaaatcaaagtcacaatgagatttgaattcacatctatcaaggtggctaccatcaaaataaataaaataacaagtgttggtgaagatgtggagaaattggaacccttgtgcactgttggtggaaatgtaaaatggtgcagcgcagccacaatggaaaacaggtatctcaaaaaattaaaaacagaattaccatataatctaggaattccacttatggatatatatttagaatcctttttgttttgttttgttttg

SEQ ID NO: 135884 - DNA, 601 bp, Human
gaactcccatatctcaacaaaaaaatataacttgagtaaggaatatgaatagatatttattcaaaaaagatatacaaatggccaacaagcatatttctctggcctgaatgtttgtgccctgccaaaattcatatgttgaaaccctaactcttagggcgatggtgttaggacatgcgcctttttgggatgtgattaattccattgtggctcattgtgaaataggacacgggccacaatcacacaccaaatctgctggtaccttgattcttgggctttccaccctccagaactgtgagaaatraatttatgttatttataaactacctaattgatgatatttcattatagcaacctgaatgaactaaggaacataggaaaagatcctcaacatcactattagggaaatgcaaatcaaagtcacaatgagatttgaattcacatctatcaaggtggctaccatcaaaataaataaaataacaagtgttggtgaagatgtggagaaattggaacccttgtgcactgttggtggaaatgtaaaatggtgcagcgcagccacaatggaaaacaggtatctcaaaaaattaaaaacagaattaccata

SEQ ID NO: 135885 - DNA, 601 bp, Human
caagaccaaatcatgaataaacaaaaaatctgactagacctataactagtaaggagattgaatcagtcaccaaacttcccaataacaacaacaataaaaaaccataatcagatggcttcagtggataattctatcaaacatttagggaattaacaccaatctttctcaaaatcttccaaaaaattgaaaaggaaggaatagtttcaaactcattttatgagactagcattttcctgataacaaagccagacaaggacactacaagaaaagaaaactaacagatccatatccatgataaatrttgatacaaaaatcctcactaaaatacttgtaaaccaaattcaacagcacaataaaaggattatagatcacgaccaaaggggatttattacttggatggaagaatgtttcaacatatgaaaattaatcaatgcaatacatcacattaacaaaatgaatgaaaaatatacataataatctctacagatacggaaaaagaaatagacaaaatgccatatcttttcatgataaaaacatttaacaaacttggaataaaaggaagttacctccacataataaaggccatgtacgaaaagcccac

SEQ ID NO: 135886 - DNA, 601 bp, Human
tactcaggaggctgtggcaggagataggtctgaacccgggaggcggagcttgcagtgagccaagatcgcgccactgcactccaacctgggcgacagagcaagacttcatctcaaaaaaaaaaaaaaaaaaaaaagtaaaatggattataacagactactacgaacaattatactccaacaaattgattaacttagaagaaatatataaattcctagaaacaaacaacttaccaagaccaaatcatgaataaacaaaaaatctgactagacctataactagtaaggagattgaatcagtcaycaaacttcccaataacaacaacaataaaaaaccataatcagatggcttcagtggataattctatcaaacatttagggaattaacaccaatctttctcaaaatcttccaaaaaattgaaaaggaaggaatagtttcaaactcattttatgagactagcattttcctgataacaaagccagacaaggacactacaagaaaagaaaactaacagatccatatccatgataaatattgatacaaaaatcctcactaaaatacttgtaaaccaaattcaacagcacaataaaaggattatagatc

SEQ ID NO: 135887 - DNA, 601 bp, Human
attaaaatattctacattgtgaaatgtgcacaggggtttccataatagaggaggtttcatttcagaaatgtatattttctacatcaatttagtagttgatccagtcagcaaatttgtattgaattttgggctcatcctttgtatcagaccctgagaataaagggcaattttgcccaagttattattcttagtctttgaaacactgggggagagagtaatttttctttgttcacttgagatcgtattgggaatttttgcatattaattttcatgtagtattttactgtgaaaatttgttttyctatactttgatttcattttcatattcaggttagtgtcaatgaaagagtataaatataatgtttaaatggactatacaattgttctatgtggcattcacaacaacaaatacattcatatttctcacttcacttttcctagaaggtagaagtggtctgatttttcatcttaatttatgggaacaaaaagaaaacaaacatatgtctaaatgtgataaacatggaagaggagaaatacctaatgtaaatgacacattaatgggtgcagcaaaccaacatggcacatgtacacctatgtaaca

SEQ ID NO: 135888 - DNA, 601 bp, Human
aatattatcaattaaatcatttttggcatttttcattgaagttcacattccctaaaggttttcagaagttcctatccaagtcaattcttatgaaaaaagagaccatctttgttctaaattcataaatttataaatattgaatattatcatgtaaagaattaactttcagagtggtcctgaactctgggtctacttttttttttttttttttgcataagaagttagtttgcctctgccctatagatactgagtccttaaatggaatgaggtctgttttagcaaatcagctatttagtaagtrgagtttttctagtttctcattttttcttctactggaaagtgttcaagaatgaggctatttttcttcatcatggccatatttgctgcaattataagacaatgacaaaaatttccattcagcttttactcagaatcaataatgcccattaagtttactgctaaaaccagtgggattctggggattcaagttgcaagagcagcataatattatcctttgcctggcactatattaactatttatgaccttatctctaatctgtcctctactttgttataatagaaaataactagcctggtgtca

SEQ ID NO: 135889 - DNA, 601 bp, Human
ataaatattgatgtgttgaataactttagtagaaataaatcacataatataagctatttgcattgaattctcaaagtctacaaaacatcctgaagaactgaggatcaaacataagcaataaccataagatagtcaatgacagcccaaagatatgcaggttaaagccacatattgtgataagactttaagatccagcaaaaaaaaaatggacaaaaagtcctccaatcacagtcatctatttgccataggtttgtaacactgatcttgctaatattttgtttatcttcatgaactcaatacmgtgcttctcatatcatacacaagaaaacccaatgagaaagatgtatattaagcaatgaaattttgttggatagagttgttggagaatcacaaactattgtaatatgtgagatttgtttatactatgagaactaatttttgtactcttagaagaagtatcattctaataaatatatgtgacttagaaaatattatcaattaaatcatttttggcatttttcattgaagttcacattccctaaaggttttcagaagttcctatccaagtcaattcttatgaaaaaagagaccatctttgttc

SEQ ID NO: 135890 - DNA, 601 bp, Human; identical to SEQ ID NO: 135773

SEQ ID NO: 135891 - DNA, 601 bp, Human; identical to SEQ ID NO: 135774

SEQ ID NO: 135892 - DNA, 601 bp, Human; identical to SEQ ID NO: 135775

SEQ ID NO: 135893 - DNA, 601 bp, Human; identical to SEQ ID NO: 135776

SEQ ID NO: 135894 - DNA, 601 bp, Human; identical to SEQ ID NO: 135777

SEQ ID NO: 135895 - DNA, 601 bp, Human; identical to SEQ ID NO: 135778

SEQ ID NO: 135896 - DNA, 601 bp, Human; identical to SEQ ID NO: 93207

SEQ ID NO: 135897 - DNA, 601 bp, Human; identical to SEQ ID NO: 135780

SEQ ID NO: 135898 - DNA, 601 bp, Human; identical to SEQ ID NO: 135781

SEQ ID NO: 135899 - DNA, 601 bp, Human; identical to SEQ ID NO: 135782

SEQ ID NO: 135900 - DNA, 601 bp, Human; identical to SEQ ID NO: 135783

SEQ ID NO: 135901 - DNA, 601 bp, Human; identical to SEQ ID NO: 135784

SEQ ID NO: 135902 - DNA, 601 bp, Human; identical to SEQ ID NO: 135785

SEQ ID NO: 135903 - DNA, 601 bp, Human; identical to SEQ ID NO: 135786

SEQ ID NO: 135904 - DNA, 601 bp, Human; identical to SEQ ID NO: 135787

SEQ ID NO: 135905 - DNA, 601 bp, Human; identical to SEQ ID NO: 135788

SEQ ID NO: 135906 - DNA, 529 bp, Human; identical to SEQ ID NO: 135789

SEQ ID NO: 135907 - DNA, 601 bp, Human; identical to SEQ ID NO: 135790

SEQ ID NO: 135908 - DNA, 601 bp, Human; identical to SEQ ID NO: 135791

SEQ ID NO: 135909 - DNA, 601 bp, Human; identical to SEQ ID NO: 135792

SEQ ID NO: 135910 - DNA, 601 bp, Human; identical to SEQ ID NO: 135793

SEQ ID NO: 135911 - DNA, 601 bp, Human; identical to SEQ ID NO: 135794

SEQ ID NO: 135912 - DNA, 601 bp, Human; identical to SEQ ID NO: 135795

SEQ ID NO: 135913 - DNA, 601 bp, Human; identical to SEQ ID NO: 135796

SEQ ID NO: 135914 - DNA, 601 bp, Human; identical to SEQ ID NO: 135797

SEQ ID NO: 135915 - DNA, 601 bp, Human; identical to SEQ ID NO: 135798

SEQ ID NO: 135916 - DNA, 601 bp, Human; identical to SEQ ID NO: 135799

SEQ ID NO: 135917 - DNA, 601 bp, Human; identical to SEQ ID NO: 93208

SEQ ID NO: 135918 - DNA, 601 bp, Human; identical to SEQ ID NO: 135801

SEQ ID NO: 135919 - DNA, 601 bp, Human; identical to SEQ ID NO: 135802

SEQ ID NO: 135920 - DNA, 601 bp, Human; identical to SEQ ID NO: 135803

SEQ ID NO: 135921 - DNA, 601 bp, Human; identical to SEQ ID NO: 135804

SEQ ID NO: 135922 - DNA, 601 bp, Human; identical to SEQ ID NO: 135805

SEQ ID NO: 135923 - DNA, 601 bp, Human; identical to SEQ ID NO: 135806

SEQ ID NO: 135924 - DNA, 601 bp, Human; identical to SEQ ID NO: 135807

SEQ ID NO: 135925 - DNA, 601 bp, Human; identical to SEQ ID NO: 135808

SEQ ID NO: 135926 - DNA, 601 bp, Human; identical to SEQ ID NO: 135809

SEQ ID NO: 135927 - DNA, 601 bp, Human; identical to SEQ ID NO: 135810

SEQ ID NO: 135928 - DNA, 601 bp, Human; identical to SEQ ID NO: 135811

SEQ ID NO: 135929 - DNA, 601 bp, Human; identical to SEQ ID NO: 135812

SEQ ID NO: 135930 - DNA, 601 bp, Human; identical to SEQ ID NO: 135813

SEQ ID NO: 135931 - DNA, 601 bp, Human; identical to SEQ ID NO: 135814

SEQ ID NO: 135932 - DNA, 601 bp, Human; identical to SEQ ID NO: 135815

SEQ ID NO: 135933 - DNA, 601 bp, Human; identical to SEQ ID NO: 135816

SEQ ID NO: 135934 - DNA, 601 bp, Human; identical to SEQ ID NO: 135817

SEQ ID NO: 135935 - DNA, 601 bp, Human; identical to SEQ ID NO: 135818

SEQ ID NO: 135936 - DNA, 601 bp, Human; identical to SEQ ID NO: 135819

SEQ ID NO: 135937 - DNA, 601 bp, Human; identical to SEQ ID NO: 135820

SEQ ID NO: 135938 - DNA, 601 bp, Human; identical to SEQ ID NO: 135821

SEQ ID NO: 135939 - DNA, 601 bp, Human; identical to SEQ ID NO: 135822

SEQ ID NO: 135940 - DNA, 601 bp, Human; identical to SEQ ID NO: 135823

SEQ ID NO: 135941 - DNA, 601 bp, Human; identical to SEQ ID NO: 135824

SEQ ID NO: 135942 - DNA, 601 bp, Human; identical to SEQ ID NO: 135825

SEQ ID NO: 135943 - DNA, 601 bp, Human; identical to SEQ ID NO: 135826

SEQ ID NO: 135944 - DNA, 601 bp, Human; identical to SEQ ID NO: 135827

SEQ ID NO: 135945 - DNA, 601 bp, Human; identical to SEQ ID NO: 135828

SEQ ID NO: 135946 - DNA, 601 bp, Human; identical to SEQ ID NO: 135829

SEQ ID NO: 135947 - DNA, 601 bp, Human; identical to SEQ ID NO: 135830

SEQ ID NO: 135948 - DNA, 601 bp, Human; identical to SEQ ID NO: 135831

SEQ ID NO: 135949 - DNA, 601 bp, Human; identical to SEQ ID NO: 135832

SEQ ID NO: 135950 - DNA, 601 bp, Human; identical to SEQ ID NO: 135833

SEQ ID NO: 135951 - DNA, 601 bp, Human; identical to SEQ ID NO: 135834

SEQ ID NO: 135952 - DNA, 601 bp, Human; identical to SEQ ID NO: 135835

SEQ ID NO: 135953 - DNA, 601 bp, Human; identical to SEQ ID NO: 135836

SEQ ID NO: 135954 - DNA, 601 bp, Human; identical to SEQ ID NO: 135837

SEQ ID NO: 135955 - DNA, 601 bp, Human; identical to SEQ ID NO: 135838

SEQ ID NO: 135956 - DNA, 601 bp, Human; identical to SEQ ID NO: 135839

SEQ ID NO: 135957 - DNA, 601 bp, Human; identical to SEQ ID NO: 135840

SEQ ID NO: 135958 - DNA, 601 bp, Human; identical to SEQ ID NO: 135841

SEQ ID NO: 135959 - DNA, 601 bp, Human; identical to SEQ ID NO: 135842

SEQ ID NO: 135960 - DNA, 601 bp, Human; identical to SEQ ID NO: 135843

SEQ ID NO: 135961 - DNA, 601 bp, Human; identical to SEQ ID NO: 135844

SEQ ID NO: 135962 - DNA, 601 bp, Human; identical to SEQ ID NO: 135845

SEQ ID NO: 135963 - DNA, 601 bp, Human; identical to SEQ ID NO: 135846

SEQ ID NO: 135964 - DNA, 601 bp, Human; identical to SEQ ID NO: 135847

SEQ ID NO: 135965 - DNA, 601 bp, Human; identical to SEQ ID NO: 135848

SEQ ID NO: 135966 - DNA, 601 bp, Human; identical to SEQ ID NO: 135849

SEQ ID NO: 135967 - DNA, 601 bp, Human; identical to SEQ ID NO: 135850

SEQ ID NO: 135968 - DNA, 601 bp, Human; identical to SEQ ID NO: 135851

SEQ ID NO: 135969 - DNA, 601 bp, Human; identical to SEQ ID NO: 135852

SEQ ID NO: 135970 - DNA, 601 bp, Human; identical to SEQ ID NO: 135853

SEQ ID NO: 135971 - DNA, 601 bp, Human; identical to SEQ ID NO: 135854

SEQ ID NO: 135972 - DNA, 601 bp, Human; identical to SEQ ID NO: 135855

SEQ ID NO: 135973 - DNA, 601 bp, Human; identical to SEQ ID NO: 135856

SEQ ID NO: 135974 - DNA, 601 bp, Human; identical to SEQ ID NO: 135857

SEQ ID NO: 135975 - DNA, 601 bp, Human; identical to SEQ ID NO: 135858

SEQ ID NO: 135976 - DNA, 601 bp, Human; identical to SEQ ID NO: 135859

SEQ ID NO: 135977 - DNA, 601 bp, Human; identical to SEQ ID NO: 135860

SEQ ID NO: 135978 - DNA, 509 bp, Human; identical to SEQ ID NO: 135861

SEQ ID NO: 135979 - DNA, 601 bp, Human; identical to SEQ ID NO: 135862

SEQ ID NO: 135980 - DNA, 601 bp, Human; identical to SEQ ID NO: 135863

SEQ ID NO: 135981 - DNA, 601 bp, Human; identical to SEQ ID NO: 135864

SEQ ID NO: 135982 - DNA, 601 bp, Human; identical to SEQ ID NO: 135865

SEQ ID NO: 135983 - DNA, 601 bp, Human; identical to SEQ ID NO: 135866

SEQ ID NO: 135984 - DNA, 601 bp, Human; identical to SEQ ID NO: 135867

SEQ ID NO: 135985 - DNA, 601 bp, Human; identical to SEQ ID NO: 135868

SEQ ID NO: 135986 - DNA, 601 bp, Human; identical to SEQ ID NO: 135869

SEQ ID NO: 135987 - DNA, 601 bp, Human; identical to SEQ ID NO: 135870

SEQ ID NO: 135988 - DNA, 601 bp, Human; identical to SEQ ID NO: 135871

SEQ ID NO: 135989 - DNA, 601 bp, Human; identical to SEQ ID NO: 135872

SEQ ID NO: 135990 - DNA, 601 bp, Human; identical to SEQ ID NO: 135873

SEQ ID NO: 135991 - DNA, 601 bp, Human; identical to SEQ ID NO: 135874

SEQ ID NO: 135992 - DNA, 601 bp, Human; identical to SEQ ID NO: 135875

SEQ ID NO: 135993 - DNA, 601 bp, Human; identical to SEQ ID NO: 135876

SEQ ID NO: 135994 - DNA, 601 bp, Human; identical to SEQ ID NO: 135877

SEQ ID NO: 135995 - DNA, 601 bp, Human; identical to SEQ ID NO: 135878

SEQ ID NO: 135996 - DNA, 601 bp, Human; identical to SEQ ID NO: 135879

SEQ ID NO: 135997 - DNA, 601 bp, Human; identical to SEQ ID NO: 135880

SEQ ID NO: 135998 - DNA, 601 bp, Human; identical to SEQ ID NO: 135881

SEQ ID NO: 135999 - DNA, 601 bp, Human; identical to SEQ ID NO: 135882

SEQ ID NO: 136000 - DNA, 601 bp, Human; identical to SEQ ID NO: 135883

SEQ ID NO: 136001 - DNA, 601 bp, Human; identical to SEQ ID NO: 135884

SEQ ID NO: 136002 - DNA, 601 bp, Human; identical to SEQ ID NO: 135885

SEQ ID NO: 136003 - DNA, 601 bp, Human; identical to SEQ ID NO: 135886

SEQ ID NO: 136004 - DNA, 601 bp, Human; identical to SEQ ID NO: 135887

SEQ ID NO: 136005 - DNA, 601 bp, Human; identical to SEQ ID NO: 135888

SEQ ID NO: 136006 - DNA, 601 bp, Human; identical to SEQ ID NO: 135889

SEQ ID NO: 136007 - DNA, 601 bp, Human; identical to SEQ ID NO: 135773

SEQ ID NO: 136008 - DNA, 601 bp, Human; identical to SEQ ID NO: 135774

SEQ ID NO: 136009 - DNA, 601 bp, Human; identical to SEQ ID NO: 135775

SEQ ID NO: 136010 - DNA, 601 bp, Human; identical to SEQ ID NO: 135776

SEQ ID NO: 136011 - DNA, 601 bp, Human; identical to SEQ ID NO: 135777

SEQ ID NO: 136012 - DNA, 601 bp, Human; identical to SEQ ID NO: 135778

SEQ ID NO: 136013 - DNA, 601 bp, Human; identical to SEQ ID NO: 93207

SEQ ID NO: 136014 - DNA, 601 bp, Human; identical to SEQ ID NO: 135780

SEQ ID NO: 136015 - DNA, 601 bp, Human; identical to SEQ ID NO: 135781

SEQ ID NO: 136016 - DNA, 601 bp, Human; identical to SEQ ID NO: 135782

SEQ ID NO: 136017 - DNA, 601 bp, Human; identical to SEQ ID NO: 135783

SEQ ID NO: 136018 - DNA, 601 bp, Human; identical to SEQ ID NO: 135784

SEQ ID NO: 136019 - DNA, 601 bp, Human; identical to SEQ ID NO: 135785

SEQ ID NO: 136020 - DNA, 601 bp, Human; identical to SEQ ID NO: 135786

SEQ ID NO: 136021 - DNA, 601 bp, Human; identical to SEQ ID NO: 135787

SEQ ID NO: 136022 - DNA, 601 bp, Human; identical to SEQ ID NO: 135788

SEQ ID NO: 136023 - DNA, 529 bp, Human; identical to SEQ ID NO: 135789

SEQ ID NO: 136024 - DNA, 601 bp, Human; identical to SEQ ID NO: 135790

SEQ ID NO: 136025 - DNA, 601 bp, Human; identical to SEQ ID NO: 135791

SEQ ID NO: 136026 - DNA, 601 bp, Human; identical to SEQ ID NO: 135792

SEQ ID NO: 136027 - DNA, 601 bp, Human; identical to SEQ ID NO: 135793

SEQ ID NO: 136028 - DNA, 601 bp, Human; identical to SEQ ID NO: 135794

SEQ ID NO: 136029 - DNA, 601 bp, Human; identical to SEQ ID NO: 135795

SEQ ID NO: 136030 - DNA, 601 bp, Human; identical to SEQ ID NO: 135796

SEQ ID NO: 136031 - DNA, 601 bp, Human; identical to SEQ ID NO: 135797

SEQ ID NO: 136032 - DNA, 601 bp, Human; identical to SEQ ID NO: 135798

SEQ ID NO: 136033 - DNA, 601 bp, Human; identical to SEQ ID NO: 135799

SEQ ID NO: 136034 - DNA, 601 bp, Human; identical to SEQ ID NO: 93208

SEQ ID NO: 136035 - DNA, 601 bp, Human; identical to SEQ ID NO: 135801

SEQ ID NO: 136036 - DNA, 601 bp, Human; identical to SEQ ID NO: 135802

SEQ ID NO: 136037 - DNA, 601 bp, Human; identical to SEQ ID NO: 135803

SEQ ID NO: 136038 - DNA, 601 bp, Human; identical to SEQ ID NO: 135804

SEQ ID NO: 136039 - DNA, 601 bp, Human; identical to SEQ ID NO: 135805

SEQ ID NO: 136040 - DNA, 601 bp, Human; identical to SEQ ID NO: 135806

SEQ ID NO: 136041 - DNA, 601 bp, Human; identical to SEQ ID NO: 135807

SEQ ID NO: 136042 - DNA, 601 bp, Human; identical to SEQ ID NO: 135808

SEQ ID NO: 136043 - DNA, 601 bp, Human; identical to SEQ ID NO: 135809

SEQ ID NO: 136044 - DNA, 601 bp, Human; identical to SEQ ID NO: 135810

SEQ ID NO: 136045 - DNA, 601 bp, Human; identical to SEQ ID NO: 135811

SEQ ID NO: 136046 - DNA, 601 bp, Human; identical to SEQ ID NO: 135812

SEQ ID NO: 136047 - DNA, 601 bp, Human; identical to SEQ ID NO: 135813

SEQ ID NO: 136048 - DNA, 601 bp, Human; identical to SEQ ID NO: 135814

SEQ ID NO: 136049 - DNA, 601 bp, Human; identical to SEQ ID NO: 135815

SEQ ID NO: 136050 - DNA, 601 bp, Human; identical to SEQ ID NO: 135816

SEQ ID NO: 136051 - DNA, 601 bp, Human; identical to SEQ ID NO: 135817

SEQ ID NO: 136052 - DNA, 601 bp, Human; identical to SEQ ID NO: 135818

SEQ ID NO: 136053 - DNA, 601 bp, Human; identical to SEQ ID NO: 135819

SEQ ID NO: 136054 - DNA, 601 bp, Human; identical to SEQ ID NO: 135820

SEQ ID NO: 136055 - DNA, 601 bp, Human; identical to SEQ ID NO: 135821

SEQ ID NO: 136056 - DNA, 601 bp, Human; identical to SEQ ID NO: 135822

SEQ ID NO: 136057 - DNA, 601 bp, Human; identical to SEQ ID NO: 135823

SEQ ID NO: 136058 - DNA, 601 bp, Human; identical to SEQ ID NO: 135824

SEQ ID NO: 136059 - DNA, 601 bp, Human; identical to SEQ ID NO: 135825

SEQ ID NO: 136060 - DNA, 601 bp, Human; identical to SEQ ID NO: 135826

SEQ ID NO: 136061 - DNA, 601 bp, Human; identical to SEQ ID NO: 135827

SEQ ID NO: 136062 - DNA, 601 bp, Human; identical to SEQ ID NO: 135828

SEQ ID NO: 136063 - DNA, 601 bp, Human; identical to SEQ ID NO: 135829

SEQ ID NO: 136064 - DNA, 601 bp, Human; identical to SEQ ID NO: 135830

SEQ ID NO: 136065 - DNA, 601 bp, Human; identical to SEQ ID NO: 135831

SEQ ID NO: 136066 - DNA, 601 bp, Human; identical to SEQ ID NO: 135832

SEQ ID NO: 136067 - DNA, 601 bp, Human; identical to SEQ ID NO: 135833

SEQ ID NO: 136068 - DNA, 601 bp, Human; identical to SEQ ID NO: 135834

SEQ ID NO: 136069 - DNA, 601 bp, Human; identical to SEQ ID NO: 135835

SEQ ID NO: 136070 - DNA, 601 bp, Human; identical to SEQ ID NO: 135836

SEQ ID NO: 136071 - DNA, 601 bp, Human; identical to SEQ ID NO: 135837

SEQ ID NO: 136072 - DNA, 601 bp, Human; identical to SEQ ID NO: 135838

SEQ ID NO: 136073 - DNA, 601 bp, Human; identical to SEQ ID NO: 135839

SEQ ID NO: 136074 - DNA, 601 bp, Human; identical to SEQ ID NO: 135840

SEQ ID NO: 136075 - DNA, 601 bp, Human; identical to SEQ ID NO: 135841

SEQ ID NO: 136076 - DNA, 601 bp, Human; identical to SEQ ID NO: 135842

SEQ ID NO: 136077 - DNA, 601 bp, Human; identical to SEQ ID NO: 135843

SEQ ID NO: 136078 - DNA, 601 bp, Human; identical to SEQ ID NO: 135844

SEQ ID NO: 136079 - DNA, 601 bp, Human; identical to SEQ ID NO: 135845

SEQ ID NO: 136080 - DNA, 601 bp, Human; identical to SEQ ID NO: 135846

SEQ ID NO: 136081 - DNA, 601 bp, Human; identical to SEQ ID NO: 135847

SEQ ID NO: 136082 - DNA, 601 bp, Human; identical to SEQ ID NO: 135848

SEQ ID NO: 136083 - DNA, 601 bp, Human; identical to SEQ ID NO: 135849

SEQ ID NO: 136084 - DNA, 601 bp, Human; identical to SEQ ID NO: 135850

SEQ ID NO: 136085 - DNA, 601 bp, Human; identical to SEQ ID NO: 135851

SEQ ID NO: 136086 - DNA, 601 bp, Human; identical to SEQ ID NO: 135852

SEQ ID NO: 136087 - DNA, 601 bp, Human; identical to SEQ ID NO: 135853

SEQ ID NO: 136088 - DNA, 601 bp, Human; identical to SEQ ID NO: 135854

SEQ ID NO: 136089 - DNA, 601 bp, Human; identical to SEQ ID NO: 135855

SEQ ID NO: 136090 - DNA, 601 bp, Human; identical to SEQ ID NO: 135856

SEQ ID NO: 136091 - DNA, 601 bp, Human; identical to SEQ ID NO: 135857

SEQ ID NO: 136092 - DNA, 601 bp, Human; identical to SEQ ID NO: 135858

SEQ ID NO: 136093 - DNA, 601 bp, Human; identical to SEQ ID NO: 135859

SEQ ID NO: 136094 - DNA, 601 bp, Human; identical to SEQ ID NO: 135860

SEQ ID NO: 136095 - DNA, 509 bp, Human; identical to SEQ ID NO: 135861

SEQ ID NO: 136096 - DNA, 601 bp, Human; identical to SEQ ID NO: 135862

SEQ ID NO: 136097 - DNA, 601 bp, Human; identical to SEQ ID NO: 135863

SEQ ID NO: 136098 - DNA, 601 bp, Human; identical to SEQ ID NO: 135864

SEQ ID NO: 136099 - DNA, 601 bp, Human; identical to SEQ ID NO: 135865

SEQ ID NO: 136100 - DNA, 601 bp, Human; identical to SEQ ID NO: 135866

SEQ ID NO: 136101 - DNA, 601 bp, Human; identical to SEQ ID NO: 135867

SEQ ID NO: 136102 - DNA, 601 bp, Human; identical to SEQ ID NO: 135868

SEQ ID NO: 136103 - DNA, 601 bp, Human; identical to SEQ ID NO: 135869

SEQ ID NO: 136104 - DNA, 601 bp, Human; identical to SEQ ID NO: 135870

SEQ ID NO: 136105 - DNA, 601 bp, Human; identical to SEQ ID NO: 135871

SEQ ID NO: 136106 - DNA, 601 bp, Human; identical to SEQ ID NO: 135872

SEQ ID NO: 136107 - DNA, 601 bp, Human; identical to SEQ ID NO: 135873

SEQ ID NO: 136108 - DNA, 601 bp, Human; identical to SEQ ID NO: 135874

SEQ ID NO: 136109 - DNA, 601 bp, Human; identical to SEQ ID NO: 135875

SEQ ID NO: 136110 - DNA, 601 bp, Human; identical to SEQ ID NO: 135876

SEQ ID NO: 136111 - DNA, 601 bp, Human; identical to SEQ ID NO: 135877

SEQ ID NO: 136112 - DNA, 601 bp, Human; identical to SEQ ID NO: 135878

SEQ ID NO: 136113 - DNA, 601 bp, Human; identical to SEQ ID NO: 135879

SEQ ID NO: 136114 - DNA, 601 bp, Human; identical to SEQ ID NO: 135880

SEQ ID NO: 136115 - DNA, 601 bp, Human; identical to SEQ ID NO: 135881

SEQ ID NO: 136116 - DNA, 601 bp, Human; identical to SEQ ID NO: 135882

SEQ ID NO: 136117 - DNA, 601 bp, Human; identical to SEQ ID NO: 135883

SEQ ID NO: 136118 - DNA, 601 bp, Human; identical to SEQ ID NO: 135884

SEQ ID NO: 136119 - DNA, 601 bp, Human; identical to SEQ ID NO: 135885

SEQ ID NO: 136120 - DNA, 601 bp, Human; identical to SEQ ID NO: 135886

SEQ ID NO: 136121 - DNA, 601 bp, Human; identical to SEQ ID NO: 135887

SEQ ID NO: 136122 - DNA, 601 bp, Human; identical to SEQ ID NO: 135888

SEQ ID NO: 136123 - DNA, 601 bp, Human; identical to SEQ ID NO: 135889

SEQ ID NO: 136124 - DNA, 601 bp, Human
tggaaggagcttgagagtcttttgagtctagccaagttttggggccagaatcctcccatgagtggccttttggtagccatactgtgattcttcccatcccagaggacagcattggtggaagatagcgggaaggtggtggctgtggggcctgagcagccaggagggatacgcaggggctgcagggtgtcctacattccagacgtcccaggcaaaggtcagggtgcaggaatgagtggcattggggaagtcagtttccccaatgagccctgatgctacatattttggatttggttggtatgtkggaccagtgtgtttgatcagttttctaatggggagacaggctttggaggttattaatgggttggtctttgggtgggattatgctgagcaccaagattctgctctagagggggtgtgaccaccattctgagggtcctggtttgacatttcatctctcccagtatgagaacctctacaaggtttcctctgggcccttggattgtaagagaccctggtgttctcttgtcagggaagagggaggaagttaaccatgaaaggagaagaaaaggaatccagggtggtgtgtaggcagaattctgag

SEQ ID NO: 136125 - DNA, 601 bp, Human
ggaagatagcgggaaggtggtggctgtggggcctgagcagccaggagggatacgcaggggctgcagggtgtcctacattccagacgtcccaggcaaaggtcagggtgcaggaatgagtggcattggggaagtcagtttccccaatgagccctgatgctacatattttggatttggttggtatgtgggaccagtgtgtttgatcagttttctaatggggagacaggctttggaggttattaatgggttggtctttgggtgggattatgctgagcaccaagattctgctctagagggggtgtraccaccattctgagggtcctggtttgacatttcatctctcccagtatgagaacctctacaaggtttcctctgggcccttggattgtaagagaccctggtgttctcttgtcagggaagagggaggaagttaaccatgaaaggagaagaaaaggaatccagggtggtgtgtaggcagaattctgagtatgtccacttggagaagtgttcagtaaagggaacagtgtggggaagggtcagcgggggtggggggtggggtgggggtggtcctctttttctagacgctgttatccttacccttac

SEQ ID NO: 136126 - DNA, 601 bp, Human
ggttcacagcacaatagcctaaatttcccctcacccctgtctccaatccctggtactcattaaccttccctcctccacctgtcaccccaaaccccaaattgctgtgactcaggcaggcccatgagtccctggtcctccaacctacttcacccgtttgactcagagattcccagagaccccagcataataaactaaatcctcttccactcatatccccaacccctggcctctactatccctctcttctccgcctgtcaccccaaacccaagttcccgtctaacccccagactctcgagtcgycagttcctccactccactgcctgactctgagattccgagtccctagtagcagacaccaggccttcctaatatcctaaaccaccacataccgggcccctatctctgaccccctccccgtgactgcatgatcccaaccctcaagacttgacctccgaccccccccacgctcggggcccttcacctctgaccctcagcaaccgcattaccccttcctgactcccacatcaccctgcctcaggccctgacctccgacctccggctccaaccccatcccctgaccccctacccttctggatccgc

SEQ ID NO: 136127 - DNA, 601 bp, Human
gtggtctacgccgagtgacagagacgctcaggctgtgttctcaggtgagaccgccgcggggccggggatcctagggacggttcatggtctttcggggatagtgccccgcggcctgggccttttctcattaggtctcatttctgtctctggaaaagaaaatgtagaagaaacgggcgcgggccgagttactcttgacttctttctggtgctccgccgcttctagcttttccccatagcggggcttggggaacttggtttgaactatgcggttgtactctgagataggaagtttccatttctkagggacacgatgccctcttttgctctgtgtaactttccccccgtaatagcagcccctagagccttcatactgtcggtcaagaatcgaaacctttgggttgattgtgccacacagtacctaccgtggtccttgatgtcatataacggtcccgcctcacggccaaagaaacagtccgagacggaacgttgacttgggtcaaagaccatgtaaatcgcgagattgtggtttgaattacagcccatgcagtgtgaggacgtatggcatctgctgagccattataccttggtcccagtgcagcag

SEQ ID NO: 136128 - DNA, 601 bp, Human
agatcataacaggtaaagaagggatcccttgaccaccacatctaccacatctgctcttacgtcctgttcaaagatgactacaacttctgtcatgagaggactccttcaccagaaggagcatcacatctcacatatggtatttttgttactgtttttgtagtaaaatacataacatccagtgtcattcttttgcatgtgaatatccagttatccagtaccatctcctaaagagatgttttttttccctcaattgaatggccttggccacttgtcataaatcagctggccgtagttttttttttttttttttttttttgagacggagtctcactctgttccctgggctggagtgcagtgacgcgatctgcctaccgggttcacaccattctcctgcctcagcctcctgagtagctgggactacaggtgcccgccactgcacctggctgatttttttttttttatttttagtagagacagggtttcaccgagttagccaggatggtctcgatctcctgacctcgtgatccgcccgtctcggcctcccaaagtgctgggattacaggcgtgagccaccgcgcccggcccagatgtatgggtttca

SEQ ID NO: 136129 - DNA, 601 bp, Human
cagctggccgtagttttttttttttttttttttttttgagacggagtctcactctgttccctgggctggagtgcagtgacgcgatctgcctaccgggttcacaccattctcctgcctcagcctcctgagtagctgggactacaggtgcccgccactgcacctggctgatttttttttttttatttttagtagagacagggtttcaccgagttagccaggatggtctcgatctcctgacctcgtgatccgcccgtctcggcctcccaaagtgctgggattacaggcgtgagccaccgcgccyggcccagatgtatgggtttcattacagactttcagttatattccactggtctatatgtctgtctctatgccagtaccacactttcttgctttgtattaagttttgcaattgggaagtgtgagttgtcctactttgttcctactccgtacggttttacacataccctttttttcccctccccatgaaggcatcattaagaattttgtgggccttaagaactttagcttttgtgagcccttcctccattaaaagaaagtgtttgaaattatattttgtgactgcattgatataaagatgaat

SEQ ID NO: 136130 - DNA, 601 bp, Human
tctcactctgttccctgggctggagtgcagtgacgcgatctgcctaccgggttcacaccattctcctgcctcagcctcctgagtagctgggactacaggtgcccgccactgcacctggctgatttttttttttttatttttagtagagacagggtttcaccgagttagccaggatggtctcgatctcctgacctcgtgatccgcccgtctcggcctcccaaagtgctgggattacaggcgtgagccaccgcgcccggcccagatgtatgggtttcattacagactttcagttatattccaytggtctatatgtctgtctctatgccagtaccacactttcttgctttgtattaagttttgcaattgggaagtgtgagttgtcctactttgttcctactccgtacggttttacacataccctttttttcccctccccatgaaggcatcattaagaattttgtgggccttaagaactttagcttttgtgagcccttcctccattaaaagaaagtgtttgaaattatattttgtgactgcattgatataaagatgaatataacttgggttgcactttattcactttcctcctctttttttttaa

SEQ ID NO: 136131 - DNA, 601 bp, Human
ctggagtgcagtgacgcgatctgcctaccgggttcacaccattctcctgcctcagcctcctgagtagctgggactacaggtgcccgccactgcacctggctgatttttttttttttatttttagtagagacagggtttcaccgagttagccaggatggtctcgatctcctgacctcgtgatccgcccgtctcggcctcccaaagtgctgggattacaggcgtgagccaccgcgcccggcccagatgtatgggtttcattacagactttcagttatattccactggtctatatgtctgtctytatgccagtaccacactttcttgctttgtattaagttttgcaattgggaagtgtgagttgtcctactttgttcctactccgtacggttttacacataccctttttttcccctccccatgaaggcatcattaagaattttgtgggccttaagaactttagcttttgtgagcccttcctccattaaaagaaagtgtttgaaattatattttgtgactgcattgatataaagatgaatataacttgggttgcactttattcactttcctcctctttttttttaatcattaaagttttatcttt

SEQ ID NO: 136132 - DNA, 601 bp, Human
cacactttcttgctttgtattaagttttgcaattgggaagtgtgagttgtcctactttgttcctactccgtacggttttacacataccctttttttcccctccccatgaaggcatcattaagaattttgtgggccttaagaactttagcttttgtgagcccttcctccattaaaagaaagtgtttgaaattatattttgtgactgcattgatataaagatgaatataacttgggttgcactttattcactttcctcctctttttttttaatcattaaagttttatctttgagataagatcrctctctgtcacccaggctggagtgcagtggtgtgatcacagttcactgcagcctcaatacacctgggctcaggggatcttcctgtcttagactccaactagctgggaccaaagatgcatgccaccaaacctgctaccttttgttttataaagaatgaaaacttttttgttgtctgtaaagatgtcaggggacttaggcactatgcctaatggataattcagccttgtttttcactctgaatatcttgtagatcttggcttttctttccttcaggggtttatttcggggggtccaaaaaca

SEQ ID NO: 136133 - DNA, 601 bp, Human
agttctcagccaggtgcagtggcttatgcctgtaatcccatcactttgggaggctgaggcggacggatcacctgaggtcaagagttcaagaccagcctggccaacatgtccaaaccccagctctactaaaaatacaaaaattagcctggcatggtggcatgcacctgtagtcccagctactcaggaagctgaggcaggagaattgcttgaacctgggaggcggaggtttcagtgagccaagattgcaccactgccctccagcctggaaggcagtgagactccatctcaaaaaacaaaaaaycaaaaaactgtggttcctactctggggtggttggtttcctgtcttagagaacacttagcaatgcctggatacatttttagatgtgaaaactgaccggggtggtgccaggcactgtggctcatgcctgtaatttcagcactttgggagcacaaggcaggcagatcacttgaggtcaagagttcgagaccagcctgctcaaaacagtgaaaccccttttctattaaaagtacaaaaaatttagctgggcttggtggcgcgtgcctgtaattccagctactcaggaggctgaggcaggagaat

SEQ ID NO: 136134 - DNA, 601 bp, Human
acctgtagtcccagctactcaggaagctgaggcaggagaattgcttgaacctgggaggcggaggtttcagtgagccaagattgcaccactgccctccagcctggaaggcagtgagactccatctcaaaaaacaaaaaaccaaaaaactgtggttcctactctggggtggttggtttcctgtcttagagaacacttagcaatgcctggatacatttttagatgtgaaaactgaccggggtggtgccaggcactgtggctcatgcctgtaatttcagcactttgggagcacaaggcaggcagrtcacttgaggtcaagagttcgagaccagcctgctcaaaacagtgaaaccccttttctattaaaagtacaaaaaatttagctgggcttggtggcgcgtgcctgtaattccagctactcaggaggctgaggcaggagaatcacttgaacccaggaggcagaagttgcagtgagccgaggttgcgccactgcactccagcctgggtgacagcaagactcagcctcaagggggggaaaaaaaaaactaggccaggcgcagtggctcacgcctgtaatcccaacactttgggaggccaagacagg

SEQ ID NO: 136135 - DNA, 601 bp, Human
cagtgagactccatctcaaaaaacaaaaaaccaaaaaactgtggttcctactctggggtggttggtttcctgtcttagagaacacttagcaatgcctggatacatttttagatgtgaaaactgaccggggtggtgccaggcactgtggctcatgcctgtaatttcagcactttgggagcacaaggcaggcagatcacttgaggtcaagagttcgagaccagcctgctcaaaacagtgaaaccccttttctattaaaagtacaaaaaatttagctgggcttggtggcgcgtgcctgtaattscagctactcaggaggctgaggcaggagaatcacttgaacccaggaggcagaagttgcagtgagccgaggttgcgccactgcactccagcctgggtgacagcaagactcagcctcaagggggggaaaaaaaaaactaggccaggcgcagtggctcacgcctgtaatcccaacactttgggaggccaagacaggcggatcacaaggccaggagttcaagaccagcctggccaacatagtgaaacctgtctctactaaaaatacaaaaaaactagctaggcttggtggcaggcccctataatc

SEQ ID NO: 136136 - DNA, 601 bp, Human
cttagattcccactcttccattacgaaggaagtgtactttttagcgacttggtaaagtcacctgttcagggtttttttcctcatggtggatggggcttacatccaagtcccctgttgaggcataccaggatcccagacagctgttggactaccccgaatgggtacttgatctctcctctggtgtctggccaacgcccatgctgctcctgaccattttcccttcatttcctgctccctgctgccccaggattacattgcagtgaaggagaagtatgccaagtacctgcctcacagtgcaggrcggtatgccgccaaacgcttccgcaaagctcagtgtcccattgtggagcgcctcactaactccatgatgatgcacggccgcaacaacggcaagaagctcatgactgtgcgcatcgtcaagcatgccttcgagatcatacacctgctcacaggcgaggtagggctctgtggcctggtgagggcaggctgtgccctcagtacacccgaaagccccacggagtgtatgtcaggcttatcccctgtgtggtgtggtcactcttgttttaggtatgaggaaaggggaggaatgcatggggctgga

SEQ ID NO: 136137 - DNA, 601 bp, Human; identical to SEQ ID NO: 34565

SEQ ID NO: 136138 - DNA, 601 bp, Human
catcttagagtctagaagagggagggaaatgtccctgggaggaaggggaataatagggtcaggcaggtggcaaagcgttccaggcagagagtggatgtgaggtgaagtactgtagtaatagaagtgaggtggcagtgaggccagagccagtgcttattcagctctttatgtgctcctcaggcttccatggtgacctttggtgggacctgtggagtttcagtcaagctagtgaattagcccagggacagattgggtcagtaggcagaatccctgtgcttggggtaggtgcccagtgagtgtrggttttgaatgagttaaatgttgagaagcctgtgactgacctcagtagtacaacaacaaagcagaaaagggctgagtttatctgggatctgcacatggttctggattgctgaattgacccatgaaatagagccaggaggggaagatttaataggtggattcagggcaacccatggcagtgtggccgttgatcaggaccagatgtaatcctggatgcattatccaagcattctctggatgctgtgtgcagatttgcatgtggggaagccatggaggtaccagtgttgtgggtgtccataga

SEQ ID NO: 136139 - DNA, 601 bp, Human
atttgcatgtggggaagccatggaggtaccagtgttgtgggtgtccatagatgtaaaggaggtatagccaaaagggtgatgtgcacatggagatggagtgtgaattcatgagcccagagctttggtatggagggtttctgaaagaatgcttagctcaggtttgtgtatgaggaataatctgttgatccccagggagctggctgataggagaagggttgggtcctacataccaggcccatggtgttttatctgtccacttgcctgttctgagctggacaaaatgattaatggaatatgagtygagaacaggcaccaatcacaccagggcctgttatctcatttgagttagatgtgacaaggagtcctggagagagaggctgtccttaagctcagttgtccacctcacacagggctatgtgaccttcaaggatttatttgtttacttctcttaggaggaatgggagctgctggatgaggctcagagactcttctattatgaaataatggcttctgtgctttgcatttatagtctccctgggtaaggccccagtatcccatttttctgggctgggtcctactcttcctttttgccctaggggtt

SEQ ID NO: 136140 - DNA, 601 bp, Human
ggtcctacataccaggcccatggtgttttatctgtccacttgcctgttctgagctggacaaaatgattaatggaatatgagtcgagaacaggcaccaatcacaccagggcctgttatctcatttgagttagatgtgacaaggagtcctggagagagaggctgtccttaagctcagttgtccacctcacacagggctatgtgaccttcaaggatttatttgtttacttctcttaggaggaatgggagctgctggatgaggctcagagactcttctattatgaaataatggcttctgtgcttygcatttatagtctccctgggtaaggccccagtatcccatttttctgggctgggtcctactcttcctttttgccctaggggttgctctttcctttccatagctagagcatgggtactgctctcttctctgattccctcacataggtcccctgggtgcctaggctcagctagatgcattggcccctctcttccctgtgttcctcaactcctgctgccctgaagccttgccaggaagggtttggaggtcaggggtcctaaggtgacccagtgaattctgcttggcctctccctggccaggtga

SEQ ID NO: 136141 - DNA, 601 bp, Human
actattgtgtcataagatgtgtgcatatctgtaaatagtccctgaacacgttacttatttttaatcacattttcctgggcctgtactcacatttcgcataggagtcacctgtcacccacagtcagccaaggtcctgctaaaagtcattgcagaggattaagttggagaccttgtactacaccccatcctcgtgtctttgtttcttgtgaggccatctccattctgtgactcttagattccagtactgtacagcagcccttttttcaacctgatcctagctctgttccaccaggaaacttargtactcagtcctgggtacagcagacacatatttgtgatgtagttgccccacccaccaaagtcagcatgtacatcaatagtatttttctgccttcaggttgttggcatgaagtgaaggatgaagagtcatcttctgaacagagcatttctatagcagtgtcacatgttaatacttccaaggcaggtttgcccgcacagacggctctcccttgtgacatatgtggccccatcttgaaagatattttgcacctggatgaacaccagggtacacaccatggactgaaacttcacacatgtgggg

SEQ ID NO: 136142 - DNA, 601 bp, Human; identical to SEQ ID NO: 22977

SEQ ID NO: 136143 - DNA, 601 bp, Human; identical to SEQ ID NO: 22978

SEQ ID NO: 136144 - DNA, 601 bp, Human; identical to SEQ ID NO: 22979

SEQ ID NO: 136145 - DNA, 601 bp, Human; identical to SEQ ID NO: 22980

SEQ ID NO: 136146 - DNA, 601 bp, Human; identical to SEQ ID NO: 22981

SEQ ID NO: 136147 - DNA, 601 bp, Human; identical to SEQ ID NO: 22982

SEQ ID NO: 136148 - DNA, 601 bp, Human; identical to SEQ ID NO: 22983

SEQ ID NO: 136149 - DNA, 601 bp, Human; identical to SEQ ID NO: 22984

SEQ ID NO: 136150 - DNA, 601 bp, Human; identical to SEQ ID NO: 22985

SEQ ID NO: 136151 - DNA, 601 bp, Human; identical to SEQ ID NO: 22986

SEQ ID NO: 136152 - DNA, 601 bp, Human
gccggctcggctggctggcgcaatctcgcgcgctccttgcattgatcaaaaatgggggttgaaacagtaaacgcgaggaggagcaactgcttcgactcggctcagaagcgcgaccaatggggatgtgagctccttcgcgcgaaccaattagcgcagggcctgcgacagcacgggccaatggggcgccgactcggcgcaggaacaaggcgggggttcggggccggctgcagactctcaccgcagcggccaggaacgccagccgttcacgcgttcggtcctccttggctgactcaccgccctsgccgccgcaccatggacgcccccaggcaggtggtcaactttgggcctggtcccgccaagctgccgcactcagtaagtccccgcgagcgggcgccgggagtgaggttcaggcgggagcacgcacgcgggtgggtttgcatccctgcgtgtggcagtcggattcccgctccctgccttgagtcccctaggcgctttgcatcagcgtgcacagcgggatcagcagctccggcaagcgggcttcgggaagaatgcagttggtgaggaagctcggcgaggcgtgccggtgcagctgcccctggcc

SEQ ID NO: 136153 - DNA, 601 bp, Human
tggctgactcaccgccctggccgccgcaccatggacgcccccaggcaggtggtcaactttgggcctggtcccgccaagctgccgcactcagtaagtccccgcgagcgggcgccgggagtgaggttcaggcgggagcacgcacgcgggtgggtttgcatccctgcgtgtggcagtcggattcccgctccctgccttgagtcccctaggcgctttgcatcagcgtgcacagcgggatcagcagctccggcaagcgggcttcgggaagaatgcagttggtgaggaagctcggcgaggcgtgccsgtgcagctgcccctggccctgactgctggtgcgaggcagtgcacgactcagctggccggggcctgctgtcccgccggtgccacgcacctgcagacgcccgggctgtgccatctcctgggccggtccgggggctggggcggggcgaaaaagaaaaagctctgatctctgccttcgcctcgcgcagctgtgcggcgagcccgggcagtgtggagcggatgcatgaatggacatagtgtgaatgagtgatgaacgggaatgaaccgatgacaggttttgcatatgcagtggatcacgttagct

SEQ ID NO: 136154 - DNA, 601 bp, Human
agcacttaggaacactgcttttcagaaatgtaaatttgaaaaccttcagtccagctttcccctccttgtcccccatagaacctaccctttcctaaagcctttctccccacccccctcctttttttaacctgcttgtcccctaaaggcgttcgagtattctaactctggtagactttgggctgcttaacccaattccctgttcatttcgttctggagtaaaccgagtgattgaattctctcccgggccacaatcagatcttgctggtggaactcactctctgccttcccaggccccagcccsgctcctcccctcccccgccaaacccaccgtccccagccccacccgcagtgaagaaggcaaagtctccgatgtgccttgagcccattgtcaggcggctgccgccgccgttagatttttatttttctaaccaggatagagctgataatatgttggagcagcatgaggcatagccaagtattttacaattatcaattgttgagcagagtagaaatctccctgggacagagcctcctctgtgttgtggtaagaacagagaatccaattttaaaggggaaaggacttcttacttttctaggggca

SEQ ID NO: 136155 - DNA, 601 bp, Human
cctgtgacatacactattttgtattctatcctgctctagtctgttctgtttcattaaaaaaattagtcgtgagctgggtgtggtggcgcacgcctgtaatccaagcaactcaggaggctaaggtgggaggatctcttgagcccaggagtttgaggctgtagtgaactgtgattgtcccactgcattccaggctgggtgatagagcaagaccctgtctcttaacaaaaaaaaaaaaaaaaaaaaaaaaaaaattggttatgatccacaaaagcaatgcattcttcaactggaaaaaaaaaaacctactggattagggaggtgtgatttttcagtaggagtctttaaaactgtttgtaattattttggttataaacttttatagaactattttcaatgaatgctgtctataagaaagatacagtctcaggagcaagttcaaagattattcacagatgaatgtttctctttactaaaagaaaagattcactctattttatttgatcagctggtgctaacaagcatccaacatttcagaaaacaataacacattcttagacccagtcgtcaaggcagtctttttttttaatctaattcttttttt

SEQ ID NO: 136156 - DNA, 601 bp, Human
ttcattaaaaaaattagtcgtgagctgggtgtggtggcgcacgcctgtaatccaagcaactcaggaggctaaggtgggaggatctcttgagcccaggagtttgaggctgtagtgaactgtgattgtcccactgcattccaggctgggtgatagagcaagaccctgtctcttaacaaaaaaaaaaaaaaaaaaaaaaaaaaaattggttatgatccacaaaagcaatgcattcttcaactggaaaaaaaaaaacctactggattagggaggtgtgatttttcagtaggagtctttaaaactstttgtaattattttggttataaacttttatagaactattttcaatgaatgctgtctataagaaagatacagtctcaggagcaagttcaaagattattcacagatgaatgtttctctttactaaaagaaaagattcactctattttatttgatcagctggtgctaacaagcatccaacatttcagaaaacaataacacattcttagacccagtcgtcaaggcagtctttttttttaatctaattctttttttttttttttttttttgagagaagtcaagctctgtcacgaggctggagtgc

SEQ ID NO: 136157 - DNA, 601 bp, Human
gcttcccagtctagcaccttagaccaaaagagatcggaaaattgagttacctgtataatctgggcataatttttttatcgttgtccctttaacccagaactttatgcattctttactttagctttaggagagtggtgaatgagatttgtgaaggggacattttctagggaatcggtaaattcgggcctttggaaaaagtgtatcaacatcagtcacattgcctaatttcatgcttaccttgtgtgtaagttgcataatcgctggctttgtggacatgggaaggaaggagactggctgtggrtggggatggatgcctggggacctcactgtagacccttccttgtcccctcgtcaggtttgtatgttcagagggaaagcagtgcagaacatatttaaataaccctattttcctttatttttttctaggtgttgttagagatacaaaaggaattattagactacaaaggagttggcattagtgttcttggtaagatttacttttgaattctgtgaatgtccatgtttcaaaggaagctttttttttttttttttttttttagaggcagggtcctgctctgtcacccaggctggagtacagtgg

SEQ ID NO: 136158 - DNA, 601 bp, Human
tcctcccacattggcctcccaaagttttgggattacaggcttgagccactgagccctggcccaaagggaactaatttaaatgcatcaaatatagaattacagggcctatagggtcttcctataggcctttatagatacatttttaaactttaatagcttgggttgcatgtctgatagaaaccattttgaaaatagcataaatgctggtgagaggttctgacatctcagcttaccctgtcataattggtttttgctaatcataggatttaggatcagaagatactgtatatttgcataacartgcctccaaacatttataatattgctttacattcaatttacagtttttattatacttaaatacaacctcattaaagtttaaaagtacataagccttttatgaagacctcgcacattgataatcttattaagtttcccctatattttttgggaagaggacctctgcattctaaaacttattttcttttgtttttggcggttctgaagactgcatggtattaagagaccatagggttaactatattgcttatttctgttaaattttgctcctgttggtttgggacatatacttagatttctg

SEQ ID NO: 136159 - DNA, 601 bp, Human
gccctggcccaaagggaactaatttaaatgcatcaaatatagaattacagggcctatagggtcttcctataggcctttatagatacatttttaaactttaatagcttgggttgcatgtctgatagaaaccattttgaaaatagcataaatgctggtgagaggttctgacatctcagcttaccctgtcataattggtttttgctaatcataggatttaggatcagaagatactgtatatttgcataacagtgcctccaaacatttataatattgctttacattcaatttacagtttttattrtacttaaatacaacctcattaaagtttaaaagtacataagccttttatgaagacctcgcacattgataatcttattaagtttcccctatattttttgggaagaggacctctgcattctaaaacttattttcttttgtttttggcggttctgaagactgcatggtattaagagaccatagggttaactatattgcttatttctgttaaattttgctcctgttggtttgggacatatacttagatttctgtgaagtgagatcacagcatggaattttgtgctccagacctaaagggcaactg

SEQ ID NO: 136160 - DNA, 601 bp, Human
aaaatagcataaatgctggtgagaggttctgacatctcagcttaccctgtcataattggtttttgctaatcataggatttaggatcagaagatactgtatatttgcataacagtgcctccaaacatttataatattgctttacattcaatttacagtttttattatacttaaatacaacctcattaaagtttaaaagtacataagccttttatgaagacctcgcacattgataatcttattaagtttcccctatattttttgggaagaggacctctgcattctaaaacttattttcttttrtttttggcggttctgaagactgcatggtattaagagaccatagggttaactatattgcttatttctgttaaattttgctcctgttggtttgggacatatacttagatttctgtgaagtgagatcacagcatggaattttgtgctccagacctaaagggcaactgttgcacatggattcctgtttgtgagaaagagatggtaagaagaatcacagagagcatcacggagtgataaattaataaataacttgctcagtgaatgtaccacttgaaaaatccttctgccatgactataaagcta

SEQ ID NO: 136161 - DNA, 601 bp, Human
atcttattaagtttcccctatattttttgggaagaggacctctgcattctaaaacttattttcttttgtttttggcggttctgaagactgcatggtattaagagaccatagggttaactatattgcttatttctgttaaattttgctcctgttggtttgggacatatacttagatttctgtgaagtgagatcacagcatggaattttgtgctccagacctaaagggcaactgttgcacatggattcctgtttgtgagaaagagatggtaagaagaatcacagagagcatcacggagtgatraattaataaataacttgctcagtgaatgtaccacttgaaaaatccttctgccatgactataaagctaaaatgtttgcaatttgaaaatcagtttgtatggtcccctaaactaagtgagccttggcccacaatttgaatgcagaataactgaaatttccctgtattgttgtttacttgcaaatttcgtaggtatttctgttcatttggttttgagctggaatatttgttattgttgtttatctttcctttcacagaaatgagtcacaggtcatcagattttgccaagattattaacaatac

SEQ ID NO: 136162 - DNA, 601 bp, Human
cagggataatcactaatatgttaggacccattcttgcattattacattaacaaaattggaattatactgattatttcaagttttctttttcaaattgcttgataaaatgattcagatggggcaggcttggtgatatttctgtgaggagctgtagacgctaattgcaatgtgaatgttcagagctggtagccatctgcttggcttctctcgtccattggcctgctgagtatcatgtcacattcataggacaatcctgtccttcatggagtgggtatttggaacatcagcctgggagagatgrcatttgaccacatggctatgaacttcctctgactggggtcccagttcaatttaagggcctatcttttcttctcctaacctggttcccaccttgtatacctgtacctagacctcggcctggtttctttccatctaattcttggccttgttaactgccctgcatctgaataatgtgaacctggaactctgtcttgggttatcagtcttcccagctgctaagaacctcatggccagagtctcctaagacctgctggttgcttgctatcctactaagcactgaatataggccatacatctttca

SEQ ID NO: 136163 - DNA, 601 bp, Human
tttcaaattgcttgataaaatgattcagatggggcaggcttggtgatatttctgtgaggagctgtagacgctaattgcaatgtgaatgttcagagctggtagccatctgcttggcttctctcgtccattggcctgctgagtatcatgtcacattcataggacaatcctgtccttcatggagtgggtatttggaacatcagcctgggagagatggcatttgaccacatggctatgaacttcctctgactggggtcccagttcaatttaagggcctatcttttcttctcctaacctggttccyaccttgtatacctgtacctagacctcggcctggtttctttccatctaattcttggccttgttaactgccctgcatctgaataatgtgaacctggaactctgtcttgggttatcagtcttcccagctgctaagaacctcatggccagagtctcctaagacctgctggttgcttgctatcctactaagcactgaatataggccatacatctttcaggacaagatatttacactcctaccaccccattccccaagaccctgccacattgccctgccctttattaatttacctctgtatctttg

SEQ ID NO: 136164 - DNA, 601 bp, Human
gatatttctgtgaggagctgtagacgctaattgcaatgtgaatgttcagagctggtagccatctgcttggcttctctcgtccattggcctgctgagtatcatgtcacattcataggacaatcctgtccttcatggagtgggtatttggaacatcagcctgggagagatggcatttgaccacatggctatgaacttcctctgactggggtcccagttcaatttaagggcctatcttttcttctcctaacctggttcccaccttgtatacctgtacctagacctcggcctggtttctttccakctaattcttggccttgttaactgccctgcatctgaataatgtgaacctggaactctgtcttgggttatcagtcttcccagctgctaagaacctcatggccagagtctcctaagacctgctggttgcttgctatcctactaagcactgaatataggccatacatctttcaggacaagatatttacactcctaccaccccattccccaagaccctgccacattgccctgccctttattaatttacctctgtatctttgctggagctctgttccctggccatctggcttccgtacacctattc

SEQ ID NO: 136165 - DNA, 601 bp, Human
tttattaatttacctctgtatctttgctggagctctgttccctggccatctggcttccgtacacctattcccaggctctgaccttactcagtggcttgggtccagtttccatggccttgtccttttggagctgggcttatttctactgcctgtagccattctcatcattatcttactttttcatcctggagtcaaagaattttgctttttattttgatgtataatagatacatgatttcatgggtaggcctaaaacattatcgaaaccccctgcccaacatccacctggttcatagcatgktgcataacacaggattattggttgcaagttataggacccccaactcactggcttaagtaaaaaagaaatgtattatctcacctaacagataaatgcaggagaatttaggtgcttctaaatgactgcaggaaggtgattttcccccatcttctggctctgctttcttatgtgttctcttcattgggtggccaccattggttgcaggattagctcctacaagtttcttctttccctcaatagaaacagctttccttacctagaagtttgagtaaaggtctcagtaccaaattccattggcca

SEQ ID NO: 136166 - DNA, 601 bp, Human
acagtctccagtaaatagttgtccaaggattgcataaataaatgagtgaattagggaagacaaagtagtattgtaacattaccatatttcttgtagtaaatccacccaagttaaagcacttggtagagcatcacttgttctcaatctttgaccacatgagtttatgtattgactgttacctatgcttctgcccagagctgttccagacaactataaggtgatttttctgcaaggaggtgggtgcggccagttcagtgctgtccccttaaacctcattggcttgaaagcaggaaggtgtgckgactatgtggtgacaggagcttggtcagctaaggccgcagaagaagccaagaagtttgggactataaatatcgttcaccctaaacttgggagttatacaagtaagttctgggagctgagctgggtggtgacgtgctcaatggtgggttaccccgacccagggcaatctgtagttttcaattattttctccccttgacagtgttagttcattaccatttagattgggtggctgtactagctaagactagagcctatgcatactcttactttattttattttctattttttttctagacaga

SEQ ID NO: 136167 - DNA, 601 bp, Human
aggacctggtggctccacaggcagaaaaagctgtccctttcttgaaaggtggctgcagctgctcctgaccttatattctcccaagtttcaatgcctttatggagcattcccagtaacggtctcatgtcctgtgccccattctgaatcagtccctgtggccatgcctgagttgcattctacctctgggctgtaggtttcattggctcccctggaactacgtgggctgagagtaggtgagggctggggttccaagaagaaactactagtccatcaatggatgtaggatagatggatactgggygacaagtaaaaactcagatatctcccatgccttttgaaaaaatttactttattttattttgttgagacagagtctttctgtgttgcccgggttggagtacagtggctcttcacaggcaggatcatagcacactgtagcctccagctcctgggctcaagtgatcctcccaccttagcctcctaaatatctgggactatgggcacataccaccatgcccaccttcccatgccatttttgaagatgatttgttcccagtaaaagtcgaaaggttggatcgctcatcctctcaggatgttgata

SEQ ID NO: 136168 - DNA, 601 bp, Human
tgtcagtctcctggttgactcccatctatgtaaggaaagaggagagtgaaaagtgcaaagtctcaaacttgtcttctgtgatagaaattccagatccaagcacctggaacctcaacccagatgcctcctacgtgtattattgcgcaaatgagacggtgcatggtgtggagtttgactttatacccgatgtcaagggagcagtactggtttgtgacatgtcctcaaacttcctgtccaagccagtggatgtttccaaggtagagtataaaaggcagggtgaggggaacccactgactcggtktctgcagggacattttaatatatacaagagcgggaagaaccatgggtgtttgaggcctgcagaacccctgagccagtgcagctgccagtgagcaggctgccaggtgcgaattcccagctgttgcagtgcctgagtcctgctgttcccagcctcgtggtgatgtttgcctcacagggtcccactcgagtccttggggaactacctgcttttgagagtggttcttagaaacgtgtttggtcaacagacggggagagacttgtcttcaagagcagatgcagattatcctgagcccaggggacc

SEQ ID NO: 136169 - DNA, 601 bp, Human
agagcattcacattgttgtgcaggcatcaccaccatccatctccagaacttttacatcttctcagatgaaatctgtacattaaacactaactccctctctccccaccgtccagcccctggcagcctccattctagtttctgtctctgtgaatttgactactctaggtatctcctagaagtgaatcatgtactatttgtccttttgtgtctggcttattgcacttagcagaatgtcttcaaggttctattgcacttagcagaatgtcttcaaggttcgtccatgttgtactgtgtgtcagarcttcctttctttttaaaggctgaataataattgtttagatatactgtatttggtttatggtctgctttttattatcgccaggcactggcaattttaaataactataaattactttcccccacccccaacttcctgccaacgctcaattttcctaagggtttcatggagagaggcatgggagagggttctgtatcttgcacaacagaattacctaaagtacctttaagcctctgttttctataatttcttctccctcaggcagcttgtcccatcccttctctttgtcataacagtcccttt

SEQ ID NO: 136170 - DNA, 601 bp, Human
cattaaacactaactccctctctccccaccgtccagcccctggcagcctccattctagtttctgtctctgtgaatttgactactctaggtatctcctagaagtgaatcatgtactatttgtccttttgtgtctggcttattgcacttagcagaatgtcttcaaggttctattgcacttagcagaatgtcttcaaggttcgtccatgttgtactgtgtgtcagagcttcctttctttttaaaggctgaataataattgtttagatatactgtatttggtttatggtctgctttttattatcrccaggcactggcaattttaaataactataaattactttcccccacccccaacttcctgccaacgctcaattttcctaagggtttcatggagagaggcatgggagagggttctgtatcttgcacaacagaattacctaaagtacctttaagcctctgttttctataatttcttctccctcaggcagcttgtcccatcccttctctttgtcataacagtccctttctcagcaccttctgactgttcttttatacaaatgtaaatagattaaaaaatctgttttggccaggcgcagtggctca

SEQ ID NO: 136171 - DNA, 601 bp, Human
aaattgcttgaacccgggaggcagaggttgcagtgagccgagattgcgccactgcactccagcctgggtgccagagcaagactccgtctcaaaagaaaaaaaaaatgtttcttctcttggtaaccagggagagttagaggccccacgttaaagactcctttctactttgggggtagaaaggaggtgtgcagagcgaatgtgaatatgtgccaggactttgcagtgatgggcttgggttagccccatccaggtgaggaccaggctgacggatcatcctcaggctttggaactctgagtatgrgtttgctgtccacatggagattgctttagagcatgaactgctccctacacaggatagagtcatttccttaaaaaaattgtgcttcgggaagagttgggaagtttgcatacatgtatgaaaaatggccaaatccttcttaagcagcatgtctttctctttttaagtttggtgtgatttttgctggtgcccagaagaatgttggctctgctggggtcaccgtggtgattgtccgtgatgacctgctggggtttgccctccgagagtgcccctcggtcctggaatacaaggtgcaggctggaa

SEQ ID NO: 136172 - DNA, 601 bp, Human
gtctcaaaagaaaaaaaaaatgtttcttctcttggtaaccagggagagttagaggccccacgttaaagactcctttctactttgggggtagaaaggaggtgtgcagagcgaatgtgaatatgtgccaggactttgcagtgatgggcttgggttagccccatccaggtgaggaccaggctgacggatcatcctcaggctttggaactctgagtatgggtttgctgtccacatggagattgctttagagcatgaactgctccctacacaggatagagtcatttccttaaaaaaattgtgcttygggaagagttgggaagtttgcatacatgtatgaaaaatggccaaatccttcttaagcagcatgtctttctctttttaagtttggtgtgatttttgctggtgcccagaagaatgttggctctgctggggtcaccgtggtgattgtccgtgatgacctgctggggtttgccctccgagagtgcccctcggtcctggaatacaaggtgcaggctggaaacagctccttgtacaacacgcctccatgtttcaggtaactctgggagtcagtcttgtggacccagggaggggtctcactattttt

SEQ ID NO: 136173 - DNA, 601 bp, Human
gcatgtctttctctttttaagtttggtgtgatttttgctggtgcccagaagaatgttggctctgctggggtcaccgtggtgattgtccgtgatgacctgctggggtttgccctccgagagtgcccctcggtcctggaatacaaggtgcaggctggaaacagctccttgtacaacacgcctccatgtttcaggtaactctgggagtcagtcttgtggacccagggaggggtctcactatttttcatcaaagcggaggttacattttaaaataaaacatgtaagcctgggcgcggtggctcayacctgtaatcttagcaatttgggaggctgaggtggatggaccacttgaggtcaggagctagagaccagcctgaccaacatggtgaaaccctgtctttaccaaaaatacaaaattatccaggcgtggtggcacatgcctataatcccagctactaaggaggctgaggcaggagaatctcttgaaccggggaggtggagattgcagtgagctgagatggcaccattgcactccagcctgggtgacagagggagactccatctcaaaataaataaataaataagcaaacaaacaaacaaataa

SEQ ID NO: 136174 - DNA, 601 bp, Human
catgtctttctctttttaagtttggtgtgatttttgctggtgcccagaagaatgttggctctgctggggtcaccgtggtgattgtccgtgatgacctgctggggtttgccctccgagagtgcccctcggtcctggaatacaaggtgcaggctggaaacagctccttgtacaacacgcctccatgtttcaggtaactctgggagtcagtcttgtggacccagggaggggtctcactatttttcatcaaagcggaggttacattttaaaataaaacatgtaagcctgggcgcggtggctcacrcctgtaatcttagcaatttgggaggctgaggtggatggaccacttgaggtcaggagctagagaccagcctgaccaacatggtgaaaccctgtctttaccaaaaatacaaaattatccaggcgtggtggcacatgcctataatcccagctactaaggaggctgaggcaggagaatctcttgaaccggggaggtggagattgcagtgagctgagatggcaccattgcactccagcctgggtgacagagggagactccatctcaaaataaataaataaataagcaaacaaacaaacaaataat

SEQ ID NO: 136175 - DNA, 601 bp, Human
ttgtggacccagggaggggtctcactatttttcatcaaagcggaggttacattttaaaataaaacatgtaagcctgggcgcggtggctcacacctgtaatcttagcaatttgggaggctgaggtggatggaccacttgaggtcaggagctagagaccagcctgaccaacatggtgaaaccctgtctttaccaaaaatacaaaattatccaggcgtggtggcacatgcctataatcccagctactaaggaggctgaggcaggagaatctcttgaaccggggaggtggagattgcagtgagcygagatggcaccattgcactccagcctgggtgacagagggagactccatctcaaaataaataaataaataagcaaacaaacaaacaaataataagtaaaataaagtaaagcatgtttccaggagccggtgatcaaatgccccagatatcctatcagattctctgcccagctcacctctccctctgcaccatctctttaccatttgatcagcttttcctcttgttcttttctggggatgttgttttttgtttggtcttggtaatccaggatccggtggttcaccattaacccaaaagctctc

SEQ ID NO: 136176 - DNA, 601 bp, Human
aggcatggtggcgggtgcctgtagtcccagctactcaggaggctgaggcaggagaatcccttgaacctgggaggcagaggttgcagtgagccgaaatcacgccagtgcactccagcctgggtgacagagtgagactgtctgaaaacaaaaacaaaaacaaaaacaaaaacaaaacaaaaaccatgcaaggttagaaaatcattgctcacccaatgagaacaagctgcaaatggagacatcaagatgtgtgcaaaatcccctccccagtccgtgatgtgaggctgatggggtacctggagcscttcagaactttgtatcacatagtagagttcttgaaaaggcctcacttttgaaaagacgcctttttttttttttccccacagagtctaatgaccataggccctgggaactttgatttaattgtgctggataaaactgccttcaaatcgttgctccgtagccctgagtgatgaactagagtggaataaagaacacactgctgttctctttaacccttcagtagaacacactaaccccaattagtgcatagagaaaaagatccctaaacttcccttctgactgcacaaaatattttttactt

SEQ ID NO: 136177 - DNA, 601 bp, Human
ccttgaacctgggaggcagaggttgcagtgagccgaaatcacgccagtgcactccagcctgggtgacagagtgagactgtctgaaaacaaaaacaaaaacaaaaacaaaaacaaaacaaaaaccatgcaaggttagaaaatcattgctcacccaatgagaacaagctgcaaatggagacatcaagatgtgtgcaaaatcccctccccagtccgtgatgtgaggctgatggggtacctggagcccttcagaactttgtatcacatagtagagttcttgaaaaggcctcacttttgaaaagaygcctttttttttttttccccacagagtctaatgaccataggccctgggaactttgatttaattgtgctggataaaactgccttcaaatcgttgctccgtagccctgagtgatgaactagagtggaataaagaacacactgctgttctctttaacccttcagtagaacacactaaccccaattagtgcatagagaaaaagatccctaaacttcccttctgactgcacaaaatattttttacttaccatgactaactgaatacacaagcatacgtttgttttagctgcagtatgaggtgaag

SEQ ID NO: 136178 - DNA, 601 bp, Human
agaggttgcagtgagccgaaatcacgccagtgcactccagcctgggtgacagagtgagactgtctgaaaacaaaaacaaaaacaaaaacaaaaacaaaacaaaaaccatgcaaggttagaaaatcattgctcacccaatgagaacaagctgcaaatggagacatcaagatgtgtgcaaaatcccctccccagtccgtgatgtgaggctgatggggtacctggagcccttcagaactttgtatcacatagtagagttcttgaaaaggcctcacttttgaaaagacgcctttttttttttttycccacagagtctaatgaccataggccctgggaactttgatttaattgtgctggataaaactgccttcaaatcgttgctccgtagccctgagtgatgaactagagtggaataaagaacacactgctgttctctttaacccttcagtagaacacactaaccccaattagtgcatagagaaaaagatccctaaacttcccttctgactgcacaaaatattttttacttaccatgactaactgaatacacaagcatacgtttgttttagctgcagtatgaggtgaagtaactaataaaaataca

SEQ ID NO: 136179 - DNA, 601 bp, Human
ggttgcagtgagccgaaatcacgccagtgcactccagcctgggtgacagagtgagactgtctgaaaacaaaaacaaaaacaaaaacaaaaacaaaacaaaaaccatgcaaggttagaaaatcattgctcacccaatgagaacaagctgcaaatggagacatcaagatgtgtgcaaaatcccctccccagtccgtgatgtgaggctgatggggtacctggagcccttcagaactttgtatcacatagtagagttcttgaaaaggcctcacttttgaaaagacgcctttttttttttttccccacagagtctaatgaccataggccctgggaactttgatttaattgtgctggataaaactgccttcaaatcgttgctccgtagccctgagtgatgaactagagtggaataaagaacacactgctgttctctttaacccttcagtagaacacactaaccccaattagtgcatagagaaaaagatccctaaacttcccttctgactgcacaaaatattttttacttaccatgactaactgaatacacaagcatacgtttgttttagctgcagtatgaggtgaagtaactaataaaaatacaaaa

SEQ ID NO: 136180 - DNA, 601 bp, Human
ctctttaacccttcagtagaacacactaaccccaattagtgcatagagaaaaagatccctaaacttcccttctgactgcacaaaatattttttacttaccatgactaactgaatacacaagcatacgtttgttttagctgcagtatgaggtgaagtaactaataaaaatacaaaacaaatagaccattaatcttaggccacctgttaaaagaatgagaacaggccaggcgcagtggctcatgtctgtaatcccagcactttgggaggtcgaggcaggtggatcacctgaggtcgggagttygagaccaccctgaccaacatggacaaaccccgtctctactaaaaatacaaaaattagccaggcatggtggcacatgcctgtaatccaagctactcgggaggctgaagcaggagaatcacttgaatccagggggcagaagttgcagtgagccaagattgtgccattgcactccagcctgggcaataagagcaaaactccatctcaaaaataataataataataaataaataaaagaatgggagcatgcaaattaagtttgtgggcctgtttggaaggcttcactggtcccagactaccttc

SEQ ID NO: 136181 - DNA, 601 bp, Human
ttaccatgactaactgaatacacaagcatacgtttgttttagctgcagtatgaggtgaagtaactaataaaaatacaaaacaaatagaccattaatcttaggccacctgttaaaagaatgagaacaggccaggcgcagtggctcatgtctgtaatcccagcactttgggaggtcgaggcaggtggatcacctgaggtcgggagttcgagaccaccctgaccaacatggacaaaccccgtctctactaaaaatacaaaaattagccaggcatggtggcacatgcctgtaatccaagctactygggaggctgaagcaggagaatcacttgaatccagggggcagaagttgcagtgagccaagattgtgccattgcactccagcctgggcaataagagcaaaactccatctcaaaaataataataataataaataaataaaagaatgggagcatgcaaattaagtttgtgggcctgtttggaaggcttcactggtcccagactaccttctcccagtgggatggggatgcctggaatcctggaattcacagaggggtgtgtagtggagccagttttgggagctttcctctgggaaaagtgctcaa

SEQ ID NO: 136182 - DNA, 601 bp, Human
tcttaaaaatgtcacactggtagtgggaagaattgagaccactctataagctgtgtaagcgttttagagcccttgtgttttcaagattttagacggtatgggagttgaaacatgagttaataaagaactggaagccacgagggtcctgtgttaagtagagccacaggggctagacatcagtgctctgcagagggctgggtgggaggggaggcaggacctcctatcctgtgttaagtagagtcacaggggctagacatcagtgctctgcagagggctgggtgggaggggaggcaggacctcytatcctgtgttaagtagagccacaggggctagacatcagtgctctgcagagggctgggtgggaggggaggcaggacctcctatcttgtgttaagtagagtcacaggggctagacatcagtgctctgcagagggctgggtgggaggggaggcaggacctcctatcccagggatgtcttcagtcttcaggacagcttgcttgcttctgagttgtctgcctcttgtttaggcttcatagagccaagttatgggtgctggctccaggcagcccctaaaagtgggtgagctttctgctggccttg

SEQ ID NO: 136183 - DNA, 601 bp, Human
gtgtaagcgttttagagcccttgtgttttcaagattttagacggtatgggagttgaaacatgagttaataaagaactggaagccacgagggtcctgtgttaagtagagccacaggggctagacatcagtgctctgcagagggctgggtgggaggggaggcaggacctcctatcctgtgttaagtagagtcacaggggctagacatcagtgctctgcagagggctgggtgggaggggaggcaggacctcttatcctgtgttaagtagagccacaggggctagacatcagtgctctgcagagkgctgggtgggaggggaggcaggacctcctatcttgtgttaagtagagtcacaggggctagacatcagtgctctgcagagggctgggtgggaggggaggcaggacctcctatcccagggatgtcttcagtcttcaggacagcttgcttgcttctgagttgtctgcctcttgtttaggcttcatagagccaagttatgggtgctggctccaggcagcccctaaaagtgggtgagctttctgctggccttgcctcctcagatcccattaagaaagccagagatcatgggcggcgagtgtgagc

SEQ ID NO: 136184 - DNA, 601 bp, Human
gattattgtgatcaataaagataggctgaggccacagtagacttcaggaagtactcattcccttctcttactttctctcttctgtctcttttgtccctctgacttcttggacgttagccagagagctaccgctgaggctgtggatattctcaggggctgtttcctcttcctccctgccttccctttctgccagcagccactcttgctctttcttcccagtgctgtctggggaggtaggctggggaagcttcaggagaggttgttggatgtttgtggctgctggctgctccctgcctaaggmccctctgggcagcccggtgttggcttttgccaacatgagctggcatgagccactgcacccaggccttgggtcccacttgagacagtgaatgagccagttggtatagggggcttccctgtgacaagctgctggctgttagagcattttccagaccccataatgtcccctcctgttaataaaggaggaagcagctgggtatccccaccctagatcttagctgagcattgactcccagtaaatttttgcacaattcccataggggatctttgattcacacctctggagagggcatagttggca

SEQ ID NO: 136185 - DNA, 601 bp, Human
ggagttcaggaagtgaagagctcgctctgggtaggggtgggattggggtctgctgatgccttctggtggagataaggaagtgtgttctggctctcaagaagagtttacattagggcttaagctggacaaggagggactgatatgatgtttagtgaaaaatctgattaaacctttttctgaatggccctcagggatctagaattgggttgaccctagtccttgcttgatgacatgctcttgttcacatgggccctgcttttgtcttgtgtattttctttctttattttttttggagacaggrtctcgctctgtcacccaggctagagtgcattggtgtgatcatagctcactgcagcctcgaacccctgggctcaagcattcctccctgctctgcctcccaagtagctgggactataggcacatgctatcacacccaactaatttttcaatttttatggagacgggtcttgctatgttgcctaggctgctttccaactcctggcttcaagcgatccttcggcctcggccttccaaagtgttgggattacgggcgtgagccactgcatttgactatcttgtctatttcaaataatgtgtttaa

SEQ ID NO: 136186 - DNA, 601 bp, Human
ttcaggaagtgaagagctcgctctgggtaggggtgggattggggtctgctgatgccttctggtggagataaggaagtgtgttctggctctcaagaagagtttacattagggcttaagctggacaaggagggactgatatgatgtttagtgaaaaatctgattaaacctttttctgaatggccctcagggatctagaattgggttgaccctagtccttgcttgatgacatgctcttgttcacatgggccctgcttttgtcttgtgtattttctttctttattttttttggagacaggatctygctctgtcacccaggctagagtgcattggtgtgatcatagctcactgcagcctcgaacccctgggctcaagcattcctccctgctctgcctcccaagtagctgggactataggcacatgctatcacacccaactaatttttcaatttttatggagacgggtcttgctatgttgcctaggctgctttccaactcctggcttcaagcgatccttcggcctcggccttccaaagtgttgggattacgggcgtgagccactgcatttgactatcttgtctatttcaaataatgtgtttaagtct

SEQ ID NO: 136187 - DNA, 601 bp, Human
ctagagtgcattggtgtgatcatagctcactgcagcctcgaacccctgggctcaagcattcctccctgctctgcctcccaagtagctgggactataggcacatgctatcacacccaactaatttttcaatttttatggagacgggtcttgctatgttgcctaggctgctttccaactcctggcttcaagcgatccttcggcctcggccttccaaagtgttgggattacgggcgtgagccactgcatttgactatcttgtctatttcaaataatgtgtttaagtctgttttaatgcaccttmaacagcagtttgcttgaatatagttctacttttgcaaagatgagctaaacggattttttaaaaatcttcattttagcatctacgtcatgggcttggttctggagtggattaaaaacaatggaggtgccgcggccatggagaagcttagctccatcaaatctcaaacaatttatgagattattgataattctcaaggattctacgtgtaagtcaatggattttatctcctattttgcctcttgtgaatttaaaactgtgtatatactgtgtaccgttgaaaagtggacatattcacctttc

SEQ ID NO: 136188 - DNA, 601 bp, Human
tcctccctgctctgcctcccaagtagctgggactataggcacatgctatcacacccaactaatttttcaatttttatggagacgggtcttgctatgttgcctaggctgctttccaactcctggcttcaagcgatccttcggcctcggccttccaaagtgttgggattacgggcgtgagccactgcatttgactatcttgtctatttcaaataatgtgtttaagtctgttttaatgcaccttcaacagcagtttgcttgaatatagttctacttttgcaaagatgagctaaacggatttttwaaaaatcttcattttagcatctacgtcatgggcttggttctggagtggattaaaaacaatggaggtgccgcggccatggagaagcttagctccatcaaatctcaaacaatttatgagattattgataattctcaaggattctacgtgtaagtcaatggattttatctcctattttgcctcttgtgaatttaaaactgtgtatatactgtgtaccgttgaaaagtggacatattcacctttctctgagacattaaaatactggtgagtgtgtgtggtcctgggccccatgagcaggggagt

SEQ ID NO: 136189 - DNA, 601 bp, Human
tgtttaagtctgttttaatgcaccttcaacagcagtttgcttgaatatagttctacttttgcaaagatgagctaaacggattttttaaaaatcttcattttagcatctacgtcatgggcttggttctggagtggattaaaaacaatggaggtgccgcggccatggagaagcttagctccatcaaatctcaaacaatttatgagattattgataattctcaaggattctacgtgtaagtcaatggattttatctcctattttgcctcttgtgaatttaaaactgtgtatatactgtgtacckttgaaaagtggacatattcacctttctctgagacattaaaatactggtgagtgtgtgtggtcctgggccccatgagcaggggagtgggtggtgagtttttccctcctgtacctcaccctggggctctcaggctttgggacctgtgtcccagtgggtggtgatgtttctcacaccaaagacatcgccctggggaagaatctcagttcaccccctggggtaggtcccgtctattccctcctttgtatatcttctgggaaaaaaacaaatgtactttctgaaatgtgtcaatttaaggactcc

SEQ ID NO: 136190 - DNA, 601 bp, Human
tttagcatctacgtcatgggcttggttctggagtggattaaaaacaatggaggtgccgcggccatggagaagcttagctccatcaaatctcaaacaatttatgagattattgataattctcaaggattctacgtgtaagtcaatggattttatctcctattttgcctcttgtgaatttaaaactgtgtatatactgtgtaccgttgaaaagtggacatattcacctttctctgagacattaaaatactggtgagtgtgtgtggtcctgggccccatgagcaggggagtgggtggtgagttyttccctcctgtacctcaccctggggctctcaggctttgggacctgtgtcccagtgggtggtgatgtttctcacaccaaagacatcgccctggggaagaatctcagttcaccccctggggtaggtcccgtctattccctcctttgtatatcttctgggaaaaaaacaaatgtactttctgaaatgtgtcaatttaaggactcctgttagcgatctttgggacaaatactcctgtcctcctcttctgcgttatttccctttttaagaaaattcactcctttccttattataagacagatgct

SEQ ID NO: 136191 - DNA, 601 bp, Human
gataattctcaaggattctacgtgtaagtcaatggattttatctcctattttgcctcttgtgaatttaaaactgtgtatatactgtgtaccgttgaaaagtggacatattcacctttctctgagacattaaaatactggtgagtgtgtgtggtcctgggccccatgagcaggggagtgggtggtgagtttttccctcctgtacctcaccctggggctctcaggctttgggacctgtgtcccagtgggtggtgatgtttctcacaccaaagacatcgccctggggaagaatctcagttcacyccctggggtaggtcccgtctattccctcctttgtatatcttctgggaaaaaaacaaatgtactttctgaaatgtgtcaatttaaggactcctgttagcgatctttgggacaaatactcctgtcctcctcttctgcgttatttccctttttaagaaaattcactcctttccttattataagacagatgctgttatcccagagtctgtgaatggaattggctttggcatgggctgactccagtttaaatattcccatgaacaaatgattaatgagtatgtcttaaccactgcccctgcacct

SEQ ID NO: 136192 - DNA, 601 bp, Human
tgtaagtcaatggattttatctcctattttgcctcttgtgaatttaaaactgtgtatatactgtgtaccgttgaaaagtggacatattcacctttctctgagacattaaaatactggtgagtgtgtgtggtcctgggccccatgagcaggggagtgggtggtgagtttttccctcctgtacctcaccctggggctctcaggctttgggacctgtgtcccagtgggtggtgatgtttctcacaccaaagacatcgccctggggaagaatctcagttcaccccctggggtaggtcccgtctaytccctcctttgtatatcttctgggaaaaaaacaaatgtactttctgaaatgtgtcaatttaaggactcctgttagcgatctttgggacaaatactcctgtcctcctcttctgcgttatttccctttttaagaaaattcactcctttccttattataagacagatgctgttatcccagagtctgtgaatggaattggctttggcatgggctgactccagtttaaatattcccatgaacaaatgattaatgagtatgtcttaaccactgcccctgcacctgggaattctgcagaaaatgtct

SEQ ID NO: 136193 - DNA, 601 bp, Human
cctcttctgcgttatttccctttttaagaaaattcactcctttccttattataagacagatgctgttatcccagagtctgtgaatggaattggctttggcatgggctgactccagtttaaatattcccatgaacaaatgattaatgagtatgtcttaaccactgcccctgcacctgggaattctgcagaaaatgtctgggtcttgtattagtttcctggggctggtgtaacaaagtactacagacttagtggctcaaaacatcagaaaactgattctcactcttctggggccagaagttcraaatcaaaatgtcagcagggttttggtccctccagagagccatgccttgcctcctttagattctagtggctcagggtggtccttgatttgtggctgcatcactccagcctccacatctgtcttcacatggccttctttctgccgtgtcttcccttctgtctcttaaaaagagaggtctttggatttagggcctgtccagataatccaggatcatctcatctcgagatccttcacataatgacatctgcaaagtcctttttttccaaataggtcatattcacagattctgggggttaggac

SEQ ID NO: 136194 - DNA, 601 bp, Human
aaatgattaatgagtatgtcttaaccactgcccctgcacctgggaattctgcagaaaatgtctgggtcttgtattagtttcctggggctggtgtaacaaagtactacagacttagtggctcaaaacatcagaaaactgattctcactcttctggggccagaagttcaaaatcaaaatgtcagcagggttttggtccctccagagagccatgccttgcctcctttagattctagtggctcagggtggtccttgatttgtggctgcatcactccagcctccacatctgtcttcacatggcctyctttctgccgtgtcttcccttctgtctcttaaaaagagaggtctttggatttagggcctgtccagataatccaggatcatctcatctcgagatccttcacataatgacatctgcaaagtcctttttttccaaataggtcatattcacagattctgggggttaggacatgcgcataccttttcagggtcaccattcaatccacaacaataggcccttcaccaaaatgccagatgggaagcacctagtgcggtgccttggatgcagagaagtgtaacaggtggtatcttcatttgcttttcc

SEQ ID NO: 136195 - DNA, 601 bp, Human
gacctgctctgtacactagccttgttctaggctcctggaagaccgagaagaataaatcatcttccctggctccctaaaaagtgctgagaacctgaatgtgagtaaaagcacttggtgggtatagtggacgggagaccaatttttctattagcttttagctctatacatttctcaggagatgtgtagacatgatgttagaggacagaaagaacggtgataccactgggaaaaaaattaagggcatcaggaacaaaataagaaagcatagaaggaattctgggactctcctgaatccccccccgccacgcctaggtcctttaactccaagcactaaacctgggcctctcccagaaggcagcctgccaaactaatgtggcaggcaggtcatctcctgggcaggtcatctcctggggaatctggtcatccttcacacccagagctcttcactcatttctgaactgccttgacccaggacttccagtccttttaagaataaacctctttctaggaactcccaccaccccctcagttgcctgcctggaaagcgtcatcccaggcacttggtgttctgtgggaccttgttactggagtagagaggagg

SEQ ID NO: 136196 - DNA, 601 bp, Human
ccagccctgccagtgaccttggcagggaattctgggactagataagacaaccatcgaagcctccaagttgattccatagcccagtcacccacactgtgctgactgaccccatgttgagcccacgtgggccgtttagcaccttgggcttagaagccccattttgccacggtggtgcgtgtgacctcgtgcaaatgacctaactgctctaagccacagttttctcatctgtacaatggaggtaatgatacatacttcttaaaattgtcaagagaattaaaaggaaatgcttctgaatcaagartatataatataaggattgagagcatttttacattaaggattgaggactcttgtgctggttaatttgtataaagtgctagaaacagtggttggcacacaggaagcattccttgcatgttagctcttaatatcattatttgtggttattgttatataaagcaattatgatattcctgacacacagtgcttatataagcttatgtaatataattaattatataagtatataatatatattaattttattatataaggatgtccaagtgacagattccatgtctggatctgaggtcacctttat

SEQ ID NO: 136197 - DNA, 601 bp, Human
gccaccttcattagttccttaggaaatgcagattaaacccatgagatatgttttgcctttcatctgcatacattaaaaggattgataacatctggtgccagcaagggcatgcacttttggtgagagtataaatctggacaaatttggagcaaagattgcagcgctcattataattcaaaacttacatgggctttgaccaaggattttgatgtctacagatttacccttccccagcactctgcctgggtacagtggtgtgcacaaaattagggaccagcaagtccaatgtaagatgtaatgrtggaaatatgcagttgtgcccatcagtaggggtctgatgaaaacaatgaggatctgtgggtaatatggaatgactgcattgagaaggatgaagcgggtctcttagcagacatgggaagatgactgtgttatgtcatcagaccaaaaggagcaagagcaagtgtaggaaaagacaaatctattagtctttaaaaactacaacaaggccagggacagtggctgatgcttgtaatcctagcactttgggaggccaaggtgggagaattgtttgaccccaaggagtttgagaccagcctgggca

SEQ ID NO: 136198 - DNA, 601 bp, Human
tacttagagatctggtttcttattccataatccatgtgcctgtgaaaatgggaaaaagaaactttgacagggatagccatatgtttcaggaaaaaaaaaagggagagcctctttttcagactagtcctccacgtttaaaatgtgagagagcttgtttgcaccttccacaccggcccgtcctactcatttatgtgagtggtgcggggacatgctggcttagagtttgccgcccatgcttgaagctcctcggtgccggcaccttggtacaggccctagttcttttgacctagaaagctttttktttgtttgtttccagccatttcctttttttaatttacagtttgcgttcagtgcaaacccatagcatgagacattactatgaatcaaaatgtaaatacacaaacacaatatagaatccaaaacagaggtgcagctttcaggaatgaagcagaagacaggttcattcacatgcacagtagcttcagggctgtgtgatctggttgttcccatgtagcttcctaaagatggaaaaaaatgattttggtcatcaagactactgtggccatattagatactggaaccgtagaaagttcttcataag

SEQ ID NO: 136199 - DNA, 601 bp, Human
gcccttggctgttacagcacttcctacgtataattgtgattccctccggagccatctctctgtagattggaagcagttaatttcccttaatctttttttctccccccagccccatactagagacactctcccatgggtagtgcataaatatttgttgcatgacaatttagtctttaatttctcacttttatgacattattgctttgtgatatcttctactttcatgataggatgggtaaattgcagggagaggaactgtaaatacggatgcttaattcttcctgctttcaatttttttctsttaagttaaatgtgctttttgttgctccacctctctgattggagcctcacattgggagcctgaggcagtggaatatcaaaagagggtagccgttgaatgtttattttcaatgtcagccgtgaaacctaccacttcgaatagtggggcctggaattcaggctcaaagtcttttccccatatttgtttccccctttggcctctcttttgcttgaagctgtgtactagactctcattaactttaacaagaattacagatgtgccctcagggggcctctcacactgcctttatttgctgtaatt

SEQ ID NO: 136200 - DNA, 601 bp, Human
ctgtagattggaagcagttaatttcccttaatctttttttctccccccagccccatactagagacactctcccatgggtagtgcataaatatttgttgcatgacaatttagtctttaatttctcacttttatgacattattgctttgtgatatcttctactttcatgataggatgggtaaattgcagggagaggaactgtaaatacggatgcttaattcttcctgctttcaatttttttctcttaagttaaatgtgctttttgttgctccacctctctgattggagcctcacattgggagsctgaggcagtggaatatcaaaagagggtagccgttgaatgtttattttcaatgtcagccgtgaaacctaccacttcgaatagtggggcctggaattcaggctcaaagtcttttccccatatttgtttccccctttggcctctcttttgcttgaagctgtgtactagactctcattaactttaacaagaattacagatgtgccctcagggggcctctcacactgcctttatttgctgtaattttaatgaattccacccgtagaagtgtaagaataaaagaggatatacttgagcaaaggga

SEQ ID NO: 136201 - DNA, 601 bp, Human
tgcaaagtgctgggaataaaaagatgaatttattcccataaatatgtacacctactatgtacccagaaaaatttaaaataaaaatttttaaaaagatagatgtattaacaggtacttatatagcatttaatatgttgcagacatagttttaaattgtgtcagttatttgtttctgcatcatagaacaccttaaaacttaagtgactgaaaacaaccaccattcacttgctcgtagttttttgggtcagcaggttgggctgagctcagctagggggttcttctgctggtcttgggatgcctsattctactgaagtcgtcatctggttattcatttggagccagatggtctacagtggtttcacatatctggcagttggtgctggctgttggctgggacacttatctccagcactctagctcaaacatgcttaagtgacagcaatatatatatatatatatatattttttttttttttttttgagacagagtcttgctctgttgcccaggctagagtgctgtggcacaatcttggctcactgcaatctccacctcccgagttcaagcaattctcctgcctcagcctcctgagtagctgggatt

SEQ ID NO: 136202 - DNA, 601 bp, Human
tcaatgtcacttaggaaaggagggagacattagcaaaactccaagtcgcgactacaagaagaagtgaaaagctggaaagagaaagctctcggtaattataaaacgaggcaaccagcctcaaaggcctcttcagggggtagtgacgaaatccgtacgtcctctaaagtgcaggaaaatgattcatccagaaaaaagaggcaacctctgaacgtagtgagaggtttttaaggaactaggcgatcggaaactgttctaattggaacaagaggcccagtagaattaagaattaaaaaaaaaaaaacatgggaatcactgaaagaggattttgccgtttccaccttaaaagacggttaaaaaaaaaaaaagctcgactaagggacatttatgggacgtgtttaacaaggtgggaaactagttcccccaacctttctatcgggttcttgacccttttagggagacagcggacgaggttcgtaagccaggaaaactagctccctggactccctggcgagtgcgtgcgatgaggagaggcccgagcactttgggggtgcacggtggtggtggggggaatgagtaaaagcgcagcgttatcgtgaacccc

SEQ ID NO: 136203 - DNA, 601 bp, Human
atgatttacttgctcatttacaaccaatagcacattttatcactcaattctccattaaaactgtaaatcagcattggaactttgtttttttttttgttgtgtttttttgtgtttttttgagatggcgtctcgctctgtcaccaggctggagtgcagtggcgccatctcagcttactgcaacctccgactcccgggttcaagctattctcctgcttcagcctcccgagtagctgggattacaggcacgtgccaccatgctcagctaatttttgtatttttagtagagacgaggtttcaccaygttggccaggctggtgttgaactcctgacttaaagtaacctgcctgccttggcctcccaaagtgcttggattacaggcgtgagccaccacgcctggctggaactctttttaaggacagttttatttgagttgtttccatgtaaagactatgcaacccagtccttaattcaagacatgaaaaatacaaactggaatagaaaaaggggctaacaggctgggcccggtggctcacgcctataatcccagcactttgggaggctgaggcaggtggatcacctgaggtcaggaggtggagaccag

SEQ ID NO: 136204 - DNA, 601 bp, Human
tatatcatctcagatttaatcttcacctcataagataaatttgcaactttcttccaaatgatttacttgctcatttacaaccaatagcacattttatcactcaattctccattaaaactgtaaatcagcattggaactttgtttttttttttgttgtgtttttttgtgtttttttgagatggcgtctcgctctgtcaccaggctggagtgcagtggcgccatctcagcttactgcaacctccgactcccgggttcaagctattctcctgcttcagcctcccgagtagctgggattacaggyacgtgccaccatgctcagctaatttttgtatttttagtagagacgaggtttcaccatgttggccaggctggtgttgaactcctgacttaaagtaacctgcctgccttggcctcccaaagtgcttggattacaggcgtgagccaccacgcctggctggaactctttttaaggacagttttatttgagttgtttccatgtaaagactatgcaacccagtccttaattcaagacatgaaaaatacaaactggaatagaaaaaggggctaacaggctgggcccggtggctcacgcctataatcc

SEQ ID NO: 136205 - DNA, 601 bp, Human
gtagtagttaagcttttggggagtcaagttatacttggggccaggtgcagtggtccatgcctgtaatcccagcactttggcgggccgaggtgggtggatcatctgaggtcaggagtttgagactagcctggccatcactgtgaaaccccgtctctactaaaaatacaaaaattagctgggtgtggcggcgcgcctgtaatcccatgaacctgggaggcagaggttgcagtgagccaagatcacaccattgcactccagcctgggtgacagagcaagactccatctcaaaaaaaaaaaaaaagttacacttggattcctgactgtggggcacagtgggagtgggctggggttcagtgcccctaaccccagcactgttcaagggtcaactgtaattttaagtgagctctcacatattaattgacaaggtccaagaattttctttctttttttttcccctgcctcaggtttatttgtactaatagcacaggaggaccccagccccataaagacggcagcccaggggggttgcatcagtccttctgtcctcacgttggcagacagagatacctactccgaagcctttgtaggggcctgagagcct

SEQ ID NO: 136206 - DNA, 601 bp, Human
atgaaacgatgtggagtgtgtgagagggcatgatttgaccttgacataagggtgataatgattctcagaagaactggaagttaggacactccagtaactcccctgagattcaacagtctaatttgtattagtaggaatagggctatatacatctctaacattttgtccagcttaaaatgctacctagcattattacattatctcataagccagtataaagcagctctagtataccatgaattcagtttcccttcaagttaaaaagcacatttctcgtgatctgtgacgtacgtttttctgkttttttttttttagtccaagctaagcatggacactgtaatatatcttaatgaagacatatccaatgcagcgtcatctttattctctgataacagccattatgttattcacaggatatatgctcagtgccaaagataagattaagctgcttttaaaagtgaagagtaaggattaactagtgctttataaatacgttctaaaacatttgaccttcagacacagagggcaaaaatagtgattaaaacacactaggcagctgggagaggtggtattcatctgcagtcctagctactcaggaggc

SEQ ID NO: 136207 - DNA, 601 bp, Human
gtgaatggctgggcacagcggctcacatctgtaatcccagcactttgggaggccaaggcagctggatcacttgagaccaggagttcgagaccagcctggccaacaaggagaaaccccgtctctactaaaaatacaaaattagccgagtgtgatggcgcatgcctgtaatcccagctactcaggaggctgaggcaggaggatcacttgaacccaggaggcggatgttgcggtgagccgagattgtgccattgcactccagcttgggcaacaagagcgaaactccgtctcaaaaaaaaaaaaagaaaaagaaaaaattaaatgtatatagatatataataaaagtagaatttcattattgtacttggcacaataagaaacacaagatacctctatgagtaagacagttctctccttcaaggagtttctagaatgcattattgtaggaatgcatctgaaacatgtgaagaggtaaatggtttcatacatcgattttagacactttccagaaatcaaagcatttgattacatgggattatatgtactttctggtactttccagtatcatgatgcctattacaggatttcctgaattaattctaag

SEQ ID NO: 136208 - DNA, 601 bp, Human
gagggacagcatgtggagaactggaaggtccagggagatacaaatgttaaaatacactttttcattgggaagtggaaaatgtacttatagtcttcataacacaaattacaaaagcttgatcaaatgttttctaataggcaaatatataaaagcagattagtagttgcctagggctgacgggaaatggagtgactgacaatgggttcaagatttatttttggcatgaggaaaatattctaaatttgaattatggtaatggttgtacaactttgtacatatactaagaaacaaactgtacagmttaaataggttaacctttatgtgggtaaattatatcaataaagctgatgaagaactggtagatgacaagtgtaatataaaggcaaccataaatacaaaatacaggaataagcaatttacttagaagataaaaaagaaggcttctggccaggcgcggtggctcacacctgtaatcccagcaccttgggaggccaaggcaggcgaatcacaaggtcaagagagatcgagaccatcctggccaacatggtgaaaccccgtctctactaaaaacacaaaaattagctgggcgtggtggcgcacg

SEQ ID NO: 136209 - DNA, 601 bp, Human
ctcttcttgctgccttgttactactaatcctttgcttacaacattacccccaagatccttgaattaccgtacattttcatattctccacctttgttccttgccctttgccttcaaagatatgtagatgttccttaactccaaaaattataaaaacaaacaaaaaaaactttaccactgttcattatcaaagttactattcatttatccattcaatatttagagtagctaacaagacaaaacaaaataattgctgctttcgtggcttatagtggggaagggtgataaacaccatgatgaaggagagaagagtgctattgtgggggcacaaattatggggatctgatctttttttttaagggaggcatcagggaaagtttctctgaggaagtaaggttgattctcaaaggacagatggcagagacccaggttaaggggtggattggcaccaggctgaagtctggtgctcacaagaaactaagtgacagcataggttggtatagtgtgtaagatcaccttattttcttcttcaggtaattttttgaaaacctggtttatatttgcatcttactctcattttttcttggttcccagtaacatagt

SEQ ID NO: 136210 - DNA, 601 bp, Human
ctcgccattgcactccagcctggatgacaaagcgagactctgtctcaaaaaaaaaaaaaaaaaaaaaaaagaacacataaacaaaaaaaaaaagtttcagctactctgttcccttttctctaaaatcctttcaattttcctatacattcatatttgtatatgccattcttaacagctatttgccattcattatacacagatgtattctcaaaaccagatacctcttctccccatacatctcttctcagaatgttttaaatgcataaaatacaaggcattataaagaaaatcaattatagcraaattgaactagcataaaattacttctaaacaatcaattttggggccaggcacagtggctcatgcctgtaatcccagcactttgggaggccaaggagggcggatcacctgaggtcggcaattcgagaccagcctaaccaacatggagaaatcccatctctaataaaaatacaaaattaacatgcctgtaatccagctacttggaaggctgaggcaggaaaattgcttgaacccgggaggccgaggttgcagtgagccgagatcacgctattgcactcctgcctgggcaacaagaacaaaa

SEQ ID NO: 136211 - DNA, 601 bp, Human
tcacctgaatttactttgtaactgaagaaatgaagatgactctatcagtcattccaaaatgtttcagaaagcaaagatttcttttatctgaacttcgattccagttcctaccaaattgcatttaatcaataattacttgtccttattcaaaaaggagtcacatttttccttggcttcagatcacagaaaataacccatataacacaaggtaatgacatttatttgcttttaactggaatcatgttttaattatcctgggctgtattactgtatacaatgtgtccctaataagaagtatcawctgccaatttcatttatcccaaggactgaaaatcactgcaataaattatttcaaattttgatgcctatgattctggtaagagtactttccttaaaataagcactaccacttttctttcaaacttttctagatattaaattctgctaagaaaatcaggtgatacttaaaattttgtttaaaaagttattttaaagcttaaactgcagtcatttctttgttaactccaataagaaccaatcccaaaatttaccatatctggaaagcttatgttttaaaaatattcaaaaggggagaacaggc

SEQ ID NO: 136212 - DNA, 601 bp, Human
tgttccttactcatctttctcatttcttaagatcgaaatatccaaactttggctgtaaaaaccatttaatctaacctacagccaatgcatcaatctaattcatgacatcaccaaaatttcctaggtcttaagtaacacaaatggttgagaatccattactccaagcagcatctacttggtcaaaaaattcttccttatattacttcaggacctttttatcctcaaaaatatagcttttctaagagtcccacacataatacataatattcaattttgcttaatttaaccaaaatgtcaatawacatttatcaacaattatatgcatacatacactctaaactctccaaacaaaatcttacaataacctgctacatatgacactaaaacttcatctgaaggagcagattgaaaactactagtctacagatgagtaagaaaccaagataattccaggttttgtcttattcccataggaaaatatctacaagtcacattattattttttttctgcctatgctaaggttaaatagtgatgcacaggattttaatactctgatttatgaataatgaaattccagtcaacagtactagtctcagttta

SEQ ID NO: 136213 - DNA, 601 bp, Human
acaaaccctccattatatttttaaatgtcattctcttcatagtatttttataagcacactgagtttaacttaaagcatttccagcattttcctgcccttaaaggtaacaaatactgatcaaaacaaaaaattatacatgtcttgatatttaccaatcattaccttaatgtattatcttttcccttaaggtttgttccttactcatctttctcatttcttaagatcgaaatatccaaactttggctgtaaaaaccatttaatctaacctacagccaatgcatcaatctaattcatgacatcwccaaaatttcctaggtcttaagtaacacaaatggttgagaatccattactccaagcagcatctacttggtcaaaaaattcttccttatattacttcaggacctttttatcctcaaaaatatagcttttctaagagtcccacacataatacataatattcaattttgcttaatttaaccaaaatgtcaataaacatttatcaacaattatatgcatacatacactctaaactctccaaacaaaatcttacaataacctgctacatatgacactaaaacttcatctgaaggagcagattgaa

SEQ ID NO: 136214 - DNA, 601 bp, Human
ctgccaacattatctttctgtccatatgttcttgctctacccagtagtatctgttaggattctattttttatttgtccccattttccccagagcttttattatcatgaatacacagattctaaattgtactcttctaccttgacaaatgtcttctgaagccaaactagtaatctctggcttgaacaacttacacctgttacctgtcaaccacagagcaagacttaggtgtcaactaccttaaatgaaagctttcttgtatctcccttcctcagaattatattttttcacatttgttacccrtgtacccaacagagacttctacaactctacaacaaggatggaacatcttatttttccatctttctttattagactctaagtttctttctagagggaagagactaattcttatttttttgccaccccaacccccagcactaagtacagtggtaggctctcaatacatgttcaatgtatggatgcttacgtgttactgaacaaacaaaaacataagccataactcttttattaggattcactcatatatgttagttaaaacatattaaaggctttttttttttttttgagacagagtctcgt

SEQ ID NO: 136215 - DNA, 601 bp, Human
tcatgcctataacgccagcattttgggaggccaaggcaggtggatcacttgaggtcaggagttcaagaccagtctggccaacatggtaaaaccccatctccactaaaaatacaaaaattagccgggcatggtggcgcatacctgtaatcccagctattcgggaggctgagacagaattgcttgaacctgggaggtggaagttgcagtgggccaagatcgcaccactgcactctacactcctgcctgggcaacagagtgaaaccccgtctcaaaacaaaacaaaaaaaccccccaaaaaaaacaaaaaataaaaccaaaaaccaaaaaaagtagggggataattccataattccattcaatagaggcacattttcttcaaaatcactgtggctaatcttagtgtttagtacttgcagcatttttttttttttcctaaccaggggtcataatttcccttgcccttctaaaacattcacaaggtcactttactaaaaacctagctaacctgtatgtacaaaatctaaacaatgtaatacaactttctttgtaaattattaaatgatgctacgaaatgtaagcaaaatatgtgaatgggtaagta

SEQ ID NO: 136216 - DNA, 601 bp, Human
gtacacaaatattaaaatgagcaaaatacatttgttaagcaaaacaaaagtgatgattaagttctgcagattcatagtgaaaagaaaacatggggaaaataaacacaaaaggacattcagcttcatggtatttaaaaaatatctctaagaaatatgtagacattgaatgaagagtgattagtacatagaatttcctccagttcacattttctaggattgcttcctttggtactttaaaatgaaggacaaaagggaagagctctgacatgagtatgtctaacagtttcattcatgtctaaayctacattcaatagcttcatttgtgactcaataaccagacactttctcacaaccaaaagactgctttataaaaattcagtgttcgctggagagttctttcctcccacaacgctaaaggaggaaaccttatttatcaagtaaactacaaatatgtaaacacgatcttcttaaacatctcaatctaaaaacaaaaatctaaagagcaaataatttgaaatgttctcctcttataaaaactgaaaatacatcaggaaaaaaatgttagtactgaacaaagatagcctattctcagtaaacaact

SEQ ID NO: 136217 - DNA, 601 bp, Human
aatggccgagcgcggtagctcacgcctataatcccagcactttgggaggctgaggcaggcggataacttgaggtcaggagttcaagaccagcctggccaaacatggcaaagtcccacctctacaaaaaatacaaaaatagccgggcatggtggcacatgcctgtagtcccagctacacaagaggctgaggcaggagaatcgcttgaacccgggaggcagaggttgcagtgagccaagaccgcgtcactgcactccagcctgggtgacagagcaaaactctttcttaaaaaaaaaaaaaaaatccagatataaactatctgaactcttccctcctacaaaggccattcttaaatgtgccaacagaatacttgttatctaccctaaaagtctgacattgccaatgaaaccaagactttttattaataaaaaatactacttagcactgacattatacaaatgggtcaggttaaacttctggaaaatttaacaagttgatataaaaatccccccaaaaagcgcttagcatttaaatcaaggtggcttacaattagcagtttaagtgagctaactaaaaacaaaaactagtgtttagaacaaaata

SEQ ID NO: 136218 - DNA, 601 bp, Human
aaaaagtctagtagtttatccttgtcgtttgcagatttcacaggcccatttcattacatactcaggaacctgtctttataaagaaagaaatgtatacatgcttgacagcagaagcaacaagtgtgctatctgtcataatgacacctgatagtctgtacacctgttactactggtaaacaaacatgaggtttcaaaatctagatataatggccgagcgcggtagctcacgcctataatcccagcactttgggaggctgaggcaggcggataacttgaggtcaggagttcaagaccagcctgrccaaacatggcaaagtcccacctctacaaaaaatacaaaaatagccgggcatggtggcacatgcctgtagtcccagctacacaagaggctgaggcaggagaatcgcttgaacccgggaggcagaggttgcagtgagccaagaccgcgtcactgcactccagcctgggtgacagagcaaaactctttcttaaaaaaaaaaaaaaaatccagatataaactatctgaactcttccctcctacaaaggccattcttaaatgtgccaacagaatacttgttatctaccctaaaagtctgacatt

SEQ ID NO: 136219 - DNA, 601 bp, Human
gctcaagcgatccaccctccttcagcctaccaagtggctcctcaactgtgagccactgtgcctagcaaaacacttatttaaaaagacccctatgttaaaagtccttgttaaagatatttagaataataaaaatgtaaatttaaaatggtgaatagctacctaattcaatgttacaagttccagagctggcaaataaaatgttcctttttcttcctggatcattcattcattcactcatttgagacagagtcttactctgttacctaggctggagtgcagtggcacaatctcagatccttgyaagacagccaagattcaccactgcaattggagcctcccgggctcaagtgatcctcctgcctcaggctcctgagtagctgggaccacagacgtgtatcactgcacccagctaatttttgtatttttggtagataaggtatttcaccatgttgcccaggctggtcttgtggaacttctgggctcaagtgatccgcccacctcggccttctaaagtgctgggattgcaggcttgagccactgtgcccagccggatcatttatctattaaggtagaaatggggtttccctatgttgcccaggct

SEQ ID NO: 136220 - DNA, 601 bp, Human
gtttatttaacttattttttattattttacttatttttgttgttgttgagacagggtctcactctgtcacccaagctggactgcagtggtgcaatcttggctcactgcagcctcgacctcctgggctcaagcatcctgccccagcatccccaagaagctgagattacaggcatgcgtcaccatgccaggctaatttttgcattttttgtagcgatggggtttcaccatgttgcctagactggtctggaactcccgggctcaagcgatccaccctccttcagcctaccaagtggctcctcarctgtgagccactgtgcctagcaaaacacttatttaaaaagacccctatgttaaaagtccttgttaaagatatttagaataataaaaatgtaaatttaaaatggtgaatagctacctaattcaatgttacaagttccagagctggcaaataaaatgttcctttttcttcctggatcattcattcattcactcatttgagacagagtcttactctgttacctaggctggagtgcagtggcacaatctcagatccttgtaagacagccaagattcaccactgcaattggagcctcccgggctc

SEQ ID NO: 136221 - DNA, 601 bp, Human
tggatgtattctaatttttctctattattaataatactgctaagtacatctgtgggcatagaatttttccatttagctccttaggaaagattctcaacaatgtataaacattttcaaggctctaggtatcagtcaccaaaaggatttccccaatcagcaatgtggaaatacaaaatattaaaagagcacaaacctctatatctcctctcctagagtaaatgccaatgtggagagtggtaaagttaaaggaggcagtctctttctacaaccttatgattgtagagttaaagttacaatctcyttctacaaccttatgagaaatttctcatgtcctggagttaggaaggatagaatggaaatgcttgcaacattttttattgattgcaccgatataaattgggtgaccacttgaaacatatacatatgttaaaagatgtaaaataatacatattatacatctttctaaaactcaacatttatatacatttatggcccgtgttaatggtaaacagtatgacaatgagactgaaaacaatctcaccactttataattactattttaactctcactgatttcttccctcaactatttatttgtata

SEQ ID NO: 136222 - DNA, 601 bp, Human
tgcccactggaagaggctgcctgctgtgctgctttctgctttaacattgtccaatcaaatgtgtagtcatattgatggttcagggtcctggaacacataaaatattttatgttaatcctttaataacagagtccagttatataacctactaactttttaagacagtgacagcatttctttacacaacgaatatttcctcaagtgtggcagcttctaaaatatttcttattatagatgaaaaaggcagcatgaaaactgaaacatgaaatcaagctgtcagttatctaggggaatactcatwagaggaggtacttcctaaaaacaagtaagagtaaatattcaactggaagtttgggaataagatgtctgactggtacctggggaagacacttttctggggttaaaagattacctgaattctctctttttttttttgagaccatgttttgctcttgttgcccaggctggagtgcagtggtgcaatctcggctcactgcaacctccgtctcgcaggttcaagcaattctcctgcctcggcctcctgagtagctgggattacaggcgcctgccaccatacccagctaatttttgtatttgtagc

SEQ ID NO: 136223 - DNA, 601 bp, Human
cattttggggattttcctacattagagatttacttgcttaaaatacacttatgaaacttagttcaataatactaaatcctctgaaaatttaactctgtgaagagtaatataaaaagcaccttctaaaaattccttgttgtgacacagggtctcatctgttgcccaggctggagtgcagtggcatgatcacagctctcattgcagcctcaacctccagggctcaggtgatactcccacctcagcctcccaacacagctgggatcacaggcactcactactgcgcctggcgcttttttttttkgggggggggggggttggggacgatgttggagggagctgggacagggtcttactatgtggcccaggcaagtctagaactcctagggtcaagcaattctcccacctcagcctcccaaatgtgttggaataacaggcatgagccactgcgcctgtcctaaagtttttaacaagaaaaccccagtaggatgttttcatcattattaaaacgatttattattgggatcaatgaatcattgagctgtatgagttccttttttttttttttttgagacagagtctcactctgtcacccaggctggag

SEQ ID NO: 136224 - DNA, 601 bp, Human
ccattttggggattttcctacattagagatttacttgcttaaaatacacttatgaaacttagttcaataatactaaatcctctgaaaatttaactctgtgaagagtaatataaaaagcaccttctaaaaattccttgttgtgacacagggtctcatctgttgcccaggctggagtgcagtggcatgatcacagctctcattgcagcctcaacctccagggctcaggtgatactcccacctcagcctcccaacacagctgggatcacaggcactcactactgcgcctggcgctttttttttttgggggggggggggttggggacgatgttggagggagctgggacagggtcttactatgtggcccaggcaagtctagaactcctagggtcaagcaattctcccacctcagcctcccaaatgtgttggaataacaggcatgagccactgcgcctgtcctaaagtttttaacaagaaaaccccagtaggatgttttcatcattattaaaacgatttattattgggatcaatgaatcattgagctgtatgagttccttttttttttttttttgagacagagtctcactctgtcacccaggctgga

SEQ ID NO: 136225 - DNA, 601 bp, Human
aaaacattagtaaatgctaccattttggggattttcctacattagagatttacttgcttaaaatacacttatgaaacttagttcaataatactaaatcctctgaaaatttaactctgtgaagagtaatataaaaagcaccttctaaaaattccttgttgtgacacagggtctcatctgttgcccaggctggagtgcagtggcatgatcacagctctcattgcagcctcaacctccagggctcaggtgatactcccacctcagcctcccaacacagctgggatcacaggcactcactactgygcctggcgctttttttttttgggggggggggggttggggacgatgttggagggagctgggacagggtcttactatgtggcccaggcaagtctagaactcctagggtcaagcaattctcccacctcagcctcccaaatgtgttggaataacaggcatgagccactgcgcctgtcctaaagtttttaacaagaaaaccccagtaggatgttttcatcattattaaaacgatttattattgggatcaatgaatcattgagctgtatgagttccttttttttttttttttgagacagagtctca

SEQ ID NO: 136226 - DNA, 601 bp, Human
ccgcctcagcctcccaaagtgctgggattacagaagcgagccaccgcacccggcctttttttttcttttctttttaaaattatttaaaatagcgatgaggtctccctatgttgtccggatggttctcaaaatcctgagatcaagtgatcttcccatctagcctcaaaaatgctgggattataggagtgagccacagtgcctggctgcttgtgtggttctgtttgttgcacagaattaagcttggagaattttaaatcagattggcagtatctaaagttaaagaataattaaaaaaaaaaaacctgtaataactcttccttccctatagaaactaaaagagtatttaaagttgggaaagataaatgacaattttaagtataggaggtatacactattcctaaactgcattaaaaaacagactgaattgttttgtcttccttataacagaattcattctgctacacatttctgacgttctggagttttaaaatacctgtttataattgattctttccccagctggtagatggtctgcattcaacaccactgagtcatagcaacgctgtattcttctaggtcttctaacagttgtgctatcatc

SEQ ID NO: 136227 - DNA, 601 bp, Human
tttaactcttcaaatgggtcaatggtatgacattccagccagggatcaacatttctccagtgaattgtccctaagatgttactgaagtatgtttaggaaaaaacctcaataggaatattcaacaggtattcaacagtcttgcagtactaagcattcttttccccaatacgcattggtctttggtttttatcttgcagattaggtggctcatccaggcttccaagagttcaagaacccatcttcactgtaacatcagttaaaatgaggaatgaatccctttattccttaaaaaaaaaggggrgggggaggggggagttaaaacagagttggaggatgtgatgattaagaagttaatagcttaattaaatttcaaatctgcaaaaagcaaaaaaaagtttatttttatataactaacaaggatattctatccctgcccgccacccaatctgaaatctaaaatgtatgctctggcccagacgaggtggctcacatctataatgctaacactttgggaggctgaggcaggaagatcacttaaagccaggagttccaaataaacctgggcaacatagtgagactttgtctattaaaaaaataaaca

SEQ ID NO: 136228 - DNA, 601 bp, Human
actggccttatgcctttgagtgagccttgccagagcctcatctggggaatcagggggttgagcaggatggtgttagtaacttattgtaagtcacagcagcagagcaggataggaacactcatttgcatgccaagctgaggagcttgacatgggatcttagcctcttctgctacagcagcttagctgtagctacaggagtttaactctggaaaaaggaaggcagtctcacatggtgtgtaccccagggtatgcacctgtaaccctcctgctccctttattcatttagaaaaggtgctgactyttctgttgagcacctggggttacagtaataagtaagtctcagcagaagatgtgagaagagctcaccattagtgccgtgccctgtgctggaagaagggtggataactccctgaggatgagttaaggaagacttcctaggggagaggagatatctacgtctaggaagaggagggggcataggcattccatgtaaacttaacacctgggttacgatctggaaggatgaaaaagcatggctttttttggccaggcgcggtggctcacgcctgtaatcccagcactttgggaggccgaggcgggc

SEQ ID NO: 136229 - DNA, 601 bp, Human
gcccactggctccctttttttttttctttttctagagagacttgataaatcggcctgagaaaataagtaatgctccagactagctctctcatttgtgagttctccaggtgaagcaccatttttgaccttcccttgtgtcttctgttcctggcacagtgcctggaccccaaggtacacgcttagagaacctcaaggaattgaattgaatagagtcacaagccagtgcaaatggaaaattgaagtaggcaatgaggtgagggaagcttggagaggccttggggcagtttactaaaattaaacyctcagggcataataaatcagaaaagccttatccgtaggtcctttctagtctgagatgtctgtcagttacagttcgttcccagaattgggcaacatatggaactttcagttatcatgttcctcctagcctacttggccacaataagtgattgcctctgtcacttttagtggtagaattgtccttgagacaacaggaactgactacagaaatcatactatttcaggggttgctgacatttgaggatgtggctgtgttttttacccaggaggagtgggattatctggacccagctcagagaag

SEQ ID NO: 136230 - DNA, 601 bp, Human
cccaccccttttcactctgcgttctggaacccctgttcgtcttcacataatgttccttccctcctggccttaactgaaacctggcactatcccaaggacaacgtttctctggcagtttttcaagtgggggctgcttattctcccacatcctcctccttccccatcctttgtctcaatgttggaagggggaagttattgttcactcagcttttaaatgctgtccccaaagcattagttttccaccttcaaacaaaatctctccttctttgaggtctcagcagtcttgctttttccactcaawtccttttcactatctgtcaacttttagtttggtccttcacacataactttgtcacatgtttcatagtctattttaactcgtgccatggatgacccagttaatacttcagcctcagtggatcttcagggaccctgctttccacttttactcagcaccttacatcattgatcataccagttttgtcataacaggcaaatcgtaaatcccaataccctattctctgaccagttattcggaaatggaagtttattgactgtgactagacgagggtaaccaaaacagacaggctttctccccttg

SEQ ID NO: 136231 - DNA, 601 bp, Human
actgggtttttatatcttagcaatattttttgtcactgatatgctcactgccctgttctttttagtgactattccaaaagcttatccatcattaagtagtgaagctcaccttctgtttctcagagaaaataaaggccaataagcatgaactctcaacttctctgcctcttatctacacacttaaagctgctctcatcttctcacctttccagaaactaatcagtcattcttttttcccttttagtttcagtcactatttcttctcccttggtacccttattctgatgattggtatgttcayaactcttcaacaggagaaaagagaggaaaaaagaaaaaatccctcctatgagtcagactctccctcttgctgctgcctatgatttactacttgttctcttcatagtcaagattttgtaagagtagttaatgtgtgttctgtatttctttacctccccttgtgtctgagcccctttgtcttgcctctaatactccctttaaattgtttaacagtgatctgtaacacgtcattgtcaaatgcagtagactcttttgggaccttattttagtctacctctctatgaatatgtgaaactcttta

SEQ ID NO: 136232 - DNA, 601 bp, Human
gggaccttattttagtctacctctctatgaatatgtgaaactctttattgtttccctccattggcttgcattctcagacttcccctcagtctgtactctttccttgggggaccttacctacactcaggtcatcagctaccgctctgtgaaaataagtcccattttttttttcaagtcatagcctcattctgttgcccaggctggagtgcagtggtgcaatctcagctcactgcagcctccacctcctgggttcaagagattctcctgcctcagcctcctgagtagccgagacaaacaggcrtgcaccgccacacccagctaatttttgtatttttagtagagaaggggtttcactgtgttggccgggctggtctcgaactcccgatctcaggtgatccgcccaccttggcctcccaaagtgctgggattacaggcgtgagccaccgtgcgtggcccaaatctttatttccacctaagaaaggtaatgtggagcctaactgcctaggtttaaatccttgttccaccacttacttagcctggtgagtatagtgatttaatctctctttgcctcaatttatttttttataaaatggaaataata

SEQ ID NO: 136233 - DNA, 601 bp, Human
ttttataaaatggaaataataatagcacctacctcatagggttattgtgagcattgactgaattaatgtatgtaaaacacttgacacactaacatgtagttaagaacaatataaatgttgacttatattgttgtcatcatcttctctgttgagtttccaattcctagtcatcttttgaagaccacatgagtaattcaaacctggcaagtttcaatccattaaaatcaagggccttctctttctttgttttaccagagctaagcactcctttctttgttttaccttgtatatactcctgctrttgaatttatcatactatactacaatcattctatatatgttacttttctaacctcactgattactgtgaggatggtagatatacctgttgcatttgatttctccagcacttagcacagagccaggcctatattatatgcttcttaaatatttatatgactgagtaagtacagttaacttaagactcagtatctcttaactggattattacattaacccctaaactacccccttgccactagtctccttttttaaaatatattctctctactgccaccaaagtgattttgtattagttaac

SEQ ID NO: 136234 - DNA, 601 bp, Human
gtaatataagtcattctttaataatctttttcaggatgtacttcactagtctgccttcttctaaactttagatttatttacttttttattggttcatgtgatttttgattggaatgattagtttcatagattgaaaggaattgagatccttataatattgaatctctttagccatttggttgactctgtttaactgtatccttttgtctttcagaaaaattgtatggaatatttttatggatcttacacatttcttatgtttattcctaggttttatgttttttgttactattgtgaagcrtttatatcatttctgtataatatttactaactttttttgtactaagaacaagctttttaatcttgttatgattatattttcatttgcttcttccaggaattttaggtatatattcatatcatcttcaagtaatgatcattttgtcttattcatttgaatgaaattgacagaacagtatccactaatccaactaacataactgaacaaatattctgaagagactgccttctcacaaagaatttacaatctagtggaagagacaaataacgaacagttaaaaaatgcagtgtaatcatagca

SEQ ID NO: 136235 - DNA, 601 bp, Human
aggactgaaacatgcccattttaggccaggcacggtggctcacttctgtaatcccagcactttgggaagctgaggtgggtggatcacctgaggtcagagttcgagaccaacatggtgccccatctctactaaaaatgcaaaaaaattagctaggcacagtggcgggtgcctgtaatcccagctacttgggaggctgaggcaggagaattgcttgaacccgcgaggtggaggttgtagtgagccaagatcactccagcctgggcaataagagtgaaactctgtctcaaaaaaaaaaaaaaaatgcccgttttatttttatttgagtcattggtaatctaatgagaagtttctctagatgctggaaacagaaaccagatttcgccacaggttgcagaatagattgaataggaagaggttgggcttggaaaacataagaaatagaaaacctcggtgttaagattttttttcaatgcttggctttcataaagagaaggatttcaggttcaagataaaattggacatatttatgtaatggtaggaaagtgtcaatagagagtgtgtattgaagaaagaggaaagacgggataattaagcaaatgcc

SEQ ID NO: 136236 - DNA, 601 bp, Human
tatgtgaaagaaaatacagcccactgaaaaatttgagaggggacactaaaaagccttagaagaaataaaatttctagtagtttcttaggggaataggaaaaggttattttagaataaaataatgaagtaagcaaatagaaaattcaaagatgactccacaaaaaattgagagaaaagaggatgtatgaaaaaggagcttgtttagggccaaatataaatgtggtcattattgaatcttctagcggaattatctaatatctattccagcaagagatggaaaatcaggaagatgtccgaagcrggcctagatgtactatatgacactctgttatatcatagaccactgtgctgtcttttcttcaacacatgcaagattttcatttctcagatgtcatgcagcctctcagttggaacaagatggtgaaccttgggtcttatattgttagagggtttagaatcacatgtacttgaggtatggtttgtggtaggtaaagtcataagctaccacagactgccctttttggttgttgctcccatgaactctgaccatgtttcttaatacttattttattctgcatctcgatatcatagactctctgtc

SEQ ID NO: 136237 - DNA, 601 bp, Human
aggatgtatgaaaaaggagcttgtttagggccaaatataaatgtggtcattattgaatcttctagcggaattatctaatatctattccagcaagagatggaaaatcaggaagatgtccgaagcaggcctagatgtactatatgacactctgttatatcatagaccactgtgctgtcttttcttcaacacatgcaagattttcatttctcagatgtcatgcagcctctcagttggaacaagatggtgaaccttgggtcttatattgttagagggtttagaatcacatgtacttgaggtatgrtttgtggtaggtaaagtcataagctaccacagactgccctttttggttgttgctcccatgaactctgaccatgtttcttaatacttattttattctgcatctcgatatcatagactctctgtcacctaaccctttattattgtttttaaaagccattttgtctctttatacaggagctgctttttacttaatattttctttatcatattattttctttccccattttttacttaacatccattccatttggcaggggggcttcatgtcttatctctgaatcctggctgattacaatgttt

SEQ ID NO: 136238 - DNA, 601 bp, Human
gttcttttgtgccctcctacctgtgagagatatttgtagtcctatgtgaatgagcttatccctccacaaccaggtgcatatgaaagtgtacatattatgactgccaagtattggaaatgaaaagacctggagtctatgctaggaagctgagatattttggtattgcattggtttttatggtaactaggttttgcatgcaattaaaaatccttatttcttgttctagggcttcccttagttaatggttattataaacctattaattcatctgttttaaccattaaaacctgttttgtttttmgctttgtgtaagagttgttactttagtgtaaaaccaattctgtcaaacgcattactgtgtttttaaaattagaatcaaaaataggaaggaaatagctgtcatttgttctgtgtgtgactagttaagcttttctggagtagctcaattaagcccaggttcttcagtttctgagtatagaattccaaattagcagaattctgtaattccagcttcctaatagtttgagcaaatgacccctccttctcctgtacctcagtcattccaaaaattacctccagactttcatcttcccatctcttt

SEQ ID NO: 136239 - DNA, 601 bp, Human
aataaatgtatcactattttccctcttcattttctgttctctctaaatccgtccctcttagggattgccactacattttactcacattattttaataattttctttatagaagttgtttgacccctattggcaccattagggcatatttttcttctgcaataaaatactcaaggtaacttctggagggctctgcatttgcaaatggtttctttcctgagacaacaaaagatgaaaactacaaatgtgatcacagtaatgagtaataaaatactcaagccccactttcagaatttggggagsaccaaatctcctactaatcctcctcaactaattcacatggtttcttgaaatagctacagaacggagtgttagtaggattttacatgacaataaaaggactatctccataaaagtactggatcttttttgaggtgatagagcatttaaaaagtgcaaacttaaaggaaacttaaattcaacttaattttaaggaagtctgatcagccaaatactccataaaaaacttgaaaactattaagctactaccttgcaagacttatgctacagatacaactgattaagaattattaactgggatac

SEQ ID NO: 136240 - DNA, 601 bp, Human
cctcagttgaattctttctttcgaggaggcaagaaatgagattgctgcagacccatacagatttgccaccagtaactcagatattcaccacccctaacaatattatccattcaatttatttctatacaaatatcacatgcatcaaccagcgtgcccaaacagaaataagtcaattagaaagtcattaactttagctcaaacttatacttgctttttttggtattttttaacattacatttcactaccagaaagcattcctgaattgcataaataggtataacatatattcaaagcttcaakaaatattttcacagaatctaattctaacatggcattagtcttacattaaaagaaaattacccttcaaacaaaatataaataggaccacagtacagtttcccagaataggagggcttattctataaaattctaggcaatagtcttttaaaagagggagaaatattgatggggatggggaagacagaataaagaaattttaacaaatgacttctgatagcctttcattttcctcagaaatataaatttcagctcaatatcatcataatagcaagtccctactgacatcctttctaagcaaat

SEQ ID NO: 136241 - DNA, 601 bp, Human
gcatattaatgttatttatctctcattgttttacttcatccaagaaaatcaaaatcatggtactccaaagactagagatgattcaagaaagcctatgcattttttctcatctgaaatcccactgggcctgatctgtttcccattgccagtgcactgctgctaaagctgtacaatatcaagcacccttcctctaaactcaaagaccattgaagaagaggacagtgtgtgagattctaaaagcccaattagaaagctggagtgtggaggttatagcaactccatcttgaattctaatctgcctgttgacatctgattaatcccacttctaggaatgcctttaagatttctgccttatctactatctcttgtataagagcacctaccataaatcctacccttaggcaaattcctacatattcctgctgaagcatgtatatcctttccctatggtatatcaaccctgggtctggggagtaacagtgaggggatcctttgtctcacagctgcctgagacacagcttctgtttgtaagcccctattaaatgtttctctctgagaaactgttttgtcactctctttgttcagtgtctcagctcccttg

SEQ ID NO: 136242 - DNA, 601 bp, Human
atgattgtgaggcctctccagccatgtgaaactttgagtccattaaacctctttcctttataaattacctactctcaggtatgtctttattagcagtgtgtgaacagactaatacagttacaaagcagcttcctcctttgttgtttgtcagagtggctctttgttccttcaggatcctaaacttctcattcaaagtcatctctgtctgttttccagcacaatttatgtcaattgtagggttccactttaggaactttcgttatgtcagattgcttccattttgttaaaaatgaagatacarcagtatgaattaatcctgatttctgtgttaggcattgcactgctccaggattgtccaaagatagagtcaaaattcctccgtttgtggtgaaagtgagacagccagtgggaaggagtccatggaaaaactccaaccgcgggcgaactgggaggaatgcacactggggtgccaccgaagtttctgctatttgcagtagggaggagcctggcccctcctcttcctgtgtggaaccttggattcaaatggcgaggcagggagcgcactagctgcgattccggctttgccgaaagtaactgttcc

SEQ ID NO: 136243 - DNA, 601 bp, Human
agttttgaagtttctcatctcagttacctgtctttcaacttgctacttgctctcatgctttcattcactaaatacaaactgtcagattcttaaactggaccctctcctccaaggccctatcagattaactttgtaaatatgcatcttcagtctttaagcaccaacattttaagctgagactaatgcctagagccacatttctaagttcagcactaaaaattcataattctggggtattagcctaaaatgtacctgaaaagtgaaccaagtttcagatattttcataaatcttgaaactccraactagaattccaatatttttaaaaatatctctcatgaagacaaggcaactgtatttactgcatcaacactattaaaggataactgatagcaacaaagggacctacccatatttcagaaggccaagatttgtcatgataaaatctaaaaaaatgggcaaaggcaatgagatcctaaataccactatcataaaaataatcagtttctatatttctatcttccttctgctataagaggaaccaaagaagtcaaatagataattgttctgtctgagccaacaatgaaatctttaagaacaggt

SEQ ID NO: 136244 - DNA, 601 bp, Human; identical to SEQ ID NO: 22987

SEQ ID NO: 136245 - DNA, 601 bp, Human; identical to SEQ ID NO: 22988

SEQ ID NO: 136246 - DNA, 601 bp, Human; identical to SEQ ID NO: 22989

SEQ ID NO: 136247 - DNA, 601 bp, Human; identical to SEQ ID NO: 22990

SEQ ID NO: 136248 - DNA, 601 bp, Human; identical to SEQ ID NO: 22991

SEQ ID NO: 136249 - DNA, 601 bp, Human; identical to SEQ ID NO: 22992

SEQ ID NO: 136250 - DNA, 601 bp, Human; identical to SEQ ID NO: 22993

SEQ ID NO: 136251 - DNA, 601 bp, Human; identical to SEQ ID NO: 22994

SEQ ID NO: 136252 - DNA, 601 bp, Human; identical to SEQ ID NO: 22995

SEQ ID NO: 136253 - DNA, 601 bp, Human; identical to SEQ ID NO: 22996

SEQ ID NO: 136254 - DNA, 601 bp, Human
caacaacaacaaaccccgaggcacagctagtgagcagcagagccagaatttcaaccaaagtctgtcttgcagacttcaagtctcctttacctttcaaggcattccctcacctccccctcctcccaagaggccacatcattcgtgtgtgctctgtcttccagaaacccttccaaccaccaagatggctcagaccaaccctacgccggggtccctggggccatggaaggtaagcccacccccatcacatccaacagggcaggggtgacatgctgcacagagcaggccccaggcctgtgctcgkccataaggcagtgactgaccagaaaaaccccagtttgtaggggaaaggtccacacaagctccagtgctgtcgaaggaaggatctctcaggatgtcccactggacaaaggaaggatgactgtggatgccattgatgggtgggagatgatacctagtttcctaactcctctctcctccccactaaagtcatcttaaaatacagcagcccagcaacagttatgtccatggagaaaatgagggcccataaagatatttactactagatcccaaataaattacaggactcagcctcccatcctga

SEQ ID NO: 136255 - DNA, 601 bp, Human
aacaggtttggcttgagccaaagcaatagtccaggggtgtctaatctttttggcttccctaggccacactgaaagaattgtcttgggccacatataaaataccataacgatagctgatgacctaacaacaacaaaaacaactcataatgttttgaggaagtttacaaatttgtgttgggctgcgttcaaagctgtcctgagctgcatgcagcccttgggcaacaggttggacaagcttgcaacagtcactagatcctgaaacaggtagagaataggtgatttggagaaaaagaaaaaaaawttttttttttttttgaggcaaggtgtcactctgttgcccaggctggagtgcagtggcacaatcatggctcactgcagcctccacctccaaggctcaaccctcagccccctgaatagctgggactgccagtagtgggtcaccacgcctggctaatttttgagttttgtagacggggtttcgccatgtttcccaggctggtctccaactcatgggctcaagcgatctgcttgccttggcctcctgaagcgttggaactacaggcgtgagacaccacacccagccaggaaatataattttaga

SEQ ID NO: 136256 - DNA, 601 bp, Human
gtggcaggaaaaaagacaaaagtaaaaaaagagaaaacatcactttcttctctaagcctgctatttgatttttctccaccaggtggtacttcccttaagctaaaactaagggtcttacaagtggcaataagtggatactcaagagcccagtaaacttgtgaaacactagtaaatgagtgaaagtgcttaccctgcagcaaaaagtaaatccttggccagttaaatttcaatctgtgtaacatttttactgcagaaacaggaaaatgctgaagtaacctttcagtaagtgggaatgactgamgaaataggcaagtcttccagtatcgatctacactgattgataataatcttcttgttctgaacacttaagtattactcaataatgcatcaggctgggatgtttctggtctttggaaacagttcaagcagaaagcagaatgaccttaaggggtgtgttgaaaatgatccctgtattaggagttaggttgggctagaacctttccaaatattcagtctatgtgagagtttctcgtgattttggttaataatctcatcttggttcaaagtcttgccaaaattcaactggtggagaagttaacct

SEQ ID NO: 136257 - DNA, 601 bp, Human
cagttcaagcagaaagcagaatgaccttaaggggtgtgttgaaaatgatccctgtattaggagttaggttgggctagaacctttccaaatattcagtctatgtgagagtttctcgtgattttggttaataatctcatcttggttcaaagtcttgccaaaattcaactggtggagaagttaacctaaatagttctaatccaaataaatagttgcctgtctggaaattatttcaatctcacttttaaaaacatttcatttgcccaccctaaggtataactgacatacagtaaaatgcacagaycctaagtgaatattctcatgagtttttgaaaaatatatagatccatgtaaccaacaccctaaccatataaagaacattccatcatagttccctggtgtccctttccactcaattgctcccctaccactttctattaccaaacagttttgtccatttttgaagttcatacaggttagtctctgtctttttaatgcttgtgtagtattcatgtcccctactggacatacaggttatatccaacaacacacatacacacgcaagcgcacacatacatatttgggcttactttttgtaataatc

SEQ ID NO: 136258 - DNA, 601 bp, Human
tgtacattcaaaatgttatggtatttaaattggaataaacaaaattatgggtaacttttttctcacaaatctgttgccttaatctttttaaattatcatgtgcttccttgtataatccaaaagtgtttcaattttgaaaaacatgaagaatgatagccatagcactagtactaaacattttaaaacaatttctgaattacagaatcataaggagtctaagatgaccatctttgagaaggaaaactttattggacgccagtgggagatctctgacgactacccctccttgcaagccatgggytggttcaacaacgaagtcggctccatgaagatacaaagtggggcgtaagtacaaaaacagggttggaatatacttcaaagtaactcctgaggttgcatcaatagttatgttttaatcagatttcatacgtatcggtatagatgtcacattctagttctacataattttgaatctcaatttctttataccaactaccactttaggttgcagatttatctcccccagacatgcctctatggaagaatttacgttgactacttatacctgttttgatgattaaggctaattaactagctatag

SEQ ID NO: 136259 - DNA, 601 bp, Human
tctttactcaaattatcattttcatttgaaaacagtggcttattttaatgctagtgtcatttttaatgtgccaattcaagacataagcattaatattatgctttgcaatctttgctgattcatcagaataagtgagaagcatcatccctctctgttattgaattaataaatcctgacatgcaaaaacatcccaatctccaggttcttctcttggtcaaagtggtaacagcacaggaccacctttcccgcaaacttttggtaagccttatagacaagaactaaagtgttctctgggggcagrtatcaactgggaaaaggaaaatacaggtttaaattacaaatgtcctcagcctctccatgacaagcagtttttcgaaggaagcaatctttaagaagtatttttaataggtaataggaggtgaatatgtccaaatgccttgaccacttatgaaatgtgatgcagaaaaagaggaaactaatagttctgccatacactaacaacatgacaaccaaataaaggtaaccaaataatggcaagttttaaatatctctttgaactcaaagaggtaaggatgaaaaccttaagcagtaagactgtgtt

SEQ ID NO: 136260 - DNA, 601 bp, Human
tataaaactcttaaaacacaggagaaaagcttcagtgacattggatttagcaatgattttgtggatgacaccaaaggcacaggcaataaaagtaaaaatatgtaactggaccatacaaaaataaaaattttgtgcactgaagaaacaacagagtataaaagcaaactacataatgggagaaaatatttgcaaatcatttatctgataagggattaatatccagaaaatataaagaaatcctaaagctcaacaacaaaaaacaattttaaaacgggcaaaggacttgaatgaacatttctcsaaagacagtgtacaaatggccaacaagcgtatgttgatgcttaacataaataattattaggaaaatgtaaataaaaaccacaatgagatacgacctcacacccaataggatggctaatgtcaaagtaaaacagaaaattgtgttagtgaagatataaagaaagtgtaaccctcgtgcactgttggtaggaacgtaaaatggtacaactgctatgaaaaacagtatggtacttcctcaaaaaatttaaaatggaattacaatatgatcctgtcatttcatttcagggtatatatccaaaag

SEQ ID NO: 136261 - DNA, 601 bp, Human
tcaaatgggaaagggcaagtctcttcaacatggtggtggaaaaactggatatccacatgcaaaagaatgaagttggacccttaccttataccatatacaaaaattaattcaaaatagattaaagatctaaacagaagatctaaagctataaaactcttaaaacacaggagaaaagcttcagtgacattggatttagcaatgattttgtggatgacaccaaaggcacaggcaataaaagtaaaaatatgtaactggaccatacaaaaataaaaattttgtgcactgaagaaacaacagagtrtaaaagcaaactacataatgggagaaaatatttgcaaatcatttatctgataagggattaatatccagaaaatataaagaaatcctaaagctcaacaacaaaaaacaattttaaaacgggcaaaggacttgaatgaacatttctcgaaagacagtgtacaaatggccaacaagcgtatgttgatgcttaacataaataattattaggaaaatgtaaataaaaaccacaatgagatacgacctcacacccaataggatggctaatgtcaaagtaaaacagaaaattgtgttagtgaagata

SEQ ID NO: 136262 - DNA, 601 bp, Human
taataaattatgttgtacattccttaatctttatcacagttctgcaagataggtcttttcattctatttgtctaatggggaaagtgaggctgagaggttatacgacttgtcaggtcacgagtggaatggaaattcataagtggatctggtcttatttttctgaatcttaagatataatgcttagaaattttcaaaactaccttaagttaaatgaaaatatggtagttaactcatcaactctccaggaaaaaagttataaatgtaaccctaatactggttggcatactacattggaaaaatygactaatgaacaaggttaatagctctatattaactagctacacatcagaaacttaaagtatgaagcacaaaaccaaaaagtgccattaaatacttatgtatgttattagaatctaggccttaaagtaattacagtataaaatcctgtcaactatcccatacgtccccaggcctccccacctccagccttttttttttttttgagacagattcccactctgtcacccaggctggagtgcagtcgcacaatcttggctcacagcaacctccacctcctaggttcaagtgactctcctgcctc

SEQ ID NO: 136263 - DNA, 601 bp, Human
gaggaggttcattaaattatagggataaatacacaaactgggtaataacatattacaaacaaaacagaattacttaagtcaataaaggcctaacatgcttatatttaaatcaatattccaaggccagaattacaaatttcacatttgttttagatttcagtaagattattatttttattgttaaaatctcaggtagtgtagtataaatgagtcttttgatgtcaaactctaaaatattcatcttaagacattaacccttgtaaaacctttgaccacataaaaaagatctctgaaggatacrttagaaactgattagccatggttgcctccatagaaaggaagtaaacaattgggtaactttttataatacttcaacttttttttaaccatgtgcatttattatatgttcaaaacaaatactcttcaaaattaaaaatgtgtttggtattctaaaataaaatctgctagaatataaaaatctggtaacagaatacattaaggtctacagctacagaaaacatgttagaattccacagtataagaaatatatttttagtttcaagtaactccgttacacgactgtgttccgatacaattcctt

SEQ ID NO: 136264 - DNA, 601 bp, Human
ttgtaccaattatcccgccatgcctaagattctttcccctctaagattaaagagcttagtcaagaatcacactaagaaaagcaataatcagttactacaaaaattagaataatgattaagttaatgtaatttatacacacaaggttgttttattatttcttcaggaaaaatgtgcccccatctctattatataaatgtttgacattaacaaatttatttaagcatgaatttctacatcactagcagaaagtgaacatgtagctccaagaaagttttcttatatactgttttgcactgtttsttgctgcataatgtcatctttctctgtcaacattgtttacccagcaaattaaaaaagttttagttgtctgccagtattgttttttgtcatgttttacaaaaaaataaagttttaacacctccaaagtctaaatgagagttacaacttaattactgcaatataatgttattcactatctggtgtcaagcctacgcaatttaataattcccaaatccttatatttaagagcaattattttacattgttattcctaagtaagtatgtttataaagtcactcagttgggagacaatcctttaga

SEQ ID NO: 136265 - DNA, 601 bp, Human
tcattgtaccaattatcccgccatgcctaagattctttcccctctaagattaaagagcttagtcaagaatcacactaagaaaagcaataatcagttactacaaaaattagaataatgattaagttaatgtaatttatacacacaaggttgttttattatttcttcaggaaaaatgtgcccccatctctattatataaatgtttgacattaacaaatttatttaagcatgaatttctacatcactagcagaaagtgaacatgtagctccaagaaagttttcttatatactgttttgcactgtttcttgctgcataatgtcatctttctctgtcaacattgtttacccagcaaattaaaaaagttttagttgtctgccagtattgttttttgtcatgttttacaaaaaaataaagttttaacacctccaaagtctaaatgagagttacaacttaattactgcaatataatgttattcactatctggtgtcaagcctacgcaatttaataattcccaaatccttatatttaagagcaattattttacattgttattcctaagtaagtatgtttataaagtcactcagttgggagacaatccttt

SEQ ID NO: 136266 - DNA, 601 bp, Human
agttgaaacttgactagtcttacacaaaatactctccacagaggatacccttaaacgggcctgaaattactataataacaataacattactgctatcgtcttgataataacaataaagcacttatctcatttgaccctaaaaaaacttagtgaggtaaaatattcagggagattaaatgatataactcaaggtggcctagatggtggcaaagccagaaccttattaagctattctaattctaaaatccacatggtctttctgtaccacctggaggtcctattggcagctgctaaattctcktggacataattccatactaacctggattgtgccacatttacccaacaaggaatggcattataatcagattgttttgtttttaatatatcctttctgcaataaaattaactatagtaaaactattcctttacttggtagattcctgtgattctgtaattacttagccattaatttcttgatgtataaaatcagtgtatcttcccccaacacacactgaaacaaaacacaatatatactaatgtttacttttaaaaacaatataacttcaactttcagagagtatatacacaaacacaagat

SEQ ID NO: 136267 - DNA, 601 bp, Human
ctttaaattaaataaataaggtaaataaaatgtttctttaaaattggatttgagtggttccatggagcacaatttgaataccacttccctacaacatctatcctcccaccttttcaaataatttttaatttaaatatgaatttaaatacacaccatcttacacaatgtgaatatatctaacactgcagaagtatacacttaaaaatggttaagacagtaaattttgttgtgtttaccacaatttattaaaaaaaaaaaaacaccatcttgtattgcttgctattttttcatgtgtttgaayatgttgaaggcaaagaatatgtcatatttctttccacaccactaagcaggtactgggcacaaaacacttcaacttattcattgactcactgaatatagcttaatacaaatcagcctgggttcacagaaccatttagaattactcaaacttcaaaaagattcaaaaaatgtatgttacctttacctcaatataaatgtgtactccccaaattcaacgcataacaactcatgaatttgctgggctactagagtataaaaaggagcactatctccctcttgtgtctttcagccatccactatc

SEQ ID NO: 136268 - DNA, 601 bp, Human
ttatcttaatgtattacaaatgtttatttacttgcctgtcttcaaagataatacgttttctagccttgcttaattccatctgtgtgtccccagtacctagaacataaatatagaactaaatataaacgtatggagctgccgctattcttatacacagccaaagtaactatgtatcacaaggaaaactgttgctgaattaatttaaaatatactttcacaattcaaaatctaacgaattcattctggaagggtatttttgcagcaactgtctagaaaattaagtgtaactatcaccaattctttataaactgctctcatctggtaaggtagggggtgtgtgtgtgtgtgcatgtgtgtgtgtataatgctaattacatggacatccaaatcaggaattatggcttagtaaggataccagaatactataccatcctttggataaaaattcctaagccagggataagaaacacatgacagataatataaattaactgctcttctcttcttagcctctctcctcatatatggggtctaaggagagtcctcaatatagcacactgtaagcagtaactgcagattgactgcagtcagcacagaagtt

SEQ ID NO: 136269 - DNA, 601 bp, Human
tctctcattctgttactatcttttcactttcttgacagtatcctttgaaacaaaagtttttaattctgaagtccaatttgtctagttgttctttgtgcttctggtgtcatgtctaactaaaacttgcctaatcctaggtcaggaagattaagcctatgttttcttctaagttttagctcttatatttgggtctttgatccattttgatctaacttttgcatataaggtagaggttcaatttcattctcttgcatgtgcatgcatattcagttggcccaaaaccatttgctaagaaaattcttttttttttttttttttgagacggagtcttgctctgtcacccaggctggagtgcaatggcgcgatctcagctccctgcaacctccaccgcccaggttcaagccattctcctgtctcagcctcccgagtagctgggattacaagcgcatgccaccacacccggctaattttttgtattttttaatagagatggggtttcaccgggttggccaggctggtctcgaactcctgagctcaggcaatccacctgccttggcctcccaaagtgctaggattacaggcgtgagctactgcacccggc

SEQ ID NO: 136270 - DNA, 601 bp, Human
ggtttggctgtgtccccatccaaatttcatcttgaattgtaactcccacaattcccacattttgtgggagaaacccccatgggaggtaattaaatcatggggatgggtctctgccatgctgttctcatgatagggaataagtctcacaagatctgatggttttaaaaacaggaagtttccctgcacaagctctctctctttgcctgctgccacccatgtaagacatgacttgctcctccttgccttccaccaggattgtgaggcctccccagccatgtagaactttaagtccattaaacccttcttttattaattgcccagtctcgggtatgtctttaccagcagcatgaaaatggagtagtagagtaatatataattattaatatttgacaaactatttgagagtaagttgagtcaccaagccttttaggccaaatacacacacttctgtgcagatgaacacggataaagccacgggaatgaaattgtccaagagtatgtcagtaaacgtgtaagaaaatctaaaactaaaccagtaacactcagggacaggcaaatacactaaggtcaaggatggaaattaaaacaaaacaaaaagcca

SEQ ID NO: 136271 - DNA, 601 bp, Human
cattataagggatacctgaagtactttaaactcttgttaacaataaattacttggcacacatttcacaacataccagtatatccacattgtggctcagaatctgatccaaacagactggaacaccagcaaattcattcatttactttcaataaaaattgataaagaactaatgctatcaagtgtgcaaaattctccagagtaattaaagttattgacttggaagaaactagatcaactagtaggcaaccctcagtaggtaacactgaaataagtgcagaattatttatgtatataatcaartgcgaaatttcgtgatatttataaatgcttcaaaattttattcagggtctgaacagcaactgtgtgactattatgtggcaggtactgaaggtataatggtaatcaaaaagaaagacaggatagtccttccttgtcactgtgggacagaaaggcagtcagacagtaagcaaataagcacacaaactactacttaattacacactatgataaatactataagaaaaaagttttttttttaaagggtcaaaatagaatcctatgcaccagccttgacaaatgcagatcacagcctctgctggg

SEQ ID NO: 136272 - DNA, 601 bp, Human
gctgggcaccatgactcacacctgttatcccagcactttgggaggcagaggcaggtggatcacctgaggtcaggagtttgagaccagattggccaacatagtgaaaccccgtctctactaaaaataaaaaaaattagctgggtgtggtggcgggtgcccgtaatcctagctactcgggaggctgaggcacgagaattgcttgaacccgggaggcagaggttgtagtgagccgagatcgcgccactgcactccagcccgggtgacagagtgagactttgtctcaaaaataaataaataaattaataaataaataaataaataaataagcaagcaagcacatgggccaggtgcagtggctcacgcctgtaatcacagcactttgggaaactgaggagggtggatgacctgaggtcaggagttcgagaccagcctggccaacatggtgaaacccgtctctactaaaaatacacaaattagctgggcatggtggcgggcacctgtaaccccagctacccgggaggctgaggcaggagaatcatttgaacctaggaggcagaggttgcagtgagctgagatcgtgccgttgcactccagtctgggt

SEQ ID NO: 136273 - DNA, 601 bp, Human
ggcatagtggttcatgcctaaatcccagcaatttgggacttgaggccaggagtttgagaccagtctggccaacacagcaaaagctcgtctgtactaaaaatacaaaaattagccagacatggtggcacacgcctgtaatcccagctactcgggaggctgaggctggagaatcgcttgaacccaagaggcagaggttgcagtgagccaagatcgtgccactgcactccagcctgggcaacagagtgagactcggtctcaaaaaaaaaaaaaaaagtacaataacattttcaatgctaaagtrtaactatagataattgttaaataatagcccaaattattcagaatctaccataaaacatttagactagaataaaccattgagatgggttttttttttttttgaaatggagtttcgctcttgttgcccaggctggagtgcagtggtgcaatctcgactcactgcaacctctgcctcccaggttcaagtgattctccttcctcagcctcccgagtagctgggattacaggcgcctgccaccatgcccagctaactttttgtatttttagtagagacggggtttcactatgttagccaggctgg

SEQ ID NO: 136274 - DNA, 601 bp, Human
actagtaagtgctgcagatccgcaagaatcagtcttaggtcttgcccaatgtatagtctcaacccccaaccctactactcacagcttcaattcctatcaataatcaaataataaaaactgtattttgagcctctatctctctctgagcaccaaatattctgcctcatgacacacccccctgaatggctcaaagggtatgtcaaactaaacatgttcaaaactgaacttaagattttcctctacccaaaatggtcctcttccaatattccctaactcagtaaaatggcatcatttatcgaataatggataaccacctcctccctgtttcttacgtcacctcctccctgtttcttacacccccaactgcattatatgtcagcaggttttactgatttaacctcctaagtatctcttgaaactgaaactcttctgccatcaccaacctccttgaccaagctattgtcaagactaaacaacaatgctccaacggagaccacttttatctccctctcctccaccccctacctctaaataaaacccttggatggcttcttattgcttttatattaataatattactcagcatggtctggaagccccc

SEQ ID NO: 136275 - DNA, 601 bp, Human
agtcacgagtcacagaaccagtcttatctccaagagctggaagtcttattctttccctgtgtgtgtaaccagttcatctctatggcccttgtacgtgcccatacatagagaatacaaacacatgagctgcaaagcctacctgacaccttgaacaaggtgtggaaaaacacatattccataagctggcaccataacaaacactccatccagctcaatgtataagatgtatactgagaatttacatatgtacatacttccactgaggcccacatgaaacataacctcatatattcattcttgccttattaagagatataaaaaacttgaccatatattatttcttgtaatttttaacttcatataccaaatcataacttttctttaccgtttactgcagtggcctagtaccaatgaactcagcacagtatcaaagaaataattaggtcatgataaatatacacattttattgtcaacatgtggggacttttaaaaaaaattaaaatagggatcagaaatcaagctataactcaggatttatttaatgaaaggcaacacattacacattgtaatcttctactttcaaaaacatgtaagtaaaca

SEQ ID NO: 136276 - DNA, 601 bp, Human
ccacagtatttgtcatatgaaataataaatgaggttccactcatgcggtctaagcaaagtaaaagagatgcaaagctagagttataatcagatcacaagcacctctcagtgtcctgccaataaaaattgtgctcctggccagatgtggtggttcacacctgtcatcctagcactttgggaggctgaggcaggcaggattgcatgaggccaggagttagagaccagcctgggcaacatagtgagatcctatctctacaaatacacacacacacacacacacacacacacacacacacacacggagagagagagagagagagacaacccaggcgtggtgatgcacacctgcagtcccagctagttgggaggctgcagcagggggatagcttgagcccaggaggttgagattgcagtgagtcatgatagcaccactgcactcctgcctgagtgacagagggagactccatcacaaaacaaacaagcaaaaactaaaaaaaaaaaaaaaacaaaactgtgctccctccaccccaacacacatagatacaaagtttccatgctaatgtaagtcacgagtcacagaaccagtcttatctccaagagc

SEQ ID NO: 136277 - DNA, 601 bp, Human
aaaagaaaaagaataaaacctacttctccattggtctgaaaaacaaatggcagattaggcaggtgacagttatcaccaggtatgctcaattttatgtacttataaaagtgcaatttcctctttgtgacttttctaaaattagactaaagctcaacttaaattttaattatttagttattcatggagcacctaccataaacacagcacgatttcaggatttaatgtagataaactacgccaaataaacaagatttgagatcaccttttagctagctcattgtaagaaaagctattataaaayctcagataaccaaaattctcatacattattacttattttttaaactgtagaatgtaaaaaatagaaaccaacaaacagtaaaaaaagataaaagaagtttatttttaaaacatcttcaactcaggaatctaaacagatgtctcctagcatacaacctaattggctggatgaggatcaaacctgagcccaccatgagtcaggactgatctgtaccaacacaagatttccccttagctgggtgtggtggctcacacctgtaatcccagcactttgggagcccaaggtcacggatcacgaggt

SEQ ID NO: 136278 - DNA, 601 bp, Human
attaaaaaaactaattgtattcaatgaaaaaagaaaaccttaattataaaaataactacttttagaaaaaaaatttaaattaatttctgtatcaatctagtgattttaagtccttaattaatacatcttataaacactgtaggttatttttataatgcacggtcctatgcttttcccctagttactcttcatacaaaggagtggcaatatatttttctccctcttgcttttcccttccatttcttaaaacatgggcaataacaataaacaacaatagctagcatattctgaacacttactrtgtgccaagcaccattccatgagctttacatacagtatttacaacaagcaaatgggatagatactattattatccccttttcagagatgaactgtaatataagattgtatgttaggagacatctgtttggagaacacactcaagtaacccatgctatatcatcaagtctggaacatctagggagggaggactgcaattttaagaactgaataaaccatgtgtgattcaataatatagtaattttcccataaccatgatattgtgggcctttattagaatcttataaaattatactgggca

SEQ ID NO: 136279 - DNA, 601 bp, Human
atcactcaatgaggatgaccagacactatgtttctcatgacatgatgcaataccacaacatcaactataaaggattcttaccaaaaaaaagaggaagaaagaaaagattcgacctgaattgaatcaagccttcggttctaactaccagtttgcagggaatagtggggatataggatcaagttaaacaccagcacaagagagcaatcagtcaaatccagaatgtggaacattatacaggacaaatgacctggtttctccaataaatcagtggcataaaaaagcaaagggaagggaatctgargagttaaaactgttataaaagaggcaaaagcgaagatttttgagacaatcaggaaatttcaagattatattactggaattgttaatactcttttaagtgtgataatggtatttaagtatatggtgcttaggaaaaccaaaatccttaccacttacaaattttttaaaaataaaatcaagactcagtttagggcttttttctacaaatactggagtatatttttatacaaaacatgctttaaaatgatcacttctaaattaattgtcattttttatactaatttcttcacaaagcaagacc

SEQ ID NO: 136280 - DNA, 601 bp, Human
gcccagctaatttttgtatttttagtagagacagagttttgccatgttgaccaggatggtctcaaactcccgatctcaggtgacccacacgcctcggcctctcaaagtgctggattacaggtgtgagccaccatgcccggtcttattattttctaaatgtaaaaaaaaatagacctcaaaaaaatgatttggcctcctgtgtccagagtcagtacttttttattacaccacagcaatctcaaacatctttacagctcttaatattttaaaatatgcttcattttatataagataaacaatytcaaagcatttgtagaagagtaaatttttgtcactctaattacattttaaatgtagtgattcttaccacatctgagtaaatgtagagaggtttgggggtttttgtatgtgttgcatgttttattaataatagatgtttcttcccttacacctgctaagttagaatcttttctgagattcttaagcatcttaaaaagttttaaatgactataatgggcccttctataccaacagagtaacagtgtacaaacagaatccacatattcatctcagtatcactcaatgaggatgaccagacact

SEQ ID NO: 136281 - DNA, 601 bp, Human
ggatatcctttgtcccttggaaatcctctgtgaatttgaaatcagtacttaaaatacagcatctatatgaagtcatgcttacttgaaagaattggtaaattcaaatttttttctaagtcaatttaagtatatacaaaaagcaatccataaaaaggctaaccatctttacatgcaaaatattagaagtttacataaaggttgagtatcttatttcatgaaatttaagcatattcctaagatgtcattaaaaagcaaaaattttaaagtatataaactatgacaattatcttgctctcctaarttgtgtcatcaattaagaaaacataagcaaatcaatcttaacacgaaataaaattactaatcagtatattttacaaaaattggagaaaaagaataaaatgagtcatttggtaataaaaatctattaattattttaaaagttaaacagaaatagcaaattttgctttctttacaaagtgagcctatatcctccgtaatgttcctcatgtgtacttattgtctatgtcaaaacttactccttgggatatacaacactttgtgctaatgcataaagtttctaggatcactacttgtatttgtg

SEQ ID NO: 136282 - DNA, 601 bp, Human
tcaggctggtctcaaactcccaacctcaggtgatccacccaccttggcctcccaaagtgctaggattagaggtgtgagccaccgtgcccagcaatgactcttaaatcttgaaataggtaacatacaatgcagagggtctcaactataaaccatccattggttctactataactccttatatccactggctattggaaatagttcatgattacagaagccaagaaaaagccaggtgggactcagctagagttagaagaatcaagcttaatggcaaagcctggttcctcatttttgacccacaataaaccatttactttcaatcagtttgatccctggtacaaaagtagctaaggagttaaacatctaggactgaacactttgggaattaaagggcataggagaagcatatatatgttgagaggcaattgtataatactacaaagaaattataaagttgcttatcgataaatctttgaaaaggcttttgactcatcaaaatgtcaggcaatagacaatcattaatacaaaaaggtgatgctactagactactattagtttaccttgactttcctatttaatcttccctctttaccaacagcct

SEQ ID NO: 136283 - DNA, 601 bp, Human
gtcaacatatgtaacagttcctgttcgaagtgtttgttcttttttgtccttctacttgccaggcactgtgtgctagacattcaacacaacttatctgttagaactataaaatgtcatgatttttaaagctcaagaaattaatctcctaattatattagggatgatttagaaagattatttatagccaaatgctataatattcctgcatcaaaacagaatacataagtgattttaagtacttttgttaaaaagttatctttcacaaactaaatcatgtatttaataaaatgcacattattgkttttacctactatgatacactattttgaagtaatcaagtcctctaaagcatatggttctataagaatatacacttatccaccttacaaagtgtttctagagatttgggaaataatacaacaaaaactattgtgcacccttaaaaataaatatagtcggccctacatatctatggattccgtattctgtgaattcaatcaaccacagactgaaaacgttaggaaaaaaaaatggatcgttgcatctgtactgaacatatatacagactcttttttccttgacattattccttaaacaatac

SEQ ID NO: 136284 - DNA, 601 bp, Human
ccatcctagccaaaaccattcaaaatacttaatggctcactctatttcttgatattacctgttgactcagttttttgaggtatgaaatgacactgtaactaagtccatattccatactgtctgctattaggttaggtgctcccatcatcctaacagctttcttcaagggctataggaaaaaagaaaacatcattcaatattaagcttattaaaaacttatggttccatgtatagtctgtcttaaaattttctccaaaaaattatttccccttcttttcctcaataaggaagtaacacaatygtatttatgtttcagtaaaatgtttgtcagtgggatgaaaggccgtttgaagtagttaaaaaggattagaggccataataactccccaagacaagaaggataagatactggtcttccttggtaccactgggagaaactaggtttggaataaatggacagaagacacattctagaggtagctctgataaaacatgggtagtaagtgaaaaacactcaaggaaaatgcaagatttctacttttgagtaattagctgctcaaccactcactagttatatgattctagatcagattataaataa

SEQ ID NO: 136285 - DNA, 601 bp, Human
gaaaaatctgcaggtttcaaaacataaagagttttttttttcttttttaaggaaaaatgactttctaatctaaatttctcaaaagataaataatgttcacatatagcaagtctaggaccacactcatgaagccattttcataaattaggaattattatataattttcaaattaatgtttcaaaacatagcacaccatggatgtgagacagaattatgtaatatatggctctaaaatgtaatatattaatataatggaattccattagaaccatcaagaactagcttttaacctgtttaacyatcctagccaaaaccattcaaaatacttaatggctcactctatttcttgatattacctgttgactcagttttttgaggtatgaaatgacactgtaactaagtccatattccatactgtctgctattaggttaggtgctcccatcatcctaacagctttcttcaagggctataggaaaaaagaaaacatcattcaatattaagcttattaaaaacttatggttccatgtatagtctgtcttaaaattttctccaaaaaattatttccccttcttttcctcaataaggaagtaacacaatcg

SEQ ID NO: 136286 - DNA, 601 bp, Human
agtacagtatggtaaaaaaaaaaaaaagtcgcatagctaactcttttatataaaattattgttagaactcttaaatcagaggtggcaaacgtttaaagtctcatctgacttgatttatagtaggtgccatggataaaggtgaagaaggaattatcagaaaatgtcatgaaactggccatccagagttaaaccatcagatactggtattatctcaagaaaatgattgagataagaaaaatcacttattttaagtatacagtttgataagtgggtgtgtgtgtgtgtgtgtgtgtgtgtgtgygtgcgcgcgcgtgcgcgcatgaatgcatgagaaaagctataaaaggaaactaaactgttaagaaaggttgttacctctagggaagagaatttggggcaacagtgatggtaggaagaaaggtacagaatcagggatgattcaccttttacttcatttgtttgaacttacaataagaatgttatagtactgtaataattctttgaaatttacatcaccatgctatgctttttcagactataaagaaaaaaaattaaaaataccagtattgaaactatgttctaaccttcgtcctgtcctttc

SEQ ID NO: 136287 - DNA, 601 bp, Human
aattatagtagaatttgtagaaaatggaagtacagtatggtaaaaaaaaaaaaaagtcgcatagctaactcttttatataaaattattgttagaactcttaaatcagaggtggcaaacgtttaaagtctcatctgacttgatttatagtaggtgccatggataaaggtgaagaaggaattatcagaaaatgtcatgaaactggccatccagagttaaaccatcagatactggtattatctcaagaaaatgattgagataagaaaaatcacttattttaagtatacagtttgataagtgggggtgtgtgtgtgtgtgtgtgtgtgtgtgtgtgcgcgcgcgtgcgcgcatgaatgcatgagaaaagctataaaaggaaactaaactgttaagaaaggttgttacctctagggaagagaatttggggcaacagtgatggtaggaagaaaggtacagaatcagggatgattcaccttttacttcatttgtttgaacttacaataagaatgttatagtactgtaataattctttgaaatttacatcaccatgctatgctttttcagactataaagaaaaaaaattaaaaataccagtattgaaac

SEQ ID NO: 136288 - DNA, 601 bp, Human
cctctttactggttccaccaccagcactgaaacatgctcaagcatctctgatattaaaaacaaagaaaaatcaccattttcaaaaccctgtgaactcttccagataccatgctcttttcccatcttccttttacaactaaacttaactggtcgtttatactcatagccattgtttccattttctcacctctcactcctcccataaccccttgttaggctctgcccctttactccacagaaactgctcttgctaagatcgccaaagaccacagaatctttccatttctcttgattgaacagtttttttttttttttttaaagtatttgggacaactacccactcaattatcttgccctttagcttccatgacattaaattctcccctattttctcctagctctaaaattcttccttctcaatctccttttctgctttctcctcttaactttggcactttcaaggttctgttctgagcgttttttcttctttttgccttggtgagattttattcagtgcaataggcagtaacctgcctctcatactacccctctagcccaatcctcttctcctgagcccaaactcaatattcatcttctaact

SEQ ID NO: 136289 - DNA, 601 bp, Human
cttgaagggaaaataaaaaatgtttttaaactcatacaactatgttttccagttaattgcacttcttaattaccatttataacctttatccaccttctttacacagtgatccctcggtatggatgggggatttattctaggcctccctatgaacactaaaatccacgaatgctcaagtcccttgtataaaatggcccaatatttgcatgtaacctatgtacattctcccatatgctctaaataatctctacattatttataatactaatacagtgtaaatacgatatgaattagactgaaytatttagaaaatgacaagaaaaaaaaagcctgtacatattcaatacagatacaaccatccatttccccgcctccaaatactttcaatctgtggttgcttgaatccaatgaatgtggaacccagggatacagagggccaatgtactaatgatcctgggctactgaaacaatcagaataaggcccatttgtccaattcttgtctccttaattacgttttcccatgtaaaaataaatgacactcaagtacgttatttttagtcaccaatattaatgtataaaggagaaaaattaaaggttata

SEQ ID NO: 136290 - DNA, 601 bp, Human
gttgaggtggcagcacctgttgcatgcaccagctgttcctcatatgcctcctgtcaggggcttgctcagctgggtcccttggaggatccacaggatctgggctgtgtgtatctgcaactgttgctgaaaaagccttggagtgccttggctcagtgagatgctgacaaagtggatggaggcatgagtgactgtgggaggcaggcagtgaatggaggcctgagtgatggcagctaaaagcatgggtaactgaaggtcggagtcaatgacacatgaaggactaagtggatgagtgactgaacargtgactgaggggcacagaggctacgaattatcctccaagaacttctttctcatcttcttagtttctccccacttcctgcagctgggaggtggcactcggcaaggcagataccttagattcagcagtggaaaccctggtttcctggggtagccgactctcccgcctgtaatataatgaccccctcccaggcatactttgccctctcactcacgggtacttggggagcaagggtgtgcagaggcgctggcgggcacgggtaggattaggtccacaggggggcatgcacagcccccaggtact

SEQ ID NO: 136291 - DNA, 601 bp, Human
gttatttgtcccactaggaaagccctccattcactcccatcccagttctctcaattgcttcttcctccactcagtctctcgctcactcaagtcctttgtgcctccattcaacacctctaatcttcaggccccactctaaccccctcagccgggagatcccttcccagatggcagcccttccacgagctgggaatagttcacttaatctagtagcttgatgtatgtggaaggaagaaaagggatgaacattttaaccctctctaacacctgggcccctctggcacctggaaacacttatagyggctaatcacctagctccaaggctccgttcacagtcttgatgccaggaatgcctttcccaacccctacctgccctgggaggcccagtcagcttcctggacctaggttgaggtggcagcacctgttgcatgcaccagctgttcctcatatgcctcctgtcaggggcttgctcagctgggtcccttggaggatccacaggatctgggctgtgtgtatctgcaactgttgctgaaaaagccttggagtgccttggctcagtgagatgctgacaaagtggatggaggcatgagtgactgtggga

SEQ ID NO: 136292 - DNA, 601 bp, Human
gtgttagagttcctcttcctcagggtctttgcaagcaggcacgtgtagacatggtcgtttctcctccaccaccagcttctgcccttgtagctcctcacaccgtggcagcggtctcccccagaaggtcacgttcttctcgccctgaccttcgaccatggaaacggtgggcctgaggcattaggggtggggaggaacggaagggagaatctcagggaaggcaagaatgcattcaattcttattgagtgcctgctatatgccgagggctactttttttttttttttttttccttttttttttttgaggcagggtctcactctgttgcccaggctgcagtgcagtggcacaatcatagctcactgcagcctcaatctcctgggctcaagtgatgctcctgcctcagcctcccaaagtgttgctgggattacaggcgtgagccactgtgcctggcctcccaacactactttttagctataggatattgggcaatttctttagcttctctgtgcctcggtttccctcatctgcaaaatgagaatggtaggaatagtaatattaatactcacctcacggggttgaatgaggataaatgagttaattca

SEQ ID NO: 136293 - DNA, 601 bp, Human
tttattgaggtttggaaggtcagggggctcagagtggaggagagaagtgttagagttcctcttcctcagggtctttgcaagcaggcacgtgtagacatggtcgtttctcctccaccaccagcttctgcccttgtagctcctcacaccgtggcagcggtctcccccagaaggtcacgttcttctcgccctgaccttcgaccatggaaacggtgggcctgaggcattaggggtggggaggaacggaagggagaatctcagggaaggcaagaatgcattcaattcttattgagtgcctgctatrtgccgagggctactttttttttttttttttttccttttttttttttgaggcagggtctcactctgttgcccaggctgcagtgcagtggcacaatcatagctcactgcagcctcaatctcctgggctcaagtgatgctcctgcctcagcctcccaaagtgttgctgggattacaggcgtgagccactgtgcctggcctcccaacactactttttagctataggatattgggcaatttctttagcttctctgtgcctcggtttccctcatctgcaaaatgagaatggtaggaatagtaatat

SEQ ID NO: 136294 - DNA, 601 bp, Human
gacacttcccctcatccatcaacagatgtataaagggttccaagccttaggggatgccgctgacatccggttcgtctacacccccgccatggagagtgtctgcggatacttccacaggtcccacaaccgcagcgaggagtttctcattgctggtgaggcaccgtccccgcgccctgtgccacaccaaccagtccctggggcgcggcctagcaaccacgagggggcgaggctctgatgggaatggtcccactggaaatggggaccaccccaatttcagtctatcagaaggccgggcctttgscagcttggcagctcagccaatcacaagctgcttgtcggtccccgccccgcctttctccttaggaaaactgcaggatggactcttgcacatcactacctgcagttttgtggctccctggaacagcctgagcttagctcagcgccggggcttcaccaagacctacactgttggctgtgaggaatgcacagtgagtgcctggaccctgacctccaacgggagatccttcccggggccattccctaaatcgtgggcttgtttcttgctccctctggctattctgtgtccctgtggctgctcccc

SEQ ID NO: 136295 - DNA, 601 bp, Human
tacttccacaggtcccacaaccgcagcgaggagtttctcattgctggtgaggcaccgtccccgcgccctgtgccacaccaaccagtccctggggcgcggcctagcaaccacgagggggcgaggctctgatgggaatggtcccactggaaatggggaccaccccaatttcagtctatcagaaggccgggcctttggcagcttggcagctcagccaatcacaagctgcttgtcggtccccgccccgcctttctccttaggaaaactgcaggatggactcttgcacatcactacctgcagtttygtggctccctggaacagcctgagcttagctcagcgccggggcttcaccaagacctacactgttggctgtgaggaatgcacagtgagtgcctggaccctgacctccaacgggagatccttcccggggccattccctaaatcgtgggcttgtttcttgctccctctggctattctgtgtccctgtggctgctccccaaccctaagggctgtccctgatctctcttgctatttccccaagcccgagactgctcccttacaaattctggctgctccctttccctgtgtccaataccgtgtgatc

SEQ ID NO: 136296 - DNA, 601 bp, Human
gtggctccctggaacagcctgagcttagctcagcgccggggcttcaccaagacctacactgttggctgtgaggaatgcacagtgagtgcctggaccctgacctccaacgggagatccttcccggggccattccctaaatcgtgggcttgtttcttgctccctctggctattctgtgtccctgtggctgctccccaaccctaagggctgtccctgatctctcttgctatttccccaagcccgagactgctcccttacaaattctggctgctccctttccctgtgtccaataccgtgtgatcrcctgtccctccctggtccctctaattctcccttgtgactattctgtaatcccactccccgttcctgagcccccgggattgtttcttggttccccagaatgttctccaagaacccaaagtgctgttccctaatcccactgacccttcctcagcacatctgcttgttgctctgcagctctgactattccagacaccagagggtgttacactgacctcctggctagtccaagcctgttccctgatggctcctgatggcctctgagcccagtgactatcttgaagccccactggctattcctgt

SEQ ID NO: 136297 - DNA, 601 bp, Human
gtctttgaggagacggtctgaagatgagtcacacaaagaaggttcaaaactgctcatggaactcactggaggaaaatgatttgtttgagaaggggtttgggggtgcggcacgtatcaggcacttaacaaatgcttcctagatcctttggagaaaaggccctcagagagagggcttggagttggggcacagagaaggcatccaatcaaaactcacaggatccatgaaaggcaaagcttttggagagaagctggggtgggatacacagcaggtactcaatgtttactaaatagtttaaaaggrctttaaggacggagctggggtgggacacatagcatagactggacacatgctcacaagacccattagagaaggcctcagggcaagggttgaggagaacaggacagtatcaggctctcaaagaatgctcacaaacctcattgaaatcaaaggccttggggaagggctcttggatgaggcatactgcaggtactagataagtgctcacaagatccattagaggacaaggcctatggggcaagggttggggagggtaggaaggacacgttcggttttcgaaggctcataggatatattgaagcc

SEQ ID NO: 136298 - DNA, 601 bp, Human
aaaaattagccaggcatagtggcatgtgcctgtagtcccagctactcaggaggctcgcttgaacccaggagacggaggttgcagtgagccgagatcgtgccattgcactccagcctgggcgacagagcaagactccgtctcaaaaaaaaaaaaagaaagaaaaacacaggacaaaattacccacaaaatgggggagatgagtctcaacttagagttttcaactttaaaccacagaggaattgagacccaggaaggaatgagggtggtgaggtttggtggaaaaggcgtcagactgtatttsggtgtacattccatcacagagtttgcacaactcctgctttatttggggctgaaatccctgaagctagtgtggttctgagtgtctgcaagttggtaaaacaggtctctgttccccacactgagcctggcgtacatacataggctctgtccctttgtccaccccaccccacatatagtagacactaaataaatatttgctagattgcctggaagaaaagactggaggggatgctgggataaaggggggcttctgagatgcagaaggggaagggatggatctttcactgaattcagcaggtgc

SEQ ID NO: 136299 - DNA, 601 bp, Human
ctgaggcaggggaattgcttcaacctgggaggtggaggttgcactgagccaagatcgtgccacagcaccagcctgggcaatagagcgagactccgtctccaaaaaaaaaaaaaaaaaaaaaaaaagggaggagcgaggatctttggatcgtgtgttaacacccaccagacagcatctgccatggcgccatggaagtgacactaggcaaccaggtagacagcatgagtcagcccgatgatgtcagccaggctctaatcagccaccccagtgttagcagatgggcacatgaataagtggcaayagcagcagagagagaagctatgtgtgggggcagcagtgttactgctgaatgtccaatctgccagcaacagagactaacattgaatccctgacacgccaccatccctccagaaggccaaccaaccactttgtggcaagctgattagattgggccccttccatcctgcaaagaacagtaatcgattttgactggaatattccatatttgagtttgccttttcttactgcaggacctcagccagctcactgtctaagggcttacataacgtttgatccaccagcacgagaccctgcataacac

SEQ ID NO: 136300 - DNA, 601 bp, Human
agggtgtatcactgtttctaaaacttttctgaccataagtgtagttggatactgtggtggtctgctcaggcctcctcttcagggacaatgtaccttgaatggcagctactgacagctcatggctgtgtccccactgggaattgtcttgtcacagggaactgccttgtccaaggttacacctacttcatgagggcatccccatggtctggtctatgaagggaaagaaaggccagcctccttgcctcaatctgggctgactctgaaggaccctcccagccccagggctccccctaagagcagyggaggcccctaaggcaactacatcttgagccagcctcttcctctgctcaacccaaccctcctcacaagtgttgatcccaatggcacactccagtaagcctcctgcatgcaaatctccacctcaaagtctttttccagggaacccaacctaaaacagtgggccatggaagtcaaactacaagggtggtctaatgcaattctggagctgggttacccagcagccagatggcagtgaggacccatcagtagtgggaggtggggcatagatagcctccgatatgctgtagcaacgcaaagtgct

SEQ ID NO: 136301 - DNA, 601 bp, Human
gagacactttcagggctactggtcactgacacacatacaatcagggtcttggacagacacacacacacacacacacacacacacacacacacggcacaaatggaccctggtgacttgactgacatatgcaagagaccccaagtacagctacttctttttccttgctctctctctgacacacacacacacacacacacacacacacacaccatcgctgacactatcccctcagaagtgttgagagagaatctctctcagccctgcacatttttcatctataaactgatgagtggggatgatragggtgtatcactgtttctaaaacttttctgaccataagtgtagttggatactgtggtggtctgctcaggcctcctcttcagggacaatgtaccttgaatggcagctactgacagctcatggctgtgtccccactgggaattgtcttgtcacagggaactgccttgtccaaggttacacctacttcatgagggcatccccatggtctggtctatgaagggaaagaaaggccagcctccttgcctcaatctgggctgactctgaaggaccctcccagccccagggctccccctaagagcag

SEQ ID NO: 136302 - DNA, 601 bp, Human
gagagggagcaacaggagggagggggagtgggagcagcagtaggaacatcacgaactgctatgtcattgtccccgggcccgtccccagctgggcttggtttccggtggcctcctcccccaggctcaagatttctagccaacaggctgcttgctccagggatggaagctcatcctcaatcaggtttatcatggaagggggatgagggggagagacactttcagggctactggtcactgacacacatacaatcagggtcttggacagacacacacacacacacacacacacacacacacacaaggcacaaatggaccctggtgacttgactgacatatgcaagagaccccaagtacagctacttctttttccttgctctctctctgacacacacacacacacacacacacacacacacaccatcgctgacactatcccctcagaagtgttgagagagaatctctctcagccctgcacatttttcatctataaactgatgagtggggatgatgagggtgtatcactgtttctaaaacttttctgaccataagtgtagttggatactgtggtggtctgctcaggcctcctcttcagggacaatgt

SEQ ID NO: 136303 - DNA, 601 bp, Human
ccatttctttgtgattggggtagaaggtctgatcaattagagggaattcttctgtccccagtttcttatgcagtcgaaccatctgggcaaactatgagaaccaggagagctgggtcagtgagtccttcaccacgaatctgtaagtttctgaacaccctcacttccccaaatcgcagactggtttcaagctcccacatacatgcatgagctgttccctctgccagtggcacccttcctgttacttaccacccagggcttgtcacagaagttgtagacagaatgcaaggagttaacactgggrattccagcatactgcagcccaatgaccaaactgcggtagtctccgttgcgtgccatgctgaaggcgtgctggcggatcagcacaaaatccggcttcagagacctagtgtggcaggggtaggagtgttgagagttcccccagaagctcccaatcactctcgaaacaaagaccaagtttttaaatctccatagctcccagaaattgcaaagtggtttctcacctctgcacacatgtgtgagctgttccctctgcctagtgcaccctttctaccctctgcccacctggtgatcccctttaagc

SEQ ID NO: 136304 - DNA, 601 bp, Human
ggcagaaaattctaattactaaaatcaggaatgaaagagtggacatactactgaccttacagaaataaaaagtattataagagagtataagagagtactgtgaacaattatgtgccagtaagttagaaaacctagatgaaatggacaaattcctagaaagacacaaactacaaaaactgactcagtaagaaatggaaaatctcaatagacctataacaagtgaagagattgatttaggaataagtaaaacttcctacaaagacatacccaggaccagatgtcttcactggtgaattctacyaaacatttaaaaagaattaataccgaccaggcatggtggctcacacctgtaatcctagcattttggtaggccaaagcaggaggatcgcttgagcccaggggttcaagaccagcctgagcaacacagcaagaccctgtctcaaaaaaagaaaaaaaattaatgccaatcttcacaaaatcttcccaaaaatagaagaaggaacactgtccaacttattctatgaggccagtattatcctgataccaaaaccagaaaaagacatcataagaaaactacagagcaatgtctcttacgaatata

SEQ ID NO: 136305 - DNA, 601 bp, Human
tgtatcaaaaaaaaataaaaattttttaaattaaaaaaatgaataaaagacatagggaagaaataacagaaaaattaaaaatggtacactagaaaatatctgtttaacttaaaagaaggcattactagaggaatacaggaacaaaaaataagatatagaaaacaaatagcaaaattgcaaacataaaccctaccttatcaggaattacaataacataagttaattaaacactgcgattaacccttttcctgtttaggaaaaaaaaacgtgcagcttgctgcctgtgctcactagattttayataaacatgctctttgaggctgaagcaaagctaactgattttcaatgtcaaaacaaaatataaaaactattcttggagttatttctaagctgaactaacatcagaatcatctgaatcatcagaatcatctgaatcatcagaaccatctattttggaaaaatcagattcatcaaatgattcttcatccaacgactgttcaagaacgatgttaacatcatttgtagggatgttacattttctaggatttgacattttcaatgattgagaattactatattttgtaagtggaaataccactcc

SEQ ID NO: 136306 - DNA, 601 bp, Human
catccagcaaaattatctttcaaaaatgaaggagaaattaagacattcacagataaacaaaaactgagatagttcatcactaacaaacttctacaaaaaatgctaaacggagtccttcagggtgaaataaaatgatactagctagtaatgtaaatctacataaagaaataaatagcacctgtaaagttaactacataggtaaatataaaagacagtataaatgcatttttttgcgtgtaacacttttttactcctgatttaaaagacaactgcataaagcaataactataactatgttcatgggcacacaatgtgtaaagatgtaatttgtttgacaataatagcacaaaggagggatgaaggaataaagttatatagaggcaatttctttgtattactgagcttaatttggtattaattctaattggagtaatataaataatgatgttaattgtaatacccaaggaaacaactaagaaaaaaaaaaaacaggctaagtgcagtggctcatgcctgtaatcacaacactttgggaggccaaggtgggtaacttgagctcaggagtttgagaccagcatgggcaacatggcaaggtcctgtc

SEQ ID NO: 136307 - DNA, 601 bp, Human
gaattgcttgaacccgggaggcagaggctgcagtgagccaagaccacaccaccacactccagttgggtgacaaagtgagactctgtctcaaaaaaaaaaaaaagaaaaagaaaaaaaaagacctcccttttagaaggggtcctgcccaatacccagaaggaagggatgttgcagagagagtctaaggctctgaacagacaggccttgctgggtttccccactcagtctgttagtacaagatcacaccctttttgtcccatcacatttctttctttcttttcttttctttttttttttttttgagacagagtttcgctcttgttgcccaggctggagtgcaatggtgtgatctcagctcaccgcaacctccgtctccttggttcaagcaattctcctgcctcagccgctcgagtagctgggattacaggcatgcgccactgcccctggctaattttgtatttttagtaggtacggggtttctccatgttggtcaggctggtctagaactcccgacctcaggtgatccgcctgcctcagcctcccaaagtgctgggattacaggtgtgagccactgcgcctggctgtcccatcacatttctat

SEQ ID NO: 136308 - DNA, 601 bp, Human
cccaaagtgctgggattacaggcgtgggccatcaggctctgcctgcatgttccctgctatcaagccctgctccagctcctgttcccactcttcgtggttccctttctgtttctactcttgtcagaactacatagttacaaaacagccaggaggtgctgctgccctaccaggcaccaggaattaatgagaaaagttgctgttaaggtagtatggctttggtacaggtttacagaaagtggccaatggaacagaatagagttctgaacctgcaggacagagatatgaaatgttagtataggcygggcgcggtggctcacacctataatcccagcactttgggaggccgaggcgggtggatcacctgaagtcaggagttcgagaccagcctggccaacatggtgaaaccccgtctctactacaaatgcaaaaattagctgggtgtggtgggatgcccctgtaatcccagctacttgggaggctgaggtgggagaattgcttgaactcaggaggcggaggctgcagtgagccaagatcgcgccactgcactccagcctgggcaacagagagacaccctgtctcaaaaaaaaaaaaaagttagtat

SEQ ID NO: 136309 - DNA, 601 bp, Human
tccctactcttttgtaaaatgttttattttattttattttatttttgagacagagtctcactctgttgccccagctggagtgcagtggtgcaatcatggttcattgcaacctcaacctcctgggctcaagtgatcctcccacctcagccagctaagtagctgggactacaggcacatgccaccatgctcagctaattttttgtagagacggggtttcatcatgttgcccaggctggtccggaactcctaggctcaagcgatcctcccagctcagcctcccaaagtgctgggattacaggcrtgggccatcaggctctgcctgcatgttccctgctatcaagccctgctccagctcctgttcccactcttcgtggttccctttctgtttctactcttgtcagaactacatagttacaaaacagccaggaggtgctgctgccctaccaggcaccaggaattaatgagaaaagttgctgttaaggtagtatggctttggtacaggtttacagaaagtggccaatggaacagaatagagttctgaacctgcaggacagagatatgaaatgttagtataggccgggcgcggtggctcacacctata

SEQ ID NO: 136310 - DNA, 601 bp, Human
aagtgagcatcctccatccccagcattcggggtgtctgtgggtgaatctctgggagagactctgtgacagctgagaggaagcttgtaggggtcacagccatgtggtattcagcatgggacccagctcagtggggagcctggggggccagtccttctctcacctgagcctcagtccttctcgccatgtttaaacatgggcgtcacagtcctggcccagaatccttcagaggtctgtggtggggttggaggatgtttacggggtgtctttgccccttggatatttttgggggggtcaaaacayaggaaatgggacagtcatggtggctgacgcctgtaatactagcactttgggaggccaaggtgggcagatcacgaggtcaggagttcaagacgagcctggccaacatggtttccatctctactaaatatacaaaatttagccagctgtggtggcgcatgccctgtggtcccagttacttgggaggctgaggcacaagaatcgtttgaacccaggaggcggaagttgcagggagctgagatcatgccactgcaccccaggctgggggatagagcaagactgtctcaaaaaaaaaaaaaaaaa

SEQ ID NO: 136311 - DNA, 601 bp, Human
ggctacctccaccagagacctggcatgagctcctggcaggatctgtaaccctgggctcattacatcccccattgctcttgtagaacatctgttaaaataggtcaagtgagcatcctccatccccagcattcggggtgtctgtgggtgaatctctgggagagactctgtgacagctgagaggaagcttgtaggggtcacagccatgtggtattcagcatgggacccagctcagtggggagcctggggggccagtccttctctcacctgagcctcagtccttctcgccatgtttaaacatggrcgtcacagtcctggcccagaatccttcagaggtctgtggtggggttggaggatgtttacggggtgtctttgccccttggatatttttgggggggtcaaaacacaggaaatgggacagtcatggtggctgacgcctgtaatactagcactttgggaggccaaggtgggcagatcacgaggtcaggagttcaagacgagcctggccaacatggtttccatctctactaaatatacaaaatttagccagctgtggtggcgcatgccctgtggtcccagttacttgggaggctgaggcacaaga

SEQ ID NO: 136312 - DNA, 601 bp, Human
caggggacacagagcccagaacagcagacgaggctacctccaccagagacctggcatgagctcctggcaggatctgtaaccctgggctcattacatcccccattgctcttgtagaacatctgttaaaataggtcaagtgagcatcctccatccccagcattcggggtgtctgtgggtgaatctctgggagagactctgtgacagctgagaggaagcttgtaggggtcacagccatgtggtattcagcatgggacccagctcagtggggagcctggggggccagtccttctctcacctgagmctcagtccttctcgccatgtttaaacatgggcgtcacagtcctggcccagaatccttcagaggtctgtggtggggttggaggatgtttacggggtgtctttgccccttggatatttttgggggggtcaaaacacaggaaatgggacagtcatggtggctgacgcctgtaatactagcactttgggaggccaaggtgggcagatcacgaggtcaggagttcaagacgagcctggccaacatggtttccatctctactaaatatacaaaatttagccagctgtggtggcgcatgccctgtgg

SEQ ID NO: 136313 - DNA, 601 bp, Human
tcaggggacacagagcccagaacagcagacgaggctacctccaccagagacctggcatgagctcctggcaggatctgtaaccctgggctcattacatcccccattgctcttgtagaacatctgttaaaataggtcaagtgagcatcctccatccccagcattcggggtgtctgtgggtgaatctctgggagagactctgtgacagctgagaggaagcttgtaggggtcacagccatgtggtattcagcatgggacccagctcagtggggagcctggggggccagtccttctctcacctgarcctcagtccttctcgccatgtttaaacatgggcgtcacagtcctggcccagaatccttcagaggtctgtggtggggttggaggatgtttacggggtgtctttgccccttggatatttttgggggggtcaaaacacaggaaatgggacagtcatggtggctgacgcctgtaatactagcactttgggaggccaaggtgggcagatcacgaggtcaggagttcaagacgagcctggccaacatggtttccatctctactaaatatacaaaatttagccagctgtggtggcgcatgccctgtg

SEQ ID NO: 136314 - DNA, 601 bp, Human
tcagggcccatttcctaagtcctcagctcttccaagccctagggggaaggtgaagtagcaggggaaggatggaacccagcgtggaggtcgttctcctgccgacctgtctaccctgcaggtcagcccttcgccaagtgcaatgcagaatggacagggaggaccggagaccagaacaggtctcaggggacacagagcccagaacagcagacgaggctacctccaccagagacctggcatgagctcctggcaggatctgtaaccctgggctcattacatcccccattgctcttgtagaacatcygttaaaataggtcaagtgagcatcctccatccccagcattcggggtgtctgtgggtgaatctctgggagagactctgtgacagctgagaggaagcttgtaggggtcacagccatgtggtattcagcatgggacccagctcagtggggagcctggggggccagtccttctctcacctgagcctcagtccttctcgccatgtttaaacatgggcgtcacagtcctggcccagaatccttcagaggtctgtggtggggttggaggatgtttacggggtgtctttgccccttggatatttttgg

SEQ ID NO: 136315 - DNA, 601 bp, Human
ctaaaaatccccaagctctgccatcctccctcccctacttctcccctcactcctctgaccaacttggaaggaaatactgacagcaatgaaatgcaggtagggttcaaaattaagaccagccagatatgctggcccataccctccacacacctccctcaacccaactgtcccctcacccaaactagggtctctagactcgaccctcacctttatgaatcatcctttctctagaaaaactgagtgagagaacctccaaatactcccctctgaggccttcctgcttccacagcggggtccagtscctggctcctgcccctcatactccaaaggtcttgactcaagtgaggcccttgggaactagaatttcagactggtgcaaacattcaatggagcacctgtgtcctcctgacctgaacgtgcttgaaaagggccccaatatatctcctttggtaaagaaaaggacccccaaattccctctcatcagagtacccactgctcttaccagtaagaacccaggtctcctccagggcattctaggtcaccaagcacagccccctggatcttctgtggtcctgtcccagagccttttacactcctggga

SEQ ID NO: 136316 - DNA, 601 bp, Human
aacccatgttgctgatgacctggtgtgagcaccctgggaccagtggggatgagggatgccaaatgttgggtttttatattttacttaaattctgatgtactggtagtaattctcaacattggcattagcactgatgatctgcaacagcagcaatggtcactgaacctgcattatcaaccgtaacctctgaataatttctccagccaatactttaaaacattttcctatactgattcctaattgctatttgcccagggctttctagttataaattatcccacagctgacaaatcactgcctkactggaaattccccattcacacatcttgccagctgacagagtcattgacaaatgccctaccaattggcaaatgactatcattgcctcaagcacagtcctgatgttgtccagtgaggatgccccatccaaacacgtgggtgttactgtcctcatcctcaggttttgtaccatgagtctgacttgagtgaaaggggacccagggcacccagagtcccacagtaacccagctggggacttgggaagaaggggtggccctggctccccagccatggctgcaggacattccttggaagggactgt

SEQ ID NO: 136317 - DNA, 601 bp, Human; identical to SEQ ID NO: 136296

SEQ ID NO: 136318 - DNA, 601 bp, Human; identical to SEQ ID NO: 136295

SEQ ID NO: 136319 - DNA, 601 bp, Human; identical to SEQ ID NO: 136294

SEQ ID NO: 136320 - DNA, 601 bp, Human
ggcagaggagacatgctcagggcagaaagggtgacctccaggggtggggcggcactgaggggatcccagccagtgggaactgcattatgagtcacttcccaggacacacaggtcagagacaggcaggcagcagctgggggtcacacagtgtctccacctccgggcccagaattgaacccagagccctgtctgtctgtccctcactccaccccaccaacaagttccagacgtcccgcccctgctttcccgggcagaggcatggtatgagcgtgggggactgttccagtaaaaagaaagtttrtttttacagtggatggatgatagtgaggcaagtgtgtgccagtgcgtgtgtgtgggggtggggggggtggggagtggtggtgagcatgtagtgactgaacccctcagccaaaccttgtatgtaagcctcacctgcacacataaactattgagaggcatgagcccttggaactcagatgtacatcgccaaacccagagatgccagtgacattgagactgacagccaacacaggctcaaagcacatgagctctggagcagcacagacacccacacagtcattcagccagccaggtgcccata

SEQ ID NO: 136321 - DNA, 601 bp, Human
aattcatggtattaagagtttaataatcatgaagcatttaatcgacaacttctaaccagtatttgtcatgttatatttcaaaaagttgagaattctaggcacatagcaaatgatagacttcttaagcaaaaatgcaaagttaagtaataaacgaacgtttaaaagactttcacaaagagaaaatcttaacctctaaccagttgaacagtagaaaacaagacataaaaaaatactcagaacaatcaaacctgtgctgtacgttagtacccactctgaaatagcatcatcagggcattatatrtttattacataatattgctttgcccttgcatatcacctttaatcaaaggatctcaaagcaccacagaatcaaggccttaacatccagtctcaaacagataaactgttatattttataattgcagatattaataaaaccctgctcctacttcccagtcctctgatcctaacatcagcctccaaaccctctctctgacttggaaacagtatttcccaaatcatctcaatctgtgactgatgccacgcacattccagcttttcttcactggacctaaaggaagtagcggcactgttttaataa

SEQ ID NO: 136322 - DNA, 601 bp, Human
gtcaatttctctcttaaagttttcaatgtaatagataaagtataattttagtccaaagctctaaatagtagcctaaatgttgtatacaatactcttataaaaacaagaatgtatttcttgataactttaccaatccagaaaacaaaattaccattgcttgcccagtcttaggccttattactaacacaggcagtaaatattttcttgcaaaaaacctacagtggttaacataagtcacactgcaactataaacaatgaatatagccgcatcatgaactatgatcttggctgcaacataaakaaataaatacatcatttaaatacaatatattataatgatattctgttgagatattttcagattttttcacaaataagttactacactaagatgttattaaatctagttcaaactcaatcactcttagcaaagaaaaaccaacatttcaagtaaatacacttgtaatatttataggacatatatattgcagaatgtagtaaaagtaccaactacaaattatgttttaaagggtacagcaaatccattcactacgggtgccactccctcatccaaaaaattgacatttggatcattaaaaat

SEQ ID NO: 136323 - DNA, 601 bp, Human
cactgtcaatttctctcttaaagttttcaatgtaatagataaagtataattttagtccaaagctctaaatagtagcctaaatgttgtatacaatactcttataaaaacaagaatgtatttcttgataactttaccaatccagaaaacaaaattaccattgcttgcccagtcttaggccttattactaacacaggcagtaaatattttcttgcaaaaaacctacagtggttaacataagtcacactgcaactataaacaatgaatatagccgcatcatgaactatgatcttggctgcaacayaaataaataaatacatcatttaaatacaatatattataatgatattctgttgagatattttcagattttttcacaaataagttactacactaagatgttattaaatctagttcaaactcaatcactcttagcaaagaaaaaccaacatttcaagtaaatacacttgtaatatttataggacatatatattgcagaatgtagtaaaagtaccaactacaaattatgttttaaagggtacagcaaatccattcactacgggtgccactccctcatccaaaaaattgacatttggatcattaa

SEQ ID NO: 136324 - DNA, 601 bp, Human
aaagatcactgtggcctaaaatgaactaaagaccattttagacacaagctggggtaggattcagagctagaaagaaggaattcaaagctgtgggaaacaatgtcatctgttttcttaataaaaatgtctaattcaaaataccaaataggagacattcaagtaaaaattcagagaaacattcaattcttaatatattatttattaagctattcaagtcacacatatatgtaaacagtacttatctaccttttggctttataaaaccctccaacttaaacctgaaataagaatcatcaggaakagaaagaaaaataaaaaggagctgtaactaaagaggaaaaagtccctgggcattaaatctcagtatacttttctattttctggaccttttcctttcatggcattttctcctggtatattcaacatatgtcattttactttaacttggaaaagtgataaaagttcactttgaaaggaaatgtattttagtaatttcctgtccacaagagggctccaataattcttacatgaatggaagtgatataacaaaagttacaataaaaatattcattaagcacataaaatatactggaaaaaactt

SEQ ID NO: 136325 - DNA, 601 bp, Human
attgtgaaaactattagcaccatcagtattttatccactaatttaaaataacttcaagttttaatactataaatatatatttttcatattccaagtgataacagaagcagacattatagacttcatatttaacaccactattactacggaacaatatttattttttctgtaagtaacgaagacagtaatagtttgtgagtcaagaaagtcactcaacaatttctgaatgtctaaaaaatatcagaggtgaaataaaagtgatactatatccatagaaatttgatacctgtgtaagaggaaygtcaaaagcactaaagaaaaatggtttacaagaaggaaagatcactgtggcctaaaatgaactaaagaccattttagacacaagctggggtaggattcagagctagaaagaaggaattcaaagctgtgggaaacaatgtcatctgttttcttaataaaaatgtctaattcaaaataccaaataggagacattcaagtaaaaattcagagaaacattcaattcttaatatattatttattaagctattcaagtcacacatatatgtaaacagtacttatctaccttttggctttataaaac

SEQ ID NO: 136326 - DNA, 601 bp, Human
gggctatcttaacactcaacctccaagtattcagaaaatttactggttcggaatgacttattacccaaggtttccaggttaccatgaattctacagtcactcttcatttttccctcccagaataagatgacttagaaaatcaaagagcacatttactaagtatatgcttcagtctcctaaaacatatttaatgttctatattgtgaaaactattagcaccatcagtattttatccactaatttaaaataacttcaagttttaatactataaatatatatttttcatattccaagtgataayagaagcagacattatagacttcatatttaacaccactattactacggaacaatatttattttttctgtaagtaacgaagacagtaatagtttgtgagtcaagaaagtcactcaacaatttctgaatgtctaaaaaatatcagaggtgaaataaaagtgatactatatccatagaaatttgatacctgtgtaagaggaatgtcaaaagcactaaagaaaaatggtttacaagaaggaaagatcactgtggcctaaaatgaactaaagaccattttagacacaagctggggtaggattcaga

SEQ ID NO: 136327 - DNA, 601 bp, Human
gctctaagtcatcaaaaataagttaaattatgcatagtatatttcatttaagcaaatgcaatggtaatccaacattgttagattgggctatcttaacactcaacctccaagtattcagaaaatttactggttcggaatgacttattacccaaggtttccaggttaccatgaattctacagtcactcttcatttttccctcccagaataagatgacttagaaaatcaaagagcacatttactaagtatatgcttcagtctcctaaaacatatttaatgttctatattgtgaaaactattagyaccatcagtattttatccactaatttaaaataacttcaagttttaatactataaatatatatttttcatattccaagtgataacagaagcagacattatagacttcatatttaacaccactattactacggaacaatatttattttttctgtaagtaacgaagacagtaatagtttgtgagtcaagaaagtcactcaacaatttctgaatgtctaaaaaatatcagaggtgaaataaaagtgatactatatccatagaaatttgatacctgtgtaagaggaatgtcaaaagcactaaaga

SEQ ID NO: 136328 - DNA, 601 bp, Human
aaacaaacagaagttctcatatttacttctcaaaattgacttgcttcacctcattttgtaaattactgatctagtgaaggggcataaagcttcacaatctatattaggtgccgagggtattatagttgtagcttatgcctgttaatactactaccatattacacagacaggtacccaataaacactgattgaatgcaagcaatattattcaaatcatagctctaagtcatcaaaaataagttaaattatgcatagtatatttcatttaagcaaatgcaatggtaatccaacattgttagaytgggctatcttaacactcaacctccaagtattcagaaaatttactggttcggaatgacttattacccaaggtttccaggttaccatgaattctacagtcactcttcatttttccctcccagaataagatgacttagaaaatcaaagagcacatttactaagtatatgcttcagtctcctaaaacatatttaatgttctatattgtgaaaactattagcaccatcagtattttatccactaatttaaaataacttcaagttttaatactataaatatatatttttcatattccaagtgata

SEQ ID NO: 136329 - DNA, 601 bp, Human
ggcgcaatctcagctcactgcaacctctgctcactgcaacctccacctcctgggttcaagtgattctcctgcctcagcctccggagtagctgcgattacagacgcctgccacaatgcccagctaatttttgtatttttagtagagatgggggtttcaccatgttggtcagggtggtctcgaactcctgacctcaagtgatccacccacctcggcctcccaaaatgttgggattacaggtgtgagccaccgtgcccagccctcccattctcttttactgacacttggcaggatctggcataygctcttcctagctgcaaaacagtcaacctaacttgtttcaccacagatgcattcctggtggtcttcacctggtgggtattaagagtttctttatctatataccaaccatatttatccagggtgactgtaaggattaaattaaatgctataatgtaaaatgccaagcatctgcctggtactagaaagtacacaacaaatattagttctctctcctctacgagctcaaagtaaagttatgtgtaatttttttatcacctaagcagttcttcactatcaagaaactgcatctctgcaaaacat

SEQ ID NO: 136330 - DNA, 601 bp, Human
acaacaaacttgtaagatccatctaagttgcatttagagggaatttcatatacattttttaaattccaaaaatattccaaaaaaaccccacaaaggagccaggcacagtggtctgcacatctgtattctcagctacttgggaggctaaggaggaaggagcagttgaacgcaggagttcagaaaccagcttggccaacacagtgagacccccatctcttaaaaagattttaaaaaataggccgggcgcagtggctcacgcctgtaatcccagcactttgggaggctgaggcgggaggatcaygaggtcaggagattgagaccaccctggctaacacggtgagaccccgtctctactaaaaatacaaaaaattagctgggcgtggtggcgggtgcctgtagtcccagttactcgggaggctgaggcaggagaatggcgtgaacccgggaggcggagcttgcagtgagcagagatggagccactgcattctagcctgggcgacagagtgagactccgtctcgggggaaaaaaaaaaaaaaagaagattttaaaaaataaataagctgacaattaatgacttaagtactcatctcaaaaaacttt

SEQ ID NO: 136331 - DNA, 601 bp, Human
ataataaaaataatatacaacaaacttgtaagatccatctaagttgcatttagagggaatttcatatacattttttaaattccaaaaatattccaaaaaaaccccacaaaggagccaggcacagtggtctgcacatctgtattctcagctacttgggaggctaaggaggaaggagcagttgaacgcaggagttcagaaaccagcttggccaacacagtgagacccccatctcttaaaaagattttaaaaaataggccgggcgcagtggctcacgcctgtaatcccagcactttgggaggcygaggcgggaggatcacgaggtcaggagattgagaccaccctggctaacacggtgagaccccgtctctactaaaaatacaaaaaattagctgggcgtggtggcgggtgcctgtagtcccagttactcgggaggctgaggcaggagaatggcgtgaacccgggaggcggagcttgcagtgagcagagatggagccactgcattctagcctgggcgacagagtgagactccgtctcgggggaaaaaaaaaaaaaaagaagattttaaaaaataaataagctgacaattaatgacttaagtact

SEQ ID NO: 136332 - DNA, 601 bp, Human
agaatggaaacagtgacatgacctaacatacacgtaattgtagtcccataaggaaagaagacaattgaatagaaataatacttaaagaatattagctaattcccgggccaggtgcctataatcccaacactttgtaatcatgcctgtaatcatgcctgtaatcccaacactttgtaatcatgcttgtaatcccaacattttgggaggctgaggcaggcggatcacttgaggccaggagtttgagaacagcctggccaatacggcaaaaccacgtctctatgaaaaatacaaaaattagccrggcgtggtgatatgcgcctgtaatcccagctactagggaggctgaggcactagaatcacttgaacccaggaggcggaggttgcagggaactgaaattgcaccactgcacaccagcaagactctgtctcaataataataataataataataataataataataataattttagctaattcccaaatgacaaaagatagtaagccaaagattgactcaggacctcaagatactctacaagctttatgtagattacaaaaaaaaaagctacacaagagcacatcaatagtaaaattggtgaaa

SEQ ID NO: 136333 - DNA, 601 bp, Human
aactggatactggacagtgaaaatacaagtgaacatgaagataggttgctagaaaatctctaggcttacgagaaggggaaaaaagaatggaaacagtgacatgacctaacatacacgtaattgtagtcccataaggaaagaagacaattgaatagaaataatacttaaagaatattagctaattcccgggccaggtgcctataatcccaacactttgtaatcatgcctgtaatcatgcctgtaatcccaacactttgtaatcatgcttgtaatcccaacattttgggaggctgaggcaggyggatcacttgaggccaggagtttgagaacagcctggccaatacggcaaaaccacgtctctatgaaaaatacaaaaattagccgggcgtggtgatatgcgcctgtaatcccagctactagggaggctgaggcactagaatcacttgaacccaggaggcggaggttgcagggaactgaaattgcaccactgcacaccagcaagactctgtctcaataataataataataataataataataataataataattttagctaattcccaaatgacaaaagatagtaagccaaagattgactcag

SEQ ID NO: 136334 - DNA, 601 bp, Human
caacagtagttaatatactcaagaaaacagatgaaaacataagaatttgaatctatgtaaattttaggataaaaaatacaaaaactaaaattaaaaactcaataattagaaataactggatactggacagtgaaaatacaagtgaacatgaagataggttgctagaaaatctctaggcttacgagaaggggaaaaaagaatggaaacagtgacatgacctaacatacacgtaattgtagtcccataaggaaagaagacaattgaatagaaataatacttaaagaatattagctaattcccrggccaggtgcctataatcccaacactttgtaatcatgcctgtaatcatgcctgtaatcccaacactttgtaatcatgcttgtaatcccaacattttgggaggctgaggcaggcggatcacttgaggccaggagtttgagaacagcctggccaatacggcaaaaccacgtctctatgaaaaatacaaaaattagccgggcgtggtgatatgcgcctgtaatcccagctactagggaggctgaggcactagaatcacttgaacccaggaggcggaggttgcagggaactgaaattgcaccac

SEQ ID NO: 136335 - DNA, 601 bp, Human
ccaagattaatacaatagtccaggagagagagggtacttgaactaggttggtagcatgatgaagagaagtagatggattctagatatactttgaaagtgactgaatataaagaatgaggaaaagagaggaatcaaggatggctccaagagacgtctgacttaagcaactgcttggctgatggtgccatggtaagtaacatagtaattagttttagcagttcttagcaactagaaggataaaagagagagaggactgccaattctacagcacaaaacagcaaaaataaataaacaaacaaayaaataaataaataaataaaataaaaccagggtacgaaaagaaaaggcaattaggctacctatgagagaacagcaatatcagaccaaatttcccatggaaaacaactataaaagtgatataaaatgcccctaaatccccagctatttgaaggtttccggagaacaaccaagggtcaggacttgaggagccaagatcccttagagaagggaaacactttgaagatctcccttcaattcccccttgaggtatttgccaattaccagtacagagcaaaaggccaagcagaaagcagcatcccag

SEQ ID NO: 136336 - DNA, 601 bp, Human
gattagttccaagattaatacaatagtccaggagagagagggtacttgaactaggttggtagcatgatgaagagaagtagatggattctagatatactttgaaagtgactgaatataaagaatgaggaaaagagaggaatcaaggatggctccaagagacgtctgacttaagcaactgcttggctgatggtgccatggtaagtaacatagtaattagttttagcagttcttagcaactagaaggataaaagagagagaggactgccaattctacagcacaaaacagcaaaaataaataaayaaacaaataaataaataaataaataaaataaaaccagggtacgaaaagaaaaggcaattaggctacctatgagagaacagcaatatcagaccaaatttcccatggaaaacaactataaaagtgatataaaatgcccctaaatccccagctatttgaaggtttccggagaacaaccaagggtcaggacttgaggagccaagatcccttagagaagggaaacactttgaagatctcccttcaattcccccttgaggtatttgccaattaccagtacagagcaaaaggccaagcagaaagcag

SEQ ID NO: 136337 - DNA, 601 bp, Human
aaggattagttccaagattaatacaatagtccaggagagagagggtacttgaactaggttggtagcatgatgaagagaagtagatggattctagatatactttgaaagtgactgaatataaagaatgaggaaaagagaggaatcaaggatggctccaagagacgtctgacttaagcaactgcttggctgatggtgccatggtaagtaacatagtaattagttttagcagttcttagcaactagaaggataaaagagagagaggactgccaattctacagcacaaaacagcaaaaataaataaacaaacaaataaataaataaataaataaaataaaaccagggtacgaaaagaaaaggcaattaggctacctatgagagaacagcaatatcagaccaaatttcccatggaaaacaactataaaagtgatataaaatgcccctaaatccccagctatttgaaggtttccggagaacaaccaagggtcaggacttgaggagccaagatcccttagagaagggaaacactttgaagatctcccttcaattcccccttgaggtatttgccaattaccagtacagagcaaaaggccaagcagaaag

SEQ ID NO: 136338 - DNA, 601 bp, Human
ggcaggagctagatcatgcaggaccctgaaggcccaaggaaaggatttgtaattttattctatggaaatttattcttcaatggaaaacactcaaggtatttttggaaaaggtactacagggaatgtgaatcaaagtagaaggattagttccaagattaatacaatagtccaggagagagagggtacttgaactaggttggtagcatgatgaagagaagtagatggattctagatatactttgaaagtgactgaatataaagaatgaggaaaagagaggaatcaaggatggctccaagagaygtctgacttaagcaactgcttggctgatggtgccatggtaagtaacatagtaattagttttagcagttcttagcaactagaaggataaaagagagagaggactgccaattctacagcacaaaacagcaaaaataaataaacaaacaaataaataaataaataaataaaataaaaccagggtacgaaaagaaaaggcaattaggctacctatgagagaacagcaatatcagaccaaatttcccatggaaaacaactataaaagtgatataaaatgcccctaaatccccagctatttgaagg

SEQ ID NO: 136339 - DNA, 601 bp, Human
gtgcggtggtgcgtgcctgtagtcccatctactcgggaggctgaggcaggagaatcactcgaacctgggaggcggaggttgcagtgagttgagatcgcgccactgcactccagcctggcgacagagctagacgctgtctcaaaaaaaaaaaaaaaaaaaaaaaaaaagtatattgatgaatatccaaggcaaagactcagccttgctgtgggatagggcttgtagcatgtttgaggaactgaaagggagccaatacaattaaagcatagcaaatcaaatgagatgacatagtcatgttagrcaggagctagatcatgcaggaccctgaaggcccaaggaaaggatttgtaattttattctatggaaatttattcttcaatggaaaacactcaaggtatttttggaaaaggtactacagggaatgtgaatcaaagtagaaggattagttccaagattaatacaatagtccaggagagagagggtacttgaactaggttggtagcatgatgaagagaagtagatggattctagatatactttgaaagtgactgaatataaagaatgaggaaaagagaggaatcaaggatggctccaagagacg

SEQ ID NO: 136340 - DNA, 601 bp, Human
aagtatgctgataaatatccaggccaggtgcagtggctcacgcctgtaatcctagtaactcccagtgggtggctcccactttgggaggcccaggcagctggatcatgaggtcaagaaatcaagaccatcctggccaacatggtgaatccccatctctactaaaaacacaataattagctgggtgcggtggtgcgtgcctgtagtcccatctactcgggaggctgaggcaggagaatcactcgaacctgggaggcggaggttgcagtgagttgagatcgcgccactgcactccagcctggcracagagctagacgctgtctcaaaaaaaaaaaaaaaaaaaaaaaaaaagtatattgatgaatatccaaggcaaagactcagccttgctgtgggatagggcttgtagcatgtttgaggaactgaaagggagccaatacaattaaagcatagcaaatcaaatgagatgacatagtcatgttaggcaggagctagatcatgcaggaccctgaaggcccaaggaaaggatttgtaattttattctatggaaatttattcttcaatggaaaacactcaaggtatttttggaaaaggtactacaggg

SEQ ID NO: 136341 - DNA, 601 bp, Human
gaaggctctgcaaaggatgagagagaagcacaggagttaaaagaaagattatggacaagcaggggttcattacaactcaaacacagggtacatacaaggggccaacaggagatgaggctggaatgcggcccaactgccaagacaagagcattaatgctgtcatggtaagaaggttggcctggattagcatgtgagtgatagccagccattagtaggtagtacagtcagacactgagatctgtattttccatagacaaatctgggaaaacggtggaaggcggaccgcagtggatgactaaamtaaaaagacgtctggatggagatcgggttaaaaagtagtggagataaaagaggaaattgatttgaaacatattagagaaaaatgattggctttattgatgggatctatctaggacactggcacccaaaaatgtttgctgcccaaattagtgaggaaaataatgagaccacttagatcacacaggacagaaaacaaataccacaagaaacataaaaatttgagaacatggcagaagacacactgtgagatttaaaaagaacaaagactccaatgaggcaatattccctctgcctacaatat

SEQ ID NO: 136342 - DNA, 601 bp, Human
cagtgtctagctgcctgacaaagttataaaacattaccaaggaattagcactgcagttgaggacaagtttcaggtgcaaatggagcaagataaagagaagtcaaggtccactttaagcagaaagtgaaggctctgcaaaggatgagagagaagcacaggagttaaaagaaagattatggacaagcaggggttcattacaactcaaacacagggtacatacaaggggccaacaggagatgaggctggaatgcggcccaactgccaagacaagagcattaatgctgtcatggtaagaaggttrgcctggattagcatgtgagtgatagccagccattagtaggtagtacagtcagacactgagatctgtattttccatagacaaatctgggaaaacggtggaaggcggaccgcagtggatgactaaactaaaaagacgtctggatggagatcgggttaaaaagtagtggagataaaagaggaaattgatttgaaacatattagagaaaaatgattggctttattgatgggatctatctaggacactggcacccaaaaatgtttgctgcccaaattagtgaggaaaataatgagaccacttaga

SEQ ID NO: 136343 - DNA, 601 bp, Human
gccgaggtgggtggatcacctgaggtcaggagttcaagaccagcctgaccaacatggagaaaacccgtctctactaaaaatacaaaattagccggggtggtagtgcatgcctgtaatcccagctattcgggaggctgaggcaggagaatcgcttgaaccagggagacggaggttgcggtgagccaagatcgcgtcattgtactccagcctgggcaacaagagcaaaactccgtctcaaaagaaaaaaaaaaaaaaaaagataattctacaagcttgattatatgtctttctatatgatagytgactaaaatcagaaaagttaaaagaaaggctgatgacagcttacttaatgatagaaaaaaaaagaacgctgacattaagagaagaaaaaaactaaaaaatcacaaaaagtaaaacaaaaagcttagcagtctgggaccacttggaatacaagtcaaaaacaaacaaacaaaaaaacaaaaaaagtcaaagatctttttagtccactgaaagtattatataaaccatacaagtgcactgtccaataatagtagccactagatacacatagatattttcattaaaattaaacataagtaaa

SEQ ID NO: 136344 - DNA, 601 bp, Human
caacagccctactattctgtaatagaaatattcacctttgtaagattaaaaaggaataatttcagagcaaaaagcaagtactattaatgcctgtcctgattatatgcagtagcaaagcaaaggtattttgacaattagaaagtgtttggaaaatatagatacaggcacaagaatggaaaaaatgactttcaaaaaaatgcacatactgaatccttctatgcctagcatatcagtatggaagaaaactacaagaattatattaaaaacactcttgaccacattgaaatacttgataatataytgagacccatatagctttcaccaaattatacaatattcctcacctccttgctgtatctgctgttgttgacaaatctgcctccttgagtttctccctatatgccttaaatgacaatccagcattttttttttcttttttcctataactctgttccttttctcacgttcataattccctttttcccaaatagaggggttgtgccttcagggtatcctccctccctcccttggtgactcatctaatctcatattgatattttttcaactgaatgctcacacaaatttatactttttagacttc

SEQ ID NO: 136345 - DNA, 601 bp, Human
aacttatcaatgaacccagaataaaggtatttagggaaaaagttttcccagcttttgatttttcttggctgcctgttcgaagtcccaaaggagtaaggtagacagtactttggggaatgaaaaagccatttgcttccctcctatgacagctgggaatctaatttcccaattttttagtaaaactccttctctgggtacaaagaatttaacaagaaacaacatctctttgcaatctctgcatcaaagcatgaactagatgactgctactgaaccaacagccctactattctgtaatagaaawattcacctttgtaagattaaaaaggaataatttcagagcaaaaagcaagtactattaatgcctgtcctgattatatgcagtagcaaagcaaaggtattttgacaattagaaagtgtttggaaaatatagatacaggcacaagaatggaaaaaatgactttcaaaaaaatgcacatactgaatccttctatgcctagcatatcagtatggaagaaaactacaagaattatattaaaaacactcttgaccacattgaaatacttgataatatattgagacccatatagctttcaccaaatta

SEQ ID NO: 136346 - DNA, 601 bp, Human
gactcatgtgttgccataatttgaaaagcaaaaatataataacaggcttacatctgcaatctgcagtacatacaacttatcaatgaacccagaataaaggtatttagggaaaaagttttcccagcttttgatttttcttggctgcctgttcgaagtcccaaaggagtaaggtagacagtactttggggaatgaaaaagccatttgcttccctcctatgacagctgggaatctaatttcccaattttttagtaaaactccttctctgggtacaaagaatttaacaagaaacaacatctcttygcaatctctgcatcaaagcatgaactagatgactgctactgaaccaacagccctactattctgtaatagaaatattcacctttgtaagattaaaaaggaataatttcagagcaaaaagcaagtactattaatgcctgtcctgattatatgcagtagcaaagcaaaggtattttgacaattagaaagtgtttggaaaatatagatacaggcacaagaatggaaaaaatgactttcaaaaaaatgcacatactgaatccttctatgcctagcatatcagtatggaagaaaactacaagaatt

SEQ ID NO: 136347 - DNA, 601 bp, Human
gggggtcagggacccacttgaggaggcagtctgtccattctcagatctgaaactccgtgctgggagaaccactactctcttcaaagctgtcagacagggacatttaagtctgcagaggtttctgctgccttttgttcggctgtgccctgcccccagaggtagagtctacagaggcaggcaggcctccctgagctgtggtgggctccagccagttcaagcttctaggccgctttgtttacctactcaagcctcagcaatggcgggcgcccctcccccagcctcgctgctgccttgcagttcratctcagactgctgtgctagcaatgagcaaggctccgtgggcgtgggaccctccaagccaggcgcgggatataatcttctggtgttccgtttgctaagaccgttggaaaaacacagtattagggtgggagtgacccaatttcccaggtgccatctgtcacagcttcccttggctaggaaagggaattccttgaccccttgcacttcccgggtgaggtgatgcctcgccctgcttcggctcacgctcggtgggctgcacccattgtcctgcacccactatatgacaagccccagtgagatg

SEQ ID NO: 136348 - DNA, 601 bp, Human
gatacataaacacttctctttaggaaccactggtcaagtacattgagaaatcacagaaagaataaatgtcattaattttactatggaggataactgagtggcaaccacattaacctagttgacactgcataatgataattacctttccttctaaaagattcacatcaattttaaacttataagaaattactcatttttctatttatttttattatactttaagttctagggtacatgcgcacaatgtgcaggttacacatgtatacatgtgccatgttggtgtgctgcacccattaactcrtcatttacattaggtgtatctcctaatgctatccctcccccctccccccatccaaccacaggccccagtgtgtgatgttccccttcctgtgttcaagtgttctcattgttcaattcccacctatgagtgagaacatgcggtgtttggttttctgtccttgcgatagtttgctgataatgatggtttccagcttcatccatgtccctacaaaggacatgaactcatccttgtttatggctgcatagtattccatggtgtatatgtgccacactttcttaatccagactatcactgatggac

SEQ ID NO: 136349 - DNA, 601 bp, Human
atctttaagtgtagacagataaaaataaatacagtatggccaagaaaggacaaattgggacaagatacataaacacttctctttaggaaccactggtcaagtacattgagaaatcacagaaagaataaatgtcattaattttactatggaggataactgagtggcaaccacattaacctagttgacactgcataatgataattacctttccttctaaaagattcacatcaattttaaacttataagaaattactcatttttctatttatttttattatactttaagttctagggtacatgmgcacaatgtgcaggttacacatgtatacatgtgccatgttggtgtgctgcacccattaactcgtcatttacattaggtgtatctcctaatgctatccctcccccctccccccatccaaccacaggccccagtgtgtgatgttccccttcctgtgttcaagtgttctcattgttcaattcccacctatgagtgagaacatgcggtgtttggttttctgtccttgcgatagtttgctgataatgatggtttccagcttcatccatgtccctacaaaggacatgaactcatccttgtttatgg

SEQ ID NO: 136350 - DNA, 601 bp, Human
gcaaatttagatctttaagtgtagacagataaaaataaatacagtatggccaagaaaggacaaattgggacaagatacataaacacttctctttaggaaccactggtcaagtacattgagaaatcacagaaagaataaatgtcattaattttactatggaggataactgagtggcaaccacattaacctagttgacactgcataatgataattacctttccttctaaaagattcacatcaattttaaacttataagaaattactcatttttctatttatttttattatactttaagttctrgggtacatgcgcacaatgtgcaggttacacatgtatacatgtgccatgttggtgtgctgcacccattaactcgtcatttacattaggtgtatctcctaatgctatccctcccccctccccccatccaaccacaggccccagtgtgtgatgttccccttcctgtgttcaagtgttctcattgttcaattcccacctatgagtgagaacatgcggtgtttggttttctgtccttgcgatagtttgctgataatgatggtttccagcttcatccatgtccctacaaaggacatgaactcatcc

SEQ ID NO: 136351 - DNA, 601 bp, Human
attttccttaaaatgttttctattttacaagttttacaataatcttattgcttttctaattaattacaaaattagaatgaaagaataataaaccaaatagtaaatttagttttgttttcttttttttctttgagaaggagttcgctcctgttgcccaggctggagtgcaatggtgtgatctcaactcactgcaacctccatctcccgggttcaagcgattctcctgcctcagcctcccaagtaggtggggttacaggcatgcgccaccacgcccggctaattttgtatttttagaagagaygggtttctccatgtttgtcaggctggtctccaactcccgacctcaggtgatccgcccgccttcggcctcccaaactgctgggattacaggcgtgagccactgcgcccggctgcaaatttagatctttaagtgtagacagataaaaataaatacagtatggccaagaaaggacaaattgggacaagatacataaacacttctctttaggaaccactggtcaagtacattgagaaatcacagaaagaataaatgtcattaattttactatggaggataactgagtggcaaccacattaacct

SEQ ID NO: 136352 - DNA, 601 bp, Human
taacaataccaccactggaatatgctgccttggttgaatatatatggtagggaaactatcttataaattagcagacattgaactcaatgaactttatgcaaatgtgatttctgaaaagataaatgtatgtgtaaattttgtaatcacacatttagagatttgtttttacttcatttacttttagctggtgaaagggggagtaagtaaaatataattgaaatctaaagattcttttcaaaggtgttgtatactacagagatgtatacacataccatatatgtatttacaaacctagcaatakgataaagtactgactggaggagggaacagttaaaaacaaaacagtccttttgtgagatctcaaagattttaaaataagcatcccacaaatctcaaatataaactcaaacctctgctccttttgattctactgaaatagtctagtttaggagagttctaatttgcttctatcttagtgaaattacaggattaaaattagaaaagtgtttctagtcactggcacaaccatattactccatagaatcacctgaggtggagtgcagtggcgtaatcacagctcactgcagtctcaaactactgg

SEQ ID NO: 136353 - DNA, 601 bp, Human
agaaacttgctctcattcagtacttttgagaaagtgttgatgttcttaattctgatataattaacaataccaccactggaatatgctgccttggttgaatatatatggtagggaaactatcttataaattagcagacattgaactcaatgaactttatgcaaatgtgatttctgaaaagataaatgtatgtgtaaattttgtaatcacacatttagagatttgtttttacttcatttacttttagctggtgaaagggggagtaagtaaaatataattgaaatctaaagattcttttcaaargtgttgtatactacagagatgtatacacataccatatatgtatttacaaacctagcaataggataaagtactgactggaggagggaacagttaaaaacaaaacagtccttttgtgagatctcaaagattttaaaataagcatcccacaaatctcaaatataaactcaaacctctgctccttttgattctactgaaatagtctagtttaggagagttctaatttgcttctatcttagtgaaattacaggattaaaattagaaaagtgtttctagtcactggcacaaccatattactccata

SEQ ID NO: 136354 - DNA, 601 bp, Human
ttcattacatacgtactccacaggtagcaaagtttagtttttagccaataaaaatcttttatttgctttatattctctagtacgagaccatatgaaaattttttactaattttctgtaagtttacttttgtcttgttccattgatttcgtacagaaatacaaaatatgaattatctgactgcacataaatccccaaaacagaatcatcaacacagtggctctcaaggaacatagatgaaattaaaaacaattttatgagtaattgctaggtgattacaactagtcctaaagctctttgttaaattaaattacctgaattagaagatccagaaacttgctctcattcagtacttttgagaaagtgttgatgttcttaattctgatataattaacaataccaccactggaatatgctgccttggttgaatatatatggtagggaaactatcttataaattagcagacattgaactcaatgaactttatgcaaatgtgatttctgaaaagataaatgtatgtgtaaattttgtaatcacacatttagagatttgtttttacttcatttacttttagctggtgaaagggggagtaagtaaaatat

SEQ ID NO: 136355 - DNA, 601 bp, Human
caaccatttcaaaaacgtaaaaggttctacaaataagctttataggatgatttatggtgttcccataagcctaacaatgtttcttaacttattccaacatatggctttttctttcttttctggaaagaagcttctctaatgaagtcctaatagtagtatgcgagtgaccctgaaaagaaagatgtatcagaaattagaatcccactgagaggccctcagagttcctttttttttttttttttttttttgagatggagtcttgctctgtcacccaggctggagagctcagtggctcgatctyggctcactgcaacctctgcctcccaggttcaagcaattctcttgcctcagcctcccaagtatctgggacaacaggcatgtgccatcatgcccagctaatttttgcatttttgtagagatggggtttcaccacgttggccaggctggtcttgaactcctgacctcaggtgatccgcctgcctcggcctcccaaagtgctgagattacaggagtgagccaccatgcctggcctgaagtcctcagactttttatagtaactcagaatgaactctgagtttaggatactccccagattccttgc

SEQ ID NO: 136356 - DNA, 601 bp, Human
tgcaaagataaaatgtcaaccatttcaaaaacgtaaaaggttctacaaataagctttataggatgatttatggtgttcccataagcctaacaatgtttcttaacttattccaacatatggctttttctttcttttctggaaagaagcttctctaatgaagtcctaatagtagtatgcgagtgaccctgaaaagaaagatgtatcagaaattagaatcccactgagaggccctcagagttcctttttttttttttttttttttttgagatggagtcttgctctgtcacccaggctggagagytcagtggctcgatctcggctcactgcaacctctgcctcccaggttcaagcaattctcttgcctcagcctcccaagtatctgggacaacaggcatgtgccatcatgcccagctaatttttgcatttttgtagagatggggtttcaccacgttggccaggctggtcttgaactcctgacctcaggtgatccgcctgcctcggcctcccaaagtgctgagattacaggagtgagccaccatgcctggcctgaagtcctcagactttttatagtaactcagaatgaactctgagtttaggatac

SEQ ID NO: 136357 - DNA, 601 bp, Human
tttaaacgactactaatcttttacagagcaaaggaaaaagaaaactgtttaggtcacttgatcagaagtacacaaataactattttcttccttttccttccaataaaaaaggaagatgaaaactaataatttctcaaattaaggccaatcaatcacctgacaaatttttctctgtttaagaactatttttaaatgttaaggaagtttttccagcctttcaaaaaagtgtttgtttccttatttttaaagttctgacttcacataatacgcctatcacaagtgtgcttgcacttcaccttartggccaatgtataacagcttgtatattttgatagcaaattgagacttaattcattttagtttaagactaaaaaacccagaactctaagaatactgtctcagacagaatttaaaaagacctttcccatgcgttctccccttcacaatgttcacaagacaaaaaccactttaacactaatcacattctgaaatgttaatttttcaattgctaaaagatagcagcatctttacatgctttatatctgtgtgtttgataatattaggtaattgctgctaatttttaaggtgtgataagagtatt

SEQ ID NO: 136358 - DNA, 601 bp, Human
caagtgctttctctgtaagccaggaattcaaaattagatttgatccagagaatgttttaaacttttgcttttatcatttgagttacagaaaataacttatactagcctgaactgacagcaaaactttattttttaaaatctgacatagctcctagtttagcaaattaaggtgcttcattcacaaattgcatttagtccccatttcaaattcctggtatagaacatattatatgcaaatgttctgtcctagaagctgcattacaccagaatcagctctgcatttacccttaactgcaccaascagtgaaaaaaggaagttcagcagcaaaagtagctaaaaataagaaaacagtcatactctaacattcacatatactcacaggctttctaattcatgatcaagaaatctaaatttagactaactaagtaaaaagatactatcacacacatccttttcagtcaggaagagaaagttaatatgtgcaaagccttcaaaacacaggaattcagagacacttaacatcaattatttaaacgactactaatcttttacagagcaaaggaaaaagaaaactgtttaggtcacttgatcagaagtaca

SEQ ID NO: 136359 - DNA, 601 bp, Human
gtgtctaaaataaaagtaaatgagccaggtacattggctcatgcctgtaatcccagcactttgggaggacaaggtaggaggattgaataagcccaagagtttgagaccagcccgggcaacatggtgagattttgtatctacaaaaaaaaaaattgttgggcatggtggcacatgcctgtggtcccaactactcaggaggctgaggtgggaggattgtttgagcccatgagttcatggttgcagtaaactgtgtttgtgccactgtactccaggctgggtgactgagcaagaccctgtctcaaaaaaaaaaaaaaaaaaaaaaaaaaaaggaacaatgttgaactctgaaaatcttctaggagtaaagtttataaatttggttacaagaatctgtgtaatatttttattgcttggagacatttgctatttccttgttcttggataaactctaggtagcagactgctgctatacctaactgctaggtaaattagggttatctatcacctctggattcaagatgtgagacgcaaaagttatcctgcctgcatacaacaatcccccaaagacaaaaaccatggcagtgctgccatgccgtttcct

SEQ ID NO: 136360 - DNA, 601 bp, Human
gtaatcagttttaaactgtttacctaaaataatagcaaatgtgtctaaaataaaagtaaatgagccaggtacattggctcatgcctgtaatcccagcactttgggaggacaaggtaggaggattgaataagcccaagagtttgagaccagcccgggcaacatggtgagattttgtatctacaaaaaaaaaaattgttgggcatggtggcacatgcctgtggtcccaactactcaggaggctgaggtgggaggattgtttgagcccatgagttcatggttgcagtaaactgtgtttgtgccmctgtactccaggctgggtgactgagcaagaccctgtctcaaaaaaaaaaaaaaaaaaaaaaaaaaaaggaacaatgttgaactctgaaaatcttctaggagtaaagtttataaatttggttacaagaatctgtgtaatatttttattgcttggagacatttgctatttccttgttcttggataaactctaggtagcagactgctgctatacctaactgctaggtaaattagggttatctatcacctctggattcaagatgtgagacgcaaaagttatcctgcctgcatacaacaatcccc

SEQ ID NO: 136361 - DNA, 601 bp, Human
caatgatgcttttaggacatattaggtaggtgctcagggctattttccactaaacttcagaatgctatgctacgaattctgttagctttgtaggatttttttccccactgtcaccaggatctgactaagaagaaataatctatttttaaataagacaatatgaatgaaagtattttaactgaaaagcaaaaagcactctgtaaacatattacaattttattattgaataatattaatattattacattactttgtctagagtcccttctcctcaattaaagcaatatggtattgaagaaaytgactaaattatggaatataaccacagagtttagggaatttacttttagaaccaagtaacaataaggaatttttaccatataagctgactgttttgactatctaaaacaaatctcttgctatgtgctgaagtaatcagttttaaactgtttacctaaaataatagcaaatgtgtctaaaataaaagtaaatgagccaggtacattggctcatgcctgtaatcccagcactttgggaggacaaggtaggaggattgaataagcccaagagtttgagaccagcccgggcaacatggtgagat

SEQ ID NO: 136362 - DNA, 601 bp, Human
atcagtttattcctcttctattaaatatatgttgggcaaatatttaagattattattactgtgttagttcaccaactattagttcccatcccctatgaattgtcctaactctgcgcaaaacacagtagcaattgaaatgtcaatccagtgtgtactacaacagaaatcctgtgtcactggggcacaaagagtgagcaccaatacagatttacaagggtctgaaacagcatcccagagaattctaaagactcagctgagatttcaaatagaacgagttagatgagtgggaaatgggtgtgtkggggggagaaatatctcatataataaatcagcttcaaacttctgagatcctctagtctggataccaaaaatgataaatacatactttgggaaatgaccatgaattacccacctaccatagatcaaagatattaaaagtattttatccaagttagaaatgtgttaataacttcctgaacaaataaatttgtgaggtctagaagccaaggaatatgtataacccacagctaaactaaacaaacaaaaccccattttattgttgctcttctgaatgccactttattcccaaatatgtactgtc

SEQ ID NO: 136363 - DNA, 601 bp, Human
attgtgtaattttaaatggcctttagaaagctgcctggttcagaaaaatcatgcaataagatctaagggattaaaactaccaaaccttcagaaatgttttgtctaattatttctagaaaactgaccctgcattggccagtagaaaacgaattagtaggtatttgtttctatatagaaatgttataaaatcagtttattcctcttctattaaatatatgttgggcaaatatttaagattattattactgtgttagttcaccaactattagttcccatcccctatgaattgtcctaactctgsgcaaaacacagtagcaattgaaatgtcaatccagtgtgtactacaacagaaatcctgtgtcactggggcacaaagagtgagcaccaatacagatttacaagggtctgaaacagcatcccagagaattctaaagactcagctgagatttcaaatagaacgagttagatgagtgggaaatgggtgtgtgggggggagaaatatctcatataataaatcagcttcaaacttctgagatcctctagtctggataccaaaaatgataaatacatactttgggaaatgaccatgaattacccacct

SEQ ID NO: 136364 - DNA, 601 bp, Human
gaaccaaagcctgggaaataccaaaacaacttaaggcaaaggcatatttatttaagtaaaatatgaaaagttgtaaagttggctttatcctcgagactctgcattcacaggttcaaccaaccacagattgaaaatatttggaaaacactgaaaacaatgcaacaattaaaaataatgcaaataaaaaacaatacatagaacaacattaaattgtattagttgtaagtaatctagagataatttaacatacaggaaaggacgtgcataggttatatgcaaatactgcaccattttatatcayggacttgaagcatctgtggattttggcattgggtgatggtagggtcctgaacaaatccttccctcatactgagagatgactgtattcaattcctcaaactgctactttttaaattcactttgcatcattattttcaagaaataaagcaacctttaaacaccaccacaatattctcatatgctttggggaagaagactcagagccacttttgaaataaaattaaaatcctcagaagaaaaagatgtaattaatgaatattagtgacactgttctggttatctaatgaaataatgttcagag

SEQ ID NO: 136365 - DNA, 601 bp, Human
agttttcaggctgggaatgttgaatatctgcactttgggctcttattgctgaactcttgtacaaagcctacctgcaagaaccactactcatggttatatcactttaagtatatgcagctcattttctcttctggattaatacactcttagccaagtgtataaatcagaatatatttgtggaactttccaaaatacatactccaaggcaccaccccagacatactgaatcatttccaaggtcatatatgttgaaggtatcaggtgattctgatgtgtactcctaggtaagatttttctaackctagatactctagaattgcactattccatacagtagctactggccatatacagctattgagcacttgaaattaatttaaatttaaaaattgatatatgagattcagttaccagaaaaccttaagcatgtttggaacttggatatatgaatttattttttcaactgtaaattttatgaaatatagactatttctaatgaaaatctgacatctgaattcagatgtgctctaagtataatgcaccttagattctgaagacttagtatgaaaaaaggtaaaacactatcaataattttgtatca

SEQ ID NO: 136366 - DNA, 601 bp, Human
ttttcaccacccagaacacaatgtgatctttggaattattatacgataatctttggaccatggggaggaaatccataaactaaggaaagcagagcaagtagacaggaggatactggtccctcgagggtacttctcaggccactgtactagccctggactgccactttccaaatttcttgttgcagaataatataaactctttacttattttaatctactaagtgtgattttgcagttactaattgctaaactcaatattaattgatacatgccatgtttgtttcattccttcctaagagtrttttaaaatgaagcaatgtttaacacagttaagaggacattagagctacagtaaactccactgcaactagtactagccatgtgacctagttctggacaaagaggtgtatggaagactgatgggggcttctaggaaatttaatcctatgctgcaaagaagagagagctgcggaaggaaactggtagatagactgtccctgccatgccctccatgccattcctcaccagttgctcttcttgtctttcaactggttgtgatacctagagcacacagctatcttgaaagtactgagcaacaagc

SEQ ID NO: 136367 - DNA, 601 bp, Human
tttttttttcctggatattttcaattcacagttggttaatccacagacacagaacctatgaatatgaaaggcccactgtatattttaggagtaaaaaatacaacttgctgaggtatgtgatatgaataatggagaaactgaggaattaaggttattccacatacctgattgagcaactgggagaatgatgatggtatcaataggatcaatcctaaatttgttttttaaaaagtggagatgttaaaaataactggccacgtgattaaggaattcagaggagattgtctgggctagaaatacwcatttgggggtcatcagcatttaagtggtatttagcctgggaactgatccaattctagaaaagagagagatagaagagagcacagactgagctctgaagaaggctaatatttaaaaagcaaataaagagttggccaaagaaactgagagggaatagctaatgagacagtaagaaaatcatgtatatggggtcacagaaaccaaaagaagaaagtgtttaaaaggccagatgctgtactgttttaagtgctgctgagaggccaagtaagatgaagacaaggcatcttttggatttgtaaac

SEQ ID NO: 136368 - DNA, 601 bp, Human
gacagaccccttagaagactttgcaagagtttagttgagatgacaaaagcctggacagggatggaggcagtgaagaagatatgtttccactaaatatagagtcatctctaggcattagtggggtctatgtttcaggaccctgccttctgacccccgcccacagataacaaaaaccaaggacgctctggttcctgatctaaaataacacagtatttccatataacctagcacatcctcctatatactttaaatcactctaaattacttttaatacctaatacaaatgactatatattaattyatttgtgtggatccaacatagtgttcagactgcagaaaattcaagttttgctttttgaaactttgtgaaatttttttttcctggatattttcaattcacagttggttaatccacagacacagaacctatgaatatgaaaggcccactgtatattttaggagtaaaaaatacaacttgctgaggtatgtgatatgaataatggagaaactgaggaattaaggttattccacatacctgattgagcaactgggagaatgatgatggtatcaataggatcaatcctaaatttgttttttaaaa

SEQ ID NO: 136369 - DNA, 601 bp, Human
atggatgtctgaaaacatggaactaacagtacagcgatgaagacaggtaaacaagcaaacaaacaaaagacaacttgtgggaaaatgctataaagaagtaacagggtcaacagggtcctagaatagggaacctggggagagggagcttgagaaagggatacttgcactgagacctgaagaaggagtcagaaatgcaaagagtaggtggtagaacagtttaggcagtgggaacttcatgcataaaaactccaaagcagaaaagaaaaagccttggcacatctgaggaaaaaataaataaatmagcacagaatggtaactgaggaagacagccaccaataaggctgaagagcaagcaagagtcagatctcacacagcctgggaaggaatttaaatattaaagtggactgtgaaaccattaaaaagttttcagcagtggagcatggtccaatttacactgaaggtcatcatggctgttgtacggatagagcattctttccttaggaacagaagctgacagaccccttagaagactttgcaagagtttagttgagatgacaaaagcctggacagggatggaggcagtgaagaagatatgtttcca

SEQ ID NO: 136370 - DNA, 601 bp, Human
actcagaacactattgtaaagctcaaatgagacaatatgtatgtattttctaagctctgtaactttctgtaaaaatataaagtagcatattattttctatgttcccttcttagggaagtagtagttgcattcaatgatctcccgttgtgcccaggtataaaagtgcaagttggaagagtttttaacttttaattgaaaaaaaattggattaactaaagactatttatatttttaacacagtatgatcatgctcaatagaatataaatctttcttttcctcaaaataatataaacatctctmcaaggtattaatcatgcattcaaaaattttgagcacctaccctagacacctactgggtacacatgatgtaaaacatagatggatgtctgaaaacatggaactaacagtacagcgatgaagacaggtaaacaagcaaacaaacaaaagacaacttgtgggaaaatgctataaagaagtaacagggtcaacagggtcctagaatagggaacctggggagagggagcttgagaaagggatacttgcactgagacctgaagaaggagtcagaaatgcaaagagtaggtggtagaacagtttagg

SEQ ID NO: 136371 - DNA, 601 bp, Human
ctagtgtagtcttaatagcatcactgttcagatcaaatatagccctcaaggaagcaatcagctatgattgctgttctgaaaaaataaaaaaaggaattctgaaaaagagaaggaaaaagttgattcaagacttatctctaacagttaactgcaagattggcaagacagaaaccaaaatatttacaaaggctatctttgggaggtaacaatatggatgactttttgccactttttaatatttccttcatttttcaaattttaaaagaattgtctattgctacttaatggttaaacgtattayaatagtctattttataaattctttgtagtgggtaaaaaccacaatgattaacaaacatgcattaaaacagctttcatagtgcttctaagagaaatcaggtatatatgaggaaattctcaaagcctctgtttgctaaagggaaaaatgaacaaaaagaagctgcttaagcagctttcattacaatctattctagaccattaaaaatcaccttccattttccttccaactcttaagatgggaaaaactaaatatttaatatatagctagcaagttaattttgtatcaaatttataaaaaggt

SEQ ID NO: 136372 - DNA, 601 bp, Human
aggaattggtaagaatatgaatttgggcatttgaatctgaaagtttaccatattttctttccttttccacagagacccaactattgttaaagagaacctaggtaccacaaactgtataaagttaatatttgtataattcattttctataatgtcaagcccagttcttgctacttcttgtatgggaaacgaaggttaaactgtaagtcaggaaccttggactctcctagtcctggcttttaaactagctgactatataatcttgggtaagtcacttcactgctcaaggctcaattccctagmccacaaactggtgagctgcataagaatcgagactgccagtccagctgccttactgctcctgagttctgtgatttaagtacctcagacttcaattctcattgccttttatctctttgttttctgctctccaccaaattattgacttcaaccacaattctacaaccagtttttcctattaattctatgaatttttagagctcctttttattcagtagttattattatccaagtaactgtttacattgctgttcaatgaagtatgacttaatctaataactgtaagtatagtatctagtgtag

SEQ ID NO: 136373 - DNA, 601 bp, Human
ccattttctaaaactactaaggatttccagaaaactatggcattacaaatgccattctaaaataaagtggtatgcatccaaagtagtaccttgtggccggacatggtggctcatgcctgtaatcccagcactttggaggccaaggtgggcagatcacctgaagtcaggagtttgagaccagcctggccaacacagtaaaactccatttctaattaaaatacaaaaaattagctgggcatggtggcgtgtgcctgtagtcccagctgcttgggaggctgaggcaggagaatagcttgagccsacgaggcagaggttgcagtgagtcaagattgcaccactgcactccagcctgggtgacagatcaacacgctgtctcaaaaccaaaaaacaaaaccaaaaaaccccacaaagtagtatcttgtatttctatattagtaaaattacacactagcatccaattacataaaactgtgctatagagaaaaaacctttattactcagcaagtgagtagttagctcttcttgtatggttattgattgacttacttttacattagtctactttagcaagaaaaatatccagaaaatatctaatgccggc

SEQ ID NO: 136374 - DNA, 601 bp, Human
tttttaattgaatgaatggttgaaacatcacaacattcaagaagctgagatgatagaacatgatttcacctattcattatatacattttccatgcaattatccaacattaagttatatacaggctagacttttaaataaattcttaaaaattctaccattttctaaaactactaaggatttccagaaaactatggcattacaaatgccattctaaaataaagtggtatgcatccaaagtagtaccttgtggccggacatggtggctcatgcctgtaatcccagcactttggaggccaaggygggcagatcacctgaagtcaggagtttgagaccagcctggccaacacagtaaaactccatttctaattaaaatacaaaaaattagctgggcatggtggcgtgtgcctgtagtcccagctgcttgggaggctgaggcaggagaatagcttgagcccacgaggcagaggttgcagtgagtcaagattgcaccactgcactccagcctgggtgacagatcaacacgctgtctcaaaaccaaaaaacaaaaccaaaaaaccccacaaagtagtatcttgtatttctatattagtaaaattacac

SEQ ID NO: 136375 - DNA, 601 bp, Human
atctccacttagaaaacggctcttacacccccaatactaccttctctttgagaaacatgactatatatgctatctatctttttaataaaaaatagtctcctttaacttggggggaaaatcactccctagtacaactggtttggcttaattataacttgccctcccatatttttaattgaatgaatggttgaaacatcacaacattcaagaagctgagatgatagaacatgatttcacctattcattatatacattttccatgcaattatccaacattaagttatatacaggctagactttwaaataaattcttaaaaattctaccattttctaaaactactaaggatttccagaaaactatggcattacaaatgccattctaaaataaagtggtatgcatccaaagtagtaccttgtggccggacatggtggctcatgcctgtaatcccagcactttggaggccaaggtgggcagatcacctgaagtcaggagtttgagaccagcctggccaacacagtaaaactccatttctaattaaaatacaaaaaattagctgggcatggtggcgtgtgcctgtagtcccagctgcttgggaggctg

SEQ ID NO: 136376 - DNA, 601 bp, Human
aagtctacatgataaccagctaacaatacaatgacaggatcaaatccacacatatcaatattaaccttgactgtaaatgggttaaatgccccaattaaaaggcatagagtggcaggccggataaagaagcaagatccattggtacgctgtctctaagagactcatcttacacgcaatgacatccagaggctcaaagtaagggatggagaaaaatctaccaagcaaatggaaaacagaaaaaaaaaagggagaaggggtttcaatcctaatttcagacaaaacagactgtaaacccacaaaratcaaaaaacacaaagatggacgttatataacagtaaagggatcaattcaacaagatctaactatcctaaacatatctgcacccaacacaggagcactcagactgataaaacaagttcttaaagacctacaaagagacttagatctccacacaataatagtttgaggcttcaacatcccactgactatattaagcagataatcaaggcagaaaattagcaaagattttcaagacctgaacttgatacttgaccaaaaaagacctaacagacatctacagaactcttcaccaaaaaacata

SEQ ID NO: 136377 - DNA, 601 bp, Human
agaagtacatactaaaaaaacaaaagtacacagaccactgacactataaaagaatgatgcaaacaagtctacatgataaccagctaacaatacaatgacaggatcaaatccacacatatcaatattaaccttgactgtaaatgggttaaatgccccaattaaaaggcatagagtggcaggccggataaagaagcaagatccattggtacgctgtctctaagagactcatcttacacgcaatgacatccagaggctcaaagtaagggatggagaaaaatctaccaagcaaatggaaaacagaaaaaaaaaagggagaaggggtttcaatcctaatttcagacaaaacagactgtaaacccacaaagatcaaaaaacacaaagatggacgttatataacagtaaagggatcaattcaacaagatctaactatcctaaacatatctgcacccaacacaggagcactcagactgataaaacaagttcttaaagacctacaaagagacttagatctccacacaataatagtttgaggcttcaacatcccactgactatattaagcagataatcaaggcagaaaattagcaaagattttcaagacct

SEQ ID NO: 136378 - DNA, 601 bp, Human
ctgaaaggggaagaaagtaagcaacttgggaaacatatttcaggatattgtccatgaaaatttccccaacttcactaaagaggccaacattcaaattcaggaaatgcagagaatccctgaaagatactacataagaataccatccccaagacacacagtcatcagattctccaaggtcaaaatggaataaaaaatgttaaaagcagctagagagaagaggcaggtcacttatacaaatcattcacttatacaaatatattcagcattctataagaaaagaatttccaaccaagaatttcawatccagccaaactaagtttaataagcaaaggagaaataaataagatcctttttagataggcaaatgctaagtgaatttgtcaccaccagacctaacttaccagaggtccttaaaggagtgctaaatatggaaaggaaagaagaccattactagccactacagaaacacacagaagtacatactaaaaaaacaaaagtacacagaccactgacactataaaagaatgatgcaaacaagtctacatgataaccagctaacaatacaatgacaggatcaaatccacacatatcaatattaacc

SEQ ID NO: 136379 - DNA, 601 bp, Human
atgaaacctaatctaaggagtacaataaaatgatgcaggagctgatagatgaagtggtcattataagaaatgaccaaactgatctgatagaggtgaaaaacacactaaaagaatttcataatgcaattgcaagtattaatggcagaataagccaagttgaggcaagagtctcaaagcctgaggactggtttgctgaactcagtcagacaaaaacaacaaaaaagagaataaaaaagaatgaacgaaactcctgagaaatacagggttatgaaataaagagactaaatctatgactaactgkcattcctgaaaggggaagaaagtaagcaacttgggaaacatatttcaggatattgtccatgaaaatttccccaacttcactaaagaggccaacattcaaattcaggaaatgcagagaatccctgaaagatactacataagaataccatccccaagacacacagtcatcagattctccaaggtcaaaatggaataaaaaatgttaaaagcagctagagagaagaggcaggtcacttatacaaatcattcacttatacaaatatattcagcattctataagaaaagaatttccaaccaagaa

SEQ ID NO: 136380 - DNA, 601 bp, Human
cctgcacaaataaaaggacaaggcacaaagctttggccttctgaaaacatccagaaaagaagttaactgactgtactcgagttacaccacagttaaagaacatcagcccacacagagaagaaagaaccagtgcatgaactttggcaacccaaaatgccagcctgtcttctttcttccaaatgaccacgctagttcccagcaggggtcctccaactggggtgaaatcacagaaatataattcagaatagagatacaaatgaagatcatcaaggttcaggagaaagatgaaacctaatctaargagtacaataaaatgatgcaggagctgatagatgaagtggtcattataagaaatgaccaaactgatctgatagaggtgaaaaacacactaaaagaatttcataatgcaattgcaagtattaatggcagaataagccaagttgaggcaagagtctcaaagcctgaggactggtttgctgaactcagtcagacaaaaacaacaaaaaagagaataaaaaagaatgaacgaaactcctgagaaatacagggttatgaaataaagagactaaatctatgactaactggcattcctgaaagggga

SEQ ID NO: 136381 - DNA, 601 bp, Human
aagaactcagtgacaaataaagaccctgcacaaataaaaggacaaggcacaaagctttggccttctgaaaacatccagaaaagaagttaactgactgtactcgagttacaccacagttaaagaacatcagcccacacagagaagaaagaaccagtgcatgaactttggcaacccaaaatgccagcctgtcttctttcttccaaatgaccacgctagttcccagcaggggtcctccaactggggtgaaatcacagaaatataattcagaatagagatacaaatgaagatcatcaaggttcargagaaagatgaaacctaatctaaggagtacaataaaatgatgcaggagctgatagatgaagtggtcattataagaaatgaccaaactgatctgatagaggtgaaaaacacactaaaagaatttcataatgcaattgcaagtattaatggcagaataagccaagttgaggcaagagtctcaaagcctgaggactggtttgctgaactcagtcagacaaaaacaacaaaaaagagaataaaaaagaatgaacgaaactcctgagaaatacagggttatgaaataaagagactaaatctatga

SEQ ID NO: 136382 - DNA, 601 bp, Human
accccaggccgaacacactgattgatagagggtctgcatttctctggggtggagccccaagaggcaagtgaaaggccctctgccacagccactgccaaggtcccttcccctgttgcctccaaactgggaagggaacatgaagcctgagctcatccaagggcagcagtgtgcagcctgggagtatgaaggccagatttgcagccaccacttaagtgggagaggagcccacactttcagagcagggagaggaagcacagctgcagtggtgaggaaatacagaggggccacgcagtggagcaasagcctacctactagccattatgcttaagcaccatctactggatcacagcttaaacttcaacaccaaaaatactttgctaatacaccctgctgtgaaaccaaggacaagaactcagtgacaaataaagaccctgcacaaataaaaggacaaggcacaaagctttggccttctgaaaacatccagaaaagaagttaactgactgtactcgagttacaccacagttaaagaacatcagcccacacagagaagaaagaaccagtgcatgaactttggcaacccaaaatgccagcctgtcttctt

SEQ ID NO: 136383 - DNA, 601 bp, Human
ggactggagaagaaacgaagagcctgagagctttattcacacttaaagcatgacagtcattgtacagaggagctcagcttcttctcattatgagccctcaacccccgcatttttcagcaagcagagccccaagcttgggccagcagtgcagtctccccaatccttggctgaacattcccactagcaacggctcagcatttctctgatttcgctctcagagacaactgaaagcccctctaccacttcagttgtactgcccttgttgccctcggaccggggaaggagtgaagaccctgagtgytttaactatacctttagcaagtcatagccaccctaagaagaggccagactgtctccccgcaaagtcctctttccccattgctcaacgtcaccaggcagggttccctggcttgagcccactatgcagccaccccaccccaggccgaacacactgattgatagagggtctgcatttctctggggtggagccccaagaggcaagtgaaaggccctctgccacagccactgccaaggtcccttcccctgttgcctccaaactgggaagggaacatgaagcctgagctcatccaagggcagcagt

SEQ ID NO: 136384 - DNA, 601 bp, Human
agaaaaaatatggcagactaacttgaaagaatattatgcagccataaaaatttataaaatatggatggaataagtcaagtcaacctttcggcaggatagttacctgccggtctgctaaatcgttggagcaacattgccctaagtaacaaacactcaggctggtagcagctctgaacctccctgggatggatctcccagagggagcagacagccatttttgctgctcaacagacctctttcctgttgccctcaggcttagaaggcagcttagtggctggggactgacagggacccccccacrgtgcagcagccttatggaaaaagggccagactgttttccatatggattttcacctccgggtagggacagggtgcctctcaacctggacccccagcacatccaccctgcccctacccgaacaccagtgggtggcagctctgcatttctctgagaaaatcccagagacaacccacagcccctctgccattgcagatgcaggggtactgcccttgctaccctcaagctgaggaaggaacagagggcctgatggcaactctggcatgccacagccaccctatggagaggagcccagtctctttt

SEQ ID NO: 136385 - DNA, 601 bp, Human
gacatataaaaatgttgtcttctaaaatcctaacaatgataaagtgtgaatgttttaatacaactaaaaaaaagaagataaaagaaaaaatatggcagactaacttgaaagaatattatgcagccataaaaatttataaaatatggatggaataagtcaagtcaacctttcggcaggatagttacctgccggtctgctaaatcgttggagcaacattgccctaagtaacaaacactcaggctggtagcagctctgaacctccctgggatggatctcccagagggagcagacagccattttygctgctcaacagacctctttcctgttgccctcaggcttagaaggcagcttagtggctggggactgacagggacccccccacggtgcagcagccttatggaaaaagggccagactgttttccatatggattttcacctccgggtagggacagggtgcctctcaacctggacccccagcacatccaccctgcccctacccgaacaccagtgggtggcagctctgcatttctctgagaaaatcccagagacaacccacagcccctctgccattgcagatgcaggggtactgcccttgctaccc

SEQ ID NO: 136386 - DNA, 601 bp, Human
ttacaaatcacatttggctttttcttttaagcctagaataataccatgcagtttatcaccattttattttagactttgttttgaataatttttgcttattttcaaaataagtccaagtatcaaaggacaaaatttgtcacattgtgggtattgaaaaaaaaaagccaaaaaagtcaaagtattttatgcaatggcagaaccaatggactgagaataaaattttctaggatgactagggcagggaatagggggatgactatactaacatccaaaggtttcaaaagtttattttaaaatccarttgctgaacagtaattccttttcgagcttatattcatgattatttaagttttacttccgcaaacaccctgcggtcaattcaaatcaataaatcactgaatttcacatttaatttttaagatatattttgaaatgctagtgttgacatcttgctctgctgaaaatatgacgagacagcaacaaagtaacaagactgatggatttaaatttcagcctcttatttctcctcctaaccctgactgaatgagttagtaagttctgatggccaatgagtaggcagatttgaggagagagaggagca

SEQ ID NO: 136387 - DNA, 601 bp, Human
gtacctttggactggatgtgcacaattgctgccattgaagggaaaaaaagagtcaaatcctgtattttggaagtattttgaaacctagtttagaagttatttccctctgttgttctccatcacctcacttctacatggcatttatttacaaaacttgccttattattttacaaatcacatttggctttttcttttaagcctagaataataccatgcagtttatcaccattttattttagactttgttttgaataatttttgcttattttcaaaataagtccaagtatcaaaggacaaaatktgtcacattgtgggtattgaaaaaaaaaagccaaaaaagtcaaagtattttatgcaatggcagaaccaatggactgagaataaaattttctaggatgactagggcagggaatagggggatgactatactaacatccaaaggtttcaaaagtttattttaaaatccaattgctgaacagtaattccttttcgagcttatattcatgattatttaagttttacttccgcaaacaccctgcggtcaattcaaatcaataaatcactgaatttcacatttaatttttaagatatattttgaaat

SEQ ID NO: 136388 - DNA, 601 bp, Human
tttcacagcatttaagccttattattttgataatacaagtatgaatagagtagtctgaatcaagtgtaattagaaaatatgtggaaaacaaaaacttctaagtagtcatacttgcaacagcacagctatttcacaaaggatatgtgaattcttcttaaatgagcaaaattaagagaaaccccaaaaaactatagatgcgtttaagtactcatcaaacgttataattttagtaatttttcacatgcttgatattattggtagtgataacaatgagaacagtatgtgttgcctgcttaccacrgtctcagaaattgtgctaacgatatttatataaggtagatattattctctttattttccagataaggaaactgaagcttgaatgaggttaaatatcttgccaaaggtaagtgggaaactgaatacagctctgtttctgaacccaagatcttaggctaagatagggtttctcaacctcagcacaactgatattttagaccagataaattcttcatttgggtagtggggggagctgttttgtgcattgtaggaggtataatatcatctcttgcttctatccactagatatcagtggcattcc

SEQ ID NO: 136389 - DNA, 601 bp, Human
taataagattcaattaaggaaaatggctgtccctggtttgtccttttcctaacattgctcagttattaatacttccttccttctattaatacatgaaatctgccaaacatttaggtctgtaaatccatgaggattacttaaatatcatgtcaactagactataaactcttcaaggggaggaatcatgaatcatgatgccctctattcctctgtctttgcttccttctactttttcttttccaccattacccagtttttcacaatgtagtttttttttttgatggcatattaaatatatatwttttttttggagactgagtcttgctctgttgtgcccaggctagagtgcagtgacacgatcttggctcgctgcaacctctgcctcttgagttcaagcgattctcctgcctcagcctccggagtagctagattacaggcacccatccccatgctcagctaattttttgtatttttagtagagacggggtttcaccatgttggtcaggctggtctcaaactcctgacctcaggtgatccgaccacctcagcctcccaaagtgttgggattacaggtgtgagccaccgcgcccgaccctaaaca

SEQ ID NO: 136390 - DNA, 601 bp, Human
ttcttataattagaaagcctgaaaagagaacagaagataaaacttgaaagatctaccgcaaaggaagaagcatgttagagctggcctaatataaataattagacgataaaaattaagtcatttgctaaaaggctgaagatgagagctgcttttggagcccttggaagtggtttttgtgccaggagtagtttttgtgcacagaaaataaaatctagaagtttaattttattttttaattaatatttgatttatgaaaattacaaaaaaaattcaaaaaattagtcccagtttttaaagttamctttaagtttttacttaacttacaaatctgtcaaaatgtatcacttaccactggctttcaattatttagattttaaactgcaattataaattaaacagattcaatttcttctttagatatttccactaactgctggtgaatcttcccaattacctataattcttataaatctaataaactaaacttataaaaatggtcaaccttaaattctcataaatgttatggtactacaaataaacttataagcatttctcctaaaaatcccaagcaaaatcattactcaattacatattttaaatt

SEQ ID NO: 136391 - DNA, 601 bp, Human
cacacacacacgcacccctacctatatgcatgttgaccttttctgacctactttagttatgtttgttaggtgaaaactaagtacccaggtataggttaactgaatttagagaataataatgatcctagaagttagaagaagatataaagaacatggctggtagcagatatgattttaaattgtattttaatcacaactatttttatagagctacgcagtcaccaggttttattaatttttcttctgcagtgtttatcttttatttttcctccattcacctgtcagcatcctagtttagacycttatgactaggtaagtaatctactaatgggtcttcctgggcactgggtgccctttctccgatgtatcttgctctagttaatcctgtatattaatttatccatgcaaaatgtatttatcaggcacttatcatatcaatgcttaaatattcaagacctgcaaaagcaacagaaattagcaggtacacttcaatatgtgcttctgaaatcatgaaattggctatgcatttgagtacatttttcttgcagcaggtacagggaagaattaaatgcatgcataaagactataaaataacaaaggc

SEQ ID NO: 136392 - DNA, 601 bp, Human
gccaggctggtcttaaactcctggcctcaagagatccactcgcctcaccctcccgaagtgctgggattacaagtgtgagccactgcacctggcctattagatattatcttattttcagaatagtcaagatgttaatgtttgaacacttaccaatactgaaggtattatccttactttatcttaaaagttttagaaagcatgactatgccataaaagctgctttcttaaggaataaaattactttctcacttttcttcaatagcaattcaacattaataagagggaatctttactaacactacacacacacacacacacacgcacccctacctatatgcatgttgaccttttctgacctactttagttatgtttgttaggtgaaaactaagtacccaggtataggttaactgaatttagagaataataatgatcctagaagttagaagaagatataaagaacatggctggtagcagatatgattttaaattgtattttaatcacaactatttttatagagctacgcagtcaccaggttttattaatttttcttctgcagtgtttatcttttatttttcctccattcacctgtcagcatccta

SEQ ID NO: 136393 - DNA, 601 bp, Human
ggagaaaggggttctgacgtcaggtaaatctacaaaacactactttatatgtttccttcttggagatgtgtcatgcatgttaacatattaaaagggcacagaattcttgcagtgaatgagtatttaactacagaaccaattttctttcccatattacctgttacccaccccacagaactagtgtttggttaaacatccttcgggaagactattcctgcttgtttaatcctttgatcctctctttcagttggtttttcttccttttataatccaaatatgggtttttccaaggttccctcaycagtctctctcccagtccctgctccatccttgagagatctcattcactcccaaggcttccactgtcacccatttggaatattcccaaactaattatccatgaagcgccattttcatttctccgtctgctagctgtccatttctgatcgggtagatagcttactgtcccctcaaatttgatatgtttaaaactgaacttatttcttaacaacagatatctttcctgacttatttatttctgctgaattctcctggtctctcagtcctttaggcatgaaagctcagtcatcatttactcctg

SEQ ID NO: 136394 - DNA, 601 bp, Human
aacattccacacaatttaactccttacttcttaaacgtctttcctcattaggttcctataattcccaaagttatgttttctggaacaccaacccccaagaggtattctggggagaaaggggttctgacgtcaggtaaatctacaaaacactactttatatgtttccttcttggagatgtgtcatgcatgttaacatattaaaagggcacagaattcttgcagtgaatgagtatttaactacagaaccaattttctttcccatattacctgttacccaccccacagaactagtgtttggttaaacatccttcgggaagactattcctgcttgtttaatcctttgatcctctctttcagttggtttttcttccttttataatccaaatatgggtttttccaaggttccctcatcagtctctctcccagtccctgctccatccttgagagatctcattcactcccaaggcttccactgtcacccatttggaatattcccaaactaattatccatgaagcgccattttcatttctccgtctgctagctgtccatttctgatcgggtagatagcttactgtcccctcaaatttgatatgtttaaaa

SEQ ID NO: 136395 - DNA, 601 bp, Human
taaaaatgttaaaatagctgatattaaaataatctacttattgttcgggggaatgtaagaatgactcccccttttatagcataactatcaattaaatatttgtatcactgttgcatgaaagagcagaatatacccagagatggtctttaatattagaataaaattcacataagatggacactgtaaaaacacagaatttaaaaaggtgcatctttccccatacttttaagaaaacatggggaaatggtttaatgcttgatgccatggctagaaaataagatcattttaatgtatgacttcwccctatgaaaaggaaactaatggtcctcagaggtattgttctagatgactgttaaagttcctcactaatatctgaaaatcattaagtaaaaagagaacgttatttaggaatataataatatacataggacacataaacattcaataatgaccaattcattcttatcagtcacactttagacttgaatagaggtaaaattacataaatccaatgctctaatttctttatcactaactctttatctttcattccttttaaacctgtgtctattgaagccatgctactgaactgtgctcctaa

SEQ ID NO: 136396 - DNA, 601 bp, Human
aaaaggcactaggctagatgcgccagaaaatacagagatgatcaaacacagttgctagctctacagtactctgggtttgctgtaaggcattcagccacctcagcaggcaatggggctaacacaaccaggtcactgaaattcaagtttatttgctttttttcaaatatgttgggcataatgtattgatgtagaaacaaaattttacttgtaatggaaagtcagtcagaagtcctatgacatagcattgttacctttaaaaatgttaaaatagctgatattaaaataatctacttattgttcrggggaatgtaagaatgactcccccttttatagcataactatcaattaaatatttgtatcactgttgcatgaaagagcagaatatacccagagatggtctttaatattagaataaaattcacataagatggacactgtaaaaacacagaatttaaaaaggtgcatctttccccatacttttaagaaaacatggggaaatggtttaatgcttgatgccatggctagaaaataagatcattttaatgtatgacttcaccctatgaaaaggaaactaatggtcctcagaggtattgttctagat

SEQ ID NO: 136397 - DNA, 601 bp, Human
tttctatcttattcgaatagcctctccagaaaagcttgttttctcttaggatttacacaacttttgagacaaaatactccttaattaatctgctatatactaactgaaaactaatcctgcatttctctgacccatggaacttctagggaatataagtagatgctaagaaaaaaagaattcttaattactgtgaaataagtttggaaatgggttaaaaaattcaaacaatgcagttgccagggaatggaggtagggcttaatggggaagtgtgtgtgtgtgtgtgtgtgtgtgtgtgtgtgygtgtgtgtgtgtttgagacggagttttgctcttgttgcccaggctggagtgtaacggcgcaatctcggctcaccgcaacctccacctcctgggctcaagagattttcctgcctcagcctctcaagtggctgggattacaggcatgcaccaccacacccagctaattttgcatttttagtagagatgggatttcaccatgttggtcaggctagtttcaaactttcgacctcaggtgatccaccagcctcgtcctcccaaagtgctgggattacaggtgtgagccaccacgcccggcgggaa

SEQ ID NO: 136398 - DNA, 601 bp, Human
atttctatcttattcgaatagcctctccagaaaagcttgttttctcttaggatttacacaacttttgagacaaaatactccttaattaatctgctatatactaactgaaaactaatcctgcatttctctgacccatggaacttctagggaatataagtagatgctaagaaaaaaagaattcttaattactgtgaaataagtttggaaatgggttaaaaaattcaaacaatgcagttgccagggaatggaggtagggcttaatggggaagtgtgtgtgtgtgtgtgtgtgtgtgtgtgtgtgtgtgtgtgtgtgtttgagacggagttttgctcttgttgcccaggctggagtgtaacggcgcaatctcggctcaccgcaacctccacctcctgggctcaagagattttcctgcctcagcctctcaagtggctgggattacaggcatgcaccaccacacccagctaattttgcatttttagtagagatgggatttcaccatgttggtcaggctagtttcaaactttcgacctcaggtgatccaccagcctcgtcctcccaaagtgctgggattacaggtgtgagccaccacgcccggcggga

SEQ ID NO: 136399 - DNA, 601 bp, Human
gatttctatcttattcgaatagcctctccagaaaagcttgttttctcttaggatttacacaacttttgagacaaaatactccttaattaatctgctatatactaactgaaaactaatcctgcatttctctgacccatggaacttctagggaatataagtagatgctaagaaaaaaagaattcttaattactgtgaaataagtttggaaatgggttaaaaaattcaaacaatgcagttgccagggaatggaggtagggcttaatggggaagtgtgtgtgtgtgtgtgtgtgtgtgtgtgtgygtgtgtgtgtgtgtttgagacggagttttgctcttgttgcccaggctggagtgtaacggcgcaatctcggctcaccgcaacctccacctcctgggctcaagagattttcctgcctcagcctctcaagtggctgggattacaggcatgcaccaccacacccagctaattttgcatttttagtagagatgggatttcaccatgttggtcaggctagtttcaaactttcgacctcaggtgatccaccagcctcgtcctcccaaagtgctgggattacaggtgtgagccaccacgcccggcggg

SEQ ID NO: 136400 - DNA, 601 bp, Human
ttgatttctatcttattcgaatagcctctccagaaaagcttgttttctcttaggatttacacaacttttgagacaaaatactccttaattaatctgctatatactaactgaaaactaatcctgcatttctctgacccatggaacttctagggaatataagtagatgctaagaaaaaaagaattcttaattactgtgaaataagtttggaaatgggttaaaaaattcaaacaatgcagttgccagggaatggaggtagggcttaatggggaagtgtgtgtgtgtgtgtgtgtgtgtgtgtgygtgtgtgtgtgtgtgtttgagacggagttttgctcttgttgcccaggctggagtgtaacggcgcaatctcggctcaccgcaacctccacctcctgggctcaagagattttcctgcctcagcctctcaagtggctgggattacaggcatgcaccaccacacccagctaattttgcatttttagtagagatgggatttcaccatgttggtcaggctagtttcaaactttcgacctcaggtgatccaccagcctcgtcctcccaaagtgctgggattacaggtgtgagccaccacgcccggcg

SEQ ID NO: 136401 - DNA, 601 bp, Human
catctgaattcctaactatgaatttacttgtattcagtagactaaggcatgaagttgtaaactagggtacatttagatatgctaaatggatggaagaagctacgggatctttttctatattctgtttagcatttagtatgatgtagattctaatatttattaaatgttaatatcaaatccttataggtagaacactcagtgagattcctgtttttacttgtggaaacatttacctaccctatgaggtagataagagaggtcagagagtcctctagcttaagttcccaaataaaacttttayaacatatcatttacttggaatgtgaacttgcagaatattttgactcattttaaaatgtaggtggaaaactacattccaaagcaacatttaataatttttgaattatagaaaccattcaactacttattagctaaaatatttttgggggaacactcaacatgaacaaaaagctgttgggctatagagatgaatgaacaggaatagttaattagcctccttgctttctatgtaaactgttttttttttcttcatcagtgaagaaacaaagaaaactttgggttcttataaatacatttcaga

SEQ ID NO: 136402 - DNA, 601 bp, Human
tgaaataatgacccattttttgaaaaaaagagtagaaaaagaatttcaaaatagaactggagaagtcaagaaaggatttctctcccccactgaaatggggcagcaatcatatttgcgaagaagtaatttaagccatctgtgaaaacagattttaacctataatacatctgaattcctaactatgaatttacttgtattcagtagactaaggcatgaagttgtaaactagggtacatttagatatgctaaatggatggaagaagctacgggatctttttctatattctgtttagcatttagtatgatgtagattctaatatttattaaatgttaatatcaaatccttataggtagaacactcagtgagattcctgtttttacttgtggaaacatttacctaccctatgaggtagataagagaggtcagagagtcctctagcttaagttcccaaataaaacttttacaacatatcatttacttggaatgtgaacttgcagaatattttgactcattttaaaatgtaggtggaaaactacattccaaagcaacatttaataatttttgaattatagaaaccattcaactacttattagctaaaa

SEQ ID NO: 136403 - DNA, 601 bp, Human
gagggaatggcattaaaaaatcctttggccatctaatcatcctggatgaaataatgacccattttttgaaaaaaagagtagaaaaagaatttcaaaatagaactggagaagtcaagaaaggatttctctcccccactgaaatggggcagcaatcatatttgcgaagaagtaatttaagccatctgtgaaaacagattttaacctataatacatctgaattcctaactatgaatttacttgtattcagtagactaaggcatgaagttgtaaactagggtacatttagatatgctaaatggayggaagaagctacgggatctttttctatattctgtttagcatttagtatgatgtagattctaatatttattaaatgttaatatcaaatccttataggtagaacactcagtgagattcctgtttttacttgtggaaacatttacctaccctatgaggtagataagagaggtcagagagtcctctagcttaagttcccaaataaaacttttacaacatatcatttacttggaatgtgaacttgcagaatattttgactcattttaaaatgtaggtggaaaactacattccaaagcaacattta

SEQ ID NO: 136404 - DNA, 601 bp, Human
caccatgcccggctaatttttgtatttttagtagagatggggtttcaccatattgaccaggctggtcttgaactcctgacctcaggtgatccacctgcctcagcctcccaaagtgctagaattacaggcatgagcctccatgcctggcctatcattatcaatttcttgttgtgatactgcactgtgattatgtaagatgttaccattagggaaaactgggtgaacagtgttggggatttctctgtattatttctgaaaactgcatggttaatttataattgtcttaaaaagattttttttaagtgctcaactttttataatttggtgtttatgtcggtctctggttatttttcttattgacatttgaaaatgaatagtttttaaaaaataacatcatattaaaacagctacttgatctagaagatataaacctatcagtgacttattttaatatgtaaattttaaaataaacattttctagagttatgaatttataaagggcatattttgaatttttgctaactgtactgtaaaagaaacaaagaatgaggaagcgatatattcattttcctatgtaagactgatttaaaataaaaattat

SEQ ID NO: 136405 - DNA, 601 bp, Human
gtctgtgaattttatcattaccaatttcttttgagacggagtctcactctgtcacccaggctggagtgcagtggcgggatctcggctcgccgcaacctccggctcccgggttcaggcaattcttctgcctcagcttcccaagtagctgggactacaggtgcacgccaccatgcccggctaatttttgtatttttagtagagatggggtttcaccatattgaccaggctggtcttgaactcctgacctcaggtgatccacctgcctcagcctcccaaagtgctagaattacaggcatgagcmtccatgcctggcctatcattatcaatttcttgttgtgatactgcactgtgattatgtaagatgttaccattagggaaaactgggtgaacagtgttggggatttctctgtattatttctgaaaactgcatggttaatttataattgtcttaaaaagattttttttaagtgctcaactttttataatttggtgtttatgtcggtctctggttatttttcttattgacatttgaaaatgaatagtttttaaaaaataacatcatattaaaacagctacttgatctagaagatataaacctatc

SEQ ID NO: 136406 - DNA, 601 bp, Human
gaagaaatcttgaaagcaatcacgcagataactggataccgggctggttattagttaattgttcctatgctataataagaatcttccagggcttattcagataaataatgttaattgtagctcctctcagtaaatgtatgacaatttctataaatgtgagcttgttcctttaaaatattaagtacttattacttaaatatttattagtgaaaggcctttttacttctttgaagccaagctaagtctaagtataaaatacatttaaaaacctctgcttgtagggtaatgggatccttgacayatcaataatgggttaaaaataagacttatttacagcttaaaatgttatatactttgtgtacatacctgtctaaaagaaaactggtaataaggactctgacttggtatgagagctattatgtagtaaagttcctaagagatggcatttagatcattcaaatgaattatatattttttatatttacttttgagacaaaacaaatcagacaagactattagtgaggcagaactaccatgatgatttcctgtaaggccaatggatacaacaagaactcttcaatgcatgtaatttcaagttaga

SEQ ID NO: 136407 - DNA, 601 bp, Human
agcaacaataaacccacagcactgcactgctgagtaaagtaactcttgcctgaaacatccagtgcctggatcagtgtttggcacatagtagtaggtgctcagccagtaactgttgactaatatttctgttttttcagttttaagatgcaactgaaagtgcagactagaaaggtcagagctgattcaaacctaggcttcagcattctggcattgtattgaatgagtggcatagtatgtagaacaggaatggataataattgtttcttggtagtgctgtggtcatgcagatagttcaaatgcrtgaacacctcaatctttaatttgttttgggctctggatctttactgtcagcaacatgccagagttaacataaatgctatcatttagtcaggtattttgaaaagtaaaattaattctaagttaccgtattaacgtatacatttgggtctacttttcaaacggactaggttaatagatatagacaattaacagattggtcttaattgggcctatgcttatatctatgagacaagcttgctactagactagagccatgaatctgcctcagtatgcttgtcaagtataccttaggactgtaaga

SEQ ID NO: 136408 - DNA, 601 bp, Human
cagaggaaacctaatcacccttctgggtggggaagggggagaaaatgacaactgcaacagtaactgtgtaaatacataagtctaaaaatttatcaagtcttatagcaaaactgcttcaggaaagaagcttatgtccaaaattgaaaagagcaacaataaacccacagcactgcactgctgagtaaagtaactcttgcctgaaacatccagtgcctggatcagtgtttggcacatagtagtaggtgctcagccagtaactgttgactaatatttctgttttttcagttttaagatgcaactsaaagtgcagactagaaaggtcagagctgattcaaacctaggcttcagcattctggcattgtattgaatgagtggcatagtatgtagaacaggaatggataataattgtttcttggtagtgctgtggtcatgcagatagttcaaatgcgtgaacacctcaatctttaatttgttttgggctctggatctttactgtcagcaacatgccagagttaacataaatgctatcatttagtcaggtattttgaaaagtaaaattaattctaagttaccgtattaacgtatacatttgggtctactt

SEQ ID NO: 136409 - DNA, 601 bp, Human
atcttcggtttgacacagaccctactactccctccttactccccctggcctgcttcagacactcaggaaactgcctagttccagaaaacatttgagtttgttaactcacagtagagtttgaaagtagtttggaagtataaaatgagaacaaaaagcaggttaagattttaaaatcttctactcagaggaaacctaatcacccttctgggtggggaagggggagaaaatgacaactgcaacagtaactgtgtaaatacataagtctaaaaatttatcaagtcttatagcaaaactgcttcargaaagaagcttatgtccaaaattgaaaagagcaacaataaacccacagcactgcactgctgagtaaagtaactcttgcctgaaacatccagtgcctggatcagtgtttggcacatagtagtaggtgctcagccagtaactgttgactaatatttctgttttttcagttttaagatgcaactgaaagtgcagactagaaaggtcagagctgattcaaacctaggcttcagcattctggcattgtattgaatgagtggcatagtatgtagaacaggaatggataataattgtttcttggtag

SEQ ID NO: 136410 - DNA, 601 bp, Human
atgattttcttaagtagacaaataagcatatcaattgtaataaataccgctctggtgggggaacgctgataataggggaggccgtgcatgcatgggggaaaaatgtaaatgggaaatctctgccaccttctcaattttgctgtgaacctagaactgctctaaaaaatgaagttggccaggtgcagtagctcacggctgtaatctcagcactttgggagactgaagcaggaggacagcttgaggccaggagtttgagaccagcctaggcaacaaattgcgaccctgtctctacaaaaaattaaaaaaaaaaaaaaaaaaaaaagccaggtgtggtggcacatgcctatagtactagctactctggaggctgaggcaggaggattacttgcacccagagttcgaggctgtggggatacagtgcaatgatcatgccattgcactccagcctgggtgacagaatgagaccccatctctaaaaaaaaaaataaaataaacataaatcaacaaagcctactttttatagaaaacattaagcacagaaatatagaaatacaacatttaaaaataaagttataagatattcatggatcctttgaagact

SEQ ID NO: 136411 - DNA, 601 bp, Human
atctaaaaacatcttgtttattcaagtttcgttataaattcctttgctgtgctataacaggctacgaaatatagaatattcatgggttgctaaacaagtaacctgtttactaataaggttgagaaaaggtataactaagactacatttacctatcctacctatcctatattttctatcttcagtgacaaatttttctactttgttttcctgtcattccatataaagagatcaggactctcttgctgccaaaatgttttattacagcaacttggtttcttgcctctctggtacagcagtttrtaagtttataactttgaattaaataaaagtgctagccaggcgcggtggctcacgcctgtaatcccagcactttgcgaggctgagtcaagtggatcacctgaggtcaggagttcgagaccagcctggccaacctggtgaaacccggtctctaataaaaatacaaaatattagcagagcatggtgatgcgcgcttgtagtcccggctacttgggaggctgaggcaggagaatcacttgaaccccagaggcagaggttgcagtgagccgagatcacactactgcactccagcctgggcaacaa

SEQ ID NO: 136412 - DNA, 601 bp, Human
taattaaattcaagctttctaattaagagttatgcaaattatgtgaacttaatacttcttaaaattttttaagcttaaaattaatttccattgggcttttactcaaattataatatttaaaaatgatgaaaggaaatagatttagtctttaggatctgtaaaggtgacaccaaagcctacttttgattttccctgatgtctatcaatatggaaatgggaaaataaatgatagtatatccttaccatggaaatccatgcagctgttaaacgacatgagataaagacctgtatgatctgacaygaacagatagccacaatatattaagtgagagaaagcagccaggtataaaacagtattgtgggaacaacagaacacatgcctatttgctatggactgactcgcatctccccaaaatctgtattgaagttttacctcccaaagtgactgtgtctggaggatagggtaattaaagttaaagtgagatcgtaagggtgaggtcctcgtctgtaccacagcggccttataagaagagaaagagctcggctcctatgctctctccctcttctcttcctgccctccaggtggggagagcaagaaggc

SEQ ID NO: 136413 - DNA, 601 bp, Human
ttaaaagttttttagaagataaaagaaaataatctacattccaggtgaaaaaccctttcaatatgcccaataagaatttcttgctgctttttctaattagaatggaattataccaaatagctgaatacaggaagagatctgataacatgttgctgtaaagaagtgatccaaaaactttgagttccacttgaataagttcaagaagtagtctgcaagaatgattacactctacgaaagtaccaccttgtttatttcctatagcaaatcagtaatgagcaattcttcaagcaaggaacctaamatctatgcaacacaatatgaatttcagtcctcacagatacattactactcatggttttctcttaatgtatgaataacaaatacatattaccctatgaacttatacggaatatttaaggttcttcagtcattaatgcccaagaaattctgcccctagtagttcagccacttgtgtttaactagaaaaaatataattaaattcaagctttctaattaagagttatgcaaattatgtgaacttaatacttcttaaaattttttaagcttaaaattaatttccattgggcttttactcaaatta

SEQ ID NO: 136414 - DNA, 601 bp, Human
ccaggctggagtgtagtggtacaatcttggctcactgcaacctcggcctcccaagctcaatccattctcctgcctcagcctcccaagtagctgggattacaggtgctcaccaccacgcccagctaatttttgtgtttttagtagagatgaggtttcactatgttggccaggctggtcttgaactcctgacctcaagtgatccgcccaccttagcctctcaaactgctgggattacaggtgtgagccactgtgcccagccaagaaactttaattttaaagaactttatcatggttaaagaargaatcaataatagtagctcttttagccccaactgcatgaccatatattttttagggggagtaaggtaggacacatgggacaaaggatataaattcaacctcagtgataaccctaagggggataacagaattaaagtgtttgagatctactggcttcacatttccaagtcaatatatatttgcttataccattgttaatgtatttcccaaatgtttaatttttatctgttgtaattaatttaatattatttttaaaaaacaccatatctatgtatttccctgtaagtcatagaaatacaag

SEQ ID NO: 136415 - DNA, 601 bp, Human; identical to SEQ ID NO: 35570

SEQ ID NO: 136416 - DNA, 601 bp, Human; identical to SEQ ID NO: 35571

SEQ ID NO: 136417 - DNA, 601 bp, Human; identical to SEQ ID NO: 35572

SEQ ID NO: 136418 - DNA, 601 bp, Human; identical to SEQ ID NO: 35573

SEQ ID NO: 136419 - DNA, 601 bp, Human; identical to SEQ ID NO: 35574

SEQ ID NO: 136420 - DNA, 601 bp, Human; identical to SEQ ID NO: 35575

SEQ ID NO: 136421 - DNA, 601 bp, Human; identical to SEQ ID NO: 35576

SEQ ID NO: 136422 - DNA, 601 bp, Human; identical to SEQ ID NO: 35577

SEQ ID NO: 136423 - DNA, 601 bp, Human; identical to SEQ ID NO: 35578

SEQ ID NO: 136424 - DNA, 601 bp, Human; identical to SEQ ID NO: 35579

SEQ ID NO: 136425 - DNA, 601 bp, Human; identical to SEQ ID NO: 35580

SEQ ID NO: 136426 - DNA, 601 bp, Human; identical to SEQ ID NO: 35581

SEQ ID NO: 136427 - DNA, 601 bp, Human; identical to SEQ ID NO: 35582

SEQ ID NO: 136428 - DNA, 601 bp, Human
cagcccaaatgcccattattgcgggtgcagattaaataaattatggtcagccctacaatgggttactatttcttgttatctattgctgaataaacagtggcttaaaacaagtcattttatcattctctctcaaggttctgtgagttgactggacccaggtgagtggtccttactgaaggtctctcatgcagtatagtcaaacagtggctggaagtagggtcatttggaagagttcctcactctcatgccaagtggctgatactggttgttagctaggacctcagctggagttgttggctgracacctacatgtggcatctcctatggcctgggcttcctcgtggcagagtggctagattccaagatcgagtgtcgcaagagaacaaggtagaagtacgtgggattttcaagacctagccttggaaatcagatagcattacttctacctttattggctgaagcagtcacgaaggtcttcctaggctaaaggagagggaacaaacatggaccccaccacttgatggcaggagtgttgacatcataagaaggggatgtggggtgggatacattggagtggctgtctttggaaaatgtaatctat

SEQ ID NO: 136429 - DNA, 601 bp, Human
aactggatgataaagtcaaatgcaaaacagtatgcgtagataggatgctgtcatttggacaaacagaggctgatatatacattgagtaacagaggttgctctggggaggagaattggggtgaagagagattggggtgggaagaaaactgatctttctctttttttgaaatggagtctctgtcgcccaggctggaatgcagtggcgcgatcttggctcactgcaatctccacctcccaggttcaagcaattctcttgcctcagcctaccgagtagctgggactacaggcaggcaccacaatrcccagctaatttttctgtatttttagtagagacagggtttcaccacgttggccaggctggtctcaaactcctgacctcaagtgatccacccacctcgacctcccaaagtgctgggattacaggcatgagctaccacacccggcctgaattttcattgtattcttttttgcactgtttgaagtttcaccatgtacatgaaattacctataattttatgttttaaaaacctgcatctgtcagatgatttcctcctgggagcctgtgggaaaaaaaacccaactttttccttttcctacgctc

SEQ ID NO: 136430 - DNA, 601 bp, Human
tgggactacaggcaggcaccacaatgcccagctaatttttctgtatttttagtagagacagggtttcaccacgttggccaggctggtctcaaactcctgacctcaagtgatccacccacctcgacctcccaaagtgctgggattacaggcatgagctaccacacccggcctgaattttcattgtattcttttttgcactgtttgaagtttcaccatgtacatgaaattacctataattttatgttttaaaaacctgcatctgtcagatgatttcctcctgggagcctgtgggaaaaaaaamccaactttttccttttcctacgctccacacacttctgtgaccagatgtgtaggctttccctcagtgacaacttttctgataccagctgggtgtcctacaactcagttcaaatctgacactaaccagagttagtgcagatcccacaagttaagggtacagtcccacaaggctgccccctgcttcaggcaccaattgcaagtcccagcttgtctcccgtacttctggccaactggctatatgtcagggttcccataacgcctttgttgggatcaattatttgatagaatggttcacaacact

SEQ ID NO: 136431 - DNA, 601 bp, Human
ggaaggaccaggacttgccaaagtggctacacatagccaagtgaactagagctcatgtctcctgatgcccaggccaaagcactctgtgaacagccagccacttgagaggctcagaaggctttctttagggaacagtgatcttcaggtgcaggcccctatctagcaaatgaggtggccacccaccctcccccaaatctcaccagttccatgggtcactaggctcccatatccaggaggggatctgcagctgtcctgaagcaatgtatcccacttggtgggaggaggatgacaagctctcctytcctcccttcccactcgaatcaggcaaccatttagggtccctgttctgccctctgtccagccccagcctcacctgtgcttaataagcctgcccgctccatcactagccaccctacatgggtgtctcagatcttcacaactgcactgcaagggaagtattctcattcctgttttactgataaggaatcttacgttcagagaggttaagacatttgtctaggccacttttagttagtggcaggtctaggaactgataatgtcacctaagaccatgctttttctttccattgtcatactgcct

SEQ ID NO: 136432 - DNA, 601 bp, Human
tctcagatcttcacaactgcactgcaagggaagtattctcattcctgttttactgataaggaatcttacgttcagagaggttaagacatttgtctaggccacttttagttagtggcaggtctaggaactgataatgtcacctaagaccatgctttttctttccattgtcatactgcctcccgaagtagattcaggggggaaatatgccttactgatgattttctcttattccttatcagaaagacagattatagataccctcattttcccctttgcctaggatgccaggaagcttgaaacyaaatgtagtgaagatatgtctctttaaaaataaatctcgagttttttctgggggcgggggtgggaggggcagaaagaaatcactcctgggttaagcatacaagttataaatcaatcgggtcacgtaactcaacagctttctactccctgatatctactcccagcttcctcattaccagctcattaccaggattaacttgcttctcctttttatctaggtggtatttgtgtcactttggccagtctctaatccatgtcatccaggtggtcatcggctacttcatcatgctggccgtaatgt

SEQ ID NO: 136433 - DNA, 601 bp, Human
ttgaaaccaaatgtagtgaagatatgtctctttaaaaataaatctcgagttttttctgggggcgggggtgggaggggcagaaagaaatcactcctgggttaagcatacaagttataaatcaatcgggtcacgtaactcaacagctttctactccctgatatctactcccagcttcctcattaccagctcattaccaggattaacttgcttctcctttttatctaggtggtatttgtgtcactttggccagtctctaatccatgtcatccaggtggtcatcggctacttcatcatgctggcygtaatgtcctacaacacctggattttccttggtgtggtcttgggctctgctgtgggctactacctagcttacccacttctcagcacagcttagctggtgaggaacgtgcaggcactgaggctggagggacatggagccccctcttccagacactatacttccaactgccctttcttctgatggctattcctccaccttattcccagcccctggaaactttgagctgaagccagcacttgctccctggagttcggaagccattgcagcaaccttccttctcagccagcctacatagggccc

SEQ ID NO: 136434 - DNA, 601 bp, Human
ttgagggacagagaccaagctagatcctttttctcacctttctgcctttggaacacatgaagatcatctcgtctatggatcatgttgacaaactaagttttttttatttttcccattgaactcctagttggcaattttgcacattcatacaaaaaaatttttaatgaaatgatttcattgattcatgatggatggcagaaactgctgagacctatttccctttcttggggagagaataagtgacagctgattaaaggcagagacacaggactgctttcaggctcctggtttattctctgagagactgagctccttccaccagaaggcactgcctgcaggaagaagatgatctgatggccgtgggtgtctgggaagctcttcgtggcctcaatgccctcctttatcctcatctttcttctatgcagaacaaaaagctgcatctaataatgttcaatacttaatattctctatttattacttactgcttactcgtaatgatctagtggggaaacatgattcattcacttaaaatactgattaagccatggcaggtactgactgaagatgcaatccaaccaaagccattacattttttgagtta

SEQ ID NO: 136435 - DNA, 601 bp, Human
tgattaaaggcagagacacaggactgctttcaggctcctggtttattctctgatagactgagctccttccaccagaaggcactgcctgcaggaagaagatgatctgatggccgtgggtgtctgggaagctcttcgtggcctcaatgccctcctttatcctcatctttcttctatgcagaacaaaaagctgcatctaataatgttcaatacttaatattctctatttattacttactgcttactcgtaatgatctagtggggaaacatgattcattcacttaaaatactgattaagccatggcaggtactgactgaagatgcaatccaaccaaagccattacattttttgagttagatgggactctctggatagttgaacctcttcactttataaaaaaggaaagagagaaaatcactgctgtatactaaatacctcacagattagatgaaaagatggttgtaagctttgggaattaaaaacaaacaaatacattttagtaaatatatatttttaaatagtctatgactgttctgttctcctaattccaacagaaagcacatgaacccttgtaacaactgcaggggctgagtggggctaata

SEQ ID NO: 136436 - DNA, 601 bp, Human
tctccagcagcccagtcctcagtgcccaccatgacacctccatactttaaggatagatatcaaatctgtttcccagcaggttgggcttgtggagagctttgggtgagccagactctgggcctggctgctgttggtagcaggatggttaagtatgtgggctctggagtctgatagatgtgggtacaaatcctagttctgtagctttctagttgtgtgacctcagtttcttcgtttagtaaatggggactagaaccgacctcaatgggttgttgtaagaaatgaatgggtcaggccgggcgtrgtggctcacgcctgtaatcccagcactttgggaggccgaggtgggcgaatcacctgagctcgggagttcgagactagcctgaccaacagggagaaaccccatctctactaaaaatacaaaaattagcaggcgtggtggcacacgcctgtaatcccagctagttggcaggctgaggcaggagaatcgcttgaacccgggaggcggaggttgcagtgagctgagatcgcgccattgcactccagcctgggcaacaagagcgaaactccgtctcaaaaataaataaataaataaaataaatga

SEQ ID NO: 136437 - DNA, 601 bp, Human
aactgggctcagagaggggtagacacaggcccaggatcacgcagtgggtcagcggcagatctgggggaaggtctccagcagcccagtcctcagtgcccaccatgacacctccatactttaaggatagatatcaaatctgtttcccagcaggttgggcttgtggagagctttgggtgagccagactctgggcctggctgctgttggtagcaggatggttaagtatgtgggctctggagtctgatagatgtgggtacaaatcctagttctgtagctttctagttgtgtgacctcagtttcttygtttagtaaatggggactagaaccgacctcaatgggttgttgtaagaaatgaatgggtcaggccgggcgtggtggctcacgcctgtaatcccagcactttgggaggccgaggtgggcgaatcacctgagctcgggagttcgagactagcctgaccaacagggagaaaccccatctctactaaaaatacaaaaattagcaggcgtggtggcacacgcctgtaatcccagctagttggcaggctgaggcaggagaatcgcttgaacccgggaggcggaggttgcagtgagctgagatcgcgc

SEQ ID NO: 136438 - DNA, 601 bp, Human
ctagagtctagtcagatgttgaagagaggtctaatctctctgactcacttcccacaaacaatctctgttgttttctggcttctgaatccaaagctgcattccactggcctcaactccccatcgcttttaggaggctgagggaacaactggctcctgcttagcagaaaccctggggcaggactgcctaggagcctgagaccggggcagggttagagtaaagggaacagtctcactacagcagtccactttgatctgtttttgaattttaagattcagagacagatttgatttgagaaacggmtgtcagtgctgaaaatattaaaagcttgaaaattgccaatcctgtttaatcccttacactttaatgtggaaaatggggtataaagaggcaacgggacttttggagatcacagtgagtgacatacagagctataaactgaccctgcagctcctggcttctatttcagtgccctgatacctacaccatagagtcattccattgtaagaggtacttaataagtggagtttcccactccattctgtgagtgggaaaacaccccctgaatcacatattggcagagccaaatgcagggtgggtttt

SEQ ID NO: 136439 - DNA, 601 bp, Human
tttgagacagagtctggctctgtcacccaagctggagtgcagtggttcgatctcggctcactgcaacctccacctcctgggttcaagtgattctcctgcctcagcctcccaaatagatgggactacaggcatgcatgaccatgcttggctaatttttgtatttttagtagagacagggtttcgccatgttggccaggctggtctcaaactcctgacttcaagtgatccgcccgcctctgcctcccaaagtgctgggattacaggcgtgagccaccgcacctggccgagagaatatttttgmatattgagagaattaccaaaatgtaagccagttgcccaagaccacatagctacttagtgactgagccagaatttgaatttgttctggactccaaatgctgggttttatatactgtatttcataatactgataaacacctgattcagtaggcgtctctctgcccatactgtttctgctttgggtgctggagagacagaagaaacaaaagaaaaacatactgagtgtattcgttctgtgctgggcacagcactgaagtacttggtagtagtatctcatttcattgcaagaattgtcctaact

SEQ ID NO: 136440 - DNA, 601 bp, Human
atgtcgaagccaggtctaatccctctaatttgcttcccagaaaaccacctttgtaacaggtccttggcttctggaatccaaagctgcattcccgtggcctcaactcctcattgctttcaggaggctgagggaacaactgcctcctgcttatcagaaacagtggggcagggctgcctaggaactggctgcccttctccccatagtctcttaggcccctttagctgccttcagccatctcaggggcccattttatccagtcttcctccttggtagggtggggttatcacaagtcacacagggsccagccctgctgccacacccctgggtgggccagccccatcacctaacacaggggcaggccaggcctccccagtcatgtctcaacctccaaacagacaattattcagtagatatgaggtcccagctgcccatttcgtactcgattttgctctcatgtctgccaggagttttttttccttttctttttttttttttttttttgagacagagtctggctctgtcacccaagctggagtgcagtggttcgatctcggctcactgcaacctccacctcctgggttcaagtgattctcctgcctca

SEQ ID NO: 136441 - DNA, 601 bp, Human
agggcagtggggagctgggcttggagaggaggtggagagctctgttttagacacttccttttggaggtgcctgggagactatcccatagccaaaggatggggaggggcggggaagagccacaaaaatgggggctggcaggcctgagtccaactgctttttgtatgaatgggacctcaaggtccagagaggggcaaggacttacccaaagccacacagcgagcaaaaggactagaaccctggtgtgttaactcccaggtgaactgggagatcctttggtaggttggagtcaagtcagatgtygaagccaggtctaatccctctaatttgcttcccagaaaaccacctttgtaacaggtccttggcttctggaatccaaagctgcattcccgtggcctcaactcctcattgctttcaggaggctgagggaacaactgcctcctgcttatcagaaacagtggggcagggctgcctaggaactggctgcccttctccccatagtctcttaggcccctttagctgccttcagccatctcaggggcccattttatccagtcttcctccttggtagggtggggttatcacaagtcacacaggggccag

SEQ ID NO: 136442 - DNA, 601 bp, Human
aagacaggcgccaggcgtagtggctcacacctgtaaccccagcactttgggaggctgaggcgggtggatcacttgaggtctggagtttgagaccaggctggccaatgtggtgaaactccgtctctactaaaaatacaaaaattaggccaggcacggtggctcacgcctgtaatcccagcactttgggaggccgaggtgggtggatcacttgaggtcaggagtttgagaccagcctgaccaacatggtgaaaccccatctctactaaaaataaaaaaaaattagccgggtgtggtggcacaygcctgtaatcccagctacttcagaagctgagataggagaatcctttgaacttgggaggcggaggttgcaatgagccgagatcgtgccattgcactccagcatgggcaacaagagagaaactccatctcacaataaataaataaatagaaataaaaataaaaatacaaaaattagctgggtgtggtggtgtgcacctgtagtcagagttcctctggaggctgaggcagaagaatcgattgaacctaggaggcagaggttgcagtgagccgagagtgcacccattgcactctagcctgggcg

SEQ ID NO: 136443 - DNA, 601 bp, Human
tccttatgcataaagaagcactgatctagccaacatttaaactttgtttattccacaaaaaatgcccgtgttcatggcagaacttttagaaaagtgcagataagcaaaaagagaaaaatcccctgcaattctacctctagagaaaagtactgttggccgggcatggcggctcacacctataatctcagcactttgggaggctgagatgggcagatcacttgaggtcaggagttcgagaccagcctggccaacacagttaaaccccacctctactaaaaatacaaaaaaaattagctgggcrtggtggtgcgtgcctgtaatcccagctactggggaggctgaggcaggagaactgcttgaatccaggaggaggaggttgcagtaagccgagatagcgccacttcactccagcctgggcgacagagcaagacttcattccaaaaaaaaaaagaaagaaagaaaagagaaaagtacttgggacatggattttttgttaggtacaatgcacaccaataggagaaaatagtaccattcatgttagatagacagacagacacatacactgtatagagtgccaccaaatcttttctagcccaaggag

SEQ ID NO: 136444 - DNA, 601 bp, Human
atcaaagaatcaataaattggaaatagaaaaaaaagaactaatccttccttatgcataaagaagcactgatctagccaacatttaaactttgtttattccacaaaaaatgcccgtgttcatggcagaacttttagaaaagtgcagataagcaaaaagagaaaaatcccctgcaattctacctctagagaaaagtactgttggccgggcatggcggctcacacctataatctcagcactttgggaggctgagatgggcagatcacttgaggtcaggagttcgagaccagcctggccaacacrgttaaaccccacctctactaaaaatacaaaaaaaattagctgggcgtggtggtgcgtgcctgtaatcccagctactggggaggctgaggcaggagaactgcttgaatccaggaggaggaggttgcagtaagccgagatagcgccacttcactccagcctgggcgacagagcaagacttcattccaaaaaaaaaaagaaagaaagaaaagagaaaagtacttgggacatggattttttgttaggtacaatgcacaccaataggagaaaatagtaccattcatgttagatagacagacagac

SEQ ID NO: 136445 - DNA, 601 bp, Human
ggctctgtcgcccaggctggagtgaagtggtgcaatctcggctcactgcaagctccgcctcccgggttcacgccattctcctgcctcagcctcccaagtagctgggactacaggcacccgccaccacgcctggctaatttctttgtgtttttagtagagacagggtttcaccatattagccaggatggtctcgatctcctgacctcgtgatccgcctgcctcagcctcccaaagtgctgggattacaggcgtgagccaccgtgcccagcctcaatgactgccatctcttacaggtacatarcactttacaatgtacagagcaccttctcagcttctgtcttactgcaagagctcaggatggcaggcaagggttattcttctaattttccaaatgggatgaatgagttctttcaaagtttgttttgttcctaagattcctgtccttaatccaagtagcctgcttccagtgccttgaatttcaagctgacagctcactttgccacccccagccatactgatgcccgctccagtcaacactccctccccaaccccaaccccaaccagcagagcagaggcctggcccattcttggagactcacgt

SEQ ID NO: 136446 - DNA, 601 bp, Human
attcattcaacaaatatttattgagtacttattatgtgccaagtactgttctaggccctgatgatacaacagtgaacaaaatagacaaacatccctgccctcatggagctgatgttctagaggatagctactccttcttcatacaaatgctctcagaattgaatgagataatgtgtgtaggtgcttagcatagtacctggtagatagtaagtactcagtaaatgtctgcattattattaacaatcacgattgccatctctttttttttttttttttttttgagatggagtctggctctgtygcccaggctggagtgaagtggtgcaatctcggctcactgcaagctccgcctcccgggttcacgccattctcctgcctcagcctcccaagtagctgggactacaggcacccgccaccacgcctggctaatttctttgtgtttttagtagagacagggtttcaccatattagccaggatggtctcgatctcctgacctcgtgatccgcctgcctcagcctcccaaagtgctgggattacaggcgtgagccaccgtgcccagcctcaatgactgccatctcttacaggtacatagcactttac

SEQ ID NO: 136447 - DNA, 601 bp, Human
tatatcatgcgtggttaattcattcattcaacaaatatttattgagtacttattatgtgccaagtactgttctaggccctgatgatacaacagtgaacaaaatagacaaacatccctgccctcatggagctgatgttctagaggatagctactccttcttcatacaaatgctctcagaattgaatgagataatgtgtgtaggtgcttagcatagtacctggtagatagtaagtactcagtaaatgtctgcattattattaacaatcacgattgccatctctttttttttttttttttttttgagatggagtctggctctgtcgcccaggctggagtgaagtggtgcaatctcggctcactgcaagctccgcctcccgggttcacgccattctcctgcctcagcctcccaagtagctgggactacaggcacccgccaccacgcctggctaatttctttgtgtttttagtagagacagggtttcaccatattagccaggatggtctcgatctcctgacctcgtgatccgcctgcctcagcctcccaaagtgctgggattacaggcgtgagccaccgtgcccagcctcaatgactgccatctct

SEQ ID NO: 136448 - DNA, 601 bp, Human
tccacctcccgagtagctgggactacaggcacatacccccacacccagctaacttttgtattttttgtagagatgggttttgccatgttgtccaggctggtctcaaaatcctgggctcaagtgatccacccactttggcctcccaaagtgctgggattacgggcgtgagcgcaacctcccttcttagcccttcctttgattcttcaccttgggaactctgctggggacgccaaagatcaagacacagcgtaggccctcttccaccaagggcctcagcatctcttccagccgcttcacaccrtacctgtgtgggtgtgggtagaggggttgaaggaaggcaggtcccaggcaacggtcctccggaccccaccacactgtgtgcctctgttagaaaccaagctgcatatggcaccaggagggctcaagcccccaggacagaaggggcagggatgcatccactaaataggagggaagactgaggccctgagtagcagagctccggaattcggctgtggaaggctccttcgaggccctctttttgaactcccatctgcagttcagctcccttctgcaacagcctctgccacgacgtctcgggtga

SEQ ID NO: 136449 - DNA, 601 bp, Human
caggatgacagccatcacagagcatagccctggccttctccttccttcatcatcacagcccctggataaggaagcacagaggaccgaccctacatgggtgctgacttaagggcaaagaccacgtccattcacctgtggccccagggccagcacaatgtgggagtgagggtgcagtcagtgtggaccctcagtccacctttgcccaacctcccttcctttttctgtttgtattggagacagggtcttgctctgtcacccaggctagagtgcactggcgcgattttggctcactgcagcctcractttctgggctcaagcaatcctcccacctctccacctcccgagtagctgggactacaggcacatacccccacacccagctaacttttgtattttttgtagagatgggttttgccatgttgtccaggctggtctcaaaatcctgggctcaagtgatccacccactttggcctcccaaagtgctgggattacgggcgtgagcgcaacctcccttcttagcccttcctttgattcttcaccttgggaactctgctggggacgccaaagatcaagacacagcgtaggccctcttccaccaagg

SEQ ID NO: 136450 - DNA, 601 bp, Human
cggcccttgccaggtatcccagggtgatgtggcagggagagaaagaacctaggctgggaaggagactgcctgtgttctggtcctgttggagtgctgggcttgatttccctgcagaggcccagaggtttaaatggttccccaaagcctcatccagcactgtcttcagttctgtgattctttttttttttgagatggagtctagctctgtcatccaggctgaagtgcagtggcatgatctcagctcactgcctcgtgggttcaagcgattctcctgcctcagcctccccagtagctgggattrcaggcgcctgccaccacgcccagctaatttttgtgtttttagtagagatggggtttcaccatgttggccaggctggtcttgaacccctgacctcaagtgatctacctgcctcagcctcccaaagtgctgggactacaggtgtgagccaacacgcccggcagttctgtgattcttagcagacacgggggcagggctggtgcagactatctcctgccagccctgtgctgcattccctgcccttaccctgttgccaagtccatgtgccatcagggcctctttgatggcttccacgcgtccatc

SEQ ID NO: 136451 - DNA, 601 bp, Human
cagacccctgcccacccctgctcaccggaaagggccatagaaacaggaagcaaatttggcactgtagctcatcaccgatacctatggggagacaatggaggtcttggcttattcggcccttgccaggtatcccagggtgatgtggcagggagagaaagaacctaggctgggaaggagactgcctgtgttctggtcctgttggagtgctgggcttgatttccctgcagaggcccagaggtttaaatggttccccaaagcctcatccagcactgtcttcagttctgtgattctttttttttttgagatggagtctagctctgtcatccaggctgaagtgcagtggcatgatctcagctcactgcctcgtgggttcaagcgattctcctgcctcagcctccccagtagctgggattacaggcgcctgccaccacgcccagctaatttttgtgtttttagtagagatggggtttcaccatgttggccaggctggtcttgaacccctgacctcaagtgatctacctgcctcagcctcccaaagtgctgggactacaggtgtgagccaacacgcccggcagttctgtgattcttagcagacacgggg

SEQ ID NO: 136452 - DNA, 601 bp, Human
gtataatttctatgaagagataagctgaggtctgtcctgctgtattcccaggacccagcactgaacctaggaacagagcagagattctcaaaaagtatctcctgaataaaaagtgtttgtggtggtggcacctctagcagtcaggaactccctctttgcctctgagttttgatcctcaggcagtatttatgctggttaatgagtaattcttctctgggtttatggttcagagtagaataggagacctcaggcagcctggcaacctctggcctcgtgggaaatgccttccagtggaattgcrgcaaatttcaactctaacccagggatatcgatctaggcctcattcccacacccagctctgctgccagaagcgttccaaggcttctcaggccccaagatcccactgctctcttcttcccctaatgctccaagaccctctcccagccaggccccaaaggctgtgcccccgactccaggttgctttcaagctgaagccacaccagaggaaagagctgagggtggcaaaggtgggcctcacggctgacccaggggaggggcggggaagcttgggagagctcataggatgcagctgcgagttaca

SEQ ID NO: 136453 - DNA, 601 bp, Human
agcctgcggacacccacacttcatgcagactgcaggcacctgcgctcacagggagccccaaagacacccccctgggaccagtgctgcccgtcccgtcctcctgccccgatggcctgtgacaccgaggagagagctggagatgagcagtgggggcctgggagggctggagctgggagcagagtctgtcttccccaccccacagcacccaccgaccccacggcccttcctgtgtccccacctgagagtggcactcctgccagcaggctggaccctggccatcaacccccttctctgcctcccyccctccctctctttccctacagcccatctctccaggtgagtcttcctccgtggctgtgcccccgtgtccccaccctggccccccacctcccatcctgacccctccgcctgcctcctcagataccacctggccatgtccctcctcctcctaaagctctccccggacccctgctgcatctggactttctactccccagatcctcattccctgctctaagggggcccaaattccgactctgagctctctggagccctttgcccattcattcattcattcattcattcgagatttagggcctgc

SEQ ID NO: 136454 - DNA, 601 bp, Human
gctcacactcacggcaacacatacacccatgtatgtgatcacatttacgggttgatgggaagacagtgacacccacacactgatgtgtgtggagattttgcacaataaaacacaggcaggcacacacacacacacacacaaacaggcattcccatggccacagagactcagccagcctgcggacacccacacttcatgcagactgcaggcacctgcgctcacagggagccccaaagacacccccctgggaccagtgctgcccgtcccgtcctcctgccccgatggcctgtgacaccgaggmgagagctggagatgagcagtgggggcctgggagggctggagctgggagcagagtctgtcttccccaccccacagcacccaccgaccccacggcccttcctgtgtccccacctgagagtggcactcctgccagcaggctggaccctggccatcaacccccttctctgcctccccccctccctctctttccctacagcccatctctccaggtgagtcttcctccgtggctgtgcccccgtgtccccaccctggccccccacctcccatcctgacccctccgcctgcctcctcagataccacc

SEQ ID NO: 136455 - DNA, 601 bp, Human
ggtcttgataaaatgcgaatttcatcatgttactgcctgcttaagggaaagttcaaggtaccaggccccggcattcaaggctttgcacagctcagctcctgtcccctcgccagcctactccccaccccgtccccacccctgcagccacacagaactttcaggattccccagaactttgtgcaagctgttccttgagtctggaaagctattagtgctgcttgtttttttttcacccagaatgctcctattcatactgctaggcccagctcagagcccccaccccccggaagccttcccggayagccaagtggtgctggtttctcccctctgacccaaccctgatcacactgaactgatggggttcctctcccaacctggaactggccagccaaaggcctctgcagccccctacatccctctctcactgcttgccatcagctggggtcctggaatctcctcctgttcctcctctggcacccccaacctcaccaggttcctggcctgctgggctcagggctcacccacccacatcagccagacccatgttcctgtgcccaaggataaggcactgtgccagacacaatgatacagatggagactg

SEQ ID NO: 136456 - DNA, 601 bp, Human
ccatgctgcacttagaagggtcttgataaaatgcgaatttcatcatgttactgcctgcttaagggaaagttcaaggtaccaggccccggcattcaaggctttgcacagctcagctcctgtcccctcgccagcctactccccaccccgtccccacccctgcagccacacagaactttcaggattccccagaactttgtgcaagctgttccttgagtctggaaagctattagtgctgcttgtttttttttcacccagaatgctcctattcatactgctaggcccagctcagagcccccacccyccggaagccttcccggatagccaagtggtgctggtttctcccctctgacccaaccctgatcacactgaactgatggggttcctctcccaacctggaactggccagccaaaggcctctgcagccccctacatccctctctcactgcttgccatcagctggggtcctggaatctcctcctgttcctcctctggcacccccaacctcaccaggttcctggcctgctgggctcagggctcacccacccacatcagccagacccatgttcctgtgcccaaggataaggcactgtgccagacacaa

SEQ ID NO: 136457 - DNA, 601 bp, Human
cagcccagccccaggtctagcctctgccagggctctgggctgcctgcctgccatccttttcccatgctgcacttagaagggtcttgataaaatgcgaatttcatcatgttactgcctgcttaagggaaagttcaaggtaccaggccccggcattcaaggctttgcacagctcagctcctgtcccctcgccagcctactccccaccccgtccccacccctgcagccacacagaactttcaggattccccagaactttgtgcaagctgttccttgagtctggaaagctattagtgctgcttgtttttttttcacccagaatgctcctattcatactgctaggcccagctcagagcccccaccccccggaagccttcccggatagccaagtggtgctggtttctcccctctgacccaaccctgatcacactgaactgatggggttcctctcccaacctggaactggccagccaaaggcctctgcagccccctacatccctctctcactgcttgccatcagctggggtcctggaatctcctcctgttcctcctctggcacccccaacctcaccaggttcctggcctgctgggctcagggctcacc

SEQ ID NO: 136458 - DNA, 601 bp, Human
cagtttccctggagccccagctctggtggtctgggtgggatcaggagaggagacctctgctccagaccctggagtctgctccagcccagccccaggtctagcctctgccagggctctgggctgcctgcctgccatccttttcccatgctgcacttagaagggtcttgataaaatgcgaatttcatcatgttactgcctgcttaagggaaagttcaaggtaccaggccccggcattcaaggctttgcacagctcagctcctgtcccctcgccagcctactccccaccccgtccccacccctrcagccacacagaactttcaggattccccagaactttgtgcaagctgttccttgagtctggaaagctattagtgctgcttgtttttttttcacccagaatgctcctattcatactgctaggcccagctcagagcccccaccccccggaagccttcccggatagccaagtggtgctggtttctcccctctgacccaaccctgatcacactgaactgatggggttcctctcccaacctggaactggccagccaaaggcctctgcagccccctacatccctctctcactgcttgccatcagctg

SEQ ID NO: 136459 - DNA, 601 bp, Human
aagtggcggtccctctccgggtcccagtttccctggagccccagctctggtggtctgggtgggatcaggagaggagacctctgctccagaccctggagtctgctccagcccagccccaggtctagcctctgccagggctctgggctgcctgcctgccatccttttcccatgctgcacttagaagggtcttgataaaatgcgaatttcatcatgttactgcctgcttaagggaaagttcaaggtaccaggccccggcattcaaggctttgcacagctcagctcctgtcccctcgccagcctmctccccaccccgtccccacccctgcagccacacagaactttcaggattccccagaactttgtgcaagctgttccttgagtctggaaagctattagtgctgcttgtttttttttcacccagaatgctcctattcatactgctaggcccagctcagagcccccaccccccggaagccttcccggatagccaagtggtgctggtttctcccctctgacccaaccctgatcacactgaactgatggggttcctctcccaacctggaactggccagccaaaggcctctgcagccccctacatccc

SEQ ID NO: 136460 - DNA, 601 bp, Human
ccagcaacgcacagaacaccacaccgttcttccagcagacacgggagcggggtcaaacaaacctggagacgcccccttcatgtgtcaggggttcagatcccggctttacaaccagctgggtgaccttgggcaagtcacttcccctctctgagctgcagtttcctgtcatctgcacaacaggggaaaattcatctctgcctcacagggtggcaaggagctggctctcatctgcatgcccagctctgggccctgggcgcccgaaggttggagaccggcatgttggagaggagcctgcgccccscaagcccgctcagctcccggcactcgcggaggtggaggtcggagggagctgggagatggagcccccacctcggagagcagcccgctagctctgcagagctgggggcccccaggttctcagaaaagcccccttttcatggtttaattgaatatttgaataatcctttcattccagcgaggcataaagaatgttgtcccaatagcggtaactcaggcaggcgcccccgcgcacaatggcccctcgagtggggctgctattcaggccgccttttgttggcgcggagcagtgggtaaattgcaa

SEQ ID NO: 136461 - DNA, 601 bp, Human
tctctgacaccaaagcccaagtctcccatgataggcaagcaggactggggccccctgcccaggagctgggtcaagctgggatgcatgttcctgtgggattggacataactttatgtcccatgccatccatgagttctgtccgagatcccccacccctggggttctaggattcccccagagaggctactctggactctagacttgccttcctcctcatctggagaccttgtacaagtcactccccttccccaagcctccctgaacccccagtctctaaagagatcattgtgaagattccagyggataacacatgtgacggtgccagcaacgcacagaacaccacaccgttcttccagcagacacgggagcggggtcaaacaaacctggagacgcccccttcatgtgtcaggggttcagatcccggctttacaaccagctgggtgaccttgggcaagtcacttcccctctctgagctgcagtttcctgtcatctgcacaacaggggaaaattcatctctgcctcacagggtggcaaggagctggctctcatctgcatgcccagctctgggccctgggcgcccgaaggttggagaccggcatgt

SEQ ID NO: 136462 - DNA, 601 bp, Human
catccagacaggcagggcagtgcatccccagggctcagggaaccagggccccctcaagacacacaaggtgccagagcctggattcaaacccaagtctctctgacaccaaagcccaagtctcccatgataggcaagcaggactggggccccctgcccaggagctgggtcaagctgggatgcatgttcctgtgggattggacataactttatgtcccatgccatccatgagttctgtccgagatcccccacccctggggttctaggattcccccagagaggctactctggactctagacttgmcttcctcctcatctggagaccttgtacaagtcactccccttccccaagcctccctgaacccccagtctctaaagagatcattgtgaagattccagcggataacacatgtgacggtgccagcaacgcacagaacaccacaccgttcttccagcagacacgggagcggggtcaaacaaacctggagacgcccccttcatgtgtcaggggttcagatcccggctttacaaccagctgggtgaccttgggcaagtcacttcccctctctgagctgcagtttcctgtcatctgcacaacagggga

SEQ ID NO: 136463 - DNA, 601 bp, Human
ttcgctccccaccatcctgggctgagcaagtctcctgacattctcttctgacaattcataatgggggtccggagggggacagggaccagctcaaggccacacatcagtaaagggtcctggaggaagcagctggagtggggaggaccggccaggataccgcagtaggggcaggggcgggagggggctggggaagaccagggcctcggctttaccgggatttactgttctcagcagcactgcgccagggacaccgaagcgggggtgcgggggtgggtgcagaaggaggacaggtttcagggaygcccccacccccagcagttctatggcttcccagctctcagcaggttggaaacccccgactgcccccagaggtcagccacagggccgggggagggaagcacagtcgctaacggagcctcagtggctacagtccagaagcccagacccagtttcccgggcaccccccaggcaccttgcacccagctcggttcatctcagcagacatccagacaggcagggcagtgcatccccagggctcagggaaccagggccccctcaagacacacaaggtgccagagcctggattcaaacccaagtctct

SEQ ID NO: 136464 - DNA, 601 bp, Human
gacctgcccaactgtatggaacagccctactccctagcctgggctgccccagacatattcaaaggtcatgggaagtcatgtcacctagctgagctcctgctggccccatccctgtcccatctgccttcgctccccaccatcctgggctgagcaagtctcctgacattctcttctgacaattcataatgggggtccggagggggacagggaccagctcaaggccacacatcagtaaagggtcctggaggaagcagctggagtggggaggaccggccaggataccgcagtaggggcaggggcrggagggggctggggaagaccagggcctcggctttaccgggatttactgttctcagcagcactgcgccagggacaccgaagcgggggtgcgggggtgggtgcagaaggaggacaggtttcagggatgcccccacccccagcagttctatggcttcccagctctcagcaggttggaaacccccgactgcccccagaggtcagccacagggccgggggagggaagcacagtcgctaacggagcctcagtggctacagtccagaagcccagacccagtttcccgggcaccccccaggcaccttg

SEQ ID NO: 136465 - DNA, 601 bp, Human
gccctggccccctaatcccccttaacacccgctgcaccaggagagcgccacgctcctggcaaccctgatccctggccgcccccagcgcgcctgctgaggcctgtgttgtccaaagtcggatttagggaaacccgagctgggcccgggggtggacggcaggacctggcctccatcctcccagcccagcccaggctcctcaccctcccttctgaagcgagccaggagcactttcttcctcacttccccagggtcaccactaaccctgaaggcacctttatgccaattacatggaagttccccrttgtccagagagatactgctatatccatcccaacgcctcctggcccaggtgctcttgtgcagtgaatgacctgcccaactgtatggaacagccctactccctagcctgggctgccccagacatattcaaaggtcatgggaagtcatgtcacctagctgagctcctgctggccccatccctgtcccatctgccttcgctccccaccatcctgggctgagcaagtctcctgacattctcttctgacaattcataatgggggtccggagggggacagggaccagctcaaggccacacatcagt

SEQ ID NO: 136466 - DNA, 601 bp, Human
ttctgcggaatgcatgtttttcaacttctacaccaccgtaaagtcaaaaaatcctaagccaaagctcatgagtcaggggccatctctgctcatggtggcaaggagggggcctggatggccacgtggtgaccgcaccccaaggagtcgtgtgcaataggcagaagtcagggagcccacacaatgcagggcaaagcctgggactgagcggaaaacaaaaatcacagaagggaggtcaggatgagatcgataaggctcagccatgtacataaactagaaatgcttgttggccgggcgtagtggytcacacctgtcatcctagtagtttgggaggccaaggtaggtgggtcacttgaggtcaggagttcgagaccagcctggccaacatggtgaaaccccatctctactaaaaatacaaaaaaaattaccgaggcatggtggcgcgcacctgtaatcccagctacttgggaggttgaggctggtgaatcaggtgaacccgggaggtggtggttgctgtgagccgagattgcaccactgcattccagcctgggcaacagagcaagactctgtctctaaataaataaataaataaataaataaataa

SEQ ID NO: 136467 - DNA, 601 bp, Human
tccaggcatgctttctgcggaatgcatgtttttcaacttctacaccaccgtaaagtcaaaaaatcctaagccaaagctcatgagtcaggggccatctctgctcatggtggcaaggagggggcctggatggccacgtggtgaccgcaccccaaggagtcgtgtgcaataggcagaagtcagggagcccacacaatgcagggcaaagcctgggactgagcggaaaacaaaaatcacagaagggaggtcaggatgagatcgataaggctcagccatgtacataaactagaaatgcttgttggcygggcgtagtggttcacacctgtcatcctagtagtttgggaggccaaggtaggtgggtcacttgaggtcaggagttcgagaccagcctggccaacatggtgaaaccccatctctactaaaaatacaaaaaaaattaccgaggcatggtggcgcgcacctgtaatcccagctacttgggaggttgaggctggtgaatcaggtgaacccgggaggtggtggttgctgtgagccgagattgcaccactgcattccagcctgggcaacagagcaagactctgtctctaaataaataaataaataa

SEQ ID NO: 136468 - DNA, 601 bp, Human
ggcaaaatcacctgacgcaagcctattttacaataaagcgttgaacatctcatggggtttactgaacaccatgctgaaaacgcaaaacagaagggttacatgggtactccaggcatgctttctgcggaatgcatgtttttcaacttctacaccaccgtaaagtcaaaaaatcctaagccaaagctcatgagtcaggggccatctctgctcatggtggcaaggagggggcctggatggccacgtggtgaccgcaccccaaggagtcgtgtgcaataggcagaagtcagggagcccacacaaygcagggcaaagcctgggactgagcggaaaacaaaaatcacagaagggaggtcaggatgagatcgataaggctcagccatgtacataaactagaaatgcttgttggccgggcgtagtggttcacacctgtcatcctagtagtttgggaggccaaggtaggtgggtcacttgaggtcaggagttcgagaccagcctggccaacatggtgaaaccccatctctactaaaaatacaaaaaaaattaccgaggcatggtggcgcgcacctgtaatcccagctacttgggaggttgaggctggtga

SEQ ID NO: 136469 - DNA, 601 bp, Human
ccataaccaacaccatccccctggcacgatcaaagccatcttgtctccatcatcactgatgcctcatctccatgaccgttgccatccgcatccccactctgccaccatcaccactgtcaccccatcagcaccacgcccacagaggcgcactgtgggtgggagtatcccatctcatgctgcaatgcaggaggactggtggccccattctagaggacagctggcatgtgcttttagtctcccctatgaccaacagacaggctccagtacccccaggaaggactctcatggggccatgggggarcatgcacattcactgcaggagtgcagatgcgctgacatcctggctaacctatcgcaagctgaaaatatcgtaagtcagaaggcatttactatgcctgacctgctgcacatcacagcctggcctaccttaaatgtgctcagaccacattaccctacagttggcaaaatcacctgacgcaagcctattttacaataaagcgttgaacatctcatggggtttactgaacaccatgctgaaaacgcaaaacagaagggttacatgggtactccaggcatgctttctgcggaatgcatgtttttc

SEQ ID NO: 136470 - DNA, 601 bp, Human
tgaccatcaaagacatgggcattgctgccaccaaccatgcaacatggtctccccgttggcaccgtgtcgccatcaccattgctgtcaccctggttgacaaacaccaccatcgtcaccaatacccacatgcctgtgtttttcatgaacatggccaccgccaccatcaaccacccaaccacagtcacctgtcaccatcatcactgccatcatcatcaccacagtggtcacaatgaacaagaattatgaagcccatcaccagcctccctcggggaggatccctgggcagttattgaacctctcsgtcccccatctgtaaaatgggcgtgacgacagtaccaacttcacaaccttgtcctgagaatttagggagccgctgtgtggaaagtgctctgaagaacagtgtctggcacgtgagaagctcggtgggttgggttagctggcaccacaataatgccatcacaatgggagctgctctcaccgccgtcatggccaaccattgctgccataaccaacaccatccccctggcacgatcaaagccatcttgtctccatcatcactgatgcctcatctccatgaccgttgccatccgcatccccactc

SEQ ID NO: 136471 - DNA, 601 bp, Human
ggatgtggttattcaggaacttcaaatctgcaaagggaggttctcggtcaccatcgcgtcaccatccatgcccatcagggctgggccaacaccgtcaccagcatcaccaataccaccttccctatgaccatcaaagacatgggcattgctgccaccaaccatgcaacatggtctccccgttggcaccgtgtcgccatcaccattgctgtcaccctggttgacaaacaccaccatcgtcaccaatacccacatgcctgtgtttttcatgaacatggccaccgccaccatcaaccacccaacsacagtcacctgtcaccatcatcactgccatcatcatcaccacagtggtcacaatgaacaagaattatgaagcccatcaccagcctccctcggggaggatccctgggcagttattgaacctctcggtcccccatctgtaaaatgggcgtgacgacagtaccaacttcacaaccttgtcctgagaatttagggagccgctgtgtggaaagtgctctgaagaacagtgtctggcacgtgagaagctcggtgggttgggttagctggcaccacaataatgccatcacaatgggagctgctctca

SEQ ID NO: 136472 - DNA, 601 bp, Human
gttggccttctcctgagcgtctttcaccaggatgtggttattcaggaacttcaaatctgcaaagggaggttctcggtcaccatcgcgtcaccatccatgcccatcagggctgggccaacaccgtcaccagcatcaccaataccaccttccctatgaccatcaaagacatgggcattgctgccaccaaccatgcaacatggtctccccgttggcaccgtgtcgccatcaccattgctgtcaccctggttgacaaacaccaccatcgtcaccaatacccacatgcctgtgtttttcatgaacrtggccaccgccaccatcaaccacccaaccacagtcacctgtcaccatcatcactgccatcatcatcaccacagtggtcacaatgaacaagaattatgaagcccatcaccagcctccctcggggaggatccctgggcagttattgaacctctcggtcccccatctgtaaaatgggcgtgacgacagtaccaacttcacaaccttgtcctgagaatttagggagccgctgtgtggaaagtgctctgaagaacagtgtctggcacgtgagaagctcggtgggttgggttagctggcaccacaa

SEQ ID NO: 136473 - DNA, 601 bp, Human
caggtactccttggcctgcatgctcagggcccgcacctccaccaggcacagcagcagctgctggaatttgtccccgcagtgcgggtagtggcacagggtgtagtcaagcagggcggcgttggccttctcctgagcgtctttcaccaggatgtggttattcaggaacttcaaatctgcaaagggaggttctcggtcaccatcgcgtcaccatccatgcccatcagggctgggccaacaccgtcaccagcatcaccaataccaccttccctatgaccatcaaagacatgggcattgctgccaycaaccatgcaacatggtctccccgttggcaccgtgtcgccatcaccattgctgtcaccctggttgacaaacaccaccatcgtcaccaatacccacatgcctgtgtttttcatgaacatggccaccgccaccatcaaccacccaaccacagtcacctgtcaccatcatcactgccatcatcatcaccacagtggtcacaatgaacaagaattatgaagcccatcaccagcctccctcggggaggatccctgggcagttattgaacctctcggtcccccatctgtaaaatgggcgtgacgac

SEQ ID NO: 136474 - DNA, 601 bp, Human
gccaggcctggggggctgaccctagacttgcctgtgtatgtgggggcctctctgcctgccctgctaagtagacggatcttttgatttatttatacctctcctaggctccaagtgtgaatcccaggacagtaacaaattgatcacagcgggcttgggacaccagcttccgaggtctgtccttgcagttttgactgacaggcttttgtgtgtgtgcgtgctctctaactgttgaaaatctttgcagctgaaagtcttaattgctttaaggcaaactttagaaattccagagctccctagttgstctgacttttccaaattcagcttgccttttttgggggaaaatgtcgccttagtttggtgtacagtacgtgcaggcaggtcttggaggcacgtttaaaaaccctgtcgttaatggaagaagaatttcattgaaagggacgcagagccgtctggaagcgcctgccccggactcagcgagtttggactcagcgagtttgagcttaccgaatgaactttggacgtcttcttttagcaaacaaaacctggaaggaagcaaaaaagacccacattctttttcttttttctcctgaaaatgaaaaaa

SEQ ID NO: 136475 - DNA, 601 bp, Human
agccaccatgcccggccatgtccccatttactgaggatatactgtgtgctaggtctggtgctgtattttacccagtccactcaccaacactaagatggaagctgtcacgatgcccatttacagatgaggaaactggggcacagagagatgagagaatgcgccaaagaccatgtgctaatacgcagcagagctggatttgaacccaggcttgtctgagcagagcccatggtctccccactgtactaggaaggtagcaggcactgtgggctggatgcctggcctgtgctgaggttcagtgtcrttttcctgatcttacagagagggaggttaagtaacttgggcagggtcataaacccacaaatggcagagtcgggattcgaacccatgtctctgattccagagttcctcaccttaaaccacatctggctgcctttgtcgtgctttgctcctgttgcatgctgcaaagccaagtaggttaagacaggctaggttcctgcagggctgggttgcccgagacctgggagaggtcttccagaaggcactgctggccttcctcgcccagggccagagctactggagagaaagggctgctgttcacatt

SEQ ID NO: 136476 - DNA, 601 bp, Human
gcactgtgggctggatgcctggcctgtgctgaggttcagtgtcgttttcctgatcttacagagagggaggttaagtaacttgggcagggtcataaacccacaaatggcagagtcgggattcgaacccatgtctctgattccagagttcctcaccttaaaccacatctggctgcctttgtcgtgctttgctcctgttgcatgctgcaaagccaagtaggttaagacaggctaggttcctgcagggctgggttgcccgagacctgggagaggtcttccagaaggcactgctggccttcctcgyccagggccagagctactggagagaaagggctgctgttcacattttttcttttctttaagtgccccagatacttttcataagggaagtgtcaaaacaattgtcaaaaggagaagaatatttccttcctcttctcaggctagaccaagcaagggagttggagggtggagagtggagggacctggtgaatcatccaagattaaatacgggcaggcactgccaggcttgtgtggagatgaggctgggacactgttcgcaggaagagtccggtgttctggccccctgatgtcaccttcacgggcc

SEQ ID NO: 136477 - DNA, 601 bp, Human
aaacagacccccacatacatggctgcgccattgtctccaattctggatttttccacagatgacttctcgggtgatctggtggtaaaggcacaggtcttctagccaggccttcttggcctccagcaagggcaggatcacagcaccccaccagacctgactggccaccaccgctgtagctgtggctgggcgagtgggggggccatgggaattgaaagatggggtggccgagatctgaaatgcattcagttgcagtggcctggatctgcacggagccgttctttctttctcttagacatctgcrtggtggtgacctcatagaattctaagaaaaaaggggctttatgtaggaattccatagagtgtgaaggaatttggacaggggaagggggagggaagttgccattcagagcctgcagtgcctgcattttccccgaattgtttaaccctcatgcttcagaattaggctgaggcttgcggggtgggtcatgttgacctgggtgaacagagatccctttaagaagaacttctccatgttccagaggcgcgttcttactgcaggtgagtggcagtatgggaattagtccacaggccccttctcgaa

SEQ ID NO: 136478 - DNA, 601 bp, Human
aattgtttaaccctcatgcttcagaattaggctgaggcttgcggggtgggtcatgttgacctgggtgaacagagatccctttaagaagaacttctccatgttccagaggcgcgttcttactgcaggtgagtggcagtatgggaattagtccacaggccccttctcgaatgcctgccctctcttgttccttgtcctcaacgtctttgaaacttgggcttgttgggaagacacctgcaaaaggatggatgcacatgaccttcagctctaatgaatcaagctgctgatgaggaattcactgggytcccaatccagagagcttcgcacacacccactggggttgagacgagcactgggtttatttattgtggacttttggagtctgaaggactcttgccacccatctgtttcacggaacagaacctgaggctcagagggagcaaggcgctcccccacagccgcattgagagcctgagcctgggcacccgatggagtgaatgaggctggagtcccagacctgcctctcatgagcacgtcgcccactgagcctcagcgtcatcatctggaaaacagggataatattatgacctcagaagcttcgggg

SEQ ID NO: 136479 - DNA, 601 bp, Human
gggacccctctggattccaccagagcaccttcctaggatcatggctcccaaaacggaagggaaggagacagcgcagtttgcaaagaggcaggatttaagcaccagggtggccctgtggcgcctcaggaaaatgtttgcctgtcagtatctgctctcgttcccacctgtccccacaaagcgaggccataagtcctcggcgtggcattggagggtctctgaaggccctgagagctgtgtcagccacggtgtgttatgaagcaaggcagatgttttgttaattatttacacagcgtcggcccckcagaggactgcgctgacaggagcggctgtcacaggcctggccgtggggcagaagtgagcagccgtcttcccctggcagtcctcctgaaaaggtctgcatggcaaggcctgagggagtcctgcacattttatgcccccgccccccaaagccatttgggtttcccttaaactggcttgttttcctgagccggtggagagatccttgtcctccggaagtggctatcgctctggggcggcttctctgccagctcgtcacaccctagacccagctgtagtctgtgtggtgggagagggtgtcacc

SEQ ID NO: 136480 - DNA, 601 bp, Human
aaaaaaagagttctgcaaagaatggcacctggcatcagagctttccctgaaaggccactaaggatgaggaacgtgagctccggggaggcgaagggggcaaagccacctgcctgttgcctgttttacataaggaggttttgcataggagtcattttaagatacatgaagtagccagaatagataaatccacatagacctaaagcagattggtggtttccagggcctttggggaggggagactggggagcgactgattaagggacatgggtttttattggggtgacgcagacgttttggaacyggatgaaggtggtggttgcacaacattgtgattgtaatacatcccatccagcggtttgctttaaagtggttaaatatatctgagaaaaatgttaaacataaaagttttggccaggcacggtggctcacgcctgtaatcccagcactttgggaggccgaggcaggcggatcacgagctcaggagtttgagaccagcctgaccaatatggtgaaaccccatctctactaaaaatacaaaaattagctgggcgtggtggcgtgtgcctgtaatcccagctactcaggaggctgaggcaggaga

SEQ ID NO: 136481 - DNA, 601 bp, Human
tacatcccatccagcggtttgctttaaagtggttaaatatatctgagaaaaatgttaaacataaaagttttggccaggcacggtggctcacgcctgtaatcccagcactttgggaggccgaggcaggcggatcacgagctcaggagtttgagaccagcctgaccaatatggtgaaaccccatctctactaaaaatacaaaaattagctgggcgtggtggcgtgtgcctgtaatcccagctactcaggaggctgaggcaggagaatcacttgaacccaggaggcggaggttgcagtgagccragatggcgccactgcactccagcttgggcaatagagtgagactccgtctcaaaaaaaaaaagacaagtttgtcttgctttaaaaaaaaaaatacctctccttttacagatggcgacactgaggcccagagagacatcatgaccagcctcaggtcccacatgcagcctgctgctctgtagcctaaatcagatcactgtcccagctttcaggtcaaggctctggttgtgacacctgggcctggactgcgggtgaaaagttttgatgcaaaaacacagaccgtccattgtcctatgggctaag

SEQ ID NO: 136482 - DNA, 601 bp, Human
ataaaagttttggccaggcacggtggctcacgcctgtaatcccagcactttgggaggccgaggcaggcggatcacgagctcaggagtttgagaccagcctgaccaatatggtgaaaccccatctctactaaaaatacaaaaattagctgggcgtggtggcgtgtgcctgtaatcccagctactcaggaggctgaggcaggagaatcacttgaacccaggaggcggaggttgcagtgagccgagatggcgccactgcactccagcttgggcaatagagtgagactccgtctcaaaaaaaaaragacaagtttgtcttgctttaaaaaaaaaaatacctctccttttacagatggcgacactgaggcccagagagacatcatgaccagcctcaggtcccacatgcagcctgctgctctgtagcctaaatcagatcactgtcccagctttcaggtcaaggctctggttgtgacacctgggcctggactgcgggtgaaaagttttgatgcaaaaacacagaccgtccattgtcctatgggctaagtggactcccttctgctaaccagagatgcttgtgctggctggtgtgtggcacgttatctca

SEQ ID NO: 136483 - DNA, 601 bp, Human
gccacctggaatgtgccagctgcagtagccgttccttccacgccccccccccatgctgtctgtggggcttgccactgagtgctccatctccccatgtgctccatcccccggcatctgctgccattggtcctgcctgttgcgttacttctctgtgccctggagcccctcaagcacagaggcctcgaaaggttgatcagacatcctcagcacctggagcggggcctggcacacaagacggcaatgaacggccaaccctagaagttcaccccacaagacctgcagggcgggggctgagtgtccragaagcctcttgggaagggatggtcttagacctagtggtgtcttcccattctgcagaggcctagggatgtccccaggtccccagagtgggaggggaagggtcagaagtccatggaaataaaacacagggccagctacaaaatttgtggggcccagtgcaaaatgaagatgcaagttcccttgttcaaaaagcagtaaaaaaaaaacacaaaagttttttcctttcctttgcaatctctttccatctgtcatgatgttttttgtttgctatttaatgtctcactccctggacacaagatac

SEQ ID NO: 136484 - DNA, 601 bp, Human
tgctgcctgtccactcctgcccctgagcagtccatccttgttcttggcagggagcagatctcagggccacagctccagcttttctcctgcaaggcctggccagctctgtggctgtacttgtgcccagagagacaggtggcagcggcagagttaggcacacctggccgtgagccacacccaccttgtgctccccgtgtctcctgggcttgttaccgcccactcaggcctctgttttcccatttgtggagcaaggggtaatagcagatcctgtctctggggcagttttcccaatctattgtgstaagggtgtatagtcctcagttccacgccaggcccagaagaggcctttgatactctgtgttgatggtaaacgacatggtatggggtgagctcggagcttggtggcccctgtgacgctctggggagcgcttccccaggccacagggcaggctctcagtccagagctgccctccctaaggaattcatcccttccttgttttctttgttcattcatttcatcccacagatccaggcgctctgctgagatacagtaatgagccccaggcatgaagtccctgcctgcacagggctggtgctgtgg

SEQ ID NO: 136485 - DNA, 601 bp, Human
cagactgttggtgctaaaattggcctgaaaaatgaccatttccgcgtgagccaggattgcgttgactccttgctccaaggctgtgaggtgtgtggggttaggttcatgtgacagatgaggaagtggaggctcagagaggctgtgtggcttgccaaggtcacacagccccgggcggccttattccacatccacctgctctgtctgccatcatccatggtggtctccggactagctttggcctccccaacatcctgcatttggataaactgaggcctaaagaacaattcagggcttgatcccraatgggggaggggacggaaccctttgcatgcttgtggaaatggacactcattccacagcgaaactgccttcaaaatgccactgattctcagggcaggagaagacttaagaaatgacagcgggcagtcagggcacgtgtgtctgtgacagcagaggggcccgtatccacccttcctgggaccgacagccagggtgatggggttttatagcatctggaacaggcaagccttttataagaaaatgtttccaaagttgtcccgtcccaccgttggcaagcagtccttaaacggcaaagaaacag

SEQ ID NO: 136486 - DNA, 601 bp, Human
tcagagaggctgtgtggcttgccaaggtcacacagccccgggcggccttattccacatccacctgctctgtctgccatcatccatggtggtctccggactagctttggcctccccaacatcctgcatttggataaactgaggcctaaagaacaattcagggcttgatcccgaatgggggaggggacggaaccctttgcatgcttgtggaaatggacactcattccacagcgaaactgccttcaaaatgccactgattctcagggcaggagaagacttaagaaatgacagcgggcagtcagkgcacgtgtgtctgtgacagcagaggggcccgtatccacccttcctgggaccgacagccagggtgatggggttttatagcatctggaacaggcaagccttttataagaaaatgtttccaaagttgtcccgtcccaccgttggcaagcagtccttaaacggcaaagaaacagccgtgctctgcattcacgaaatggtgagctggcatttaggccatttatttaaagcgggagttgaggaggctaaagacttcagttctgagtggcggctcgcagcctcactgcagcaggggagcgtaatctt

SEQ ID NO: 136487 - DNA, 601 bp, Human
cgccaggcagttttgcttagaggggaagggaaagaaagagagggagagaaaactcttacaaatggatgcttccttgggtggtaaagatccttggccatggaggacagaggccgcagggcccatccaatctgcttcctgcgcatgtcccgtgtgagcctcgctgtggcagggcatgtgatggccccagtggcagatgtgaacggggcttgacacctgtgtaccacagccccttgacttcagaagaagggaaggagggacccagcatttatgggctgctgacagatgcctggcactgtgctgrccaaaatttgggaagtggtatctctgtcctcatttttagatgaaacagcagagtcccagagagtgtagacacttgctttgagtcacacagctcatgagcagtagcactgaagtttgaacctcagtctgtccattttcgtggaggaccagcagtgcccctccttgaggctccagaagcagcagagtgtggactcacagtccgggtacctgtcagcagcctgtcccagcatcacctcccaattccccaagaaagtgagcagacatctggagggtttttgctttcatgtaagaatgctgatcg

SEQ ID NO: 136488 - DNA, 601 bp, Human
aaaacgtaattttaaacttctagggatgagatgtaggtgcccacttatttaaaccagggccatttcatccacgtcactaacttgccggatgtctttgagtcatggtttcacctgcctgagcctcggtttcctcatcttcactcccagcactgtggaggggtgacctggttgatgacggtcatggagcccagaacccatgggtaacggggtcagcattcagaagtgtcagctccagctgcctgcccccgcctgccgggccctgtcctctgccaggcggagctcctggttctctgggtctgtratgctttccttctcacttctcagacatcactgcttctggggagtctcctctgacctcagcacactgcttagaaacccctgcttggtgcctccatagccccttctgcatcttccccaacatggccccccaccctgtgaggcccactaatggccagtcccctgccccaggatcccctccagggctaggactgagccactttcctctgtggtcccagtgctcagcccagggcctggcctggcaaaggcctcggtgacggtaatgaggggagggagcaatgcacccttcgtttgttcctcaggc

SEQ ID NO: 136489 - DNA, 601 bp, Human
ccacagaagccatagggtcagcctaagagcaagagtggaaaaagaaaaatcatgaagcaataatgagcccgtggtacatcgaaggggccattgaatccccgtggactcaggacgacagtggctggaacagtggttgtctatgtgtggctggagtgtgtgcagaggggccagtgcttgagcctgaatcttcacagcccctcctccatacatgcaaatcctaacagtatgttattattgatatgtaaatattagctattagctttttaaacaataattcctcctcctattgctattgtggctygttcatcagagcacccttcagatcagtaggggttggccaggtggcgaaggcctgcagttagagcatggggagactgcgtgagcaggtgcagaggtgggaaacagcagttgcaggaaccataagtggctccgtggagctgacgtggtggaggacagacatcacctgggcttgggcttgatgggtcaaggggtcttaggtgctaagctcaggagggatggcaacccagaaaccttgaaggtggataaggaaggggagatggggtcttaggaatatgtgtctggtggcgcgtgtggaaaatga

SEQ ID NO: 136490 - DNA, 601 bp, Human
aggtgctgatgccactgtggacattcctgagcctctcagctacctgaggccgcacttccacccaaaaagagtccttggctgggccgggtgtggtggctcacacctgtaattccagcactttgggaggccaaggcaggtggattgcttgaggccaggagctcgaaaccagcctggccaacatggtgaaatcccacctctactaaaaataacaaaaattaaccaggcatggtggcacacgcctgtaatcccagctacttgggaggctgaggcaggagaatctcttgaacatgggaggcggagrttgcagtgagccgagcttgtgccattgcactccaacctgggcaagagagtgaggctccatctcaaaaacaaaacaaagaatcctcagctctttctcccatcccaccaccttctcctaccctttcctgctgggtgttggggcagcggagggctctccccttggcaccctcagcctctctcggctttcctgtgaaaaaccaggccgatgcctgccgacttgtgagaataaatgataaaatctgtgacgctcccagcactgcctggggagaggaaggaaagtgttgtcttccctaaattccta

SEQ ID NO: 136491 - DNA, 601 bp, Human
cagtagtgtcccaggcattgaggagggctgtttccaggtctgtccgggtgtcgttttccgtggaggagaagttgctcaagaagatgagcccaggctagcccacaagccctcaccccctcgcagacccaggtggctgcaggaggattctagaggagactgggttctgcccgccaacagggggctcagccacacccccccacccctggcccaccataggacttagtgcccacttgggatgcggtcagaatatttttaggttgaatgggcgcatgagggtggggagacgcatgcgtcagatacyggctggatgacttcatgtatgttggttgacacattatacagctggggagactgagactcagagaggctgagggtcttggctaagatgcccagcaaagaagtcttcataccacatctgactccccgctcccttgagaattcccgtcacctagagcacccgtcccagcccctgccgcagtgctggggaggatcagtggagaccagggtggggggaccaagcacgatctcagacctcctgtgtaccggggcactttgcctacacagtctcatcttcagtagatctctttcctggttttctgat

SEQ ID NO: 136492 - DNA, 601 bp, Human
tcccatatttcaattctggcctggcctggagaggatggggggcttcaacctgtcttggtgggatagcctgggctgtgataccggaggcatcactttcccaccaagaaagagcaggagggtctttatgggggcaaacagggcagggagctccccctcggacccctgggaaacatggggctagattgggcccgacaccagcccagtccctttgcagcctactccagcctttctcttccctttttttttttttttttttgagacggagtctcactctgtcacccaggctggagtgcagtggcaygatctcggctcactgcaacctctgctccccgggttcaagcgattctcctgcctcagccacccgagtagctgggactgcaggcacacaccacaacgcctggctaatttttgtatttttagtagaggcaggggtttcaccatgttggccaggctggtctcgaactcctgacctcaagtgatttgcctgcctcggcctcccaaagtgctgggattacatgcgtgagccacgcgcctggcccagcctttctctttctgacttcacttgccccacctgtgcagtgggaggacaggagaacccctt

SEQ ID NO: 136493 - DNA, 601 bp, Human
cgcgcctggcccagcctttctctttctgacttcacttgccccacctgtgcagtgggaggacaggagaacccctttgtctgttgagtgctgattatgtgccaaggaatttgctgcatgatctgatctgatggccccagtgactctttgaaacccggccccttattggcaccacccagtcactccctggctgcgtttccctcaaggcacgtatcgctgtctgaaatgaccatgtctgttcactctcatgtctgtgtctacctcccaaccacgcaaaacctgtgggaggggaaggccttctctstcttgtccactcctgtgtccccaacccctcggacagcacatggcttcacaagcttctcaagaaatgcttggcaaatgatggcagagtgggttaaccctggtgttctcaaaaagggaatggaggcccacagagggcaggcccatccctgggtcacactgccagggcaggattggagcccctgcctgtccagggtcagctggggcctctctcactgaccagctttgagcctggaattccaggtgtgcctggctgtgtccttgcaggttcacaccgcccaaagaaacttccagtccacacttg

SEQ ID NO: 136494 - DNA, 601 bp, Human
agtactccgagagtgttcactagaattaccctcatgttcactggaatatactggtcagatttctgagagggagaccccctttttgtactcataggagaatggaggaggccggccatgcttctcctcagccacgattgaaaaagtcacctagcacagtggcctgagtccactggttcccaaatcccagacccaggccaggcctagggccgtgtgaagtcttccgcggacccacggtgaaataagaaaaggaaggcctggcttggcatagctactttccatgtcagctgttttttcttttttytttttttttttttttttttttttggaggcagaatctcactctgtcgcccagactggagtgcagtggtgcgatcccagctcactgcaagctccacctccagggttgaagtgattctcctgcttcagcctcctgagtagctgggattacaggtgcctgccaccacacccagctaattttgtattttagtagagacagggttttaccatgctagccaggctgatctcgaactcccgacctcaggtgatctgcctacctcggcctcccaaagtgctgggattacaggcgtaagccaccacaccc

SEQ ID NO: 136495 - DNA, 601 bp, Human
tgcatctcaggcattgattggcattgaggaaaacccacctagacttggtatcgcgggagggagggtcatgtgcagggagccctggaagggagcctggagagctgggtgccagccctggctctgcaccccttaccagccatgtgcaggtcatggcagtgccctgtggatcctacttcctgagcctcccctctgcaggcttgatgccactgctgtcatttcggcctctatcccacaactcgcacagggcttgcctcacctttaggcctttgcacgtgccatgccctctgcctggagtgccctkcccctattcctccactcagagctgcttcccgttccgaggaaaaatcccatgccccaggtagactgcacgcacattttcttgtgtttccacaccctgctttgcagagcagcgggcaccctggttgtagtttaagggacgcctgagagccccattgaggatggagattggtcccccttgcctggcacacgcttggtgcccagcacttgtgtgtccattgagtgagcaaataatggaatgtctggaggcatgtgacgcctctgctgtgtggcttggtttccccatctttaaaataccagatgt

SEQ ID NO: 136496 - DNA, 601 bp, Human
ctgctgtctcccaggtcttcaaatttacaccactctgactctcagtttccctatctgcaaaatgaaggcaggaatgcccacctcatggggtgagccagtggacccaaatacgtggtgcagtaggtgccacggagtagtggcacgtgattttgtggctgttagtgtgagtattccttactttagagagcagaggaaaacacatcagcagattgtttaagccaaaaaatgtctgttgtttgaagaatttcgttttggaaggcaagcccaggttttgggtcagaaccgtattccctcaggcacrgcacggttgaacgtcgaggcatattttacaggcttggtgaccgctcaagcctttgagccctccatgcgggtgctctgaggtcagacttttcgggaagccctcacacagctggtctgcttgtcgcgttggtagcaccgtttccacagagcaggctctgtttggctatgaatagatgtttttctcactcttttcttggatgcctgaatggcaggctcccctcctgcagtctcagaggccgacctgcatgtaaaactccaagcggacatcagagtgggttcgtctgttcctgcttggacttga

SEQ ID NO: 136497 - DNA, 601 bp, Human
aaatgggtgcatgagccctgcctggcagggtgagatgaggtacacaagccctatcctacttcactcccctcttccttcctgcccgaaaggccctggctcacctgggatccagctggggcacagcaggtgttgatatgtccacctgctgccccccggctgtgatatgcccccctggctgcgggggacagagggacagctggccacaccgggaagcctggggacagaccctgggacatcagggtcaggagcgtacagggtgcagccctcttggcctagtgatggggatccctaggggaaagacctaggggccaggaggtcatggagacaagactcgaacccaggattggggcccccaggtcctcctgtcctttgtgtaggctcactttcaggttaccctggcaccagcaggggccagcctggttgggcctgggaattcagagatgggtgccaaggtgggcctggagcacgacgtaggcagacacggggccgagccccaccttgctacccgctggtaaggggccttgggcaagtcgtggccactcctgagcccccatctcctcatctcaaaaatgaacatcattcccactcttcccacctttca

SEQ ID NO: 136498 - DNA, 601 bp, Human
gcactccagcctaggtgacagagtgacactgtctcaaaaaagaaaaaaaaaccgcccagaagaaatgtgtcatttcaccctctggaaccatgagccctgtgatcatgaggcacaatcgtcatgtaaatatatagggtctctcaccagccacgggccaagatttattttatggagacagtgggggagggggccagctcagtttcattgtcctggtaactttgtaaaatgctttgccatcacttcccagctcctgggaggatgcagcaggagctgtgcagcctctctcgccctcccaaaaggsggatccccagaggccctggacacctccttccaggtccacaggcccaaaggcctggtgtccataaggctggggttccctggaaagtgggtttctggaaatacttgttgcagggatatcgctgttgcgtgagggctggttgtttatgataacaggaatcataacagtggcagtacccacattgattgattgattgattgagacagagtctcactccatcacccaggctggagtgcagtggcgcgacctcaattcactgcaacctctgcctcctgggttcaagtgattctcctgaatcaagtg

SEQ ID NO: 136499 - DNA, 601 bp, Human
ctgcagcccccttcattgccccacgttgaaattaacggccccttctgtgattcagcaacgcagttaagtacattggggttttttggttggtgtttcgttttttgtttttttagaaagagggtcttgctctttcacccaggtggaatgcagtggcacaatactagctctccacagccttgaactcctgggcttaagtgatccttccatctcagccttccaaagtgctaggattacaggtgtgagccaccacgcctgacctagttaagactttgattggacaccccccccgccccccccgccrcacacacacacacacacacacacacacacacacacacactccatctgctccttcgctgaggggagggtgctctggacacactgctgaggatgtccaggtcaggactcaggcctgcattcccatccaagctctgcctctgcagctaggactccctgagtctcagtttcctcatctgtcaaatggatacactgtctgccttccagggttgttttgtgagcacacaggctggcactatccctgaaggatctggcccagcacccgacactgatggggtgccctggatgcatgcctccatataca

SEQ ID NO: 136500 - DNA, 601 bp, Human
gcagcccccttcattgccccacgttgaaattaacggccccttctgtgattcagcaacgcagttaagtacattggggttttttggttggtgtttcgttttttgtttttttagaaagagggtcttgctctttcacccaggtggaatgcagtggcacaatactagctctccacagccttgaactcctgggcttaagtgatccttccatctcagccttccaaagtgctaggattacaggtgtgagccaccacgcctgacctagttaagactttgattggacaccccccccgccccccccgccacacacacacacacacacacacacacacacacacacacactccatctgctccttcgctgaggggagggtgctctggacacactgctgaggatgtccaggtcaggactcaggcctgcattcccatccaagctctgcctctgcagctaggactccctgagtctcagtttcctcatctgtcaaatggatacactgtctgccttccagggttgttttgtgagcacacaggctggcactatccctgaaggatctggcccagcacccgacactgatggggtgccctggatgcatgcctccatatacaca

SEQ ID NO: 136501 - DNA, 601 bp, Human
gtgattaaatacaggatccccagtttaattccagagcaacccagtgaatcacagatcctttgtcagccgtataagaagcatctgcacaagaagggcgcttctagactgtggagtccaacccactcatgttgcaggtggggaaactgaggcccaaagatagcctgtgactttcccaagaccatgcagccctatgggagtctggcctgtatgagtcctgggccaccagaccacacacagcacagctcagagcacaagccactcctgcggagctaaaaatggccacatacttcctaagcccaaytccagggttcagtgaggatcctggtaaggagagcgacacaggaaggtgcaggggttgccatggtgtggccccagatgctgtgattacgcgccagccccgtcacaccgtacgggtggtaggactgggcaaagaagacgccgccacctggatgcactgaggtgtgcacagccacgtggagatgatgctgggggctcacggtgactctcaggaggccctggcctggcctatctggagccttctctgtgaaatgaggctggtaacgcccactagcagggttgtaggggacatggatctgtggcc

SEQ ID NO: 136502 - DNA, 601 bp, Human
agtctggcctgtatgagtcctgggccaccagaccacacacagcacagctcagagcacaagccactcctgcggagctaaaaatggccacatacttcctaagcccaactccagggttcagtgaggatcctggtaaggagagcgacacaggaaggtgcaggggttgccatggtgtggccccagatgctgtgattacgcgccagccccgtcacaccgtacgggtggtaggactgggcaaagaagacgccgccacctggatgcactgaggtgtgcacagccacgtggagatgatgctgggggctcrcggtgactctcaggaggccctggcctggcctatctggagccttctctgtgaaatgaggctggtaacgcccactagcagggttgtaggggacatggatctgtggccacctcctcaaggggtgccacacgcaccaggtcctgactgggagtccggcccccagggcctgtggatggctggcctgggcccagcctccgcccccaagggtgctggcacctggcatgtgcccgacagttggggccggctggtgggaaggtgtgtgtcaggtggcggagcctcggtgccaggatctcactcacgcgt

SEQ ID NO: 136503 - DNA, 601 bp, Human
cccgtctctactaaaactacaaaaattagctgggcgtgatggtgtgtgcttataatctcagctactcgggagcctgagtagtgtgtcagttcctccctgccagccagtctgcctgggcgtggtagtccttccagcccctgggcttgtgctaagtttctttctgtaattgctccatctggctggtctgagaagcaggttcaaatggcaggagaatcacttgaacccaggaggcggaggttgcagtcagcagagatcgcgccattgcactcaagcctgggcgacaaagcaagactccatctcaaaaaaaaaaaaaaagtgccgagatgaaggagggtcgagagatctggtcctggcagacaagtgggactttgcccattgagaggcaccgatgggtctttagtccaaggctggtgcatggaatgacatggaaggaccagggtgctgtgttgctggggagggggaccgctcatttaatatggctgcacgcaaggcctgggggatgttgggggcaaatgcatgagggcaggctcgtgtcaggtggtcagggaatggcttgctccggtgtgcggaccttttgctgtggagtttcaggagagattgg

SEQ ID NO: 136504 - DNA, 601 bp, Human
acatggaaggaccagggtgctgtgttgctggggagggggaccgctcatttaatatggctgcacgcaaggcctgggggatgttgggggcaaatgcatgagggcaggctcgtgtcaggtggtcagggaatggcttgctccggtgtgcggaccttttgctgtggagtttcaggagagattggcaggttcaggcttgtgtgttaggaaaacctttccatggtgggctggaggctgggctgcaggggagtgtggaggctgaaggtaactgtagggacccaatgagaagggacaaggccagcacagrgtggaggccctggggtgagtgaagacatttggaggaagaatggttgggactggatgaagaccaggtgtgggtcctgggggagggcgaggcatccggaggctacagcagccctgtttctgggtgggcaccgtgtggcccccaatcagctggcctcctgatgctgcaggcccaccctgggggaggccccaccaccctgaggaagggggcagcggggaacctgtctgcatggccaccttccaggagtggctcatggtcctgcatccctgcaccttagagcagccaggcttccgctgtcatgga

SEQ ID NO: 136505 - DNA, 601 bp, Human
gctgggctgcaggggagtgtggaggctgaaggtaactgtagggacccaatgagaagggacaaggccagcacagagtggaggccctggggtgagtgaagacatttggaggaagaatggttgggactggatgaagaccaggtgtgggtcctgggggagggcgaggcatccggaggctacagcagccctgtttctgggtgggcaccgtgtggcccccaatcagctggcctcctgatgctgcaggcccaccctgggggaggccccaccaccctgaggaagggggcagcggggaacctgtctgcayggccaccttccaggagtggctcatggtcctgcatccctgcaccttagagcagccaggcttccgctgtcatggagctgcagaatccgggcaggatgcttggctttgcaggtggagagctggggcgagcgtgagggaacacaggacccggccggaaaccagactccatctgtggcttgtcccctccagcttgacaggcccccatgactctggcctgagatcgggctgcttcctgtcaagtgatgaatgggcaacgtctgcttatcctgagaccagacaagaagcggggctggggctggggaa

SEQ ID NO: 136506 - DNA, 601 bp, Human
tgggcttgcgctgagtttctttctgtaattgctcagtctggctggtctgagaagcaggttcaaatggcagctctctccactgtgtggactcaactttggcaagccatgtttctccatggagccttagtttcctcatcaacaaaacaagggtgatggtactttgcaggtgtcttgggagatgccgtttcacccgtggatgttggctgatgttgaagttggtccggccttgacccagccagtggccagtgcagtgagctgtccttgccgggcctccgatcttcagctccctggggcatgtgtygggcagtggagcctctgcaggctggctgaaggccccaggcagtgggcatccatcctcggcttctgccaccaggagccagctggaccaacagacatcacccctggtgctggcactggtgctgccagtaccattcgctcggggcggagagaaagctgtgtgtgcctgagtgtgaagccacagggacggcttcctgctttagggaaaacaacctgtgaagctgtgccctcggctggaggcacagaggaggggccttgctcagggaaactggagaggggagtacagtgtctggccaaggctgac

SEQ ID NO: 136507 - DNA, 601 bp, Human
agccaggaacctgagctgggaagcctcactgtgcagctatccacagtgttttgcaaatgtagggcccttgcttgaggcagaagaaaagccctctttgaggtggtgttcagtgtggcctgcagctctgggtcttgcattccatggatttttggcccctgacttgggcttggcagctactacctcattgttctgcaacttggcaggagccgcgggatcccggggacgggcagtcctcagtgttaccccgaggtgcctgcacgcatgtgctaagggtcttttccctgctccgtgtggctcgtcyttccacgtcccctttgccttggcctttctgcatctgaaccccctaagaagcagtttctgacaggaatttccagagcacagggcttgggtttctgttggggtgtggaccaatagaacaaaatgccctaaaatccaatacccatggagagccccaagaggcagtagattccttggaacaaagagggagtttagagtcactgagatctggatttgaatcctttctctgcagcttatcagcctaatggcatcgagcctcttcctctgagcctcggtttccccatctataaaatgggtctaccaa

SEQ ID NO: 136508 - DNA, 601 bp, Human
gtcccctttgccttggcctttctgcatctgaaccccctaagaagcagtttctgacaggaatttccagagcacagggcttgggtttctgttggggtgtggaccaatagaacaaaatgccctaaaatccaatacccatggagagccccaagaggcagtagattccttggaacaaagagggagtttagagtcactgagatctggatttgaatcctttctctgcagcttatcagcctaatggcatcgagcctcttcctctgagcctcggtttccccatctataaaatgggtctaccaatagcccygagggtgaatgggaaagacctggcccacaggaaccctcatcccttcctttctcccttcctccttccccctcgcgcctccccacctccttcccctcagcagggaccctctctggctctcggtgggtaggggcttgcagagtcctccgtggctgctgctttcctagaacagggaacatcaacacctgccggctcctccctggaggctaacggtgccgcaggttccattaggttctgaacagagcagctcgtaatgactggggtttggcagcaaaggcaccactggggtagacagtggtgctg

SEQ ID NO: 136509 - DNA, 601 bp, Human
ggcccccctgaccctgagttgggcgtgttctgcagtccataccatccacttccctgcagtctcacatcctgtcatctattttgagagagcaggtttaccccagaacagtctgtggaaggtgtggggcagggaggagagctgggccgccctgaggacacagagggagaagggtgctgggagccagcctgcaagttctggggagcctcagggtgcctttgagggcacaacttgggaggccaagctcagcgggtgagttagggtttggtggacatcctttgacatgtcaaagggtgtcacagayatccctggagcctgagaggtctggtcggcccaccactgtggctggaaacagactacagtggggaggaaggaagagtgacttgcaccctgagacacagtggccggacctctaggagctggctgtgacagcccggagggtgttgatgcctttcccacctcctggaacacccccgtgttaatgggggcgtgggtctacctgggagggagtggcagggctgctggcccagcagaccgggggaagactcttggtttggaatttgactggggcataggtgaccaggtgagacagcaggaggcgggg

SEQ ID NO: 136510 - DNA, 601 bp, Human
gcagtccataccatccacttccctgcagtctcacatcctgtcatctattttgagagagcaggtttaccccagaacagtctgtggaaggtgtggggcagggaggagagctgggccgccctgaggacacagagggagaagggtgctgggagccagcctgcaagttctggggagcctcagggtgcctttgagggcacaacttgggaggccaagctcagcgggtgagttagggtttggtggacatcctttgacatgtcaaagggtgtcacagatatccctggagcctgagaggtctggtcggccmaccactgtggctggaaacagactacagtggggaggaaggaagagtgacttgcaccctgagacacagtggccggacctctaggagctggctgtgacagcccggagggtgttgatgcctttcccacctcctggaacacccccgtgttaatgggggcgtgggtctacctgggagggagtggcagggctgctggcccagcagaccgggggaagactcttggtttggaatttgactggggcataggtgaccaggtgagacagcaggaggcggggtctgtctggagagagatgacgtctttggctg

SEQ ID NO: 136511 - DNA, 601 bp, Human
gccccctcagctgttgaataagggccaccgcaggggagggggctccattcctcaggacttctggctctccaggggtacagctgagctgctccaggagcctaggccaggcctcaaggggttctgcctaggatgtggtcacatgagaggtgcccctcgggacatccagggcttgtctgggagaaggagcagcagccagaaacaggggccccatcacatgtgtgatctagtcccttccatgcacaccatgtgggagccctggcacacaggaggtgctgcagaaatgcttgtggggtgagcgcargtctctccttctggggaggaggagggcttttcccctggcatcaggaagcatcccggtggctgggtcacacaggttctatgcacataacctcagaccctgccccagaagcacttgtttgatgggggaggccagaggctaaaatattgggggagatgcccagatggccttgagctcaggactgggcacacagtgggtgcttaaccagggacctgtggctgctgtgactacctatgaccagcatctctgactctcccagggcagcccaagccctggaggctgaggggggctgttcctttgcac

SEQ ID NO: 136512 - DNA, 601 bp, Human
catcacatgtgtgatctagtcccttccatgcacaccatgtgggagccctggcacacaggaggtgctgcagaaatgcttgtggggtgagcgcaggtctctccttctggggaggaggagggcttttcccctggcatcaggaagcatcccggtggctgggtcacacaggttctatgcacataacctcagaccctgccccagaagcacttgtttgatgggggaggccagaggctaaaatattgggggagatgcccagatggccttgagctcaggactgggcacacagtgggtgcttaaccagggrcctgtggctgctgtgactacctatgaccagcatctctgactctcccagggcagcccaagccctggaggctgaggggggctgttcctttgcacagaggtctaagtaggacggcaaacaggacctcttggccctggccttccctgtgtcacacgtgtggtgcgccagggcccagccaggacaaggacgtaggttccttcccacagcagctgtctgcagcctgacccaggcctttctcttctgagcacccaggctgccagcatgggtataggtgggggtgacaatgggggataggggtacaga

SEQ ID NO: 136513 - DNA, 601 bp, Human
acagcacctcacatcgtgggtactgaggaaatggtatgtcatggatcttatattttaaaaaccatttctgttttcatagctaaaggcctccgagctggataatacccccagtgtagaaagaaagaaactacaaccacctgaactgtggtttttgttaacctgctatgcccaaggctagtggcttgttcatttcaggaagctttctagccttgagagccagcagcacatgaaaaaatatttgctgaaaccggcagaaccatatatgaaattcatatatacttaggaaagctgaacatacttrcttttatagaggtttctaatgaatgaatgaatggaattgaggaaagaagcttaaaatgcctcatgctttttaaattttaccaatgtgctgcagagagctttcattgggaatgaagtgtaagcctcacctgacacactaagaaccacgtgaatttccaagaaggggaaaggtattcttgcctgagaaagccccggctaatgtgtcttccatctggaaagtctttgcaaagccagttgggatgtgccaagttcagttatatttgggtgctcttccgagagaacttcgcaggggattgggtca

SEQ ID NO: 136514 - DNA, 601 bp, Human
aaatatttgctgaaaccggcagaaccatatatgaaattcatatatacttaggaaagctgaacatacttgcttttatagaggtttctaatgaatgaatgaatggaattgaggaaagaagcttaaaatgcctcatgctttttaaattttaccaatgtgctgcagagagctttcattgggaatgaagtgtaagcctcacctgacacactaagaaccacgtgaatttccaagaaggggaaaggtattcttgcctgagaaagccccggctaatgtgtcttccatctggaaagtctttgcaaagccrgttgggatgtgccaagttcagttatatttgggtgctcttccgagagaacttcgcaggggattgggtcagctctttctaggtgtgcattgcacaggccaaaatctttatcagaatcttcccaaagcagtgatgctagttggttaaggtttaatgaccaaatatcaatggctattaaaattcagttagtgggccgggcacggtggctcacacctgtaatcccagcacttcgggaggccaaggtggatggatcacctgagtctggagttcaagaccaacctgggcaacatggtgaaaccctgt

SEQ ID NO: 136515 - DNA, 601 bp, Human
tttatcagaatcttcccaaagcagtgatgctagttggttaaggtttaatgaccaaatatcaatggctattaaaattcagttagtgggccgggcacggtggctcacacctgtaatcccagcacttcgggaggccaaggtggatggatcacctgagtctggagttcaagaccaacctgggcaacatggtgaaaccctgtctctactaaaaatataaaaattagctgggcgtggtggtgttcacctgtaatctcagctacttgggaggccaaggcatgagaatcgcttcaacctgggaggcagmggttgcagtgagccgagattgcaccattgcactccagcctgggcaacagagtgagaccccatctcaaaaaaaaaaaaaaaagaaaaagaaaagaaattcagtgtctgctaactgctgtcaattcagcaactgtttttttggggtttttttcctgccatgggaagtgcccagtgcctgcctttgggggctcccagtctgctgagaagctctgcatgttgcagagaggtggaagctccccgggagggatggacagatgctgggagagcccagagaatggggaggccagttctgctagataga

SEQ ID NO: 136516 - DNA, 601 bp, Human
tattaaaattcagttagtgggccgggcacggtggctcacacctgtaatcccagcacttcgggaggccaaggtggatggatcacctgagtctggagttcaagaccaacctgggcaacatggtgaaaccctgtctctactaaaaatataaaaattagctgggcgtggtggtgttcacctgtaatctcagctacttgggaggccaaggcatgagaatcgcttcaacctgggaggcagcggttgcagtgagccgagattgcaccattgcactccagcctgggcaacagagtgagaccccatctcaaaaaaaaaaaaaaaagaaaaagaaaagaaattcagtgtctgctaactgctgtcaattcagcaactgtttttttggggtttttttcctgccatgggaagtgcccagtgcctgcctttgggggctcccagtctgctgagaagctctgcatgttgcagagaggtggaagctccccgggagggatggacagatgctgggagagcccagagaatggggaggccagttctgctagatagatgatcaggaatttggggtgggacagggagaggccccagacctgaaggtgcatggccaatcaggtta

SEQ ID NO: 136517 - DNA, 601 bp, Human
aaaaaaaaagaaaaagaaaagaaattcagtgtctgctaactgctgtcaattcagcaactgtttttttggggtttttttcctgccatgggaagtgcccagtgcctgcctttgggggctcccagtctgctgagaagctctgcatgttgcagagaggtggaagctccccgggagggatggacagatgctgggagagcccagagaatggggaggccagttctgctagatagatgatcaggaatttggggtgggacagggagaggccccagacctgaaggtgcatggccaatcaggttagagaagktgttgaaatacctatgcttagagaaggtaaaagaatgtatggtgtttatgaaggtctcaaatccatactatctcatttgaaattgaatctgtagcaaatgaggagcccattatgggttttcaggtggcaagggggtacttgggttgggttctagatagatcactggtggctcgtgctcaaggctcagggaaggtgaaaatagggaggtgaggaggccccttcttcaccaggtgagatgatgcctcatggggctacagcactgggggctggacatggggagagagggttccagagacttcc

SEQ ID NO: 136518 - DNA, 601 bp, Human
acatctaccaaatccattagagtttccctacccacagtgtcagatgtctttaaaggtgaaattcgtttataagaaatgtcatcctgatgaagtgtgctttttaaaatcatagaaacggttgccttaaaattaatgatgcattgcaaatatcagggaaaaaagacccatccagtgtaaagatgattaaaattcaggtcagaagtctgacttagtcaggctaaattttttaatgagatttcagaaaattaattgggcgaatgcatttttattcttttagcatgtaattttatgctcctgtttaaaaaaaaaaagattcgtctatggctgaggctgattgtggttcaaacattttaaactcaaattagcgcagggtggggggtgtttgtggcctaatttgatctgacttggagaagacagcgtgggtttctcagagctttctgggtggggggtagctatagtggtctgagacatcctccctgccccccagtctcccagtcatgccctgcctcttcctgagaatgccagcgacatttcttgggaggtgggattgggatggcggtggctcggggaccttggccatctcattggctcctgctcacca

SEQ ID NO: 136519 - DNA, 601 bp, Human
ttgtggttcaaacattttaaactcaaattagcgcagggtggggggtgtttgtggcctaatttgatctgacttggagaagacagcgtgggtttctcagagctttctgggtggggggtagctatagtggtctgagacatcctccctgccccccagtctcccagtcatgccctgcctcttcctgagaatgccagcgacatttcttgggaggtgggattgggatggcggtggctcggggaccttggccatctcattggctcctgctcaccagtttcctgctgctccccagggcccttgttccagyggttcctctaccctcctcctctcaaatcccatgtgcctgccccaggcagcccaggccttctccctcgtgcccacggtgacaggcagcacagcgagtggtgacaccgcagggtcagcctccctgtcccccggcccctcgatcagtctcctctgcctttggggagagctgagggcctccgtgccctggcagaggagcctgaggagtcagaggtggcctcctatggtgttgccccacagcgcagccctggaagggaggctgagggcagctcttgcctagcatggtcccttgacaaatggtcct

SEQ ID NO: 136520 - DNA, 601 bp, Human
aaacattttaaactcaaattagcgcagggtggggggtgtttgtggcctaatttgatctgacttggagaagacagcgtgggtttctcagagctttctgggtggggggtagctatagtggtctgagacatcctccctgccccccagtctcccagtcatgccctgcctcttcctgagaatgccagcgacatttcttgggaggtgggattgggatggcggtggctcggggaccttggccatctcattggctcctgctcaccagtttcctgctgctccccagggcccttgttccagcggttcctcyaccctcctcctctcaaatcccatgtgcctgccccaggcagcccaggccttctccctcgtgcccacggtgacaggcagcacagcgagtggtgacaccgcagggtcagcctccctgtcccccggcccctcgatcagtctcctctgcctttggggagagctgagggcctccgtgccctggcagaggagcctgaggagtcagaggtggcctcctatggtgttgccccacagcgcagccctggaagggaggctgagggcagctcttgcctagcatggtcccttgacaaatggtcctgggtgacaa

SEQ ID NO: 136521 - DNA, 601 bp, Human
ctcctcctctcaaatcccatgtgcctgccccaggcagcccaggccttctccctcgtgcccacggtgacaggcagcacagcgagtggtgacaccgcagggtcagcctccctgtcccccggcccctcgatcagtctcctctgcctttggggagagctgagggcctccgtgccctggcagaggagcctgaggagtcagaggtggcctcctatggtgttgccccacagcgcagccctggaagggaggctgagggcagctcttgcctagcatggtcccttgacaaatggtcctgggtgacaaagtygcaaggttgtgtctcttacctgcccacaggtgcacgtcgtcagccccaccgcctcactgcagcccccaaggttaccgccagccgccgaggggtgggaacggcagggtgatgatatcaacagccaagaaccccctgggcttgtccactgctcaggccgtcccagtccccggggaagcaggtccaccactaggcccattcgacagatagcagcacaatcaccgtcaccacgactggagaatgacatgtcccagcacctagtgccaggccctcttccaagggcttgcatttgcttatccattt

SEQ ID NO: 136522 - DNA, 601 bp, Human
cgtgccctggcagaggagcctgaggagtcagaggtggcctcctatggtgttgccccacagcgcagccctggaagggaggctgagggcagctcttgcctagcatggtcccttgacaaatggtcctgggtgacaaagtcgcaaggttgtgtctcttacctgcccacaggtgcacgtcgtcagccccaccgcctcactgcagcccccaaggttaccgccagccgccgaggggtgggaacggcagggtgatgatatcaacagccaagaaccccctgggcttgtccactgctcaggccgtcccagyccccggggaagcaggtccaccactaggcccattcgacagatagcagcacaatcaccgtcaccacgactggagaatgacatgtcccagcacctagtgccaggccctcttccaagggcttgcatttgcttatccatttaacccccagcagccccctgaagggggtactgttatgatctcctcagtttccaaagaggaaactgaggcccagaagccttgcccaaggcccacagctgggaagtggcagaattgaggtttgagccccagcctccaggccccagcattggagtctcaacatcagag

SEQ ID NO: 136523 - DNA, 601 bp, Human
aggagaatcgcttgaacccgggaggcggagattgcaatgagccgagatcgcgccacagcgctccagcctgggtgacaagagcaaaactctatctcaaaaaaaaaaaaaaaaaaaccagttttctgaaaggccatcggggtggtcggtcattagtcagcagtgatcacatttggggccaccctgggcgcactgttctggggccagccccacgcccgtcttgcagtttagagccacaccagacactaatcaccaacatcatctcccagagtcctcagagaaatcctggagccagtgttactgkgcctgtgtgtggacgaccagcccagggtcacttggctgcaggggcaaaagtggaacttgcggggagctgacccaggagcgggggaggtcttggaggtggcgacggagcagccaggccttccaggccaaggacacagttcaccctttcccttctgctgagagcccccaggtgcaccagggccaggactctgctggcccaggcagctgcccccaggagcctggtgtctcaaggtgccccacacctgagcagaggccaccctggggacagcgtcctgtggcagccctgggagtgcagtggtgc

SEQ ID NO: 136524 - DNA, 601 bp, Human
ggaacttgcggggagctgacccaggagcgggggaggtcttggaggtggcgacggagcagccaggccttccaggccaaggacacagttcaccctttcccttctgctgagagcccccaggtgcaccagggccaggactctgctggcccaggcagctgcccccaggagcctggtgtctcaaggtgccccacacctgagcagaggccaccctggggacagcgtcctgtggcagccctgggagtgcagtggtgccccagagcctgctggaccatgtccccagcacacgtgctccatctaggaagcygccccaccagaggagctggcctctaattgggtcggatggactgtgacaagaaatgcaaatctgggtcatccatatgcgtgtgagcagctggagccccagccacctccacccacatccaccaggagcttcggccccactgtggagctgcacggtgtagcctcccaggacgggcagtgttgggaaccccggccagactcccactagtcacagtaagaagcctggtcttccagggcaaagaccctcagggaccacttcctccaaacccttcactgtgcctgggggaaactgaggcccaagagg

SEQ ID NO: 136525 - DNA, 601 bp, Human
gatttacaggcacccaccaccacacccggctaatttttgtgtttttacaaaaattttttggccaggctggtctcaaactcctgaccttaagtgatcgcccgcctcggcctcccacagtgctgggattacaggcgtgagccactgcgcctggcctagaagagacattttcactttacttttttccctgcttttccagtgagtttctattattcattaagtcatgattcagggtcccagagtagggatcaccacataaccaggttcccctcaggcactctgggagaaggacagaggagaagtygatggacccagcttagacctgcccaggagacgtgcccctgctccgcaggcatctcaggctgagacgcagctggtccggccagcagttcctggtgtttccaggtggggaagcagctgtcagaagggccagtcctgtagttctcggtttggtcttgatgccttccgccagggtgctggctcctaaagacgcctcggtacggtgcccggctcagtgtgaccctcaccaaagacccacttcatgctagaaagttgaactgcttgttctggcttcactaggggcggtggcatggagctgggtgat

SEQ ID NO: 136526 - DNA, 601 bp, Human; identical to SEQ ID NO: 37514

SEQ ID NO: 136527 - DNA, 601 bp, Human; identical to SEQ ID NO: 37515

SEQ ID NO: 136528 - DNA, 601 bp, Human; identical to SEQ ID NO: 37516

SEQ ID NO: 136529 - DNA, 601 bp, Human; identical to SEQ ID NO: 37517

SEQ ID NO: 136530 - DNA, 601 bp, Human; identical to SEQ ID NO: 37518

SEQ ID NO: 136531 - DNA, 601 bp, Human; identical to SEQ ID NO: 37519

SEQ ID NO: 136532 - DNA, 601 bp, Human; identical to SEQ ID NO: 37520

SEQ ID NO: 136533 - DNA, 601 bp, Human; identical to SEQ ID NO: 37521

SEQ ID NO: 136534 - DNA, 601 bp, Human; identical to SEQ ID NO: 37522

SEQ ID NO: 136535 - DNA, 601 bp, Human; identical to SEQ ID NO: 37523

SEQ ID NO: 136536 - DNA, 601 bp, Human; identical to SEQ ID NO: 37524

SEQ ID NO: 136537 - DNA, 601 bp, Human; identical to SEQ ID NO: 37525

SEQ ID NO: 136538 - DNA, 601 bp, Human; identical to SEQ ID NO: 37526

SEQ ID NO: 136539 - DNA, 601 bp, Human; identical to SEQ ID NO: 37527

SEQ ID NO: 136540 - DNA, 601 bp, Human
ccacagccagagccaggacagggccttgccctgagggagcaggacctgggctaggcctcaccttcctcccccttcctctcgtcctgccccacctaccccaagcctcctaccccacaccaatctccttctcctcgccctgcagacatcaagcctgccaacgtgttcatcacagccacgggcgtcgtgaagctcggtgaccttggtctgggccgcttcttcagctctgagaccaccgcagcccactccctaggtaagggggacctgtctgtgccccagcagcccccagcggtcctggtgaccrtgcagggagacgcaaacattctccccacgtgtgtttggtcagttagtgcaggaagatgccttttttaagccccagggttttctcatctgttcagaatagtgacccagaagggaatcagctgtggccagaggagcccagctggggcttcccacaccccctgatcacctcccagcccttgcgggagaagctgactgagccggttgcttggagcagggggcgtgtctgtggcacagggcggtcatcttcccactgctgtgagtgtcccgttcacgggcagcacccttggtccatccctcctag

SEQ ID NO: 136541 - DNA, 601 bp, Human
gagatttttccgaggtcacatggcagcaggcctctccttcagaacccacgctgcttccaggaaacgagggccgggggcctcggcagataccgttggagtccccctttggggacccgggccactgactctccgttgctggaaggaagcctcgtctttccttgtcccctcaaacatttacttcccttgtgaaaaaccaagtgtttcggtcagtttgggactgtttacctgtgtggttgaagggcttcgaaaagaccaggaaattcaagggaagctgtcaaagagaagagttagaaccgctgcrtcctgtcccccgtcagtcagcaccgagcctttctctgtcccactgcagaaaaaagactgtggcgctccgtcagagagggttaggatcgcatcattaggaatgggcagagatgcgtctcatccgacagtatgattttattgacttggactggtgcacttattatattaatgagaaggaattggaacttgggagaaggccgccctcataagccgggctcttcccaagccctccgagcgccgaccaggccacatgatgggtggaaggagccctcctggggcctgtccccactccgggctctgt

SEQ ID NO: 136542 - DNA, 601 bp, Human
acgccggcgtaatgcaggaaaaatgaaagatttgcctatacacagctcacaagctacaagcaagtgtctcgctccgagcaacggcagcagctgcaagacaaatcacggggctgggagagcgggcgggcaggcctggctcctcggctgtagtgacaggacagtctcggtgacaggcagccacgggtgacagggcaggaagggcggctggtcacacccaggcccatgcagggcccgtgctgcctcttgggggctgggagagcaagtctagttgggggtgaccccatcaggtactcgaggtcasggccctgctgggtctcccagggcttagcctggcgctgaggcgcaaaccccttccttcttcttccttgagcaaactgcctggccctgggctgtgtgctggggatatgcgattatgcagctttcgaggggacagacacagtccatgccaggtggcatggtgaggggacaggtgggactgcctcttggggcccactgtgggcaggcagggcaggcgtggggctctgtgattctatacagagccccagggagcccagggtggctccacccctcccagagccgccctcacttcgttactctgtag

SEQ ID NO: 136543 - DNA, 601 bp, Human
cactgaactcactgaaaagatgagttaaagacggagaaaaaagagttcaaaaaacattttgttttttcgttggccaggcgtggtggctcccgcctgtgatctcagcactttgggaagccgaggcagtcagatcacttgaggtcaggagtttgagaccagcctggccaatatggtgaaacctcgtcgctactaaaaatagcaaaaaaattagccaggcctggtggtgcacgcctgtaatcccagctacttgggaggctgaggcaggagaattgcttgaacccggcaggtgaaggttgcagtsagctgagatggcgccattgcacttcagcctgggcgagcgactctgtctcaaaaaaaaaaaaaacaaaacattttgctcattttgcttttttgtaaatcatcacaaggcttattattatcccattttacagattaggaaactgaggcccagggaagtaagagagaccacatccctgtggtcacccagtagccagataccagagccccacgggaaatcagctcaagttgaagagcccttctcgaggcatcagcctacagcatggcccagggagggtttgggttgtgggtgcccagggaaggg

SEQ ID NO: 136544 - DNA, 601 bp, Human
aaacattttgttttttcgttggccaggcgtggtggctcccgcctgtgatctcagcactttgggaagccgaggcagtcagatcacttgaggtcaggagtttgagaccagcctggccaatatggtgaaacctcgtcgctactaaaaatagcaaaaaaattagccaggcctggtggtgcacgcctgtaatcccagctacttgggaggctgaggcaggagaattgcttgaacccggcaggtgaaggttgcagtcagctgagatggcgccattgcacttcagcctgggcgagcgactctgtctcaaaaaaaaaaaaaacaaaacattttgctcattttgcttttttgtaaatcatcacaaggcttattattatcccattttacagattaggaaactgaggcccagggaagtaagagagaccacatccctgtggtcacccagtagccagataccagagccccacgggaaatcagctcaagttgaagagcccttctcgaggcatcagcctacagcatggcccagggagggtttgggttgtgggtgcccagggaaggggtcgagagaggatccccagcgagacctcaggtgcgaggaacacctagggct

SEQ ID NO: 136545 - DNA, 601 bp, Human
tttcgttggccaggcgtggtggctcccgcctgtgatctcagcactttgggaagccgaggcagtcagatcacttgaggtcaggagtttgagaccagcctggccaatatggtgaaacctcgtcgctactaaaaatagcaaaaaaattagccaggcctggtggtgcacgcctgtaatcccagctacttgggaggctgaggcaggagaattgcttgaacccggcaggtgaaggttgcagtcagctgagatggcgccattgcacttcagcctgggcgagcgactctgtctcaaaaaaaaaaaaaamaaaacattttgctcattttgcttttttgtaaatcatcacaaggcttattattatcccattttacagattaggaaactgaggcccagggaagtaagagagaccacatccctgtggtcacccagtagccagataccagagccccacgggaaatcagctcaagttgaagagcccttctcgaggcatcagcctacagcatggcccagggagggtttgggttgtgggtgcccagggaaggggtcgagagaggatccccagcgagacctcaggtgcgaggaacacctagggctctgagcgctccat

SEQ ID NO: 136546 - DNA, 601 bp, Human
tcgttggccaggcgtggtggctcccgcctgtgatctcagcactttgggaagccgaggcagtcagatcacttgaggtcaggagtttgagaccagcctggccaatatggtgaaacctcgtcgctactaaaaatagcaaaaaaattagccaggcctggtggtgcacgcctgtaatcccagctacttgggaggctgaggcaggagaattgcttgaacccggcaggtgaaggttgcagtcagctgagatggcgccattgcacttcagcctgggcgagcgactctgtctcaaaaaaaaaaaaaacacaacattttgctcattttgcttttttgtaaatcatcacaaggcttattattatcccattttacagattaggaaactgaggcccagggaagtaagagagaccacatccctgtggtcacccagtagccagataccagagccccacgggaaatcagctcaagttgaagagcccttctcgaggcatcagcctacagcatggcccagggagggtttgggttgtgggtgcccagggaaggggtcgagagaggatccccagcgagacctcaggtgcgaggaacacctagggctctgagcgctccatcc

SEQ ID NO: 136547 - DNA, 601 bp, Human
gctgaggcaggagaattgcttgaacccggcaggtgaaggttgcagtcagctgagatggcgccattgcacttcagcctgggcgagcgactctgtctcaaaaaaaaaaaaaacaaaacattttgctcattttgcttttttgtaaatcatcacaaggcttattattatcccattttacagattaggaaactgaggcccagggaagtaagagagaccacatccctgtggtcacccagtagccagataccagagccccacgggaaatcagctcaagttgaagagcccttctcgaggcatcagcctrcagcatggcccagggagggtttgggttgtgggtgcccagggaaggggtcgagagaggatccccagcgagacctcaggtgcgaggaacacctagggctctgagcgctccatccctgaggaaaagcccacctgacctcgccagcagcaggtgttggtggacgacctggagctcatcctgggccccacagggaaggacagagcctcctctcatggtgtgtgtcagcgctgccttgccggggatcacaccgtgctgtgctgcgtctgtgcccaggcctggcatgggggcccttgtggaacattt

SEQ ID NO: 136548 - DNA, 601 bp, Human
cgagcgactctgtctcaaaaaaaaaaaaaacaaaacattttgctcattttgcttttttgtaaatcatcacaaggcttattattatcccattttacagattaggaaactgaggcccagggaagtaagagagaccacatccctgtggtcacccagtagccagataccagagccccacgggaaatcagctcaagttgaagagcccttctcgaggcatcagcctacagcatggcccagggagggtttgggttgtgggtgcccagggaaggggtcgagagaggatccccagcgagacctcaggtgygaggaacacctagggctctgagcgctccatccctgaggaaaagcccacctgacctcgccagcagcaggtgttggtggacgacctggagctcatcctgggccccacagggaaggacagagcctcctctcatggtgtgtgtcagcgctgccttgccggggatcacaccgtgctgtgctgcgtctgtgcccaggcctggcatgggggcccttgtggaacatttgctgagtggatggacgaccttcatggccaggcatccctggggacacctgtccgtgcaggtgcggagggccatgcagatgc

SEQ ID NO: 136549 - DNA, 601 bp, Human
tattatcccattttacagattaggaaactgaggcccagggaagtaagagagaccacatccctgtggtcacccagtagccagataccagagccccacgggaaatcagctcaagttgaagagcccttctcgaggcatcagcctacagcatggcccagggagggtttgggttgtgggtgcccagggaaggggtcgagagaggatccccagcgagacctcaggtgcgaggaacacctagggctctgagcgctccatccctgaggaaaagcccacctgacctcgccagcagcaggtgttggtggasgacctggagctcatcctgggccccacagggaaggacagagcctcctctcatggtgtgtgtcagcgctgccttgccggggatcacaccgtgctgtgctgcgtctgtgcccaggcctggcatgggggcccttgtggaacatttgctgagtggatggacgaccttcatggccaggcatccctggggacacctgtccgtgcaggtgcggagggccatgcagatgcatcccaggccgcctcctgccccagccccaccctgcgtcccatcccaacagtgcaggatgcctgggaatgatcctgtcag

SEQ ID NO: 136550 - DNA, 601 bp, Human
tgcctgggaatgatcctgtcagtccctcgggcccagaatccctgcctcagcagatggatctcaggcctgagtttcagccgaggttctgagcactaacccctcggtggcagtcacaggtctgccaccttcctggcattttcaggggcacagactgttaggaagagatgagctgatgccaagaggggagggaaggagagggaagggccttaaggggccagcaagtgaggagtcaatctggacctgggatgtaaactccagctctttggttcattcattcgttcatccattcgacaaggatctrtgctgggcctgggccgttccccgggaaggctggcttggcccctgcctttgtggaagatacagcctggtaggagaatccatttagtcttcaccatgaaccaaacactcctccaacaattgcttctcattttccagagagggaaaccaagtctgcagaggtcagggggggaccctctgttttcctgatggggagaccgaggctgagagagagtttctgttctcagccagggagtggaggaagcaggtgcagcccagccagctccagctccatgtcactgctgtccccacctgcccctgtctg

SEQ ID NO: 136551 - DNA, 601 bp, Human
gctccagctccatgtcactgctgtccccacctgcccctgtctgtcccatggaggattcagtgccaaggcacagccccccagcccaatgtcccgccggctggacggatgtcagcaaggagaccgcatttctccagctgctttccaatccaccatctggggaagaggggcagcttgcagacaccagcctccccttcctgtgaaatctgcctttttcgtagctaatgaacatgtttcaaacaccgagagcatttcaaaacacggcaaagtttgttttgacaggaccggcgcatcttggggaagyggggcccctttaatcagcctccctctttcagatcccgcattctcctctgatatctgctgggtttgaaatcgggagttctaggtaaagattccgggaaggtcagggtttgtcaggctcttctttcatacacacagctccgtcccccaccaagaggagggggcggtgggagtctcagggaggggcatggaaacccaggctgcacagggctctgcctctgcgtctcggcatcgccgggagatgggccgggataaggcccgggctgcactgcacacagaggtcgtcctgggcaggacccccgct

SEQ ID NO: 136552 - DNA, 601 bp, Human
ttctaaccagcctctccaggcaattcagctgcagcatggatcatttcagtccttttttttttttttttttttttgagactgaatttcgctctgttgcccaagctggaatgcagtggtgcgatctcggctcactacaaccttcacctcccgggttcaagagattctcctgtcttgccctcccaagtagctgggagtacaggcgcgtgccaccacacccggctgattttttaaatttttagtagagatggggtttcaccatgttagccaggatggtctcgatctcctgacctcgtgatccacmcgccttggcctcccaaagtgctgggattacaggcgtgagccaccacgcccggcccaagtccattcttgatagacatggtctactggctgtttctgaatacttcctgggacaggcaactaactccctgcctcctgatgggcccactcctgcaaggtcccagcagggtcaaggctcagttaatcttagttggaggtgggcaggtggctggctggatggatgggtgatggacagactgatggatgaatgaatgggggttggatggatggatggatggacgatagacaattatggatggttgga

SEQ ID NO: 136553 - DNA, 601 bp, Human
cagtccttttttttttttttttttttttgagactgaatttcgctctgttgcccaagctggaatgcagtggtgcgatctcggctcactacaaccttcacctcccgggttcaagagattctcctgtcttgccctcccaagtagctgggagtacaggcgcgtgccaccacacccggctgattttttaaatttttagtagagatggggtttcaccatgttagccaggatggtctcgatctcctgacctcgtgatccacccgccttggcctcccaaagtgctgggattacaggcgtgagccaccaygcccggcccaagtccattcttgatagacatggtctactggctgtttctgaatacttcctgggacaggcaactaactccctgcctcctgatgggcccactcctgcaaggtcccagcagggtcaaggctcagttaatcttagttggaggtgggcaggtggctggctggatggatgggtgatggacagactgatggatgaatgaatgggggttggatggatggatggatggacgatagacaattatggatggttggacagttgggtggatgatggatggatggcaatttgcaacactagcatc

SEQ ID NO: 136554 - DNA, 601 bp, Human
tggtgggtttacaggcgtgagccaccgtgccattcattgtgttttaatttgcccttccctgatgagtagtaagaaaagtagcctcacttcatgtgcttcttggccactgggatattctcttttgtgaagtgcctgttcagggcttttgctcatttgaataagggggtagtttgtctcttatgtactgatttgcagaagctttgaaatatgttctgtgaagagtccgttgtcaggtgtatgtgttgggatgattttctcccagtctgtgacttgcctttaactctggtgtggtttgatgaaytgaagttcctagttttaatgccttacacacgtttcctttttggttagtgccttttccatcctgtttaagagatttcggccaacccgagtctggaccggctaattggcgggtggccatgggcagagctaagtggtcagtttctggaacctgagggtctgggtttgaactaattcctgccactctcgtgcaaacctcttcacccatctgagcctcagtttctccatctggaaaatggagatactgcctcatagcactgttgggaacagaaatgagctgacacatggaagatcttggtcagcc

SEQ ID NO: 136555 - DNA, 601 bp, Human; identical to SEQ ID NO: 37528

SEQ ID NO: 136556 - DNA, 601 bp, Human; identical to SEQ ID NO: 37529

SEQ ID NO: 136557 - DNA, 601 bp, Human; identical to SEQ ID NO: 37530

SEQ ID NO: 136558 - DNA, 601 bp, Human; identical to SEQ ID NO: 37531

SEQ ID NO: 136559 - DNA, 601 bp, Human; identical to SEQ ID NO: 37532

SEQ ID NO: 136560 - DNA, 601 bp, Human; identical to SEQ ID NO: 37533

SEQ ID NO: 136561 - DNA, 601 bp, Human; identical to SEQ ID NO: 37534

SEQ ID NO: 136562 - DNA, 601 bp, Human; identical to SEQ ID NO: 37535

SEQ ID NO: 136563 - DNA, 601 bp, Human; identical to SEQ ID NO: 37536

SEQ ID NO: 136564 - DNA, 601 bp, Human; identical to SEQ ID NO: 37537

SEQ ID NO: 136565 - DNA, 601 bp, Human; identical to SEQ ID NO: 37538

SEQ ID NO: 136566 - DNA, 601 bp, Human; identical to SEQ ID NO: 37539

SEQ ID NO: 136567 - DNA, 601 bp, Human
acactttttctgctttggaactcatatgcctaccattcttcatttgcttgggcttaggcagtcaacaaaacccagaaaccataaataacaaagctaactacatcaaagctccactcaaaacctgtcggtggtgcctttggttcatgggccaaatctaagctccttagcatggcattcaagaccatctatcatctggttctggtgggacccctcatcctcatctcttgccataaatgctataccctacatgtagataactatttgttagtctttaaacatgctattctgttttacatagttstgtctctgcatatgttgcctgtactcagaaagaaacttaaagtggaaaaatctggcaacatcaccttccctaagtgacatcatcataaccaagtgattcaagttaatatcaccaataatgggtatacacttacatcatgtgctcttgatattatggtctaagaaggacacaacatcatttctatggcattcttgcgaaaaatgcataacctgcatgtattcgtgaggaaactgacaagcccaaattaagggatattctacaaaatacatgacctatttgcttcaaaatcgacaatgttaa

SEQ ID NO: 136568 - DNA, 601 bp, Human
tggtttttacttctgccataataaaaaagagcagctattagtccagaccaagaaacaaaaagaatttgtaagacatatatatgacttgaataacgagaataaaaatgttttagaaaaaaagaataaacacagcagagttgggaatcacacagcctgattgaatgtacgctgtgctcatatgataagaaatcccccaaacatcatcagtgtatgtcttaagacaactccgaacacctttctttcattccctcacatttaactggctaaatcctataaatttacccagtaaatatctcttgartctattctctcccctctatctgcactgccattgctctgcttcaaactattatctgtatctcttgcctgtacttctgtgaaaaccttctaactgctttctctctccctcagttttactcaccctcacctcactcctcacaaaccatttctacctgctagaatgatcttcctaaaatgcaaatctaaataaaaccttttagtggttgcctcttggctcataccagtaacaataatagttttttaaaattttatttgattttttggtagagacagggtctgtcttgctatgtcgcccaggctc

SEQ ID NO: 136569 - DNA, 601 bp, Human
aagaaatctcaggataccttcctgggaggtctaagcttgataacactcaaatcgtttatgctctaggccaaaggagtaatggatgcagcaatgggtaggcccgaaggctgaactgttatctcctcaggtagaagtgactaaagactgaaagaatactccttctacccactcaagcctgcacttaaagtggtcacatgccaccaggctagccatggggatgctggtgaggggtgcagacaggctacaaccagccagggctttgtgaaggagcctatatccgatatataactattcccagaawtactgctcatctctagcatggaagtgctctgacccatcccagcacctggcttacctaggcccaagcagaatcaaaggcccttctatctcaattccataggaactggaaagtaacctcaactctatgagaaaggatgcttaaggaaaaaataagggatcactggtttcaaagataagcacagatttgtcccctgacacttgagtcattatccccccaactcattctgaagccacgggtataggagccagggacgcgagtgggtgtggggtagggacactttgagactgcaaggggccaaga

SEQ ID NO: 136570 - DNA, 601 bp, Human
aggggtggggatgaaatggggtagggcacaaaaaaggaggacacaacgggagaggcagtgtcagcatctgtctggtggcctagtatgtagcaagcaaagataatgctctgtcctttaatcagcaaccccttgccccaagtgttcactctggcactccagaccctgcaggtgtgtggctatcagccagacccctagccaggagtgccaaacctgttcctggctgactcttgacctgagggacacaaaggagttcccaagtgcctggcctgtccatacaccctagatctgccctttctcttgsggacagcacatccttcttttccaaaattcctccaacaggcagccaccgtggacccccagcagtgatgggggctggcagccagcctagcagcccccactcagtctccacagcctgactgcaaagctttcctccacaccccgcatcccaccccttgataaacaaagttgttctctgttccacgggcctgcctttgcctgcagccgtgcctcctccacatctgcccactccagttttaatgcccctgtattcactgtctacaaattatcagcattcaaagccagaaagttggacaaacacacc

SEQ ID NO: 136571 - DNA, 601 bp, Human
tttacaaaaaatacaaaaatcagctgggcatggtagtgcgtgcctgtggacccagctactcgggaggctgaggtgggaggatcacctgagcgtgggaggttgaggctgcagtgagctgtgactgttatcactgcactggcctgggcaatagagtgagaccctgtctcagaaaaaaaaaataaaacaaaaaaccaaaaaccaaaccaaccaaccaaccaaccaaaaaacctaaaaaagaaaaaaaacaacctcccccaacaaaaaaccagtgtaataactatttacatggcatttacatcayttatatcgcatccagtattataaggattctagagctgatttaaaatatataggaagatatgcgtagattatacacaaatactacaccattttatatgaaggacttgaacatctgtagattttggcatccatgggggtcctggaagcaatcctccacggatactggagatgactgcacatgcaatctggaacgttgaccttcggccttggcatggctcctagtatgagctggggattcttttagctgatttgagctactatggctgactcagtttctctctacctggcccaatggctttta

SEQ ID NO: 136572 - DNA, 601 bp, Human
ctgcccctcagtatctgctggacagccagaacaagaatctttaccacatgaagcaaggcaacaaccaaaaaagccaggattttatattgaaatagacctatttaaatgtcagaaagctcagaaggggtcaagaccacatagaaacatacatacatacacacacaccccaatacataaaattcctctgcaaatacaggattttaaactttatttttcctattcttattttaaattttttagagatgaggtctcactatgttgcccaggctggtcttaactcctagcctcaactgatcctctagccccagcctcctgagtagctgggattacaggcaggagccactgtgcccagctaaagatatcactttaaataaatgatccctcaaagctcatgggaaattctgtgaaattaagataattttaaaaattgagatataattcatgtatcataaaattcactcttttaaagtacacaattcaagaaattaagttaatttgagatactctgagtctctgtttcctcatccataaaatggctataatattgccaaccaccagcggagactggtatgagattaaatgatataaggccacaaagtac

SEQ ID NO: 136573 - DNA, 601 bp, Human
accttgtgtattctctgaggatatacataggtatggatgaacccctcaaggccctgccccagccaggcactgctgcatgagaaagaaaatgtcccaaagaacagcaatgactcaaaagatctcccccaggggttaaggagagtcctgcacaccaaggaggtatcaggcaatgcaagggggcgggatgaggaacaggccagagctgcacactatgcgggatgtgaaggggtttcctgtttacccaaaaaaccctggatgccttaagcactgagaactaaaaacgctggttcttctactttcmgggagaggagattatgaacatatttaagcaacgtttctgttgctttgagataacaaaacagcaaaactccaatcacaacaattgtttgcctggtgtcaggctctgccaccacttcacctaagggcctctcctctgaatcaaatactcctctggagactgaatagtgggaagtccattaaaaaaactccaacagaaatctaacaaaatgtcgtctaaatgcaaagggaagttcactgagaatagccagcagagaccaccaggaaaggtcatcctcactccaggcgcgccccagtcttcctt

SEQ ID NO: 136574 - DNA, 601 bp, Human
ccagaacaagtccctctgagctcctagggaagagcctcttctcctctgcaggcctgcccacaagctcaccctgggagctccctaatctgtccggctctcttctactccctacctcctcgtcatctctagaagcactgtagagtttagaaagcctcccctgcatcccagcttgttcctggccctccaaattcaacctttctccaccaggcctcacttgacaggcccccaccagcccagcaagttgtccctgtgccaccctctggcccagactgtcttgattccccatggcacttgggacccmcaaatgtgaggcctatgaccttgtgtattctctgaggatatacataggtatggatgaacccctcaaggccctgccccagccaggcactgctgcatgagaaagaaaatgtcccaaagaacagcaatgactcaaaagatctcccccaggggttaaggagagtcctgcacaccaaggaggtatcaggcaatgcaagggggcgggatgaggaacaggccagagctgcacactatgcgggatgtgaaggggtttcctgtttacccaaaaaaccctggatgccttaagcactgagaactaaaaacg

SEQ ID NO: 136575 - DNA, 601 bp, Human
aacatatctgtggactgaatccagcccgcagctgccagtctgtgcttaagctccaaaaacatgacggtatcaactctcctcgctcaatgtctttattggaagatatatgagcaaaaagaaccacagtaactgcttgcacaaccagaaccatgttcatttgttctccaaagcagcctctaaacagctgcatacatctcccatcagtcttccagaacaagtccctctgagctcctagggaagagcctcttctcctctgcaggcctgcccacaagctcaccctgggagctccctaatctgtccrgctctcttctactccctacctcctcgtcatctctagaagcactgtagagtttagaaagcctcccctgcatcccagcttgttcctggccctccaaattcaacctttctccaccaggcctcacttgacaggcccccaccagcccagcaagttgtccctgtgccaccctctggcccagactgtcttgattccccatggcacttgggacccacaaatgtgaggcctatgaccttgtgtattctctgaggatatacataggtatggatgaacccctcaaggccctgccccagccaggcactgctg

SEQ ID NO: 136576 - DNA, 601 bp, Human
atttttgagtgacttcctgatttttcaatattgaccatcaattcttttgtttttttcctcaagaacacgtgcggatccaacccaacatatctgtggactgaatccagcccgcagctgccagtctgtgcttaagctccaaaaacatgacggtatcaactctcctcgctcaatgtctttattggaagatatatgagcaaaaagaaccacagtaactgcttgcacaaccagaaccatgttcatttgttctccaaagcagcctctaaacagctgcatacatctcccatcagtcttccagaacaartccctctgagctcctagggaagagcctcttctcctctgcaggcctgcccacaagctcaccctgggagctccctaatctgtccggctctcttctactccctacctcctcgtcatctctagaagcactgtagagtttagaaagcctcccctgcatcccagcttgttcctggccctccaaattcaacctttctccaccaggcctcacttgacaggcccccaccagcccagcaagttgtccctgtgccaccctctggcccagactgtcttgattccccatggcacttgggacccacaaatgtga

SEQ ID NO: 136577 - DNA, 601 bp, Human
gccactttagcaggcccagtgaactgctccaaggtgacaggagctacagcgctggcaggagggtctggtaaatgatgaaactcccagccagcctgtggttcgctgggagcacagagaggaaggaaagggactttaaaaacatacatacaaaactgcttaacttatggccagcccagttagaaggtatggcccaggaggccgggatctttgctgtgtcccaagaacaagaacaactccaggccctcaggaggttgctccgtgaggcaggcgatgagtgaagccactgaaggagggaagaaasgaatgagtgactgaaactgacacatgcagtccaaggaccttcttcccttcagctgaggaggccttggtctgctcccaccccaggagactggtcccctaccccactgcctgtgcccagctaagtggacccatcctccgcctctcaccttaagtcccattttgtcacaggagcacaggagtttcctgaccatccctccccactgcaagtctgatctcttgccaccttcctgctcaccctgtgacacacagaggatgcctgtattcagggcaggcagcacgacatctgctgagttcaccactg

SEQ ID NO: 136578 - DNA, 601 bp, Human
aagcctgtggccactttagcaggcccagtgaactgctccaaggtgacaggagctacagcgctggcaggagggtctggtaaatgatgaaactcccagccagcctgtggttcgctgggagcacagagaggaaggaaagggactttaaaaacatacatacaaaactgcttaacttatggccagcccagttagaaggtatggcccaggaggccgggatctttgctgtgtcccaagaacaagaacaactccaggccctcaggaggttgctccgtgaggcaggcgatgagtgaagccactgaaggarggaagaaaggaatgagtgactgaaactgacacatgcagtccaaggaccttcttcccttcagctgaggaggccttggtctgctcccaccccaggagactggtcccctaccccactgcctgtgcccagctaagtggacccatcctccgcctctcaccttaagtcccattttgtcacaggagcacaggagtttcctgaccatccctccccactgcaagtctgatctcttgccaccttcctgctcaccctgtgacacacagaggatgcctgtattcagggcaggcagcacgacatctgctgagt

SEQ ID NO: 136579 - DNA, 601 bp, Human
gcaggtgccatcaaaatgtctcattgcttgactgagtatactttgacgacaaaaattcctaactatggaggaaaaaggaagtacaaatttgacgagtttaaaattgatcgaaatacaatgactgccaatctaagaggacctctttctcaggccacaaaaatgagtagccctacatcatagggcctgtactcttagtatctgttctgagaaaatatatcatgacaaaaatgtgaccatgaaatgcagtcattataaatttcttttcgatttacaataaaagcatcttcacacatttgaaacygtagcacactgagcgtgagacacctatttattccatcttcaggcagcgtgctgggcaagcctgtggccactttagcaggcccagtgaactgctccaaggtgacaggagctacagcgctggcaggagggtctggtaaatgatgaaactcccagccagcctgtggttcgctgggagcacagagaggaaggaaagggactttaaaaacatacatacaaaactgcttaacttatggccagcccagttagaaggtatggcccaggaggccgggatctttgctgtgtcccaagaacaagaacaact

SEQ ID NO: 136580 - DNA, 601 bp, Human
caaccagggaggctctaaccagtgctctataaaggcaagaaagggggccggttccccattccacttctccagggcatgaccttgggcaaacaaccaaatttccctgggccttagctgccctgaggggcaaaagagggatactccgccctgccctcaccccctgggctgttgtgaggatgaaatgaaatgaggtagtctataaatgcattctgaaaaccacaggaaattgcagagatgttcaagatcgttctgattctacccctggactgtggcctccagggacaggttcctgctggctccytgccacgaggcatcacttggtgtttgccaacaaggaggcactcagtaagtgttaaaacgggtgagtgaaaggaggcagagcaggtgccatcaaaatgtctcattgcttgactgagtatactttgacgacaaaaattcctaactatggaggaaaaaggaagtacaaatttgacgagtttaaaattgatcgaaatacaatgactgccaatctaagaggacctctttctcaggccacaaaaatgagtagccctacatcatagggcctgtactcttagtatctgttctgagaaaatatatcatg

SEQ ID NO: 136581 - DNA, 601 bp, Human
gcccatgcctcttgacaaagaaggaagggggtgccagaggcacaccaacagcctgcaccccagccctagacagcacacgctgcacagtcatcctgggaaaagagagtaatgctgcaggaagccagtcctaaatcacattcaaaggccaactgaaaaaaaaaaaaataacaagtagggacagggattcctgggatggtgctcattatgggtgtcaggctgagtagagctggcacaggccttggtttgtaaacacagggcagaacgagcattgcctaagagcgctttgctcctgcacatcccraagaaccaggcagtcactacaagtggaagctcaaagaacatgcactcaagtggaagctcaaagaacgtgcactcaagtggaagctcaaagaacgtgcactgaccaatggatgcggcatcagaaccgagtggcggctcagccttcacggtgtcctggcgttctcccaatggtgttctgggaatttgatcctaacctcatcattagtgttcagaggactacaggaaaacacagaacccccaactaactgcacaccactgatcagatattggtcctactaatgtaccaagaaacatcctaatt

SEQ ID NO: 136582 - DNA, 601 bp, Human
gaggagggggaagtagcaagaaaatactgcccatgcctcttgacaaagaaggaagggggtgccagaggcacaccaacagcctgcaccccagccctagacagcacacgctgcacagtcatcctgggaaaagagagtaatgctgcaggaagccagtcctaaatcacattcaaaggccaactgaaaaaaaaaaaaataacaagtagggacagggattcctgggatggtgctcattatgggtgtcaggctgagtagagctggcacaggccttggtttgtaaacacagggcagaacgagcattgcytaagagcgctttgctcctgcacatcccaaagaaccaggcagtcactacaagtggaagctcaaagaacatgcactcaagtggaagctcaaagaacgtgcactcaagtggaagctcaaagaacgtgcactgaccaatggatgcggcatcagaaccgagtggcggctcagccttcacggtgtcctggcgttctcccaatggtgttctgggaatttgatcctaacctcatcattagtgttcagaggactacaggaaaacacagaacccccaactaactgcacaccactgatcagatattggtcc

SEQ ID NO: 136583 - DNA, 601 bp, Human
taaaatatacagaagcgagcctggtacagcacgtggtaagtgcctaatgaacatcagctactactattatttgtatttattattgaaaggaggggttgagagtagccaattccatgactcatgaacaatcatccatctatttattcagaaccatcacttgaaggaggatgggcgcatgtgataaccagcaaataaatacaaccactgtttccaaccaggggttttgtttgtttgctcgtttggggtcagctaagtggctatttaacacggtcacattccactggatgtcagctgtcctctsttctcattccatgtccttccttctctcagttactgtcagtgtcacactcctgctccgtttttaacaatacagtgtgtggctgggaatcgcatctgtcaggtccacatcagtggcacaaattttaaaagctatagagcaaatgcctgaaatccgcccctctgaacccagccctgggcaaaccacacagcatcctgtgctcagtgctccatttctacgctttaaaagcactgcagaatcgcctgatcacaaaacttaatatgcagtaaagtcactgtgtggtttgggcaagccagtgaaaag

SEQ ID NO: 136584 - DNA, 601 bp, Human
gcaatttgcccacggtcacccagccagaagcaaggcttccgcagccccctgtgagctccagcaggacagtcaggaggagagctgtcttctgaaggaaccctcaggatgatggggtgtcctgttagtgcagcagctgcctctgtggcagaggggtccctggaaacatgaaggctcattttcacccaagtcacacagccaagagaataatatcagaatcaataaaaatatagatgcatggggaatagtcagatgggctttagtcctaactttgccccaactcagtatatgactatgtgcaaaygttaactctttcaggtctcaaagaaaagctctgtgtcttagtctcctcctctgtaggatgagaacagttaacagtacctttctcctattgtaaggattaaatgcaaccacaagtgtaaaatatacagaagcgagcctggtacagcacgtggtaagtgcctaatgaacatcagctactactattatttgtatttattattgaaaggaggggttgagagtagccaattccatgactcatgaacaatcatccatctatttattcagaaccatcacttgaaggaggatgggcgcatgtgataac

SEQ ID NO: 136585 - DNA, 601 bp, Human
cagtggctcacgcctgtaatcccagcactttgggaggccgaggcgggcagatcacgaggtcaggagatcgagaccatcctggctaacatggtgaaaccccgtttctactaaaaatacaaaaaattagccaggcgaagtggtgggcacctgtagtcccagctactcaggaggctgaggcaggagaatggcgtgaacccgggaggtggagcttgcagtgagccgagactgcatcactgcaccccagcctgggcaacagagcgagactccctctcaaaaaaaaaaaaaaaaaaaaaaagaaacwaattaacaaagcccaaaacaacaaagaaactaatgtgtacaaaaatgtttcaaaagctattttgatgattagttaagtgctatccaacatttactgccattaaaaatcatcaacaaaacaagcctcaataagtccaccccacatactgcagtctagactcccaaagaaccagccttaggctgggaggtggctcacacctgtaatcccagcactttgggaggctgaggcggcggatcacaaggtcaggagttcaagaccagcctggccaaagagaccagcctggtcaacatggtgaaaccc

SEQ ID NO: 136586 - DNA, 601 bp, Human
cgcagtggctcacgcctgtaatcccagcactttgggaggccgaggcgggcagatcacgaggtcaggagatcgagaccatcctggctaacatggtgaaaccccgtttctactaaaaatacaaaaaattagccaggcgaagtggtgggcacctgtagtcccagctactcaggaggctgaggcaggagaatggcgtgaacccgggaggtggagcttgcagtgagccgagactgcatcactgcaccccagcctgggcaacagagcgagactccctctcaaaaaaaaaaaaaaaaaaaaaaagaawcaaattaacaaagcccaaaacaacaaagaaactaatgtgtacaaaaatgtttcaaaagctattttgatgattagttaagtgctatccaacatttactgccattaaaaatcatcaacaaaacaagcctcaataagtccaccccacatactgcagtctagactcccaaagaaccagccttaggctgggaggtggctcacacctgtaatcccagcactttgggaggctgaggcggcggatcacaaggtcaggagttcaagaccagcctggccaaagagaccagcctggtcaacatggtgaaac

SEQ ID NO: 136587 - DNA, 601 bp, Human
tgggcgcagtggctcacgcctgtaatcccagcactttgggaggccgaggcgggcagatcacgaggtcaggagatcgagaccatcctggctaacatggtgaaaccccgtttctactaaaaatacaaaaaattagccaggcgaagtggtgggcacctgtagtcccagctactcaggaggctgaggcaggagaatggcgtgaacccgggaggtggagcttgcagtgagccgagactgcatcactgcaccccagcctgggcaacagagcgagactccctctcaaaaaaaaaaaaaaaaaaaaaargaaacaaattaacaaagcccaaaacaacaaagaaactaatgtgtacaaaaatgtttcaaaagctattttgatgattagttaagtgctatccaacatttactgccattaaaaatcatcaacaaaacaagcctcaataagtccaccccacatactgcagtctagactcccaaagaaccagccttaggctgggaggtggctcacacctgtaatcccagcactttgggaggctgaggcggcggatcacaaggtcaggagttcaagaccagcctggccaaagagaccagcctggtcaacatggtg

SEQ ID NO: 136588 - DNA, 601 bp, Human
cttatgtacatcatctcgtttaattctccctcaataccataaggtaggtactgttaggattttccccattttacagataaggaaaaactgagagttagacaagacagagtgacatgcccaagatcccacaacaatgacacaggagggctggtatctaaagccacagctagaggacctgaagcacatgctctcagacactgttctgtactggctcactgcacagatggaaagacagggttggggaggggcactgatccagtgcatcagtgcaggcccaggggccatgaggcaggtctcccamctctcagctcaggctcatgctgcctctaacacggatgagggtgtgagagccaagatcaaaagtctcctgtacacaacgcaggtggtggctgactgtcagttccccaagggcactgacgcctcagccctctcagtaccctctcctcccctggcaggctgcttgacactcagtgacagccagtgttgggtgggtgggtgggtggaactactttaactcgtaagggccacttcctaccgttgtgccatctgtgaaaggtttctccaaagcagattctcatgcaatattttcagcaaatgtact

SEQ ID NO: 136589 - DNA, 601 bp, Human
tgctaagctggttccctcttcatcgcccaaagatgccacaggtccaggcatttctggtgatcatgactcacacgctccccatgactttagcctacagaatttcctcagcagtacgtgcatttctcctgccaagctgaggccagggaactccgcacccctgcagcacaggcagtccctagcccgagtccctgtaatccaggtccctagcccaattcttacttgtcaaatataaaagcttcattctacaaccttgcatatttagggtaattaatagagaaagctcctcatgaacagaaaaaaacaaggacagatcatgcagaaaagcatgcttttgatctatgcctttggtcttctgatgagctcagagaattaatatttgcaaggcactcttgacaagctgaggcagaagcacaaattagtgtggttatgctaattgagaggttctgtagctccaggaccaaatgattacagaaagtgaaaagggttgactgggctttggtctctctgcaaatagcactgtgcttcatgctagctgcactgacaaatttgcaaggagactacacacatttactttcacatacccgaaattcccagtggagca

SEQ ID NO: 136590 - DNA, 601 bp, Human
tttctccctggggacaaggtccacagagtttccatcagactcctgggagacctatgatcttaaaaagctcaggaacctctgttccagttcaaggccctccaattatagagtggggttcagaggcccaggaaggaatcctggcttgccccagaggacatggtgtgtctgtggcagtgctaagctggttccctcttcatcgcccaaagatgccacaggtccaggcatttctggtgatcatgactcacacgctccccatgactttagcctacagaatttcctcagcagtacgtgcatttctccygccaagctgaggccagggaactccgcacccctgcagcacaggcagtccctagcccgagtccctgtaatccaggtccctagcccaattcttacttgtcaaatataaaagcttcattctacaaccttgcatatttagggtaattaatagagaaagctcctcatgaacagaaaaaaacaaggacagatcatgcagaaaagcatgcttttgatctatgcctttggtcttctgatgagctcagagaattaatatttgcaaggcactcttgacaagctgaggcagaagcacaaattagtgtggtta

SEQ ID NO: 136591 - DNA, 601 bp, Human
ctatttgatctttccaagaccccgggtatttgcgaattctcacttatcatatagtagtgggaatttacggcttggcagaaacatgtccacacataatgaatctttctccctggggacaaggtccacagagtttccatcagactcctgggagacctatgatcttaaaaagctcaggaacctctgttccagttcaaggccctccaattatagagtggggttcagaggcccaggaaggaatcctggcttgccccagaggacatggtgtgtctgtggcagtgctaagctggttccctcttcatcrcccaaagatgccacaggtccaggcatttctggtgatcatgactcacacgctccccatgactttagcctacagaatttcctcagcagtacgtgcatttctcctgccaagctgaggccagggaactccgcacccctgcagcacaggcagtccctagcccgagtccctgtaatccaggtccctagcccaattcttacttgtcaaatataaaagcttcattctacaaccttgcatatttagggtaattaatagagaaagctcctcatgaacagaaaaaaacaaggacagatcatgcagaaaagc

SEQ ID NO: 136592 - DNA, 601 bp, Human
tctatttgatctttccaagaccccgggtatttgcgaattctcacttatcatatagtagtgggaatttacggcttggcagaaacatgtccacacataatgaatctttctccctggggacaaggtccacagagtttccatcagactcctgggagacctatgatcttaaaaagctcaggaacctctgttccagttcaaggccctccaattatagagtggggttcagaggcccaggaaggaatcctggcttgccccagaggacatggtgtgtctgtggcagtgctaagctggttccctcttcatygcccaaagatgccacaggtccaggcatttctggtgatcatgactcacacgctccccatgactttagcctacagaatttcctcagcagtacgtgcatttctcctgccaagctgaggccagggaactccgcacccctgcagcacaggcagtccctagcccgagtccctgtaatccaggtccctagcccaattcttacttgtcaaatataaaagcttcattctacaaccttgcatatttagggtaattaatagagaaagctcctcatgaacagaaaaaaacaaggacagatcatgcagaaaag

SEQ ID NO: 136593 - DNA, 601 bp, Human
ccatttgtatatctcctttggagaaatgcctattcaagccctttgcccatttaaaaattgggttgtgttttttttttttttttgagacggagtcttgctctgtcacccaggctggagtgcagtggcgtgatctcggctcactgcaagctccacctcccaggttcatgccattctcctgcctcagcctcccgagtagctgggactacaggcgcgtgccaccatgcccagctaattttttgtattttttagtagagacggggtttcaccatgttagccaggatggtctcaatctcctgacctygtgattcacccgcctcagcctcccaaagtgctgggattacaggtgtgagccactgcacccggccaaaattgggttgttttttgttggtcctgtgccatctttgtctatttctagcaaacagacagatagtcagccaaggtcaaattctcacgcagataagcagttattatgtcaatgcaatagaatactactcagcaataaaaaggaatgaaccagtgataaaaaggacaacttgacgagtctcaaagtcagtacagagtaaaaggccgattacacactttatggttgtacttacacggt

SEQ ID NO: 136594 - DNA, 601 bp, Human
ttccctaatgatcagtgatgttgagcacattttgatgtgtttattagccatttgtatatctcctttggagaaatgcctattcaagccctttgcccatttaaaaattgggttgtgttttttttttttttttgagacggagtcttgctctgtcacccaggctggagtgcagtggcgtgatctcggctcactgcaagctccacctcccaggttcatgccattctcctgcctcagcctcccgagtagctgggactacaggcgcgtgccaccatgcccagctaattttttgtattttttagtagasacggggtttcaccatgttagccaggatggtctcaatctcctgacctcgtgattcacccgcctcagcctcccaaagtgctgggattacaggtgtgagccactgcacccggccaaaattgggttgttttttgttggtcctgtgccatctttgtctatttctagcaaacagacagatagtcagccaaggtcaaattctcacgcagataagcagttattatgtcaatgcaatagaatactactcagcaataaaaaggaatgaaccagtgataaaaaggacaacttgacgagtctcaaagtcagt

SEQ ID NO: 136595 - DNA, 601 bp, Human
gtgtgatcccagggctgatcagcacaggagttttgacctgctccacttctactctgtgccagttcaccccttgttaagcaacgtggtagtcccagaggttaacatattgatgctgaacttagtacagacaccaggtaggcatggtgcactacagcccagaactcctgggctcaagcaatccccctgcttcagtcccctccttagtccctgagtagctgggactacaggcgcacaccaccatgctcagctaattttctttttcggggtctcactctgtcacccaggccagagcgcagcagcrctatcagagctcactgcagtcttgaccttgcgggctaaagcaatcctcccacttcagccttctgagtagctgggactacaggcacgcaccactgcacccagctctgtttgtagttttgatttgcacttccctaatgatcagtgatgttgagcacattttgatgtgtttattagccatttgtatatctcctttggagaaatgcctattcaagccctttgcccatttaaaaattgggttgtgttttttttttttttttgagacggagtcttgctctgtcacccaggctggagtgcagtggcg

SEQ ID NO: 136596 - DNA, 601 bp, Human
ggagcttgcagtgagccgagatcacgccactgcactccagcctgggcgactgagcgagattccggctcagaaaaaaaaaagtccactcctgtcctaaaacaccaggattgttattttcagcatccacggcctggtaaatccaaggaaggctaaagatgattaaggaacttagaaagaaagcctacagcaactctgatggatgaaatgagttctgaccagcaatactgaaatctgccacaggaaatgtcaaggtccccccctaaagatcttgtgattctgttctcccttgttgcagaaagayggcctcatcctcccaagagacacacagatattggcaaaccctgtttaaaaacagcagccacagtctgttaattccatctgccttgtgcttacccatttatcataaaggatattacaaaggacacagatgaagagctgcactgggcagggcctgtgagaaggggcacggagcctccacatcctccccagctgtgctacctgttcagctatctgcaagctctattttctgagtttttgaaaacagccatcctcatgggtgtgagctggtatctccctgtggtaggtaggtatgtacttaggt

SEQ ID NO: 136597 - DNA, 601 bp, Human
ctgccaacagcgcacaagtgttcagattcccccacattctccacaacacttattttctgtggggtgtttttgttgtggtggcagtgattgttgctgtggaaagagtttgactgctttattatattttgccattaatattttataaaaagtagtgaaaatgagaaaatggaatagttgataccagtgaaaaacacaggtttcataaaatactactgccgagagaagacagaggtgagtggccatgccaaagctgtagatcttcatcctcactcaggtaactcatcggactgtgtgagtgtcyggctgacagtgtattgttaagatacaggtttgatattcaattttcagacatgctttcaggaaggccatatacacatacgaagtagcagactgcccatagggttcatgggaaaaaagtccactcggccgggcacggtggctcacgcctgtaatcccagcactttgggaggccgaggcaggtggatcacgaggccaggagattgagaccatcctggctaacacggtgaaaccctgtgtctaccaaaaatacaaaaaattagctgggcgtggtggcgggcgcctgtagtcccagctactcggg

SEQ ID NO: 136598 - DNA, 601 bp, Human
ataaataaataaataaataaaaattttaaaaagatatttaagattaaattatgtaattatataaacattgaaaaaactgtggtaaagtacacataacatttgccatcttaatcattttaaagtgattaccacttattaccacttcagtggtaataagtaacattcataatgtgccatcatcaccagcagccatctccataacttttctaccttgcaaaactgaaatagtccccattcctccctccttccagcccctggcagccacctcagcgcctttcggttgctataattttgtctagcrtaggcacctcacggtctagtggaatcatatggtacttgtctttttgtgactagcttattttacttagcataatgtcctcaaggttcatccacactggaacatgtcagaatgtccttcctttttaaggctgaataatattccatgtatgaacagcccacgttttctttatccattcacccatcagtggacacctgggtcacttccatcttttggctgttgtgaatgatgctgctacagagatggtacacaaaggtctcctcgagtccctgctttcccttcttttgcgtacacacccatagg

SEQ ID NO: 136599 - DNA, 601 bp, Human
tgccctggattaaaagcttcatgggctgggcatggtggctcccacctgtaatcccaacactttgggaggctgaggcgggaggattccttgagcccaggagtttgaggctgcagtgagccatgatcacaccactgcactccagcctggataacagagcaaaaccctatctctatttaaaaaacaaaacaaacaaacaaacaaaaacaacggggcggggggcaggcatggtggctcacgcctgtaatcccagcactttgggaggctgaggctggcagatcacttgacatcaggagtttgagascagcctagccaacatagtgaaaccctgtctctactaaaaatataacaattagccaggtgtggtggtacatgcctgtagccccagctactcaggatgctgaggcaggagaatcacttgaacccagcagacggaggctgcagtgagccgagatcacaccattgcacttcagcctgggtgacagagcgagactccgtctcaaataaataaataaataaataaaaattttaaaaagatatttaagattaaattatgtaattatataaacattgaaaaaactgtggtaaagtacacataacattt

SEQ ID NO: 136600 - DNA, 601 bp, Human
agtttttcacagcttcacttttgaaatcaaggtgcgttttataatccacctgctaatgtattttctcctttgtttcctgagaaacattaaatcgataacgccttacatgtcttatatgtgttggtgtcttagtgtcaaaaaaaaaccccaaggtaattggttatcacccagattcatagagagacgtgttaatgatactcgtgggaacagagaccctatcgtggccatctccaggtggcgctcccactcacacagcggtaccatgccacctaacagggcctgccaggctggaaaattcttrgagagggccttgatcttgcttttgcctagatcgtcctctcttttcccctcccccaagccagtgataccttctcaagaacgtggcgatagcctggaatcctgccaaacagctctggagtaagtgccatctgtgttgtcaactcagagagagtaagtgctgctgatggatccaggcagagccctcggagggaagccaatgcagagcttgagagtctttactaacagccgacatgagccaagcactaactacgcgccaagctatatcaccaccaggggctagagctcaactagacatttaggc

SEQ ID NO: 136601 - DNA, 601 bp, Human
aagccgggaagtgtgctcatccctccatctgtcacgcgctctgtcagcacggtgatcctcagggtaattttcctctggtgtccggatatctaactaagaggctagaagagaggtgcattgacaagcaaaaatccagagtccaacccttcagtctaaggcgaagtctcgtttggaggggtgtacttggacccagtcacagcaagctccatgagggcaggagacctgacttctttaccagtgttccaggcatctattgccaccaactgtatggaatagtcgccgaagaattcagctcgaagaygggtcagtggcttatactgtatctccctgattctaagtcacagacatttggccctctgtagccatgggttctgcatctgtggattcaaccaacctcaggcaaaaaaaaaaaatggatggttgtgtctgtaactgaaacacgtagacttttttcttgtcaatattccctaagtaagatggtatagcacctatttatatagcatttccactgtattaggtattgtaagtaatctagagataatttaaagcatatgggaggatgcataggttatctgcaagtactatgccattttgcatcagg

SEQ ID NO: 136602 - DNA, 601 bp, Human
tttcttgaaccaaaccatcccagattttgatgcttctaggagtgactggaacatgccaagtagcagatgcccatgggagaacggagccccagacaatcccaccgaccctcccgcagactccatggacttgacctgcattagaacaggctgtggacctgaagcagttctctcactgcaaacccagaccctctccagtgcgaatttgtggaacgcgatagatgttaatgattactccctcagtgttttctcatccaaatcaggacatttcgaagggggtagggaggactctgttaataatgaygccaggacagcaggcagaagccgggaagtgtgctcatccctccatctgtcacgcgctctgtcagcacggtgatcctcagggtaattttcctctggtgtccggatatctaactaagaggctagaagagaggtgcattgacaagcaaaaatccagagtccaacccttcagtctaaggcgaagtctcgtttggaggggtgtacttggacccagtcacagcaagctccatgagggcaggagacctgacttctttaccagtgttccaggcatctattgccaccaactgtatggaatagtcgccga

SEQ ID NO: 136603 - DNA, 601 bp, Human
acatcaagcttcttacctgtctttctggctgtttcctttaacctcctcccacagtatatcacttgcataaaaaatgaaacttcttagaaaaatcctatgcctgtatcttttccacagcaacagaaaaaaaaatctctgtccaagttaaccaagacaagtgtccctatataattatttttccaactttctctataaaacttaaattgacaaaaatactaatatcccttttatccattccaaagaataacaatttgagatttgatgtgatttttaccttaagataatgtgatctggttgttayatgtacatgtttatgtttcttgaaccaaaccatcccagattttgatgcttctaggagtgactggaacatgccaagtagcagatgcccatgggagaacggagccccagacaatcccaccgaccctcccgcagactccatggacttgacctgcattagaacaggctgtggacctgaagcagttctctcactgcaaacccagaccctctccagtgcgaatttgtggaacgcgatagatgttaatgattactccctcagtgttttctcatccaaatcaggacatttcgaagggggtagggagga

SEQ ID NO: 136604 - DNA, 601 bp, Human
ccacctggccccagatgaccctgtcagcaacacctgccaacatcacaggctgcaagttatcaatttgtcacaaacatcaagcttcttacctgtctttctggctgtttcctttaacctcctcccacagtatatcacttgcataaaaaatgaaacttcttagaaaaatcctatgcctgtatcttttccacagcaacagaaaaaaaaatctctgtccaagttaaccaagacaagtgtccctatataattatttttccaactttctctataaaacttaaattgacaaaaatactaatatcccttktatccattccaaagaataacaatttgagatttgatgtgatttttaccttaagataatgtgatctggttgttatatgtacatgtttatgtttcttgaaccaaaccatcccagattttgatgcttctaggagtgactggaacatgccaagtagcagatgcccatgggagaacggagccccagacaatcccaccgaccctcccgcagactccatggacttgacctgcattagaacaggctgtggacctgaagcagttctctcactgcaaacccagaccctctccagtgcgaatttgtggaacg

SEQ ID NO: 136605 - DNA, 601 bp, Human
cgaccacctggccccagatgaccctgtcagcaacacctgccaacatcacaggctgcaagttatcaatttgtcacaaacatcaagcttcttacctgtctttctggctgtttcctttaacctcctcccacagtatatcacttgcataaaaaatgaaacttcttagaaaaatcctatgcctgtatcttttccacagcaacagaaaaaaaaatctctgtccaagttaaccaagacaagtgtccctatataattatttttccaactttctctataaaacttaaattgacaaaaatactaatatccyttttatccattccaaagaataacaatttgagatttgatgtgatttttaccttaagataatgtgatctggttgttatatgtacatgtttatgtttcttgaaccaaaccatcccagattttgatgcttctaggagtgactggaacatgccaagtagcagatgcccatgggagaacggagccccagacaatcccaccgaccctcccgcagactccatggacttgacctgcattagaacaggctgtggacctgaagcagttctctcactgcaaacccagaccctctccagtgcgaatttgtgga

SEQ ID NO: 136606 - DNA, 601 bp, Human
aaaagaagcaaataggccaggcgcggtggctcacacctgtaatcctagcactctgggaggccaaggcaggcagattgcctgagctcaggagttcaagatcagtcttggcaacatggtccctgtctctattaaaaacacaagatattagcgaggcatggtggtgcatgcctgtaatcccagctaccggggaggctgaggcaggagaatcgcttgaacccaagaggttgcagtgagccaagactgcaccactgcactccagcctgtgcaacagagtgagactgtctcaaaaaaaaaaaaaaaaggctacatttaaagggggaaaaagagcgggggatgagggacagaaagtgatgcgcaccctatctgttattctgggcccagtggttagggctgacctctctgggtggcatctgaacaaagatgtgaggcagctagggatagggagcaaaggacacaggaagaggaactcatgtttgcccagttcttccaatcgagtactccccagcatgaactcaccaaaaccctaccgcaggatccatcttatcaatgagaaactgatttttaaaaggagatgggtgagcaacttttcccaagatcacat

SEQ ID NO: 136607 - DNA, 601 bp, Human
ctttcacaggaggctagaggccccaagtcactgactcccattgcagtgctctcccacagctagcccgccgacccacgtctgcaggggatgtgtcaacaactacatatgctggctcccatcccactggccactgctgctggatcccacacgaggctgcttctatccaggcaggcctagaaggacaatctacggaaatgaactgcaaagtcaccagcccatctttcttgtgcaacctaatctgcaaaacacaggggctcagaacctgtcccttgcttcagatttcaaggacccccccaatgakacagtttctggcttttcaagaagcttcatggatgaggctggttcactgaagggcaatcagggctcagcatccagccttctgaagaagctgtttacttgttgttctttacaaagtcaggacttggccaggaactaaacgtagccctcagtatgggaaagggagaaatttggaagacttggtggaaagtctaaatatgtaaggagaatgcttcttaaacccctgatgtggccaggcactatggctcatgcctgtaatcccagcactttgggaggcagaggtaggttgattacttgagcccag

SEQ ID NO: 136608 - DNA, 601 bp, Human
caacaaataccaacacggagcttggggagggtcggataacatgcacgaagaatcacttagttatcccggtgatcagtgctaaattcagggtgggggacgcatgtctagcagggcgacctaatctaagctggaagtcagggaagggtgagacttgaaggatgagcagagctggaccaggcaaaggggcagtgtgtatgaaagccctgtgtagctggaggtatgtgcccaggggaaggccgggggtcagatgggacagggccttatagatccagggctttgtctcatgggctttgggggttcytaaggtgccggcaaaccacgtgttcattcttctgggaagagaggtctatggctttcaccaaagtcttaaggagtttcaagaggttaagaatggccgggcacggtggctcacgtctgtacttaggatcccagcactttgggaggccaaggtgggcagatcacaaggtcaggagatagagaccatcctggccaagatggtgaaaccccatctctactgaaaatacaaaaattacctgagcatggtggtgagcacctgtactcccaagctactcgggaggctgaggcagaagaatcacttgaa

SEQ ID NO: 136609 - DNA, 601 bp, Human
tgtgggaatgttccaagtgtgagttccagctcagcccagaatataaacaaaagcgatgaccagcctggaggtcaggcctagcaaagcactgaggcagaaagtctgggaggcactcttctgtcttctggggtcctctagactctgccttttttttttttttttttttgagacagtctccctctgttgtccaggttggagtgcagtggtgcaatcacagctcactgcagcctccaactgctgggctcaagcaatcctcctgtctcagcctcctgactagctgggactatacgcacttgccacsatgcctggttaattagtaaaattattttttgtagagatagcatcttgcttggttgccaggctggtctcaaactcatggcctcaggtgatcctcgagcctcagcctcccaaagtgctggaattataggcatgagccaccgagtctggccgagactgctttgaagtaactttcctgtccaggcctggaggaaatcatcgaaggcaaaggccaccacgtgtcgaatgtcataggaaatacaagctcagggactctcttatgacacatctgcaaacttatagatcagtctcagaatgtcatagc

SEQ ID NO: 136610 - DNA, 601 bp, Human
ggctgggctctcaggcgggtacccggtagctcacacaaagctttgtgtatggaatttgtctgctgggaggaaagtctgatgttggtcacttccctcctggagaaaaatacaacaatacgaggaagcgccaagcactgtgggaatgttccaagtgtgagttccagctcagcccagaatataaacaaaagcgatgaccagcctggaggtcaggcctagcaaagcactgaggcagaaagtctgggaggcactcttctgtcttctggggtcctctagactctgccttttttttttttttttttttgagacagtctccctctgttgtccaggttggagtgcagtggtgcaatcacagctcactgcagcctccaactgctgggctcaagcaatcctcctgtctcagcctcctgactagctgggactatacgcacttgccaccatgcctggttaattagtaaaattattttttgtagagatagcatcttgcttggttgccaggctggtctcaaactcatggcctcaggtgatcctcgagcctcagcctcccaaagtgctggaattataggcatgagccaccgagtctggccgagactgctttgaagta

SEQ ID NO: 136611 - DNA, 601 bp, Human
atagctgtcactgtttttattattattacctataaatctccaagctttagatacaatacattgaaaaaaattatttaccctcactagggattttctcccccatatcagagtaagatccactgcaatattctagtaaataatcattctcttagtataattaaaataaaatttatcttacaaacatctgtacctcaggaataatttttttttttaagagacagggtctccctatattgcccaggtggcctcaaactcctaggctcaagtgatcctcctgcctcagcctcccgagtagctggaytccaggaggaatgatattttgattgtggaacatgacataagccagaggggtaatattgtggccactgaagtaggaaacattttaaggagtgcctgtccctacacgcaagacgctgttggctccagacgaactctgagtcaggatcctgcaaggcggtgctcacttcttgaaggagatttttttttttttttagatagaaatggctcagaagggaagggctcgtggatccctgtaatgtgcacactcacccacccagaaccaaagaaacagaggctgggctctcaggcgggtacccggtag

SEQ ID NO: 136612 - DNA, 601 bp, Human
cacagggaacccccaccacgcgagaggggtccagtgaaaactaacagttgcacagcagaatacctggcacacagtaggtgcttaataactctctgttgaataaatgagtggataggtgacagaataaaccaatgagaattatccccaacatacacacactgattgtccccaccccctggaatgcattaaccagagtttctaatccataaacaacctctcctctcctagcaagagtcagagggtatgggcggctggggcgctgtttcctccacttccccactccttagctcaggccactccrggccctggaatttcttccctatcaggagtgcgaagcccctgaagtcaggagccgtgtctggggcagctcctcctggcgcctgtgcacacagacaacaatgggtcacagttacagaacctgggctcaggtgtgccctctctcgtttctcagctgggggccaacacatttgtaactgtgtttccatgaaaaaacgcatcctaggttccaaacaactaatatactgatgaacctttagaatgaactggacatttttccttgagagaacagctttgaaatgaggaccctgtggtccaacccttc

SEQ ID NO: 136613 - DNA, 601 bp, Human
gcacagggaacccccaccacgcgagaggggtccagtgaaaactaacagttgcacagcagaatacctggcacacagtaggtgcttaataactctctgttgaataaatgagtggataggtgacagaataaaccaatgagaattatccccaacatacacacactgattgtccccaccccctggaatgcattaaccagagtttctaatccataaacaacctctcctctcctagcaagagtcagagggtatgggcggctggggcgctgtttcctccacttccccactccttagctcaggccactcygggccctggaatttcttccctatcaggagtgcgaagcccctgaagtcaggagccgtgtctggggcagctcctcctggcgcctgtgcacacagacaacaatgggtcacagttacagaacctgggctcaggtgtgccctctctcgtttctcagctgggggccaacacatttgtaactgtgtttccatgaaaaaacgcatcctaggttccaaacaactaatatactgatgaacctttagaatgaactggacatttttccttgagagaacagctttgaaatgaggaccctgtggtccaaccctt

SEQ ID NO: 136614 - DNA, 601 bp, Human
gaatagctggattacaggtgtgcgccaccacacccagctaatttgtgtatttttagtcgagatgggggatctgccacgttggccaggctggtctcaaactcctcacctcaagtgatccgcccgcctcggcctcccaaagtgctgggattacaggcgtgagccaccacgcccagcccttcatcacttttataattgtagacggaaaatacattagcttaggtggcagatatctggcttcggtcaatttagtcaaaagcaccaaagtaaatttattttacagagttggatggtacaaaatggragcaagtatagaaccggagtaatatttgggacaacattccaaaaaagacccacagaaccagagagaccaagtttaagaggcacttaatgctctgttaagtttctgggcgcagtgggccactgtgttaaaccaggcccttcctttctgaaggaaggggaaataatctttccaatttatgcaaaacagacaaaaaccaaaatccaaatctctacaagatcttaaggcctcataattgatctaccaatacagagatcatttttgcaaaatcacggcctgagagtccaaacttggcaaagcaaa

SEQ ID NO: 136615 - DNA, 601 bp, Human
agtctcactctgtcacccaggcaggagtgcagtggtgcaatctcagctcactgcaacctctgcttcctaagctcaagtgattctcttgcctcagcctcctgaatagctggattacaggtgtgcgccaccacacccagctaatttgtgtatttttagtcgagatgggggatctgccacgttggccaggctggtctcaaactcctcacctcaagtgatccgcccgcctcggcctcccaaagtgctgggattacaggcgtgagccaccacgcccagcccttcatcacttttataattgtagacrgaaaatacattagcttaggtggcagatatctggcttcggtcaatttagtcaaaagcaccaaagtaaatttattttacagagttggatggtacaaaatgggagcaagtatagaaccggagtaatatttgggacaacattccaaaaaagacccacagaaccagagagaccaagtttaagaggcacttaatgctctgttaagtttctgggcgcagtgggccactgtgttaaaccaggcccttcctttctgaaggaaggggaaataatctttccaatttatgcaaaacagacaaaaaccaaaat

SEQ ID NO: 136616 - DNA, 601 bp, Human
tgctaaggagtaccctttccaaagtaacatgttagacaaaagaatgactcacagaaagtcagaagggctggaacctgacagtaaattagcatcccacctactttctttttaagagaaaatgatctatcatttgacaaacagcaactgctcttaatatttccatgcattttcttccagttatttgttttcttttcataaacacacccatatatgcagttgtgaaaaaactgtcttgctactgatcaaatgctaccgcaacttcttctggcaagaggaggcaaagacctggtgaagtctcgcrtatgtcatctctggcatgcctgccagccggccggtctcctgggtcaataactgtgataaaaggccgctgagtgcgtcaacagactgtcctgcactgagacactattaaaggtccttgagctccaaatgtaccactgcactgctctgtggccctgccaacttcctcctcctcaagctgacatgaccccaagccctagagagacagagtaggtgttaagagaggctgttgtcccacttcctgggtgtccaggatggataaatgaaagattttacagaaagtaccttgaaagtactttggaac

SEQ ID NO: 136617 - DNA, 601 bp, Human
tgaaaaacggcttttccttctgagatggactttggaccgcagtccccgggtctatcagcccaaacaaataaaaccctatgcgccaaagatgtgctcctggtcagtggggcctgtgaaggcttaaaaaccagaactgctctgttctcttctttaatctccaattcactgtggatcttgaaatccctactaccaacagtggtcctaccactcttctcatttaaattactgaacacaactaaacaaaaccacaaaataaaacatcaaacctgtctgtctgtatacccagctgcttccaatgaamatcttcagacattttaactcatggttttctaaggagaaccagagacaatccaaacgtaagtaaacatattaaatttctattctaaaagtggtgcttttaagtagttggatcaatgctgattttctcctggctggctggagacaccagcccacacggtgctgaattcagaagagtaccgcatcttggtctgcttcagtaaataccggtgtctgctaaggcccattctgaagacactgtactatgtatgacacagtcagaactggttctttattttaatgtgtaaaaatacatgaaagaaag

SEQ ID NO: 136618 - DNA, 601 bp, Human
tgttctgcctctgcggcttttcaactccccaggtgtaggacatggaaacacacgtaaatgatctaaatggcagataacagtttcctttaaatttgcctttggaatgcactctgggcctgcccttcctaatcatgatcatctttggctctggttaaagtcttattctccagagctcctaacacaggggaatccgggcagaaatcaggggccgcctggtctgtcccaactgtctgtagcaaatccacataacgatatgcccaggattcccattcacttgttcctaaactagacacagaccatsctactttgccctggaacctggggccatcatccacccaccaagatttcacaaccacgttgaatgtgggctgcagatcagggtcatggtggtgccctgacattcttcttctttttttttttgaaacaggggttttgctctgtcacccaggctggagtgcaatggtgcaatcttgactcactgcaacctccgcctcctaggttcaagcaatcctcccacctcagcctcctgagtagctgggactacttgcgcgcgccaccatgcctggttaattttttgtatttttggtagagatggggtttc

SEQ ID NO: 136619 - DNA, 601 bp, Human
cctcaaactcactctgtacccacacagccccaatcatcccccacaatctgtgccactgaagctctcctgcttcgaaagtcaaccttccgatgctcaggagaaaaccactggggtcgtcctagactactctttctctctttcaccccatactcaacccctcagtaaatcccactggctctcccttccaagtccttacagtcatctcaaggcctggcttcatctgccatgggtctccagcctccgccctagtcacacattcccaggtcagggcctctgcgccacctcttccttttccggagcrcgcctgcccagacatctgcaacacacaggattctgctccttatttctgatcactctccctttccatcacatgtaaaactaacaaccctcttcccctgtccatcctgtccccttccctggctcctctatatgatacctgtcatccaaaagcctacatattatacttgttcatatgtaaactaaaaactccagagggcagagatgtcttattttcctcattaggtatcccccgtgcctggaacagtggagacacaggacctgttcaataaacatttgttggatgaatgaacatccaatcaat

SEQ ID NO: 136620 - DNA, 601 bp, Human
gcctcctcctcaggaacactttctgcagttggcttctgaacaccagtctcctgctttccccctaccttcctggaaggtctttcgaggtttctgctggtgctccctcatctcctccacctcctaatgctggagtgctctggggctcaggctttggcccctgctcttctctgacttacttgctggtatctcacccagtctcatagctttaaacaccatctttatgtcaacaactctcaaaaaagcctacacttcttttctgaactccagatttttatactccagattttaatggcctaatggmcacctccttgtagatctctgacaggcacctcaaactcactctgtacccacacagccccaatcatcccccacaatctgtgccactgaagctctcctgcttcgaaagtcaaccttccgatgctcaggagaaaaccactggggtcgtcctagactactctttctctctttcaccccatactcaacccctcagtaaatcccactggctctcccttccaagtccttacagtcatctcaaggcctggcttcatctgccatgggtctccagcctccgccctagtcacacattcccaggtcagggcct

SEQ ID NO: 136621 - DNA, 601 bp, Human
caatgcaccacagctgataatcaggacttctctctcgtccggcaattctcctggtcttgagcgatgtttccatctctaccaggtcattcccatcagcattcaaccttgccattatttcaccctttatgaaaaaactttcccttgaccgcaatacccttaacaactaccaccttgtgtcttcactcccgctttcagcaaaactccaagaacgcccatgctccctgtggccaattctcctctgctcattctttgacactttcacacccaacactccactgacacttttttttttttttttttyctgaggtgcagttttgctcttgttgcccaggctggagtgcaatggcgtgatcttggctcactgcaacctctgcttcccaggttcaagtgattctcctgcctcagcctcctgaatagcagggattacaggcatgtgccaccatgcctggctaattttgtatttttactaaagacagggtttctccatgttggtcaagctggtctcaaactcccgaccttaggtgatccgcccgcctcggcctcccaaagtgctgggattacaggcatgaggcactgcgcctggccccactgacacctcttg

SEQ ID NO: 136622 - DNA, 601 bp, Human
gcaaggactgtaaatactcaatgcaccacagctgataatcaggacttctctctcgtccggcaattctcctggtcttgagcgatgtttccatctctaccaggtcattcccatcagcattcaaccttgccattatttcaccctttatgaaaaaactttcccttgaccgcaatacccttaacaactaccaccttgtgtcttcactcccgctttcagcaaaactccaagaacgcccatgctccctgtggccaattctcctctgctcattctttgacactttcacacccaacactccactgacactttttttttttttttttttctgaggtgcagttttgctcttgttgcccaggctggagtgcaatggcgtgatcttggctcactgcaacctctgcttcccaggttcaagtgattctcctgcctcagcctcctgaatagcagggattacaggcatgtgccaccatgcctggctaattttgtatttttactaaagacagggtttctccatgttggtcaagctggtctcaaactcccgaccttaggtgatccgcccgcctcggcctcccaaagtgctgggattacaggcatgaggcactgcgcctgg

SEQ ID NO: 136623 - DNA, 601 bp, Human
aagaactcttgtgatgattgaaagcaacatgcttagctcacagacagctgtgacaaattgtttgcagtaatggccaaacgattccctgctcctcatacccacagcttggcaagatgactttgcactctcctgttagaagggcgggtagaaggagggggcaggtctctctctcccttccccttgaatctgggctggcctgtggcctgctttagccaatgaaataaagtagaggtaactgtgcggcttctgacctggggcctcagggctgccccccttccccgaccaggtgagcaaccccacyacgggagggaccctgggctagcctgctggaggcccagggataagccctcccagcagctgattgtagacacttgaggaaccctaggcaagaccaggagcccagcagcccagcctgaactgccagctgcagaagtgtaaactaggtgcccagttgttatttaagctccctaaatagcggggtgatttgtcagcaaggactgtaaatactcaatgcaccacagctgataatcaggacttctctctcgtccggcaattctcctggtcttgagcgatgtttccatctctaccaggtcattcccat

SEQ ID NO: 136624 - DNA, 601 bp, Human
tgctaaggcaggtgtaattagttgccttcattttacagatgagcaaattgaggctgacggaaattaagtaatttcccctggattacactgatacataagtagcggggctattttctcttagcaaactacataaaaaaataaagagcaactctgcatcctgaatgtcatgcctgagatgagcttgctgaaagcgcagcagagacagcagccctctgctggcccaggcttctcctccatcccttctcgctccctcccttcctcacactcagctggctgggatcccaacccagggactccaagragggcccagctccgggctccctatgtaagcaaggtcacagagacttgaaatgggtgattgaacctaattactcactgctctgctccctctatccaaagagagcttgaaaacattttcactgaggtctttgctgagattgcagactcagcacaggacctgcctcctgctttcctaaatgagcgaagtggcttgcagcggctctagctctggggccaacaaggttttgacgcttgaattaggagagggcagagagaaggctgcagctcttgcagcaaaatgcagggctgtcaggtatacacc

SEQ ID NO: 136625 - DNA, 601 bp, Human
ggtatatctcctaatgctatcccttccccctccccccacccacaacaggcccccgtgtgtgatgttccccttcctgtgtccatgtgttctcattgttcacgcactttctttacatgcaactcactaacggataatgttgactgtctattgtgtattttcacctactagcaatataggtttcatgaggatatctgtaacccaagtggctaaaacaatgcctggcatgcagcacatgtctaatcaatgttcattagataaatgcatgaacgtgcttcttctgagttaccactctctcataatycggaagcacacagggactgcctggttccaattctgtagattctttagctcaaatccccgccaatgattagaatgcttccctgtgtccggtttcaaattcctgaggcagaaccaattgacccggcttgtcttcccaaagcaggccacacgatagaggtcaatggtagctacccatggatgagccatttagtgtagaagggcctcttggcacaaccgaaaaagagcaaagccatctgaagctattcagtgtggaagcaaaagctctccccagattgcaagcgcactgctgtgttacagcaga

SEQ ID NO: 136626 - DNA, 601 bp, Human
gcctggcatgcctgtgccccaggtttatctgcttggccaactgcttcaccttctcaagactggacgcagatatcacctttcaatgaggccaccccggacactctctttagctctgcaacctgaccccatgatccctggaattcctgatgcccccttatcctccttcctacagcactcatcaccttcacactttcttttttttttttttttatactttaagttttagggtacatgtgcacaacgtgcaggttagttacatttgtatacatgtgccatgttggtgtgctgcacccattaactygtcatttaacattaggtatatctcctaatgctatcccttccccctccccccacccacaacaggcccccgtgtgtgatgttccccttcctgtgtccatgtgttctcattgttcacgcactttctttacatgcaactcactaacggataatgttgactgtctattgtgtattttcacctactagcaatataggtttcatgaggatatctgtaacccaagtggctaaaacaatgcctggcatgcagcacatgtctaatcaatgttcattagataaatgcatgaacgtgcttcttctgagttac

SEQ ID NO: 136627 - DNA, 601 bp, Human
ttgacacagagtaggtgctcaaaggtttgttaaaatgaaacagaaatgtaatcttgcaatgaacccaaggctggcacgctctcgctcactctgctgcagtcacactagattcgtgctgttccttcaatacctaccaggtccccctgcctggcatgcctgtgccccaggtttatctgcttggccaactgcttcaccttctcaagactggacgcagatatcacctttcaatgaggccaccccggacactctctttagctctgcaacctgaccccatgatccctggaattcctgatgccccctgatcctccttcctacagcactcatcaccttcacactttcttttttttttttttttatactttaagttttagggtacatgtgcacaacgtgcaggttagttacatttgtatacatgtgccatgttggtgtgctgcacccattaactcgtcatttaacattaggtatatctcctaatgctatcccttccccctccccccacccacaacaggcccccgtgtgtgatgttccccttcctgtgtccatgtgttctcattgttcacgcactttctttacatgcaactcactaacggataatgttgac

SEQ ID NO: 136628 - DNA, 601 bp, Human
tctggctggaataatggaaactccaagaaatgcatgataatgaggacacccatgaatgacgtgttaagatttaaaccccaaaataatgatgacggagtagtgctgatgccctaagttttggtcacactgtctcctaggtgagagcatgacaaaaagggagaaattgttaaattaaatttataggaggtcattggtttgaactgagctcctgcaatatgcccaatagaccaaaccaaaatggtgtcactcacgctcaagttccataccactaagccaaaataagatttttatctgaccttcmgagaaatcaggagagagagagaatagccaaatccccaaacaggccagttgtagctggcatgataagaaagtcccctctgctttaacctttataagaaaagtaactctgaaacaaccaatctgctttttattttctgtttctgctttcctcagtccttttctttctataaaaccaacctcctctgcttggcccatcagaacactcaattctattcaagtgtttctcaattctggaatcacaagtaaaagccaattcaggtctttacattgttgtaatgttgtcttttgacaatacctttcc

SEQ ID NO: 136629 - DNA, 601 bp, Human
aagttccagcaaagcaaactttgtgatcaatcactagcattactgcagttgtgtaaataatcaggccaagtttgacgagactaagctcattttgcaaaaaaattcacctcgctttatctttagtagaaatgagggtgactgtagagagaaaaactatgtttcagaagaaaaactatagtacacctgttattagattgtagccctgttcgttgtttttgagtttttactatttgtaggctggaacggatccagaattcttctactttcctatttggaaacatctggctacaactctccaaawacacacaagaactgctctgtcccagaagccctacaagctggagcttgacaactccatgtatattatgagggacaggtctcatacctgatatgtgggccacagagagttcacccaaacaccggacgttataatcacaggcagtcaaactgcaaaccaggacaagctgacaacttcatgctgtggacagcttttcccaagacatcagaacaagattctttatcataatgaggctctgactcctcttgatttttccttgcttatgcctacctttttcacttggcaggataatgctacattgcc

SEQ ID NO: 136630 - DNA, 601 bp, Human
gaaaggaaaatgagccacagccaggtctcttgacctttccaaggttagttcgtgcacagttacctgcctgggcagaggtgcttagaggagatatgctggagatgccgtgccagatgaaagggagacctctctcaaggtggagaattgtccctccaagtcactccctttaaaagcccccaaatcccacaagttaagaacttcaggaagaactgaagtcaattattccgagtctgtgaacacctccagtcaatggtttacactctggtgttgaataaaagaaccacaattcactgtttatacrtaaaccaaataaacagcaacaagtgtcctgtatttcttatctcagtggatgttaactacccattaacataagccaggaacctggtggcatccttgactcactttatactgctaaataaaacgtacaagggcctacatttctggcactcagctggctactttgaaactctgtaagaaatttacatctataaaggaaatctccattttgtaagggatctgcctctctgcaccctgaatcactagaaactattacaatgaagaaggcaagactcaaatctaaataacaagcctgtggctgggt

SEQ ID NO: 136631 - DNA, 601 bp, Human
catagaattcccattcactcctccccaaaagtctgttctcaactgagcatgttttccttagatttcattgtttaaaatgcctcaagagtaaggtggtccttggcttttaatgggaagaagcaaaggaaacgcatggaggcaatgcagccacttgtacaaccagcctcctgtgattcctttagaactcagagcagcccctaggttggtgccaaggaggacaagtttaaatgtagctgaaaacactaaatgcttaatcttctctctcaccacgccacacatcccaggatcctccacccccatrccttaaaaaaatcaattttcatataatgttctatataaatgggaaattaacctgtcaatcttgatactccaccatcacatgggtctcaatagtttaataacaaaaccctatgggctgtgaggaacaagtgtgttacccacgtgaagatacacagcatagcaattcttctgtaaatcatgtgagttgctcatggatggaggcttcccggaacctctgaatgagaagcattttcattaggagcccaagtacccaagaaaagaaaggaaaatgagccacagccaggtctcttgacctttccaa

SEQ ID NO: 136632 - DNA, 601 bp, Human
tactgagattacaggcgtgagccatcgcacccggccttgcatagaattcccattcactcctccccaaaagtctgttctcaactgagcatgttttccttagatttcattgtttaaaatgcctcaagagtaaggtggtccttggcttttaatgggaagaagcaaaggaaacgcatggaggcaatgcagccacttgtacaaccagcctcctgtgattcctttagaactcagagcagcccctaggttggtgccaaggaggacaagtttaaatgtagctgaaaacactaaatgcttaatcttctckctcaccacgccacacatcccaggatcctccacccccatgccttaaaaaaatcaattttcatataatgttctatataaatgggaaattaacctgtcaatcttgatactccaccatcacatgggtctcaatagtttaataacaaaaccctatgggctgtgaggaacaagtgtgttacccacgtgaagatacacagcatagcaattcttctgtaaatcatgtgagttgctcatggatggaggcttcccggaacctctgaatgagaagcattttcattaggagcccaagtacccaagaaaagaa

SEQ ID NO: 136633 - DNA, 601 bp, Human
tcaaactcctggcctcaagtgatccgcctgcctcagcctcccacagtactgagattacaggcgtgagccatcgcacccggccttgcatagaattcccattcactcctccccaaaagtctgttctcaactgagcatgttttccttagatttcattgtttaaaatgcctcaagagtaaggtggtccttggcttttaatgggaagaagcaaaggaaacgcatggaggcaatgcagccacttgtacaaccagcctcctgtgattcctttagaactcagagcagcccctaggttggtgccaaggargacaagtttaaatgtagctgaaaacactaaatgcttaatcttctctctcaccacgccacacatcccaggatcctccacccccatgccttaaaaaaatcaattttcatataatgttctatataaatgggaaattaacctgtcaatcttgatactccaccatcacatgggtctcaatagtttaataacaaaaccctatgggctgtgaggaacaagtgtgttacccacgtgaagatacacagcatagcaattcttctgtaaatcatgtgagttgctcatggatggaggcttcccggaacctct

SEQ ID NO: 136634 - DNA, 601 bp, Human
cgatctgtgccataaggacatgctcctgctgcagttaactagcccaacctattcctttaatttggcccatcccttcgtttcccataagggatacttttagttaatttaatatctacggaaacaatgctaatgactggcttgctgttaataaacacgtgggtaaatctctgttcagggctctcagctctgaaggctgtgagacccctgatttcccacttcacacctctatatttctgtgtgtgtgtctttaattcctctagcgccgctgggttagggtctccccgacctagctggtcttggyagaggggcatatagtggagtatggagaaaactcaggcgaattcagctacgtgcatttggacaaacagagaggcagggcagggcaaggaggaaggagacacattttaggcaaatcactctccaatttagtcagagcatatgatgccaggtgagggtcagatggagaggcgaggtgactgcttcttcagttccttcatgcgttctggggtgtgaatatctcacctcactgatacgattctggtgtttaaaggtaacaattttctttttacaacgtagtacctgaatataaaacgaattcctt

SEQ ID NO: 136635 - DNA, 601 bp, Human
gaggaagagattccgggaggatcccaaggacccctcagttgcagccatgtcgagactgatgctgaggaggaccccaactgtcatgagcaacacccgtcgaacacagccacccacctggggacagatcaagaagctgtcacagatggtggaagaaaacctgaggaaagcgggacaaccagtcacaacaagtaatttaatggtagctatgatagaggttatcaccactgccgtgagtattccttcaacaagggctgacacagagaacaattatacttactggacatatttatctagtaacccrttaaaatggataaaaacacttggaagctctgtgatttcaatgatgattgtgcttttaatctgtgttgtctttgtacagtctgcagatgtggatcctgactcctgcgagaagtagctcaccgcgacaaagctgcccttgcttttatggatttgcaaatcaaagaaggcggacatgttgggagcaggccccccaaaatctggccataaactggccccaaaactggccataaacaatctctgcagcactgggacattttcatgatggccataatgcccacgctggaaggttgtgggttcacgg

SEQ ID NO: 136636 - DNA, 601 bp, Human
gagagttagttatattggggttcaatatgcttaactgtgtgtcacaatgacaactcattgtcttaccacttttttctactgaatcacgacatcattttagctttccattggcagaagtgcctcatccacattattaagcctggctctgctcttttttcatcagcctgtccactgcaattgaaggaggagaggagtgttgggagcaggccccccaaaatctggccataaattggccccaaaactggccataaacggaatctctgcagcactgtgacatgttcatgatggccataatgcccaygctggaaggttgtgggtttacgggaatgagggcaaggaacacctggcccacccagggcagaaaaccactaaaggcattcttaagccacgaacaatagcatgagagatctgtgccttaaggacatgctcctgctgcagttaactagcccaacctattcctttaatttggcccatccctttgtttcccataagggatacctttagctaatttagtatctatagaaacaatgctaatgactggcttgctgttaataaacacgtgggtaaatctctgttcagggctctcagctctgaagactgt

SEQ ID NO: 136637 - DNA, 601 bp, Human
cattcaagttgcccactcggggtgtgggcaaaagaactgatttccttggagctgtaggactaaggtccccagcttcttgttggatataggcaggaggccaccttcagctccctgccacaggggcctcttcctcaaagctagccaggaagaatggccccagagggagtcagctggcaagaggagttagaagtgggaagcgagtcacaggccacatccaactccaggtgagacaatgagacaaaggcgtcaactccaggaggcaagaatcctaggggtcaccttaaagtctgtctgccatacrcatctagctcctttacaactataaaatcaaagcacatttataactaaacgcaactaaaactcccatccccaaattttgattaacagtgcacactgatggacaataaggacaatgtcttcttgagactgcacagtcagttccaatgtgaatccagtgtagagagttagttatattggggttcaatatgcttaactgtgtgtcacaatgacaactcattgtcttaccacttttttctactgaatcacgacatcattttagctttccattggcagaagtgcctcatccacattattaagcctg

SEQ ID NO: 136638 - DNA, 601 bp, Human
ttttataacattaaataagtaccagtaacaacttgtgtaagtcctgaaatgtttcgtattgccgcataatgaagtacacaaacttagtggcttccaacacacatttatcctctaccagcttctgtgggtcaggggtccgggtccacgcacagtttagctgggtccctgaaaggctgcaatgagggtactacgcagcggggactccgccagggaagggtcttcattcaagttgcccactcggggtgtgggcaaaagaactgatttccttggagctgtaggactaaggtccccagcttcttgytggatataggcaggaggccaccttcagctccctgccacaggggcctcttcctcaaagctagccaggaagaatggccccagagggagtcagctggcaagaggagttagaagtgggaagcgagtcacaggccacatccaactccaggtgagacaatgagacaaaggcgtcaactccaggaggcaagaatcctaggggtcaccttaaagtctgtctgccatacgcatctagctcctttacaactataaaatcaaagcacatttataactaaacgcaactaaaactcccatccccaaattttga

SEQ ID NO: 136639 - DNA, 601 bp, Human
tgatctgacttggctcagatttttataacattaaataagtaccagtaacaacttgtgtaagtcctgaaatgtttcgtattgccgcataatgaagtacacaaacttagtggcttccaacacacatttatcctctaccagcttctgtgggtcaggggtccgggtccacgcacagtttagctgggtccctgaaaggctgcaatgagggtactacgcagcggggactccgccagggaagggtcttcattcaagttgcccactcggggtgtgggcaaaagaactgatttccttggagctgtaggamtaaggtccccagcttcttgttggatataggcaggaggccaccttcagctccctgccacaggggcctcttcctcaaagctagccaggaagaatggccccagagggagtcagctggcaagaggagttagaagtgggaagcgagtcacaggccacatccaactccaggtgagacaatgagacaaaggcgtcaactccaggaggcaagaatcctaggggtcaccttaaagtctgtctgccatacgcatctagctcctttacaactataaaatcaaagcacatttataactaaacgcaactaaaa

SEQ ID NO: 136640 - DNA, 601 bp, Human
tctgcatcaatcccacaaagattcactccaggccagaactaaattctcctaagtcaaaactacatcatgggatttgacccttttgagtagaagcagaaatcagagttctcacccagagcacaggtcaacaagctcttgtctgcactagttaaaacaactcacctaataattaatagaacatactcacagctgtttctgcttagaatcgaggtcaacgcaaaccacggagctaatgtgcaaagttacaaagcaattcctcccctaatggtaggtatttatttagaaaacactaagcacacarcaaatgagacactttaaaagcaaacagagtcagaagcttagaactcaagatttactgcaactgagttgtattcgtttggttctaagtttcctagtggcaaaggtaaaaaggtaaataagataggttttgtccattaaaagaaagtaaataaactcaacagaagagggacttttcctagcacaacattctagaaggaatttcaagaagaatgtaaagtaactttgaatctggtcttcaactttgcttttacaagatctatgatgttcttcaaataacaatttaatattttcactctacaaa

SEQ ID NO: 136641 - DNA, 601 bp, Human
ttcccagcgcaccctgaggaaaggggcaagggctgtgaggaagtgaagggtccctcaagtgtgctcccctcaccccaatctcagtgcccaccatgggacatgggaatcacctgtgtgggggactgagtccccttcaaggcagctgagccccaagcaccccggctgtgctaagatctccaagatgggcaagaaaatctggggacacaactgccaaacaatgagaaaacttaacttggctcccagcccaaccacgtcctttgatgggtagcagatgccacaaagagtggctggtgcagctaayacatacctggaacgacacctcctgtcctcttgttctgttccaaggttgtcaggctgggacgaaatcccaagaaagaaatgggcatgtggtcactaccatagcagactgccagttagggacatcagaatatatttctctgtcctcaagttaggaagtgagaggacaaacctggccttctgtgttgtttcagccactaattggttttgtcaattaggcaaaacataatttctctaagcctcttttctcatccacaggcattagcctagtcagcggttctcaaagtgtggtcctgaaccaaca

SEQ ID NO: 136642 - DNA, 601 bp, Human
atggtccccaacaggctgagaagccaaacacccacaagccaccttccactaagagacgaattaccaatgtactggtggtcctgatgtctagataaaaatgaattccccaaccatgtcttacagcaaattgccacaaggcaaaatccaaagtaagcacacaccattatcctgcccctgtaccaggaaagcccccagggaatgaaggtagagaagaggaatttaaggcaagggttagtcaggagctagtctacttcttgctcctcaaaagatagcctgtaatttactgagcacttactatacrccagccctgacaggcagacattaattgccattttgcagatgaagaaactaaagctcagagaaaagaactaggtgcaaagtcacagcatgattgggaaacagcctgaactcgaactgctcagtttgacaaaaactcagtcttttttttttttttaatctcgccctgtggcccaggctggagtgtagtggcatggtcgtagctcactacagccttgaactcctgggctcaagtgatccttccaccttggcctctcaaagtgctgggattataggctggcctcacagtcttaatcatgacaat

SEQ ID NO: 136643 - DNA, 601 bp, Human
atgacggcatcagtgtcacatgggagggggtctggatgccagctctttagccctggtgcaaacctaagaatctgatgaactggggtctctggggaagggacccaggacactgggcttcaacaggtgggcctgcagtgctggagtgtgagaagcactgtttcagaagacaaaggtctgagggaaccggttgagctattaagattttccacatcttgggccaaagacggggaggggctgatgactagcccagcacagcccagggcacatgggaagtgacaggcagatgggaccctttgacttygacagcaggggaagttctaatctcatctcagatcagaacattccttaggataagcccctcctggttgggaaacaaatctgtaaatgctgaacctggaaaaggcccgtgtagggtaagagggggtgaccaccagttccagccaccaaattccaactaagcagtcacccctaccaaggaaatttagctgaatcaggctcttctggtaaaaggctcagagcaccagtcagccagtatctcctgaagccctactgcgtgtgtggagtgacagacataagaaccagggggccaaagccaccactg

SEQ ID NO: 136644 - DNA, 601 bp, Human
ttgaccccggtaagaaacgtattttatattacaaccaagtacacaaaatatgtcaaaaatctaaagatttaaattctattttactttttcactacttgctatttcactgaatcaattttaggacaacattgtgtcttcatccttcgttcagctgaaaagggactgggcatcagatgacggcatcagtgtcacatgggagggggtctggatgccagctctttagccctggtgcaaacctaagaatctgatgaactggggtctctggggaagggacccaggacactgggcttcaacaggtggscctgcagtgctggagtgtgagaagcactgtttcagaagacaaaggtctgagggaaccggttgagctattaagattttccacatcttgggccaaagacggggaggggctgatgactagcccagcacagcccagggcacatgggaagtgacaggcagatgggaccctttgacttcgacagcaggggaagttctaatctcatctcagatcagaacattccttaggataagcccctcctggttgggaaacaaatctgtaaatgctgaacctggaaaaggcccgtgtagggtaagagggggtgac

SEQ ID NO: 136645 - DNA, 601 bp, Human
caataggtgctgctgtaggttaggggtcatgtatggtggtgaagaccgcaaacctagcccatagccaaaagttgccaagacactggttagcttcccctcctgagcctggaactaaggaccaagcacaggtgcaaaggcacaggtgggcatttcagagagggagaagtagctaaggcagaggctaataagctttttgaccccggtaagaaacgtattttatattacaaccaagtacacaaaatatgtcaaaaatctaaagatttaaattctattttactttttcactacttgctatttcackgaatcaattttaggacaacattgtgtcttcatccttcgttcagctgaaaagggactgggcatcagatgacggcatcagtgtcacatgggagggggtctggatgccagctctttagccctggtgcaaacctaagaatctgatgaactggggtctctggggaagggacccaggacactgggcttcaacaggtgggcctgcagtgctggagtgtgagaagcactgtttcagaagacaaaggtctgagggaaccggttgagctattaagattttccacatcttgggccaaagacggggaggggc

SEQ ID NO: 136646 - DNA, 601 bp, Human
cccaacaacgtggggcctttgctgccacagaggttctgggggcactggaatgcaggctctgcactcaggtggtctataagctgacaagaaagtcaagcctccaacccagggctatggcacactgtgaggtgagtcaaatgctgaggacatgtgggggtcactttgtgagagatgcaggaaaagttcatgaatggaggccctggaaccgagactggcagacggtgcaggatctggctgtggaaagtgcagggcagttgagctgggggagaacaggtgccctggagagttgtgggaactggtyctggccacttgaggggtggatttgtggattactcccaatgttgatgtttacgatgcacaaccaacccatttagcacttcccaaaatcaatgtcatagatgaaaacatgaaacagaaaatctcagaggccatgcatgtattaaggctaatatcgtttcacgaaacttaatcacaaccaacttgaaacatgtgaagacccttctccctggagtgtggagtggagaaaccccctcactgggccaataggtgctgctgtaggttaggggtcatgtatggtggtgaagaccgcaaacctagccca

SEQ ID NO: 136647 - DNA, 601 bp, Human
agggcccttgaggttctgggaaaatcagaagtcctcctggtttaagcacagacagaatttcattgggttagagcctaaaattcaatccacttcatttccagtcaaatgtattggcccccactatgtacagggagttgtatcaggtgctgagtaacacaaggccctgcccacgtggagctggcagcgatgacaatggctacacagcaatgactaggaccacttcttgtgcagtgagcacccagcaccaccgcaggcactcaacaggcctcatctcactgaagcctcgaagtgaccctccaayacaggtaccactgtcttcatgccacagacagggagagtgaggccgaggagtaagtgacagaccctggatttgaatcagttctgcttcacacaccagccacacggtctcctaatttagtagagagaggagtaagtaccctaaggatggttcaaacaaagcagaattcaagttcagaggaaggagggctcacgtctgctcttggccctagaggacttttcttatttcctctgggtcagtgttccacttaagtcagcacccactcagcgtgggacactgggcttggctaggatcaccaccatc

SEQ ID NO: 136648 - DNA, 601 bp, Human
gaaggagctggcagccacaatccctagcagcttgggacactgcagaaggagctcatgggcagagaaagaagacagtgaagggacaggagtcacctcaaaagtccctccctgtcaccttagggaagcaggctgcactgcacagtgcaggtcagacactgcgtggcatcctcactcatccaccccttcactccataaacatttacacgcaaagcacttgcaaggtgctggggtcaggaggaggcccagtttaccacccaggcccccctgcccctgaacgagggcagttcaggctccttcctcygaactggaggagaaagcgtcaactcgcctccctcagccctttctcctcctcatgttctgacatgacacccaagcatgcagagggctgggatagaagagcccaccctggtgctactgataccagctgactcttacttcagagttactggcctaacccccacgggaggctcctgagggcccttgaggttctgggaaaatcagaagtcctcctggtttaagcacagacagaatttcattgggttagagcctaaaattcaatccacttcatttccagtcaaatgtattggcccccactatgtac

SEQ ID NO: 136649 - DNA, 601 bp, Human
ccagggtatatctcatcatctggaggcagagccctcccccggcctttgtcttttaggtggagttgtttggggcagcctccgtggctcagaggaacctgcctgttaggatggctgccagcctaggaggggcaggtggaggcagcatgccatctcagcactccaacagtgctctgccggggccgcagcctcctgctctccagtgcagtgccaccagcaaagcagccagtctgggggcaggaaggcctgtctagctggggctgggtcgtggtgatggagccccatgggcctgcaggcaggaggyggcagcagacggcccccacctctgctgcgctagccctgctcagagactctgagaactcacagtttgacaggccaccctctgggcctccagaggaaaaacagcattttcattcgtcagtaagcatacattcatgtatttatctcccagacaacaggggaaggagctggcagccacaatccctagcagcttgggacactgcagaaggagctcatgggcagagaaagaagacagtgaagggacaggagtcacctcaaaagtccctccctgtcaccttagggaagcaggctgcactgcacagtg

SEQ ID NO: 136650 - DNA, 601 bp, Human
cacagggttaagtttaaacctcccctcccctcccattttcacagacaaggtgactgcagccctagccggtgtcctgaaccactcaaggcggcctgtccccacggtggcctactcccagggaagcgtttcttttccattactgttaggcattgatctagagatgaaaaccacagacttcataggcttcctgagatgtgaattagtcatttctcagctttattttcagaggcaaaatgaaaaaaagagtgatggtaaaataacagtttattctgagtaaaccacagagcagaggccagggtayatctcatcatctggaggcagagccctcccccggcctttgtcttttaggtggagttgtttggggcagcctccgtggctcagaggaacctgcctgttaggatggctgccagcctaggaggggcaggtggaggcagcatgccatctcagcactccaacagtgctctgccggggccgcagcctcctgctctccagtgcagtgccaccagcaaagcagccagtctgggggcaggaaggcctgtctagctggggctgggtcgtggtgatggagccccatgggcctgcaggcaggaggtggcagcag

SEQ ID NO: 136651 - DNA, 601 bp, Human
agcctatccacgtattcccgtcccacccacgtctcagatggaagggaaaggccgtcatcttgtgtgatgctgagtcagctggcctccctggggcttgcttttctctgctgtaaaatgggagtagtgatctttacctcactgggccgttgggaggatgtcatacagtactgcacatacagtgagtcactaagcccagtcctggcacttagttaacattcataaatgtcatctgtggccaccagaccgttcaaaaatatactcctttttgggataaatgccaccatcttcagtggacagctgytatttcttaacacaactggctttaaaaatagagaaaaattctaataacttaagcatctcctaggatttaaacagaacccacagccctcgtcaggtaaacttttccgcgtgaacaaagcatggagatgatgtccagggagcccctcccttacctgccagagacgtgaagagaattcccagactcgctcctcttataaaccacagatgctgcttgaggggatggaagggacgcctctgagactcagagcggcttccctcccggagcccaatcaagtggttaaatcagcagcggctgttttta

SEQ ID NO: 136652 - DNA, 601 bp, Human
ctcaacagatgaggagaccgagtcacaggcggcttcctgctcgccttaggcagggctcagggcagcactggagtcccagactatggagccctcccacaccctcttcctacacggaggtactgcccatttcctcctccacagtacctggtacagggacagaggtggctgggtgatggcctcaagaaatgtcactgtgcaaggtctggtgatggaatgcatggaaaaagaggcagtcttctattgtttcaagagaagaaatctctaccatcacagcttcccaacattccagactgattttctytgaaggtagggaccacagtcattcaaaggggaactgccaccatgtcctatggctatgacatggggcaaacagaagtggcactcatctctacacgtggcctagggcagcctatccacgtattcccgtcccacccacgtctcagatggaagggaaaggccgtcatcttgtgtgatgctgagtcagctggcctccctggggcttgcttttctctgctgtaaaatgggagtagtgatctttacctcactgggccgttgggaggatgtcatacagtactgcacatacagtgagtcactaagccca

SEQ ID NO: 136653 - DNA, 601 bp, Human
ccactgggatgtcactgttctatgtcctttcagtggacacagctaggagagaaatatgtacatgtatttaatgtaaatatatataattaaatatgagtgtgtatatatctatatatttttaaatcataagttaatactgttatttcttactgcaagccaacaccaccaggttcttcctccttccttgattccatatttgcagctcccttcctatcagtgagaaccctggtttctaacatcatcaatctattcatttgccttatcctacaataaacacaaaatttcttcagaattgctacaygaatatcattaacaactactaaaggtaaaagttcaagatttcttagcaattcttttagtccttagaatatatcctgtgatgggcatatagcaagtactgtgttcaaaaagatattctaattcttttttctgtgtgggttatattatcatttaatatacagttaggtttgtttttattgatattcaatttcaggattttttctgaatttgtaaaatatttatacagttcaaaagttaaaaaactacataacttctgttttatccctcatttacacagaaataagtagtatatccatcctta

SEQ ID NO: 136654 - DNA, 601 bp, Human
atctgccatttctttaatgtaccctagctccttttggtggggagtggtatttagaaaccaagatcggggcattagatgtgctcattgccactgggatgtcactgttctatgtcctttcagtggacacagctaggagagaaatatgtacatgtatttaatgtaaatatatataattaaatatgagtgtgtatatatctatatatttttaaatcataagttaatactgttatttcttactgcaagccaacaccaccaggttcttcctccttccttgattccatatttgcagctcccttcctawcagtgagaaccctggtttctaacatcatcaatctattcatttgccttatcctacaataaacacaaaatttcttcagaattgctacacgaatatcattaacaactactaaaggtaaaagttcaagatttcttagcaattcttttagtccttagaatatatcctgtgatgggcatatagcaagtactgtgttcaaaaagatattctaattcttttttctgtgtgggttatattatcatttaatatacagttaggtttgtttttattgatattcaatttcaggattttttctgaatttgtaaa

SEQ ID NO: 136655 - DNA, 601 bp, Human
gaatctgccatttctttaatgtaccctagctccttttggtggggagtggtatttagaaaccaagatcggggcattagatgtgctcattgccactgggatgtcactgttctatgtcctttcagtggacacagctaggagagaaatatgtacatgtatttaatgtaaatatatataattaaatatgagtgtgtatatatctatatatttttaaatcataagttaatactgttatttcttactgcaagccaacaccaccaggttcttcctccttccttgattccatatttgcagctcccttccwatcagtgagaaccctggtttctaacatcatcaatctattcatttgccttatcctacaataaacacaaaatttcttcagaattgctacacgaatatcattaacaactactaaaggtaaaagttcaagatttcttagcaattcttttagtccttagaatatatcctgtgatgggcatatagcaagtactgtgttcaaaaagatattctaattcttttttctgtgtgggttatattatcatttaatatacagttaggtttgtttttattgatattcaatttcaggattttttctgaatttgta

SEQ ID NO: 136656 - DNA, 601 bp, Human
tggctaatttttttttgtatttttagtagagacagggtttcaccatttcggcgaacctggtctcaaactcctgacctcaagtgatctgcctgtctcggcctcccaaagtgctagccaccatgcccagccctggctaagttttgttcgttttgtagagatagggtctcactatgttgcctaggctggtctcgagctcctgggctcaagtgatcctcttgcctcagtctcccaaagtgctgagatcacaggtgtgagcctccacgcctggttccaacgttgtattctggaaaaaaaaaatcawatctactgatgtgctgaaaaaatattatgaagcgaacgtccacatacccgtcacctagattcgtcaaccgttaacattctgccatgcccgctttccaaagttatattttggaaaaaaaaaaatcaaatctattgatgtgctgaaagaatactatgaagcgaacgtccacatacccttcacctagattcgtcaaccgttaacattttgccatgctcgctttccatcccttttctttctctatcacagaaacacacatgcaaatttatttttcatcaaagcaactgaaagttgcacacgtta

SEQ ID NO: 136657 - DNA, 601 bp, Human
tttctaacaactttaacatggaaagatcctctgtcttacttaatatacaactattcctgttaaaacagagggaaaacaatatttgaagttttgcaattccaaagactcttttgttatgaaaatccattcctactacccaattgttcaggaagtctactggataactatgacactgctaatgggaatattaagcctatcttttaaaaaattttcaaacaatctcattataaaaatccaagcactgtaaaaatatataacgtagacggtaaacatttctcataattccacacacagcagaaayattttttcacttttttttttttttaaacaacaagccattgtgggcattttcccatgtgagtgcagttaatggctgcatgatgctctgctggacggcaaccacagtgtatttatgcagtcaggcccccgaatgaatagattctaacttctgctcttcaaacaatgctgcgttgatgaacaccctcaagctggcctgtctgcgcccttgtatggtgagacagactcctagggatggacggcatgggaagctggatgcgacatagtcaaactgccccccactgagctgaatgcagccagcact

SEQ ID NO: 136658 - DNA, 601 bp, Human
gatgaggatttccaattttttaaaagtcttttcacttgtctaggattttgtggactgcaaggtaaagatggagacagagggctatgggcacaggaggcagcagagctgaagtctgtggctttttttttaaatctatttatttattttatcttgagaccaggttacgagactggctaatttttgtatttttggtagagacagggtttcgccatgttgcctaggttggtctcgaactcctgggctcaagggatcctcccatctcagcctcccaaagtgctgggactacaggtgtgagccatcacgccaggcctgtgtgtctttgttttaacttcagctcggccactaacctgggcaaactttttacccgagcctccggttcctcacctagaggaaagccatagccacagacctagctcctcctcaggtaattgtggagattaaatgtgacccgtgtgtaaagcatgtagccaaggacctgatatatagcaaatacttaatacatggcagctattattgtcatgtgataacctcgtcaggtctctgccaacacttaaaaaggcaaaagctaaaaataaccccagtctagtcgagccaaaagcaa

SEQ ID NO: 136659 - DNA, 601 bp, Human
gaacggctggattgtagggtatatgccacattgattcttacagatattgcaaaacaattctcccaagtggctatgccactttacagtcccactagcaaggttgggagagtcctagttgctccatattcctcccggcacctggggttgccagacatgcaaactttcccacatggccatgtctaagaaaggacacaaaagtcctccttcacctggaaatgccatatgctggtgtattttattgtgatctatctaatctgtgagagcaacttcaagttcacctgaacttgagaacagaaagcckcagactcttgctccatgttacatttaccccaaggtcagagactcccagtgactaatctgctagtcattccttccagaggaagggtggcttatatgagcttacaaacaatttctgtataaattgactgtgatgttaccaacagcagccactttcttgggcaaccatcgcaggctacagatctggctgtcggatgaatgtccttctctaccgagagagaaagaggatgggccggaggagaggatgtagcctgctcacagaatcatgtctcaacagaaaaccaagcagagcaaaaagacatca

SEQ ID NO: 136660 - DNA, 601 bp, Human
aaaaatttaaagatttcatacaaatatatatatgtacaagttatagagaatgaatcaaatccaggcacccaccatctggcctagcaaacagaaccttctgcagcgatggaggcggccggtacctgaactgtctaacacgacaggcactagtggctactgaggcctgattgtggctgctgtggctgaggcactgaactgtgagttaactgtgtaaacagcccctggggctggtgactggcacactggatggtgcagctcgagaagcggatggattccactggtgctgccatgtgctcctctrcagccacatctcttccctacaggcagcccgactctgactttcagacttatcatcccttacttttcaggatagtttatatcgacatatacagtttaacttataagtttgtgaacgttacctaagtgatggcatattgtaaagattctcacgctcttgttttttactcaatagcaggcctgacactcaggcatgctggggtgtatcagtgatttcgttttcaatgctgagaaattccgtagattccataatcccagctttatttatctgctctcctgtcagtggacactgggtcgcttccag

SEQ ID NO: 136661 - DNA, 601 bp, Human
gatcaccaaaaaaccctctcaggttcatgcaagggcagggaccaactaagggcacttctgcctatgagctgttgatggaactcaagaggtttattattgcactcacaattcttgtctgccttgggcaaggctgggaaaacatgtcagcacctaaagacagtgcaatgcctaccaataaatctccctcctcagggtatccacctcagcacagccagctctagcacaagaagccataaatcaggcagagagaagagattctttcaaatgacaaccaaccttctcaacgctggaaatcgaggayagcactaactaggacagtatgtttgtcacatccttcttgaaaccttgggttagcagcacaggcttcaggtgattctcaaggtcattcacactatgcctttgagtgctgaggaggtactataatgctttgcgatagcagggtggggaggaaacgacaggtgccctcacatgaacactgctgttagggcaatctcgccaacggctccagacaggcaggcagacagacagacagacagacagatgcactctccctgcccctttctcatgcacgtcaatcatctgggatggagggcgacgtgaa

SEQ ID NO: 136662 - DNA, 601 bp, Human
gggctgaggagctggcaagattcacaactgcgccgtcatgaccacggcggaactggggtagacaagtgaggtgtagaggtcgatcaccaaaaaaccctctcaggttcatgcaagggcagggaccaactaagggcacttctgcctatgagctgttgatggaactcaagaggtttattattgcactcacaattcttgtctgccttgggcaaggctgggaaaacatgtcagcacctaaagacagtgcaatgcctaccaataaatctccctcctcagggtatccacctcagcacagccagctctrgcacaagaagccataaatcaggcagagagaagagattctttcaaatgacaaccaaccttctcaacgctggaaatcgaggacagcactaactaggacagtatgtttgtcacatccttcttgaaaccttgggttagcagcacaggcttcaggtgattctcaaggtcattcacactatgcctttgagtgctgaggaggtactataatgctttgcgatagcagggtggggaggaaacgacaggtgccctcacatgaacactgctgttagggcaatctcgccaacggctccagacaggcaggcag

SEQ ID NO: 136663 - DNA, 601 bp, Human
tcatatgtcagcagtcatccctcgcattcaaatgaactgggatggtgtgacttctcccgctcccctctgtcctgcctcttctctctcttcacccaagcagggtggatcccatttacagtttatacttccttctttatacttcaacatggatgtgaacagtctaatccttcatgtgatgcttaagagggtgtgcactgttagccaggcctggtggtacatgcctatagtcccagctactcgggaggctgaggcaggagaatggcgtgaatccaggaggcagagcatgcagtgcaagattgcrccactgcactccagcctgggcgactgccaccacgcctggctaatttttttgtatttttagtagagacggggtgtcaccgtgttagccaggatggtctcgatctcctgacctcgtgatccacctgccttggcctcccaaagtgctgagattacaggtgtgagccaccgcgcccggccaaaaaattttctaaaaggggggtgtgcactggagtcagaatgtttgcattcaaatacttagatatcatctctctaaatctttcccttattttgtctggaaaatgagtgagataacattatattt

SEQ ID NO: 136664 - DNA, 601 bp, Human
gcatggtggtacagacctgtagtcccagctactcaggaggctgaggtgggaggactgcttgagcccaggagttagaggctacagtgagcactgcgctccagcctgggcaacagagcgagaccctgtctcaaaaaaataaaggcttgggggacaagttccctgaggactgtacctgtcttgttcatgcctgttttcccagtgctgacatggcagttggcccatagaagataatcagtaaacatatattcaacaaatgaagaaaccaaccaacaacaaaaatatcccaggaagaagactgctkcttttagtaacagcagaaatacttgaaattggctgaaaattaagcaacaaaacactgtcctacgcaatggaaaaataaatacctgtagttttaaaaataaaaagcactccctctgtcaagtttttccagcaatttagtacaacaaaacaaaccagaaaaccaaacaaaacaaccctccaaataaatagcacggcaccttgcactacatggctctcactctgtctactattgctgcacgtgacttaacaaggccaaagttcagttcccttgctaaagaccttccaggtggccaggcaggat

SEQ ID NO: 136665 - DNA, 601 bp, Human
caagaagctgtcatctcctatgataacaatgccttcttttataacacctcctgaaggatctgcctgaggctgttttacagttaacttttttgtttttagtaagcagaagcatactctcaaataatgataaaaagtagagtaaatccataaaccagtaacatagtcatttattatcaagtactacgtactgtacataaccatatgtgctatatatttacaccagcatcaccacaaacaggtgagtaatgcattgcgctggatgtaatgatggctacatcaggcgaggcgacaggaatttttyagctttatgattatcttatgggaccataagattataatgtggtctgccctacatatgttataatgtggtctgtcactaactgaaatgtcgttatgcagagcatgactctatttaaaaatcatatgcagccatcccttagcatcctcaggggcttggttccaggatcctctgcggggatcaaaatccacgatgctcaagtcccttatataaaacagtggaatatttgtgtatgacacacatcctccacatgcttcaaatcatctataggttacttacgataccaaatacaatgtaaatgtt

SEQ ID NO: 136666 - DNA, 601 bp, Human
ctcacttttatccaaggtcccctggactctttcctgaacaattcagcccacggtcaccacccagttgaacataataatagtgcaatagagttttttccatccccaaaaccatggaccaggattctgcagtagaaggcaaggcaaacccaattgttcttaatgttacactgaccttctgcctttgagacctggaagccacagcactggtggacataaattctactgcctgctgctccagatccaaggggagagggtagccctctggtagaaatctgtctgttgcctcctggaagagaggaarcctggattcctacagagtttgaaatggctgtttgaggccgaagggaggggttgatgaaagtcaatagctgtttcaacatatctggcttgactggccctgctgaggccactaactcttgaggacatctttggctgtgtctcaaggggtttgcatgtttcagagcacaggccctaaagccaaatgatggatgttctggacatcacagagttccctgtgtttgagtgtgcgccaaggcaacgtagggaactgcagggcagggaggcagcagcctggggtgtggacatgatgtgctgagctgtt

SEQ ID NO: 136667 - DNA, 601 bp, Human
ggccgaacagtttcatatcagaattcactagcaggataacgttgttagtaagtgaatcattttactctgactgcctggactagtgttggatgacaattacactctacttgtagttaatactacattcggctacaagaggttactaaacagattgcaataaaaaataactgtggcacagaccaaatctactgtattactcttcttcaatctggaatttagatcaatctggcaaacactgactgtttccctcttgcttgtcagtcacctttcgttaaaagagggggcaggaaaaaccactttycaacaaaagacttttagatttaaaacctttattttcctccacttttaactaaaattttaagatattctgctggtcaacataaaacccaaaaatagatgaactgcaaaattcaagaattatgtatttaaataacaggctagtgtttaccagcggcattaaatggatggctgtgacagtagttctgctacatagaaattatactttggataatcactaaaggattaagaatatctgtctacaaggtttattttattttacattgctaagtttagttttatttatttattttttggagacaga

SEQ ID NO: 136668 - DNA, 601 bp, Human
catctccctgcacttccatttccctcgtatctgagcagggaaagccatgcatatgacctgaagtaaaataagaatgtacgtaatcactccctaagtggtaagagagctaatgaataatcaacgagggcagcagatgacagacccactgcaaggtttcttggacataatcctctaagtccacgtactctgggaagtttctcaatgcttctggttctgtccatgggcctccacgaagcaagaggttcgcatttacttgtcccacgcaggtggcttgggacagaacacagacatccaacccttyctaatgagcaatgatgaaaaaggggtaacattccttcttgggtgaagatcacacctacagctccctgctacagaacaggtttctcagccttggcactactgacattttggggcagagaattctttgttgtgtggggggctgtcctgtgtattgtaggatgtttagcagcttcccaacccctacccactagaagccaataacatctgctttgccttcctatggcaacaaccaaaaatgtctccagacattgccaaatggcccctggggtttacaggcaccccactaaatgagcggtacttt

SEQ ID NO: 136669 - DNA, 601 bp, Human
gaatctgtactttcatctccctgcacttccatttccctcgtatctgagcagggaaagccatgcatatgacctgaagtaaaataagaatgtacgtaatcactccctaagtggtaagagagctaatgaataatcaacgagggcagcagatgacagacccactgcaaggtttcttggacataatcctctaagtccacgtactctgggaagtttctcaatgcttctggttctgtccatgggcctccacgaagcaagaggttcgcatttacttgtcccacgcaggtggcttgggacagaacacagwcatccaacccttcctaatgagcaatgatgaaaaaggggtaacattccttcttgggtgaagatcacacctacagctccctgctacagaacaggtttctcagccttggcactactgacattttggggcagagaattctttgttgtgtggggggctgtcctgtgtattgtaggatgtttagcagcttcccaacccctacccactagaagccaataacatctgctttgccttcctatggcaacaaccaaaaatgtctccagacattgccaaatggcccctggggtttacaggcaccccactaaa

SEQ ID NO: 136670 - DNA, 601 bp, Human
tgcaggattaaaaaaaaaatggcaatgcaacattattcctattagtccagaacagtgaggcctagcaagaagacatgtcgaacacagacattggttacaatgagagcaccaaatcaccacctgccaccaggctgtccggcagcagcatctccctggaagagctgaaggggaaaggctttcaggaatccacccaagagcactcggatccaatctctgtccaaatgccctcagagatggggcattaacacctcccaggaccccctgctcactgctcattgtaattatacctttggacacccartatatggctaaatttcctctacaacttcaacactctgcagctcactgctagacttgttaaaaggttgcaaaaaagtttagaagttcatcacaatgtactttgaatttttaaattcactaagaagatgcaagagactgctaatgtggaatcagtctgggaagacaacagaatatagtgagaaaaacagattttgatcaagaaaatgtgcaccagggccaacactgtctgcacagtgggaataataaaagcttccccacacaattatggtgaggagtaaataagacagcatgtctgaaacca

SEQ ID NO: 136671 - DNA, 601 bp, Human
tgtttaaaggttacaaccaccctgtgaagtggatactattatttcacaggtggggaaactgaggcttagtgggacgtgggggaggttaagcaacttgcctaaggccacacagctgtagtgacagatatggaatttgaacttggtctgtctgagttcagagcctggagagatagagaggagaataaagaccagatcagaaatgtgctgaagttaaaaagtttacttgagatcccctggtcaaaaagatctcatttaacaaacgagtaaactaagaccccgatggcagagatggacataaaayccccatcgcctttcctgccccgtgggccatattcatttctgacgcccaggctgtggctccacagccatgtgctgccacaggagatggcggggaagagggtgaggaaaactggccctcctctccagacagttctctccccacagccgtgccgcagccgggacacccgacttgctctgtcactccttgtcccatctgcagcctgggtgcctcccctctccacagcaacataagcctcatttccacactataggacagtgtaccctgaaaatgtgggtaaagccagggagtgagggggagggc

SEQ ID NO: 136672 - DNA, 601 bp, Human
attttatataggctattttgtttaaaggttacaaccaccctgtgaagtggatactattatttcacaggtggggaaactgaggcttagtgggacgtgggggaggttaagcaacttgcctaaggccacacagctgtagtgacagatatggaatttgaacttggtctgtctgagttcagagcctggagagatagagaggagaataaagaccagatcagaaatgtgctgaagttaaaaagtttacttgagatcccctggtcaaaaagatctcatttaacaaacgagtaaactaagaccccgatgrcagagatggacataaaacccccatcgcctttcctgccccgtgggccatattcatttctgacgcccaggctgtggctccacagccatgtgctgccacaggagatggcggggaagagggtgaggaaaactggccctcctctccagacagttctctccccacagccgtgccgcagccgggacacccgacttgctctgtcactccttgtcccatctgcagcctgggtgcctcccctctccacagcaacataagcctcatttccacactataggacagtgtaccctgaaaatgtgggtaaagcca

SEQ ID NO: 136673 - DNA, 601 bp, Human
tcattggtccacataagcctggaaactaaatgaggctgtccgtgtctggggatggcttagagacaaagccaactgctgggctttgggcttgtcacccacaaaatggggagaataacatctgccccgtgtaactaaagaggtgactgtgggggactgaatgagaaagcatatgaagtggttcacaacatttaacaggcactataccaacaccagagaccatatacctgccagtaataaagcagagaaagagggcctaggatgggaacatctgaaagggaagaaagaggccagatcgtagctrccactcatcggggacatggaggcacccactgtgctatggattttatataggctattttgtttaaaggttacaaccaccctgtgaagtggatactattatttcacaggtggggaaactgaggcttagtgggacgtgggggaggttaagcaacttgcctaaggccacacagctgtagtgacagatatggaatttgaacttggtctgtctgagttcagagcctggagagatagagaggagaataaagaccagatcagaaatgtgctgaagttaaaaagtttacttgagatcccctggtcaaaa

SEQ ID NO: 136674 - DNA, 601 bp, Human
ctggaagaatttcagaaggaaaaccccttcaatgggattagtcaaaggactaccagaaaacaaaccatatttcatgggtccttacagccacacccaggcacttcccattttctcctctaggaaatggttatagacattcaatgtcaattaagagccacccctcaatagacaaaaaatacccccagccattaccatgtgacttcatcagttcttacccagggtttgcaagtgacctccaagcagagcctggctctgggaagcaacactcctagcagcaatacactctgggtgtgagggtccmggggacgctatcctggactctcccaaagaggcttagcgcctgagggtgcagggtgatcagtcgcctcttcccactgttcccctctcgtccatgctctaggacatataccctctgcccatgactgcccgagtcgccgccctcccctccccgggatacaccaggcccagtggcctcagttcctttgctcttgttctcctgcccccactgccaatccaactgctgctttccctcaggtcgggctccaggaactactcagtcaagaggcttcatcagatcaactccaacacccctgtaactctc

SEQ ID NO: 136675 - DNA, 601 bp, Human
ccagccttcccgtcattagcttggaagcagaatattcctgtgtcaaggggctaagacataagaaaggaaggaaagttgaggactataaaaaatgccatctgaggcccagctgctggctcagttccacaatggagcaaagccctccgcatgtgacgagtgtgactctcgctctcacatgggcctctgcgtgcctcactcgggaatcctccattcaaagctcatgctaagagccagctgcttgttggaggccagcctatcactgtctcaggaaccgaggtgagggcggcaaagggcctgtttscaaggaccccccactccctgccccacggaagaaacgagaaaggaccttccagctcgcaaactgcacttagggaggaaagagataatgcaaagcatctaaaaggagcatctgaggaggtatttccaatcactgtgggagaccaagaaaaccacctccactagcctggaagaatttcagaaggaaaaccccttcaatgggattagtcaaaggactaccagaaaacaaaccatatttcatgggtccttacagccacacccaggcacttcccattttctcctctaggaaatggttatagacatt

SEQ ID NO: 136676 - DNA, 601 bp, Human
atttgttgttggaactactctcttaggaaagaggacggagaggggaaaacaaagaccctgcagtctctccgggggttggaccagagctgatctgatcctgcaggggaatgtgcttctaacggctgggctggacctcgctctgcttcctggcaaggccaggtgaggcatcttgaaagaagcctgctgccttcccctgatgtgctgtaggaggattccaccggagaaagcatctcactgtcacactgctggtaacagtgaggtgaaagaggggaaacacttttattcactacttcctttctayctgcattggatgctaacgtttcccggaaggtgctggaattatgtccagccttcccgtcattagcttggaagcagaatattcctgtgtcaaggggctaagacataagaaaggaaggaaagttgaggactataaaaaatgccatctgaggcccagctgctggctcagttccacaatggagcaaagccctccgcatgtgacgagtgtgactctcgctctcacatgggcctctgcgtgcctcactcgggaatcctccattcaaagctcatgctaagagccagctgcttgttggaggccagccta

SEQ ID NO: 136677 - DNA, 601 bp, Human
tcagaatcagtcaaggaggaaacaatttttgcaaggatctaaagtttccatttagccaggcgttccactctgcatgttccaacaggagaaaagggtcggcaggaatgaaagcaaacttttcaagtccattagaaacaaacaaacaaaattcctaaaggagccctgagaaagccaggattgggtattttagaagattatatggatgaaaagtatttgttgttggaactactctcttaggaaagaggacggagaggggaaaacaaagaccctgcagtctctccgggggttggaccagagctgwtctgatcctgcaggggaatgtgcttctaacggctgggctggacctcgctctgcttcctggcaaggccaggtgaggcatcttgaaagaagcctgctgccttcccctgatgtgctgtaggaggattccaccggagaaagcatctcactgtcacactgctggtaacagtgaggtgaaagaggggaaacacttttattcactacttcctttctacctgcattggatgctaacgtttcccggaaggtgctggaattatgtccagccttcccgtcattagcttggaagcagaatattcctgtgtca

SEQ ID NO: 136678 - DNA, 601 bp, Human
tgctttaatgagaagctcttcagaatcagtcaaggaggaaacaatttttgcaaggatctaaagtttccatttagccaggcgttccactctgcatgttccaacaggagaaaagggtcggcaggaatgaaagcaaacttttcaagtccattagaaacaaacaaacaaaattcctaaaggagccctgagaaagccaggattgggtattttagaagattatatggatgaaaagtatttgttgttggaactactctcttaggaaagaggacggagaggggaaaacaaagaccctgcagtctctcckggggttggaccagagctgatctgatcctgcaggggaatgtgcttctaacggctgggctggacctcgctctgcttcctggcaaggccaggtgaggcatcttgaaagaagcctgctgccttcccctgatgtgctgtaggaggattccaccggagaaagcatctcactgtcacactgctggtaacagtgaggtgaaagaggggaaacacttttattcactacttcctttctacctgcattggatgctaacgtttcccggaaggtgctggaattatgtccagccttcccgtcattagcttggaa

SEQ ID NO: 136679 - DNA, 601 bp, Human
tgctaatcactagaccaggtccaagcagtgtatactgattgttagcaattagaatcaaatctattttagatgtgccacaaggagccgacaggtttgcggaattttaacagtcatgagctcaaaacaggtctgcagtttattagaattcctccgtcacggggccagcttcatcatcttctgcactataacgatgagacagacgtcaggagcgcacgaatgaagactattttgagaatagcaaatcaggggtgacggggcctgtgatggtggtggggatgtgaggatgggaacgcaggtgagtgtgtgtgtgtgtgtgtgtgtgtgtgtgagagagagaccacgctaccagctacactgtgatgccagcgcccacaaacagaagccctgagtgcctcaatgattgtagagtagcagccgaatggagaatttttacatctttcacgtatttttaaataactaaagataattttccctaggaattgtggaaaggattatttttccatttcaaacaattatcacagaggaagagcaacaatatagaaaatttatgtgctgcaacctcctctactccaaaaaaacacacaaaaaacaaaaaaacacc

SEQ ID NO: 136680 - DNA, 601 bp, Human
tcttccttggcagcgctataccacatgggtgtgcctttgtgtttacggtcctgccccccttagactgtaagtgccatagggcagggtctgtgccagctttgctcatatttcctattatctctcattgcctggcatatagaaggttctcactaaatgcttcttgaataaatgaaacaaaactgaatttgtaaagcttctcacctagagaatctttgttctggctaaaatatttttaaagcaattgtggaaaagttatttgctctgacattgacaagttcataacctataggtttctctctcytttttttttccccagtcactttgaaaaatcaaggaaatttttctttcagacatgcctttctactaatgaagtggtgctgtaatgactccatagaggaaatgtacttgggactgccacagagctttatgagtggaaactcattctcctctgttttggctgctctaacttgtgaacatctcatcagaatcaattcgatagaaggaaaccttaacaatgttacctgaagaataacaattttcaataatagcattttcagaagcctagacaggaacagcaggggtgggtgggccagagtgactc

SEQ ID NO: 136681 - DNA, 601 bp, Human
tgggaggcctaggtgggcggatcactggaggtcaggagttcaagaccagcctggccaacatggtgaaaccttgtctctactaaagatacaaaaattagctgggcatggttgtacgtgcctgtaatcccagctacttgggaggctgaggcaggagaatcacttgaacccaggaggcggaggttgcagtgagcccagatcatgccattgcactccagcctgggcaacaagagtgagactccgtctcaaaaaaaaaaaaaaaaaaaaaaaaaagaaaatgatcacagagaaggaagggcttaartaacagttgacaagtcaaaatacagctctggtgctcaagtaacacagtaaattacctggtgaagttgggaagaggtggggtaccgatttcaaaaggtcatgctgggatatctctttggcctcgagtggctcggccccccagcatccaggtgctaggctgggtgtggttctcagagaaaaacattgagggtctttaaattcctcagatttccttccttcaagagtcataatcagctctgagctacaggctcccggtggaaaagcagccccagagccagatgaggggacaggggtctatctt

SEQ ID NO: 136682 - DNA, 601 bp, Human
agaattttttgagagggatgtcagactttttaattgtcctgaggcacgagttagaaaagactgaaaaaggccagacgtggttgctcatgcctgtaatcctagcactttgtgaggccgaggcaagtgaatcacttgagcccaggagttcaaaaccagcctgggcaacatggtaaaaatctgcctctacaaaaattagttggacgtggtggcatgcacctgtggtcccagctactccggaggctgaggctggaggattgcttgaatccagaaggcggaggttgcagtgagcaagattgtgccrttgttgcactccagcctgggcgatagagtgagactgtctcagaacaaaaagaagaagagactactctagagtctatgtctacagcagtgactggaaactgccgactggtcactgaaaatcagttttcaaaagtcaaaaacggtatttggaaaagtagctctccaaatatgtaatactttatttccatgttcattttattcatactgaaaatgatcataggtcgggcgcggtggttcacgcctgtcatcccagcactttgggaggcctaggtgggcggatcactggaggtcaggagttcaa

SEQ ID NO: 136683 - DNA, 601 bp, Human
tagctggtgattacaaacaggacaagatggaggaggagagactacacaatcagtgaagagagcagttagaaaagaggcagctcccttgcaccctaccgcctggaggagggaggacggtgggagaagcagctcttcctaaaagcacaacgccaggccccaaagaggagcatcacggccttagagggagttaaagagcgccagaacacagtgccctggatgccccactttcagattcactcttctttacaagcagggcaaaaggaacagagagaagtctgtgttgtttgcatctgttgatacrggaaaacattcctggttcttcattgattcatgagcaattataattagatcgtcatctttctggagaggcagctgtgaactcaactaatgaacaatggcaaaacaatcctggaatgacaggcacacatgtgcagacatgtgcccaaattcaaagatgacgtcatgatcccaatgacgctccctacactagctcgcgtggcctaggcttgaaaagactataaaaggggcgggctgctttttaaatttaccacctatctccctgcctagacagaaggtctttagtcttgacttgccttaacta

SEQ ID NO: 136684 - DNA, 601 bp, Human
taagtcatgatagaaccagacaatgggctgaccattacgttgttattaaagacaaagtcacaacaagaatatgcactgtatcgtggaaagatgctgtaatacactgagtggaaaaacagttctaggtgatatgctggtttatattgcacgttttgtaaacaaagccaaatcaagaatatatgtaatacaaaaaatatggctatgaaacacccttttatcttgttctttttctattttctaaattttctgaaatgaacatatattacttctgaaataataattaaacaagcaaccccgcccyccaaaattaaatgcatatatcaaactcttgggctcaagtgatcctcctactttggcctcccaaagtgctgggattacaggtgtgagccaccacgctcagccaggcatatccacagatgcaggttcagtgttaccctactctgtgacagttgttaccccattcagatgtctattcttgaagaaatgtggagaagcaaaatctctaagagccaagtactagcaagaaaggagaaccttaatacttgcatgttagcacaatttagaagttaatatttaagggacagccatctagctggtgatt

SEQ ID NO: 136685 - DNA, 601 bp, Human
cacctataatcccagcactttgggaggtcaaggcgggcagatcacttgaggttaggagtttgagaccagcttggccaagatggtgaaaccctgtctctactaaaaatacaaaaattagctgggcatggtggcgtgcacctgtagtcccaactacttgaaaggctgaggcaagagaattgctctaatctgagaggaggaggctgcaatgagcccagatcgcaccactgcactccagcctgagcaacagagactctgtctcaaaaacaaaaaaaaaagctccaaatttatgttttatattttyaccaggagcttggagtagagatgaatataaacctttacaaccatccatgtcatcctcagtttactcttgatcaaacaagagtgctctcaagtcaaagcacccaaacccaagcctttaaaagttctttgtcattatgaaacgaagctgcccaggaaaagcactggtatgtgtcactggacgcgctcacagaagatccttggaaacagtcatgctgaagggtaaacttgagacagggcaatacttcaagcctgtgtgaaatatacacacactgctaaccactgaaaaaggaatatgggcctc

SEQ ID NO: 136686 - DNA, 601 bp, Human
tcatctgaaaatgatctaagggttctctaaaatgctccaggccgggcgcagtggctcacacctataatcccagcactttgggaggtcaaggcgggcagatcacttgaggttaggagtttgagaccagcttggccaagatggtgaaaccctgtctctactaaaaatacaaaaattagctgggcatggtggcgtgcacctgtagtcccaactacttgaaaggctgaggcaagagaattgctctaatctgagaggaggaggctgcaatgagcccagatcgcaccactgcactccagcctgagcmacagagactctgtctcaaaaacaaaaaaaaaagctccaaatttatgttttatatttttaccaggagcttggagtagagatgaatataaacctttacaaccatccatgtcatcctcagtttactcttgatcaaacaagagtgctctcaagtcaaagcacccaaacccaagcctttaaaagttctttgtcattatgaaacgaagctgcccaggaaaagcactggtatgtgtcactggacgcgctcacagaagatccttggaaacagtcatgctgaagggtaaacttgagacagggcaatact

SEQ ID NO: 136687 - DNA, 601 bp, Human
atgagtggctgcctcctgacagtcgcctctgtgcgtaacagtcaacatcaaaatcctcaagtggaaaaagaaaaacaaagccaaatcacttctgagaaacggtggcacagaccaggggtgaggcaaccggtgcatttacttagagaaggaaatactgccaggcgaactcagaaaccacctctgacgtcagtagtcgaaggacacatacagctgagaagcagccatctggagtttgtggggggtgtggccagggagggccctggggctggactcacctatccccaggagacgcccttggctstgccctccctgccctgacccttatccccatatgggaacttggaccgtgtcctggagagagagggatgggtacaaggtctcgcactcctcgatgtgacaaacaccagcgcctgaagaccatgggtttctttcagcttcaggagccacatccctgagccccccaccccctccctgccttcccatgcagggaacaggggctgcattacctgcctattgattccaacaggcaaactggagccactggtggctcggctcatgggggccaccacagccactcgggtaggggacggcgccgactgtc

SEQ ID NO: 136688 - DNA, 601 bp, Human
ttttgaagtatttccttaaatgacttttttgcctatacaattcctttttgaaaaagcctaactgagggccacgcggtggctcacgcctgtaatcccagcactctgtgaggccgaggcgggccgatcagttgaggccaggagttcaataccagcctggccaatgtggcaaaaccccgtctctactaaaaatacaaaaattggctgggcacgctggcccactttgggaggctgaggtgggcagatcacctgaggtcaggagttcaagaccagcctggtcaacatggtgaaatcccgtctctaytaaaaagacaaaaaaattagccgggcgtggtggcacacacctgtaatcccagctgcttgggaggctgaggcaggagaatcacttgaacccgggaggcggaggttgcagtgagcccagatcgtgtcactacactccagcctgggtgacagagtgaggctctgtctcaaaaaaaaaaaaaaaaaaaaaaaaagaaacaattgagaatactatgtaaatggtcctgtactttttctagttatcaatatgagtgatttttaatagctacagattattccagcaaatgaatgtaccataattcat

SEQ ID NO: 136689 - DNA, 601 bp, Human
cttttattttttacatttcttatttaaaaaaaaaatacacaaccattacggaaaccgtggcaaattacatcaagaaaataaaaatcacccacagtaccataatctaactgtactttctatttacattttgaagtatttccttaaatgacttttttgcctatacaattcctttttgaaaaagcctaactgagggccacgcggtggctcacgcctgtaatcccagcactctgtgaggccgaggcgggccgatcagttgaggccaggagttcaataccagcctggccaatgtggcaaaaccccrtctctactaaaaatacaaaaattggctgggcacgctggcccactttgggaggctgaggtgggcagatcacctgaggtcaggagttcaagaccagcctggtcaacatggtgaaatcccgtctctattaaaaagacaaaaaaattagccgggcgtggtggcacacacctgtaatcccagctgcttgggaggctgaggcaggagaatcacttgaacccgggaggcggaggttgcagtgagcccagatcgtgtcactacactccagcctgggtgacagagtgaggctctgtctcaaaaaaaaaa

SEQ ID NO: 136690 - DNA, 601 bp, Human
gtcttgctggaggaattcatagtcgggatcatagtggtctgcagttacaacaggggaaaaagagacccgttagccacaggccctgcaggagcagccagctccccccgcccgcctctcgccggctcgctcatgggtgtgtgacaaagacctgtctccagggcttattttatattcacatgttatattcttcattcttctccctgattataaaagcaaaccagatgggaatatggctgtttgctatacttttattttttacatttcttatttaaaaaaaaaatacacaaccattacggaaacygtggcaaattacatcaagaaaataaaaatcacccacagtaccataatctaactgtactttctatttacattttgaagtatttccttaaatgacttttttgcctatacaattcctttttgaaaaagcctaactgagggccacgcggtggctcacgcctgtaatcccagcactctgtgaggccgaggcgggccgatcagttgaggccaggagttcaataccagcctggccaatgtggcaaaaccccgtctctactaaaaatacaaaaattggctgggcacgctggcccactttgggaggctg

SEQ ID NO: 136691 - DNA, 601 bp, Human
agagaggtcttgctggaggaattcatagtcgggatcatagtggtctgcagttacaacaggggaaaaagagacccgttagccacaggccctgcaggagcagccagctccccccgcccgcctctcgccggctcgctcatgggtgtgtgacaaagacctgtctccagggcttattttatattcacatgttatattcttcattcttctccctgattataaaagcaaaccagatgggaatatggctgtttgctatacttttattttttacatttcttatttaaaaaaaaaatacacaaccattacrgaaaccgtggcaaattacatcaagaaaataaaaatcacccacagtaccataatctaactgtactttctatttacattttgaagtatttccttaaatgacttttttgcctatacaattcctttttgaaaaagcctaactgagggccacgcggtggctcacgcctgtaatcccagcactctgtgaggccgaggcgggccgatcagttgaggccaggagttcaataccagcctggccaatgtggcaaaaccccgtctctactaaaaatacaaaaattggctgggcacgctggcccactttggg

SEQ ID NO: 136692 - DNA, 601 bp, Human
ggcaaccccagcttccaagtcattctgggagcatgaacagagacagtgtgctctagacagggatccttagacaatcactctgtggaaactaggcaagttctgctgaaattcacgtatccacctcgctctacacagatgttgctgcaatgctgtcctgcgtgccaggacactcgttcccctctgtcactgtgatcaggccagaaggtcaactgctgccatctaaagaggagaatccctcaggctacatggagaccggacctgagattgtatagaaactgtaaaggagaggtcagctgatgargctttaaaaatgatcacgtgtaatgacaaaacctggctcccagaagtgtccacatacctggctggcctatcttttatgaaataatgaggccactgatttgattctggtctaatgctgaaataaaacatactgccatttcaggttataaaatgcacttcctgacaacagtgcaacaaaggcttactgtgtttgtttttcttctctggtagaggaggtggtttttctgggtcaccggttgactcaggagcagtaaaatcacccacaaattcgacaggggctgaggaacctccatgctgaaag

SEQ ID NO: 136693 - DNA, 601 bp, Human
atgcttctggcagtgccattgcacacccctctgcgggagccctggtttctgatgagcaaatatacacgacagatggggatgacatcattagtcccacagagccagctctccctctagctgggggaccacactgctgaggccatcacacaagctgggcaacacccactgaggagctggggatacatgacatcatcgcagccgccgccttctgtggaccacgcagccagccctcagggcgatccttgctggactgaaccaagccaggtcttcccttctttgagaatggggcccagctctaagstgggctcagaagctctcatttgggaatttggagtagagattccatttctaggtcatagaagttctctgctggatgtgtcaactgaggccagggaagcctggggctgtgtggctaatgtgaccacacacattgaaacggtgacagctgtgctgccaagaaaatcgaagcagaactatgctagtgaagcagggagagggcggggacagagggggccaggcaagtcccagaagtgtggagcagttaggggagctaggagaaaaccgaatttccaggagaactctccttattacttttatgaca

SEQ ID NO: 136694 - DNA, 601 bp, Human
gaacctgaatggcacgcagcccaagataacaggggtggagggggaggccaacagctctttaaacacttgtccatgcagagggaggggaagagaaggaaatgcttctggcagtgccattgcacacccctctgcgggagccctggtttctgatgagcaaatatacacgacagatggggatgacatcattagtcccacagagccagctctccctctagctgggggaccacactgctgaggccatcacacaagctgggcaacacccactgaggagctggggatacatgacatcatcgcagccgcygccttctgtggaccacgcagccagccctcagggcgatccttgctggactgaaccaagccaggtcttcccttctttgagaatggggcccagctctaagctgggctcagaagctctcatttgggaatttggagtagagattccatttctaggtcatagaagttctctgctggatgtgtcaactgaggccagggaagcctggggctgtgtggctaatgtgaccacacacattgaaacggtgacagctgtgctgccaagaaaatcgaagcagaactatgctagtgaagcagggagagggcgggg

SEQ ID NO: 136695 - DNA, 601 bp, Human
ctgcagcttgcaaggatgccatcctgcccagtgtctgagctcagaggacccctcccctagggaaggaaagggggtgaacctgaatggcacgcagcccaagataacaggggtggagggggaggccaacagctctttaaacacttgtccatgcagagggaggggaagagaaggaaatgcttctggcagtgccattgcacacccctctgcgggagccctggtttctgatgagcaaatatacacgacagatggggatgacatcattagtcccacagagccagctctccctctagctgggggaccmcactgctgaggccatcacacaagctgggcaacacccactgaggagctggggatacatgacatcatcgcagccgccgccttctgtggaccacgcagccagccctcagggcgatccttgctggactgaaccaagccaggtcttcccttctttgagaatggggcccagctctaagctgggctcagaagctctcatttgggaatttggagtagagattccatttctaggtcatagaagttctctgctggatgtgtcaactgaggccagggaagcctggggctgtgtggctaatgtgaccacaca

SEQ ID NO: 136696 - DNA, 601 bp, Human
agtgatgaattggttaaagcctcaaaatggtggcctaaattaatagggattttcagccacttgagactgtttgaaaggaaacaatggctacccctccctttccttctcccctctatagaccctgcatgaggaccgccgcccacacttgttctaggagctggaagggtaaggctctctggcatctgctgcagcttgcaaggatgccatcctgcccagtgtctgagctcagaggacccctcccctagggaaggaaagggggtgaacctgaatggcacgcagcccaagataacaggggtggagrgggaggccaacagctctttaaacacttgtccatgcagagggaggggaagagaaggaaatgcttctggcagtgccattgcacacccctctgcgggagccctggtttctgatgagcaaatatacacgacagatggggatgacatcattagtcccacagagccagctctccctctagctgggggaccacactgctgaggccatcacacaagctgggcaacacccactgaggagctggggatacatgacatcatcgcagccgccgccttctgtggaccacgcagccagccctcagggcgatcct

SEQ ID NO: 136697 - DNA, 601 bp, Human
tgagctccagtttctctacctatgaaattggaggtaatagagcctgccttgcaggtggctgtcaggactaccttccatagggcatgtgaagctttagctcagggcacaccatggctgtagctcaggagttttttagaggtttgcaggctccagtgctggagacagtgatgaattggttaaagcctcaaaatggtggcctaaattaatagggattttcagccacttgagactgtttgaaaggaaacaatggctacccctccctttccttctcccctctatagaccctgcatgaggaccgccrcccacacttgttctaggagctggaagggtaaggctctctggcatctgctgcagcttgcaaggatgccatcctgcccagtgtctgagctcagaggacccctcccctagggaaggaaagggggtgaacctgaatggcacgcagcccaagataacaggggtggagggggaggccaacagctctttaaacacttgtccatgcagagggaggggaagagaaggaaatgcttctggcagtgccattgcacacccctctgcgggagccctggtttctgatgagcaaatatacacgacagatggggat

SEQ ID NO: 136698 - DNA, 601 bp, Human
agctgggattataggcatgcaccaccgtgtccagctaatttttgtatttttagtagagatggggttttgccatgttggtctggctggtcttgaactcctgaactcaggtaatccacctggctcgtcctcccaaagtgctgggattacaggtgtgagccaccaagcccagccccacacttcctctttaatgctgcacaaccaatgtcaccaggctccagacgaagaggcaagcctaggaaggtgatcccaagcacccacaaactgctccctaaaaagactaaatatgaccgggcgcactggmtcatgcctacaatcccagtgctttgggaggctgagggaggagggtcacttgaggctagttcaacaccagcctgggcaacatagtgagacccccgtctctaaaaagaaaaaagaaaagaaaaaaattagcaatggtggtatgtgcctatggtcccagctattcaagaggctgaggtggggggatcccttgaacccaggagttcaaggttgcagtgagctatggaaaaaagaaaaagattaaacacaaccatctctgcctgacttttctgtaaaactgtgatctcttcaggaggtctttctg

SEQ ID NO: 136699 - DNA, 601 bp, Human
aaggccagacactgagctgaggaagacagtcacagaggtagggagtttatttcttccctgagccacactgggggtccaggtatagaggaaatgctctctctccaggagtgtcactgaaggaaagtgttcaaagtcaccttctttatttaaaagaatatgtaagaatttcttactagctccaacaagcaccgagcagaacttggttgtaaaagatgcacaggaagaaatggttcccctctgaggtcagctgctgctactgaaagggcagctcacagccccttgagcttgtctcacacttcctttttttttttttgagacagagtttcgctcttgttgcccaggctggagtgtagtggtgcaatctcggctcactgcaacctccacctcatgggttcaagcgatcctcctgcctcagtctactgagtagctgggattataggcatgcaccaccgtgtccagctaatttttgtatttttagtagagatggggttttgccatgttggtctggctggtcttgaactcctgaactcaggtaatccacctggctcgtcctcccaaagtgctgggattacaggtgtgagccaccaagcccagccccaca

SEQ ID NO: 136700 - DNA, 601 bp, Human
gctccgagtagtcctccagcaactgcatgtaggccagcactgtgaaacaagggagaaagctgcagcgaggccgggggaggccacatcagggaacccctcccccaattcttcccacagcagctagggggctttccactgaaagcacctcagagagggacgaacagacggagcacggaggacttttcgggcaatgaaatcacactctgtctgatgcgctaacggaggagacacgtccagaccggcagacgcgcaacaccaatggggaaccctaatgtgaactggggactcaagcgagggcacmtggcgggtgcagggatggcaagtctcagctacctcctgagcaggcactttcccctcgaggcatgtcgcaagtgccacgagcagctgccaggtggagctgagattcagatgccaagaaaaagtggtggctctgcagtgctaaattttgtatcttcaaataagcacaaagccagaggcttctctgcaaaccccaactagtcaacaaatcaaggaaggccagacactgagctgaggaagacagtcacagaggtagggagtttatttcttccctgagccacactgggggtccaggtatagagga

SEQ ID NO: 136701 - DNA, 601 bp, Human
tctgctggtagatgtgctcgttctgtggcgtctggtagaacatagagggctgcggctccgagtagtcctccagcaactgcatgtaggccagcactgtgaaacaagggagaaagctgcagcgaggccgggggaggccacatcagggaacccctcccccaattcttcccacagcagctagggggctttccactgaaagcacctcagagagggacgaacagacggagcacggaggacttttcgggcaatgaaatcacactctgtctgatgcgctaacggaggagacacgtccagaccggcagaygcgcaacaccaatggggaaccctaatgtgaactggggactcaagcgagggcacatggcgggtgcagggatggcaagtctcagctacctcctgagcaggcactttcccctcgaggcatgtcgcaagtgccacgagcagctgccaggtggagctgagattcagatgccaagaaaaagtggtggctctgcagtgctaaattttgtatcttcaaataagcacaaagccagaggcttctctgcaaaccccaactagtcaacaaatcaaggaaggccagacactgagctgaggaagacagtcacag

SEQ ID NO: 136702 - DNA, 601 bp, Human
gaagttctagtcacaagggaaggtgtcactcaccagctgccgctgcttggggggtagggcgggcggcggggccagctcctgcacggagtccaccccactgaaggagtcgctgaagccgtatacctccatgaggagcttgttcttctgctggtagatgtgctcgttctgtggcgtctggtagaacatagagggctgcggctccgagtagtcctccagcaactgcatgtaggccagcactgtgaaacaagggagaaagctgcagcgaggccgggggaggccacatcagggaacccctcccccmattcttcccacagcagctagggggctttccactgaaagcacctcagagagggacgaacagacggagcacggaggacttttcgggcaatgaaatcacactctgtctgatgcgctaacggaggagacacgtccagaccggcagacgcgcaacaccaatggggaaccctaatgtgaactggggactcaagcgagggcacatggcgggtgcagggatggcaagtctcagctacctcctgagcaggcactttcccctcgaggcatgtcgcaagtgccacgagcagctgccaggtggagctgagat

SEQ ID NO: 136703 - DNA, 601 bp, Human
ctggagctccctgctggggagcttcctcttcctggggagcatggctggacaagaggctcagatcttcaaacctgactagggccctccatgttcattaactggcagcaaagggagaaagtttggagggatgccacaggtacccccgatctgctcaccctcccagtgcctgggcagttccagagcctcatggggtgcccacggtggaacagcttgccttctgtgctggcccgtgcttccttacatgcacaggagtccttagcacacgagtgttttctagaagaggaaggtgccatgtctgaarcagagtggctctgtttaaagccatcctccacttcaatggcacttgttttccttgggccctccccggccaaggctgggttgtaagtcactctacacagttaggcccattatgccaatcaagtccacagatggctgtgcacagaccatgtcctgtgctttgattgagtccctcctttctgggaggtctatgttgaagccaaagaagaaagaaaaaaatacaagagactgtcagcagagagagcaaacaccctgagtacaagcctgtccctgctgcgcggggctgctgtggaaaagaaaggtc

SEQ ID NO: 136704 - DNA, 601 bp, Human
cgttctggagagggatggcttctgggcccagttcagggactaaaaccagctgccgaaggccatctgcatgaaagggcaccctccttcatttccttacactagatcctaaaaattgtgtccactggaagcaggttgggtggaaggaggacgagggggctggagccacacagaactgggctgactctgggcttggagctgctcctctgtggggagtggatccatgtgtcattcacacgtcttcagaactcagacggggctccggcagcctgggtttgagtctggaccctgccatttctcaccygtttggccttgggcactacttaaaggtctccgtgcctcaggttttccatctgtaaaatggggataaccctagtgtctcctgtacagggctgttgggaggatgaaatgggatgatacgtgtgaagcacttgaaatattgcttaccacactgtacatgggccaacaggtgtgtgtaatgagcaccatttttgtctgtgaagtgtggataacgcttcctgcatctgcatttgagagagggtgtgaccagcagctggcaggacctgtcaggtggtatgcctgggctgtcattaggattgggtgt

SEQ ID NO: 136705 - DNA, 601 bp, Human
gctcttgtatgtcccagggataaaaactatgacgtactcataaccaaacttaattaaaatgtcctcgaatttaattttgtagcgaacagtccagttcattcatagtcctctaaccctaactgctcaaaagggatattgtggaaactctaaggggaaagaaaacaaaaacaaaaatctagctcagtcaagagctcggattgtctaaaggccaagtttcgcaagatttgtgaaaggagcttgccagaggtgcctctgaggaaaccaggggcttctgtgtggccacagcagggtgaggggagcrcatcttcccagcatgagtagggatgctgggggctctaaggcgtgaggcctcagtacccattgggagaatgcactccaaggtcctcagacaggcaggaccatcttggtcgaaggcactgggcattggactgcccaccctgggcacagatggaaaccagacaagaccaaactgggaacttgagtttggataagtctttaaaagtcactcggtccaaactcatcatttacagagggggaaaaaaggccaaacaggttaactctcatgtgtaaagttagaaacagaacaagactagaatccaga

SEQ ID NO: 136706 - DNA, 601 bp, Human
tgtctggggctcatctcagaatttaaccaaaggatatatgaaggacatgttggcactgtactgaatcccttctctgaggttccggcatactgggtgctgaatgtcccaaacctggccattactaatggttcctgaggtattctccttttaatgacataaggaccttataaggtccttccctcaggctccttggtgggctttttgctaagaatgcagtgttttagacacaagatgtcttaaggctcttgtatgtcccagggataaaaactatgacgtactcataaccaaacttaattaaaaygtcctcgaatttaattttgtagcgaacagtccagttcattcatagtcctctaaccctaactgctcaaaagggatattgtggaaactctaaggggaaagaaaacaaaaacaaaaatctagctcagtcaagagctcggattgtctaaaggccaagtttcgcaagatttgtgaaaggagcttgccagaggtgcctctgaggaaaccaggggcttctgtgtggccacagcagggtgaggggagcgcatcttcccagcatgagtagggatgctgggggctctaaggcgtgaggcctcagtaccca

SEQ ID NO: 136707 - DNA, 601 bp, Human
tccacacaggtttagtgccctacaaattcccttggcaagaggttttcaatggttagaatcttttagtggaaataatcgtccactgtgccaagaaccacgtgaggtgtcttcagatttgtcaactgctgtgtttccaaggggcactccttcagagttccatgctggacaaaccacacaggcccaggagcaatgaatgaagaaagtcaggaataaagggccgctctgatagtaatccaaagctctatgtctggggctcatctcagaatttaaccaaaggatatatgaaggacatgttggcacygtactgaatcccttctctgaggttccggcatactgggtgctgaatgtcccaaacctggccattactaatggttcctgaggtattctccttttaatgacataaggaccttataaggtccttccctcaggctccttggtgggctttttgctaagaatgcagtgttttagacacaagatgtcttaaggctcttgtatgtcccagggataaaaactatgacgtactcataaccaaacttaattaaaatgtcctcgaatttaattttgtagcgaacagtccagttcattcatagtcctctaaccc

SEQ ID NO: 136708 - DNA, 601 bp, Human
gcgttgtggagggcggctgtaatcccagctactccggaggctgaggcaggagaacgcttgaacctgggaggcggaggttgcagtgagccgagatcgtgccactgaactccagtctgggcaacagagcaagactccatctcaaaaacaaaaacaaaaaaccaaaagccatgacgcactcagacccaaaattaattaatatgtgtgcagatgttctttggttctgcgcaggcttcatgcccgtcttcctcagcctgctgacctgtggccctgctttgctcggggccatcctcctcaactgcawgtcttttgcaacccggcctggaaaagttgatgtcctgagcttgctgaattaaacccatccctggtatcagggaaggagtgaatgagaatacttctcagtatccacctccatttaaattgttccacacaggtttagtgccctacaaattcccttggcaagaggttttcaatggttagaatcttttagtggaaataatcgtccactgtgccaagaaccacgtgaggtgtcttcagatttgtcaactgctgtgtttccaaggggcactccttcagagttccatgctggacaaaccacacaggc

SEQ ID NO: 136709 - DNA, 601 bp, Human
tgaaaccccatctctactaaaaatacaaaaaattagctgggcgttgtggagggcggctgtaatcccagctactccggaggctgaggcaggagaacgcttgaacctgggaggcggaggttgcagtgagccgagatcgtgccactgaactccagtctgggcaacagagcaagactccatctcaaaaacaaaaacaaaaaaccaaaagccatgacgcactcagacccaaaattaattaatatgtgtgcagatgttctttggttctgcgcaggcttcatgcccgtcttcctcagcctgctgaccygtggccctgctttgctcggggccatcctcctcaactgcatgtcttttgcaacccggcctggaaaagttgatgtcctgagcttgctgaattaaacccatccctggtatcagggaaggagtgaatgagaatacttctcagtatccacctccatttaaattgttccacacaggtttagtgccctacaaattcccttggcaagaggttttcaatggttagaatcttttagtggaaataatcgtccactgtgccaagaaccacgtgaggtgtcttcagatttgtcaactgctgtgtttccaaggg

SEQ ID NO: 136710 - DNA, 601 bp, Human
cacgtgctttcatgtggtgtgaacttgtatgttacatacaaggtatcttaagactcccatatattccagggataaaaaccatgacgtggccaggcgcagtggctcacgcctgtaatcccagcactttgggaggccgaggtgggcagatcacctgaggtcaggagtttgagaccagcctggccaacgtggtgaaaccccatctctactaaaaatacaaaaaattagctgggcgttgtggagggcggctgtaatcccagctactccggaggctgaggcaggagaacgcttgaacctgggaggyggaggttgcagtgagccgagatcgtgccactgaactccagtctgggcaacagagcaagactccatctcaaaaacaaaaacaaaaaaccaaaagccatgacgcactcagacccaaaattaattaatatgtgtgcagatgttctttggttctgcgcaggcttcatgcccgtcttcctcagcctgctgacctgtggccctgctttgctcggggccatcctcctcaactgcatgtcttttgcaacccggcctggaaaagttgatgtcctgagcttgctgaattaaacccatccctggtatcagg

SEQ ID NO: 136711 - DNA, 601 bp, Human
ctcccacccccggctaccgggttctgcccacagatgctccctgctctctctctcaatgtgatctagctctgaccaggacaaaaagccaatgagacaagatggcatcagggaggaacaaaggacaaaggtcaggatggcaggaacttattttttccaacaggtgccgagagccccatggactgtcttccacttccctcccgtgggccattccgttttcctcctcctctcctcccttcttctctccttgtctctctatctctcccctttcctgtttggcctttaggcccgtcagtgtgcccakggtttctgtgatggctcatccttggggatggtttgtggccaggaggttgtgggtagggaaggagagaaagagtgagtgagtgagaggcagatgaatgggcagagtgaaggagcctgcaacaggtcccgaggggctgggcctggcatttcccagcgaggggacgccatggcatggggactgagcgtctgcatgaagctcaagccttctgttgagagcacatgtgctgatgcacagaaacctgggcccatctcagaaaacgactgttttgcccagaatgggatgccagctgctctgcagacc

SEQ ID NO: 136712 - DNA, 601 bp, Human
ggctaggctgcaccaaagctgccagttcacagcccatcccctctcctcaggggacatgcaatcctgagaagacgaaccggaacatgacacaggaaagcagcagcctcccccacatggcgacagatctgatgctaatagctccctttccatgaaatgctggttgtgcgtcacgtactacatgtgtgcttttcatccttgtaacaaccttgtgctcccactgcacagaggaaagcggggcccagggcactggggcagggcggtgtgctcaggttcatacagcaagtaaggagaaaacacggtggggagaagacagggttgtgcaggaaggagaaactcgtatgttgggaagggatgaagggaaggcagtggaggtgtgcaggggacaggttcgtggtaaggtggggagaagcagtgtgagggcctctgaagagccagggaagctggccctggttctgcagggatgtggcgacactatagtctagctgcagggttgagaagcagggagggcctctgactgcagaggcaggaaggccagtcaggagctgcagtgcatccaggtgagacatgggggtggggaggaagtgagtggccacgggctgga

SEQ ID NO: 136713 - DNA, 601 bp, Human
gaggtaacgccgtctcctccagagctgggcctttctctataggtggctctacgttatcccgagggtcgcagtgacctggaaggggctctggtctgcatgtacctccttccacaagaccaggtcaagctgagtgggatctaatccagccttcacacttcagagcagcactgggtcttttaggaagagtggaaaagcacagggggaacgcactgcaggagccaaactgtgtttcaagggctctgcagacaggaactacctgggaaactcttgagtcagacacagcagccagagcctcaggtcrgtagggaaggaaaatgaggaagaaaatggattcttggccagagcctgggaccaatgcatctgttacatgggagctagaggctaggctgcaccaaagctgccagttcacagcccatcccctctcctcaggggacatgcaatcctgagaagacgaaccggaacatgacacaggaaagcagcagcctcccccacatggcgacagatctgatgctaatagctccctttccatgaaatgctggttgtgcgtcacgtactacatgtgtgcttttcatccttgtaacaaccttgtgctcccactgca

SEQ ID NO: 136714 - DNA, 601 bp, Human
ggctgtaaacaataaagattctcaaagtctacaaccaggggttggaaacagctgcatcagagtggttgcttttgaaagcccccaatgcgaggcactctcagctctgttcctgctgtcaaggctgtgaccagtcctgctgctgagatgggcatactccctactgcccacagtaaggcaaggcaggctcgctcctgggctcaggaggtaacgccgtctcctccagagctgggcctttctctataggtggctctacgttatcccgagggtcgcagtgacctggaaggggctctggtctgcatgwacctccttccacaagaccaggtcaagctgagtgggatctaatccagccttcacacttcagagcagcactgggtcttttaggaagagtggaaaagcacagggggaacgcactgcaggagccaaactgtgtttcaagggctctgcagacaggaactacctgggaaactcttgagtcagacacagcagccagagcctcaggtcagtagggaaggaaaatgaggaagaaaatggattcttggccagagcctgggaccaatgcatctgttacatgggagctagaggctaggctgcaccaaagctg

SEQ ID NO: 136715 - DNA, 601 bp, Human
actccttagtggagcttatttttaaaaaccacctgaatatcctaagaaaaaaggatgtaaaagaacaaaaatgcgttgcttgggagaagatgggtgaatgcaaaagttccttattaagttccttctcatgtgatgtatttttgcaactggaatcacaatatctccactgaaaatactacgttttggccaatggcttcatggcaaattaactcttgcaaaacctccaatacattctaggatgctctgtaattcactaagtgttgatctgaatagcatcaaccctttatagaaagatttagtrcagactgaaaaatgattcaaattcagttctagaagtctgacaactatttttactcagtttgcatttcaacagcctgacaggggctctaatttatacttattcttagaactctatttagagcctgtagctacactttgtaacatgtcagaacatgaaggagaaatacacgcctctcaacgtccagcctacacacttttcttttgacccagccttacgagatctcaaaatttatttggcaattaagcagttcaaaaatgggcaattaagcagttcaaaaatgttaatctaacgctgtatttt

SEQ ID NO: 136716 - DNA, 601 bp, Human
aaaaaatatcttctcccttttcaaataaactccttagtggagcttatttttaaaaaccacctgaatatcctaagaaaaaaggatgtaaaagaacaaaaatgcgttgcttgggagaagatgggtgaatgcaaaagttccttattaagttccttctcatgtgatgtatttttgcaactggaatcacaatatctccactgaaaatactacgttttggccaatggcttcatggcaaattaactcttgcaaaacctccaatacattctaggatgctctgtaattcactaagtgttgatctgaatarcatcaaccctttatagaaagatttagtacagactgaaaaatgattcaaattcagttctagaagtctgacaactatttttactcagtttgcatttcaacagcctgacaggggctctaatttatacttattcttagaactctatttagagcctgtagctacactttgtaacatgtcagaacatgaaggagaaatacacgcctctcaacgtccagcctacacacttttcttttgacccagccttacgagatctcaaaatttatttggcaattaagcagttcaaaaatgggcaattaagcagtt

SEQ ID NO: 136717 - DNA, 601 bp, Human
taccttaggcccaggggcaactccttttccttgatgcccttgtgttaatttaaaacaataactataccttacataatgtcaaaagatgagttccaaagccaagtggtaggttctgaggccaatgccacatgcacatgaactgagatctgccactgaccgttttgtctttgatcctggtaagaaggcagtcctgtgggtcacactgtgtgaatgacaagatggcattcttctcaccaaagaaaggcaacattagcattatgttgggtccaaaaaatatcttctcccttttcaaataaactcyttagtggagcttatttttaaaaaccacctgaatatcctaagaaaaaaggatgtaaaagaacaaaaatgcgttgcttgggagaagatgggtgaatgcaaaagttccttattaagttccttctcatgtgatgtatttttgcaactggaatcacaatatctccactgaaaatactacgttttggccaatggcttcatggcaaattaactcttgcaaaacctccaatacattctaggatgctctgtaattcactaagtgttgatctgaatagcatcaaccctttatagaaagatttagtacaga

SEQ ID NO: 136718 - DNA, 601 bp, Human
ttgaactcctgggctcaagtgatcctcctacctcagcctcccaaagtgctgtgattataggcgtgagccatcgtgcccagcaggaaagcagatctttaaaggaacaattctgagtcctcaatataacagccactccacttaattcctctgctgatcaggaagagcgcgtgccagaggaggctgtctgctcatcagcggctgagggttagggacacaggctgaggaaccttgatcagaatggttgctccacagtgacttgagctccaagccctggagaattgtcagctccaccagttacagygaaatgtggtcatgtaaatgaatggattcactggcatggtgaagtgtttgggaagagaagttgccagaaattggtcattactgcataatcttggctcaagtaaggcttatgacttcagagtttttggatgctacttagcaaaacagataagctattggacagctggttttcgggcttaaatttttatccctcatttgtgagaaaacacattcaggggaagctgcttttctagtgtggtctgggcttccttcctcagcggagaatcaatgggagccacagctcagcactggcgctgggctc

SEQ ID NO: 136719 - DNA, 601 bp, Human
tcatctttaaaacggggatgaaaacaatagcccctcccccataaggtttctgcgacgttccgcgagacgcagagcgctgcgtgcaagtcctccgcatggtgctggtgcggacgacctctcggccagcagcagccgtcctctcctgccctcccaacaatccaggaactgccctaaataacagtactggggcattcagtaggggcctaatacatatttgctgatacgtattttagtaggcacctaatacatagtctaggcactgtattaattaaggtgtctagaatattacctgactcacagmagcgtctcagttttgagtgtggatgggtaagagacgaacttcacccactgcatgggttcaggtccagacactggggagggaggctcagggaaatgaccaggggtgtgggctgccaaggagggggcagctagcaaggagaaagcaaggagagtcggcctctcttggacaaaggggcctggcctgctctgcctctgcctctgcagctgtgagctcacgttctggtattcaagctatgcagtcgtgctgggacaagagccaaactggaaaggtaccttcacggggcagggagacacagggaaa

SEQ ID NO: 136720 - DNA, 601 bp, Human
tttgtagccccaattctcagatctgccagatgttcattcccaatgcccagacactgccacgagatttgctaaacagatccccctcaccttgccttgctgctgcctagtttaaggagtcatgttccgcgctgactccttctggagtcttgaaatagcctcatcggcgcccccgtgtaaagtcactttgtgcttccacgtgccctgcaataactgagcacctgatttacacatacacaaatggcttttgtgtcatcacaaaatgtaccaagttggagaagtgtcttcctaaccaatcatatartgtgtttagccggttttaattcaacaaggtgaggggcagactcccacagcatggtgcctcttccgggagacggcacagggcagcggctgactgcaaggtctccagttgcccctcatggcatctccgcttgtgtgccctagtacaagtgactgaagttcttgagcctcagctcaagctgttcatctttaaaacggggatgaaaacaatagcccctcccccataaggtttctgcgacgttccgcgagacgcagagcgctgcgtgcaagtcctccgcatggtgctggtgcggacgacctctcg

SEQ ID NO: 136721 - DNA, 601 bp, Human
gttttccatcgatctctggaggatgcctgcacacagcaagcctcccttactggctgggaaagtccacagagaagacagcaagcaggatgcactggctgaggggtgggacggcgtgctgctgggggggctgccttcagggaacccttgtatgactgtttcagggagtggctcaatcttttgtagccccaattctcagatctgccagatgttcattcccaatgcccagacactgccacgagatttgctaaacagatccccctcaccttgccttgctgctgcctagtttaaggagtcatgttcygcgctgactccttctggagtcttgaaatagcctcatcggcgcccccgtgtaaagtcactttgtgcttccacgtgccctgcaataactgagcacctgatttacacatacacaaatggcttttgtgtcatcacaaaatgtaccaagttggagaagtgtcttcctaaccaatcatatagtgtgtttagccggttttaattcaacaaggtgaggggcagactcccacagcatggtgcctcttccgggagacggcacagggcagcggctgactgcaaggtctccagttgcccctcatggcatctc

SEQ ID NO: 136722 - DNA, 601 bp, Human
ccagatccatgacatctgccctaagcactcactaccacttacacatctgctttcccatctaacctacaaactcaaggccaaccctatgccatggtcaaataaatcagtggaagtgtcatacatgtgaccagcactgaacactcaggtacctgtacaagtgaagttcccttcatatccttctttcaggagctcggggggcagacaccctgcttggtacaccctggcttgccgccctcacctacaccctcacagcaggctccacgcaacacttcaacgtttcacagcaattacccaggatggygctgcaggcctgggagctcgctctgggccttcctgggatggcagtggggtgaagggcttggctttctgggttttccatcgatctctggaggatgcctgcacacagcaagcctcccttactggctgggaaagtccacagagaagacagcaagcaggatgcactggctgaggggtgggacggcgtgctgctgggggggctgccttcagggaacccttgtatgactgtttcagggagtggctcaatcttttgtagccccaattctcagatctgccagatgttcattcccaatgcccagacact

SEQ ID NO: 136723 - DNA, 601 bp, Human
ctgtcttgtctgctcaggaacttcgtggccaaattcaatgtcattgtaattactcattttgaatttctggatgaatctctcaggttttattccttaagagtcaaacactgcaacttttaaacattgaaatccaccttgaatgcttttggaaaggagcggcacaaaccttaagcgtggctggcaagctgcactatggaaatgctaacgatgtctgagtccatttctcttcctaccccatttttttctttctttctttctttttttttttttttaacaaatgaagtaggctgggcatggtggytcacacctgcagtctcagctctttgggaggccaaggcaggtggattgcttgagcccaggagtttgaggccagcctgggcaacatggcaaaaccccatctctacaaaaaatacaaaaatgagctgggggtggtggtgagtgcctgcagttttagctgctctggaggctgagatgggaggatcacttgagcccagaaggcagaggttgcagtgaggcaagatcaagtcactgtactccaggctgggtgacaaagcaaggtcctgtctcaaataaaaacaaatgtgatcttacaacagctttg

SEQ ID NO: 136724 - DNA, 601 bp, Human
catgctctgctgggacagaaaataaaacctgcgtggcccatcgctgtcttgtctgctcaggaacttcgtggccaaattcaatgtcattgtaattactcattttgaatttctggatgaatctctcaggttttattccttaagagtcaaacactgcaacttttaaacattgaaatccaccttgaatgcttttggaaaggagcggcacaaaccttaagcgtggctggcaagctgcactatggaaatgctaacgatgtctgagtccatttctcttcctaccccatttttttctttctttctttctttttttttttttttaacaaatgaagtaggctgggcatggtggctcacacctgcagtctcagctctttgggaggccaaggcaggtggattgcttgagcccaggagtttgaggccagcctgggcaacatggcaaaaccccatctctacaaaaaatacaaaaatgagctgggggtggtggtgagtgcctgcagttttagctgctctggaggctgagatgggaggatcacttgagcccagaaggcagaggttgcagtgaggcaagatcaagtcactgtactccaggctgggtgacaaagcaagg

SEQ ID NO: 136725 - DNA, 601 bp, Human
ttggctgaagcaaaatgtggaaagtggattgctcaatagaactgctgtaccgcgatggtcgggagctggggcagcagcatcacgagggtgctgacgtcgggtaccttgtggctccctcaggagggggtgtgcatagtcatggcaggggctatgggccagactcacccgcttcctcagaagcagtcagtgttggagcaatgggacatgctggggagggagatgaaggtctgaaaggccctatgggaagaagagtccctccctctgcatgagggacagaagatgaagccaacaccagaagatragggaggaaggaaccccacagagagcactagatacacagccggggcccgtgccacgctggtcccagagatttctagatgacccatctggccaggctctgaggagtgccacacgcactgaagcaggagcaaagggcagacctccacctggaagccacgtcctctccaaagggccgagctggctcccagcagcctgcaggagcccagtctgctggtgactaggagggggctcagcccaacagaagcaggtgcgggggaagcggcctcgggagggcagggcccaagccccaccaggccaggcc

SEQ ID NO: 136726 - DNA, 601 bp, Human
aactctgctgatttaaagaagtcctcagggctgcagtgctcaaccgggttcagtccccaaagggccagctctcaggccctggggtgccagtcccctcttcctccggcagacttgcttcctcctgggtccctgggctggccctactcagtgacaacatggcctgccaacatccctggtctgctgctgagcctgatggagaactggggcaggacaaatacagaaagagtgcttcaaggcaaggagccagtgagccctggaagtgtcacagtggagggagagagccatgcgaagctggcctctmcctgcacgtggacttcaccatggggaggctgagccggggggtgccagatgcacatgtcagcagaggagacagctcccatggactgggtcaaatcccactggagtggacactcttcaatgttctataacctgctaatgtctgaaacagggctggctctgggtgggcctctgaacccctgtggggaccctgctgagagaaccacctgaacgggtgtgaccaagctcttcacgggtgggggcccgccctggggtggatcactgggagtcttccagccctcatgggcctcccttcaaggaacct

SEQ ID NO: 136727 - DNA, 601 bp, Human
gcatagaaacagaggccagaagtcaaggaccctgctcaagaccacacagctcataaacagcagagcttggatttgaacccagggctatctacctgcaaagcctgtgcccttaaccactgggccctgctgtcgtgaaccaaactctgctgatttaaagaagtcctcagggctgcagtgctcaaccgggttcagtccccaaagggccagctctcaggccctggggtgccagtcccctcttcctccggcagacttgcttcctcctgggtccctgggctggccctactcagtgacaacatggccygccaacatccctggtctgctgctgagcctgatggagaactggggcaggacaaatacagaaagagtgcttcaaggcaaggagccagtgagccctggaagtgtcacagtggagggagagagccatgcgaagctggcctctccctgcacgtggacttcaccatggggaggctgagccggggggtgccagatgcacatgtcagcagaggagacagctcccatggactgggtcaaatcccactggagtggacactcttcaatgttctataacctgctaatgtctgaaacagggctggctctgggt

SEQ ID NO: 136728 - DNA, 601 bp, Human
tcaataccctgtctctaaaaaacaaaaaaaggaaataaggaaagaaggaagagtttcaacttgaaataccctcaggcctaggggctagctgggagaggctgctcaggcaggcctcatgagtgggcgcactgctctcgggggacccagctcctctgggtccacttcctacctctcactgccgtctctgctgtccttcccagggacgccgctgaccgctgagggatctctgggatgtccgtctttcccagccggtggctcctggaaagaggagtgggtgctgagttctggacaggggccctcygcggggctgctctgtcttcccagcattcctgcctgcaagtggctgtggagtgcaagttcctatggagcaatctcagatgtgaacaaattaaagatgaatgccgttaatcacaggaaacacaagccctcaagactagcatgtggcctttggagaaagtgaaaggtgccactatttgtctcatctgtaagctgccaacctaggcaaagccacctcaactacctcctcaaagaagactgtcatagccactccccccgagcacagccagggactgggctctaggctgtgcccacttctcctcat

SEQ ID NO: 136729 - DNA, 601 bp, Human
aagagtggccaggaggcaggctgggcaggtggccctcttcaacaggtccctatgcaatgccttctcatttctttttctttcttttgctatttttattaactgcctcttcaaccattcatgctgagccctgataatgacaagtgggcactcccttgctctaaggtcaccaaagaccccagaggtggctaaagcttgacctaaggagggaggaaaagcttgaacacatggaacatttcatagagaaggggaagtcaatgtgaagttgcaggtgggagtgcccatttgcagatcctacacatcrtatttcacaggtgcatactggggaaatctactacgtatttctacacttggtcaggtttggtttatgctaatattgaaaaatgtggccaggcatcatggctcacgcctgtaatcccagcactttgggaggctggggcaggtggatcatgaggtcgggagattgagaccatcctggctaacatggtgaaaccccgtctctactaaaaatacaaaataaataaataaataaaaacttagccgggcatggtggcacatgcctgtagtcccagctacttgggaagctgaggcgggagaatcgctt

SEQ ID NO: 136730 - DNA, 601 bp, Human
tggaactctgaagacgatactttggggtccagtgaagctagtggcatacccacgagctgcatttgcttggcccacacactctgccccaggtattaacctagaaaccacaccattcctggcttcacacctggggaaagctcagtctgggcagacaagtcagagagacaagtcagagagcacaagagtggccaggaggcaggctgggcaggtggccctcttcaacaggtccctatgcaatgccttctcatttctttttctttcttttgctatttttattaactgcctcttcaaccattcatgytgagccctgataatgacaagtgggcactcccttgctctaaggtcaccaaagaccccagaggtggctaaagcttgacctaaggagggaggaaaagcttgaacacatggaacatttcatagagaaggggaagtcaatgtgaagttgcaggtgggagtgcccatttgcagatcctacacatcatatttcacaggtgcatactggggaaatctactacgtatttctacacttggtcaggtttggtttatgctaatattgaaaaatgtggccaggcatcatggctcacgcctgtaatcccagcac

SEQ ID NO: 136731 - DNA, 601 bp, Human
acttgaacccaggaggtggaggttgcagtgagccgagatcgcaccactgcactccagcctaggtgacagagtgagactctgtctcaagggaaaaaaaaaaatgtgccttcagtaaaagaatatggatgggtcagagtgggccctgcccagtctcgagaaaatccctgctccacatctcgtcaatgttcaccctgtggtttggccttgatggagggacaacatcccataattatttctgagcagtcaaagtgttcatccttctctttcacgagaaccatctggaactctgaagacgatactytggggtccagtgaagctagtggcatacccacgagctgcatttgcttggcccacacactctgccccaggtattaacctagaaaccacaccattcctggcttcacacctggggaaagctcagtctgggcagacaagtcagagagacaagtcagagagcacaagagtggccaggaggcaggctgggcaggtggccctcttcaacaggtccctatgcaatgccttctcatttctttttctttcttttgctatttttattaactgcctcttcaaccattcatgctgagccctgataatgacaagt

SEQ ID NO: 136732 - DNA, 601 bp, Human
tttttttttttgagacggagtctcgctctgtcacccaggctggagtgcagtggcgcaatcttggctcatcacaacctccacctcctgggttcaagtgattctcctgcctcagcctcctgagtagctgggattacaggcacatgccactacgtcctgctaatttttgtatttttagtagagacagggattcactatgttggtcaggctggtctcgaactcctgtcctcgtgatctgcccaattcggcttcccaaagtgctgggattataggtgtgagccaccgtgcccagccacttatttgtttttttttttgagacagagtctccctctgtagcccaggctggagtgcagtggtgcgatcttggctcactgcagccctgacctcctgggctcaagccatcctcccaccttagtctcccaagtagcgaggactacaggcacaagccaccatgcctggataattctgttcattgtagggatgaggtctcactatgtagctcaggctggtcttgatctcctgactcatgtgattctcctgctttggcctctcaaagtgttaagattataagcatgagccaccgtgcccagtctttttttttttt

SEQ ID NO: 136733 - DNA, 601 bp, Human
tctcagccactccctgccaaggcccaccgcacagttagcatttagggagaggaggagctaaggggcaagcagaatgggagagaaagctgcattgctcttgaggctgctccccaagtcttctccaaggaccgacttgccacgggaccctttgcttggcgctaagaaagagctgtgaaccaagcagacatagcctcttgtccctgagggttcagtcgagcaggagacagaatttatttatttgcttttttttttttttttgagacggagtctcgctctgtcacccaggctggagtgcagtggygcaatcttggctcatcacaacctccacctcctgggttcaagtgattctcctgcctcagcctcctgagtagctgggattacaggcacatgccactacgtcctgctaatttttgtatttttagtagagacagggattcactatgttggtcaggctggtctcgaactcctgtcctcgtgatctgcccaattcggcttcccaaagtgctgggattataggtgtgagccaccgtgcccagccacttatttgtttttttttttgagacagagtctccctctgtagcccaggctggagtgcagtggt

SEQ ID NO: 136734 - DNA, 601 bp, Human
cacggaagtgattccgctgggaaaataaaaaggttccattaagctgtttgagtgatggtctcagccactccctgccaaggcccaccgcacagttagcatttagggagaggaggagctaaggggcaagcagaatgggagagaaagctgcattgctcttgaggctgctccccaagtcttctccaaggaccgacttgccacgggaccctttgcttggcgctaagaaagagctgtgaaccaagcagacatagcctcttgtccctgagggttcagtcgagcaggagacagaatttatttatttgcttttttttttttttttgagacggagtctcgctctgtcacccaggctggagtgcagtggcgcaatcttggctcatcacaacctccacctcctgggttcaagtgattctcctgcctcagcctcctgagtagctgggattacaggcacatgccactacgtcctgctaatttttgtatttttagtagagacagggattcactatgttggtcaggctggtctcgaactcctgtcctcgtgatctgcccaattcggcttcccaaagtgctgggattataggtgtgagccaccgtgcccagccactta

SEQ ID NO: 136735 - DNA, 601 bp, Human
gctactgactggctgtgtggccataggacagtcgctgctgcctctggatgttccatctgtacacggaagtgattccgctgggaaaataaaaaggttccattaagctgtttgagtgatggtctcagccactccctgccaaggcccaccgcacagttagcatttagggagaggaggagctaaggggcaagcagaatgggagagaaagctgcattgctcttgaggctgctccccaagtcttctccaaggaccgacttgccacgggaccctttgcttggcgctaagaaagagctgtgaaccaagmagacatagcctcttgtccctgagggttcagtcgagcaggagacagaatttatttatttgcttttttttttttttttgagacggagtctcgctctgtcacccaggctggagtgcagtggcgcaatcttggctcatcacaacctccacctcctgggttcaagtgattctcctgcctcagcctcctgagtagctgggattacaggcacatgccactacgtcctgctaatttttgtatttttagtagagacagggattcactatgttggtcaggctggtctcgaactcctgtcctcgtgatctg

SEQ ID NO: 136736 - DNA, 601 bp, Human
tcaaaccggctcagctcccgatgcctggaggccaaggcagtgccggtgtgcacggctcgaaaccgctcccggaacatgcctgccccgatggcagctacgtcactatggactggatcctcagctctgctactgactggctgtgtggccataggacagtcgctgctgcctctggatgttccatctgtacacggaagtgattccgctgggaaaataaaaaggttccattaagctgtttgagtgatggtctcagccactccctgccaaggcccaccgcacagttagcatttagggagaggaggasctaaggggcaagcagaatgggagagaaagctgcattgctcttgaggctgctccccaagtcttctccaaggaccgacttgccacgggaccctttgcttggcgctaagaaagagctgtgaaccaagcagacatagcctcttgtccctgagggttcagtcgagcaggagacagaatttatttatttgcttttttttttttttttgagacggagtctcgctctgtcacccaggctggagtgcagtggcgcaatcttggctcatcacaacctccacctcctgggttcaagtgattctcctgcctc

SEQ ID NO: 136737 - DNA, 601 bp, Human
gagactggccggccaggtggtgctggccccttgagggcaggcagtgaagggtgctgtggccatgccccatcaggtcactagcacctcctttccagagcatgactgggaatgacaactcttttgctagcagagtccacccaacaagacgttttagggattaggggacggtccctgcttttccagccctctcaatcagcacactgaatgcgtggtagggtggggcagctgtgtgctgtgaaactgaggccactgctacagaattgaaggttcctggacagaacaaaccttcaagaatttcctygtggagtatgtgagtgaagtccggtctaatggtctgcaacaatagagtgactcagcagtcaggaaaggaatcaaaaggtacctgcatgttatcttaagtttagtactactgggtgacatgccatcactcaaggcgctgtctgtggtgcgcttagtatgcgctgagcccctcaaggaccctggaggccctggggtcactaccttgtaccagcggaggacagatgccacgcacgcctggagttgaacatgatctacttgtcttccaaggtgggctctccctgctctgactcaggcgcaccag

SEQ ID NO: 136738 - DNA, 601 bp, Human
gcagctccagcttacccctcacctctccatgcctgcctcctcttagagggggctggtaccagtcagggactcccagactttccagaattacaacagccctatttatttgctgtggtgacaccttctcaactgtgctgtctctgatattacagaatgaagtggaattttaaaatgtaggacactgcctgagccaacgggtggccagactcactccctgcagccaccccccgtgcctgctgaggtgtgaggcccaaggaggctccgcagctgtgctcctcactgtgaggctgggtgcaaacaygcactgcttaaatcttgtgctctggacatacaccacctgctcccaccttctccctcattcccgagctgctgggtagaggaatctcgaggaacccacatctccagctgagtcatgctggcttggctcctgcccccacccttgccccatcccctcttgcatcaaacgagaggaaaacccacgcctgctcttgcactgggggctgcgtggggtggggctggcaggtgaaggaggctccgggctgggaatcacagcagggcccatccgcactgtgctcaggctcattcctcggcccccacaccc

SEQ ID NO: 136739 - DNA, 601 bp, Human
tgtcctaaggctttatgcttcagagggtctcagccatcatgggaacaaagaaaatcgtctgttcaaacccgtcagcaggatcctgaaatgaaaccctaggctttacttttatttttaaatttttattatgattattattttcgagacagggtctcactctatcactcaggctggagtgcagtggtgcgatcttggttcactgccacctctgcctcctgggttcaagtgattctcctgcctcaagcctcccgagtagctgggaccacaggcacgcgccactacgcctggctgattttagtasagacaaggtttcaccatgttggccaggctagtctcaaactcttggcctcaagtgattcactcagcttggcctcccaaagtgctgggattacaggcgtgagccaccgtgcctggtcagtacttttagatggtagggtccaatcagaaaaatccggggaaattccacgttttgggtcctaagggataggctgaagaggcacggcttgggccgggtaccaaggagaggcatggtgccagccactgggcaggtgtgggctggcagctccagcttacccctcacctctccatgcctgcctcctct

SEQ ID NO: 136740 - DNA, 601 bp, Human
gcctgtcctaaggctttatgcttcagagggtctcagccatcatgggaacaaagaaaatcgtctgttcaaacccgtcagcaggatcctgaaatgaaaccctaggctttacttttatttttaaatttttattatgattattattttcgagacagggtctcactctatcactcaggctggagtgcagtggtgcgatcttggttcactgccacctctgcctcctgggttcaagtgattctcctgcctcaagcctcccgagtagctgggaccacaggcacgcgccactacgcctggctgattttartagagacaaggtttcaccatgttggccaggctagtctcaaactcttggcctcaagtgattcactcagcttggcctcccaaagtgctgggattacaggcgtgagccaccgtgcctggtcagtacttttagatggtagggtccaatcagaaaaatccggggaaattccacgttttgggtcctaagggataggctgaagaggcacggcttgggccgggtaccaaggagaggcatggtgccagccactgggcaggtgtgggctggcagctccagcttacccctcacctctccatgcctgcctcc

SEQ ID NO: 136741 - DNA, 601 bp, Human
ctgggtgcagagtgctggggggtggtagccagggtggatttgagtccttgctctgagagaggcaggggagatggcacggggagtgggatgggcgagggagccgagggcttgggaaccccctctggtgtctccgcctgcatgtcccagagaagacacacgtcctctctgtccatctctcaaaggaaacggcagatcagagaggggaaacaggaaagggttttatctcatgggcactttctaccgatgatggtgctgcctggagaaccgtgctgtgggagctgaggccaactctggtcccagsggaaaagggcacttaggctgacgagtgacgcctgccctaggcatcaaaacccggtggcatgcctgttccaggtaggagccagccctggattagactctgagaggctctgcctgtcctaaggctttatgcttcagagggtctcagccatcatgggaacaaagaaaatcgtctgttcaaacccgtcagcaggatcctgaaatgaaaccctaggctttacttttatttttaaatttttattatgattattattttcgagacagggtctcactctatcactcaggctggagtgcagtggtgcga

SEQ ID NO: 136742 - DNA, 601 bp, Human
tgcaggggccctgggtcaggaaggaaaggatatctgtactgcagcttcttgatgagctcctctggggagatgaaggtcctgtaggtggtcaggaatgcctcgcagtacaacaccaaatctagagggaaaaacaatgcaaactgcttgtctgggtgcagagtgctggggggtggtagccagggtggatttgagtccttgctctgagagaggcaggggagatggcacggggagtgggatgggcgagggagccgagggcttgggaaccccctctggtgtctccgcctgcatgtcccagagaagwcacacgtcctctctgtccatctctcaaaggaaacggcagatcagagaggggaaacaggaaagggttttatctcatgggcactttctaccgatgatggtgctgcctggagaaccgtgctgtgggagctgaggccaactctggtcccaggggaaaagggcacttaggctgacgagtgacgcctgccctaggcatcaaaacccggtggcatgcctgttccaggtaggagccagccctggattagactctgagaggctctgcctgtcctaaggctttatgcttcagagggtctcagccatcatg

SEQ ID NO: 136743 - DNA, 601 bp, Human
gatgaggaacttgcctgagctcaaagctggaatgcaggagggtagaggtgggaacctcggtccatggggctcctgtgtccctacttcaatcacactgccacccaatatgctgctcggcttcccccacgaggactgaagggcaagagggtccctctctctccaaaatgcccatggtgcaggggccctgggtcaggaaggaaaggatatctgtactgcagcttcttgatgagctcctctggggagatgaaggtcctgtaggtggtcaggaatgcctcgcagtacaacaccaaatctagagggaaaaacaatgcaaactgcttgtctgggtgcagagtgctggggggtggtagccagggtggatttgagtccttgctctgagagaggcaggggagatggcacggggagtgggatgggcgagggagccgagggcttgggaaccccctctggtgtctccgcctgcatgtcccagagaagacacacgtcctctctgtccatctctcaaaggaaacggcagatcagagaggggaaacaggaaagggttttatctcatgggcactttctaccgatgatggtgctgcctggagaaccgtgctgtgggagc

SEQ ID NO: 136744 - DNA, 601 bp, Human
aaggtgactgtgctgacccctgagctgtctatttgggtcttggtatccttcgtgcccaacgccctggggctcagctctgagaagctgccggagccgaccatgagggtctctcagaggcgtctgcaggaccggcacacttgcccctcccagtctggggcatgtctaattcgtttttagaatcatccaatgaccacaactgccaccagacacacattcccagactatgttccagcctcttcacatcatttcactcggcccttttagagatgaggaacttgcctgagctcaaagctggaatgcrggagggtagaggtgggaacctcggtccatggggctcctgtgtccctacttcaatcacactgccacccaatatgctgctcggcttcccccacgaggactgaagggcaagagggtccctctctctccaaaatgcccatggtgcaggggccctgggtcaggaaggaaaggatatctgtactgcagcttcttgatgagctcctctggggagatgaaggtcctgtaggtggtcaggaatgcctcgcagtacaacaccaaatctagagggaaaaacaatgcaaactgcttgtctgggtgcagagtg

SEQ ID NO: 136745 - DNA, 601 bp, Human
acccatctcaccctggtctatcgggcacaggccattctctcaaaggaccaagatagagcaggcaagagccagctctgcccagagccgatgggcaggagaagcaggtggaatggagcctttgcctccccactggcccccaggaccccaagggtgaagcactcaccagagctcatccaccacccgtaccagcacgaagaacgtgttcttgctgacgcgcttcttgaatgtgtcggcaaagggagagaatttctcatatgtggagcacgggttaaagaaatagccatgtggccggctgagggtsgtggagtggaggactgactcctggtgaccactcactgagcgctcacaatgtgcccatcttcctgcatgtaaagcactggcatccagaaacgagggcacgggactagcgcagtggaacaactgcaaagccaggatttgagcacaggcgtctgtccccagggatgcccccggctgctgccctctcctccctgccacgccatctccgctgcactgtccagacccgcctttccatcgggttcaccccgaggtgcccatgagattacagacacgtagagagtgccttgctgaactttaggtagag

SEQ ID NO: 136746 - DNA, 601 bp, Human
gagagacacctcacccatctcaccctggtctatcgggcacaggccattctctcaaaggaccaagatagagcaggcaagagccagctctgcccagagccgatgggcaggagaagcaggtggaatggagcctttgcctccccactggcccccaggaccccaagggtgaagcactcaccagagctcatccaccacccgtaccagcacgaagaacgtgttcttgctgacgcgcttcttgaatgtgtcggcaaagggagagaatttctcatatgtggagcacgggttaaagaaatagccatgtggycggctgagggtcgtggagtggaggactgactcctggtgaccactcactgagcgctcacaatgtgcccatcttcctgcatgtaaagcactggcatccagaaacgagggcacgggactagcgcagtggaacaactgcaaagccaggatttgagcacaggcgtctgtccccagggatgcccccggctgctgccctctcctccctgccacgccatctccgctgcactgtccagacccgcctttccatcgggttcaccccgaggtgcccatgagattacagacacgtagagagtgccttgctgaa

SEQ ID NO: 136747 - DNA, 601 bp, Human
caccaagacttcccggcctctcagactagatgctccccaacttgccctgctgagcactgtccacacgtggccatttcccagccgcacagccacttaccatggtcatctcccccagcaggaggaaggcagtccgcctgatggagatttgttagcggaacggatatggccaagtgccatgctgtcagatggccagccatggaaacactgaggagcgagggagaggtggcctctcccattccagcctccacacagcctccaccatggctggcggctgagagcacggcctgctggagactggacytaagataccatgggagcaggtgcgttgggcgggttctctcctgagggtccaggagggacctcatgaggaaatccagggcctgggtgcagggtggagagacacctcacccatctcaccctggtctatcgggcacaggccattctctcaaaggaccaagatagagcaggcaagagccagctctgcccagagccgatgggcaggagaagcaggtggaatggagcctttgcctccccactggcccccaggaccccaagggtgaagcactcaccagagctcatccaccacccgtaccagcacgaa

SEQ ID NO: 136748 - DNA, 601 bp, Human
taactggagggtcaaccaccctctgcccaactccacaggtcccactacgcacaaacacccagccaggtgtgggtcctggccctggccagcagggattctgtccttttcaacgagtgtcagcccaacccctggtcacaggggacttcaggccgttttgtggagaaacaccccacagtactcattgtgcctgggcagccagcgcttgcgtgtatacgacatcccggaagatgggctcctgcctggccctgttcggcggtgcagccagaggagcttcccaggcacacactgagtggcgtcactyctgactcggagctgcctttgctctgccctgtactcagggaggaccaactaaagatagcatgtgacctcgccctccccagggctgggtggcttctctcctgcaggggtggggggctcccacctaggagactcagccagccctgccccactcagaaggcccctctcctgcctcttctcctgttacgtgcctctccctgaagtgctgcctcctgaggaccccccatgcagaggccgtgtgaatttcccacctctccccatacactagcttacaaccatccctgaacatgggcttgaacaagaa

SEQ ID NO: 136749 - DNA, 601 bp, Human
gagggcggcccggtaggctcggaaggaggacgagctgtcgatcagtgtgcagtactcggccaggccctggcaggacaggacaggacaggaccggacaggggtgagcgagtgctggggcaatgctggggcagagccctggtcctcctcactaactggagggtcaaccaccctctgcccaactccacaggtcccactacgcacaaacacccagccaggtgtgggtcctggccctggccagcagggattctgtccttttcaacgagtgtcagcccaacccctggtcacaggggacttcaggccrttttgtggagaaacaccccacagtactcattgtgcctgggcagccagcgcttgcgtgtatacgacatcccggaagatgggctcctgcctggccctgttcggcggtgcagccagaggagcttcccaggcacacactgagtggcgtcactcctgactcggagctgcctttgctctgccctgtactcagggaggaccaactaaagatagcatgtgacctcgccctccccagggctgggtggcttctctcctgcaggggtggggggctcccacctaggagactcagccagccctgccccactca

SEQ ID NO: 136750 - DNA, 601 bp, Human
ctttctgaacttctttacaccaaggctctcaaggtccctgggtggccgtgcatcctcaggttgttctaatgcgcagccacgtgtgaggacactggaatactgtgtgatgccatgtgtggggagaggagccatacatctgtcacaagcatggctgcacatgctcacgggcaggctacagaaggaaatgagagtggggctgggggctgggaaaggagaacccgtattcttcacctgagcgcttcttttctgtttaaactgtattataagaagcattatatattatattatatatatgtattgkatattatgcattataactgtattacaagaaccttaagtaaaaccaagtacaaatgtctccgttagaaacccctaaattaagatttctctgctggagcctgacagatcttccccagagcaatggaggcaaacccaggcggggctgggggcctggaggggctgctactcacaggtacgggatgcacggcggttccacctccgagagggcggcccggtaggctcggaaggaggacgagctgtcgatcagtgtgcagtactcggccaggccctggcaggacaggacaggacaggaccggacagg

SEQ ID NO: 136751 - DNA, 601 bp, Human
cgctacgtcccttttctatgaaacacatatttcctctcgcccatggtccacgctcaggaagcactttctgaacttctttacaccaaggctctcaaggtccctgggtggccgtgcatcctcaggttgttctaatgcgcagccacgtgtgaggacactggaatactgtgtgatgccatgtgtggggagaggagccatacatctgtcacaagcatggctgcacatgctcacgggcaggctacagaaggaaatgagagtggggctgggggctgggaaaggagaacccgtattcttcacctgagcrcttcttttctgtttaaactgtattataagaagcattatatattatattatatatatgtattgtatattatgcattataactgtattacaagaaccttaagtaaaaccaagtacaaatgtctccgttagaaacccctaaattaagatttctctgctggagcctgacagatcttccccagagcaatggaggcaaacccaggcggggctgggggcctggaggggctgctactcacaggtacgggatgcacggcggttccacctccgagagggcggcccggtaggctcggaaggaggacgagct

SEQ ID NO: 136752 - DNA, 601 bp, Human
tctctgagggttgaggcctcgagggcagccctgcagtaaccctataggatgtgccattgaacactcagcactgggatgctgctgcgcttttggtctcttggagattctcagtgtctactagtatatactaaaggctctcgtaagtcctgcaacagacacttgtttggttttggttattccgctacgtcccttttctatgaaacacatatttcctctcgcccatggtccacgctcaggaagcactttctgaacttctttacaccaaggctctcaaggtccctgggtggccgtgcatcctcargttgttctaatgcgcagccacgtgtgaggacactggaatactgtgtgatgccatgtgtggggagaggagccatacatctgtcacaagcatggctgcacatgctcacgggcaggctacagaaggaaatgagagtggggctgggggctgggaaaggagaacccgtattcttcacctgagcgcttcttttctgtttaaactgtattataagaagcattatatattatattatatatatgtattgtatattatgcattataactgtattacaagaaccttaagtaaaaccaagtacaaatgtct

SEQ ID NO: 136753 - DNA, 601 bp, Human
ggcaggtggatcacctgaggtcaagagtttgagactagcctggccaacatggtgaaactccgtctctactaaaaaaaatacaaaaaaaaaaaattagccaggcgtggttgcgcatgcctgtagtcccatcgactactcaggaggctgaggtgggagaattgcttgaactcaggaggcagagattgcagtgagccaagatcatgccactgcataccagcctgggtgacagagtgagactccatcacaaacaaagaaacaaagaaacaaacaaggtgtagtaacttaataggtgcttctgacygcagaggacttaaggccagatgagaaagacaggggcagttcctccactcagggagaactcagcttgagggagcagatgtagagccacagtgggaaagactgttagtgctcagagcaggaagcctggggatttgtatctctgagggttgaggcctcgagggcagccctgcagtaaccctataggatgtgccattgaacactcagcactgggatgctgctgcgcttttggtctcttggagattctcagtgtctactagtatatactaaaggctctcgtaagtcctgcaacagacacttgttt

SEQ ID NO: 136754 - DNA, 601 bp, Human
gcccaggagttcaaggctgcagtgagctatgattgcaccactgcactccagcctgggtgacagagactccgtctttattaaacaaagaaactggctgggtgtggtgactcctgcctgtaatcccagcactttgggaggccaaggcaggtggatcacctgaggtcaagagtttgagactagcctggccaacatggtgaaactccgtctctactaaaaaaaatacaaaaaaaaaaaattagccaggcgtggttgcgcatgcctgtagtcccatcgactactcaggaggctgaggtgggagaaytgcttgaactcaggaggcagagattgcagtgagccaagatcatgccactgcataccagcctgggtgacagagtgagactccatcacaaacaaagaaacaaagaaacaaacaaggtgtagtaacttaataggtgcttctgaccgcagaggacttaaggccagatgagaaagacaggggcagttcctccactcagggagaactcagcttgagggagcagatgtagagccacagtgggaaagactgttagtgctcagagcaggaagcctggggatttgtatctctgagggttgaggcctcgag

SEQ ID NO: 136755 - DNA, 601 bp, Human
aaccagcctgggcaacatagcaagacctcgtccctacaaaaaatacaaaaattagctgggcatggtggcgtgtacctgtaatcccagctactaaggagaccgatgtgggaggattccttgagcccaggagttcaaggctgcagtgagctatgattgcaccactgcactccagcctgggtgacagagactccgtctttattaaacaaagaaactggctgggtgtggtgactcctgcctgtaatcccagcactttgggaggccaaggcaggtggatcacctgaggtcaagagtttgagactascctggccaacatggtgaaactccgtctctactaaaaaaaatacaaaaaaaaaaaattagccaggcgtggttgcgcatgcctgtagtcccatcgactactcaggaggctgaggtgggagaattgcttgaactcaggaggcagagattgcagtgagccaagatcatgccactgcataccagcctgggtgacagagtgagactccatcacaaacaaagaaacaaagaaacaaacaaggtgtagtaacttaataggtgcttctgaccgcagaggacttaaggccagatgagaaagacaggggca

SEQ ID NO: 136756 - DNA, 601 bp, Human
caagaacgtaacaagaactccagcctgggtaacaagaacgtaactctgtctcaaaaaaagaaaaaaaaaaagagtttgaaaccagcctgggcaacatagcaagacctcgtccctacaaaaaatacaaaaattagctgggcatggtggcgtgtacctgtaatcccagctactaaggagaccgatgtgggaggattccttgagcccaggagttcaaggctgcagtgagctatgattgcaccactgcactccagcctgggtgacagagactccgtctttattaaacaaagaaactggctgggtrtggtgactcctgcctgtaatcccagcactttgggaggccaaggcaggtggatcacctgaggtcaagagtttgagactagcctggccaacatggtgaaactccgtctctactaaaaaaaatacaaaaaaaaaaaattagccaggcgtggttgcgcatgcctgtagtcccatcgactactcaggaggctgaggtgggagaattgcttgaactcaggaggcagagattgcagtgagccaagatcatgccactgcataccagcctgggtgacagagtgagactccatcacaaacaaagaaacaa

SEQ ID NO: 136757 - DNA, 601 bp, Human
tggctcacacctgtaatcccagcattttgggaggccaaggtgggaggatcacctgaggtcaggagtttgagatcaacctggccaacatggtgaaaccctgtctctactaaaaatacaaaaagtagccgggcatggtggtgcacacctgtcatcccaactcgggaggctgaggcaggagaatcacttgaacctgggaggcggaggttgcagtgagccaagattgcgccactgcctgggtaacaagaacgtaacaagaactccagcctgggtaacaagaacgtaactctgtctcaaaaaaagaaaaaaaaaaagagtttgaaaccagcctgggcaacatagcaagacctcgtccctacaaaaaatacaaaaattagctgggcatggtggcgtgtacctgtaatcccagctactaaggagaccgatgtgggaggattccttgagcccaggagttcaaggctgcagtgagctatgattgcaccactgcactccagcctgggtgacagagactccgtctttattaaacaaagaaactggctgggtgtggtgactcctgcctgtaatcccagcactttgggaggccaaggcaggtggatcacctgag

SEQ ID NO: 136758 - DNA, 601 bp, Human
cctgagggtgatgcggctgccatggctcaacccataagggcgaagctgtgggctgctaaagtaacattaacaaatgagcagtaaaaaaaaaaaataacaaaacccaaaccagggggcaggggcagagatctccttttattaacaggtgtggtgggctgggtgcaatggctcacacctgtaatcccagtactataggaggctaaggcaggaggattgagctcaagagtttgagaacagctaggctgggtgtggtggctcacacctgtaatcccagcattttgggaggccaaggtgggaggaycacctgaggtcaggagtttgagatcaacctggccaacatggtgaaaccctgtctctactaaaaatacaaaaagtagccgggcatggtggtgcacacctgtcatcccaactcgggaggctgaggcaggagaatcacttgaacctgggaggcggaggttgcagtgagccaagattgcgccactgcctgggtaacaagaacgtaacaagaactccagcctgggtaacaagaacgtaactctgtctcaaaaaaagaaaaaaaaaaagagtttgaaaccagcctgggcaacatagcaagacctcg

SEQ ID NO: 136759 - DNA, 601 bp, Human
ctccgcatgtcatagtgcctggtgcaggggatggggagcagtcagtgagcacctgtgtgggctggatggcccgatggcgccaccctcctggaaggtgccgcggggaccatccccacagcctcgcagcaaacggatgctgcaggggctaccgttgaccaatgtgacagaggggacaccagtgctcagagacggtgccaccagcacatggagcacaaacagggccctgaggctgggctgctcacagggagggggccccaggtgatcccactgcccccaacaacgcatgccagggcccgccctgggggagctctggtgcctcagagtcaggcaggccagggtttgtcaggcccttctcacagcaaggtgggcaccagcttctggtgtgtaaaatgggaggacgagctgtgctgtcacggggtccaggcccagggccaggctaggcctggcatggagcctggtgggcatgctctcaagtcatcctggcagaaactgaagggcccggactatatctcagcagtggcaggtccctgggtcctctgtggctccccctcccctcggtgtcccgggctgtctctccttgtgtgtggcccggggctcagct

SEQ ID NO: 136760 - DNA, 601 bp, Human; identical to SEQ ID NO: 20099

SEQ ID NO: 136761 - DNA, 601 bp, Human; identical to SEQ ID NO: 20100

SEQ ID NO: 136762 - DNA, 601 bp, Human; identical to SEQ ID NO: 20101

SEQ ID NO: 136763 - DNA, 601 bp, Human; identical to SEQ ID NO: 20102

SEQ ID NO: 136764 - DNA, 601 bp, Human; identical to SEQ ID NO: 20103

SEQ ID NO: 136765 - DNA, 601 bp, Human; identical to SEQ ID NO: 20104

SEQ ID NO: 136766 - DNA, 601 bp, Human; identical to SEQ ID NO: 20105

SEQ ID NO: 136767 - DNA, 601 bp, Human; identical to SEQ ID NO: 20106

SEQ ID NO: 136768 - DNA, 601 bp, Human; identical to SEQ ID NO: 20107

SEQ ID NO: 136769 - DNA, 601 bp, Human; identical to SEQ ID NO: 20108

SEQ ID NO: 136770 - DNA, 601 bp, Human
gggccggggggggcgaggaggcgggggcggcaggacggggggcgggggcggcggcggccacctggcccggaccaccgcggcccggagggccgtcaacaaagtggtgtacgatgaccacgagagcgaggaggaggaggaagaggaggacatggtctccgaggaggaggaggaggaggacggcgacgccgaggagacccaggattctgaggacgacgaggaggatgagatggaagaggacgacgatgactccgattatccggaggagatggaagacgacgacgacgacgccagttactgcacrgaaagcagcttcaggagccatagtacctacagcagcactccaggtacccacccagcccagttgctgcagactccttccccacctcctctgccctccccccttgctcactcgtgtgctgtgcatcctgctccgatctccccccaaccccgcctcccccccaaacagaggggaaatgcgacggcacatcaagtggcaaaaaactagatttacaagaggaaagaggcgcattgttcaaaatggagattgcattgttgcagtttgcaggccacactcgctcgctctctctccccccccccaacc

SEQ ID NO: 136771 - DNA, 601 bp, Human
ggtctgacattttgtttttcttaatgacacttgtgtctacttgtcttatccttatatgaaattattaactccttagagataagtattgagcttattccccctgcagctcctgtaacagagttttgcacatagcaggtgctcatcaaagattggttggataaattattgttagtagataagaacttgtaatagatgaagttttgataactctacagtgggtgtcataatctctaaatactttggatttaggaaactaaaaattggtctaattgttttttgtttttgttttttgttgttgttgttttttctaattggtttttgatggacaatttgatcagtgaatgtttttttttttttctgtgaacgtttttcattgcaagagttactttgtttttgagttgctatttcatattgcttgccaggcattttcctttattggctgtgatgttaatttggatgctttaccttttgcaacacattatttttaaagattatggtaaaatagatgtgacttttttttttccttatctcttctaaaaaaaaacgggatacatgtgcagaacgtgcaggtttgttgcataggtatacgtgtgccatggtg

SEQ ID NO: 136772 - DNA, 601 bp, Human
attttgtttttcttaatgacacttgtgtctacttgtcttatccttatatgaaattattaactccttagagataagtattgagcttattccccctgcagctcctgtaacagagttttgcacatagcaggtgctcatcaaagattggttggataaattattgttagtagataagaacttgtaatagatgaagttttgataactctacagtgggtgtcataatctctaaatactttggatttaggaaactaaaaattggtctaattgttttttgtttttgttttttgttgttgttgttttttcyaattggtttttgatggacaatttgatcagtgaatgtttttttttttttctgtgaacgtttttcattgcaagagttactttgtttttgagttgctatttcatattgcttgccaggcattttcctttattggctgtgatgttaatttggatgctttaccttttgcaacacattatttttaaagattatggtaaaatagatgtgacttttttttttccttatctcttctaaaaaaaaacgggatacatgtgcagaacgtgcaggtttgttgcataggtatacgtgtgccatggtggcttgctg

SEQ ID NO: 136773 - DNA, 601 bp, Human
acagagttttgcacatagcaggtgctcatcaaagattggttggataaattattgttagtagataagaacttgtaatagatgaagttttgataactctacagtgggtgtcataatctctaaatactttggatttaggaaactaaaaattggtctaattgttttttgtttttgttttttgttgttgttgttttttctaattggtttttgatggacaatttgatcagtgaatgtttttttttttttctgtgaacgtttttcattgcaagagttactttgtttttgagttgctatttcatattgyttgccaggcattttcctttattggctgtgatgttaatttggatgctttaccttttgcaacacattatttttaaagattatggtaaaatagatgtgacttttttttttccttatctcttctaaaaaaaaacgggatacatgtgcagaacgtgcaggtttgttgcataggtatacgtgtgccatggtggcttgctgcacttaccgaccggccctctaagttccctccccttgccccccaccccccggatgtgacattttgagttctaaacttttagaacatgcccacttgcctggaatgagt

SEQ ID NO: 136774 - DNA, 601 bp, Human
ggtgctcatcaaagattggttggataaattattgttagtagataagaacttgtaatagatgaagttttgataactctacagtgggtgtcataatctctaaatactttggatttaggaaactaaaaattggtctaattgttttttgtttttgttttttgttgttgttgttttttctaattggtttttgatggacaatttgatcagtgaatgtttttttttttttctgtgaacgtttttcattgcaagagttactttgtttttgagttgctatttcatattgcttgccaggcattttcctttrttggctgtgatgttaatttggatgctttaccttttgcaacacattatttttaaagattatggtaaaatagatgtgacttttttttttccttatctcttctaaaaaaaaacgggatacatgtgcagaacgtgcaggtttgttgcataggtatacgtgtgccatggtggcttgctgcacttaccgaccggccctctaagttccctccccttgccccccaccccccggatgtgacattttgagttctaaacttttagaacatgcccacttgcctggaatgagtaacaatgcatgacagtgagt

SEQ ID NO: 136775 - DNA, 601 bp, Human
gaataacacataaagaagtatgattgatgagtttgaatcctgttgtactgtgaaggctgaaagaggaatttaccttattggtaatttagagtaatttgattaatttttatagtttacagggttggtttaagtactgacgtgacattcctaacataagaaatagctcactcctaatacaagaaataactcagtattttgtaggtaatgtaacaatgcaaagacattagttgacattactaaagtcatgaaaggtttattcattgaagattgttttccttttatggaaaaaatgtaaggatgscaactttttagtataaaattgaaatcacctagttttgcttaagctaaaggcatatcgctgaataatgctttaattcatttttactttttaaatttagacttacttcagcctataggttttatgacattgccaatatactgagaaggattgtataggaagtgttttcaataggcatttggtaaggttctgacagcactttgaaattaagcatttgctaattttaagaaattatatttaaaacagaatggttcttgtgttgcagtctcagtcttgtgtgagacttctgagaatacttacctg

SEQ ID NO: 136776 - DNA, 601 bp, Human
acaatattattcctatcagtgtcaatatcttttcagtataatttctgattgctgcatgcgaggtacgcagtgcagtgggcattttaaggagggcgagataatataccccatttaaggggattgatgtgggcatacacttcctggatgggcatgtggagagtaaggaaaggcagattgagggagggagggagggagagggagcgggagcgggagggagcagcaggcactgatagtaaagtgtgggcagtctcaagtaactcggtttagcaagagcctgagtgtgtgaataggaaataaaccraagctcctttgtatgctgtgttgggcagtacctagaggatcaggctatagcaactgtactttcccccttttctgtagaatagggattgggctggattgtgatcctcagccctttttcactcctgaacacccagaggagttatgttgtattcccagcagcaccatgcacaaacatgaaacagaaccatatcaaatcacagagatgctgttgaaccactggtgtagctgtttctcccaaattgagagaattactggggaaatggcctgaagctctctctctttcacatctgtttaattttgg

SEQ ID NO: 136777 - DNA, 601 bp, Human
tgtgcctggctaattttttgtatttttttttttttttagtagagacagggttttactatgttggccaggccggtctcgaactcctgatcttgtaatccactcgcctcagcctcccaaagtgctgggattacaggcgtgagccactgcgccccgcctgatttgcctcttatggacatttcttataaagtggaatcatataatatatgtcttccatcatttagcctaatgttttcaagcgttatgcatatcttaacatgtatcagtactatatttgaataacacttcattgtatggctatacmgccttttttttttttttatggagacagggtcttgcagtgttgcccaggctgacctcaaactcctggactcaggcaatcttcctgcctcagccttccagcctccagagtagctaggattacaggcacacatctctgtgtccagagaccatgttttgcttatccatttcttaagttcatggacatctgaactgtttccactttttggccattaggaataatgctgctgagcacattcgtgtacatgtttttatctgtacgtatgttttcatttctcttgggtatataactaggattatttgc

SEQ ID NO: 136778 - DNA, 601 bp, Human
ggctgacctcaaactcctggactcaggcaatcttcctgcctcagccttccagcctccagagtagctaggattacaggcacacatctctgtgtccagagaccatgttttgcttatccatttcttaagttcatggacatctgaactgtttccactttttggccattaggaataatgctgctgagcacattcgtgtacatgtttttatctgtacgtatgttttcatttctcttgggtatataactaggattatttgctgtattattgcaaattcagttttaatttctttcttttttttttttttgagacagagtctcttgtcgcccaggctggagtgcagtggcatgatcttggctcactgcaacctctgccttctgggttcaagtgattctcctgtctcagcctcctgagtagctgggactacaggtgtgtgccaccatgcctggctaatttttgtatttttactagaagagggtttcaccatgttggccttgcttgtcttgaacttctgacctcaagtgatccacccgccttggcctcccaaagtgctgggattacaggtgtgagccaccgtgcctggaagaaagtaattcaggagttagaa

SEQ ID NO: 136779 - DNA, 601 bp, Human
aaagcctgtggattcttttcacgctctatactgtccagtatggtagccactagccacatgtggagagttaaattaattaaaactaggcaggccaagcgtggtggctcatacctgtagtcccaatactttgggaggctgaggtgggaagatcacttaaggcagcagttgaagactagcctgagcaacatagtaagacactgtctttacaaaagaattaaaatagtttggcagaggttggcatgcctgtagtcctacctaattgggaggctgaggtgggaggattgcttgagcccaggagttwgaggccctagtcagctatggaccatgccaccacactccagcctgggtgacagagtgagaacccatctcttaaaaaaaaaatttaagtaaaatgaaaagttagtttctcctgtggcactagctgttatatgttcatttcaagtgctctatagccacatgtattgcaccacacaaatgtagagcatttggggcatttcatatcattgcagaaagttctcctggactcattgtagtcagtctgcctctgttagaccagggggaatttacctaacatctctttttctctagccttttatttgcc

SEQ ID NO: 136780 - DNA, 601 bp, Human
tccttggtggtagggtgaagaggaagttaacatgtgattagaaaatctgccacagtcctggtaattttttttttttttttttttgagacggagtctcgctctgtcgcccaggctggagtgcggtggcgcgatttcggctcactgtgagctctgcctcccgggttcacgccattctcttgcctcagcctcccaagtagctgggactacaggcacctgccaccatgcccggctaattttttgtaattttagtagagatggggtttcaccatggtagccaggatggtcttgatttcctgacctygtgatccgcccacctcagcctcccaaagtgctgggattacaggcgtgagccaccatgcctggcccagtcctggtaaaattaagctaaaagttatatatataggccagaagagaaggaaggattaggattcagagacttttggttgagaaattaaatttgataattcagagaatttcagtgttataaaagtgtaaaagctgatatgcaaactgaattgcgagatgttagtatgtcctagtgtgtctgggttctcctgtataaaacgtcttaggagtcactggccaaattatttatctatgg

SEQ ID NO: 136781 - DNA, 601 bp, Human
taaaattaagctaaaagttatatatataggccagaagagaaggaaggattaggattcagagacttttggttgagaaattaaatttgataattcagagaatttcagtgttataaaagtgtaaaagctgatatgcaaactgaattgcgagatgttagtatgtcctagtgtgtctgggttctcctgtataaaacgtcttaggagtcactggccaaattatttatctatggaaccccctgagatttgctaagaaagttatacttagacttctttctactcatggatatgttctgtaattcacacrcttgggaaacggcatggccatgtgattcataccaaatggcaatgttcagtaggtgcagtttatatattttactagaaatatggcttcttgctcgatttcagtatgttcatagtgcctcttttgaggtctgtgtatagtatatagtatattctatttatggaagttaagaagtatttcagaaatgcatgtattaatctgtgtggaatttctcttgtcctgttctaattcttgcatagatacttgtctcaagagatggtccaacatttaaaatagtgaatgacatcttagctcatcctaaaa

SEQ ID NO: 136782 - DNA, 601 bp, Human
aaaggtttatgaacttattcatagagcctcaaaatacatgaggactgataaaactccaaggagaaacagacaaatccttaacaatatcgtagacttcaacactcttctcacagtaatcaagagaacaagtaggcagaaagaaagtgcagttttctgtttttgtagacagcaaaattatttcacacacttcttaaagtcttattcagtaagttactcatttctccaccttatgactgtactgtgctttcaaagtgctgtgcaaagagtaaaatgttttaaggtggttttactgtaatttcasatacatatttgaacttttgagtctgaattatccaggtgaaatgcattggatttctgatcctctgtaaacttggaagattaccttcttccaggtatattggttttccttaattgctttaatagcatgagttgtgaatcttctctgtgtctcagaagaaacctaacagtggagattgtttatggcaagggtcacaaatttacatgctcaggttaggaccctctttaaggtaaagacatgaagtgcccccctttttattaatacataactgcatttgctgataatattgatttgccttaaaaa

SEQ ID NO: 136783 - DNA, 601 bp, Human
ccaccttatgactgtactgtgctttcaaagtgctgtgcaaagagtaaaatgttttaaggtggttttactgtaatttcacatacatatttgaacttttgagtctgaattatccaggtgaaatgcattggatttctgatcctctgtaaacttggaagattaccttcttccaggtatattggttttccttaattgctttaatagcatgagttgtgaatcttctctgtgtctcagaagaaacctaacagtggagattgtttatggcaagggtcacaaatttacatgctcaggttaggaccctctktaaggtaaagacatgaagtgcccccctttttattaatacataactgcatttgctgataatattgatttgccttaaaaaaactagtcctattgagaattcaggctctttttgcgtttacagacagtgctgtcctgaatgtgctagagatgtacctttagtcacttaagctggtgtttctgtagggtagattcctaggactgggattggattgttgcattatagtgtgtaccatttaaaagtctggaccagattatactctcaacatctgtttttaaaccttccctagtctgtgcttatgtg

SEQ ID NO: 136784 - DNA, 601 bp, Human
ccccctttttattaatacataactgcatttgctgataatattgatttgccttaaaaaaactagtcctattgagaattcaggctctttttgcgtttacagacagtgctgtcctgaatgtgctagagatgtacctttagtcacttaagctggtgtttctgtagggtagattcctaggactgggattggattgttgcattatagtgtgtaccatttaaaagtctggaccagattatactctcaacatctgtttttaaaccttccctagtctgtgcttatgtgttttgttttttttttttgagayggagtcttgctctgtcgcccaggctggagtgcagtggcatgatctcagctcactgcaacctccacctccttggtccaagcagttcccctgcctcagcctcctgagtagctgtgattaaaggcggacgccaccacgcctggctaatttttttgtatttttagtagtgacggggtttcaccatgttggccagactcatctggaattgctgacctcaggcaatctgcccaccttggcctctcaaagtgctgggattacaggcgtgagccaccgtgcccagcctatgtggttttaaattaactt

SEQ ID NO: 136785 - DNA, 601 bp, Human
ttacaaataatgcttctgaaaatctagtaaaacctttaaattttatttttgcttcttctctttatcaggaaagtaatgtagaacatttagaaaacccagaacattaatattttggttcctctcattagttaaccatctttgtgtaaacatgtgtatgtacatacttttttttttgagctggagtatcgctctgtcacccaagctggagtgcagtggcacaatcttggctcactgcaacctccacctcttaggttcaggtgattctcttgcctcagcctccagagtagctgggactacaggygctcgctgccatgcctggctagttttttatatttttttagtagagacgaggtttcaccagcccaggctggtgttgaactcctgagctcagtcagtccttcctccttggcttcccaaactgttgggattacaggcgtgagccaccacacccagcacatgtgtgcatacatactttttacaaaattggaagaagtataattcatttgctaaatattttcacttatgccatgaaatcagattttatctttgtgtataaaaatacctgctctgctggggcttctagttgaaaactaatgaattt

SEQ ID NO: 136786 - DNA, 601 bp, Human
gaatcatatgtacacatctgattttcttacatttgtatctcctttttctcttcaaattacattgccctctaccattgatgggaacctgggtaataaaaaaaaaagaaaaaaaagaaacaaattgcattgtgtaccacctccaaagcaatgttaaatgttagttataacgataggcatcttagtatgctttccgaatttaatggaactgatgcgaatatttcatggttaactgtgggtttgagaccttcaatgtgttgaatgtattcacctggttctcttttttttcctaagtttttttttwaaaaaaaatcagctatggctattgtattttgtcacatgtcatcttagcatcttttaagatgatcatatagtttttctcctgcaagctacatattaattactgtggtgtatattcatagaattatattagatcttataatattgatccacccttacattcctgcagcaaacctctcttgatcctactttttcatgtactgtttgacttttaaaaaggtattttaatttttaaatagtttatacatgtacagtgcataatgtatttgagattcatctatgttgttgtgtgtatcagtagttt

SEQ ID NO: 136787 - DNA, 601 bp, Human
tgattttcttacatttgtatctcctttttctcttcaaattacattgccctctaccattgatgggaacctgggtaataaaaaaaaaagaaaaaaaagaaacaaattgcattgtgtaccacctccaaagcaatgttaaatgttagttataacgataggcatcttagtatgctttccgaatttaatggaactgatgcgaatatttcatggttaactgtgggtttgagaccttcaatgtgttgaatgtattcacctggttctcttttttttcctaagtttttttttaaaaaaaaatcagctatgkctattgtattttgtcacatgtcatcttagcatcttttaagatgatcatatagtttttctcctgcaagctacatattaattactgtggtgtatattcatagaattatattagatcttataatattgatccacccttacattcctgcagcaaacctctcttgatcctactttttcatgtactgtttgacttttaaaaaggtattttaatttttaaatagtttatacatgtacagtgcataatgtatttgagattcatctatgttgttgtgtgtatcagtagtttctttattgctgagtagca

SEQ ID NO: 136788 - DNA, 601 bp, Human
aacgataggcatcttagtatgctttccgaatttaatggaactgatgcgaatatttcatggttaactgtgggtttgagaccttcaatgtgttgaatgtattcacctggttctcttttttttcctaagtttttttttaaaaaaaaatcagctatggctattgtattttgtcacatgtcatcttagcatcttttaagatgatcatatagtttttctcctgcaagctacatattaattactgtggtgtatattcatagaattatattagatcttataatattgatccacccttacattcctgcarcaaacctctcttgatcctactttttcatgtactgtttgacttttaaaaaggtattttaatttttaaatagtttatacatgtacagtgcataatgtatttgagattcatctatgttgttgtgtgtatcagtagtttctttattgctgagtagcagtcccttatatgagtgtatcacagtgcatttatccattcaatagttggatatttcagttatctctggtttttggcaactatgaataaagttgtcctaaacgtttccataatggttttgtatgaacacaatacttgtttttcttgagt

SEQ ID NO: 136789 - DNA, 601 bp, Human
tgtttaatttgtgaaaataaagatggggttttgccatgttgcctaggctggtcttgaattcctgggctcaagcagtccacccacctcaccctcccaaaatgctgagattacaggtgtgagccaccatacctggccatatcattataatttgaaatggtttcttgtttgtttttcttttaaatttaatctgacagcctcttttaattaatgtgttttggaccatttacatttaatatgattgataatgattggatttaggtttcctattttattatttgttttctgattatctcttttttgrggggtttcttctgtttcttttttctgcctacttttggattaattgaatattttttagtgttttattaattggcttttggttatatctgtgctatgtttttgctgtaggaattacaaaatatatacctaaactatctacttagagttagcattttacctctaaataaaatgtaaaataaaacgtaaaagtattgcaaccatacaggtttctttattctagcgcccctcccttatgttataattgtacatatgtgtatatatctttatacactttcaatatatgtagatacatatagatatg

SEQ ID NO: 136790 - DNA, 601 bp, Human
caattaaggccaaaaaaaaaaaaaaaaaaaaaagacatttcagatgaagaaaatctaagagaatgtgttgccaaaagttctgctgtaaaataaatataaaagaaggtctttaggccaaaggaaatactagaacttcagagataaagagcaacagaaatggtatctgggaaaatgtaaaaacacaaacagttgtttcttaagctctttaaaatatgtatagtggtttaaagcaaaagttataacactggtgagactttcaatgtatgtagatatatatgtagatacatatatctatatatatgtagatgtatgtagatatatacctatatctacatacatataaatatatatctacatatatagatacatatagatatctacatacatctacatacatgtagatgtatgtagatatatacctatatatctacatacatgtaaatatatatctacatatatggatacatatagatatgtagacatagatacatatagatatatatctacatgagattgagtctagctttattgcccaggctggagtgcagtggtgtgatgtcggctcatttttgtatttttagtagagatggggtttcaccat

SEQ ID NO: 136791 - DNA, 601 bp, Human
gtatgtctcaccatttggatttatctgatttttttatttattttttttgagacggagtttcactcttgttgcccaggctggagtgcaatggcatgatctcggctcaccgcaacctctgcctcccaggttcaagcaattctcttgcctcagcctccctaggagctgggattataggcatgtgccaccacgcctggctaattttgtatttttagtagagacagcgtttcttcatgttggtcaggctggtcacgaacttccaacctcaagtaatccatccgcctcagcctcccaaagtgctggrattacaggcatgagccactgcgcccagcctgattgttttttacatgcatagattgagtttagtatacttgtgataggaatgctgtataagtgcacgtctcctcctcagcacatctcatcaggaggtgcaccatcaatttgttccattattgatatagatcacttggtaaaggtgacatgtgctagaatcatccctgtaaaggtatctttcacctttgaaagtagtatttatctgtaaggtgattctttgagaatatcctattgcccaacaacctttcacccagtagttttaggatctgtt

SEQ ID NO: 136792 - DNA, 601 bp, Human
cctaggagctgggattataggcatgtgccaccacgcctggctaattttgtatttttagtagagacagcgtttcttcatgttggtcaggctggtcacgaacttccaacctcaagtaatccatccgcctcagcctcccaaagtgctgggattacaggcatgagccactgcgcccagcctgattgttttttacatgcatagattgagtttagtatacttgtgataggaatgctgtataagtgcacgtctcctcctcagcacatctcatcaggaggtgcaccatcaatttgttccattattgatttagatcacttggtaaaggtgacatgtgctagaatcatccctgtaaaggtatctttcacctttgaaagtagtatttatctgtaaggtgattctttgagaatatcctattgcccaacaacctttcacccagtagttttaggatctgttgatggttcttgcttgaatcagttacacctctgattgcaaatggtgacttctctatttctatcatttctttgttaattatctggcatttgaagacatctccctttcttcctctctccctttggagtcttactgaagagtggcctcgagttctttt

SEQ ID NO: 136793 - DNA, 601 bp, Human
taggagctgggattataggcatgtgccaccacgcctggctaattttgtatttttagtagagacagcgtttcttcatgttggtcaggctggtcacgaacttccaacctcaagtaatccatccgcctcagcctcccaaagtgctgggattacaggcatgagccactgcgcccagcctgattgttttttacatgcatagattgagtttagtatacttgtgataggaatgctgtataagtgcacgtctcctcctcagcacatctcatcaggaggtgcaccatcaatttgttccattattgatatwgatcacttggtaaaggtgacatgtgctagaatcatccctgtaaaggtatctttcacctttgaaagtagtatttatctgtaaggtgattctttgagaatatcctattgcccaacaacctttcacccagtagttttaggatctgttgatggttcttgcttgaatcagttacacctctgattgcaaatggtgacttctctatttctatcatttctttgttaattatctggcatttgaagacatctccctttcttcctctctccctttggagtcttactgaagagtggcctcgagttcttttat

SEQ ID NO: 136794 - DNA, 601 bp, Human
ctggataagatgtaaaatatatttcttactttggttgtgggcaaacaggtgtgcaggctgttcagttataagcagaaccttaaacttgacaatcctgaatttctctctgaagttgtgataccagtttacagtcccagtggtggtatactggtgtttccattgttttgcatccttcccaacagtttgtttggttaaactgttaaatttttttccattgaggagtctgagaacagttatctcattgtggttttactttgcctttccttgctaactagtgagattggggtccttttttttttttaatgcaggaaaattaatataattcacctggtagagagataccagattagtgttgaaattgataatgagtgtaatgctcagtggcatattctaaatacacttctgtgaagaagtgaaatgacttgacttgctaatactaatgattgacagttgaggggcttaagtggtttaatttaatgtcgttctctctttaaacactgtagtctatgttcaattctataaacttgaatctttgaatttagtataatgacgttgtatttatacaagactatgagtagtcattagtggcagcatcatttta

SEQ ID NO: 136795 - DNA, 601 bp, Human
agaaccttaaacttgacaatcctgaatttctctctgaagttgtgataccagtttacagtcccagtggtggtatactggtgtttccattgttttgcatccttcccaacagtttgtttggttaaactgttaaatttttttccattgaggagtctgagaacagttatctcattgtggttttactttgcctttccttgctaactagtgagattggggtccttttttttttttaatgcaggaaaattaatataattcacctggtagagagataccagattagtgttgaaattgataatgagtgtaatgctcagtggcatattctaaatacacttctgtgaagaagtgaaatgacttgacttgctaatactaatgattgacagttgaggggcttaagtggtttaatttaatgtcgttctctctttaaacactgtagtctatgttcaattctataaacttgaatctttgaatttagtataatgacgttgtatttatacaagactatgagtagtcattagtggcagcatcattttattgatttgagtattaatatttttatatttttatagatacctgtccaattttttcttttaaaattttataacga

SEQ ID NO: 136796 - DNA, 601 bp, Human
tttgaatttagtataatgacgttgtatttatacaagactatgagtagtcattagtggcagcatcattttattgatttgagtattaatatttttatatttttatagatacctgtccaattttttcttttaaaattttataacgaaaatacatgtatgaattattttttaaagtataaaaaagtaaaaagaaattagtcttcttttcctgtcccccgactctccccagaagcaagtactataaaaagattcttatatgacctcttagatatatatataccttatcactatccccttgccctcttttttatttttagtttatttattcaaatgacattctattcattgttctgtagctgttcattccttctgcttaacactgtatcttaaagattgtttcattttaacacataggaattttaccactactgaatttgattccattctgtagatgcatcataattcatttgactatttatgtatatttagattaaaaagaaaacccacataaaaatttcagcttttgtaaactatattgaattaaatattttgtacttaaatgaatgtgtgactacaggataagttccaggaggtggaattacag

SEQ ID NO: 136797 - DNA, 601 bp, Human
ttaccactactgaatttgattccattctgtagatgcatcataattcatttgactatttatgtatatttagattaaaaagaaaacccacataaaaatttcagcttttgtaaactatattgaattaaatattttgtacttaaatgaatgtgtgactacaggataagttccaggaggtggaattacagggtcaaagggacatacattcagatagatgtttgccaaattaccttctaaaaatccaaccaatttatactctcccaaaaatagatcagaatgggccgggtgcggtggctcacgcctrtaatcctggcactttggcaggccgaggtgggtggaccacctgaggtcaggagttcgagaccagcctagccaatatggtgaaaccccatctctactaaaaaatacaaaaattagctggggtggtggcgcctgcctgtagtcccagctactcaggaggctgaggcaggagactcacttgaacttgagaggcggaggtcgcagtgagccgaggtcacgccaccatactccagcctaggcgacggctgtaggtgattaaatgagatagatacgtttgttaaaaacaaaactctcagttatttat

SEQ ID NO: 136798 - DNA, 601 bp, Human
ttgcccctactttgtgctgtgtatcttatgtgtaaatgttttttctcatttatattcttgtcaaatcattcacaaatgcagttatttattattattattattattatttccttagagatccttgttctgacactgttattttttaatcatgattacctgtgagcctgttaatctctctaggtaattgagaactgattataatttataatttttttacttctggtttataatctaatgggaaaactttgcatttagattttctatagatttaaaaattagagctgaatcattgcttcttcgkattattttaacttgacaattattaaagaaatgtacttatgtattttaggggggtatatgttcaaataggaaatttgtagaaatgatgtaatgtattgatttgtaatgatgtcacgtctttatctacaggtaggcgaaaaccaagagtacatcggcctcgttctcctatattggaagaaaaagacatcccgccccttgaatttcccaagtcctctgaggatttaatggtgcctaatgagcatataatgaatgtcattgccatttacgaggtactgcggaactttggcactgttttgagatt

SEQ ID NO: 136799 - DNA, 601 bp, Human
taattttctgctcctcattaacattgtggtactatgtagccagttggaagctctgagcaagtgggtgggccttatcaattttgacttaaccattggatgattttcattgtcttttttattgggggaaatccctcttgtcagtatcttgaggtctgtcctcgagagtaagctctagaggagcaatggcatggaagggccttttcctgtgtcctgcttgaagcatgaaggtcttgctggtggtattctggtggctgagtggtggaagaaagcttcatttattgtgcacacagcatttactacktgtattgtcacttaaatcctcagttttttgtacagtacctttgttcacaactgagcgtggtttctgccagtccagggaacctcagtttacctcctctagagactagacctttggcagcttgaaggggagaatggtggtttaggaatctgctccagccagttccctattctagagacacccctccttgttatcattgcgttttgaggattgtgttctcaacttcaccttcctttttagtttgagatcaggctttcttgggtctgctgaatcagtaatcacttgttcatctactttaaaatc

SEQ ID NO: 136800 - DNA, 601 bp, Human
cctctatgtctagtcctagacattaatttgcctgtttgttttaagttagtgaccatctctgttgaagtctttaactccattaaaagtgaatggaaccttaggagagttttaggcaggagaggaagctcctcttctctccagtttgggcttcgattgtccagaagtaaagaagagggatgagatattatttgagataactccttcaaaaaccagaacttagcaaagcatttacaccattttgttagaaatatttctaaactatattataaagttagctgggtatcgtggcacatgtctgtaagtcctaactacttgggaggctgaggcaggagaattgcttgagcctaggagtctgagtacgcagtgaaccacgatggtgccactgcactctagcccgggcgacagagtgagaccctgtctctaaaataaatttattttattctaaaataattctaaatacattcttctcatcatattgttacattgatgatcttaaagttggttgagatgtagctgaaactggcttccacaaagtactctcacgtggttctgaattttgaggtcatttttctttgtgtcatgttttttagatatcatttct

SEQ ID NO: 136801 - DNA, 601 bp, Human
ctgtacgtcatgtgactgtactgaatcccataagcagttgtagcacaatggcaggtatttgtgtatctaactatatctaaacatttaaaaaggtaatacgtataatcttatgtgatcaccatcacgtatgtggttcctggtggaccgaaacattgtgcagtgcatgactgtgtgtatattttactttagttctccatatttcattttcccaagagaaccttgttcattccactgtaaattagggatgctatacattttagtgttttatttctgccttgggtcattactgatattccccaamatgttagtttgtttctttaattcaagtatcttattaaacttttttggcattccagtttttaattttaagaaataatattctttttgaactttttgcctttttaaaaaaataaaactttaaattttagagtatttttagatttatacaaaagttgcaaagatagtagagggtttccatatatcctgcacttggttgcccctgttattaaagtcttagattagtgtgaaatatttgttacaactaatggaccagtattgatacactgttactaactcaagtccatacttcattccaatttcc

SEQ ID NO: 136802 - DNA, 601 bp, Human
caccatcacgtatgtggttcctggtggaccgaaacattgtgcagtgcatgactgtgtgtatattttactttagttctccatatttcattttcccaagagaaccttgttcattccactgtaaattagggatgctatacattttagtgttttatttctgccttgggtcattactgatattccccaacatgttagtttgtttctttaattcaagtatcttattaaacttttttggcattccagtttttaattttaagaaataatattctttttgaactttttgcctttttaaaaaaataaaacyttaaattttagagtatttttagatttatacaaaagttgcaaagatagtagagggtttccatatatcctgcacttggttgcccctgttattaaagtcttagattagtgtgaaatatttgttacaactaatggaccagtattgatacactgttactaactcaagtccatacttcattccaatttccttagtttttacctgatgtcctttttctgcctcatgatcctgtaccacttgatatttagtcatcatgttttcctctgggttgtcggtttctcagactttccttgtttttgatggcct

SEQ ID NO: 136803 - DNA, 601 bp, Human
ctgctcttctgcatacattatctgctatacatataatcctattaattttccccattctccatttgcttaaaaatagaatgtttatatttaataaagatacccggatagctgtatccaaccttgttctcacatattctacatcaatattcctgtgaattcatgcgtatttttggagaatgataggctctcacatataaatactgttgggcacaaatatactttgtcttcagaaaaaagcattcttagttaccatgaattatatttattcatatctggtagttggaagtatttctctattagmtctgtttagaaaaatgtgtaatttttttattagaaaagttttagtgttcagaagtctttgggggataagtaattgcagtaacacaatctccgtcttactctccccccatatagatcaaatcataggaaattttattaatttcagccagcttacttccccccttaatttccttttatgaatcatggcattaaaatagacaaatccctttttgctctcctgtgttttagtacaacaacagagaaccatctttagtcctctaaaaggcaatgtgagataggattttataaagtacattgaatt

SEQ ID NO: 136804 - DNA, 601 bp, Human
ataagcaagtgggcaatggtaaatgaaccctatacagacacataggcattcactcatatacatatgtgcccacacaaataaatacagaaataatatagatgtatatatttatgactacattttttagctctgttggctgagagactctagaatagtaacaccccaatagtaacaaacacaccaaccacttagattgtgacttctaacatcattctccaatttgttcttcaaaaaagaacaaaggctccttggagagatggtggattgtagggctggggcagggaaaatacaaggtgagccyggagcatcttgtaatagtggaaagtaagaaaatgctggatggatggatggatggatggatggatggatggatatgtgtcaaaaggacactggactcggaaaaagtccccagtggccaaagctgaaacaatttgtgcaacaaaattaaaagtgatagtattgcatgataacccaaagaatataattaatatccatgagtgcgtactgatataccgtgtgttctgtacactgtggtccttctgtatcccgtggtctataacatgccatagtatcactctgtctaagttgaaagagggtaggt

SEQ ID NO: 136805 - DNA, 601 bp, Human
gacacataggcattcactcatatacatatgtgcccacacaaataaatacagaaataatatagatgtatatatttatgactacattttttagctctgttggctgagagactctagaatagtaacaccccaatagtaacaaacacaccaaccacttagattgtgacttctaacatcattctccaatttgttcttcaaaaaagaacaaaggctccttggagagatggtggattgtagggctggggcagggaaaatacaaggtgagcccggagcatcttgtaatagtggaaagtaagaaaatgcaggatggatggatggatggatggatggatggatggatatgtgtcaaaaggacactggactcggaaaaagtccccagtggccaaagctgaaacaatttgtgcaacaaaattaaaagtgatagtattgcatgataacccaaagaatataattaatatccatgagtgcgtactgatataccgtgtgttctgtacactgtggtccttctgtatcccgtggtctataacatgccatagtatcactctgtctaagttgaaagagggtaggtgtactaagagacttagtgactttcagaacaattaag

SEQ ID NO: 136806 - DNA, 601 bp, Human
tcactctgtctaagttgaaagagggtaggtgtactaagagacttagtgactttcagaacaattaagggacttcagaaagaaagttgtttccaaaagggcctctgttttctctttttacagttgaggaaatgatggcctggagaggttaggtagcttgcccagagtcacacagctaatccaagtcagatttgcagtgggttttgggtttctaggttttgatcactgcagtgtgctgcccagactgtgggtctatgtcagcttgcagtttttgtcatctgtcacagatatccgtgacagatakctatatcaaggctatattttaaaaagataggctcattttactttttttaaaaagtagagcccataattagcatgtattatctagaggtgaaggtacaccaaattgattgaattctgtaaacacaattttgtttgtaatcttgatttttatttcataggtctaatgctttaaaaatacttaatttttcctctttaatagcttgtattgaaactcgtaagtgacatttgtggtactgttctatttggttatatataggaataatttttttgtttgttttacacattatagaagaaattttgg

SEQ ID NO: 136807 - DNA, 601 bp, Human
gatcaggataccgtcccctcttataacgtgtgtaacaattgtaatgagttttatgtattagtgaatttgctataatgttatattcatgtctctatttatacttcccattaagttgccatttccctatgaaaaagaactattctttaatattataccagagtatacacttttgtatgtgataaaatgttcatttttatattaattacttaagcattcttaatatattattaaatattcttaaatactctctgaattacctattgcagcaatatccgagaatctacttgctttaaaatggccrttcaatggaagcaggttttttgtgattatttagtagttgactgaatgtggccatttgccctgaagcaattttaaagaatatctttgaagttttgttgtgcattttgctgtagagccaacagaagttggggataaaggtaactctgtgtcagcaaatcttggcgacaacacaacaaatgcaacttcagaagagactagtccctctgaagggaggagccctgtggggtgtctctcagaaacccccgatagcagcaacatggcagagaagaaggtggcatctgagctcccccaggatgtgcca

SEQ ID NO: 136808 - DNA, 601 bp, Human
tgtaatgagttttatgtattagtgaatttgctataatgttatattcatgtctctatttatacttcccattaagttgccatttccctatgaaaaagaactattctttaatattataccagagtatacacttttgtatgtgataaaatgttcatttttatattaattacttaagcattcttaatatattattaaatattcttaaatactctctgaattacctattgcagcaatatccgagaatctacttgctttaaaatggccgttcaatggaagcaggttttttgtgattatttagtagttractgaatgtggccatttgccctgaagcaattttaaagaatatctttgaagttttgttgtgcattttgctgtagagccaacagaagttggggataaaggtaactctgtgtcagcaaatcttggcgacaacacaacaaatgcaacttcagaagagactagtccctctgaagggaggagccctgtggggtgtctctcagaaacccccgatagcagcaacatggcagagaagaaggtggcatctgagctcccccaggatgtgccaggtacagagggcagcgtatcaatgcctctgtaatggggg

SEQ ID NO: 136809 - DNA, 601 bp, Human
gctaccactacacctagcccaacaaaggtactgactattctgacttctatcaccactgattggtttgccttttttaaaaaaattactggaaccatacagtatatactctttgatgcctgatagcttttttcccacctcaacaaaacatcaatgagagccatccagatgttgctagtagtagcagcttattcttttttattgcagtatgatattccattatatagatatgtcatgattcttgttacattttggtggttattttaatgatttttggtttgggaccattatgaataatactatyatgaatattttacatgtttcttgtgcacatacatgtgcatttctggaggtacaagcctagttgtggattttctaggtcatggagctggtttatgctcatctttggtagatactgctaaacagttttccacaggggttgtagaagtattcagttcaacagtgtatgagagttctagctcctctgcatccttgctaacactgggtatcatcagcatcactctttgtctttttggaggactgaggggacatgctagtgggcatgtagggatattttactgttctttgcacttgctagctccct

SEQ ID NO: 136810 - DNA, 601 bp, Human
gtgatgtattttccttgttatatattatagcatccagtttattaatattttgtttaggatttttgcatttactttcatgagtaaaattggcttgcatttttcttctctgataatgtcagtctttagtatcaggaatattttgtcagtctttagtatcaggaatattttggcctcatatcatgagttggtactagaagagtttttgtggggctgttgttaattatttctttttttttttttttttctttttgagatggagtttcagtctttcgcccaggctggagtacagtggtgcgatctyggctcaccacaacctctgccttcctgtttcaagcgattctcctgcctcagcctcccaaatagctgggattacaggtgcccaccaccacgtctggctaatttttgtatttttagtagagacggggtttcaccatgttggccaggctggtcttgaactcctgacctcatgatccacccgcctcagcctcccaaagtgctgggattagaggcgtgagccaccgcgcccggctagggctggtgttatttcttaaatgtttgctggagtgatttggttctggagttttcactgtgagaaggttat

SEQ ID NO: 136811 - DNA, 601 bp, Human
ttggcctcatatcatgagttggtactagaagagtttttgtggggctgttgttaattatttctttttttttttttttttctttttgagatggagtttcagtctttcgcccaggctggagtacagtggtgcgatctcggctcaccacaacctctgccttcctgtttcaagcgattctcctgcctcagcctcccaaatagctgggattacaggtgcccaccaccacgtctggctaatttttgtatttttagtagagacggggtttcaccatgttggccaggctggtcttgaactcctgacctcrtgatccacccgcctcagcctcccaaagtgctgggattagaggcgtgagccaccgcgcccggctagggctggtgttatttcttaaatgtttgctggagtgatttggttctggagttttcactgtgagaaggttattatagatttcattcacttctttagtagataatggctatcttagtccatttgtgttgctgtaaaggagtatctaaggctggtggtttatttaaaaaaagagatttctttggctatgtggttttgcagactgtacaagaagcatggtactgacatctgcatctggtga

SEQ ID NO: 136812 - DNA, 601 bp, Human
tcagtctttcgcccaggctggagtacagtggtgcgatctcggctcaccacaacctctgccttcctgtttcaagcgattctcctgcctcagcctcccaaatagctgggattacaggtgcccaccaccacgtctggctaatttttgtatttttagtagagacggggtttcaccatgttggccaggctggtcttgaactcctgacctcatgatccacccgcctcagcctcccaaagtgctgggattagaggcgtgagccaccgcgcccggctagggctggtgttatttcttaaatgtttgctgragtgatttggttctggagttttcactgtgagaaggttattatagatttcattcacttctttagtagataatggctatcttagtccatttgtgttgctgtaaaggagtatctaaggctggtggtttatttaaaaaaagagatttctttggctatgtggttttgcagactgtacaagaagcatggtactgacatctgcatctggtgagggccttatgatgcttccactaatgacggaaggggaaaggggagccagtgtatattgatacctcattgtgagagagcaaataggggaggcggggg

SEQ ID NO: 136813 - DNA, 601 bp, Human
tctgctcattttggcaaatttttacaatttattagcataataacatcgtatcttttttatatatatagggtctatactcgctctatttttccaatctggaaattcgttacctgcccccgttaatcgtgttgtgaggctgttagcaattccattagtctttttttaaaaaaacacaactttgtctttgttgaccttctttattgtatgtttttctccaaattaatttctggtcttagtattttgtccttccttttattttctttgtacttttatggattttctttcctagcttctgaagatsgttgctttgatggtttgtagtttagttttgtttttttatgacgtctactatcaaggctatcagctttcctctatgtcctgctatagctacatcccacaaacttattttatttttaaatgcatgaccagaacacaaccacaaactgtaataggtcatgttccctttatcatttagtttaaaatattgtctaatttctgttttaatatggtgtgtgatgaagtatattgcttaatattcaaacatttgtaggtttttgtttttggtttttggtttttggttttttgtgtgtgtgtaagacag

SEQ ID NO: 136814 - DNA, 601 bp, Human
ttgtgccactgcactccagcctgcgcaacagagtgagactccatcttaaaaagaagttaacaatcgcatttaggcattacctttcagttaatttgggcatagtattcaggcagaagaccatagagttaaataatcctgcttaattctgtttctaatactatttgagtacttttgaaaagtaagactataagcttcagattttgaatactatctcagcaaactacctctgcaatatctggcgcactgtaagttttgagagatagtcatatcacttggttattctccagctctggggtatccraaaaattgtctgccttgtactggagactaaggtgatacgagtcagtgagttagagttgggtcctcacccccccaaaaaaagtcagtgagttaatagcctggaagacttaaaaaaataaggtgttgcctaccactttcttttatacattgcattactgatacatgaacagattttcttttaaaaatacagcttcttaatgaaatcctaaaacaattgtcttttctgacaattcgtcatttttcatgtgatttccaatttaaaaatcagatattctatttttctagaagaacctaacaagac

SEQ ID NO: 136815 - DNA, 601 bp, Human
gaagctttttaaaagcactgtgtcattctctttctcttttcgggaaatctgacccagaccaaatgatgtctaaaaagtatctattacaggactttatagatggtcccaagaactaaccaccatagttcaacatcttggcataaaactccatgatctgaaggccaggcgcagtggctcacgcctgtaatcccagcactttgggaggctgagacgggtggatcactggaggtcaggggttcaagaccagcctgaccaacatggtgaaaccccgtctctactaaaaatacaaaaattagctggrcatggtggcgggcgcctgtaatcccagctacttgggaggctgaggcaggagaatcgcttgaacccaggaggcagaggttgcagtgagccgagatcgcaccactgcactccagcctgggcgacaagagcgaaactccatctcaaaaaaaagaaaaaaaacctccatgatctgagacccaagagaaaattgatagtctgaccaactgctttgctaccacacatccaaagtgacttgctttccagcctggggtggcaagatgctcagtaccctctctccattttgacttattatttaaggagg

SEQ ID NO: 136816 - DNA, 601 bp, Human
aacatcttggcataaaactccatgatctgaaggccaggcgcagtggctcacgcctgtaatcccagcactttgggaggctgagacgggtggatcactggaggtcaggggttcaagaccagcctgaccaacatggtgaaaccccgtctctactaaaaatacaaaaattagctgggcatggtggcgggcgcctgtaatcccagctacttgggaggctgaggcaggagaatcgcttgaacccaggaggcagaggttgcagtgagccgagatcgcaccactgcactccagcctgggcgacaagagygaaactccatctcaaaaaaaagaaaaaaaacctccatgatctgagacccaagagaaaattgatagtctgaccaactgctttgctaccacacatccaaagtgacttgctttccagcctggggtggcaagatgctcagtaccctctctccattttgacttattatttaaggagggcaaagaggtgtgttctttctgtttaaaacaaaaatctgtggaatgtgagataattttaattaccataccttaaaaatcggggctggaaatttgtagaaatttctagacctacttttgaattgtattt

SEQ ID NO: 136817 - DNA, 601 bp, Human
accccgtctctactaaaaatacaaaaattagctgggcatggtggcgggcgcctgtaatcccagctacttgggaggctgaggcaggagaatcgcttgaacccaggaggcagaggttgcagtgagccgagatcgcaccactgcactccagcctgggcgacaagagcgaaactccatctcaaaaaaaagaaaaaaaacctccatgatctgagacccaagagaaaattgatagtctgaccaactgctttgctaccacacatccaaagtgacttgctttccagcctggggtggcaagatgctcagyaccctctctccattttgacttattatttaaggagggcaaagaggtgtgttctttctgtttaaaacaaaaatctgtggaatgtgagataattttaattaccataccttaaaaatcggggctggaaatttgtagaaatttctagacctacttttgaattgtattttctttatttccaaaactgtagtagtgtgatattttggagtcaaaatcttaaaatattctaccagattatttagaatttactggttttgatagaaatacatcaaacttgcttaaaaagggaattttattgacatacac

SEQ ID NO: 136818 - DNA, 601 bp, Human
tgcagtgagccgagatcgcaccactgcactccagcctgggcgacaagagcgaaactccatctcaaaaaaaagaaaaaaaacctccatgatctgagacccaagagaaaattgatagtctgaccaactgctttgctaccacacatccaaagtgacttgctttccagcctggggtggcaagatgctcagtaccctctctccattttgacttattatttaaggagggcaaagaggtgtgttctttctgtttaaaacaaaaatctgtggaatgtgagataattttaattaccataccttaaaaatyggggctggaaatttgtagaaatttctagacctacttttgaattgtattttctttatttccaaaactgtagtagtgtgatattttggagtcaaaatcttaaaatattctaccagattatttagaatttactggttttgatagaaatacatcaaacttgcttaaaaagggaattttattgacatacactattgagaagtccagtgttggtgacagcctcaggtgcattgttggatctagggagccaaatgaggttatcgaggctacttctgattttgccgtttcatatttttctgtttattt

SEQ ID NO: 136819 - DNA, 601 bp, Human
cttattgtttgctgttatcaacggttttctccatgttgtgggaataaaagtggccaacttctgatttacacccttcctgctcattagtacaaaaagcaaagaccccttctccatctctggattttaaaaactggaaaaggatgctgagaggattgagccaaagagccagtcctgggacagtcactgtggccagctagtggtgtgctttgtctggccacgctgggtcctgctgctcgctccaaaggggcaacatacttgatttgcagccctggcagaatcatatgattaaagtgtgggaggscggtggtgagggaagtatctccccaaaggaaagaaggggtatggaacaggtaaaattaacagatgtttacaaaattgtcttaattattttccccaaaatgcatagccagttttcccaatcctagtttttctctatttacttaaaatgccatctttattatatatcatatagtaaattatctgtcttttcatttgccagtgccacagtgtcttcatttttttaaagctttaaattaaaaaggaaaaatcagagcttattcaactatctggtcaatggaaatttaacagtgatgcagtagtt

SEQ ID NO: 136820 - DNA, 601 bp, Human
ccatttgtgcattctcctcccacaccacatcccgcaagagacctgcattccaatcccagcttcttcctcctagtttttctgtttgcaccccctttcatgcctcttactaggttggtattctccaaacagtcttggagggcagacatcatcaactccatttcactgatagagaaagtagagtttgagagctaaagtgacttgcccaagagtgaccaattgttagagcccggtcttgccttctgactctacttggtgtctgtcacactgtagaagctacacccaggctgtcccctggaccttkggcctcccagctttacccgagtaacctcacaggttcccttccttgggtcttgtactgaagctgtcagttcagttctctgtgtttgccccaactcatggttctcctactagccctcaccccagcctgtccaagttcaccattcctcctctttaggtaggaagaggggagatagagttggtgagttcaaggagaagcctgctccaaccccagagtggctgaccacgtttctgccctccccagagagaagcaaaatgatgcctgccacactcactgctcttgctgtccacatcttccggccac

SEQ ID NO: 136821 - DNA, 601 bp, Human
aacccccactctgtccatttgtgcattctcctcccacaccacatcccgcaagagacctgcattccaatcccagcttcttcctcctagtttttctgtttgcaccccctttcatgcctcttactaggttggtattctccaaacagtcttggagggcagacatcatcaactccatttcactgatagagaaagtagagtttgagagctaaagtgacttgcccaagagtgaccaattgttagagcccggtcttgccttctgactctacttggtgtctgtcacactgtagaagctacacccaggctstcccctggaccttgggcctcccagctttacccgagtaacctcacaggttcccttccttgggtcttgtactgaagctgtcagttcagttctctgtgtttgccccaactcatggttctcctactagccctcaccccagcctgtccaagttcaccattcctcctctttaggtaggaagaggggagatagagttggtgagttcaaggagaagcctgctccaaccccagagtggctgaccacgtttctgccctccccagagagaagcaaaatgatgcctgccacactcactgctcttgctgtcca

SEQ ID NO: 136822 - DNA, 601 bp, Human
tctctaccttcctgaacctcacttttcatgataacaaaaatatgtgccccaagaggatcgacagagagaatatacatgaaaaagccttaaaatactgactggtttgtgaaagctactccaattaagtttgtaaagaccctgtgatgcagctatgtttatgacccttcacagataaggaatacagaaggatacacagacaattcagtacaaaggagttacctgtccacggtcacccaagactatgggttccaaatccaggggcaggaactcatcctggttcccttgctctttccagtgcacmataacccctcatgcttttgttaaacctctgagctcataatgctgggatacaatacttggcaccttggagtttcaggaaacacaagccactgcaggagcacagatgcatccttcctcacacctgctaggaagctcagcgctccctctagcgcccaagtgtggcttgcacccaggtgctggcagctctgggtttagaaaccttattccggtaaaatactgtcatctagtgtctactcttgtaattccaggctggcggggttctgttctctagggagagattgagcaggtgatcacttacatt

SEQ ID NO: 136823 - DNA, 601 bp, Human
ttaatgtttctgtgtccatctggggccttacttgttgcgttggactcatgtgtttgtgtgtgtgtgtgtgcgcgcgccttgtgtgtgtgtgggtgtgtgtatttttctcttctgatctgtctacttcctaaactggactattgtccaatctatagaccaactctatctcttactatctggttgatcttagacaaatatctctaccttcctgaacctcacttttcatgataacaaaaatatgtgccccaagaggatcgacagagagaatatacatgaaaaagccttaaaatactgactggtwtgtgaaagctactccaattaagtttgtaaagaccctgtgatgcagctatgtttatgacccttcacagataaggaatacagaaggatacacagacaattcagtacaaaggagttacctgtccacggtcacccaagactatgggttccaaatccaggggcaggaactcatcctggttcccttgctctttccagtgcacaataacccctcatgcttttgttaaacctctgagctcataatgctgggatacaatacttggcaccttggagtttcaggaaacacaagccactgcaggagcacaga

SEQ ID NO: 136824 - DNA, 601 bp, Human
gaatttcctggacccctctcctggtttcaatttggtgtatcagggtggggctgaacagcctgaaaacattctgacgattaggtgagatgagaaattcccatcctggaatagctctttgcaccaactttaatgtttctgtgtccatctggggccttacttgttgcgttggactcatgtgtttgtgtgtgtgtgtgtgcgcgcgccttgtgtgtgtgtgggtgtgtgtatttttctcttctgatctgtctacttcctaaactggactattgtccaatctatagaccaactctatctcttactmtctggttgatcttagacaaatatctctaccttcctgaacctcacttttcatgataacaaaaatatgtgccccaagaggatcgacagagagaatatacatgaaaaagccttaaaatactgactggtttgtgaaagctactccaattaagtttgtaaagaccctgtgatgcagctatgtttatgacccttcacagataaggaatacagaaggatacacagacaattcagtacaaaggagttacctgtccacggtcacccaagactatgggttccaaatccaggggcaggaactcatcctggt

SEQ ID NO: 136825 - DNA, 601 bp, Human
cccctctgtaaatgaagttgctgcacaggatgtgtggtttgcacgctggggaacagccaaagcaccaggagcttatgaattgaatttcctggacccctctcctggtttcaatttggtgtatcagggtggggctgaacagcctgaaaacattctgacgattaggtgagatgagaaattcccatcctggaatagctctttgcaccaactttaatgtttctgtgtccatctggggccttacttgttgcgttggactcatgtgtttgtgtgtgtgtgtgtgcgcgcgccttgtgtgtgtgtgggkgtgtgtatttttctcttctgatctgtctacttcctaaactggactattgtccaatctatagaccaactctatctcttactatctggttgatcttagacaaatatctctaccttcctgaacctcacttttcatgataacaaaaatatgtgccccaagaggatcgacagagagaatatacatgaaaaagccttaaaatactgactggtttgtgaaagctactccaattaagtttgtaaagaccctgtgatgcagctatgtttatgacccttcacagataaggaatacagaaggatacacaga

SEQ ID NO: 136826 - DNA, 601 bp, Human
ctcccctctgtaaatgaagttgctgcacaggatgtgtggtttgcacgctggggaacagccaaagcaccaggagcttatgaattgaatttcctggacccctctcctggtttcaatttggtgtatcagggtggggctgaacagcctgaaaacattctgacgattaggtgagatgagaaattcccatcctggaatagctctttgcaccaactttaatgtttctgtgtccatctggggccttacttgttgcgttggactcatgtgtttgtgtgtgtgtgtgtgcgcgcgccttgtgtgtgtgtgkgtgtgtgtatttttctcttctgatctgtctacttcctaaactggactattgtccaatctatagaccaactctatctcttactatctggttgatcttagacaaatatctctaccttcctgaacctcacttttcatgataacaaaaatatgtgccccaagaggatcgacagagagaatatacatgaaaaagccttaaaatactgactggtttgtgaaagctactccaattaagtttgtaaagaccctgtgatgcagctatgtttatgacccttcacagataaggaatacagaaggatacaca

SEQ ID NO: 136827 - DNA, 601 bp, Human
ggtaacttagaaaaaggataaggggtgagcccaaccacacagctgctgttgggtagagcctgaactagaattccagctgtgaaccccaaatccagctccttctaggattccagctctgggaacaccctcagtgcagttaccactccagctgcttccagcagaatttgggatcagggtgatcaaagacaggaggcttctggggatgggtgtgcgggctgtttccagataccgggagacccagaatctggtctgtggaagcccagcttccagaaacagcagctctgcagaggtggtacgtatyagggaaactcatgaccaagcattgaatgctcagagcctaaaaggggatccatagttggggtacccttgctctaaggaattggattattatattagcccctcctagcaatgcccagagtagccatcaattcctcttccgtctttcaactggtgatggtgcatccctatttcacagtccataaaagtgaaagggagtttatgaaatgcctcaaagggcagagacattgggtttgggatgggcagcttttccctccacctcttcctttctttctgattccttcttcttaccattccctgtttt

SEQ ID NO: 136828 - DNA, 601 bp, Human
aagcccagcttccagaaacagcagctctgcagaggtggtacgtatcagggaaactcatgaccaagcattgaatgctcagagcctaaaaggggatccatagttggggtacccttgctctaaggaattggattattatattagcccctcctagcaatgcccagagtagccatcaattcctcttccgtctttcaactggtgatggtgcatccctatttcacagtccataaaagtgaaagggagtttatgaaatgcctcaaagggcagagacattgggtttgggatgggcagcttttccctccayctcttcctttctttctgattccttcttcttaccattccctgttttacaaacagaaagacccaggacacaccctcaatggacttttcttcttgttgtttcattgcagttgggattaatacttcaactacctgctgctacagatttatcaataagaaaatccctaagcagaggctggagagctacagaaggaccaccagtagccactgtccccgggaagctgtaatgtatgtggacgatgaccacccacccctcacacctcagtcctaggttcttccctgggcagggaataggactagtatc

SEQ ID NO: 136829 - DNA, 601 bp, Human
atccatagttggggtacccttgctctaaggaattggattattatattagcccctcctagcaatgcccagagtagccatcaattcctcttccgtctttcaactggtgatggtgcatccctatttcacagtccataaaagtgaaagggagtttatgaaatgcctcaaagggcagagacattgggtttgggatgggcagcttttccctccacctcttcctttctttctgattccttcttcttaccattccctgttttacaaacagaaagacccaggacacaccctcaatggacttttcttcttsttgtttcattgcagttgggattaatacttcaactacctgctgctacagatttatcaataagaaaatccctaagcagaggctggagagctacagaaggaccaccagtagccactgtccccgggaagctgtaatgtatgtggacgatgaccacccacccctcacacctcagtcctaggttcttccctgggcagggaataggactagtatcagaatgagttggagtcaaatactgtgatgcatacagcatctctaaccttatcccagacatttgccagtgagaaacaatacaagtaaagaaag

SEQ ID NO: 136830 - DNA, 601 bp, Human
ggaagcagtgccttcttttacattttggcacaagctccctaacttgtcacagatcaggacttttgagtagcacggcctatatctgaagtatttgtcttaaaacttcaatacatgacttaaatataagtgcatatttttagagatcataattaaatttaattcgtgaatatcagcacttaatcgactacatagccacaatgtgattaggcattttgagatgggctaagaaagagacttaggagttatttgggaggctggggtggagggatgtagatggatagtgaatgtggttattatctgmactttagaagcttacaatctaagggaaaatgaaatattcaaagcaaaatcccatggagtaaagtgagttacaattgacagatgatatccactagtttaatttctcagtgaaactctggggactagctctcttttgttttcaagaatctcaatgtcactaaataaaaacaatgtgattctctcctcaatggagcaatagagagagcaaggcctggaatcagggacagatactctgaccataaagagtggaagaatcttctcttgaagagctctccacatctctgtaaaatcacatcaaaat

SEQ ID NO: 136831 - DNA, 601 bp, Human
agtcagaggccaggtaaacagtacctattaataaacagatgtcatctgtcatcctcaattttgacggatcagtatctgttatttgaagtgtgatccttacactagttaataattctcaaactgtttgttacagttctgctacaagataaggagcttttaccttcagggtgataagcctctaaagtaacaaaaaaaggtggggaggtgagcttgtgccagaatgtaaaccaactgtgaaactaagcacactgtttagttcagctctttatttagacagaaagacctgctttaaacatattakttttaaaaagttgacaaaaattctatatatgtattgagtaaaacatgatgatctgaaatatgtataagctgtggaataatagctatgagttaataaacacagctgagtgcagtggctcatgcctgtaatcccagaactttgggaggctgaggcgggcagattgcttgagctcagaagttcaagaccagcctgggcaacacggcgaaatcccgtatctaccaaaaatacaaaaaattagctgagcaaactggtgagcacctgtggtctcagctacccaggagggtaggagaattgcttgag

SEQ ID NO: 136832 - DNA, 601 bp, Human
acatcatagcatactgcagcctccaactcccgggctcaagagttgtttttgcctcagcctcctgagtagctgggaatacaggtgttatgccactgcacctggctcttactgctgagttctgagagttcattgtatgtgctggatactagtcttttactgaatacgtggtttaacagatattttcttccaatatctaacttgtcttttctatcttttcatatgggctctcacacagcaaaatttttaatttaatcaggtccaatttatcaattgtttcttttatggattaggctttcgtggycaaatatagctctttgtctccagatccagaaaattctctatgttttttcctaaaacttttatagctttgtgctttacatttaattctataatccattttgtatttttgcataaggtgtgaagtttaggctcatcatttttgaaaaagctgtccttccctccattgaattggttttgtaactgctaaaaatcagctggaggtatttgtgcaggtgtatttctgggttatattttctgttccatggtctatgtctttccttctaccaataacacacagtattgattactatagctatatact

SEQ ID NO: 136833 - DNA, 601 bp, Human
aggcaacatcatagcatactgcagcctccaactcccgggctcaagagttgtttttgcctcagcctcctgagtagctgggaatacaggtgttatgccactgcacctggctcttactgctgagttctgagagttcattgtatgtgctggatactagtcttttactgaatacgtggtttaacagatattttcttccaatatctaacttgtcttttctatcttttcatatgggctctcacacagcaaaatttttaatttaatcaggtccaatttatcaattgtttcttttatggattaggctttygtggccaaatatagctctttgtctccagatccagaaaattctctatgttttttcctaaaacttttatagctttgtgctttacatttaattctataatccattttgtatttttgcataaggtgtgaagtttaggctcatcatttttgaaaaagctgtccttccctccattgaattggttttgtaactgctaaaaatcagctggaggtatttgtgcaggtgtatttctgggttatattttctgttccatggtctatgtctttccttctaccaataacacacagtattgattactatagctat

SEQ ID NO: 136834 - DNA, 601 bp, Human
gaattggtaaaatcccagattttattaagtcatcaatcggtggatttctgtcactggataacagttttctaggaaaataaatatgagaaattaattgctataattttcaaactgtgaaaagaaataacaacatattaacttctagactaccaggtaacacaactgaggaatgacataattctctctctagacaaattagtatttaccttgctgcctggacagcactcaattggaccactgggttatcacttgtggcattctgcaataccaaatgtaaatttcagaaatgaaaaaaaaaaaatcaatttcaaaatacttcaaaacgagagtattaatttagtaacatacctgcaatatagcttctagggttacattttgcttaaaaagaaaaaaaaaatagttcagcagagtttattaacaaaattacattcattaaacagtgtacctgagttaatatactttcattatcattataaagttggtcttatattaaaaatgaagttctcacagttactataaaaattattttaaaatcactattaaaacatggtaacttactgctttaaaatcagcatcaacatctgaatcttctagactttct

SEQ ID NO: 136835 - DNA, 601 bp, Human
gtgattgtgtcactgcactccagcctgggtgacagagtgaaaccctgtcacaaaaaagacataaaggaaagacctgttaaaaggaaatgatagatattaagttaggatagctgaaagagtacaaattcccttaagtggaataccaaggattggggggatttagtcagcaaaaattaagattagacaaaggttagggagtttgaagaaaagcctataaacagggaagagagcaagcaaggttgttagtatcaaaaggttaaagaagtccgggcaaggtggttcacacctgtaaccccagcaytttgggaggccaaggcagatggatcacctgaggtcgggagtttgaaaccagcctggccaacatggcaaaaccccctctctactaaaaatacaaaaattagctggacatgatggtgcgtgcctataatcccagctgctcgggaggctgaggcaggagaatcccttgaacccaggaggcggaggttgtggtgagctgagattgcaccactgcactccagcctgggcgacagagagagattccatctcaaaaaaaaaaaaaaaagaaagaaaaaagagaaaaaaggttgaagagatccaagaa

SEQ ID NO: 136836 - DNA, 601 bp, Human
acagacacatctaatcaatatatcatgtcgattttacctcttaaacatttcttacatttatataatcacccctaatatcaagtgctagttgaggccctcatcatctcactttaaccactatcacacgctctaggctggtcttaaagctagaaccccatctgtctccattacaccatctgctttacatactagggatattacaaggctgtataattttgttgaaaaaacaagatcattatattttcgaatagtaatggaagacctcacaaagaaagtgacaactgaactagcttttcaaagrtggatttaaaaagaaaggcagtgacagtgggaaataaaacaggtatcatgcatggaaggatcatgatgtgtaggaacgacaaggattagatcaagagagctgaaactaactaagaagcaagtaacagggtgtttgtgcatgtgtgtgtgtgtttcaggatgggagtgaggagtgtattctacagatatgctaaggatggggcattgaaaaagggaggaaagaaaataatgttcaaatcaatggtatgcagaatggctaaaaaaggttaaaggctgatataggagagacctattaaaagac

SEQ ID NO: 136837 - DNA, 601 bp, Human
aaaaatttttcatgataaattaatgacggctatgaaaaagatatcggtcatcaaaagtaacttataaaagtcatcatttaaaaaatgttacaagataaaatttctttattacaaaactctacttccttgccatcattaaaacacaaaaagttcagacagtaaggaatttacttactagactgcacaacagcttgagtctgtgcagaagttcctgatgctatgttagttaatgcccaagcagcttcaaactgtaatgaaggactgtaaaaaaacaataacacatctttttagacacataacyaccacttaaattaatgaatcttaagactgataagatatggctattctttgccttgtccttgaatttcaccttgttataatccaattgcctgctagccaaccctactttttttttttttttgagatggagtctccctccatcacccaggcgggagtgcagtggcgccatcttgactcattgcaatctctgcctctggggttcaagtgattctcgtctccacctcccaagtagctgggattacaggtgcacatcaccacacctggctcatttttgtacttttagtagagatagggtttcact

SEQ ID NO: 136838 - DNA, 601 bp, Human
ccagcataagctagatcactttttaaaaatttcaatcaactgtgcactacctcattttttttttttgctgtatctgtgtattacttgtattatttacttaaaatttaaattaattcagttttaacaactttacggagatataattacaataaatttacatttaagtgtgtaattcaatgacatttcatatttatacagagttgtgaggacatcgccacaatctaattttataacatttccaggacctcaaaagaaatcttggctgggtatgatggctcatgcctgtaatcctaacactctsggaggccgaggcagatggatcaccaggtcaggagttcaagaccagcctggccaagatggtgaaaccctgtctctactaaaaatataaaaattagccgggcgtggtggtgggcgcctgtaatcccagctactttggaggctgaggcagagaactgcttgaaccagggagacggaggttgcagtgagccaagatcgtgccactgcactccagcctgggtgacagagcaagactccgtctcaaaaaaaaaaaatatcatactcagccgggcacagtggctcacacctataatctcagcacttt

SEQ ID NO: 136839 - DNA, 601 bp, Human
cattaaaaaaaaaaaaaaaaaaaaaaagagttcctaccccaaacatgtaaccttaaaatgtaatgctttagtctacaaaatctcaattcctgatacggggattaaccaaagaactgattaatctcatatcaggtctatcttatactttaaaataatttctcataatccttactctttacagaatgtatacattatacccatttccagcataagctagatcactttttaaaaatttcaatcaactgtgcactacctcattttttttttttgctgtatctgtgtattacttgtattatttacytaaaatttaaattaattcagttttaacaactttacggagatataattacaataaatttacatttaagtgtgtaattcaatgacatttcatatttatacagagttgtgaggacatcgccacaatctaattttataacatttccaggacctcaaaagaaatcttggctgggtatgatggctcatgcctgtaatcctaacactctgggaggccgaggcagatggatcaccaggtcaggagttcaagaccagcctggccaagatggtgaaaccctgtctctactaaaaatataaaaattagccg

SEQ ID NO: 136840 - DNA, 601 bp, Human
gaacgaagaagtctcagaaaaagaggtactgcatctgtaataaagaaaaactaatatttatactagcaacatgttgaagagtttacagatttcagatcaaagaaattgatcaaatacacagcctggcatattgtagctggaagaacaaatgtggcaaatatctttaccctaaaaagaatcaatttcagtattttcccctagtaatagtcaagtaccgtaaccaactggcagtatctaaaggttgctatcataccattaactaaaagaaagcaacagcatgaaatccttcctataatccataaaaaaaaaaaaaaaaaaaaaaaagagttcctaccccaaacatgtaaccttaaaatgtaatgctttagtctacaaaatctcaattcctgatacggggattaaccaaagaactgattaatctcatatcaggtctatcttatactttaaaataatttctcataatccttactctttacagaatgtatacattatacccatttccagcataagctagatcactttttaaaaatttcaatcaactgtgcactacctcattttttttttttgctgtatctgtgtattacttgtattatttacttaa

SEQ ID NO: 136841 - DNA, 601 bp, Human
atcttacacctgtggctgggcgtggtggctcaggcctgtcatcccagcactttgggaggccgaggcgggcagatcacgaggtcaggaggtcgagaccatcctggctaacatggtgaaaccccgtctgtactaaaaatacaaaaaaattagccaggcgtggtggcgggtgcctgtagtcccagctactcaggaggctgaggcaggagaatggcgtgaacccaggaagtggagcttgccgtgagccaagatcgcgccactgcactccagcctgggcgacagagcaagactccgttatcaaacraacaaacaaacaaaaaactcacacctgcaatgaaatcagtatatgtattattttgtcccctgtacatgaattcctgaagtacaaacatagggaaaatataccatctggcctttacaattcttcatttacctcctgaactgtctccataggcggtgggggatccttattcctgcagagattgacaatgacccatgtgacgttccgaaggaaggtgatggggatggagggactgatgaaggacagaagaggtttgacaactcccagtgatatgacataatctctacattgaggaccatcacc

SEQ ID NO: 136842 - DNA, 601 bp, Human
agaaaagctacacttaaaactgccgtaattgtctcacttacctgcttaacgtaaaaatacgattttacttaataagctacttaagtcaaattaaagttttcaacttcacctttagtcaagaaaattcgaaccagtacaaagtacaaagctttgcttgttaaattcaggccccagagatctctttttaaaatatgggagaaagggagcagggggttgtaggaaatcacacaaaatacctttgcatagcaacaaaaagtagcaggtactagagaaagatgtccattataaagatacacagttrgccaagtgtggtggctcatgcttgtaatcccaccactttgggagggtgaggtgggtggactgcttgatgccaggagttcaagaccagctggccaacatggtgaaaacccatttctactaaaaatacaaaaattagcctggcatggtggcacatgcctgagacatgagaatcgcttgaaccccggatgtggaggctgcagtgggcaaagattgtgccactgcactccagcctgggaaacagagcgagactgtctcaaaaaaaaaaaaaaaaaaaagagataacacagtcaacagtgaataa

SEQ ID NO: 136843 - DNA, 601 bp, Human
ttataagcctatcacaaggcaaaaaacttatacattaataaaatgaaaaccaaaaaggcttttctatatagaaatttaatagccttatattaaacagctcttaggtgaaacacacacacacacacacacacacacacacacacacaaaacagaaaaacccaacaacaaaatttctatttttcttttctttttgagacagagtctcactctgtcaccccggctggggtgtagtagcacaatcttggctctctgcaatctctgcctcctaagttcaagtgattctcctgcctcagtgccccaygtagctgggattacaggcgcgtgccatcacagtcagctaatttttgtgtttttagtagaaatggggtttcaccatgttggccaggctggtctcaaactcctgacctcaggtgatccacccgcctcagcctcccaaagtgctgggattacaggcatgagccaaaacgcctggcctaaactcaacaaaatttctaaaaagttaaaacaaaaatgccacacatcagaatctatgacatttatttaaaacagtgattaaaggaaaattcatagccttaaaaatttatacaaatttgtctgaacc

SEQ ID NO: 136844 - DNA, 601 bp, Human
tatgagggaagtcaaataggcaaaaaataaaggtataactcttatgaatatatattgaactttataccctgataatggcaactacaacttgcacatgtacaaatatcatattaggttcaaagaaaacatcaataaattacctaagtcagaaacattataagcctatcacaaggcaaaaaacttatacattaataaaatgaaaaccaaaaaggcttttctatatagaaatttaatagccttatattaaacagctcttaggtgaaacacacacacacacacacacacacacacacacacacaaaacagaaaaacccaacaacaaaatttctatttttcttttctttttgagacagagtctcactctgtcaccccggctggggtgtagtagcacaatcttggctctctgcaatctctgcctcctaagttcaagtgattctcctgcctcagtgccccatgtagctgggattacaggcgcgtgccatcacagtcagctaatttttgtgtttttagtagaaatggggtttcaccatgttggccaggctggtctcaaactcctgacctcaggtgatccacccgcctcagcctcccaaagtgctgggat

SEQ ID NO: 136845 - DNA, 601 bp, Human
catatgagggaagtcaaataggcaaaaaataaaggtataactcttatgaatatatattgaactttataccctgataatggcaactacaacttgcacatgtacaaatatcatattaggttcaaagaaaacatcaataaattacctaagtcagaaacattataagcctatcacaaggcaaaaaacttatacattaataaaatgaaaaccaaaaaggcttttctatatagaaatttaatagccttatattaaacagctcttaggtgaaacacacacacacacacacacacacacacacacacacaaaacagaaaaacccaacaacaaaatttctatttttcttttctttttgagacagagtctcactctgtcaccccggctggggtgtagtagcacaatcttggctctctgcaatctctgcctcctaagttcaagtgattctcctgcctcagtgccccatgtagctgggattacaggcgcgtgccatcacagtcagctaatttttgtgtttttagtagaaatggggtttcaccatgttggccaggctggtctcaaactcctgacctcaggtgatccacccgcctcagcctcccaaagtgctggg

SEQ ID NO: 136846 - DNA, 601 bp, Human
aaaaagattttcaaattggccctggctctcaaaacaaaacccaattccacgctgtatacaagagacacacataaaacaaagaatttggaaaggctaaaaataaagggatgagcaaaagtatgccaagtaaatgataaaaagaaagctgaggttgtaaccctgttaaaagacgaccagtagaatttaatctaaaaagaattacaaagaaaaaaggatactttacaaagttaaatcccacaatttatcatgaaaatacaacagttataaacatctattaaccaaatagccctgcaatcactgktttaaagcagagaataaacacacacacacacacacacaaatatatgtaaaaacatactaataataggaggttttaacatactactgtcatatgagggaagtcaaataggcaaaaaataaaggtataactcttatgaatatatattgaactttataccctgataatggcaactacaacttgcacatgtacaaatatcatattaggttcaaagaaaacatcaataaattacctaagtcagaaacattataagcctatcacaaggcaaaaaacttatacattaataaaatgaaaaccaaaaag

SEQ ID NO: 136847 - DNA, 601 bp, Human
tagtaagagagcattaaaaaggtgtaagaataaaggtaaccactagaacaaaaatacaaacttccccaaataccaaaagaaaattgagaaagacaaaagtatgcttagcagagaaaaaaaaaaacacagggacattatttcacaaaatgacagttcaaatcaatctatcaacctatgtgaatgggcctaactaacctattaaaaaaaaaaaaagattttcaaattggccctggctctcaaaacaaaacccaattccacgctgtatacaagagacacacataaaacaaagaatttggaaagrctaaaaataaagggatgagcaaaagtatgccaagtaaatgataaaaagaaagctgaggttgtaaccctgttaaaagacgaccagtagaatttaatctaaaaagaattacaaagaaaaaaggatactttacaaagttaaatcccacaatttatcatgaaaatacaacagttataaacatctattaaccaaatagccctgcaatcactgttttaaagcagagaataaacacacacacacacacacacaaatatatgtaaaaacatactaataataggaggttttaacatactactgtcatat

SEQ ID NO: 136848 - DNA, 601 bp, Human
aatatatataatattttaataaacgcctggaatgggcacacacttccacctagaaagtcactttggtaaagcaggatgaacagatctaataagtgcctacccctaattagagtgggagagagaaagaagaaatgcaattaggttattgcaattatttgggggaaagatagagtcttgaactaaatctgttgttctagatagataaggagagacagatttgaacctatataagaagaattgaaatgattttgtaatggaatgggaattgcaaggaggaatcaaaatttctagcttaggccakgctgttcactgaaggtagacaaggaagaagagcaggtttgtgggagatgatcgtttcatttctgtctagttaaccacggaaagcttgaaggagttcttagatgatatgtataaagggtcaagaacaattggctatacaagtgtggaactcagcaaagaaactgggtgagataaagatttggaaatcaacaaaatcaggctcagggactagcagaagaaatgtggaagataagcacttacagatagaattaaagcctagctgtacaagttaactggttatagcaaacacaactgtatacaa

SEQ ID NO: 136849 - DNA, 601 bp, Human
agatttgggaagtgtgacaggacatcacaattgagaacaacctgggtctgctcgtcggtgccagtcactatgttgccaactgctctgagggctgctgtctagggtggggataaaatgttttctataaatttatttgcttataagactaattctatatttttcataatcctgagaaaaagtaaaaatgcaaggcataaataacacttatttcatcctttcacaaagcaccaagcagtctgagagctattctgaattttaaatagtctcttgtgaaaaactgaaactttatgaaaaaaaaaaattgtgtgaaaattggttggaaaaagattcaaaaaataaaaggaaattaaaattttagaagaagtccagtttcttaaggctgggcatggtggctcatgcctataatcccagcattttgggaggccgaggcgggggggatcacctgaggtcaggagtttaagaccagcctgggcaacatagtgaaactccatctctactagaaatacaaaaattagctggtgtgatggtgcatgcctgtaatcccagctactctgaaggctgaggcaggagaatcacttgaacctgagaggcagaggctgcg

SEQ ID NO: 136850 - DNA, 601 bp, Human
aatttatttctttttcttttttcctttttttttttttttgagacagagtcttgctctgtcgcccaggctggagtgcagtggcacaaacttggctcactgcaaactccacctcctgggttcatgccattctcctgcctcagcctcctgagtagttgggactacaggcgtctgccaccacacccggctaattttttgtaattttagtagagacggggtttcactgtgttagccaggatggtctcaatctcctgacctcgtgatctgcccgcctcggcctcccaaagtgctgggattacaggcwtgagccaccatgcctggccaactaaacgtaaatttaaaccacaatgagacaccacttcacatctactaggattgtcagtaattttttttaacagaaaataaacgttggctaggatgtggagaaattagaattctagtaacactgctggtgggaatgtaaaacagtgcagctgcaatggaaaacggtttggtggttcctcaaaaagctaaacccagaattaacatatgatcgagcaattctacttgcagttatatatccaaagaaattgaaagcgggaactcaaataggtatttgtatgcc

SEQ ID NO: 136851 - DNA, 601 bp, Human
atggcaagtttgtgacagtactagaaccaactcccccacagtgctttaatataaatttactaatctattttttttttgagacggagtctcgctctgtcacccaggctggagtgcagagtgcagaggtgtgatctcggctcactgcaagctccgcctcctgggttcatgccattctcccgcctaagcctcccaagtagctgggactacaggcgcccgccaccacacccggctaagtttttctatttttagcagagacggggtttcactatgttagccaggatgatcttgatctcctgacctygtgatctgcccacctcggcctcccaaagtgctgggattacaggcgtgagccactgcgcctgggcattttttctttctttcttttttttttttttttttgagacggagtctcactctgtagccagggctggagtgcagtggcacgtctcggctcactgcaacctccacctcctgggttcaagtgtctcctgcctcagcctcccaagtagctgggattacaggtgcccaccactatgcccagctaattttttgtgtttttagtagagacggggtttcaccatgttggccaggctggtctcga

SEQ ID NO: 136852 - DNA, 601 bp, Human
agaaagtgactgatggaatgtctaatagaaatacagtacaaacttatgtcatcctaataataaaaggaaaactcttagtaaatttacatcatgtataggttttcatttacatgaagatacacgctattttaatatctacttacatcatcaccagagaaatactgatctatgatttcaaatgctaatttatatatgtcttcattttcatgttgctgtaaaacttcaattttctccaaacctggtaaaaataaaataatcaaaataactggttaattgataaggagatactaatcaaaaccayactcattttaatcatggagaaatcctaaggaactcagaacacactgctcccccatctaagatagtggtttgtctaaaaaacagacaaaacacggggctgcttctagttggaggaccagaatcccactaattttttccttcttagaagcccttgaggtacccggatccctgaggcagacagtctaaaaaaacacccaaacaatccatttgacagagggaagctgtggcataaatatgtaaagagacttatttcaagttatatggcaagtttgtgacagtactagaaccaactcccccacag

SEQ ID NO: 136853 - DNA, 601 bp, Human
aattttggcatgccagaagggttaaaaaaaaaaccgagatgtggtctctgttgttaattactatgtgtgttaaatttttaaatagtattttccttatttttaagtgtagcagtgttcactgtagaatacttggagaatctaacaaaatataaaaatgaaaacctaaagcatttataatcccatcatctgtagataatcaccagaacttctgagaatgtctttcctccttccttttatgtgtacatggaaaatacacatgattataacttcaaaaaaaatttttagagacgatgtctcgctktgtctttcaggtgaaattcatataacataaaattagccatttaaaaatgaacaattcagtgttcatttttagtacagtttagtacatttacaatgttatgcaaccactacctctatgcagttccaaaacatctgcatcaccccaaaaggaaactcagtgcagtcagcccttggtatctgcgggagattgattccaggacctgtggataccaaaatatactcaagtcccttatctaaaatgacacagtatttgcttttgtttctctttttgagacaggctcttcctttattgcccaggctg

SEQ ID NO: 136854 - DNA, 601 bp, Human
tttacaatgttatgcaaccactacctctatgcagttccaaaacatctgcatcaccccaaaaggaaactcagtgcagtcagcccttggtatctgcgggagattgattccaggacctgtggataccaaaatatactcaagtcccttatctaaaatgacacagtatttgcttttgtttctctttttgagacaggctcttcctttattgcccaggctggagtgcagtggtgcgatcatggctcactgcagcctcaaactcctgggctcaagcaatcctcccacctcagcctcctgtgtagctggraaaataggtgcaagacattgaacctggctaattttttattttttatagagatgagttctcactgtttttcccaggctggtctcatactactggcctaaagcaatcatcccatcctggcgtcccaaagtgctgtgattacgggtgtgagccacaatgcccaacgtaattatataatgttttttaaaacaatgttttgaattcatacttaccttgacttcattagttacagatgatgtggtgcagaagcatagcaagtctaagaagaaacagtagtcatcattgtgaccattgtaatggccc

SEQ ID NO: 136855 - DNA, 601 bp, Human
caaaaggaaactcagtgcagtcagcccttggtatctgcgggagattgattccaggacctgtggataccaaaatatactcaagtcccttatctaaaatgacacagtatttgcttttgtttctctttttgagacaggctcttcctttattgcccaggctggagtgcagtggtgcgatcatggctcactgcagcctcaaactcctgggctcaagcaatcctcccacctcagcctcctgtgtagctgggaaaataggtgcaagacattgaacctggctaattttttattttttatagagatgagktctcactgtttttcccaggctggtctcatactactggcctaaagcaatcatcccatcctggcgtcccaaagtgctgtgattacgggtgtgagccacaatgcccaacgtaattatataatgttttttaaaacaatgttttgaattcatacttaccttgacttcattagttacagatgatgtggtgcagaagcatagcaagtctaagaagaaacagtagtcatcattgtgaccattgtaatggccctttgcagtttaccagtacatccccaagcatcttatttgtccctgctacatggcctc

SEQ ID NO: 136856 - DNA, 601 bp, Human
ccttatctaaaatgacacagtatttgcttttgtttctctttttgagacaggctcttcctttattgcccaggctggagtgcagtggtgcgatcatggctcactgcagcctcaaactcctgggctcaagcaatcctcccacctcagcctcctgtgtagctgggaaaataggtgcaagacattgaacctggctaattttttattttttatagagatgagttctcactgtttttcccaggctggtctcatactactggcctaaagcaatcatcccatcctggcgtcccaaagtgctgtgattacrggtgtgagccacaatgcccaacgtaattatataatgttttttaaaacaatgttttgaattcatacttaccttgacttcattagttacagatgatgtggtgcagaagcatagcaagtctaagaagaaacagtagtcatcattgtgaccattgtaatggccctttgcagtttaccagtacatccccaagcatcttatttgtccctgctacatggcctctccgactccaatgcccctggttaataggtttatgtgacctttgttaaacatcactctacaggaaaaataaatgaataactcttg

SEQ ID NO: 136857 - DNA, 601 bp, Human
ggctcaccgtgattcttgcgtttattttcctggatggtttttagtcatatcaagctcatggcagtgtgggtaaactcagtcacttagttccaaggcacagaaatggttgatgaatccctaggtttagcatatgccgtgtttattaaaagcccagaatttaaagcatgcttcaaaagcgtaaaagaaagtcagaaattttacccttccttggtgtattaaatgttctgcatgcagtttaaggtaagacccttaaattatggttccctaattatgaagttatccttgtttaccacagaagtarcataactggctttaaaaattcagatgaattataggtcacatgtgaaaatcttatcattaggaagagagagaaacacatttgaagatcagatctcccaatgaaaaaacatattttatcttaaggcattagaattcacaaagatacgcaatagttttgagtgtgtaaaaatgtaaacttctctatatcataattatgaaacaagttaaaaggacacggtaagctgggcacagtgcctcatgcctataatcccagcactttgggaggccaaggcaggaggattgcttgagcttaggagttcga

SEQ ID NO: 136858 - DNA, 601 bp, Human
gaaattttttttaatgaacaattttttatgtgtaataatatcaggatcttattaatgatttctggttttaaaaagtataagcaatggaaggagatgtacgtagcctctcttaaaaagcaccaagaagaccagcacagcacttagaacttcagcccttaataaatatggtattgatatgaatagcaagaagaaggaatcgcttagagagagtgttgttttactggcaggtaaaagctcagctgaattattcggtttagttctctgatcttcaaactagagaaggtgttcatggtggacttasgagttagctattgcaaatgtgtttatctccaggtccagataaaccatttcccagatgaaagaacttaaagctagaataggaaaacctctgaatgtgagctttaaatgaatttcagaatgggaaaattgtcagaaaacaggacataagcaaatattattcttattttcaaaaatgaggaagagtacattctggaaaccagattataagtgagacattattccccagtataatttgagcattattattaaacatatggtttatacatatttagagaagaaacatatcttttacaaacctgga

SEQ ID NO: 136859 - DNA, 601 bp, Human
gggtagctgcagtcaagcctgggcatgggaggtgagctgacagtactggggcatgatgctgtatgcgtcccaacagcaacaggtgtttaaaatcagagagaaagatgtgctcttactagtaaacgggtgccgctgtgctgaagcctaggcaacagagcaagaccccatctcaaaaaaaaaaatagtaaactgctgttgtgtttttaaaaattaagcagcaaggaggtgagctgcatcatttacagagggaacattttttaaataattccgttacacttagaagcatgtgtaatcatatcaygttaccatgcaccccccgccctgtcagatcacccctccaaacacttgtgcttctgtctccttcctcactaagtactaaagcaggtgattgcaagtctgcctttatgagttttaagcaggacattacagataattaagcaaaaagaattggcagcttcagattaaaacagctgagcgagccaacccctctcattattagcctgttgccctgaatggttcattctgaagtgacctctttcagcattcgctttggagggggcctccatatgttaagttacccaggtttgttgtacttctgcct

SEQ ID NO: 136860 - DNA, 601 bp, Human
tgtgtgaaggaggcagtcaagataagagtggacgaaagagtgtgcttggcagagagaatggcctttgccaagccctgaggcaggaaggagcttggtggattcaaggaactgaggtggaggccagtgtgatgcaaggttctgagcagggaagagtggccgagtagcgtgacagcagcggttcccaatgggggcagatttgtcccccaggagacattagacagtgctgtcagaactgaggggagtaggtgctactggtaggaggccagggacactgcccccccaccccccgacaacaaatactcatcagccccaagtgtcaatagtgctaagttgagaagccctgagttagagaaataggcagcagcctagacaaaggttgtggactagaggagaaagaagaaaacaagtttgagattcatttcagagttgatattgactggacggggccatggttggatgtgggggtgagggcatggtaggaatgattgatcccaggattctaatttgagcacctgggtggatgctgtgaccatctgttgagacagagatgaatggtaggggggaaacaagtcttccaatttggacatgtgagtttgagaat

SEQ ID NO: 136861 - DNA, 601 bp, Human
gaaataggcagcagcctagacaaaggttgtggactagaggagaaagaagaaaacaagtttgagattcatttcagagttgatattgactggacggggccatggttggatgtgggggtgagggcatggtaggaatgattgatcccaggattctaatttgagcacctgggtggatgctgtgaccatctgttgagacagagatgaatggtaggggggaaacaagtcttccaatttggacatgtgagtttgagaatgtcagagaggcaagtgggtggctggacatggacttgggactcaaggaagrggtctggggctcagcttcaatttgtcaaattgcagatgcataggcattggtgaaatagatggagaagagaggcctcaggaagggggaacatccatattttgatgttgcctcctaagatccttttccacagttatattcctaaaatacacaaagctggccaagtcactgccttattatcttccattggccttctggtaccttcagaaaatatccatgctccatagcgtggcatgtgagtccttcacagccatccccattgggtgggtcttgaccatctcctgccattatcttggacacgca

SEQ ID NO: 136862 - DNA, 601 bp, Human
cccattccttcccacgcaagctgatcactctgtgatgtcttcattccagaaacagctctatcattgcctttgtccaccctcccaggcagtggctgtcagtcaccctccccagcctccctcagcaccctgcacttaaccctgttatgtcacaggtgactttgttttgtaataattgttggcagttatgtcctgccaactgcactgtgagtggctggggagcaggagccttgcccaattattttgacatccagagggtcccacgcagcgtctggtacagcatccaaaggatgtatcacttttwtcttcttaattctaagattgttatagattttccaaagagatatgttcttgagcctacagttctggaggtgcaattagaggtgaaatatggggcggggctggggggctgaagagggatagaatttgtactgtggatgttcacagaaagaacactttgaaggtgctcagttccattcccttggctttttctgtttcaaaatggtagtgattacctgagttgtgggtcactgtacaggcatttgaaagttggctcttaatgatgtggcatcctgaagtcccctcatctgtagtctacagatgg

SEQ ID NO: 136863 - DNA, 601 bp, Human
ggggacttggcagtccaggtattactagaattcaatacttagtgaaggccccaataatactgccacctactccatattgggatactgttcaaagtatggaattggaaatttcaaacccattccaattgcagattgggaccccattctccttctgtggtagtccttattattgactattgaaggtggaaggttgtttcaaaaagcagtggaattctgtggcaaaaggaaatctaaccttcatggattaaagacacctttttaaaaagcctgtgcctagaaagtgaattttttttttttttttgctttccgtcatattaaataaaaacgacaaattttctgttgtagctttaccatctctcagtgtctgatttagtttgaggaagctatattgggcttcaagaaccctttttcctcatctgtctctgactacacattcaaactgttcttcctgggacaatagagtttttctgggcagaagcaagtgccaccctcttgaaggacagagagtacagtagaatggggtgagggtgtatggttgaagacagtagggtaagggaaggtgggagtgggcagacaacatctaaaacccgttcatgggttt

SEQ ID NO: 136864 - DNA, 601 bp, Human
actattgaaggtggaaggttgtttcaaaaagcagtggaattctgtggcaaaaggaaatctaaccttcatggattaaagacacctttttaaaaagcctgtgcctagaaagtgaattttttttttttttttgctttccgtcatattaaataaaaacgacaaattttctgttgtagctttaccatctctcagtgtctgatttagtttgaggaagctatattgggcttcaagaaccctttttcctcatctgtctctgactacacattcaaactgttcttcctgggacaatagagtttttctgggsagaagcaagtgccaccctcttgaaggacagagagtacagtagaatggggtgagggtgtatggttgaagacagtagggtaagggaaggtgggagtgggcagacaacatctaaaacccgttcatgggttttaaagaaaatcatgaacaaactaagctgcacaatcagcatagtccctcgccccaggttatttctttatttttaacttatttattaattattctaatcttggagacaagtctgttctcccattcctgacccccaacccagtgttctttggaatatttgatttggatataactt

SEQ ID NO: 136865 - DNA, 601 bp, Human
tgtttcaaaaagcagtggaattctgtggcaaaaggaaatctaaccttcatggattaaagacacctttttaaaaagcctgtgcctagaaagtgaattttttttttttttttgctttccgtcatattaaataaaaacgacaaattttctgttgtagctttaccatctctcagtgtctgatttagtttgaggaagctatattgggcttcaagaaccctttttcctcatctgtctctgactacacattcaaactgttcttcctgggacaatagagtttttctgggcagaagcaagtgccaccctmttgaaggacagagagtacagtagaatggggtgagggtgtatggttgaagacagtagggtaagggaaggtgggagtgggcagacaacatctaaaacccgttcatgggttttaaagaaaatcatgaacaaactaagctgcacaatcagcatagtccctcgccccaggttatttctttatttttaacttatttattaattattctaatcttggagacaagtctgttctcccattcctgacccccaacccagtgttctttggaatatttgatttggatataactttaagattacaaattagagg

SEQ ID NO: 136866 - DNA, 601 bp, Human
cccgctaattaggggagccctgtttttccgagtcctcaagagtactaagcactgctcctttaaaaatgttttaacagctagataggtgaaaatgccttagttttcactttaatttgcattattattgtaagttagactttttcagatgatttttattgatttatgtgtattattatttatgaataccctttgctgtctgatttgtaagcactaatatatttagggccttgcatttttgttgcagatgcttttccattcttaaattagacttttacttttccttactttgtgtttttttttkttttttttttgacccaagcttttatatagtcaaatttgttaatagttcccttaaggcttttatctttgctcttattttgtaattttgtgctagtaatgccttgctttaattttaataatttgtaatgcaagacttcccatggtattcttaattttcaaaaatttcttagtgatgtttttacattttttccctctaattgaactttagaattataaggtcactatctctaaaaaaatttctattgtgatttttgttgaaattatattaaattaatgaattcagaaagaagcatctttaaac

SEQ ID NO: 136867 - DNA, 601 bp, Human
aaatcattgagaaattttggttttggcagaggggaaaaagcttgtgtttcttttgcctgaaagtctgtgctttttcatctctgttttccttttattgagaattttaatgtaatttcatgttatatttgggcctatgcttcttcatttgcaaaatttggggtgtggttgactgctaaatgccattgaagtctcttgatttcttggtggtggtggttttgtttgttttattctgtgatcatctcttgcagcagtcattttatgaaggccaggcaggatgccttgggacggggaaagagaagarggtaaagagtggggagaaggttacatctcctttcgagaaaacctgagttggtttccctttggtgcaaaggcaataatatcttgcatattttcccaccctcccttaaacaccctgtggattaggaactcaaatgactctataggtttaggaagattaatcctctgtgggaaaaagtagagattttctcccccttttctatgttcttggcaaagtgaatacaacagaaaattatcaaaatctgtcatgagagtttgaatttaggaaaattaacttgaatgtgtataaaacatgacactgtgc

SEQ ID NO: 136868 - DNA, 601 bp, Human
tagtaatatcacttcaagtgttttgcacttggcttggtgaaacaaaatgtgagttaaaactgtggagtattaaagcattattcttgacacacctacaatatgagacactccattgatgtggatagcatatatgcagacaacaagcattgatgttgtacttccacctatagatagaagggggatgtaccttggtatgggagttttgcacttagacaaagtcttagttctcaaccagagctgattttgctcaccacccctccagagggcatttattactgtctgcaggtatttttggtttttrtgtctggaggaagtggtgctacaggcaccatttgtaaagaccggggatgctgctgaacatcctacaatggacagctccacacatcaaagaagtctcgaatccaaaatgtcaatagtgccaaagttgagaaatcctggcctacaggaatttatgacttatctgctactgggctttgaaggccatatagacagttgattaatttagaaacagcttggcttgtggaataaacatacctggtatagtctgtgaactgaagtgagccaaggtggtcccagtattgcttccacacttgctgtctca

SEQ ID NO: 136869 - DNA, 601 bp, Human
cctatagatagaagggggatgtaccttggtatgggagttttgcacttagacaaagtcttagttctcaaccagagctgattttgctcaccacccctccagagggcatttattactgtctgcaggtatttttggtttttgtgtctggaggaagtggtgctacaggcaccatttgtaaagaccggggatgctgctgaacatcctacaatggacagctccacacatcaaagaagtctcgaatccaaaatgtcaatagtgccaaagttgagaaatcctggcctacaggaatttatgacttatctgmtactgggctttgaaggccatatagacagttgattaatttagaaacagcttggcttgtggaataaacatacctggtatagtctgtgaactgaagtgagccaaggtggtcccagtattgcttccacacttgctgtctcagatctctgttctcagtgaccagagttaaaaaccagcttccctctgcccttcacgtctgtgggtcctatggttgaggatttttatgtattgtttttctttggggtcctgataaagcttagataaccaaacatagaatttttaaaggtgattgtgaatacaaaga

SEQ ID NO: 136870 - DNA, 601 bp, Human
atgtaccttggtatgggagttttgcacttagacaaagtcttagttctcaaccagagctgattttgctcaccacccctccagagggcatttattactgtctgcaggtatttttggtttttgtgtctggaggaagtggtgctacaggcaccatttgtaaagaccggggatgctgctgaacatcctacaatggacagctccacacatcaaagaagtctcgaatccaaaatgtcaatagtgccaaagttgagaaatcctggcctacaggaatttatgacttatctgctactgggctttgaaggcyatatagacagttgattaatttagaaacagcttggcttgtggaataaacatacctggtatagtctgtgaactgaagtgagccaaggtggtcccagtattgcttccacacttgctgtctcagatctctgttctcagtgaccagagttaaaaaccagcttccctctgcccttcacgtctgtgggtcctatggttgaggatttttatgtattgtttttctttggggtcctgataaagcttagataaccaaacatagaatttttaaaggtgattgtgaatacaaagaactaaggagtgccttacc

SEQ ID NO: 136871 - DNA, 601 bp, Human
aaccctatgccaggggaggaattgggcctcagcatggacaagtcttggcaaagaccactatggcagcagtgtctgaaaaaggaaaagagtccaaggagggaggaaatgactaggaggctgctagagccttccctcagcgccatgttctactcacagaccaatgtagtaaaaatgatttgtatttccttgttcctttttaaatttttgaaaaaaaatttccatatttgggggttttccccattgccaggtggttacattccaaagaaattatatcatgggatacagacacaagtatttccartcatgcttattgtgtagggctgatggcaaggtgattcccctccatggccacacatcataaccaggcaagcccgttaagtatcagcaactggaagtccagcatcaggaccacccatccctctgtcaggcagccccggttggtggtggtaaatggaggagactgaggcctctttcactcacttaaattcggagagtgagccactctactcctgttgggaaaacctatttccttacccaacgagactgtagaaaattcccctcagccatataccatgccaggtttcttttacaagccaacctg

SEQ ID NO: 136872 - DNA, 601 bp, Human
attgtgctgcgtgttggtgatcccaaatgtctgtccatgtttgtaaattaatatggtggggcttatgaaatcaggaccacagtcattgtctgtgaatacttctctttttctacctttggtcaaaaagttggttggtagaagaagagctagaagcctagagccagagccgtggagccgtgggggttctctttcatcctatctgcagcttgggtagccagctgggttttggaggagagtgcatctcttccgaagaccttagttgctttccttgcagaagggctgatcctggcctccgggaacrggagaaacatagtaattttaaaggttatgaggaaaggaggatagggatcccgaaggccagggaggaaaagccagtgagtttggagcgtgggagctgcaggcaggtgggagaagctgaaggcctaacgtggctgttttatttgtttaaatgtacagggctcagaaatagaggattttggaaactgtattccactgttctaaaagagaaagtgtgtaggggggaaaatagcatcttgactacaatgtaatcctagatcttgaaacgtgaggttacatggacaaaaaatgcttaatcccaact

SEQ ID NO: 136873 - DNA, 601 bp, Human
agaatggtgaaaagagccatgaacatattccattcattccccatcaaaagaagagtgagtggagttatggcaagaaaggtactaccgtaatgtgaaaagattccacctaaagatacctgatcatttcttacttcagggaagcccatcttacaggtcctttctggccctacagtgtaagactttaaaagacataggtaggcaggcacaattgcagtttctccatatctttctgcctaggtgtgtttctcaacccccacttcacccacaagctgctgttacatgttcctccaagagtccagcrtcccagtgagccaattagggaacacactccttatttgttattgcaaaagtatatatttaattgtgaatatgggtgtaaattcttctaaaggactattttaaattttaaatgaaaaaggctagagaagtgtaaaattttattataaaaaggaataaacaagaaccttatttggtagatgataaagaatagctatagtttctgccctgtgagagcatacaattttaataatcaaaactcttaagagaaggcatggaaattttattgttttagagcttccatggggactattttacaaatgca

SEQ ID NO: 136874 - DNA, 601 bp, Human
aggaataaacaagaaccttatttggtagatgataaagaatagctatagtttctgccctgtgagagcatacaattttaataatcaaaactcttaagagaaggcatggaaattttattgttttagagcttccatggggactattttacaaatgcagtttaactttaattgctgtaaaataattgaacatgactattagtgtataaccataaaaaaatgaaaattataaagttaagagcaaataatacaattaatacacaaaaagagaatctgtctcactagtgatcaggaaaatggagactaraacaacaagactggcaaaagttaacaatattgatgatactggtattggtaggagtatgaggatagaatcattcttacacagcactctgttggtgagtatgtaaattgatgaaatccgtagaagacatcttggcagtacctaccaaaagtataaatgtgcatttttttaactcatcagttcttctaggaatcaaagctgaagaaatattcaagaaataaatgtataggagtatatgaacaaggatattcatcaccacattattttctattaaagagagagaacaagaaccctagtgtctat

SEQ ID NO: 136875 - DNA, 601 bp, Human
acagagcagggtgaaggagggttgagggacaggcctggggtagatatcctgcactgtcacttcctggcaaaggtaggaagaagtggatattctctcacttctcctatcagccagctggactggggggattttacgatcctaggggctactagagctacagggatgcaggagccaggctctctgaatcacctgacaaaggcaagtggattatcattcagagacactcactgtggactaggtcctatcaaaaaataaacttctcttgaatcaagacattgaattttaggggtgtgttttttttataggacttggtatttgaggattgatttattacagcatttagcattaacaggaactcaactgtagaaagttttgaaggccaagcaaagaatttggattcatttctacagatggttaaaaattagtggaggcttctatgctgggaggtggttttaaaaggaaaaacagaaagagagccttggaatgatgagtctggcagtcacatggcaggtggaatggaacacagtgagcaatccattgatgcagctggcccaaaccccatgtgatcagcgggacctgtgaatcagtcccacacaataca

SEQ ID NO: 136876 - DNA, 601 bp, Human
ttcctggcaaaggtaggaagaagtggatattctctcacttctcctatcagccagctggactggggggattttacgatcctaggggctactagagctacagggatgcaggagccaggctctctgaatcacctgacaaaggcaagtggattatcattcagagacactcactgtggactaggtcctatcaaaaaataaacttctcttgaatcaagacattgaattttaggggtgtgttttttttataggacttggtatttgaggattgatttattacagcatttagcattaacaggaactcaaytgtagaaagttttgaaggccaagcaaagaatttggattcatttctacagatggttaaaaattagtggaggcttctatgctgggaggtggttttaaaaggaaaaacagaaagagagccttggaatgatgagtctggcagtcacatggcaggtggaatggaacacagtgagcaatccattgatgcagctggcccaaaccccatgtgatcagcgggacctgtgaatcagtcccacacaatacaagctgaagggatggaagcataatcatattccaagttcaggtgccagcctgccatgtagaa

SEQ ID NO: 136877 - DNA, 601 bp, Human
gtaactgggactacaggtgccgccaccatgcctgaccaattttttgattttttgtagagaaaaggtcttactatgcggcccaggctgatctcatactcctaggcccaggtgatcctcctgccctggcctctcaaaatgctggaattacaggtgcaagccaccatacctggacaggaccttttattccagaagccaccagaagggtcatagacctgccgtatatttcatgctggggcagaagaaaaatctaaccccagaatacatttagaggaacagtgggagacaaaaataaacttgttaygattacattttataaaagcacaatcattacataggtttgttgcattaaggccttgacctaaaagaaaaagctaaaaagatgagcaactcctaaacatgcctttgtcatgcctcaaaatgtattttaaaacatagtagcaataccttcattggaggacatttccatcccaatatataaaacataaaatttagaaaacttgggaagtacaaaacttgaaagcaaaaatcacctaatatcccgctatccagaaataattgtacattttggtatatttccttcctgtcttattttcctccgtgg

SEQ ID NO: 136878 - DNA, 601 bp, Human
tagcaataccttcattggaggacatttccatcccaatatataaaacataaaatttagaaaacttgggaagtacaaaacttgaaagcaaaaatcacctaatatcccgctatccagaaataattgtacattttggtatatttccttcctgtcttattttcctccgtggatatgtacacgtgtacttggtttttcttgtttaaattttatgatctgtattgtgtcctgctttttaaacttaacatagtatcttatttttctaagttaaggatcacttctaaaatatgatttaagtgatggcatratttgacgagtccatcaaataattttgtcaaatatgctagatccagatttaggtttatatatgaattaacaatatgaatgagaaaaatatagagaatttgactcatagctttagatattccatcaagttgtagtatttatattatcagatgaaagagctacttgtggagacggttgtcacccctttcttcaaactctctttccttggtttcagtgaagccatatttccctgattttcttctactgtgttagtcactcctacgtctcctccaaagcttttcctccttccatctattttcta

SEQ ID NO: 136879 - DNA, 601 bp, Human
ccagggcaattaaggagacctgaggatcaaggaccgaattcaggggacactgcaattatagcaaatacaatatgagaggtcagagaagaagtgacaggagagactataagaaagctggaagtgggccgggcatggtggctcacacctgtaatcacagcactttggggctgaggtgggcagatcacatgaggccaagagtttgagagcagcctggccaacatggcgaaatcccatctctactaaaaatacaaatattagccagatgtggtggtgcatgcctgtagtcccagctactcaggcrgctgaggcatgagaattgcttgaacccgggaggcagagattgcagtgagccgaggttgcacgactgcactccagcctgggcgacagagtaagatgctgtctcaaaaaaaaataaaaaataaataaataaataaatatatatatatatatagaagtggctccaggaccatattctatcatagaaatcaagagaagacatttttttccagaatagacaggtgttctctggtgttaaaagcttgaagaaataaaaagatataaagcatgtggggaggtggggatgggtcttagatttgctaag

SEQ ID NO: 136880 - DNA, 601 bp, Human
atatatatatatagaagtggctccaggaccatattctatcatagaaatcaagagaagacatttttttccagaatagacaggtgttctctggtgttaaaagcttgaagaaataaaaagatataaagcatgtggggaggtggggatgggtcttagatttgctaagtaaaaatattcaatcagaaagaaagctatcttttctataaagtaaatgatctttattacatccattcatgtcagggtttcttaacctgagcattattgacattttggtctggatgattctttgtggtgggagctgtcytgtgcagcatccctggcctctacccactagacgtaatgccaccacctccagttgtgattaccaaaaaatgtcttcagatatcatcagatgttcctggtgaagaaccactgatttaagtatttaattcctaccatgtatgtagcactacattaggcagtgcaaggcataaaaagtatgacacacttcaccgtaaaaaaatacattctaattgtcctaaattgagttattctgttatttctcctattatgttggttaaaactatatatgtgtatactcatacacacacacatacacacacac

SEQ ID NO: 136881 - DNA, 601 bp, Human
cctctacccactagacgtaatgccaccacctccagttgtgattaccaaaaaatgtcttcagatatcatcagatgttcctggtgaagaaccactgatttaagtatttaattcctaccatgtatgtagcactacattaggcagtgcaaggcataaaaagtatgacacacttcaccgtaaaaaaatacattctaattgtcctaaattgagttattctgttatttctcctattatgttggttaaaactatatatgtgtatactcatacacacacacatacacacacacacgcacacacacacgtrtacagtagttattctccaagttaacattacatcagcttaattattggatgatattagaaaagtagtaaatgggaaatattggtgtccccatgctgtatgttttagcacagattaatgtaagaaattattatggatctatggtgggactagtaagcaatttccaaattaaattataagaaacattatcacaaaaaacatttgaaaagaaagagctttaatgtttggaatagattctgcatcaaaagaagcaacttatcatcttgccaaacctcagcctcgtcattgttttggagcaagaaa

SEQ ID NO: 136882 - DNA, 601 bp, Human
tgtttgcaaaaataccaaagttacccatatatgttgtctctagctttcatcattttagggtgaggggatcaattatttaaaaacaaatacatctggaaatggatgatggtaatatgaatgtattaatgccacaaaactgtacacttaaaagtggctaacatagtaaattttatgttgagtatattttaccacaataaaactaattaattaaaaattctattactacgttcatttaggaagagaagaagtaatcattaaataagtatcaccacaagtgacaggatttttcaaatgaaaaatmaaaataaagaaaataaaaataaagatattcaatttggggacttgtctttggagctgtgagaattgattttaacatttctcttaaaaataagtcatgttattaccaggcttgggtaaacatagctaaagtgacactttgtttaccactagtgtcctcatcaccttattaaaaatctatatgtatctttagaataattgtctttacacatttatctctgtgtctaggtgtcaactgcctaaaaataaaacctgtttgtggacatgcagtaacccccacatagtcaccaaggagcagagccca

SEQ ID NO: 136883 - DNA, 601 bp, Human
gtttgcaaaaataccaaagttacccatatatgttgtctctagctttcatcattttagggtgaggggatcaattatttaaaaacaaatacatctggaaatggatgatggtaatatgaatgtattaatgccacaaaactgtacacttaaaagtggctaacatagtaaattttatgttgagtatattttaccacaataaaactaattaattaaaaattctattactacgttcatttaggaagagaagaagtaatcattaaataagtatcaccacaagtgacaggatttttcaaatgaaaaatamaaataaagaaaataaaaataaagatattcaatttggggacttgtctttggagctgtgagaattgattttaacatttctcttaaaaataagtcatgttattaccaggcttgggtaaacatagctaaagtgacactttgtttaccactagtgtcctcatcaccttattaaaaatctatatgtatctttagaataattgtctttacacatttatctctgtgtctaggtgtcaactgcctaaaaataaaacctgtttgtggacatgcagtaacccccacatagtcaccaaggagcagagcccat

SEQ ID NO: 136884 - DNA, 601 bp, Human
tttcagtctcttcacttgtaaaacaggagtttaccctgatgtaaagatcattacagaaaacagactgcccttgggtttgacccacatgcacttcaggatttatttggacagccagggaatacccaccttttggaaaagaattccaagaaactacggcaagggtaaaacattatcctaaatgataagcaaacatatatgtcaaagattcatataaaatattgcctcatatcatcactcaatgttacaggtttgacaaactagccaactgcctgcatttctaggcataatgacataaacttakccaagagtccatcttataccagggattcccaatccctgggctgtggacaagtaccagtccatggcttgttaggaaaccagcagcacagcaggaggtgagcagagggcaagcaagtattacaagggcgagctccgcctcctgtcagatcactggcagcattagattctcataggagcacaaaccctgtagtgaactgtgcatacaagggatctaggttgtttgctccttatgagaatgtaatgcccgatgatctgagatggaacagtttcatcccaaaaccatccccccatttccactgtc

SEQ ID NO: 136885 - DNA, 601 bp, Human
tgggcagggagaaacccctgaaacttgtaacagaatcctgaaaaggaggaataacagaggaacgtcaagtctaagttaagccattcctatctgcttatgacttttctgctgttctgatgtgagtctaatctcccaatcttgtttgttcctgatcagtttgggccattgttttccctccctggactatgatttatctgctaaatggggaattccagatggcggctaatgcttcctcaagcttcaacattgtgtaattctgaacatacgttgccattaagatatatgtatttttagactaagwcaagcagtagctttggccttaaaaatgaacttgcctcagaagaggtgaatatcagaatgccagagctggtctgtgattgaactttaactgcttcttagtgaataagtggggaagaggacagagaaacttctgttctttatttgaaatttctttctccttttttggagctaaaaatgccctgatgtgatagggattgtaacgtgtgcttgcttaattgtttaggttcttacttggcaaaataaagttggaaatccaaggttggattccaaacttttgttgtcgaaattttactggcccatg

SEQ ID NO: 136886 - DNA, 601 bp, Human
ttttccctccctggactatgatttatctgctaaatggggaattccagatggcggctaatgcttcctcaagcttcaacattgtgtaattctgaacatacgttgccattaagatatatgtatttttagactaagtcaagcagtagctttggccttaaaaatgaacttgcctcagaagaggtgaatatcagaatgccagagctggtctgtgattgaactttaactgcttcttagtgaataagtggggaagaggacagagaaacttctgttctttatttgaaatttctttctccttttttggagmtaaaaatgccctgatgtgatagggattgtaacgtgtgcttgcttaattgtttaggttcttacttggcaaaataaagttggaaatccaaggttggattccaaacttttgttgtcgaaattttactggcccatgggatccaagcatctagaaccactgctcaaaaccccatagctgagatttccaaagcttcaacttacgccaagacaagaaagtcagttgtcgggtgtttttttttttttttccacaccctacataagtgcattgaagaaatataaggtaaatcttaaactgtgaggagtt

SEQ ID NO: 136887 - DNA, 601 bp, Human
tgcatcttataatttggataagatgtaaataattaaaagctgattctactctgtgctgatgaagactctcggatgtctcctctgaatcttcttgtaaaggaaaaaagaaaatctgtgaatgatcttctttatttggtccctaagaaaatcatatgacttctgcctaatgaagcaatactgcttcctcaaggcacatcaataagtctccaaagaatggtgagcgcaaggttgaaagtccctagcatactgctgcccttaaatgtatatattactctctttctctcaccactcccctttcatwgaagcctcaggtgcctctacccatcactaccaatgcaagtacacaagcacacgcatttgttctgtgtgtgtgtgtgtgtgtgtgtgtgtgtgtgtgtgtgtgttagagaacaccctttggtttctagccattctgtaattactgagggttgccatcattcaggaaatatatttgagaaacccaatggggttttgatattatattatggaaaacaagatctcttatcttctgccacacactcaaatttaatggattctctttctgaatttccttgaacttctcaccagctgaagagatgcc

SEQ ID NO: 136888 - DNA, 601 bp, Human
acgcatttgttctgtgtgtgtgtgtgtgtgtgtgtgtgtgtgtgtgtgtgtgttagagaacaccctttggtttctagccattctgtaattactgagggttgccatcattcaggaaatatatttgagaaacccaatggggttttgatattatattatggaaaacaagatctcttatcttctgccacacactcaaatttaatggattctctttctgaatttccttgaacttctcaccagctgaagagatgccttagacttgcgtttcacactgttgatccagtcaatatgaccagatggatgyctgtctttagccctcccatatccattgccccaaaggctggaagtccattctttcattcatctggacctcacaaatttgctttctttggggaagatccttttctgaacaacttcccacacagcctccccaagtttcctaatgagtctttaagctggaaaaattattttcataatgtggttagagtatttacaaaggagcataagaatctaagctcatcacttctcacaagaaaagtctttgtccctgtacctagcaaaaggtaaattaatcaatcagtggacactttgaacaccaattata

SEQ ID NO: 136889 - DNA, 601 bp, Human
cctgtctctactaagaatacaaaaattatctgggtgtggcggcacacacctgtagtcccagctacttgggaagctgaggaaggggaatcacttgaacctgggaggcggaggttgcagtgagccgagatcatgccactgcactccagtctgggtgacagagtaagactccgtctctcaaaaaattaaaaaaaaaaatttaaggcaacacatttatataaccaaaaataccagacacaaaattaatataagcaccttgaatatttctggaatgaaataaagtgagagcagtggttttctcaaatgttgagaattgggggaagaatcaaggatagcagagacacttttcattgactacatgccgttttgtaaactattttaatttcttatctactttaaaagagaacaaaagtaggcatgtattccctattttttttctttttttttttttttttttgagacagagtctcgctctgtcaccccggctggagtgcagtggcatgatctcggcttagtgcaacctctgcctgccgggttaaagcaattctcctgcctcagcctcccgagtagctgggattacaggcatgcgccaccaggccaggct

SEQ ID NO: 136890 - DNA, 601 bp, Human
gaagaggaaagtggccacataatatgagagccacatattgtcagaagaccctttctggtggtgccagggagctcttaaggacttagcagtagcaaatccaagaatcccagacctttggaccccagcttctttgttgttcccagatggatttgttaagcctcttaacctatggctgacctccccctgcttcttggcgcccccacctctcctttcatattttggcttgacatctcagaccctggaattctatttcctttagcatgagtgctggccggaagggccagcttgacctagcttattscccgctccccatggactgcttccctgactgccaatcagagctgccgtttctgagctctgcgtctgaaaagacctgaacagcctcatcctgcactgagtcctcctgacacataccatcttctcctggcatccttgtggcagcccctgagtccctttgcctggcttccccaagcccagtcccagacccctgtgtataataagcctgccctttgggatggttcattcctgaccaactcctccatgtagcacattggccacttggaactattctagaaaactgatcttcttttatgcctcaacc

SEQ ID NO: 136891 - DNA, 601 bp, Human
gaggaaagtggccacataatatgagagccacatattgtcagaagaccctttctggtggtgccagggagctcttaaggacttagcagtagcaaatccaagaatcccagacctttggaccccagcttctttgttgttcccagatggatttgttaagcctcttaacctatggctgacctccccctgcttcttggcgcccccacctctcctttcatattttggcttgacatctcagaccctggaattctatttcctttagcatgagtgctggccggaagggccagcttgacctagcttattcccygctccccatggactgcttccctgactgccaatcagagctgccgtttctgagctctgcgtctgaaaagacctgaacagcctcatcctgcactgagtcctcctgacacataccatcttctcctggcatccttgtggcagcccctgagtccctttgcctggcttccccaagcccagtcccagacccctgtgtataataagcctgccctttgggatggttcattcctgaccaactcctccatgtagcacattggccacttggaactattctagaaaactgatcttcttttatgcctcaaccctg

SEQ ID NO: 136892 - DNA, 601 bp, Human
cctatggctgacctccccctgcttcttggcgcccccacctctcctttcatattttggcttgacatctcagaccctggaattctatttcctttagcatgagtgctggccggaagggccagcttgacctagcttattccccgctccccatggactgcttccctgactgccaatcagagctgccgtttctgagctctgcgtctgaaaagacctgaacagcctcatcctgcactgagtcctcctgacacataccatcttctcctggcatccttgtggcagcccctgagtccctttgcctggcttycccaagcccagtcccagacccctgtgtataataagcctgccctttgggatggttcattcctgaccaactcctccatgtagcacattggccacttggaactattctagaaaactgatcttcttttatgcctcaaccctgctgagcccaattcccccacaggatcagagggctctttccaaaagcaggcatccagatgtcaggttctgcaccccatctccacattgctattccccattggctgtgtgtggtgggggagaaatggatatgtaaatgatgagtcccctttcttgaaggctttcc

SEQ ID NO: 136893 - DNA, 601 bp, Human
ctgagtccctttgcctggcttccccaagcccagtcccagacccctgtgtataataagcctgccctttgggatggttcattcctgaccaactcctccatgtagcacattggccacttggaactattctagaaaactgatcttcttttatgcctcaaccctgctgagcccaattcccccacaggatcagagggctctttccaaaagcaggcatccagatgtcaggttctgcaccccatctccacattgctattccccattggctgtgtgtggtgggggagaaatggatatgtaaatgatgagwcccctttcttgaaggctttcctatcccttggcctgaccctctatatgctcactgccacagccatccatacccacaagttaatttgagccaaggaaagagtggtgacattgagtactacaaagacatcacagatcacttgctatcaaaaccagaaagcaggatttattcaaaccatccccaatggctcccacgtgacagacaagctgagatgcgtgtcctatttgaaaactgctcatcccaggtaccccttcatcttccgccaggcctgcacctcttctagtcttctgtgacccagggaac

SEQ ID NO: 136894 - DNA, 601 bp, Human
tgtaaatcctggagcctgaggagcaaggcttaatctatctttatatctacatgcctggttcttagtaggtacttagtaagtgtttattggaatatgtatttgaacagaggaataatcagctgtctaatgatttaaaaaaaagagaaagaaaggtttaggtaagaaacctgtctttggtgatttttgtgtatctagctattttttaagttctgcctattttggaggaagtatccagtttcactgcaatgcctgccaaaaattgcactgagaatttaataaagtagattatctccattttgartcacttgggattatttgaaaagttgtactggttgtcctcctatcaagagtcatttgtgtaacaaaagtacatttatattgcagtgagttttcccatggaagcagtgttgtaaatggtcattagactttttttctttccaacttttattttaagttcaggggtacatgagcagatttgttacatgggtaaattgtcatgagggtttggtgtacagattatttcatcactcaggtaataagcatagtacctaataggtaaattttccatctttctaccctcctcctcccgccctccaccctc

SEQ ID NO: 136895 - DNA, 601 bp, Human
cagaggaataatcagctgtctaatgatttaaaaaaaagagaaagaaaggtttaggtaagaaacctgtctttggtgatttttgtgtatctagctattttttaagttctgcctattttggaggaagtatccagtttcactgcaatgcctgccaaaaattgcactgagaatttaataaagtagattatctccattttgaatcacttgggattatttgaaaagttgtactggttgtcctcctatcaagagtcatttgtgtaacaaaagtacatttatattgcagtgagttttcccatggaagcartgttgtaaatggtcattagactttttttctttccaacttttattttaagttcaggggtacatgagcagatttgttacatgggtaaattgtcatgagggtttggtgtacagattatttcatcactcaggtaataagcatagtacctaataggtaaattttccatctttctaccctcctcctcccgccctccaccctcaagtaggcccttgtgtctgtcattttctactttatgttcacatgtgctcaatgtgcaactcccatttagaagtaagaacatgcaatatttggttttctgttact

SEQ ID NO: 136896 - DNA, 601 bp, Human
cacttgggattatttgaaaagttgtactggttgtcctcctatcaagagtcatttgtgtaacaaaagtacatttatattgcagtgagttttcccatggaagcagtgttgtaaatggtcattagactttttttctttccaacttttattttaagttcaggggtacatgagcagatttgttacatgggtaaattgtcatgagggtttggtgtacagattatttcatcactcaggtaataagcatagtacctaataggtaaattttccatctttctaccctcctcctcccgccctccaccctcargtaggcccttgtgtctgtcattttctactttatgttcacatgtgctcaatgtgcaactcccatttagaagtaagaacatgcaatatttggttttctgttactaggttaattcacttagaataatggtcttcacctccatccatgttgctgcaaaggacatgatttcattctttttatggctacatagtattctgtgttgcgtatgtaccatattttcattatccagtccactgttgatgggcatctaggttgattctatgtctttgctattgtgaatatggactttattttattagcact

SEQ ID NO: 136897 - DNA, 601 bp, Human
ttcacttagaataatggtcttcacctccatccatgttgctgcaaaggacatgatttcattctttttatggctacatagtattctgtgttgcgtatgtaccatattttcattatccagtccactgttgatgggcatctaggttgattctatgtctttgctattgtgaatatggactttattttattagcactgacccctgtcttctttaggtgtatgtactgtctctccagcgagactttaaatgtctcaaagggcaaagctcattctttacacctctctgcagctgcagcacctggcttaytctatacactcagtacatgttgcaagattgtgattgaaaactcttttgaattgaaaatgtatatattaattttaaaagaacaattaggatctatttttgtattcattgtaatttaccatgattattttttctctgatataagttatctatgtaaaatctagaatcccatatcatttaattaatttgataaatttttatatgctgaaatatttattaataactctgggaaatgactttgagacaaagtatattagtgagaacttgtgtttacaacccaaatatttttaatccttcaagtga

SEQ ID NO: 136898 - DNA, 601 bp, Human
tggacaataaggatgcatttccaaggcttactttatctgtgggttggttcaggtaacatttatttaaactttgagccagacaatctattacatataggttctctcattcatcttcacaacagccatgtgaagtgagtggtatgattaccttttgacagataaagaagtgaatcctcaggagaggttcagcttccgcaggtccacagagctcacagtgctgcatccagaatttatacccaggtctctctgactccaaacccatgttctttcatcattacactctccttaaggagcttgtgtrtaatggtggtaaggccactgaaatgaaaacattaagtaataacatggacagatataggcagcatgggctagaagtgctcaatgactggtcacctaactctgacaaggagatacaggggcagatgctgtaggagtcaggaaagggctcaatcctagtggagagcttggtttggacaggacaatgagttcatgaaatcttgcagcctatttcaaggaaggaacacagtgccaagtgactaaggaacacaaagtaaaataaataatccaaacatttaattttaaaagtttaatgaaaagcata

SEQ ID NO: 136899 - DNA, 601 bp, Human
cttaaggagcttgtgtataatggtggtaaggccactgaaatgaaaacattaagtaataacatggacagatataggcagcatgggctagaagtgctcaatgactggtcacctaactctgacaaggagatacaggggcagatgctgtaggagtcaggaaagggctcaatcctagtggagagcttggtttggacaggacaatgagttcatgaaatcttgcagcctatttcaaggaaggaacacagtgccaagtgactaaggaacacaaagtaaaataaataatccaaacatttaattttaaaartttaatgaaaagcataatcaagcccattgacatttgccaactgttaccaatgtgcatgcacacgaaatcctattaagttaaaagcgaggcttccttctgagcaatgcagcggttacaggggggttgattgtttttgaaatcttgcaggggaggagattagggactcaatgtgtgacgttgaatcctgtgtgagcagcttttgagaattctgattcactacagaaacggaaggattatcaagtcagtagtttgcttttttttttttttaaactctcactgcaaaccaaagtattatcaaaa

SEQ ID NO: 136900 - DNA, 601 bp, Human
agtaataacatggacagatataggcagcatgggctagaagtgctcaatgactggtcacctaactctgacaaggagatacaggggcagatgctgtaggagtcaggaaagggctcaatcctagtggagagcttggtttggacaggacaatgagttcatgaaatcttgcagcctatttcaaggaaggaacacagtgccaagtgactaaggaacacaaagtaaaataaataatccaaacatttaattttaaaagtttaatgaaaagcataatcaagcccattgacatttgccaactgttaccaaygtgcatgcacacgaaatcctattaagttaaaagcgaggcttccttctgagcaatgcagcggttacaggggggttgattgtttttgaaatcttgcaggggaggagattagggactcaatgtgtgacgttgaatcctgtgtgagcagcttttgagaattctgattcactacagaaacggaaggattatcaagtcagtagtttgcttttttttttttttaaactctcactgcaaaccaaagtattatcaaaatttctatagaaagaatgaaaatgggaaactgaaggtaatttcctcggctct

SEQ ID NO: 136901 - DNA, 601 bp, Human
gacagatataggcagcatgggctagaagtgctcaatgactggtcacctaactctgacaaggagatacaggggcagatgctgtaggagtcaggaaagggctcaatcctagtggagagcttggtttggacaggacaatgagttcatgaaatcttgcagcctatttcaaggaaggaacacagtgccaagtgactaaggaacacaaagtaaaataaataatccaaacatttaattttaaaagtttaatgaaaagcataatcaagcccattgacatttgccaactgttaccaatgtgcatgcacaygaaatcctattaagttaaaagcgaggcttccttctgagcaatgcagcggttacaggggggttgattgtttttgaaatcttgcaggggaggagattagggactcaatgtgtgacgttgaatcctgtgtgagcagcttttgagaattctgattcactacagaaacggaaggattatcaagtcagtagtttgcttttttttttttttaaactctcactgcaaaccaaagtattatcaaaatttctatagaaagaatgaaaatgggaaactgaaggtaatttcctcggctctaagaaataaact

SEQ ID NO: 136902 - DNA, 601 bp, Human
ctaagaaataaactccttttcctttcttcctaaaagagatattacctaaagattggagagttgaagcatttcctgagtttgttgttatgtgtctagcaagttttcattttaagtaacttgtcccacagaaatttatatatgcaataattcaagttaaggagagctaaaatctttgggcttatgaaatagaacaatgttatatctactacttagagtttctggcttttttgtaaaaagaacctactggtctctgattagatgaccctaagtgtaggagtaaggtcaatataggccccaagcrgaaagacccacaaagtatttgggggagggagcaaagggaaggaaatgcccccaaggacccctcttctcctccctgttgagaatcctgggagtgcagagaggaaagctatggcaggaaggggaagtggccacacggggcctgatggtagcaactctggctttgaagatgtatctggaaaggctttgaggttggctgctgtggatctggttgtggattctgacgtaagccagtcatacagatcatgatgcaaaacagggcagagttgccaacagccaatccaaaagagatgttaggggcagc

SEQ ID NO: 136903 - DNA, 601 bp, Human
gccccaagcagaaagacccacaaagtatttgggggagggagcaaagggaaggaaatgcccccaaggacccctcttctcctccctgttgagaatcctgggagtgcagagaggaaagctatggcaggaaggggaagtggccacacggggcctgatggtagcaactctggctttgaagatgtatctggaaaggctttgaggttggctgctgtggatctggttgtggattctgacgtaagccagtcatacagatcatgatgcaaaacagggcagagttgccaacagccaatccaaaagagatgttaggggcagcaaaccctggtgatttacaaaatggaattgaggctccataccttgggaggaacttctggaagctagtgagggactgagttacagagatttaaggcatatttgagagtttccaaggtctaggaaaatattacaaagtttaaaaaatggttcagaaatgtgccttgtgatacattacccagtgcattgtgtacctgtcagacatgaccttgtcttcctcccagaagctttcaacttaggcttaaagaataaagagtaaaatcagtttgattttatagggcttaattttattcat

SEQ ID NO: 136904 - DNA, 601 bp, Human
tacttcactggacagatcaattgtccatagctactcaggctacagagaagttaaaactgaacgtttatttaaaatatcttcatccagccttaatgcgagcctggctggaatgattctacatctcgttaacttcctctcttcatttctccacacaaagacctcatttgtaaactttgcccatattcagccagctccagatgttccaaggacaaaccattatcacgaccaactcagtgtttgctgcattttcataagcacttggtgatctctcttcaaatgatgacgggagttctttagacayagagattctccatcctctgatattcctcattctgaattggctatccaacttttttttctagtttgttagcaatttcagaaaaaggtctacaatcaaattttcaaagaccagaaaaagcagtgattccagattgcagatttactctctgtccactcagatgtgcggggaaaatgtagttacttaattatctatgaatccttttccctactagcatccacttcctcaaactgaaacttatcagttagtaatattgcagtctcttctggtttagacagtcacccctccagttaaatattctgt

SEQ ID NO: 136905 - DNA, 601 bp, Human
ttggtttgtttatcccagagcatctggattttgctgattacaccacattgtttcatttaacacactcctctcttgtgcgttttttctgtaaatggattgtaggatcctacaggttgagtcagtcagatttaggtctgacttcatatttgatgtctcccctcatcaggaggcacatcatgtcagaatgcctttctttctgcaatgttagtacctgttgatgaccactgattagactcattcattcatcaggagtggtaaaatggggatgttctaattttattatatgtctgctagactgcamaaaggaattttaaacaaaagagtacctgtcacatagtaggtgcgcaataaaatacgtattgaatgggttaatttccataagaacccctatgacaagggagcagaggacaggaaaactaagaaggccttgagatgtgttccatcttagggccagcaccaagcgttcttggatgattaaagagccttcacagttgaccaagcctgtgacatgctgttcttgcaaaggcttcctaaagaaaaatgtgatagtcttactagactcaaagctcagcctaatttatagcaaaacaactttgccttt

SEQ ID NO: 136906 - DNA, 601 bp, Human
atggtgtgggtaggtttgaaagcactgtaggcttttatctttatttttctgacaacacagagcacataatcacagtaaatgtttttagtgccaaaaatttgttcatgggcattgtaatcatgatgcacaggtatcaagttcttatatttaagatacagggtgtagtgttttacattctttattgctgaatattttggttttcacttacttatacatgtggaaagcagtataacaaatattcattcctactgtgttcagagcacacagcaaaatgcactaagtcaaaccagtctttgttgagaaatgaagtcttgtgtgtatgatacaaagaatataggtgtaacctgaggtagaattttatatgacagagggacactaataatgtgcttgggtcttcagaggggagacatatcccaatagtttgttgaaatcattagtaaatttgcatggagtggggacaggctttgaaaaaacagtaggatttgaaaagatggtaaggaccatctagaagaaacgacatgagcagaagcatcagagtttacatcttcagagcacattcaggggtaaagagctccagttagactagcctggcaaatgtctc

SEQ ID NO: 136907 - DNA, 601 bp, Human
ttctactctgagctcctgcctgactcccttctgaacttgactttttgaaagatgaagtgtgaaccctctggaataattgatacccatttgcagcccactctcagttctcattgatggcaaagatgcctgtaatacagaataacctatttcttgaaggccatatgccatacttcacaaagccttttctcaggtggcatccatgaagtggcagccacaggtaactgaatcttcaggcctgatcccctctttactatatcataaatatcaaaaggcagttgggctgaacaagaacaagaagcayaagaaattctggattattttatccctaaacaattatctataggctatgatccttcagggtgtttcctagctaaagtataggaacagcttctcatgttggttcagagacagccgttctgacaaccagggttgtcttgcttttctgagcagctttgtgtgagaaataccaggtattaagaagtctgttgtaggggagaatcatatacagactagtagaaaaagaactttatcatagaggaaaacacccagtttgcaggcattcttcctgaacactgctcttccgtctgaaaaggtcctgagt

SEQ ID NO: 136908 - DNA, 601 bp, Human
tgactgtggcagcccacgtcactgggtaattatagacagtcacattcaccttagggtgggactctaggaattaatttctacttggtgctaaaatgggttaaactggtctccatttctattcatctaaagataactagatgagtggcagtttctccagttattactccttcacccacttggtttctttttttaacaatggctgaaaatgtttttgtccccattaactacatattcaaaacattcaccacaagaggaaggaatagactttgaatttgaataaacatgttttattgtttatttwttttttttttttttttgagacagagtctcactctgtcacccaggctagagggcagtggtgccatctcagttcactgcaacctccacctcccaggttcaagcgattctcctgcctcagcctccaaagtagctggaattacaaacatgcaccactacacctggctaatttttgtatttttagtagagatggagtttcaccatgttgcccaggctggtctcaaactcctggcctcatgtgatccacctgccttggcttcccaaagtgctgggattataggtatgagccactgcacccagcctg

SEQ ID NO: 136909 - DNA, 601 bp, Human
ctgtggcagcccacgtcactgggtaattatagacagtcacattcaccttagggtgggactctaggaattaatttctacttggtgctaaaatgggttaaactggtctccatttctattcatctaaagataactagatgagtggcagtttctccagttattactccttcacccacttggtttctttttttaacaatggctgaaaatgtttttgtccccattaactacatattcaaaacattcaccacaagaggaaggaatagactttgaatttgaataaacatgttttattgtttatttattatttttttttttttgagacagagtctcactctgtcacccaggctagagggcagtggtgccatctcagttcactgcaacctccacctcccaggttcaagcgattctcctgcctcagcctccaaagtagctggaattacaaacatgcaccactacacctggctaatttttgtatttttagtagagatggagtttcaccatgttgcccaggctggtctcaaactcctggcctcatgtgatccacctgccttggcttcccaaagtgctgggattataggtatgagccactgcacccagcctgagt

SEQ ID NO: 136910 - DNA, 601 bp, Human
cgtcactgggtaattatagacagtcacattcaccttagggtgggactctaggaattaatttctacttggtgctaaaatgggttaaactggtctccatttctattcatctaaagataactagatgagtggcagtttctccagttattactccttcacccacttggtttctttttttaacaatggctgaaaatgtttttgtccccattaactacatattcaaaacattcaccacaagaggaaggaatagactttgaatttgaataaacatgttttattgtttatttattttttttttttttttgagacagagtctcactctgtcacccaggctagagggcagtggtgccatctcagttcactgcaacctccacctcccaggttcaagcgattctcctgcctcagcctccaaagtagctggaattacaaacatgcaccactacacctggctaatttttgtatttttagtagagatggagtttcaccatgttgcccaggctggtctcaaactcctggcctcatgtgatccacctgccttggcttcccaaagtgctgggattataggtatgagccactgcacccagcctgagtaaagatgttttaa

SEQ ID NO: 136911 - DNA, 601 bp, Human
gccatctcagttcactgcaacctccacctcccaggttcaagcgattctcctgcctcagcctccaaagtagctggaattacaaacatgcaccactacacctggctaatttttgtatttttagtagagatggagtttcaccatgttgcccaggctggtctcaaactcctggcctcatgtgatccacctgccttggcttcccaaagtgctgggattataggtatgagccactgcacccagcctgagtaaagatgttttaagcaaatacacaataagaatgatgttcgcaattcagagctttttrtctgcctaaggggattctgttgttctagtcctgcaccctgacagatgtggtctctcgtctcagccagatgtggtagtaactacaggattaatttgcatgtgtaaaatgcatattgactaacagaaacaactgcaaccaaagtaagttattgaaatggcagactgcatcagttatgtgtactagctgagcaaggagactgaaagaaagcaatcattttccaaggccataagtgcctgccttctagaattctccaacgatgactaaaccatgggcatatttcatttttgtaaaggaaattaa

SEQ ID NO: 136912 - DNA, 601 bp, Human
ctctaaaagaaaattttttaattaaaaaaaaaaagaattaacctcaatcttactgagatcaaaaattcctcctatgaaagaaggtcaatatggtaggttaatttaatgtttccttccagctgagaaaggaagggactgcatacatagtacctcgaacattgaaggggagagagtgaataccctcattccattcccctcctgttttctgagaccatttcaatttcctgttaccagatggatctgaatcgtctagtcttgtaccaaccaggtgcatctaagggccccccacctttctctattkaaaacccaacactttggggggagaccaaagcgggcggatcacttgaggtcaggagttcgagaccagcctggctaacatggtgaaaccctgtctctactaaaaatacaaaaattagccagacgtggtggcacatgcctgtaatcccagctattcgggaggctgaggcaggagaatcgcttgaacccaggaggcagacgttgcagtgagccaagatcgtgctactgcactccagcctgggcgacagagcgagactccatgtcataaataaataataaataaattaaaaaatatacctatcat

SEQ ID NO: 136913 - DNA, 601 bp, Human
aacaatgtttattcatgccaaagcgaacaacaatgtaacttctctttataggcaacggctgaactttaatcctctatggatacccctcaggctcttgccttctgctgatatttctaaattactgccttgttggaagaatgtgtccacttcaggcagatactgccaggataccagaaagagtacattttaaaagatgtagcagggccaggtgcagtggctcatgcctataatcccagcattttgggaggccgaggagggcagatcacttgaggtcaggagttcgagaccagcctggccaacrtggtcaaaacccctctactaaaaatacaaaaattagccaagtgtggtggtgggtgcctgtaatcgcagctactgatgatgctgatgcaggagaatcacttgaatccgggaggcggaggttgcagtgagccgagatccgccactgcactccagcctggcgacagagcaagactctgtctcaaaaaaaaagaaaaaaaaaaaaaaagaaatttctctattggaatccataagcctgaattcaaaatgaagcattatagaagcaaatttactatgtctacaagtgtacagcttggatacatga

SEQ ID NO: 136914 - DNA, 601 bp, Human
cccctcaggctcttgccttctgctgatatttctaaattactgccttgttggaagaatgtgtccacttcaggcagatactgccaggataccagaaagagtacattttaaaagatgtagcagggccaggtgcagtggctcatgcctataatcccagcattttgggaggccgaggagggcagatcacttgaggtcaggagttcgagaccagcctggccaacgtggtcaaaacccctctactaaaaatacaaaaattagccaagtgtggtggtgggtgcctgtaatcgcagctactgatgatgcygatgcaggagaatcacttgaatccgggaggcggaggttgcagtgagccgagatccgccactgcactccagcctggcgacagagcaagactctgtctcaaaaaaaaagaaaaaaaaaaaaaaagaaatttctctattggaatccataagcctgaattcaaaatgaagcattatagaagcaaatttactatgtctacaagtgtacagcttggatacatgatttggataaatgattactaaataaacatagaaaagtagctccttcatccacctcctttcccttcatctatcccctttcctgg

SEQ ID NO: 136915 - DNA, 601 bp, Human
tcaggtgatctacccgcctcagcctcccaaagtgctcagatacaggcatgagccaccatgcccagcgattttctaattttagaacattttcattaccccaaaaagaaaccccatacccattagcagtcactccccattccgtcctcttcccagcccctggcaactactgatttactttctgtctctatggttttgcctattctggcatttcatataaatcatataatgtgaacttttctgtttggctttttgcacttaacagaatatttttgaggtttatctgtagcctcgtagcatgtaycagtaatttattctttttattgcagaatattccattatattgatataccatagtttgtttattcatcagttgatggatatttgggatgtttccattttggccattatgaataatgctgttacgaacattcatggacaaggttttgtatgggcatgtattttcatttcttctgaatatgtacctagaagtggaattgctgggtcagatggtaactctctgataacattttgaggaactgtcaaactcctttccaaagcagctgtgtcattttacaatcccaccagcaacatatacgagttc

SEQ ID NO: 136916 - DNA, 601 bp, Human
tgaattttataatcagtttgttaatttctgggggaaaaagggtagctggtagtttgataaagatagtgttgaatttggggagtgttgccatcttatatcttacatcccataaatgtgggattctttttagttaagccttatgcttacaaaggacttcaccattgaataatcagataaatgttcacccatatttttcttttaccttttatagattgttgtttatgttttcttttctttaatctatgttgtattcattttggtgtatgaagtgagggagatctaaccttgttttttcacaggyagttaactattgtcctaataccacttattgaataagatatttcacttcaaagcacagtcaagtactttatcacttttgtttattgcgtaggtagtagtgataatgtttatagtgctgctacagtggaaaatagtcctgctacagtgggaaaggtgattcctatctacttttcttgctttatgttttctaacatttatcatgacctataatgacctatactttaggtcctatgctataggttttacttacttaatgcctgtcccctttatttaaatgtaagctagctgggcacggtggctc

SEQ ID NO: 136917 - DNA, 601 bp, Human
catccactagattccacaagctcagcatgcccaaaattgaatttagccacttaccaccccagagtctgcctctctacctgggtccacgtcttatggaagaccaccacaatccacccaattacccagccagaatgctgccatcatcccttgaccccttccttctgcttaccacccacgtgcagttactcagcaacacctatcagtcctcactctgcagtatcaggattgcagccccttctctcacagtacctctcctgattcagccactgtgttttttggtttgcaggttttattattattwttttttttgcataaagttgtggccccaaacaggtctctttgcctcccatcatgtacccattcaatccaatttccacacacacacactgcagctagaggaatcagtttaaaatataaatctgctcttgctgatttctgttaaaacccttccatgctaataataataataataataatgctaaaggaaataaacgtccatggattccctggtgcccaaagtccttaactttcacttaacacatttcctggcacacagtagacactcaatggttatttgatgaataatgcaatgaatgaatgg

SEQ ID NO: 136918 - DNA, 601 bp, Human
aatttgtctaaagtactaaagcttagtttcctgaatagaatataagagttaaattaatttgttagagaaaattaactgttctaaaacttcagaacaataatgcattcatgaacaaacactcgtgcacctattatgtatctagcactacactaagcactgatgatatagaaagctttttaaatattgattagttcctccctcaataatttaatagtctcttttgagccggagattgaaacatgtgacagatctgtaatgaaacaattgctaatatttctgcatatgctactatgggtacgcrgagagaaataagagaaaaaaagaccaattcttccaaaagagagctcacagagaaaaagatatttcaactaaatcctgaaaatgtaacccagagttcattaagaagagagacaggaagggcatctcaaggagaaagaacagcatgtgcaaaggcctaagggcagaatgaacatggtaggttccaatatggcagaagggtgagctgaaaagtgaacatggaggcagtcgagtggcagaatgcaaggctagaaatggacacaggatacctactgccagccatggttgagccaaagacaaatct

SEQ ID NO: 136919 - DNA, 601 bp, Human
agccctccacaaatgttatttattaggatgatgatattattatgattctaagactgctcgagggacaaataaaccttcccttctctttaagtggagagattgtcctccattcttctctcatttgtgtgtcccaaagtccttctccaattaagttcttgcaagcagcctctgggaaggccccagatgagctgtgtaatctaagctctgagattcccaaggctaaacacaattactctaatacacttactatcaggctacccctttatgcaaacttctaaaggaagagagacactgccaaaarcatattcaggggaaaacataaagaggcctcaacttccctctccccctccctccaaggaaattctctagcaatattaagccaagaagaattattgcagcaaatagtgaatgtaaataaggatggccttgctgccgcttaagcagcttccatggacgtgtcctccatgaagtcccaggcttcagcaagcatgattgatggtgaagtacattttcattagttcaggttcccaacacacttctgaagttgtagactgctgtttagacaaagattggaagtgaattatacgtctgacataaaacc

SEQ ID NO: 136920 - DNA, 601 bp, Human
ggtgaggctcccctgaataatcttccctttgactaactcagtgttagccaactcagggcaacctgagttacatctgcaaaatcccttttgctaggtcacatcacatagccacaggaataacagctcatcatgtctgcaggccccacaacaaagggagaatttacaagagtgtgggtcattacgggtcatcttagagttctacctaccacactggctttagaaaaaagcatatgggagcatgaggaaacacttctctccctcaaagaactgctcctcatgggttgaggggtcaccttcccartgatgtgtgacctgagactgagtcactggacagatgtgttttgctctgtcactcaggccatgtctactttgtgaagtaaagctggtatgcccaaaacctaggtcgaagaccagctccacctaccttataaggagtggcaattcattggaatctgatatcaggttatttttgacacccagttttcaatgttatggagagttttcatgtttttctttccatttaatgagaagttgggatcaagaatattgaagattgcaagccaggtgtcacattaaagttgaagcctttctaatttttgaa

SEQ ID NO: 136921 - DNA, 601 bp, Human
tttacacactaaaaatctctaattttgaatttgttgtgcctataaaggaataccaggaataccttaaagttataattgtatttattagcatctattttaggtcagtcttgggggagtgatggaaagaatccacatagactccagagagatgggcaggggttactgcccagccttgaacattcctctttcctcacaaggatgggctctcgcataagtaatttcatgggcccctaagttttaaagaaaaaataagtgttttctcatttttaaaaaaggcagctttgctgttaaaatatgtcartaagagtcctggataatgtttaaaagtatttatgggctcagatggggttaaggtagagctgactgttagtctgttgaagtatttgtttcccagctcttgaaaagcctgggttcttagatccaacctgagaatcatagatatgtgcatatcacagggagggcaaaaaggttcactgtctgtttatacacttgccagtcatccttttaatctctgccaaattgtctgctttaactcctatgagtttttttatgccatctttttgaaatagtaaatcactttattaggtttttaaaagaacat

SEQ ID NO: 136922 - DNA, 601 bp, Human
tttcatcatttttattttagtaaattttttaggaatgggtttcttcagagtgagcactcttagttaatattacacaggtagctgcaaagatattgtaatattctcttttggtatgtgtgatcttagtgactatggtaaacagaataattgctcccccaaagctatccacatcctaattcctgtaacctgtgaatatgttaccttatatggcaaaagggactttacaaatgggattaaattaaagatcctgaaatgggatgattatcctgaattatccagataggcccaatataatcacagrgttcttgtaaggggaagacagaagaaaggtgagaatcagagaaggagacacaacatcagaagcagaaggcaggatactccatttgccctgatatgattattattcattgcatgcctgtaatcaaaatatctcatgtaacctataagatttttggaaattgtatgctctctagcaactttgtgtgaatttttatataagcactgttttataagttctatgaagtgttataaaaatagaaacaaattttaaaaaataagtaaaataacaattatctgttaaatgttagactagttcttgttg

SEQ ID NO: 136923 - DNA, 601 bp, Human
tgaattttgtttcttctccctttttagtctcggttttcatccaggctgcctttttctctttgtagtctacatgttctatactggaggttttcctcagatttttggaaatcttcatttgtctgctcaactaaggcttgagtgggagactagaaaactgattagaggccaggtgtggtggttcacacctataatcccagcatatttggaggccgaggtaggaggactgttggagcccaggagttcgagaccagcctgggcaatactagtgagaccccatccctacaaaaaaaattaaaattarccaagtgcagtgacacacctgtagtcccagctactcagaggctcagatggcttgagcctgggtggttgaggctgcagtgagctgttattgcaccattgtactccagcctgggcaacagagcaagactctgtcttaaaaaaaaaaaaaaaaaaaaaaaatccctgactggaaacttaagcacttgagcagagcttgttgaccagcaagctattgagctggtcagactccctataggagatgcttccagtttcttgcttggaggagaaaggcctggctgtcagccttctgggacatctggca

SEQ ID NO: 136924 - DNA, 601 bp, Human
tgcaagaccaagcctttctgcctgaactctagtacctcaatcacaggctgggaatgacttaaggaaacgaagccagttccaaacgctaacacacagctgtcatacagattttgtcccacaaatgaacaatgatataaatgtagtcaatcttaaacttctgaattaactgtaaagtgatacaagagctttgtgtttaaggatgagaaggttcagcctagttcttcagtggttccatacttaaaccatccaaaaatacaggtatgtatccttatctattgaaaagaagaaaaggcagcggggygcagcggttcacacctgcaatcccagcgctttgggaggccaaggcaggtggatcacctgaggtcaggggttcgagaccagcctggccaacatgatgaaactccgtgtctactaaaaatacaaaaattcgccaggcatgatgcatacctggcacatacctgtaataccagctattcaggaggctgaagcaggagaatcgcttgaacccaggaggcggaagttgtagtgagctgagattgtgccactgcactccaacctgggtgacagagtgagactccatctcaaaaaaaaaaaaaaaaaa

SEQ ID NO: 136925 - DNA, 601 bp, Human
tttagaattgaagaaaatgggctgttgctttcaaaaatcatgttcatttaaattgtgtttttactctctgttaagaaatcacatataaacatatggatttgagcaccccctgcgatttttctggggtcccaccaggatctgtggctgcctaactgatatccacctctccagcatgttgccagcagccacagtgactccaatggaagcagcaacttcaaaatattatgctaaaattggctcctaatgttttcctcttgccttcatgcagtagcatgccagagcccacatcttcttgcttgcyagagtcaaattttgcaagccagttgttaagaacagcgatttttattatttatgtatttatttattgatttatttattttattatactttaagttctgggatacgtatgcagaacgtgcaggtttgttacataggtatacatgtgccatggtggtttgctgcacccctcaacccgtcatctccattaggtaattctcctaatgatagagtgccccccactccccgacaggccccagtgtatgatgttcccttccctgtgcccatatgttctcattattcaattcccacttacgagtgagaa

SEQ ID NO: 136926 - DNA, 601 bp, Human
ttgtgtttttactctctgttaagaaatcacatataaacatatggatttgagcaccccctgcgatttttctggggtcccaccaggatctgtggctgcctaactgatatccacctctccagcatgttgccagcagccacagtgactccaatggaagcagcaacttcaaaatattatgctaaaattggctcctaatgttttcctcttgccttcatgcagtagcatgccagagcccacatcttcttgcttgctagagtcaaattttgcaagccagttgttaagaacagcgatttttattatttaygtatttatttattgatttatttattttattatactttaagttctgggatacgtatgcagaacgtgcaggtttgttacataggtatacatgtgccatggtggtttgctgcacccctcaacccgtcatctccattaggtaattctcctaatgatagagtgccccccactccccgacaggccccagtgtatgatgttcccttccctgtgcccatatgttctcattattcaattcccacttacgagtgagaacatgcagtgtttggttttctgttcttgtgttagtttgctgagaatgatggct

SEQ ID NO: 136927 - DNA, 601 bp, Human
agaaataatagtgcttaggccaggaattgtttcctgttcactgtgtcttaaacctttattggttccattagcttacacagcaaaaggcatttccaattcagcatattttatttccagtatgccactctgatctcaaactttagttagagaagaccaactaaggctaagaatcaaaacttttggaagctagcaagacctgatcaaatccaaactcctgatttttacagagaagggaactgtggagtacaggaaaattcaatgtcttacccaaatacagtactcacagctacttagtgccacrttgctaccacaaccccactaccctgcctcttgctgtagctccttctttcacatattgtactgctcctctgagccacaggggccatcggtgccctatgacagtggtccccaacccttttggcaccagggaccagttttgtggaagacaatttttccatggattggacggcagagtagggatggtttcagaatgaaactgttctgcctcagatcatcaggcattagattctcatgagaaacacaaaacctagatccctctcatgagcagttcacaatggagttcatgctcctttgagaatct

SEQ ID NO: 136928 - DNA, 601 bp, Human
actaccatgagaacagcacgggggaaaccacctccatgatttaattatctcccaccaggtccttctcccaacacatgggaattatgagattacaattcaagatgagatttggatggggggacacagacccaaaccatatcaactatagattagatcatggtattatatcattttacatttcctgatttcgataattgtactgtattatataaaaggatgtccttgtttttaggaaattcacactgatgggcttatgggtaaaggaatgacttgtatgcaatttagtcttcccaaacagttyagggaaaaaatgcttatgggtatttataaataaataattacaaagcaaatatggtcaaatgataggaagggtatcctggacttttcagcattccttccctttttctgtgagtttaaagttatttcaaaattaaagtttaaaaaaaaatttaaaagaaagacacttccggaatattcttttatatataagagcttccagaatattcttttatatatttgatatatattaatatatttgatacacttaatattaggaaagaaataaaaatcataaataaaaactcaagaatggaaaaactta

SEQ ID NO: 136929 - DNA, 357 bp, Human
tgtatgcaatttagtcttcccaaacagttcagggaaaaaatgcttatgggtatttataaataaataattacaaagcaaatatggtcaaatgataggaagggtatcctggacttttcagcattccttccctttttctgtgagtttaaagttatttcaaaattaaagtttaaaaaaaaatttaaaagaaagacacttccggaatattcttttatatataagagcttccagaatattcttttatatatttgatatatattaatatatttgatacacttaatattaggaaagaaataaaaatcayaaataaaaactcaagaatggaaaaacttagttgtttttttggggtttttttttttt

SEQ ID NO: 136930 - DNA, 601 bp, Human
caacatggtgaaaccccacctctactaaaaatacaaaaattagcgggacgtggtggcgggcgcctgtaatcccagctgctcgagaggctgaggcaggagaatcgcttgagcccaggaggcagagattgcagtgagcgaagaccgtgccattgcactccagcctggctgacagagcaagactccgtctcaaaaaaaaaaaaaaaaaaaaaaaaaatccacacaattcttttaacaagttttttttttaatattaaaaaggtcagggcttttaatatttcacatatcttcaattaataggtamatatgtacaaagacaggattatgtgcagttcccaggttcccagacgcgggaaagacagagattataatgtcctcagtggcctcctgttcagcttggaggcttagacaggaacctcagaggatgcctttagatggggagttttcagaagaggtgagctctgatttaaacctggaaggggtcgcagaggaagaggagagatgaagcccaccttccccagccctgccctcagctctaccacccagggaagaccataggctgctgttggttccctccacatggccaatggccagccttctgcca

SEQ ID NO: 136931 - DNA, 601 bp, Human
caataaaaccaggcatgcttgggttttaaaagaaatgatggcgccctttcacttctgcaaatagtgcttcttttcacaagcaatgttttcctacaatttattacacaaaagaacatctaggtcaatacgaaatcaccacgtataacaagagaacgaatcctctaatgttgaggcaaagtagggctccttagtgttattcccagcgaggaaatgtttccctttgactcagccgtgctccctgatgtttgaatcttctgtgtgttggcgttgctcccttggtaagttagtaggccgagaggckcagaactgggtcatgggaagaacccaaattcagtgctggagaatcttggctgattctctcctcagttgtcaccaaccagctgtgtgatttgggaaggaacctttctgactgcctaaggagggaaataatgcccaccctgcctaccttacaaggctgctttgaggatcatgagtgaccctttagtgcctgtcaaattacctgtatcagcttaatcgaactgttagataatgcctagaaagataccctgatgggctacactgtaaaagagtattttctgtgccaagtgcatcttgcatgtat

SEQ ID NO: 136932 - DNA, 601 bp, Human
aataaaaccaggcatgcttgggttttaaaagaaatgatggcgccctttcacttctgcaaatagtgcttcttttcacaagcaatgttttcctacaatttattacacaaaagaacatctaggtcaatacgaaatcaccacgtataacaagagaacgaatcctctaatgttgaggcaaagtagggctccttagtgttattcccagcgaggaaatgtttccctttgactcagccgtgctccctgatgtttgaatcttctgtgtgttggcgttgctcccttggtaagttagtaggccgagaggctyagaactgggtcatgggaagaacccaaattcagtgctggagaatcttggctgattctctcctcagttgtcaccaaccagctgtgtgatttgggaaggaacctttctgactgcctaaggagggaaataatgcccaccctgcctaccttacaaggctgctttgaggatcatgagtgaccctttagtgcctgtcaaattacctgtatcagcttaatcgaactgttagataatgcctagaaagataccctgatgggctacactgtaaaagagtattttctgtgccaagtgcatcttgcatgtatg

SEQ ID NO: 136933 - DNA, 601 bp, Human
ggaaggaacctttctgactgcctaaggagggaaataatgcccaccctgcctaccttacaaggctgctttgaggatcatgagtgaccctttagtgcctgtcaaattacctgtatcagcttaatcgaactgttagataatgcctagaaagataccctgatgggctacactgtaaaagagtattttctgtgccaagtgcatcttgcatgtatgctacgtctttgtatgcctgcacaaaaaaaaattttttttgggggggggcagagttttgctcttgttgcccaggctggagtgcaatggtgcratctcggctcaccgcaacctccgcctcccaggttcaagcaattctcctgcctcagcctccctagtagctgggattacaggcatgtgccaccacgcctggctaattttgtatttttagtagagacggggtttccatgttggtcaggctggtctcaaactcccgacctcaggtgatctgcccacctcggcctcccaaagtgctgggattacaggcatgagccactgcacccggcctacctgcacaaaattacataaaacaggggaagtgttcttttggaattttctgggtttttttaagttt

SEQ ID NO: 136934 - DNA, 601 bp, Human
tcctggctgggcgcagtggctcacgcctgtaatcccagcactttgggatgccgaggcaggagcatcaggaggtcaggagttcgagaccatcctggctaacacggtgaaaccccatctgtactaaaaatacagaggaaaaattagccgggcgtggtggcaggcgcctgtagtcccagctactcggaaggctggggcaggagaatggcgtgaacccgggaggcggagcttgcggtgagccgagatcacgccactgcactccagcctgggcgacagagccagactccgtctccaaaaaaaaaaaagtcctccaggccctgcatggtctggtctcccctgcatctccgacctgccccctccctgggtctccctcttccttgctgatgctattctagccacactggcctccttggtgttcctctcacagaccaagcacatctctgccttgggacttttgtgtttgccattcctgtctgtgtattcttttccacctatcccatgctccctcacttccttcaggtctcagcccaagtacctctttttcagataggcttttcttgaccgccccctacgtaaaacagcaggtcccccaccaaccgttgta

SEQ ID NO: 136935 - DNA, 601 bp, Human
cttcatgagctaaggattcatgccactttcatgtgtctttacaaaaactagattttcaccagtcacggaggtgcaatattcctaagtgagccaaaactcaaattcagctccatgtgtggtcctgcctaaacttgaacccaggagcaccctgttgttgttattgaccataaatataagtctcacgtccatctcattggaatcatgtgtcttacaagagtgagggaaggatacagaaaggaaggaatgagggggttttattgagaatattttttgtaaaattctttcactgttttttcctgatttttttttttttttttttttgagatggaatttcactcttgtcgcccaggctggagtgcagtggcgcgatctcgactcactgcaacctccacctcccaggttcaagcgattctcctgcctcagcctcctaagtagctgggattacagggacctgccaccacgcccagctaatttttcgtgttttcactagagacggggtttcgccatgttggtcaggctgattttgaactcctgacctcaggtgatccgcccgcctcggcctcccaaagtgctgggattataggagtgagccactgcacct

SEQ ID NO: 136936 - DNA, 601 bp, Human
tgcctaaacttgaacccaggagcaccctgttgttgttattgaccataaatataagtctcacgtccatctcattggaatcatgtgtcttacaagagtgagggaaggatacagaaaggaaggaatgagggggttttattgagaatattttttgtaaaattctttcactgttttttcctgaattttttttttttttttttttgagatggaatttcactcttgtcgcccaggctggagtgcagtggcgcgatctcgactcactgcaacctccacctcccaggttcaagcgattctcctgcctcarcctcctaagtagctgggattacagggacctgccaccacgcccagctaatttttcgtgttttcactagagacggggtttcgccatgttggtcaggctgattttgaactcctgacctcaggtgatccgcccgcctcggcctcccaaagtgctgggattataggagtgagccactgcacctagccaaaattgtttaagtattcattaatttaaaacagtaatctattatatgttaaataatgtttttatgaatattattatattttccaaaacaaaaataaattttgtgagaaaggtggcatt

SEQ ID NO: 136937 - DNA, 601 bp, Human
ttcatctccctatgtcttcacatcacatcttccccctgtacgtgtctgtatccaaaattcccctttgcataaggacatcagccatattgaattagggcccaacctgtggcctcgttttaatctgattacctctataaagaccctgcctccaaataaggtcacattctgtggtgacaacagttaggacttttaacatagaaattttaggggaacacagtttagcccgtaacagctacttgggtgtttttgtaaaggaaaatgccgccgaggaaagtgctgagatggaaaaggcttgatgggrgcacaacttttttttttttttttctttttttgatggaatcttcctctgtcacccaggctggagtgcagtggcgcaatcctggctcactgcaacctccacctcccaggttaaagtgattctcgtgcctcagtctgctgagtagctgggaattataggcgcacgccaccacacccggctaatttttatttttattttttttttgtaatgacagggtttcagcatgtgggccaggctggtctcgaactcctgacctcaggtgatccacctgcctcggcctccccaagtgccaggattacaggt

SEQ ID NO: 136938 - DNA, 601 bp, Human
aagctttgtaatctctgaccccttgtgtacatactattgtgtagtttcaatcatagaatcaagcattttattttaggtagaaataaaaatacacctttctctttcttataccccaacatatgtgtgggatgaataacactgggatttaggctgaaatactctacttttactttttatggcaactattaacgacactttttactgtcaggtatcagaattttaaatagttcatgaattctcagagtatctcagtgcataggcaaaaatgctgcacctttgtgggcgtgtgtgtgtgtgtttgttgtgtgtgtgtgtgtgtgtgtgtgtgtgtgtgtgtacagaggttcacctggggacagagctgaaatgtcactccagggtctgtagtctctgagctcctctgccaaagcaccagcgctgagagggaggaacttcaccacagttaggttggccaagatgaacaacactgacaagtcccgtgaggtctctgatccctgagcggtcaaaccttatttcagtctctacacccattcggtcaggatgggtctgaatcttggttgaccttgaggagaagctgctaatcttttgggcaataatgccc

SEQ ID NO: 136939 - DNA, 601 bp, Human
gtgtgtgtgtgtgtgtgtgtacagaggttcacctggggacagagctgaaatgtcactccagggtctgtagtctctgagctcctctgccaaagcaccagcgctgagagggaggaacttcaccacagttaggttggccaagatgaacaacactgacaagtcccgtgaggtctctgatccctgagcggtcaaaccttatttcagtctctacacccattcggtcaggatgggtctgaatcttggttgaccttgaggagaagctgctaatcttttgggcaataatgccctgaagagtccatctgcktgctggggagcagaagggacttctgcgtgtaccacactttgaagaatgagctcaagctatgagttagtttccttccagggtagagaactgatgtttgtgtctctgcagtgatggctaatataggactcctgagttatgaatttgaaggaaggaaaattatggcaccttttatgctaaggaaggaataataaaatggtttctgcatacttctcactgtggccatgtttacaagcaagaagacgctgtgctttcagatcccacagatacctctccatctcattttaacagggttataaatta

SEQ ID NO: 136940 - DNA, 601 bp, Human
ctgtgccactattgctggtgacagtgtcacatctttcagcaataccgggactaaactaatacctaagcctttcttccctgaggctagtcttcagagactcaaagacaactattatgccctgtctctacctctcctattttctagaccaaaaagcccaggcctttagccattcccctggggtcctggctccagggcccttcactggtggatctcctcaggcatcactcaggtgatgtacactgtccctctcagagtctggcactggaagtgagacacagaactccagtgtgatctatagaaygaggaaagcaaaactatcacctctttttgtttttattctgctttgttttttaagaacgcaggacttctaaatctaatcagtaggacctcatcattttatgtgggttgttttgtatgtcactggttttgtgagagacctgcaccatacatcaaagttatcagactgaggctgaatgaaatccaccagtccaccttaaagacagctatcctgggaatgtgggcaacgtcccacttgcccactgctatagcttatagcaccttacactcacctcttcctacagattatttttgagtaacagcg

SEQ ID NO: 136941 - DNA, 601 bp, Human
tatgtcactggttttgtgagagacctgcaccatacatcaaagttatcagactgaggctgaatgaaatccaccagtccaccttaaagacagctatcctgggaatgtgggcaacgtcccacttgcccactgctatagcttatagcaccttacactcacctcttcctacagattatttttgagtaacagcgtgaccatgttgtgcatttagccaagcaaacctttctagcttaggtgaatgagagggagcggccaacgtataaaacaaaatagtaagttcataaaaattacagtgcacaatagkctcagataaaatattaattgttaaacagaattccctgtatgtgacatgttctctttcctaataattttcagttatttcaaactttttactcaagttttttcaagcctccaattaaaggtgctgagctgcaccagtctctgtgacccccagctccaaccttcttcactacaattttgggggtactagcacatgccaggtacagtactcaattataaatatatgatttgtgtatatcgtgtgtgtgtaaaacacttcattttccccatggaaaaatttatccctcaccaccaccctataaag

SEQ ID NO: 136942 - DNA, 601 bp, Human
atgccaggtacagtactcaattataaatatatgatttgtgtatatcgtgtgtgtgtaaaacacttcattttccccatggaaaaatttatccctcaccaccaccctataaagtagagtttgttacctccactttatagatgaaacaacaaggttccaagaagatgttgcataatattctacagatgaaataattaggaaatcaggccgggtgaggtggctcacgcctgtaatcccagcactttgggaggccaaggtgggcggatcactaggtcaggagttcaagaccatcctggctaacacwgtgaaaccccatctctactaaaaatacaaaaaattagccaggcgtgatggcaggcagctgtagtcccagctactcgggaggctgaggcaggagaatctcatgtacgtgggaggcagaggttgcggtgagctgagatcttgccactgcactccagcctgggcaacagagtgagactccatctaaaaaaaaaaaaaataggaaatcagatgatttgacccaatgtgtctgtctctaaaggctgaatataatattgctttccccacatatatcatagtgctgctgtcacaggttgagttagct

SEQ ID NO: 136943 - DNA, 601 bp, Human
agtactcaattataaatatatgatttgtgtatatcgtgtgtgtgtaaaacacttcattttccccatggaaaaatttatccctcaccaccaccctataaagtagagtttgttacctccactttatagatgaaacaacaaggttccaagaagatgttgcataatattctacagatgaaataattaggaaatcaggccgggtgaggtggctcacgcctgtaatcccagcactttgggaggccaaggtgggcggatcactaggtcaggagttcaagaccatcctggctaacacagtgaaaccccrtctctactaaaaatacaaaaaattagccaggcgtgatggcaggcagctgtagtcccagctactcgggaggctgaggcaggagaatctcatgtacgtgggaggcagaggttgcggtgagctgagatcttgccactgcactccagcctgggcaacagagtgagactccatctaaaaaaaaaaaaaataggaaatcagatgatttgacccaatgtgtctgtctctaaaggctgaatataatattgctttccccacatatatcatagtgctgctgtcacaggttgagttagctggctctgattt

SEQ ID NO: 136944 - DNA, 601 bp, Human
taacttacttaccactaggcttctatttacattcaaaactatttatttcacacaccatctatctacctatcatctatcttttcttttttttgagacagagtctcgctctgttgcccgggctggagtgcagtggtgcagatctcggctcactgcaacctctgcctcccgggttcaagcgattctcctgcctcagcctcccgagtagctgggactacaggcatgcgccactaggcccagctaattttgtatttttagtagagacagggtttcaccatgttggttggccaggatggtctcgatmtcttgacctcatgatccgcccacctcagactcccaaagtgctgggatgacaggcttgagccactgcgcccgaccctactatttatttttttaatgagaaacaatttaggatacagcagccattgaagaaaaatatcaccacagggaaaaccgtaaacgacttcaggtcctccactcccgtgaagcttcattaaggtgccaccggtttcaatacaagtgcttttcaatcacaccactttcatataaaagtctataaggcacctagggaggaacaccggcattaatttccccattgtattcc

SEQ ID NO: 136945 - DNA, 601 bp, Human
atgcaaaatctcttacaccactgcagataggatttttttttaaaaaagggaggttttgctagataaaccactagaggatgccaaaatttaatgaattattttcaaatggtgtgaacaacaaagagaaacattttcctagtccttaaaatgggcacaagaatgagtgctatctttctttagaggtatagtttgtaagttataggtatcctgtattcagaaatgcagaagaccagggtaacttacttaccactaggcttctatttacattcaaaactatttatttcacacaccatctatctayctatcatctatcttttcttttttttgagacagagtctcgctctgttgcccgggctggagtgcagtggtgcagatctcggctcactgcaacctctgcctcccgggttcaagcgattctcctgcctcagcctcccgagtagctgggactacaggcatgcgccactaggcccagctaattttgtatttttagtagagacagggtttcaccatgttggttggccaggatggtctcgatctcttgacctcatgatccgcccacctcagactcccaaagtgctgggatgacaggcttgagccactg

SEQ ID NO: 136946 - DNA, 601 bp, Human
tggatctcaaagctcccctattcatcattcattcatcaacaatctgaacggcctactatgtgccaggcactaatgaacaagaggtgcgtccccattttttcatttttctttttttgagacagagtttcgctcttgttgcccaggctggagtgcaatagcgcgatctcggctcatggcaacctctgcctcccgggttcaaacgattctcctgcctcagcctcccaagtagctgggattacaggtgtgcaccaccacgcccagctaattttgtatttttagtagagacggggccagtatggcyccattttatgggagcccataaactagcaattagccttctacaccagaaactcttcgtggaaagaacctatgaagtgaaaatctaccaaatctaatgcaaaatctcttacaccactgcagataggatttttttttaaaaaagggaggttttgctagataaaccactagaggatgccaaaatttaatgaattattttcaaatggtgtgaacaacaaagagaaacattttcctagtccttaaaatgggcacaagaatgagtgctatctttctttagaggtatagtttgtaagttataggtatc

SEQ ID NO: 136947 - DNA, 601 bp, Human
gctgagttctcagaatggatctcaaagctcccctattcatcattcattcatcaacaatctgaacggcctactatgtgccaggcactaatgaacaagaggtgcgtccccattttttcatttttctttttttgagacagagtttcgctcttgttgcccaggctggagtgcaatagcgcgatctcggctcatggcaacctctgcctcccgggttcaaacgattctcctgcctcagcctcccaagtagctgggattacaggtgtgcaccaccacgcccagctaattttgtatttttagtagagayggggccagtatggccccattttatgggagcccataaactagcaattagccttctacaccagaaactcttcgtggaaagaacctatgaagtgaaaatctaccaaatctaatgcaaaatctcttacaccactgcagataggatttttttttaaaaaagggaggttttgctagataaaccactagaggatgccaaaatttaatgaattattttcaaatggtgtgaacaacaaagagaaacattttcctagtccttaaaatgggcacaagaatgagtgctatctttctttagaggtatagtttg

SEQ ID NO: 136948 - DNA, 601 bp, Human
tggtggcaggcgcctgtaattccagctacttaggaggcctgaggcaggagaatcacttgaaccgaggaggcggaggttgcagtaagctgagattgcgccactgcactccagcctgggcaacaagagcgaaactccgtctcaaaaaaagaaaaaaaaacgccaccacattgtaccccataaggatacaccattcttgtcagttaaaaattaatactataggctgggcgcagtggctcacacctgtaatcccaacactttgggtggccgaggagggtagatcacccgaggtcaggagttcaasaccagcctggccaacatggcaagacccccatctctactaaaaatacaaaaattagccgggcgttgtcggggccccctggtagtcccagctactccggaggctgaagcaggaggatcgcttgaacctgggaggcggaggttgcagtgagctgagatcgcgccactgcactccagctttggcgacagagcgagactctgtctcaaaaaaaaaaaaaaaaaattaataccatagttctgttacgcactcaaagtgtcaactattattttaaaaggcacaatttcacagacaaattaggttgcc

SEQ ID NO: 136949 - DNA, 601 bp, Human
caacctggccaacatgatgaaaccccatctctactaaaaaaatacaaaaaattagccaggcgtggtggcaggcgcctgtaattccagctacttaggaggcctgaggcaggagaatcacttgaaccgaggaggcggaggttgcagtaagctgagattgcgccactgcactccagcctgggcaacaagagcgaaactccgtctcaaaaaaagaaaaaaaaacgccaccacattgtaccccataaggatacaccattcttgtcagttaaaaattaatactataggctgggcgcagtggctcacrcctgtaatcccaacactttgggtggccgaggagggtagatcacccgaggtcaggagttcaacaccagcctggccaacatggcaagacccccatctctactaaaaatacaaaaattagccgggcgttgtcggggccccctggtagtcccagctactccggaggctgaagcaggaggatcgcttgaacctgggaggcggaggttgcagtgagctgagatcgcgccactgcactccagctttggcgacagagcgagactctgtctcaaaaaaaaaaaaaaaaaattaataccatagttctgtt

SEQ ID NO: 136950 - DNA, 601 bp, Human
ctcatgtctgtaatcccagtactttgggagggtgaggtgggaagattacttgaggccaggagttcgaaactagcctgggcaacatagtgagtccctgcctctatttatgtgagaaaaataaaagttcaaaaacccccaccacaagttgggcgtggtggctcacgcctgtaatctctgcactttggaggccaaggagggtggatcacctgaggtcaggagttgaagaccaacctggccaacatgatgaaaccccatctctactaaaaaaatacaaaaaattagccaggcgtggtggcaggcrcctgtaattccagctacttaggaggcctgaggcaggagaatcacttgaaccgaggaggcggaggttgcagtaagctgagattgcgccactgcactccagcctgggcaacaagagcgaaactccgtctcaaaaaaagaaaaaaaaacgccaccacattgtaccccataaggatacaccattcttgtcagttaaaaattaatactataggctgggcgcagtggctcacacctgtaatcccaacactttgggtggccgaggagggtagatcacccgaggtcaggagttcaacaccagcctggc

SEQ ID NO: 136951 - DNA, 601 bp, Human
tgggctctgtggcccacacctgtaatctcagcactttgggaggccgaggtgggtggatccttcaggctaggagtttgagaccagcccagcaacatggtgaaaccccgtgtctactaaaaatacaaaaaaaaaattagccagcatggcgcacctgtagtcccagctactcaagaagctgaggcacgataattgcttgaatccggaaaacggggttaggatgcagtgagctgagatcgcgccactgcactccagcctgggtgacggaccaagactctgtctcaaaggaaaaaaaaaaaaaaaagtgtgctcctgactgggcttggtggctcacacctataaatcagtactttgggaagtcgaggcgggtggatcacttgacgcctggagttcaagaccagcctggccaacatggtgacaccccatatctactaagaatacaaaaattagccaggtgtggtggtgcatgcctgtaatcccagccacttgggagggtggggcacaagaattacttgaaccaggcaggcagaggttgcagtgagccaagatcttgacactgcactccagcctcagtgacagagcaagactctgcctcaaaaaaaaa

SEQ ID NO: 136952 - DNA, 601 bp, Human
cctgtaatcccagctactccagaggctcaggaaggagaatcgcttcaacctgggaggcggaagttgcgatgcgccaagatcgtgccactgcactccagcctgggcatcaagagtgaaactctgtctcaaaaaaaaaaaaaaaaaaaaaaaagaagtgtgggcttggtagggcgcagtggctcatgcttgtaatcccagcacattgggaggccaaggcaggtggatcacttgaggtcaggagttcaagatcagcctggctaagatggtgaaaccccaactctagtaaaaatacaaaaatcakccaggtgtggtggcacatacctgtaatcccagatagtcaggaggctaaagcaggagaattccttgaacttgggaggtgaaggctgcagtgaaccaagattgtgccactgcactccagcctgggatacaggacaagactctgtctccaaaaaaaaaaagtgtgggctgggctctgtggcccacacctgtaatctcagcactttgggaggccgaggtgggtggatccttcaggctaggagtttgagaccagcccagcaacatggtgaaaccccgtgtctactaaaaatacaaaaaaaaaatt

SEQ ID NO: 136953 - DNA, 601 bp, Human
aggaggttggaggaagaactggcgagggcatcagtaaacattttgaaaagctgagtttgaaaccaggctttactagcatttgaaaaggtgtactggtagggcaatttggcttcaggaactgttgtaaacaaaggcaatgtgacacatataaaccagtttgggctggagctgactgaataggaaatattttctacaaggtttcctcccatttaaaacaaaaggccaaagtcgtcagtgtaacacttatattcttcggttcttattccagactaattatgtcccttcttccctcacaaaatckacattcctgtcaaagactataacctggccacaacctgaacatatcctatgtttcctccatagctttgctcatctattaagtattaagaagtgtgggcttaggcccggcatggtgactcacgcctgtaatcccagcactatgggaggctgaggcaggcgaattacctgaggtcaggagttcgagaccagcctgaccaacatgaccccatctctactaaaaatacaaaatgagctgggtgtggtggcgcatgcctgtaatcccagctactccagaggctcaggaaggagaatcgcttcaacc

SEQ ID NO: 136954 - DNA, 601 bp, Human
tagacaagacagacaaaatccttgatctcttagaccttattattctagtgcagacaagtgagtgagcactattgagtgtgtgcacacatgtgtttgcaaagcatggcacagacaataaacaagaaaatattactgataaatgttacaaagcaaatttctttagaataacatttaaacagaaacccgaactacaaggagacaactcagccaaaataagaaaagcactccaaggttagggaatagttggtttgaaagtcctaaggtgagaatgagcttgctttatctgaggaaaagaaacatrgccaggtggaaagacctcgactagactgagggaatgggaggcagggagaagatgacaattattttgcatatcacttcttacttcattcctttttccatctagttctttttaccattccattttctttccccctcttttaacccgtttaggttgaagatctagtcagttaatggctatcaaagttcataactgcagatcttctagcttttttttttttaagatggaattttactcttgttgcccaggcaggaatgaagtggtgtgatatcggctcactttagaactccgcctctggggttc

SEQ ID NO: 136955 - DNA, 601 bp, Human
tccttaagaaactttgaagattgtgatttcaacctcagtttttatttacatgtatatatttttttctagccaatcacccaattaaataaacagtctcagaattcatatagcttttgctgtactcaagacaaaaatatgggaatcagctctgattcctcatcctccatatccagtctctcactaaatcctggtaattttatatcttaaatatcttccaattcatacttttttctagccccactgctgctgctctattcgaagccaccatcatctcttgcaatggataactcctgatccaatycattttcaacactagccagtgatttcaaaatgaaaatctatctcttcacatcattatctgtgggcatttgagctgaaggcccctgcacctacacctatcaatcatcattaccttgcgctttgcccaacttttcacttaaccaatttccttagcttaaatgtcacttccttagaattccttccctagagccccagactgggttaactctgtatgaacatgctcctattgtattcattcacataacaattatctactgggcacctattacgtgtaaggtgctggaaaaatggggtagacaag

SEQ ID NO: 136956 - DNA, 601 bp, Human
atttatctagcccagggaggagaataaagttacaaagtttgtgtaataaacggcaaaaggaggccgggcacggtggctcacgcctgtaaccccagcactttgggaggccgaggtgggcggatcacctgaggtcaagagtttgaaaccagcttgaccaacatggtgaaaccccatctctactaaaaatacaaaattagctgggcgtggtggcacatatctgtaatcccagctactcgggaggctgaggcaggagaatcacttgaacccgggaggtggaggttgtagtgggccgagatcgtgycactgcactctagcctgggcaacaagagtgaaactctgtctctaaataaataaataaatggcaaaaggaatttaccttccaaggagtaaagaaaggaagtaaattctggatacaaacagaaaattttaacgaaatttatttgtgactttttttttttgagatggagtctggctctgtcacccaggctggagtgcagtggcatgatctcggctcactgcaacctccgcctcctgggttcaagcaattctcctgcctcagccttccagggcgtgcaccaccacccctggctaatttttgtat

SEQ ID NO: 136957 - DNA, 601 bp, Human
gcgatctcagctcactgtaagctccgcctcccgggttcacgccattcttctgcctcagcctcccaagtagctgggactacaggcgccagccaccacgcccggctaatttttttgtatttttagtagagacagggtttcactgtgttagccaggatgctctcaatctcctgacctcgtgatccacccgcctcggcctcccaaagtgctggaattataggcgtgagccaccatgcccggccctgagaggttagcttttatgactcctggcattaattatctatttatatatttgcacatacaytctacttcttcattatacactactagagcagtatatattcagagatagctctctgaaacccagtgcactgagaaaagtcaatgagaaaacaacatttttgtcctacagatctggctgaaattcatgacttggtttctccaaacagcagagcagttccagaaaacactcaagaagaacccagatatggctactatgaatgaaccaagaactacaaaacagagaaaccaagaccttatttctggaggactgagacagaagagctgccagaaacagaaatcacattgcatataccggaagtgc

SEQ ID NO: 136958 - DNA, 601 bp, Human
ctgcttaaaagatcctcagcatccctttcaccagaagaaaggtaacaggagcaccagaagcatgattagggttcctatgtggtctgcttctcagtgaaagacctgtttaatcaaacaccaggacaataagcaaagcacaactgtcacgattccaagccttggcccctaatatctttcacttctctgacctctcaactttatgtttataggtagtcacgtatagttactatataactcagtttcttcatctgtaaaacagacttaatgaccctcatgcgataactgagaggttagcttttttctttttttttttgagacagagtctcgctttgtcgcccaggatggagtgcagtggcgcgatctcagctcactgtaagctccgcctcccgggttcacgccattcttctgcctcagcctcccaagtagctgggactacaggcgccagccaccacgcccggctaatttttttgtatttttagtagagacagggtttcactgtgttagccaggatgctctcaatctcctgacctcgtgatccacccgcctcggcctcccaaagtgctggaattataggcgtgagccaccatgcccggccctgaga

SEQ ID NO: 136959 - DNA, 601 bp, Human
gagttcgagaccagcctgaccaacatggtgaaaccccatctctactaaaaatacaaaaattagccgggcgtggtggcgcatgcctgtaatcccagctattcaggaggctgaggcaggaaaatcgcttgaacccgggaggcggatgttgcagtgagccaagatcacgccactgcactccagcctgggcgacaaagcgagactccatctcaaaataaataaataaataaataaaaatttcttacttttgatttttttaaaaaaatacttaaaaatatggactgcttcatgaatttgtgtgtcrtctttgcataggggccatgctaatcttctctgtatcgttccaattttagtacatgtgctgcttaagcaagcaccagtttaccattttatacaatgcaatgtatctttgacattattccataaagatctccatccctaacagctgccatagtattccattgtatggtttcctttattataatgaagaatgctgttttgacattggcagcgagccaaaatcacaccactgcactccagcctgggcgacacagcaagactgtctcaataaaacacaaaacaaaacaaaaaaccccaaaacttg

SEQ ID NO: 136960 - DNA, 601 bp, Human
gaccccactccacagcgaatacatgaggaagtggtgtttttaaagcagttaattttttctaattaaaatcatatattaacattcaattacaaaaatatataacgtggccaggcgcagtggctcacgcctgtaatcccagaactttggaaggccaaggcgggcggatcacaaggtcaggagtttgagaccagcctggccaacatagtgaaacccccatctctactaaaaatacaaaaaattacctgggcgtggtggcaggcgcctgtaatcctagctacttgggaggcagaggcagaagaaytgctacaacctgggaggtggaggttacagtgtgccaagatcgcgccactgcactccagcctgggagacagtgtgagcctccgtctgaaaaaaaaaaaaaatttatttttcttgttgccaggtgcggtggctcacgcctataatcccagcactttgggaggtcgaggtgggtggatcacgaggtcaggagttcgagaccagcctgaccaacatggtgaaaccccatctctactaaaaatacaaaaattagccgggcgtggtggcgcatgcctgtaatcccagctattcaggaggctgaggc

SEQ ID NO: 136961 - DNA, 601 bp, Human
attgcactccagcctgggcaacagagtgagactccatctcaaaaaaaattttaaaaaaggctgggcgcagtggctcatgcctgtaaccccaacactttgggaggtcaaggcaggcagatcactaggtcatgagatcgagaccttcctggccaacatggcaaaaccctgtctctagtaaaaacacaaaaattggccgggcatagtggcacacgcatgtagtcctagctacttgggaggctgaggcaggagaatcacttgaaccggggaatcagaggttgcagtgagctgagattgtaccacygcactccagagcctggcaacagagcgagactcagtctcaaaaaaaaaaaaaaaaaagaaaacagaaaaaagaagaaatacagatgcctagaccccactccacagcgaatacatgaggaagtggtgtttttaaagcagttaattttttctaattaaaatcatatattaacattcaattacaaaaatatataacgtggccaggcgcagtggctcacgcctgtaatcccagaactttggaaggccaaggcgggcggatcacaaggtcaggagtttgagaccagcctggccaacatagtgaaac

SEQ ID NO: 136962 - DNA, 601 bp, Human
ctgggcgtggtggtgtgcacctgtaatcccagctactcaggaggctgaggcaggagaatagcttgaacccgggaggcggaggttgcagtaagccaagatcatgccattgcactccagcctgggcaacagagtgagactccatctcaaaaaaaattttaaaaaaggctgggcgcagtggctcatgcctgtaaccccaacactttgggaggtcaaggcaggcagatcactaggtcatgagatcgagaccttcctggccaacatggcaaaaccctgtctctagtaaaaacacaaaaattggccrggcatagtggcacacgcatgtagtcctagctacttgggaggctgaggcaggagaatcacttgaaccggggaatcagaggttgcagtgagctgagattgtaccactgcactccagagcctggcaacagagcgagactcagtctcaaaaaaaaaaaaaaaaaagaaaacagaaaaaagaagaaatacagatgcctagaccccactccacagcgaatacatgaggaagtggtgtttttaaagcagttaattttttctaattaaaatcatatattaacattcaattacaaaaatatataacgtg

SEQ ID NO: 136963 - DNA, 601 bp, Human
acagatgcctgcctgggtgtgatagctcacgcctgtaatcccaccactttgggaggcgaggtgggtggatcacgaggtcaggagttgagatcggcctggccaacatggtgaaaccccagtctctactaaaaatacaaaaattagctgggcgtggtggtgtgcacctgtaatcccagctactcaggaggctgaggcaggagaatagcttgaacccgggaggcggaggttgcagtaagccaagatcatgccattgcactccagcctgggcaacagagtgagactccatctcaaaaaaaatttwaaaaaaggctgggcgcagtggctcatgcctgtaaccccaacactttgggaggtcaaggcaggcagatcactaggtcatgagatcgagaccttcctggccaacatggcaaaaccctgtctctagtaaaaacacaaaaattggccgggcatagtggcacacgcatgtagtcctagctacttgggaggctgaggcaggagaatcacttgaaccggggaatcagaggttgcagtgagctgagattgtaccactgcactccagagcctggcaacagagcgagactcagtctcaaaaaaaaaaaaa

SEQ ID NO: 136964 - DNA, 601 bp, Human
ctctatgagaatcagaatcacctatggagtttagaaatacagatgcctgcctgggtgtgatagctcacgcctgtaatcccaccactttgggaggcgaggtgggtggatcacgaggtcaggagttgagatcggcctggccaacatggtgaaaccccagtctctactaaaaatacaaaaattagctgggcgtggtggtgtgcacctgtaatcccagctactcaggaggctgaggcaggagaatagcttgaacccgggaggcggaggttgcagtaagccaagatcatgccattgcactccagcctgggcaacagagtgagactccatctcaaaaaaaattttaaaaaaggctgggcgcagtggctcatgcctgtaaccccaacactttgggaggtcaaggcaggcagatcactaggtcatgagatcgagaccttcctggccaacatggcaaaaccctgtctctagtaaaaacacaaaaattggccgggcatagtggcacacgcatgtagtcctagctacttgggaggctgaggcaggagaatcacttgaaccggggaatcagaggttgcagtgagctgagattgtaccactgcactccagagcc

SEQ ID NO: 136965 - DNA, 601 bp, Human
ctcacacctgtaatcccagcactttgggaggctgaggcaggcaaattacctgagatcaggagtttgagaccagcctggccaacatggtgaaaccctgtctctactaaaaaatacaaaaattagctgggcgtggtcgtgcacatctgtaatcacagctacttgggagcctgaggcaggagaatcacttgacttcaacccagaaggcggaggctgccttgagcctagatcacaccactgcactccagcctgggctatagagtgagacttcgtctcaaaaaaaagaaaacgaaaaagaaaaaamcaataaataaacaaaaatggccgggcgcggtggctcacgcctgtaattccagcactttgggaggcagaggtgggcagatcacaaggtcaggagatcaagaccatcctggctaacatggtgaaaccccatctctactaaaaatacaaaaaattagctgggcgtggtggcgggtgcctgtagtcccagctactcaggaggctgaggcaggagaatcagttgaacctgggaagcagaggttgcagtgagcccagatcgcaccattgcactctagcctgggcaacagagtaagacgccatctca

SEQ ID NO: 136966 - DNA, 601 bp, Human
actgagcctggccctttccttactttttaagtactgtcttaagagcaactcaaataagaagaatatagaaaacagatccccgcttcttcctgagctttctttactggctcatcccagagcatctacatccagagatactgtattactggagattcccagccagccttcccaacgtgtttttttgtttacaattagttctctagggtttcaagaaagctatttgtcaaaatcagtagagaggtcagggctcggcagcacacacctgtaattccagcactttggaaggcctaggcagaaggaytgcttgagcccaggagtttgagaccagcctgggcaacgtagtgagaccccatctctacaaaaaataatcagctgggtgtgctgggaggatcgcttaagcacaggaggttgaggctgctgtgagctgtgattgtgccactgcactccagcctgggtgaggaagcaagactgtctttaaaaaaatgataaagaggctgggcgtggtggctcacacctgtaatcccagcactttgggaggctgaggtgggcagatcacgaggtcaggagatcgagcccatcctggctaacacggtgaaacccc

SEQ ID NO: 136967 - DNA, 601 bp, Human
gaaaacaagtgtggggaaaacagaactgtagttatcaaagataatagaatctgagtttactcctttataaaatacatcatcaagctaggtaacatctaagggtttttccagtgttgaaattttagtcccttataaatctattttatttagtccttcatccaaatttgacttttttgggggagggggacacagtctccctctgtcgcccaggctgcagtgcaatggtgctatctcggctcacctacgcctctagggttcaagtgattctcatgcctcagcctcctgagtagctaggactacrggcacctgccaccaggcccagttgatttttgtatatttagtagagatggggtttcagcatgttggccaggctggtctcgaactcctgacctcaagtgatctgcccgttttggtttcccaaaactctggaattaacaggcatgagctaccgtgcccggacccaactctttgacttctgacagacttaaagccttatgattaccaatttttgtcagtagatggcactgtatcaatgaaacaaaattgatcaacaaaactggccaaagaattacctggatggcaggtaatccaagacaaggaa

SEQ ID NO: 136968 - DNA, 601 bp, Human
gtcttgctctgttgcccaggctggaatgcaaagtggcgcaatctcggcttactgcaacctccgcctcctgggttcaagcgattctcctgcctcagcttcccaagcagctgggactacaggcgtgtgccaccaagcccagctaatttttgttttttttttttttggttttttttttttttttttttttagtagagacgggatttcactatgtgttggccaggttggtctcgaactcctgacctcaggtgatccacctgcctcggcctcccaaagtgttggaattacaggcatgagccaccaygcctggccttcacagcaaacttctttattcttgtgtatccatttaaaacttttatacccattcttggtaattttaaaaggctcccaatactccttttaccataaagcatggtagctagggccaggcgtgcaggctcacatctgcaatcccagcattttggaaggcccaagtgggagaattcctgaagcccagtagtgtgtgaccagcctaggcaacacagcaagactccatcttcacaaaaaaaccgttgtaaaagagcacggtagctaaaatattgcattaaattgaaaggctgggtgc

SEQ ID NO: 136969 - DNA, 601 bp, Human; identical to SEQ ID NO: 35301

SEQ ID NO: 136970 - DNA, 601 bp, Human; identical to SEQ ID NO: 35302

SEQ ID NO: 136971 - DNA, 601 bp, Human; identical to SEQ ID NO: 35303

SEQ ID NO: 136972 - DNA, 601 bp, Human; identical to SEQ ID NO: 35304

SEQ ID NO: 136973 - DNA, 601 bp, Human; identical to SEQ ID NO: 35305

SEQ ID NO: 136974 - DNA, 601 bp, Human; identical to SEQ ID NO: 35306

SEQ ID NO: 136975 - DNA, 601 bp, Human; identical to SEQ ID NO: 35307

SEQ ID NO: 136976 - DNA, 601 bp, Human; identical to SEQ ID NO: 35308

SEQ ID NO: 136977 - DNA, 601 bp, Human; identical to SEQ ID NO: 35309

SEQ ID NO: 136978 - DNA, 601 bp, Human; identical to SEQ ID NO: 35310

SEQ ID NO: 136979 - DNA, 601 bp, Human; identical to SEQ ID NO: 35311

SEQ ID NO: 136980 - DNA, 601 bp, Human; identical to SEQ ID NO: 35312

SEQ ID NO: 136981 - DNA, 601 bp, Human; identical to SEQ ID NO: 38796

SEQ ID NO: 136982 - DNA, 601 bp, Human; identical to SEQ ID NO: 38797

SEQ ID NO: 136983 - DNA, 601 bp, Human; identical to SEQ ID NO: 24138

SEQ ID NO: 136984 - DNA, 601 bp, Human; identical to SEQ ID NO: 24139

SEQ ID NO: 136985 - DNA, 601 bp, Human; identical to SEQ ID NO: 24140

SEQ ID NO: 136986 - DNA, 601 bp, Human; identical to SEQ ID NO: 24141

SEQ ID NO: 136987 - DNA, 601 bp, Human; identical to SEQ ID NO: 24135

SEQ ID NO: 136988 - DNA, 601 bp, Human; identical to SEQ ID NO: 24136

SEQ ID NO: 136989 - DNA, 601 bp, Human; identical to SEQ ID NO: 24137

SEQ ID NO: 136990 - DNA, 601 bp, Human; identical to SEQ ID NO: 30354

SEQ ID NO: 136991 - DNA, 601 bp, Human; identical to SEQ ID NO: 30355

SEQ ID NO: 136992 - DNA, 601 bp, Human; identical to SEQ ID NO: 124489

SEQ ID NO: 136993 - DNA, 601 bp, Human; identical to SEQ ID NO: 124488

SEQ ID NO: 136994 - DNA, 601 bp, Human
atgtagtggggaaggcagaagcaaaggctacatgtagagggaacctgcgactgcattccaaagtaacctcatcccagagttgttcccagagttcagagtttttctttctttctttttggggtggagtctcgctctgttgcctaggttagagtgcagtggagcgatctcagctcactgcaacccctgccttccgggttcaagagattctcctgcctcaacctcccgagtagctgggattacaggaggctgccaccatgcccagataatttttggttttttttttcagtagagatggggtttyaccacgttgaccagggtggtctcaaactcctaacctcaagtgatcaacgcacctcagccttccaaagcgctgggattaaaggcgtgggccaccacacctggcatacagcttttctaaattaatttcagaaagtctttgtgtgcagcgtcaaaagcacttgcttctgggtccaagaagtccaactctgagccacatcttcctgagcaaggggtttgagctgaagtgatccccagggccataaaagaatgttggggcagggcatggtggctaacatctgtaatcccagcactttgggatgct

SEQ ID NO: 136995 - DNA, 601 bp, Human
taatatccctacaaagagggttggaagtcagaattctctatggggaagaggtccaggaatggtactcaggtggtcccaggaagtgtgggaggagtaaccttctccaagatgtagtggggaaggcagaagcaaaggctacatgtagagggaacctgcgactgcattccaaagtaacctcatcccagagttgttcccagagttcagagtttttctttctttctttttggggtggagtctcgctctgttgcctaggttagagtgcagtggagcgatctcagctcactgcaacccctgccttccrggttcaagagattctcctgcctcaacctcccgagtagctgggattacaggaggctgccaccatgcccagataatttttggttttttttttcagtagagatggggttttaccacgttgaccagggtggtctcaaactcctaacctcaagtgatcaacgcacctcagccttccaaagcgctgggattaaaggcgtgggccaccacacctggcatacagcttttctaaattaatttcagaaagtctttgtgtgcagcgtcaaaagcacttgcttctgggtccaagaagtccaactctgagcca

SEQ ID NO: 136996 - DNA, 601 bp, Human
agactaaaaactcttccactgttcaggagctgggggcagactaggccaacttcatcaggtaccagggcccatgataccattaggggccagccaaatgtttccttttaaaattcagaagaatgaataactagaactgggcctgggttatatttgtctttatattaattatgttgcaaaacataaatttttaaaatcctgtattctggccagacacagcagctcatgcccgtaatctttggggaggccaagacgggaggatcacttgaactcaggagttcgagaccagcctgggtaacacagmgagacactgtgtgaaaaaaatgtaaaaattaactgggtgtggtggtgtgcgcctgtagtcccacctgctcagggggctgaggtgggacgatcacttgagcccaagggtttggggtcacgtaacagtaagctatgattgagccactgcactccagcctgggtgacagagagagaccctgtcccaaaaacaaacaacaaacaaacaaaaaaacatactttacaactattgtttcgttattaccttgctataatcctacttcgagttctggaaagaatgtgtgaaacagtattttgggcattt

SEQ ID NO: 136997 - DNA, 601 bp, Human
atacaagccacttcacttgatgctttggattagaaattagtaatgtccagtacaaagctcaatgagactaaaaactcttccactgttcaggagctgggggcagactaggccaacttcatcaggtaccagggcccatgataccattaggggccagccaaatgtttccttttaaaattcagaagaatgaataactagaactgggcctgggttatatttgtctttatattaattatgttgcaaaacataaatttttaaaatcctgtattctggccagacacagcagctcatgcccgtaatcttyggggaggccaagacgggaggatcacttgaactcaggagttcgagaccagcctgggtaacacagcgagacactgtgtgaaaaaaatgtaaaaattaactgggtgtggtggtgtgcgcctgtagtcccacctgctcagggggctgaggtgggacgatcacttgagcccaagggtttggggtcacgtaacagtaagctatgattgagccactgcactccagcctgggtgacagagagagaccctgtcccaaaaacaaacaacaaacaaacaaaaaaacatactttacaactattgtttcgtta

SEQ ID NO: 136998 - DNA, 601 bp, Human
tacaaagactggcagcttcccatctatacctcctggctgcaaaaactactaaaaaaggtacttcaacaacaagaaaataaacgtataagaaacaagcaaaaggaaccatgaggcaaaccaaacattactccccacctcccccttttttttttgagacagggtctggccttgtcgcccgggctggagtgcagtggtgctatcaccactcactgcagcctcgacctcccaggctccatccttctgcctcagcctcctgagtagcagggaccacaggtgtgcgctgctatgactggctaatttytttttttttttggtagagatggggttttactatgttgcccaggtgagtctccaactcctgggctcaagtgatctgtccaccttggcctcccacaggctgagattacaggtgtgagtcactgcatcttgccagtaaatagatatatgtatttttaaaaaggtacaatggccaggtgtggtagctcatgcctgtaatcccagcgctttgggagttcaaggcggggcggatcacctgaggttgggagtttgagaccagcttgaccaacatggagaaaccccatctctactaaaaatataaaat

SEQ ID NO: 136999 - DNA, 601 bp, Human
ccatctcaaaaaaaataaaaattaaaaaggccgggcacggcggctcatgcctgtaattccaacactttgggaagccaaggcgggtggatcacctgaggtcaggagttcaagaccagcctagccaacatggtgaacccttgtctctacaaaaattagccaggcatgatggtgggtgcctgtaatcccacctacttgggaggcgaggtgggaaaatcgcttgaatccgggtggcagaggttgcagtgagccgagatcacgccattgcactccagcctgggcgacagagtaagactccgtctcaaaaaaaaaaaaaaaacccaaacccacacaagatcaacctacctcttgctgcccagcttaaactagatgacaaaagaaagatttccatacaaagactggcagcttcccatctatacctcctggctgcaaaaactactaaaaaaggtacttcaacaacaagaaaataaacgtataagaaacaagcaaaaggaaccatgaggcaaaccaaacattactccccacctcccccttttttttttgagacagggtctggccttgtcgcccgggctggagtgcagtggtgctatcaccactcactgca

SEQ ID NO: 137000 - DNA, 601 bp, Human
tgtgagctaagatcacgtcactccactccagccagggcaacagagcaagactccatctcaaaaaaaataaaaattaaaaaggccgggcacggcggctcatgcctgtaattccaacactttgggaagccaaggcgggtggatcacctgaggtcaggagttcaagaccagcctagccaacatggtgaacccttgtctctacaaaaattagccaggcatgatggtgggtgcctgtaatcccacctacttgggaggcgaggtgggaaaatcgcttgaatccgggtggcagaggttgcagtgagcygagatcacgccattgcactccagcctgggcgacagagtaagactccgtctcaaaaaaaaaaaaaaaacccaaacccacacaagatcaacctacctcttgctgcccagcttaaactagatgacaaaagaaagatttccatacaaagactggcagcttcccatctatacctcctggctgcaaaaactactaaaaaaggtacttcaacaacaagaaaataaacgtataagaaacaagcaaaaggaaccatgaggcaaaccaaacattactccccacctcccccttttttttttgagacagggt

SEQ ID NO: 137001 - DNA, 601 bp, Human
gcaggttcggctgggcttcatccactgtccacgtagacaatgaaggagcgaaggacagtccttctgctgggtcccatgctaggaacccctctcctcgatctagaactgcttgcaatgggaagaccctgaacttcttttgttttgttttgttttgagactgagttttgctcttgttgttgcccaggcttggagtgcaatggggcgatcttggctcactgcaaccttcgcctaccgggttcaagcgattctcctgcctcagcctcccaagtagctgggattacaggcatgcgccaccacgccyggctaatttttgtatttttagtagagacggagtttctccatgttggtcaggctggtgacccggaacttcttgaagagaacaagggcacacagaggccagggcagaatgctgatgtctgggtagggtgtaataaatactcactgaatgaactcaagttttacttgctggccagggaggaagtagaccgagaaatccctcctataggctgaacaggggacaggacttcatacgctggctcctgactcagggcatttggatgtcgaggaaggagaagggaaaggtttctgcctcgggggtctg

SEQ ID NO: 137002 - DNA, 601 bp, Human
tgacctcaagtgatccgcccgcctaggccttccaaagtgctgggattacaggtgtgagccaccgtgcccagccagaaaaaaagtttaaaaaaataaatcagagctcctactattgccaagcgaccctgcaagcccaccacacactgtgcagctgttgatgcaagggtgcccacccaccaccagcatctgaagcacagcacccccagctaggagcttcaggttttccagagatttccaggtgagtctctcttggatgccaacagtttctacagagcagtgtgagcacctgtgtgtctcgccyggggtacaaagaagcacagaagcttctgacccagggccttcctcaggatggcacggtggctactctgtgaaaggctttccctgctgacccagaaaacgggaacaaggcaggttcggctgggcttcatccactgtccacgtagacaatgaaggagcgaaggacagtccttctgctgggtcccatgctaggaacccctctcctcgatctagaactgcttgcaatgggaagaccctgaacttcttttgttttgttttgttttgagactgagttttgctcttgttgttgcccaggcttggagtg

SEQ ID NO: 137003 - DNA, 601 bp, Human
aggggtggctcgaaaaattccagtgagatccaagcaaagcccaacgtgactgattgcgctcagctgactgcaggggtctctggagaaggaaacccagagactccagcacgccagggcccctccccaccatgcactcgttccctctttttctctgaggactcatgacatgtcacgaaaatgcagctcccagcctgcaaggagctgtgggccggcacaccacctgcgccaggggcgcgccccctggagggctgacgctgccatggctgccatttgaggccggatctcgctgtgtcctgtgcastgtagggtgttgggctgcgtccctcgcccccacccattagatagatgccaggaacacacctcccaccccccagctgcgacaaaattgtttctagttgttgtgagatgtcccctgggtgggaatggagaggggaagaaccctcctgagttgagaaccttgctccttcacccgccacatgagggtagaaggcagaccccagactctcctgcatcagggtttcaggatgaaggtcctcagcccccactcactccacctcttgaccaacctcaggctgaggtccatagtcaaagagcttggttc

SEQ ID NO: 137004 - DNA, 601 bp, Human
tttaaaattcactattatagtgatttttttttatttgtttgcatagcctggcacctgtgtttgctctgtttgtaccattttactgctccataccaagagtccaagtggcacaaattctgggtccgttgtccatcacaaacaagacattgatttatatattgggactgcaggtacagtatgcatttttatgttcacttttctttaaccagatcttttttttttttttttttggtctttttctcatttgatctccttgaaaacaatggtttttttccccccataatcttggcttcatgatctrtatcaaatgtttaaaggaagtgttacagaacaagaacatcaaggtatagaagatactagaatactttcatagtctttagaaatctgataagagctttcactgtaatttgtatctgtggaaaatattttcatttcattgtacaattgcatgtgcgtactttttaacaatcatagtatgaagtggaaacaaatgagaacaatcaaaaagtagaaagtagaaaatcagtgtcaaaattaatttattgaatacagtgtcgcaaataaagctctgaagaagaaacccggtgtgctctaccaaccc

SEQ ID NO: 137005 - DNA, 601 bp, Human
ggaagtgttacagaacaagaacatcaaggtatagaagatactagaatactttcatagtctttagaaatctgataagagctttcactgtaatttgtatctgtggaaaatattttcatttcattgtacaattgcatgtgcgtactttttaacaatcatagtatgaagtggaaacaaatgagaacaatcaaaaagtagaaagtagaaaatcagtgtcaaaattaatttattgaatacagtgtcgcaaataaagctctgaagaagaaacccggtgtgctctaccaacccgagctttggggttttyaagaagcattgtcagcttgattatttccttgtttgtgaagctgtgatggtagcgtcaccatttgctaaatggtttgctgtgaagactactagagtactactgtccaggttacatttgaaaagcttctttgccaatcctcagcgaatgtcaattgctccctgctgggctccaggtctgtggtaggagaatgattttcagttttctatctgtactacctgtcacttttcttttactctcacggcttttgatgtagttttattctacagcttcctgtgtcaccatgtgtcgcttggccttttg

SEQ ID NO: 137006 - DNA, 601 bp, Human
ttctgcatttgattcttatgagtaggatttgctatagcagatttaatatttttaaagttgttgtgacagaggccatgtggaattcgaagagcactccagacctccctcaggagacccaagttctagtcctagcatggctgtctccagccatgagacttgggttgagtcatggaaaccctctgagcctcacattcactgtatagttcttccaactctaaagctatgtagaatctttgagaatgaaaacactgttttattaattgtggagtaggagttcagtgtggcattgtggaaagtcttyggagccaggttgttgaatttcggtttaatgacttggtctggtaatgatttgctttgtcacttactttttctgagcccccatttccccatctatcaaatggggatgataatatctaccttacagaggtattttaaagatagcatgaagtgtttagtgtaatctgaacagataataagagttaagtcaattggttactattaattaataatttatatctctatagctaccactattcatttttctgagattgtaaatgtatttcttgttttgtttttggcataaagcaagtagtatgtttca

SEQ ID NO: 137007 - DNA, 601 bp, Human
ggcaaaaactgcagttacttttccaccaacctaatatctagtgccgtttccacagtgttacacagctcaccatgagggatcccccttagccctgccgaaagcagaaaggtagatgcaactaccacggatagtttttcaaaataatataaatttccaatatttttgtaatatttccggtaactttgagagggagaagttgagatcagaaaatagaggtggagatgcctcattgcctccttgataaaatctaggtccttagcatgaatggcatgcagggttcttcttgactgtctggtgtcarctccccctgtgcccaccttgaaggagtgtaactgaactcctttgtgctaaaatgtctgtcctccacctgcctccctcccctccaagcctttgcatgtgtttctgtgcctttgtctctccccactacaaccagggacattgttgaatgaatgaatgaatggatgaatgaatgaatgaatgaatgaagacttgaatcataatcggaagagccaaaatgcttaaggctcatttaagtatccaatgacttgagagcccataacatcatgccctgtgcaatgggctatgacgttgtgggctctca

SEQ ID NO: 137008 - DNA, 601 bp, Human
acttaaagatgactgtaagattattcacatgtatcattgataaatgtttttgtgttacctttttcctcatttgacagttctgatttttaatgcaaacatttagtatttaaaataggacttttcatgaaatgttgcaaaattgtaattggaaagcttggctattacagccaagtgacatatatcagtttaaacaaatacttcaacatttcagtgaccgtatcaactgttcttctagatgtctggtgagagaccttcaaaaattgaagtcagtctttacatattcataattccactaattttsttacacattaatacttttccttaaagcattgcttacttactgaacttcatttaaattcttcttgtggttctgcagagagcttttgagccatctacatctcagaacttcttcattttctacagttttatgaatcatagtactgagtcattaccacagggatgcaccctaattctcaaaagccgaggtctcaggactgatctgattctggcatgattaaaatagaaagagccttcttttgccaattttctttttacagttcacacatttatctttacttgaccctcttttaagctgtttgag

SEQ ID NO: 137009 - DNA, 601 bp, Human
tgattctggcatgattaaaatagaaagagccttcttttgccaattttctttttacagttcacacatttatctttacttgaccctcttttaagctgtttgagagtgaattaacaggcctatattcctcagacttctcccttcaacgcagcccttcactgtacccatttcctgcattcgttacttgtcatgtacagtatatcagactttgattatctctgatccagcagccttagtgtggaaaaaaaacaatctgttacacccaaaagtaagatttgggacttcaaatgtggtctgagtttgkattgttttctgtaaggagtggggatctttaaagcacttcaagaagaaacactttacgatggtgcaagattacagaagccttatcagggttcgtagatcataggacaggggtagggaaaatgagccatctggagggagtcaagacagcgcatttgcgggctgtgatttgcctttctctcttccctctgtagtacttttaaagacaaacaaaaaaacccaaaccactgtcttaaagtaactgtgaacaaatggaaacagcataacctgctgtggaagcataagcatctttagagtatgtttt

SEQ ID NO: 137010 - DNA, 601 bp, Human
agaagaaacactttacgatggtgcaagattacagaagccttatcagggttcgtagatcataggacaggggtagggaaaatgagccatctggagggagtcaagacagcgcatttgcgggctgtgatttgcctttctctcttccctctgtagtacttttaaagacaaacaaaaaaacccaaaccactgtcttaaagtaactgtgaacaaatggaaacagcataacctgctgtggaagcataagcatctttagagtatgttttgaggccctggcctgcttctgggcgagggatggtaggtgtgrgttcctctgcgccgcctttgcttgtgcccagctctctcttctctccatgcttccttttctcctatttaaccttttttcccttagattgcttctccattgaccaaagagtggtataggtagcagctcagataactcctctgatgcacaagcctcccagttaaacttactttagagatttggattattttctagtagttcattgaaaatgaggacaggaactgcaaagaaaaatcaaggctaaccagatacagtggctcatgcctggaatcccagcactttgggagactgaggcaggtggat

SEQ ID NO: 137011 - DNA, 601 bp, Human
gttcgtagatcataggacaggggtagggaaaatgagccatctggagggagtcaagacagcgcatttgcgggctgtgatttgcctttctctcttccctctgtagtacttttaaagacaaacaaaaaaacccaaaccactgtcttaaagtaactgtgaacaaatggaaacagcataacctgctgtggaagcataagcatctttagagtatgttttgaggccctggcctgcttctgggcgagggatggtaggtgtgggttcctctgcgccgcctttgcttgtgcccagctctctcttctctccrtgcttccttttctcctatttaaccttttttcccttagattgcttctccattgaccaaagagtggtataggtagcagctcagataactcctctgatgcacaagcctcccagttaaacttactttagagatttggattattttctagtagttcattgaaaatgaggacaggaactgcaaagaaaaatcaaggctaaccagatacagtggctcatgcctggaatcccagcactttgggagactgaggcaggtggatcgcttgagcccaagagttcaacaccagactggccaacatggcaaaac

SEQ ID NO: 137012 - DNA, 601 bp, Human
ccagctctctcttctctccatgcttccttttctcctatttaaccttttttcccttagattgcttctccattgaccaaagagtggtataggtagcagctcagataactcctctgatgcacaagcctcccagttaaacttactttagagatttggattattttctagtagttcattgaaaatgaggacaggaactgcaaagaaaaatcaaggctaaccagatacagtggctcatgcctggaatcccagcactttgggagactgaggcaggtggatcgcttgagcccaagagttcaacaccagmctggccaacatggcaaaaccctgtttctacaaaaaacaaacaaacaaacaaacaaaaatttcaaggctgaccaaagccatgagggtgatgggacttgtgaaaggaccacatgtagaagttgaagacaagtagcaggttcttaagaagcatccaaatttggagggtgccttataattaaaatagcaagtgtgatgtcagtgcttgtccaatgtacaccccacacacactcacattcacgttgactcatccatatacactcccttttctcctttttcctccctccctctctatgctaccttt

SEQ ID NO: 137013 - DNA, 601 bp, Human
gaatcccagcactttgggagactgaggcaggtggatcgcttgagcccaagagttcaacaccagactggccaacatggcaaaaccctgtttctacaaaaaacaaacaaacaaacaaacaaaaatttcaaggctgaccaaagccatgagggtgatgggacttgtgaaaggaccacatgtagaagttgaagacaagtagcaggttcttaagaagcatccaaatttggagggtgccttataattaaaatagcaagtgtgatgtcagtgcttgtccaatgtacaccccacacacactcacattcaygttgactcatccatatacactcccttttctcctttttcctccctccctctctatgctacctttcccactcctgaccacagggagccaggactaactggaagaagccttctattaatatattcttccttgtggcaattgcaactcaggcccaggatgacaaatggtgtcttaggccattgttaacacagggaggtagcgaccagttgacgtgtgatttttaaatgctcagtgcagaataaatgaaatgatgccattgtcttaataaagctggcagatagaattgccttataaaatttataa

SEQ ID NO: 137014 - DNA, 601 bp, Human
tttataaaaatagctataaaattttattattgcaacttatgttctacctgtaggcaaaaatctagcctcctttcaaaatgcgacctcctcacctacccctgtcacttctgtgaaccatacactccaactacacacaatccattcccaaacatccactttcaggattctgtatgattgtgcaaacaagtatttttctttaacaaacacacagcacttagtatgtaccagacacttgtggtagattttttactctagtatttttgtttgttcaaatatatttggtcaaaatatgttctgcccytctctactgaagccctccctatagggcctctgcatgccctgttgacatcaggttttgttgtttgacttacactagccactaaaatatgaacagcagtgacaaatgcttcatccaagcagaagcttgaagagccactgcctggttccaccattgctctgtcccctttgccatgagaaaagcagggcccggagaggggcagctcctcagactccagaatgaagaagtcaaatggagcagggctgtaccaacatgtagcatgaacaggaaagaaatctttgttataagctactgaaatttgat

SEQ ID NO: 137015 - DNA, 601 bp, Human
ttacactagccactaaaatatgaacagcagtgacaaatgcttcatccaagcagaagcttgaagagccactgcctggttccaccattgctctgtcccctttgccatgagaaaagcagggcccggagaggggcagctcctcagactccagaatgaagaagtcaaatggagcagggctgtaccaacatgtagcatgaacaggaaagaaatctttgttataagctactgaaatttgataatttgttaccacagtataacttagaaaaagctgactaatagtactcttttctaagcactttacaarcattattttaattagccctcataaaaacctgaggaactacggaatattctccctattatagatgaagaaactgaggcacagggaaattaactacagtcatgcactgcgtaacaacgttttgatcaacaacagagtgcgtattcagtggtggccctgtggattctaatggagcataggtagaaacctggtgtatggcactcagtgttggcactgcagatcaagtaggggaaatgactgatattcagtcatggtgccagaacacttgattttctgtatgaaaaaatatatataaatgaaaat

SEQ ID NO: 137016 - DNA, 601 bp, Human
tacactagccactaaaatatgaacagcagtgacaaatgcttcatccaagcagaagcttgaagagccactgcctggttccaccattgctctgtcccctttgccatgagaaaagcagggcccggagaggggcagctcctcagactccagaatgaagaagtcaaatggagcagggctgtaccaacatgtagcatgaacaggaaagaaatctttgttataagctactgaaatttgataatttgttaccacagtataacttagaaaaagctgactaatagtactcttttctaagcactttacaaayattattttaattagccctcataaaaacctgaggaactacggaatattctccctattatagatgaagaaactgaggcacagggaaattaactacagtcatgcactgcgtaacaacgttttgatcaacaacagagtgcgtattcagtggtggccctgtggattctaatggagcataggtagaaacctggtgtatggcactcagtgttggcactgcagatcaagtaggggaaatgactgatattcagtcatggtgccagaacacttgattttctgtatgaaaaaatatatataaatgaaaata

SEQ ID NO: 137017 - DNA, 601 bp, Human
gttcacaccattctcctgcctcagcctcccaagtagctgggactacaggcgcctgtcaccatgcccagctaatttttttgtgttttttgtagagacggggtttcaccgtgttaggcaggatggtcttgatctcctgacctcgtgatccacccgcctcggcctcccaaattgctgggattacagacatgagccacagtgcccggcctatgtctatgctcttaaaagatagctttgcataaccacatgcagtttcttccaactatatcccctatttcactcacatatcccttcttctaggaartcttactcatttaagtcctggcccaacccttttcctgagtcagtcctgactttatttatgagagctctcctcttaaatttttaagtgacagtttataattgttgactataggtatggggttgtgcagcgaatctctggagcttatcgctcttgcttaactgaaactttatgcctgttgatttttaactctccttttccctctgcccccagcccctagcaaccaccattttactctctgattctgtgaaattgactatcttatatacctcatataagtggaatcatgcagtatttgtcttt

SEQ ID NO: 137018 - DNA, 601 bp, Human
actcaatctgaagtaaagaaacattcagagaaaacttaaaggataatttaaagtatattaggctggtatagtagtgttactgaataaaggaaaaagaagtagagataaggaagaggttgccaagaaacacccgtacttttacattgtagagattactggtagattatcatgtccgttgcaggacagaacattttcccatgggtcttcacattgtctttttatcaggaaattaaaattttttcatcagttttgattatctctttaaactatatgtagttttggtttttggtttttctctctytctctgtgtgtgtgtgtgtgtgtttaagtgtccagtgtttgtcttcggggactgactgtgttgatattttccttctgtcttgatgatagcctctgggaagggactatggtaaaattaacatgtcgttttgaatttatttattatttataaacaacagcataggatgttatcaaaggtcttccatgttagcttatattgatagctgagaacattttcaaagcagcagaagttttttgttgttaaaagcttgtttttgttctgctaaaatcctacctcttataaaatttaaaagatttatgt

SEQ ID NO: 137019 - DNA, 601 bp, Human
ttgaggctgtatctataaatccacaaatcttttagagcttcacattcacttttagtttgttatttttcatcaaaggtaagaaatgagtttcaactgaaataagcccatatttttattaatttttcattttttgaatccatttaagaaagtgcatgtaacttttaaaggaggatggtccgcttgttaaaatggatattagaaggtgtttgtttacatataagaacctgatgatggttttctccatgtgctagagactctagttgccttccagtatattttttccttcataagggaaggttcrttttatttgagccagcaatgcctccagctgagatcacatatctcttatccttcgcctctcagtctgaccactggtctaagtcctggcgtcctggccattgagctgtaaacacacatatttgtgtgacttctgagaaggctccttaaagtcgccttttgtcctttcttattttttttcttctggctgctttgactacagttaagatgtttggagctttttaaatatgaaggtgaaataaacttctcttgtatttaagccactgttgtttgaagttttctacttagcatagttgacctaatc

SEQ ID NO: 137020 - DNA, 601 bp, Human
tttgactacagttaagatgtttggagctttttaaatatgaaggtgaaataaacttctcttgtatttaagccactgttgtttgaagttttctacttagcatagttgacctaatcctcctgatgcatgatttcccaaaaggaaaagcctagagcaggtttctaagacagtatgtgagaaacgaataatctgtgattagtgttattacttctgtctctattccaatttggttttccaagaatcagaaggatatccagcattttaattgggtacctcaaaatcttttaatttagtatcatttctmttccctcatatgagatagaaaagctatagaaagttcaatctgaatcacttttgcacttaaagaatagcaagtctcagagtaactgccaaaggcacatggttctgtctgtcatgaaaagaataatcttttcaaaatgtatgacaaatggcagaaataactttgggaatccctaatttgcattcacattcttggggtaataaattagggaatgtacaaagttcccttatgctttctctaacattttcattggagaagaaggaataggaaaatgtaagatgcatcagggcagggatttttctg

SEQ ID NO: 137021 - DNA, 601 bp, Human
gcatttgttaattcaccattcacccaggaaatacttacagtactatgtgccagacactgttctaagtgcagaggccaagtagtgatcaaaagcaacccaaatcttccccattcagagtttacatttagatagatgggatagaaatgtaagcagatgaacacaaaagccctacttccctgccagaatttgcagtcctatttttgtttattactgggtggggtatccatattcttcacagaatggtcctgctgaaattgaatacatagttttgtgagtgtatactcacgtctgattgtcattrtgggggcagggaaggcatggacaggagagtgaagatctttaaccttcctcagtttcttaagggagtctgtggcctcccccccataaattaagagcttctaccaaattgtgaactccttaaatactggcaaaaactatgcattttcattatatttttcttaatttatttaaaaacctgatttaaaaaaaattagcaacaagatcttgctccgtcacccaggctggatgcattggtgcaatcatagctcactacaacctcgaattcttgggtcaagtgatcctcccacatcagccttccaag

SEQ ID NO: 137022 - DNA, 601 bp, Human
ctctctcatgcagggctgcagtggaatgagcctcaaagctctacttggtgttgccacattgctccccagaggcgccatagcttcaccttccctcgggactgtgtgagagttctcagttccctccatccttaccaaaacctcacacctggaatcccagcacttagggaggcagaggcaggaggatcgcttgagcccaggagttcaagacctgcctggcaacatggcaacacctcattctccacaaaatggaaaaaaaaaaaaaagagataaaactggatgttagaggagctttacatttttsccagttgctgtatttaagattgctcattttagatttcagagtcctaaaaacaagtgaggataaacatcttttcatgagtttgtcagccatttgagttttctcttctgaaattaccttttcatatgcttttaaaactgggctctttcttacacattcctagggtttcttgatatgttctgaatgctgccttggttggctgtatgaattctgaatactttcttcaggcctcttgtgttttcatttcatttatggtagcttttggcatactacagcttttaaattgtaaagtagaccagtgtg

SEQ ID NO: 137023 - DNA, 601 bp, Human
tacacattcctagggtttcttgatatgttctgaatgctgccttggttggctgtatgaattctgaatactttcttcaggcctcttgtgttttcatttcatttatggtagcttttggcatactacagcttttaaattgtaaagtagaccagtgtgtgttttcttttctagtttgtaccttatgtttcttaatttaaaatattttgccaccccagtgccaaaaaggtattccttctgtattttgtgcagaaagatttacaatttcatgaattctatttgagttcttattccattgcaagtttaygtttggtgtcaggaaggggccctgttctgtctcttccttgtgtatagcccatgtgccccttccctcccaatttacccatgtctgctgaataccaggtgcccttacactgaggatcctatttctaggctcttgttctcttggtctatttaagtaaccctagataaagaccacactgttttaggtagccaaactttatagtatgtcttgaaatctgataggacttacgtttctttaaaattgccttgccttttctgggttttttatttctttgtcttttaactcttaattgtgatatacaac

SEQ ID NO: 137024 - DNA, 601 bp, Human
tcatgccctacacagcttttcccttctctctgtggaggggagaaagggtacatggagcatgaggaggaactggggtgcctcttacccagacttaagtaaccctctacttctctcctccttccacagggcctagaccctctagtccaggggtatctagtcttttgaactcttctgtgacacattggaagaagaattgtcttgggccacacataatatacactaacactgaagatagctgatgagctttaaaaaaattgcaaaaaaatctcctaactttttttcttttttttttttttttttytttttttttttttttgagacagagtctcactgtgtcgcccaggctggagtgcagcggcacaatctcgacttactgtaacctccaccacccaggttcaagcgattcttgtgcttcagcctcctgagtagctgggaccacaggtgtgtgccaccacgcccggctaatttttgtatttttagtagagacgggtttttaccatgttggccaggctggtctcaaactcctgacctcttgtgatccgcccgccttggcctcccaaagtgcagggatgacaggtgtgagccactgcgcccaaccttg

SEQ ID NO: 137025 - DNA, 601 bp, Human
ttataaatggaactaatattggtgaggattttaaatgtctagaaaaatcagtagttgaaaaactgattaaaacactatgtaaataaaaaccaagattttagattgtgtttattctctgataaattgatcgtgtgactgggtcagctgagacatggcagttgttttctgctggtgtctctgtgatggccatctgccaacaaaggtaaccgcagagtcagtacagtgtgaaagtgtttcaataatcagatcttttacggctttttaaaaaatgaagacagtgtcttgacaatcttttaccagmactttgaatactaaatgattagaattttgctagctcttctaattcaataaaaaacaattttgttttactaagttcaattttgtgttgatttgcactgcttagtgttctgcagtgtggtagaggattttgcttattgcctaacactgctatgactaagaaaaataccgtgtgcagtgtctggaggctgctgatttttgagtcgtgtacattttttaaaataatactacatttaaacaatcacattggacgtttttcttctagatgtccggtctgtgctacgacagcaaaatgttccaggtg

SEQ ID NO: 137026 - DNA, 601 bp, Human
cattcttagttttttaaaaaggtaaaaaataaattgcagctgaaagattggtcaaactggacattcttgttccacctatattagataagcatgacttcttagagaaacaccaacctagttaacaagatgtgctatttatctgtttttataatcttgtaaaagccacagtgtcttcctgttaaaatgctaatcatatgctatggagtgaagaacaaatgtaaaatttcttgattttccttggttgaaatgaagagaatatgaaggcaagaagattttcagtggaacaaccaaggagtagataaaaaaaaatgctgtgttttctcaaccttgctatcaataatcagaaattattgcacatttgtctacaaattctgcatccaaacaatctgatactacatttgtcttccatgggcagtgagagaaggagggttagtgcacatcaggctaaaacctcaggcctgatctttcttggacacttctgtgagccagcccacagggctccccatttttcgcctccaccttctttacccctggggtagttgtaaaccgtacagttacctctgccatctctctgtcttccactagcattggatgcaagaag

SEQ ID NO: 137027 - DNA, 601 bp, Human
ttggtaacttggtgggtctccactgctgaccacatgctcactttgtggcctacagacaggcacttcatggtgcagcagcagtttatgcaagtgggattcttggctgtttgcgcacgccctcgctccaggattctacggacccccattgtggttctcctttcctgccttgctgtaaactccgcacggtgtctttccccccagatacttggaacatcacgggatctgccaggttgtacccaggcctcagggaatgagacagacccaaacccctgccctgctggagcgtgcattcccaccaggygcctgtgaagtggcacaggcctttatggctgtctacactgctgtcagactcctccactttcataggatggtctcactaacagatctgaagtccagagcaggacaccagcccctgggctcttgctgggcttttacgttgagtggtctgctgggcagcacagaccagactcttgattttttcctaagcttcctaagttctcttctagggtccgcacatgggtacacccaaacctgagcacttagcctcctgctgaacttcttcactcagctgtgtctcagttttcttcacataagtatgata

SEQ ID NO: 137028 - DNA, 601 bp, Human
tggagcgtgcattcccaccaggcgcctgtgaagtggcacaggcctttatggctgtctacactgctgtcagactcctccactttcataggatggtctcactaacagatctgaagtccagagcaggacaccagcccctgggctcttgctgggcttttacgttgagtggtctgctgggcagcacagaccagactcttgattttttcctaagcttcctaagttctcttctagggtccgcacatgggtacacccaaacctgagcacttagcctcctgctgaacttcttcactcagctgtgtctcarttttcttcacataagtatgataaatcaccacgtagagaactcttttgttaaaccaccactggaaattatctgccgtatttgtgtgcatgcacgagtaccgtacagggtgcagttgtattggaatgtaataccaggagaaaagtttattttcatttacttttcaacaaataagtacttagtgcttattatatggtaggcctagagctggacattgaggacacaggtgtaaaaaagatagcccccagtcctttttcttatggagcttaggtcctgtctctcttgcagaattagcatgtttca

SEQ ID NO: 137029 - DNA, 601 bp, Human
tgaacttcttcactcagctgtgtctcagttttcttcacataagtatgataaatcaccacgtagagaactcttttgttaaaccaccactggaaattatctgccgtatttgtgtgcatgcacgagtaccgtacagggtgcagttgtattggaatgtaataccaggagaaaagtttattttcatttacttttcaacaaataagtacttagtgcttattatatggtaggcctagagctggacattgaggacacaggtgtaaaaaagatagcccccagtcctttttcttatggagcttaggtcctrtctctcttgcagaattagcatgtttcactctttatcagtaagaagaccaccaccatttattttgccagtcctatagtaagtactcagtatatgttatctcatttatgcccggtgtacgcctagagagatgcaggtattccctcatgaccccggaggctcaggggagtgcttgcttgtccaggggcatgcagctgttgatggggatctgggagtgagacccagctgtgtctgactctgaggtctctgtttctgatccctaactcatatacctcccaatatgagagctccttggtgatttgt

SEQ ID NO: 137030 - DNA, 601 bp, Human
gtctgcagtttttcatttcaggtattccaaaataacactcaagtcttgattcagtgttgtatttctttagatttctcttgcctgcttatgccagagttcatcctgccatctggcaggtgctcgctgccaccccctgccacgtgctcctcgtgtggctctgggggcacagttagacagttagactgcttgggaagctctctgaccaatactggtggcttcgctgtgggcacaaaataaatgaagaacatgtcctttccctccgtgagtttgtggccaacttcagggagctcaggcagttgtrgttgaaatagatgagcatccaagaaacaaggaaatatttactgaagcacccatgcagtgaaaatctgaggagagagccactggtgtggactgatgctgccaaaaaagatttcaggaagtagaaggacgggtggaatttggatgggtggagagggtaaggcacatcattccagaggagaggaccagcaagagtgaggcatggaggtgctaatgagaccttaaaaaggagagacctccaggagccctgtgattgacatgtgggcagatatgtagtgagaaatgggaaatgatatagtaactg

SEQ ID NO: 137031 - DNA, 601 bp, Human
aagcccggctctcagaggagtgccttggctgggctgatgctgtactctggatcgagctctccttcctctgttcactccctaaataggttgtttcccaagactcagttctctgcctactgagcttttcacgttagacacccaaggggacccacccagcccctgtcctcaccactttattgagctcatggctcccatgagtccctcaagatctagagactggacctccctctctcctggggctccagaccgaaatatcctactgcctatagtacatctccacttcactgtcccatcagctctygacaggtactgtttctttttttctttctttttttttttttttttttgagacagagtcttgctctgttgcccaggctggagtgcagtggcgtgatcttggctcactgcaacctctgtctcctggcttcaagcaattctcctgcctcagcctcccgagtagctgggattacaggcgctcaccaccacatccggctaatttttgtatttttagtaaagacggggtttcaccatgttggccaggctggtcttgaacccctgacctcatgatccacttgccttggcctcccaaagtgctgggatt

SEQ ID NO: 137032 - DNA, 601 bp, Human
agtacatctccacttcactgtcccatcagctcttgacaggtactgtttctttttttctttctttttttttttttttttttgagacagagtcttgctctgttgcccaggctggagtgcagtggcgtgatcttggctcactgcaacctctgtctcctggcttcaagcaattctcctgcctcagcctcccgagtagctgggattacaggcgctcaccaccacatccggctaatttttgtatttttagtaaagacggggtttcaccatgttggccaggctggtcttgaacccctgacctcatgawccacttgccttggcctcccaaagtgctgggattacaggcgtgagccaccgcacacagccgacatgtactgtttctttgctaaatttgtttccctttctcactccctacctgatgaaaagcacccattgtttacccgaaagtccaaacctagggtttcaccccagacatttcccacttatacatccatgtccttcctgccttccccaccagttcagccccaaagagtctccctccttgatgtaagtccgtcattcatctccagtgctgtagttcaggccaccggcgccatttgcctggatt

SEQ ID NO: 137033 - DNA, 601 bp, Human
catgaggctgtactaggcactaggtttctacaggagtctgtgcaaagagaagaaaaaagaaccctgagcctaaacagtgggtgtggccagttctccctaagggatacagcgagggtaatcttgaggccagcattggggcaggtgtttcagtcacggggggccttatgaaaaaacgcacaggggctcaaaacagctgtggggacagcaaggaattgcattcgcctgagattgaggttcctataagaaagaggcaatgaaagacatggttgggaagagagcagaggccaggacgggtcttctwccaaactaagaattgctgttgtgttcatcctgccagaagtggtggatcagtgaggccttttaaacaggagagtaagttagatttatttttaagaaagctcactttagtcataatatgaacgttgtctgaagggatgacggtaggctggccacagtggctcatgcctgtaatcccagcgctttgggaggccaaggcaggaggatagcatgagcctaggagtttgagaccagcctgggcaacatagtgagacctcttctctacaaaaaaattttttaaatcagctgggcgtggtggcctgtg

SEQ ID NO: 137034 - DNA, 601 bp, Human
ctaggcactaggtttctacaggagtctgtgcaaagagaagaaaaaagaaccctgagcctaaacagtgggtgtggccagttctccctaagggatacagcgagggtaatcttgaggccagcattggggcaggtgtttcagtcacggggggccttatgaaaaaacgcacaggggctcaaaacagctgtggggacagcaaggaattgcattcgcctgagattgaggttcctataagaaagaggcaatgaaagacatggttgggaagagagcagaggccaggacgggtcttctaccaaactaagarttgctgttgtgttcatcctgccagaagtggtggatcagtgaggccttttaaacaggagagtaagttagatttatttttaagaaagctcactttagtcataatatgaacgttgtctgaagggatgacggtaggctggccacagtggctcatgcctgtaatcccagcgctttgggaggccaaggcaggaggatagcatgagcctaggagtttgagaccagcctgggcaacatagtgagacctcttctctacaaaaaaattttttaaatcagctgggcgtggtggcctgtgcctgtagtccca

SEQ ID NO: 137035 - DNA, 601 bp, Human
cctaggtaatccttcgcccacagtgagaagtgtcttttcacatggatgactgatgtccaggctctcctggatagcctcagatgggggctggttaccaggggaactaataagtgattagagggttgagactttcagccccacccccaacctctgtgattagggagaggggttgagttgatcaccaatggccagtgatataatcaattatatctacataatgaagcttccataaaacccccaaaggacagggtttagagaacttccagattgctgaatatgtgctggagcagggtgcaggggstgccagagaggggcaggggccatgccccatgccttgccctgtgcatctcttccatctgactgttcatctgtatcccttgcaatatcctttctaataaatgggtagatgtcagtgtttccctgagttctgtgagccatcctagcaaattaactgaacccaaggagtggaccacgggaaccctcatttatagcacgttggttagaaccgcaggttaggtctggcgattgccatctgaagtaggggagcagtcttgtgggagtgggcccttaacctgtgggctctgatgttatctcctgggag

SEQ ID NO: 137036 - DNA, 601 bp, Human
agcacatctggtgtcagaatattgtgttgagtcgtgtgtgagtgtagaaaggaagaaaacagtgttgtttttcttcagagccatgctcacaatagaaagcagcgtaatataatgaaaagaacaagaatgggcagttagggactcaatcctgggttgacagggacatctatacacaatctgtagaatactgttgtcattggggataaaaaaaattatacaaaattaccttaggtaccagaggctctatcagatattagttattatcatagtattgggcatctgtttttgtggctctcaggargtttgagagagtcctaatttaggagccaaccttgatagttattactcgtaaaagcttgtaacctctagagcaacagtcagcaggtgatggcctgtgggccaaactacctgtttttgtacaatctgaagctaggaacaggttttacattttaaatggttatataggtaactacatagtatctttgatctcttgcctctttatcttccaaacctaaaatgtttaccacctggccctttacagaaaaatatttgccagtccctgctgtagaaggttatatagccagcagctttcaaagtaacc

SEQ ID NO: 137037 - DNA, 601 bp, Human
aaatgtgaattctctcttagttctggtcatctgttatttgtgggagccaatcctctctctgttggctgatgatgagaattctgttatataccacaacacaaacttggggataaaactttccattaggcatttctgtaaaatttccatctattttagaagcagaactaaggtgaagcccagtgtgaatgaatcctgcttgttggtacaagccaagtgggacatttggcagcaaagcccaggagtccttggtgctcttcttttaactgcctcctcatctcattgggctgcccggtgttaactrgttgattatcacctctgtgttttgcctgcaaggaaagaagctactgacacccagagtggctcagcgatactcacacgtgctttcagttactttcgcagcatttggttaaagtgagtttagctgcacatcctcacttggtaacattctgtggctgtgaaaattgtttctctctttatcctcccccagcaacagccatttggtatcatctgagatgtgcaccaggaggcagatctgccctgtcaatcatgagagttcctatcattaatcaagtattttgaattcaataactttttttagtgt

SEQ ID NO: 137038 - DNA, 601 bp, Human
gcccaggagtccttggtgctcttcttttaactgcctcctcatctcattgggctgcccggtgttaactggttgattatcacctctgtgttttgcctgcaaggaaagaagctactgacacccagagtggctcagcgatactcacacgtgctttcagttactttcgcagcatttggttaaagtgagtttagctgcacatcctcacttggtaacattctgtggctgtgaaaattgtttctctctttatcctcccccagcaacagccatttggtatcatctgagatgtgcaccaggaggcagatcygccctgtcaatcatgagagttcctatcattaatcaagtattttgaattcaataactttttttagtgttttaaaagtatttactggtccttgatgtattttttagcagctgatggaattcacataccatataactcaccccctcgaagtgtacagttcggtggtttttagtattttttaattgcacaaataccgtaatttgagaacatttttcatcaccccaaaagaaactgcgccccattagcagtcattcccatccgccctgtcctaggcagccacttaatctactttctgtctctgta

SEQ ID NO: 137039 - DNA, 601 bp, Human
aagtgccactccaccagaccagtttctgtcactgccccttcatcaggccagcttccttaggaagcttcctgttgcctcttggcctcaccagtgctaccattttcattaccgtctattccgcagaatacacgcagtgccaggctctggtgagtcccacagtgaccaaggcagcacgatccctcctctccctgagcttagagtagaaagcgtcagttacagtgaaatgtgatggtcactcttctgggagaaatgtgtagtgcagtcaggaagagtcaagaaattgtgtctggaggcagcaccrtcggaaactctctacctccgtctccacccctgtgtccggggtaggggcagtgcacgtgtgttgcaaaggagtccaccaggaatccaaagggagcgaattctcatgtgtcccgagcatcctcagagacagcaagctggcacgtggcaccctcctcagcacttttcctttttggctatgctctttcactttttggtgcaatttgatttgaaaacgattcttttcaagttgctatgcttccttgtcaacaaagcagtctaatcagttaaagctagttcttttatgactttcttctttcaagag

SEQ ID NO: 137040 - DNA, 601 bp, Human
ttaggaagcttcctgttgcctcttggcctcaccagtgctaccattttcattaccgtctattccgcagaatacacgcagtgccaggctctggtgagtcccacagtgaccaaggcagcacgatccctcctctccctgagcttagagtagaaagcgtcagttacagtgaaatgtgatggtcactcttctgggagaaatgtgtagtgcagtcaggaagagtcaagaaattgtgtctggaggcagcaccgtcggaaactctctacctccgtctccacccctgtgtccggggtaggggcagtgcacktgtgttgcaaaggagtccaccaggaatccaaagggagcgaattctcatgtgtcccgagcatcctcagagacagcaagctggcacgtggcaccctcctcagcacttttcctttttggctatgctctttcactttttggtgcaatttgatttgaaaacgattcttttcaagttgctatgcttccttgtcaacaaagcagtctaatcagttaaagctagttcttttatgactttcttctttcaagagtttataagtatatagcatcagatgtggaataagttactagtgcttagttgataaaa

SEQ ID NO: 137041 - DNA, 601 bp, Human
ctttcttctttcaagagtttataagtatatagcatcagatgtggaataagttactagtgcttagttgataaaaatctgcaaattaaatgaaaattacttgcaagaactctattttcagtgaagttacagctacgctgtttatctcaatctgtacctccttgcagaagctactgctgtgtttccagtgcttttgtagttgatcatactgatctttttgacaaaattcagaacagaaagataggatcaatctaaagtgtgatccttttccaagactgactcattaagtgaccttgagaaaatmatttctattttccatcctgccttggtgtcttcatgagaaaaaagagcgaggtacagtctcatgatacctcagaaaacaagcaaatgatgatgatgtacttggctttttgaagatgtaaaagttatcagtaatcctaattcttttcctgggttttccttttgtcacttattaatcagtttttgaaaggacgaatgaatttagagatgtactctggagcagtatcatgttaaaccaggggtatattagaaaaatcatcctcataatcattctgggaagtttttcctccccaaaaaaaagcca

SEQ ID NO: 137042 - DNA, 601 bp, Human
cttgagaaaatcatttctattttccatcctgccttggtgtcttcatgagaaaaaagagcgaggtacagtctcatgatacctcagaaaacaagcaaatgatgatgatgtacttggctttttgaagatgtaaaagttatcagtaatcctaattcttttcctgggttttccttttgtcacttattaatcagtttttgaaaggacgaatgaatttagagatgtactctggagcagtatcatgttaaaccaggggtatattagaaaaatcatcctcataatcattctgggaagtttttcctccccaaaaaaaagccatcctgatgggttttcaaaaccagaaaaaagctcttaatgaggaacagaccactggagtacccatgagcatctcaggaaaactgagaccctcgagaagccttgatttcgtgcaacccccaaggtttcagagccagcagcccagtgctgtggttgacagacgtggttttgtggagaaagcagccagaggccaggaattttcagagtcgtgagtcacgatctcccacccaagattagagcacagattagccatactgagatttggtaaaatcattctgtctaagcaatggag

SEQ ID NO: 137043 - DNA, 601 bp, Human
tcctcacagagcagccttagcattctcattctctaccaaaaccaaaaccaaaccaaaacacaggaaaaggttgggacacctctggtcctgacggtccctggaggaaaagttccccatgaggagtgatgggtcagtcacgttttcaaaacaaacgagagccaggacgcaggcctgtggctcagcccgcagcgtgcttggtgccacaagcccccccgcagctgcccagagtctcaccccactctgtgcagggggcctggagggcagcggcggcacagacccactggacgccctggtgcatggmtgagccatgtgcatcccatggctctctccagagtcccttccctgcacctccagggcctccccagatggaactggctgggagccgtgctttgttgaaacaaagggaaaacctgtctctcttgggtttgcagctgctgttgaaaccaactgaacctgtttgtaaaattgtacctatgtcacagtaagatcagctgtgctaggtatgtcaggcctctgaaaagaaatgtcattaaagtaaacaagacttgggacacatgtctgtcagactgtacacagtagaagcatcccttgcaggggctgt

SEQ ID NO: 137044 - DNA, 601 bp, Human
tgaaaccgagagctgcaaaactagcctgggactttgttcaagcgatcatctcctttccctctagtttattattttttccaatacctactgagactactgctaagcagcacagaaagatacaatacactgtttttatagcacgacacaaagatcatgggtggcacttcacatgacagggttagattcagtcttctgagttttctaaggttcctatttttaagactttaccaaggaaccaaggctttcaaatatgcagcatggtttcttctgggcctcgcgttgccccatctcttatccaagwggtgaatgtgttgccagtttgtgtgtggttctggtggtgggctttgtttggttttctttttttgggctttgtttggtttttccccagttttgccacaaagcttttgctgaggacagcagcctctgtggtgtcttttctctctgtattgtgctcactcttgtagtcatgcaccacataacaatatgttttggtcaatgacagattgcatgtatgacagtggtctcataagattatgatgccatatttttgctatgtcttttctatgtttagatacacaactaccattgtgttacagctgcc

SEQ ID NO: 137045 - DNA, 601 bp, Human
acagttttaagtctaacaagatgcctctcgttcagtcctgaagtgcttcttgtttagtttttaatgtacgtttgttttgttatctcagccaaactcttttcagggccataggaaattagtcatttctctgtgtcacagcctccttatctggccccaggacagcgcactacgcatagaaggcaaatgagtaaaactaagtgtaagcatattcatacttacaccaaaagctgcagcttccacagagcacagggaattgcaaataactgtcttctatgaggagctgccatttgtggtttcaccrgtttcccagcattgcttctttgtaactcctggttcttgtattagaagaggatgctatgtccatgaagaatgtaggtatcaagcatgtcctttgggagcctccttgctttaacccctctcaccccttccaccccgccttcattagtaacccatcacctgggtcttcatatcccaactaactacagtcttggctaagaaaaccccatacgccttaactcagcaatatgcctcactatgtctttgtccattcagttatccattttgcaactgtttcttgagtgcttgcatatgccaggtcgta

SEQ ID NO: 137046 - DNA, 601 bp, Human
tacatacttatcagggtttctcaacctaaacaccattgacattttgatccagaccattctttgttatagcggctgccctgtacattgtaggatgtttagcaacatccctgacctctacctactaaatgccgacagcaccaccatcctgtcccccctcccctccttcacataacaaccaaaactgtgagcagacattgccaaatatctcctggattgggggtaggagaacagagtcaccatgaccatatatccatctaaaaaagttaaaatagaccagacgcaatggtgcacatctatagtytcagctactcaggaggctgagatggaagattgcttgggtccgggagttcaggactgcagtgcgccatgattgtgcctgtgaatagccactgctctccagtctggacaatgtagcaagaccctcatccccaaaaaaagttaaaatagtatatatactcgtgttctgagtattttttaatttatgtaaatagtattacattttatttatattatttacataaactacatacaatttatgtaaatggtatatgtatatgttgtatatgcatattcttgtacaactttatttgttcattaaaca

SEQ ID NO: 137047 - DNA, 601 bp, Human
ttgttgggctgtgtatttttgcgagtcttgtgggtataaaataacttgttttcatttgcctttccctaacactagtgagattgaatatcttttcatatgtttcttgacttgggatttccccttctgtaaatggagtattcatatacattatctgcttttctcttgagtcacttatttttttctcattgatttataagtgttgtcttataagttcataagtgtcattgatttattaagtctcattgatttgtaacttttgaattttgagcatatagcagttatatgttgtaaacattttctytcaatctgtagtttgtcttatttaattcagtaacaattgaacttttaatacaaaagttcttacaggtaaagtaatttttaaccacttttttcattgtgatttatacttcgtatttctgttttagatatcctttcctatcctaatgacatgaaaataatctcctatttcttcaaaaaaattttcacagtttggctttccacatttaaatctttaatcttagtttttatttttgtgggtggtgtgaagtaagggcctagttttatcttttccctatctatagccagttgtcccaggactgta

SEQ ID NO: 137048 - DNA, 601 bp, Human
ctcctatttcttcaaaaaaattttcacagtttggctttccacatttaaatctttaatcttagtttttatttttgtgggtggtgtgaagtaagggcctagttttatcttttccctatctatagccagttgtcccaggactgtattcagtacgggctcataaccaagtgcccatgtttactgttgattcctagactctgtcttctgtttggattttttgcctaacttccactaataccacatgactttaattactgcagtctaatagtaagtcctaataactggtagagaaatcctttcttayatttcttcaaaatagtcatgcctagttttgagctttaacttcaagtagtctagtcccaccaaaatatacacatgtgcatacttttgaattttgagtatatagcagttagggaataggaataataataggaatctgactccacatgacagataacacaacatagcagaaacttaaccgaggtagtttatttctgtcttgtatagaagtccagcagtgggcagcccaggccggcggggcagtgtcctgaaggtgtcagcccccggctctttgctgctgctgtatcctcagcacagggcttcc

SEQ ID NO: 137049 - DNA, 601 bp, Human
tttaggattattgtatctacccaagaaaaattaactatatattgtataatttttcttgctcataatggccttgtctagttttggaaacagtgttatgctagtcccaaaaaattaggtgggaaactctccttccttttctgtactctagagcagtttatataagataaggagtcattaaagatttcatacacttcacctgtaggtttttggtgggtagatttttaagtactgtttcaattacattaaagtatgatatatatccagaaaagtacatgctatataataatagtcatacaaatgyactttttgtgtttattttgttcaacatcatttgagagattcagccatattgttgcatgtcattctggttcattcattcaaactgctttattagattacagtatgtgaatgcaccataacttacccattctatagttgatgggcatttgggtagttcccgtctttgactgttggaaataatgctgctgagaacgttctagtccatgtcttttgatgaacatgtgtttgaatttcttttattcaggagtggaattgctgagtctcacatatggctcagcttaagtagatggtcctgaacaat

SEQ ID NO: 137050 - DNA, 601 bp, Human
ttttctgtactctagagcagtttatataagataaggagtcattaaagatttcatacacttcacctgtaggtttttggtgggtagatttttaagtactgtttcaattacattaaagtatgatatatatccagaaaagtacatgctatataataatagtcatacaaatgtactttttgtgtttattttgttcaacatcatttgagagattcagccatattgttgcatgtcattctggttcattcattcaaactgctttattagattacagtatgtgaatgcaccataacttacccattctatrgttgatgggcatttgggtagttcccgtctttgactgttggaaataatgctgctgagaacgttctagtccatgtcttttgatgaacatgtgtttgaatttcttttattcaggagtggaattgctgagtctcacatatggctcagcttaagtagatggtcctgaacaattttaaaagataattaccaatgtctgttttctctagaataagttttaataagttatacttttctagaaagttgtctttcatcaaagttattggtatgaataaagtattcttgtgatttttttaaaatctgccat

SEQ ID NO: 137051 - DNA, 601 bp, Human
ggatctagtacacaattactttgtaaatactttaaatgtaatggaaaagaatgtatattctctaaatattaaatgcaaggtatatatgtccattcagaaataaacttgttattttttatattattttttgtctggttgatctatcagttactgagttatatgctgaaaattaaatatatgtctggatgcttccacttctcttgtaattctattaatttttgctttctgtgttttgatgccattgtgttacatataaatatgatattcatgtattctattgattttatccctaatactgccwttttttgccttcgaggtctatttatttggcatgaatgtagcaacaacagctttctttgattagtatttctctgatttttttccatctctttacatcaacttgtgtacgtctttatattttagatttatcttttgtggggaggaggtgagaggtgagagtggcttctgtttccctaattttttttcacatctgttttttctcataataccttattcttttctttaaggtcctcctgtgacgtcctagtctttttgaagtgtgtaatcattttcagatcctcctatattcaggtccttgggg

SEQ ID NO: 137052 - DNA, 601 bp, Human
taaatattaaatgcaaggtatatatgtccattcagaaataaacttgttattttttatattattttttgtctggttgatctatcagttactgagttatatgctgaaaattaaatatatgtctggatgcttccacttctcttgtaattctattaatttttgctttctgtgttttgatgccattgtgttacatataaatatgatattcatgtattctattgattttatccctaatactgcctttttttgccttcgaggtctatttatttggcatgaatgtagcaacaacagctttctttgattrgtatttctctgatttttttccatctctttacatcaacttgtgtacgtctttatattttagatttatcttttgtggggaggaggtgagaggtgagagtggcttctgtttccctaattttttttcacatctgttttttctcataataccttattcttttctttaaggtcctcctgtgacgtcctagtctttttgaagtgtgtaatcattttcagatcctcctatattcaggtccttggggacccagtctcttgtgtgttttgtgtgccgacttgctcatcatgggtgatttccttgtggatt

SEQ ID NO: 137053 - DNA, 601 bp, Human
ttctctgatttttttccatctctttacatcaacttgtgtacgtctttatattttagatttatcttttgtggggaggaggtgagaggtgagagtggcttctgtttccctaattttttttcacatctgttttttctcataataccttattcttttctttaaggtcctcctgtgacgtcctagtctttttgaagtgtgtaatcattttcagatcctcctatattcaggtccttggggacccagtctcttgtgtgttttgtgtgccgacttgctcatcatgggtgatttccttgtggattttgtrgttttgaattctgagtttttccccactggagctttaactataaatcccatgtaaccccaaggcaagagaatatctctccagagtaattttacatttgcttttgcttggctccttcgatatctccatcccaaaaccaatctttatgtaacttttttgatgggttctgagaccatgaatataacaacatatgtatagtataacttgaaccccaaatttgcctgtggttcttaattctcaggcaggaccaagattcctgctgtctccgggggaagacaggctttttagtttgatttttttttc

SEQ ID NO: 137054 - DNA, 601 bp, Human
cttgctcatcatgggtgatttccttgtggattttgtggttttgaattctgagtttttccccactggagctttaactataaatcccatgtaaccccaaggcaagagaatatctctccagagtaattttacatttgcttttgcttggctccttcgatatctccatcccaaaaccaatctttatgtaacttttttgatgggttctgagaccatgaatataacaacatatgtatagtataacttgaaccccaaatttgcctgtggttcttaattctcaggcaggaccaagattcctgctgtctcygggggaagacaggctttttagtttgatttttttttcatccctttcgctgagggtgctgccatttgaagattgtatctttagacagataattgagctcaaaattgctgcctctttcagacccaaggccgcatcttccgaactcaaacagtgatagaacccaagtggtcctgggtgagcagggcctctgctcccccgtctcccaggctgctcacagtgtgcggctctgcttcccacgcccacttgttcctgaggccttgcaactccacttacttctttcatatttagctgtgtatagaaata

SEQ ID NO: 137055 - DNA, 601 bp, Human
ggattttgtggttttgaattctgagtttttccccactggagctttaactataaatcccatgtaaccccaaggcaagagaatatctctccagagtaattttacatttgcttttgcttggctccttcgatatctccatcccaaaaccaatctttatgtaacttttttgatgggttctgagaccatgaatataacaacatatgtatagtataacttgaaccccaaatttgcctgtggttcttaattctcaggcaggaccaagattcctgctgtctccgggggaagacaggctttttagtttgatttttttttcatccctttcgctgagggtgctgccatttgaagattgtatctttagacagataattgagctcaaaattgctgcctctttcagacccaaggccgcatcttccgaactcaaacagtgatagaacccaagtggtcctgggtgagcagggcctctgctcccccgtctcccaggctgctcacagtgtgcggctctgcttcccacgcccacttgttcctgaggccttgcaactccacttacttctttcatatttagctgtgtatagaaatatttatctattaatagcatttttaggtg

SEQ ID NO: 137056 - DNA, 601 bp, Human
gtaattttacatttgcttttgcttggctccttcgatatctccatcccaaaaccaatctttatgtaacttttttgatgggttctgagaccatgaatataacaacatatgtatagtataacttgaaccccaaatttgcctgtggttcttaattctcaggcaggaccaagattcctgctgtctccgggggaagacaggctttttagtttgatttttttttcatccctttcgctgagggtgctgccatttgaagattgtatctttagacagataattgagctcaaaattgctgcctctttcagayccaaggccgcatcttccgaactcaaacagtgatagaacccaagtggtcctgggtgagcagggcctctgctcccccgtctcccaggctgctcacagtgtgcggctctgcttcccacgcccacttgttcctgaggccttgcaactccacttacttctttcatatttagctgtgtatagaaatatttatctattaatagcatttttaggtgtttgtagtaggaagagtttcagatcttagtctataattttgtcaggactagaagacttctagaaatagagatttaaattaataaattcaaag

SEQ ID NO: 137057 - DNA, 601 bp, Human
tttttagtttgatttttttttcatccctttcgctgagggtgctgccatttgaagattgtatctttagacagataattgagctcaaaattgctgcctctttcagacccaaggccgcatcttccgaactcaaacagtgatagaacccaagtggtcctgggtgagcagggcctctgctcccccgtctcccaggctgctcacagtgtgcggctctgcttcccacgcccacttgttcctgaggccttgcaactccacttacttctttcatatttagctgtgtatagaaatatttatctattaatarcatttttaggtgtttgtagtaggaagagtttcagatcttagtctataattttgtcaggactagaagacttctagaaatagagatttaaattaataaattcaaagattgccatatagctagaaacatggatttttttaaagcagcatgtgatgcatttttcttcccatggtggcttcttttttgttggtgacatagactaagccaggaacggcattgctgtcagtcttcaggatccgtggagccaccctcagaaagatggttactgatgctcacttctcacctttttgctgtttgtcagat

SEQ ID NO: 137058 - DNA, 601 bp, Human
ggtgacgggcgcctgtagtcccacctacttgggaggctgaggacaggagaatggtgtgaacccgagaggcagagcttgcagtgagctgagatcacgccactgcactccagcctgggtgacagagcaagactctgtctcaaaataataataataagtatatccattattccatctctctcttttttattgtttttttttttttttttaaacaggtatctttatactactatgacccatactcaaaattaacaaatgattaaatttttctcatatttgcttctgatttttttaaaaccaaagrgggaaaaactcatcaagtgtatctcttctgaccctcccaaagcttagaaaatgactgttaggtaaaatcagacaagaaagttaaataagactagaccaaagctgggatttaacaaaaggaagatgagcaaatttcagcttcctctcttcgattcatgtctttctttcctttagctgacagtgaccagctgtctgctctgcaccggggctaagcgctgtgctgaattctgaaaacactaagatggataaggcggaatgtcctgccctgaggagctgtgagcccagggcagggaaacaggtg

SEQ ID NO: 137059 - DNA, 601 bp, Human
ccattgcctccactcacgccagaacaagtgtctatcctagcacagtcttttccagagtctcagtgtcctaccagcattctcattttgtcctccacatgtttattggtcacttttgatcttcacattcagccttctctaactggtgctgggcaccgggtgtgtcaggctctgtgttggggggaagcaagccaggcctggtgccagccctcaagggagctcaccgtctatgagggagaccagatccatgcaaggccctaacccagtacccaactcatgcaagtacctagtgccagtccttagmgcagaggagacctgtaaacattcattcctgtactttaacaacttgacatcaggagattttacattgaaactttctcttcctgtggatgttagatcggatcaggtgctcatggtgagttctgatgcttctcatcccagtagctggactacagagacaggaagcagcctgcagagaaaatgaagtagtccagggtttcagtgtgagttaatgtgtgttgtggctaaaatgtggtgctttcgatagggagagagatgggctgaccatctataataccattatttatatagtcatcagagttgt

SEQ ID NO: 137060 - DNA, 601 bp, Human
ctctgaaactacataaagaaaggacagcaggggccacttggctaacttgcacggctgtgagcactgcactgcacccctccactggggagtattgggtaagcacccatcggaacacctatcccctgacccttctcgtccttgctggctggttgtcatcgcatacccaagcccaagcatgcagtttcagtttgccatggatgtttagttttggacactatgggaaaccttcaggtgccctttcttagtgtaattgtttattctttttaaagaactgtgctaacattattgctacttagcaatwgtttttaatctggtgaaaataacaggtcagtgggcagtgaaagttctcctgtcacacttgtcttctcacccataaaaatcacttaaagctctgaagccagctttggctaaaggggcatgatctgccccgcagaggatgaagagcgagcccgctgcaagctgtgacagcagacgctctcttctgccaagacctgtgaaaagccagtcttagttgtcaaaaccagcaccgcggcacatgtcgttcatgtctgagagaatgaactcagaaggaagtctcgtgtacatagaaagctttcgttct

SEQ ID NO: 137061 - DNA, 601 bp, Human
ttcatcactccagattatgaatcgtcatttgccagatctccaaattgctgagtgtggacagcagatggattcgtttgtgctggctgggtgcaaagaagcagccagtcctcagctgcacttgaagtactacaggtagtagtaaaggtagcttttccaagccgtttaaataaacgtcattaagagtggccaagttgtttgggggccatggcatcatggtggtggatagtaggtggaaggaaggcaggccagctcccgtttggcctgagttatctccaccaatgacaatggtccttaactggarggaacatcatacaggttatttccacccaagattggaaagaccaccttgatcagagagagttttccttccacatgacacatatccagcctgagtcctccagcccctctccctgcacaacctgatggaggcttgagaaagcacagggaggaacacttagcttgaaaatgttcctaaggaaaaggaaagtgtgaattctgagaaccaagtggcagaattgaagtttcacgtctggcaaaagcttaaacagattattatcaaatagatggtttgtgaacgttgaaaagacagctgtggtctagg

SEQ ID NO: 137062 - DNA, 601 bp, Human
agggagcccaggacagaaggcagtggggcaatgaggacttcgctctgggggccttctagtctgggagacatggaaaaaggcaggggccccaagacccaccaggggaagaggagtcatcaggctcagggcagagggcagagacagcaacacagcagaacaagccacggtacccacaggcctgggtgggggccgagaaaagccagtgggttgagggaggaaggagagggctgtcacacccgcaaagtgctttatgtaggaaaagagaatagggttgttctcggttacttcaaagggcaaaatsaagagctgtggcattgtgtggatggcagcttgtgaggggcagaacaccagggtggcagcattctcagccacctggcagtgaggccagggcactcagccacagctgatgtgcatatgatgcattagtagtgtgcatgtgtgtgtgtgtgcctgtgcacgctcttgtgtaaggagctgcatcactggtgtggccagttaagctgggcctgctgaaaacactcaggaattttcacataaaatgctctcgagtcaggtctctcaaatcctgcctgaccttttaagtctaggacagtacatatct

SEQ ID NO: 137063 - DNA, 601 bp, Human
gtgcgtcagtccccgtgctaagggttgaaagcaacgttccggggaggagcacgctcactgcgtgcatttgtaagcctagtcctcacccactgagtggtcccatgacatgggcggcaccccccgtttggaaaagccctggctggactccagcttctgagcagtgtccactgcgtgtccctgttggccctcaactcttccctaaggcttttgggggaggagggtctgggtgtctgggcctgggtggtcactgggaggttccctcccccacctgcctctctactctctgcaccttcttcctcaycttgctgagtccttaggttaattttgctcacaatatccagagttagccactaggctgcgggtgaagtgggatagagaggaagaacagcaggctttctggagccacatgcccaggcccatgcccggcccctcctccagccaccccatgccatagtccccattcacacccactgagtcccctgagcagaggaagggtggtgatactgggccccttctctttccaccatgtagcaccgagtagctcgctctctttcggaaagaaaaattggaaactctgactaagtcctcaggtgaacccaca

SEQ ID NO: 137064 - DNA, 601 bp, Human
caacgttccggggaggagcacgctcactgcgtgcatttgtaagcctagtcctcacccactgagtggtcccatgacatgggcggcaccccccgtttggaaaagccctggctggactccagcttctgagcagtgtccactgcgtgtccctgttggccctcaactcttccctaaggcttttgggggaggagggtctgggtgtctgggcctgggtggtcactgggaggttccctcccccacctgcctctctactctctgcaccttcttcctcaccttgctgagtccttaggttaattttgctcasaatatccagagttagccactaggctgcgggtgaagtgggatagagaggaagaacagcaggctttctggagccacatgcccaggcccatgcccggcccctcctccagccaccccatgccatagtccccattcacacccactgagtcccctgagcagaggaagggtggtgatactgggccccttctctttccaccatgtagcaccgagtagctcgctctctttcggaaagaaaaattggaaactctgactaagtcctcaggtgaacccacaaaagcctctttaatgcgcaagtggctaaaaa

SEQ ID NO: 137065 - DNA, 601 bp, Human
tcttccctaaggcttttgggggaggagggtctgggtgtctgggcctgggtggtcactgggaggttccctcccccacctgcctctctactctctgcaccttcttcctcaccttgctgagtccttaggttaattttgctcacaatatccagagttagccactaggctgcgggtgaagtgggatagagaggaagaacagcaggctttctggagccacatgcccaggcccatgcccggcccctcctccagccaccccatgccatagtccccattcacacccactgagtcccctgagcagaggaagggtggtgatactgggccccttctctttccaccatgtagcaccgagtagctcgctctctttcggaaagaaaaattggaaactctgactaagtcctcaggtgaacccacaaaagcctctttaatgcgcaagtggctaaaaaactcaacatgtacaagactgttgactttgatgaggtgttactgcaagtgcagtttattttaatataagtacaaaaaaatgtattcctgtggcaatctggggccatgaatatttttgtaatatattcttaattgggaaaaaaggttgcaaataagctttagt

SEQ ID NO: 137066 - DNA, 601 bp, Human
cctgggtggtcactgggaggttccctcccccacctgcctctctactctctgcaccttcttcctcaccttgctgagtccttaggttaattttgctcacaatatccagagttagccactaggctgcgggtgaagtgggatagagaggaagaacagcaggctttctggagccacatgcccaggcccatgcccggcccctcctccagccaccccatgccatagtccccattcacacccactgagtcccctgagcagaggaagggtggtgatactgggccccttctctttccaccatgtagcaccragtagctcgctctctttcggaaagaaaaattggaaactctgactaagtcctcaggtgaacccacaaaagcctctttaatgcgcaagtggctaaaaaactcaacatgtacaagactgttgactttgatgaggtgttactgcaagtgcagtttattttaatataagtacaaaaaaatgtattcctgtggcaatctggggccatgaatatttttgtaatatattcttaattgggaaaaaaggttgcaaataagctttagtaacattgccaatttcaatactggagactgcctgtagagaaaag

SEQ ID NO: 137067 - DNA, 601 bp, Human
cacatgcccaggcccatgcccggcccctcctccagccaccccatgccatagtccccattcacacccactgagtcccctgagcagaggaagggtggtgatactgggccccttctctttccaccatgtagcaccgagtagctcgctctctttcggaaagaaaaattggaaactctgactaagtcctcaggtgaacccacaaaagcctctttaatgcgcaagtggctaaaaaactcaacatgtacaagactgttgactttgatgaggtgttactgcaagtgcagtttattttaatataagtacaaaaaaatgtattcctgtggcaatctggggccatgaatatttttgtaatatattcttaattgggaaaaaaggttgcaaataagctttagtaacattgccaatttcaatactggagactgcctgtagagaaaagtacaggaaatctccgtattcacagaatcaggatttgtggtcaaaaacaatgcatgcctgttcctccctgcttctggtggctttcactgcctccttcctcagttgctgccccaggctcagccccactttgctgcctgcgtaagccccaggctgcgagtggcacagctgt

SEQ ID NO: 137068 - DNA, 601 bp, Human
gaacccacaaaagcctctttaatgcgcaagtggctaaaaaactcaacatgtacaagactgttgactttgatgaggtgttactgcaagtgcagtttattttaatataagtacaaaaaaatgtattcctgtggcaatctggggccatgaatatttttgtaatatattcttaattgggaaaaaaggttgcaaataagctttagtaacattgccaatttcaatactggagactgcctgtagagaaaagtacaggaaatctccgtattcacagaatcaggatttgtggtcaaaaacaatgcatgcytgttcctccctgcttctggtggctttcactgcctccttcctcagttgctgccccaggctcagccccactttgctgcctgcgtaagccccaggctgcgagtggcacagctgtcaaagtagtctgagcacccaaaggcaggcagttctgtggcagtgacgccaggagtgcgatgccagggccgagcatggcagtgacgccaggagtgtgatgccagggctgagcgtggcagtgacgccaggagtgtgatgccagggctgagcgtggcagtgacgccaggagtgtgatgccagggccgagcgt

SEQ ID NO: 137069 - DNA, 601 bp, Human
tttaatataagtacaaaaaaatgtattcctgtggcaatctggggccatgaatatttttgtaatatattcttaattgggaaaaaaggttgcaaataagctttagtaacattgccaatttcaatactggagactgcctgtagagaaaagtacaggaaatctccgtattcacagaatcaggatttgtggtcaaaaacaatgcatgcctgttcctccctgcttctggtggctttcactgcctccttcctcagttgctgccccaggctcagccccactttgctgcctgcgtaagccccaggctgcragtggcacagctgtcaaagtagtctgagcacccaaaggcaggcagttctgtggcagtgacgccaggagtgcgatgccagggccgagcatggcagtgacgccaggagtgtgatgccagggctgagcgtggcagtgacgccaggagtgtgatgccagggctgagcgtggcagtgacgccaggagtgtgatgccagggccgagcgtggcagtgacgccaggagtgcgatgccagggccgagcgtggcagtgacgccaggagtgcgatgccagggctgagcatgggtcaccaccatagggaatc

SEQ ID NO: 137070 - DNA, 601 bp, Human
aaggttgcaaataagctttagtaacattgccaatttcaatactggagactgcctgtagagaaaagtacaggaaatctccgtattcacagaatcaggatttgtggtcaaaaacaatgcatgcctgttcctccctgcttctggtggctttcactgcctccttcctcagttgctgccccaggctcagccccactttgctgcctgcgtaagccccaggctgcgagtggcacagctgtcaaagtagtctgagcacccaaaggcaggcagttctgtggcagtgacgccaggagtgcgatgccagggycgagcatggcagtgacgccaggagtgtgatgccagggctgagcgtggcagtgacgccaggagtgtgatgccagggctgagcgtggcagtgacgccaggagtgtgatgccagggccgagcgtggcagtgacgccaggagtgcgatgccagggccgagcgtggcagtgacgccaggagtgcgatgccagggctgagcatgggtcaccaccatagggaatcaaacgacgctgagtcgtgtgtcctcgcagtgagcctgggcagctcatgccgacctgcttccaaggcctggtcccagtaggcc

SEQ ID NO: 137071 - DNA, 601 bp, Human
tactgtaacatgtcatctcctgcgtcgtgatggggagagggtaatgttacttcacaaaggacatgtcagatccttcttcatggacttttttagttactgttttttctctcaaacttgttttcgaatctcctgggagtgagggagaaacagggagctgaatcctcccccaagctgttccaggccagaggactctgcagtaccttctcctacatctagtaacaaagaatggtgataaccatgcactggttcaaggttctggagttctccatgaaacttgggttaattttgctcagagtatccrgagttagccactaggctgcgggtgaaatgggatggagaagaacaacagcaggcttcctggagccacatgggctgactagggcactctgtggctggcctggcatgggctcagcccaggaagaggagaaacgatcccttgcctgcccctccctgtggcagggctaactgcctggccctcctggctcgcagccagccagccccctggcagcaggttctcctcagggcttgggtcttcaacctgtggcgacaggaggcagggcagactgtggaggacaggatgcaggtcagggagagggaaggc

SEQ ID NO: 137072 - DNA, 601 bp, Human
gggtaatgttacttcacaaaggacatgtcagatccttcttcatggacttttttagttactgttttttctctcaaacttgttttcgaatctcctgggagtgagggagaaacagggagctgaatcctcccccaagctgttccaggccagaggactctgcagtaccttctcctacatctagtaacaaagaatggtgataaccatgcactggttcaaggttctggagttctccatgaaacttgggttaattttgctcagagtatccagagttagccactaggctgcgggtgaaatgggatggagwagaacaacagcaggcttcctggagccacatgggctgactagggcactctgtggctggcctggcatgggctcagcccaggaagaggagaaacgatcccttgcctgcccctccctgtggcagggctaactgcctggccctcctggctcgcagccagccagccccctggcagcaggttctcctcagggcttgggtcttcaacctgtggcgacaggaggcagggcagactgtggaggacaggatgcaggtcagggagagggaaggcaggggtggaccgccatgagcatgaaaagacccgaagca

SEQ ID NO: 137073 - DNA, 601 bp, Human
ttctctcaaacttgttttcgaatctcctgggagtgagggagaaacagggagctgaatcctcccccaagctgttccaggccagaggactctgcagtaccttctcctacatctagtaacaaagaatggtgataaccatgcactggttcaaggttctggagttctccatgaaacttgggttaattttgctcagagtatccagagttagccactaggctgcgggtgaaatgggatggagaagaacaacagcaggcttcctggagccacatgggctgactagggcactctgtggctggcctggcaygggctcagcccaggaagaggagaaacgatcccttgcctgcccctccctgtggcagggctaactgcctggccctcctggctcgcagccagccagccccctggcagcaggttctcctcagggcttgggtcttcaacctgtggcgacaggaggcagggcagactgtggaggacaggatgcaggtcagggagagggaaggcaggggtggaccgccatgagcatgaaaagacccgaagcaagttgactcttgcaatgtgcaactgttatgttctgcaaaatgagcaacgatgtatcaaattgatg

SEQ ID NO: 137074 - DNA, 601 bp, Human
catcttccaatcatctcttgccccatgaagtcacttttcttccccgccacgccccctttatcttccagtcttttaaagctggacatttagttgctgttgtatcaaagaaagctcagtttaatagttcccacgccattctttgcaatctatagcaatttaagttccttctgggtgttggaggttgggggttggggagggaggagggaacatctcccagccactcagaagagtaagtgctaccaggtataaacttttgatctgctcaggtgtgccttattttaccctgtttttttttttttttcattctcaacagctcatttcttttttactgctctcctagtttatcatactccctttacctccactatcttccttctcatcaccaaggaacaattcaccgtgttcttaaaaatattggtttttggttttcaaagcttgtagcaaattccctggacaaagagacatcctctgtcttgctctctatcttagggaggaaacatttgatctttcaccattaaatatgttagctttaggtttttggtaaatattttttaaatcaggctaaggaagttcctcttttccccctagtttgctgagagtt

SEQ ID NO: 137075 - DNA, 601 bp, Human
taaacttttgatctgctcaggtgtgccttattttaccctgtttttttttttttttcattctcaacagctcatttcttttttactgctctcctagtttatcatactccctttacctccactatcttccttctcatcaccaaggaacaattcaccgtgttcttaaaaatattggtttttggttttcaaagcttgtagcaaattccctggacaaagagacatcctctgtcttgctctctatcttagggaggaaacatttgatctttcaccattaaatatgttagctttaggtttttggtaaatrttttttaaatcaggctaaggaagttcctcttttccccctagtttgctgagagtttttcttatgaatctatgttaacttttcgcaaatgatttttctgcatctcttgagatgatcatttaaggaagaaataataccaattctacataaacataaaagaggggagacggccaggcgcggtggctcacgcctgtaatcctagcactggcgctctgggaggctgaggtgggcggatcacctgaggtcaggagttcgagaccagtctggctggtgaaaccccgtctctgctaaaaatacaaaaat

SEQ ID NO: 137076 - DNA, 601 bp, Human
atcacctgaggtcaggagttcgagaccagtctggctggtgaaaccccgtctctgctaaaaatacaaaaattagacgggcgtggtgatacactcctgtaatcccgggtacttgggaggctgaggcaggagaatcgcttgaacccgggaggcggaggttgcattgagccgagattgtgccactgcactccagcctggatgacagagcaagactctgtctcaaaaaaaaaaaaaaaagacacttcctaactcattttatgctagcattatcctgacgccaaactagacaattcatattaagaaractgcaaatcagtatcccttatgaacatggatgtaagaaatcctctacaaaatattagcaaatagaatgcagcaataaatatataaaaagtaacatatgaccaagagcagtttatcctggtgttgcaaagctggttcaccattcaaaaatcaatgtaattaaccatatcaatagactaaaaaacaaaactttttagatgatgttgattgttttaacaaactaagtttgtgtaagtaggaacttacgtcctgtgattcagctgctagtggaccttgtttctagggtgtcttgaaaaactat

SEQ ID NO: 137077 - DNA, 601 bp, Human
gacaattcatattaagaaaactgcaaatcagtatcccttatgaacatggatgtaagaaatcctctacaaaatattagcaaatagaatgcagcaataaatatataaaaagtaacatatgaccaagagcagtttatcctggtgttgcaaagctggttcaccattcaaaaatcaatgtaattaaccatatcaatagactaaaaaacaaaactttttagatgatgttgattgttttaacaaactaagtttgtgtaagtaggaacttacgtcctgtgattcagctgctagtggaccttgtttctarggtgtcttgaaaaactatcaaacacattaatattttaggggcaccttttttaataccagtaatctgaacaggagctggtgattctttggtgattaaaatattcatggttttctgcttttcaatccagttgaaagacagtaaacaagcaaacaagtcattagcatttattataagtacaataagaaaaagaacatagtgctttgatagagaccatcagggaaaatgtaatacatggaatagtgacaggagacctttctgagatgatataaacagacaaacaatgttatttagtatatgatt

SEQ ID NO: 137078 - DNA, 601 bp, Human
gaaagacagtaaacaagcaaacaagtcattagcatttattataagtacaataagaaaaagaacatagtgctttgatagagaccatcagggaaaatgtaatacatggaatagtgacaggagacctttctgagatgatataaacagacaaacaatgttatttagtatatgattgtacactatatctggcatgctttggcatgatttagtttgttttaaattgattttttaaagaaataatgtgcttttagtgggagaatgggcaagtatgtaagaaacggttataactaaaaattttgtggtygtttctttattctctatgttttagtggcagaaccaagaatagaagatggatagaaatttagttaactgacttagaatttggagaatgaataaaccctaacagcaatatccatcccactctcttttatttcctcaacctaatggaatggtaggatcttgaactcactctgttaccatctggtaattgcatgtgttgttattataatcaatgtgagcaaatactgctttaggctctgatgatgcctagtgttgtataagaatggccatcacatgtctactatatgcagatgagtattaattg

SEQ ID NO: 137079 - DNA, 601 bp, Human
cactgccattttctcatttaactaatagttattctacttctacatttagcagttaatactagtttactggcagtaatatcaagtaattgctaggtaagtataattttacatcataattcaaatcattaataaattagtaacaaggcagaatctctggctgccctgaacagaccattaaagaccagaggaagtggctttaagaacaaatttgaaaggaaagtgaattttatctatttttttaatttataaaatcagagtttttgttatttgactgtcacctaaagaatgaggaagaatttgytataatttagggacaggaacgaacaggtttttaagactcgtttgtgtgtctaggtttttaagtctagtttgtatgcaaaaacctggagggaagagatggttatagacagtttgaaaactctcaggagttcattgtggccaagttagagaataaagtaccaaaaagatactctgggcagagagaaatgaagctggaaaagtaaataggtgccatagtgttcagatccttgcatgtgagttctggcaggtggcctcgaaaaagcacttaacctcccagacgtagttttcttattggctggta

SEQ ID NO: 137080 - DNA, 601 bp, Human
cagagagaaatgaagctggaaaagtaaataggtgccatagtgttcagatccttgcatgtgagttctggcaggtggcctcgaaaaagcacttaacctcccagacgtagttttcttattggctggtaaaaggatacactgggttgagtgcagtggttcacagctagtgagcactttgggaggccggggccagaggattgcttgagtgtaggatttcagaccagcttgggcaacatagtgagacgtctctactaaaaaataaaaaaatttagctggctgtgatgatgtatgcctgtagtctcarctatctgggaggctgaggcaggaggattccttcagctcaggaattagaggttgcagtgagctgtgattgttgtcactgcactccagcctgggcaatggagcaagaccctgtctgaaaaaaaaaaaggaagataaaatgaaacctgccttgccatggcagtagaggtgaagtgggtactgctcctagctcctcacatacaagggtctcaaaacatatttacaaataattttaaatattctttatctagtgaaaaatttgtcattggaccatagaataaaaagaataagttgactgaagatt

SEQ ID NO: 137081 - DNA, 601 bp, Human
gtctgaaaaaaaaaaaggaagataaaatgaaacctgccttgccatggcagtagaggtgaagtgggtactgctcctagctcctcacatacaagggtctcaaaacatatttacaaataattttaaatattctttatctagtgaaaaatttgtcattggaccatagaataaaaagaataagttgactgaagattttttaacagccaaatactataatttattaattatttttctcaattggccaaaattttagaggcattgtgaaaatttgttgagttagtcagaggtttttttggttattttrttactcaatatttaagtttgaaaagccagaagactggtgatagaggttatgaaaccttttatcctgcttgatgtaaatgggatgcttctaattaactgtgtagagatggctttgcaaatgcatgtatagataattatctttgtgagcagtctggaaaaatatttttggtatagttttaagaccatcattttgtgttttctcccagttttgtaaatttaaatagaatacatatgtgtatcagttctatagatttgtaacttacagctacatataattattgtaaaactaatgcttttataa

SEQ ID NO: 137082 - DNA, 601 bp, Human
tgatagaggttatgaaaccttttatcctgcttgatgtaaatgggatgcttctaattaactgtgtagagatggctttgcaaatgcatgtatagataattatctttgtgagcagtctggaaaaatatttttggtatagttttaagaccatcattttgtgttttctcccagttttgtaaatttaaatagaatacatatgtgtatcagttctatagatttgtaacttacagctacatataattattgtaaaactaatgcttttataaaatactagaaaatagaaaggtggattcacaccacccargctaactgctaacattttagaaaatttccttcctatctttctgtatttgcatatgatcatttcaaacacagggttttttttttttaattgtaaaagtaggacattttaatgattttttttttttgaagacgtgagtggtaaaagttgaccctcttctctaccctttctccatttcccagaggtagtctttatagctgcttttattctttgtattcagatagcttctggtgagcctgactcatggcaatctggagtcaggatctaacaatatattcagtagatattagttgcattgaattt

SEQ ID NO: 137083 - DNA, 601 bp, Human
tttttggtatagttttaagaccatcattttgtgttttctcccagttttgtaaatttaaatagaatacatatgtgtatcagttctatagatttgtaacttacagctacatataattattgtaaaactaatgcttttataaaatactagaaaatagaaaggtggattcacaccacccaagctaactgctaacattttagaaaatttccttcctatctttctgtatttgcatatgatcatttcaaacacagggttttttttttttaattgtaaaagtaggacattttaatgattttttttttttgaagacgtgagtggtaaaagttgaccctcttctctaccctttctccatttcccagaggtagtctttatagctgcttttattctttgtattcagatagcttctggtgagcctgactcatggcaatctggagtcaggatctaacaatatattcagtagatattagttgcattgaatttctttatatctatctcatttaattgttgatatgagtaagaagttaaaaagcatgattctggttaaaatttaatcaagttatgattttatctactattggatcattcattatgtcctcagtttgat

SEQ ID NO: 137084 - DNA, 601 bp, Human
gcttttattctttgtattcagatagcttctggtgagcctgactcatggcaatctggagtcaggatctaacaatatattcagtagatattagttgcattgaatttctttatatctatctcatttaattgttgatatgagtaagaagttaaaaagcatgattctggttaaaatttaatcaagttatgattttatctactattggatcattcattatgtcctcagtttgatactaattggtatcactacagtggctgcgtttggttcctagtactttttgtacttgttagctttggctgacatrgagtagatttgcagtgaactgatttacagtacttgctgattttgtccagacctttcactaaaatattctaactgtgacttttagtttgcagcacagatgtaaaattgctctgttgtatgtaccatcgtgttttataactttataacaggatgactttgtgggtacataaaattaacaaataaatttaaattctcttatcagggttcatgatacttttccttaaaaggcaatttaggtagtcttctgatttgattaatgaatgctagggttttagattaggagccaaaggtatcttttcta

SEQ ID NO: 137085 - DNA, 601 bp, Human
taaaatattctaactgtgacttttagtttgcagcacagatgtaaaattgctctgttgtatgtaccatcgtgttttataactttataacaggatgactttgtgggtacataaaattaacaaataaatttaaattctcttatcagggttcatgatacttttccttaaaaggcaatttaggtagtcttctgatttgattaatgaatgctagggttttagattaggagccaaaggtatcttttctacttcttttcctcattatacagaggcttcactgatgtatatagacatacagatggctagkttatctactaaagtagagatgtaatctttagtcagttctagaaatataccttgggtgtctgtgattcagccatgtacagtgctaggcaatgagattaaaaacattgaataagacacagttttttcccttgacttggcagttaatttttatcctttttggtttttagatagaattgaatactgaaaaagcatagactaggaagcttgcaggaagtggagaaaggagcaggaagtagttcgaagtgctttagtgaactataaatagaaccaagtaagaatggatataatgtagaggagccca

SEQ ID NO: 137086 - DNA, 601 bp, Human
tagcaagtagattatcttctacaagcagagaaatgaagggataaggatagttgccctttaaacaggaaggtcttgtcttacaaaactcaaatgcatgtgagatgaatagcactgtttatatacgtgtcatggcttccactggttttgcaagacctcatttgatgatctaagtacatgtgatcattcttcagggagaaatgcctatggcaccttttttgtttgtttttaatttcaaaatttcagatgttagaccagcaaatactataatgtgttcttgaggtaagatatagtgatgcatttytaatatgatttttgtttcctctattccttttttctatcatctaaaacttattttgtaatgatgtacttaaaaagttatcagcttctttcgatataaagttattaattgtgaaaatgacattctcattttttctctatgtgatagattaaggtctgacattttattttcctgtgacatcttaagaattgtaaaaaaaacactaattttttgttacagttattttgccagatataagagaggcaatgaagttaagtaggtttcattgtgtagtagaggccaggaagccagtagtttacttcc

SEQ ID NO: 137087 - DNA, 601 bp, Human
tcaatatatatatatataaggaatcttctttgcttattttaagttggtaggggaaactgataatgtaggttacattattttcaaaataaacttgaatgggaatcactaagcttaaatatattttaattggcagctttagggtgtgttggggattataaatagctgttctttgagctctgtatttaaattcaagtctacatattttagtctttttttctagaatgacatatctgtatgtttctgtgtgtgtgtatatatgtatacgtatacatacgtatacatatatacatacgtatatacrtatacatatatacacacacatgcacatatatatgtatagtggagccagaacttttaagtgcattttataatagattttgaggctatatccttctgatttttatttttaaaattagaaacagtaggatgattgcagtagttatgaaaaatgaagaagtaaatgggaagatgtgagagaaatatgttgatgatttgtcatatttgtgctcaggtcatcctattcttcaggactaaatggagccaaatcccacaggatttaagactttgcttagtcctggaaattcctggatcattttcttta

SEQ ID NO: 137088 - DNA, 601 bp, Human
tcaaaataaacttgaatgggaatcactaagcttaaatatattttaattggcagctttagggtgtgttggggattataaatagctgttctttgagctctgtatttaaattcaagtctacatattttagtctttttttctagaatgacatatctgtatgtttctgtgtgtgtgtatatatgtatacgtatacatacgtatacatatatacatacgtatatacgtatacatatatacacacacatgcacatatatatgtatagtggagccagaacttttaagtgcattttataatagattttgmggctatatccttctgatttttatttttaaaattagaaacagtaggatgattgcagtagttatgaaaaatgaagaagtaaatgggaagatgtgagagaaatatgttgatgatttgtcatatttgtgctcaggtcatcctattcttcaggactaaatggagccaaatcccacaggatttaagactttgcttagtcctggaaattcctggatcattttctttatgctataacaaattagcctcaattcaagataaattaaataacattgaaaattttttctcttctacttaagggttctacaa

SEQ ID NO: 137089 - DNA, 601 bp, Human
ggattgggtacattcagggtactatggtcatagactataccatgtttttatccatttagccatctatggacatttggtttgtttccatatcttggctatcctgagtaatgctgcagtgaacatggaagtgcagatatctttttttttttttgagacggagtctcgctctgttgcccaggctggagtgcagtggtgcgatctcggctcactgcaagctctgcctcctgggttcacgccattctcccacctcagcctcccgagtagctgggactacaggtgcctgccaccacgcccggcttaytttttgtatttttagtagagacggggtttcaccatgttagctgggatggtctcgatctcctgacctcgtgatccacccgccttggcctcccaaagtgctgggattacaggtgtgagccactacgcctggcctaaagtgcagatatctttacaaggtagagattcatctcctttacaaggtgattgtctcctttggatatgaattgctgggtcatatggtagtctattgttaatttctttagaaatctccatactgtttttcataatggctgtaccaatctgcattcccaccaacagtgca

SEQ ID NO: 137090 - DNA, 601 bp, Human
tagaagcacaataataaaattcatattttgagcacagatacatttgttgttagaagcagtctattatttttttcttccataggcaagagataaaagaagcagtttcttaactacttgtaggttttctatagacatcgtttgtttcttttattgcaggggatcaggaaaatgtttctgtaaaggactagatagtaaatattttcagctttgcaggcctttaagtgtctgttgcaactatttgactttgccttgtaaacagccatagacaatacataatgaaattttacttatgaaaagaggsagtgggccagatttggcctgtaggctgtcatttgctgaccccgctctattggaagcagaaagttatggaaaaactataaacaaaacaataaaatcatctttctcctccccacctcaccgattttttaacctttttgctattttttactctttcttactattaggaaactgagatacagagacattaaataatttgctaaagtcacacagctaataacagctgagccaggacgtgggcccaggcagtcagctatagagcccacatttttgatgcttattattataccctattgcttttaca

SEQ ID NO: 137091 - DNA, 601 bp, Human
catagacaatacataatgaaattttacttatgaaaagaggcagtgggccagatttggcctgtaggctgtcatttgctgaccccgctctattggaagcagaaagttatggaaaaactataaacaaaacaataaaatcatctttctcctccccacctcaccgattttttaacctttttgctattttttactctttcttactattaggaaactgagatacagagacattaaataatttgctaaagtcacacagctaataacagctgagccaggacgtgggcccaggcagtcagctatagagccyacatttttgatgcttattattataccctattgcttttacaaccagttattatagataatggttagtgtcagttacagattatataatgtgaattttataaatatgctatgattttccaaaaggaaaaatatttttgccaatgataaacaatatagaaacgtaacaattagcaagtaaaagttctccagtaatctcttggcccaaagataacctctattaagtttttgcataccctttcagactttccaatgtgtatatacatattttaaaaacataaatgggaattgttattaatataaa

SEQ ID NO: 137092 - DNA, 601 bp, Human
aatttgctaaagtcacacagctaataacagctgagccaggacgtgggcccaggcagtcagctatagagcccacatttttgatgcttattattataccctattgcttttacaaccagttattatagataatggttagtgtcagttacagattatataatgtgaattttataaatatgctatgattttccaaaaggaaaaatatttttgccaatgataaacaatatagaaacgtaacaattagcaagtaaaagttctccagtaatctcttggcccaaagataacctctattaagtttttgcayaccctttcagactttccaatgtgtatatacatattttaaaaacataaatgggaattgttattaatataaactgacctataaccacacttagttgtggacaaagttctaaatcagaatatgtaaatctattatgctttatagtattctattacgatatgccataatatattttaaccaaatctccattgatgtcttagaccaatctcctacaaaggaaattgcttattggagtgtatgagaatttaaaatgttaatacatattgccatatgccctgtaacgtgatcgtacaaatacatact

SEQ ID NO: 137093 - DNA, 601 bp, Human
atatttttgccaatgataaacaatatagaaacgtaacaattagcaagtaaaagttctccagtaatctcttggcccaaagataacctctattaagtttttgcataccctttcagactttccaatgtgtatatacatattttaaaaacataaatgggaattgttattaatataaactgacctataaccacacttagttgtggacaaagttctaaatcagaatatgtaaatctattatgctttatagtattctattacgatatgccataatatattttaaccaaatctccattgatgtcttagrccaatctcctacaaaggaaattgcttattggagtgtatgagaatttaaaatgttaatacatattgccatatgccctgtaacgtgatcgtacaaatacatacttttaataacagcataggagaatgcctttttccccgtaccttcaccttcactggctactgctattcatttttcaatcttttgtcagtctggtaggtgataaattaattcttttattttaaaccctttctttcataataatattttttatcatttgcattttttcttttacagactgagttttttaatatgttattttcc

SEQ ID NO: 137094 - DNA, 601 bp, Human
tttaaaaacataaatgggaattgttattaatataaactgacctataaccacacttagttgtggacaaagttctaaatcagaatatgtaaatctattatgctttatagtattctattacgatatgccataatatattttaaccaaatctccattgatgtcttagaccaatctcctacaaaggaaattgcttattggagtgtatgagaatttaaaatgttaatacatattgccatatgccctgtaacgtgatcgtacaaatacatacttttaataacagcataggagaatgcctttttccccrtaccttcaccttcactggctactgctattcatttttcaatcttttgtcagtctggtaggtgataaattaattcttttattttaaaccctttctttcataataatattttttatcatttgcattttttcttttacagactgagttttttaatatgttattttccacaaatacactgttgacttttttttttaatagtatgaagtattcagaacagaagaggaagaaaaaataaaatctcagggacaagatgttacatcatcagtatatttcatgaagcaaacaatcagcaatgcctgtgga

SEQ ID NO: 137095 - DNA, 601 bp, Human
tgctgagagaacaaaaatctgtatgtttcaaaatccagttgccatctggctttaaatccctgcttcagggacttttaatatttttctgatcatctcatttaagattcatctccctgccgggcatgggggctcacgcctgtaatcccagcactttgggaggccaaggcaggcggatcacctgagttcaggagctcaagactagcctggccaacatggtgaaccccgtctctactaaaaatacaaaaatcagctgggcgtggtggcatgtgcctgtaatcccagctatttgggaggctgaggygggagaatcgcttgaactcgggaggcggaggttgcagtgagccgatatcccaccactgcacttcaggctgggcaacaagagcgagactctgtctcagaaaaaaaaaaaaaaaaagattcatctctcatctatgggcttaagagtgttcggtgtattattatctccattgctgtttgtattccagcctactgatttttttgtcagttcctacaaaatacataggtctttgctgtctgtattagtttgcttgggcattcatcacaaattgttaccaggtgcctttaacaacagaaatttatt

SEQ ID NO: 137096 - DNA, 601 bp, Human
tttgagttcctggcttcaggtgatctgactacctcggcctcccaaagtgctggcattacaggtgtgagccaccgccccagccaaacactttcaataaaagtttgacagctaattttgtagcagttctgttaagaccagtgttttatattaggcttaatgtgactatttatatcctagcttgggataggaaacagattgtgtgagaaatagtaaattgatagcttttcagttactcctgaattttatttcttttttctttttcattattattatttttctgatgtgaagtctcgctctgtckcccaggctggagtgtagtggcgcaatctctgctcactgcaacgtctgcctcccaggttcaagcaattctcctgcctcagcctctcaagtagctgggactacaggcacgtgccaccacacccggctaattttttgtatttttagtagagacagggtttcacagtgttagccaggatggtctcaatctcctgacctcgtgcctcagcctcccaagtagctgggactacaggcgcgtgccaccacacccagctaattttttgtatttttagtagagacagggtttcacagtgttagcaaggat

SEQ ID NO: 137097 - DNA, 601 bp, Human
agtgttttatattaggcttaatgtgactatttatatcctagcttgggataggaaacagattgtgtgagaaatagtaaattgatagcttttcagttactcctgaattttatttcttttttctttttcattattattatttttctgatgtgaagtctcgctctgtctcccaggctggagtgtagtggcgcaatctctgctcactgcaacgtctgcctcccaggttcaagcaattctcctgcctcagcctctcaagtagctgggactacaggcacgtgccaccacacccggctaattttttgtrtttttagtagagacagggtttcacagtgttagccaggatggtctcaatctcctgacctcgtgcctcagcctcccaagtagctgggactacaggcgcgtgccaccacacccagctaattttttgtatttttagtagagacagggtttcacagtgttagcaaggatggtctcgatctcctgacctcgtgatccacccgcctcagcctcccaaagtgttgagattacagtcatgagccaccgctcctggccctgaattttatttctttaaagtgggttcatgattgagttttgaagcactgtg

SEQ ID NO: 137098 - DNA, 601 bp, Human
caggcgcgtgccaccacacccagctaattttttgtatttttagtagagacagggtttcacagtgttagcaaggatggtctcgatctcctgacctcgtgatccacccgcctcagcctcccaaagtgttgagattacagtcatgagccaccgctcctggccctgaattttatttctttaaagtgggttcatgattgagttttgaagcactgtgttacaaaaattaataatagacatataaagctaagctttcaattgactaatgtgttggttgtgtgtgttattgtaatgtgtagccctaaaygaaatacggttgaatgttctactagaaaaatagttactgattttaaaattaatataacctgatatatacgtgcccagttaagaaatttaaaaatgaatgtatacagttggcccgctgtaatggtgggttccttacttgtggattcaaccaaccacttaatgaaaatatttgaggctgggcatggtagctcatgccagtaatgccagcactttgggaggccaagaagggaggatcgcttgaggccaggagtttgagaccagcctgggcaacatagtgagaccctgtatgtacaaaaaaatt

SEQ ID NO: 137099 - DNA, 601 bp, Human
gtgccaccacacccagctaattttttgtatttttagtagagacagggtttcacagtgttagcaaggatggtctcgatctcctgacctcgtgatccacccgcctcagcctcccaaagtgttgagattacagtcatgagccaccgctcctggccctgaattttatttctttaaagtgggttcatgattgagttttgaagcactgtgttacaaaaattaataatagacatataaagctaagctttcaattgactaatgtgttggttgtgtgtgttattgtaatgtgtagccctaaacgaaatayggttgaatgttctactagaaaaatagttactgattttaaaattaatataacctgatatatacgtgcccagttaagaaatttaaaaatgaatgtatacagttggcccgctgtaatggtgggttccttacttgtggattcaaccaaccacttaatgaaaatatttgaggctgggcatggtagctcatgccagtaatgccagcactttgggaggccaagaagggaggatcgcttgaggccaggagtttgagaccagcctgggcaacatagtgagaccctgtatgtacaaaaaaattagccaga

SEQ ID NO: 137100 - DNA, 601 bp, Human
agtaaaagtttttgaagttaatttaaatcataaaatatgtaattaatttacaatgaaatattaatatgtaatctattttggttagtgttgacctataaaagagggattatttgaccactggggtaaacagtgcataatttctgatttcaagtatgtcatcataaatatatatacataattaaagatacatgtgtgtgtttgtgtgggtgtgtatatttttaatttaagaaaatcctctgtttagaatctacttggcttttttggcccagccagtacagactgtcagtggcagtaaatagtwtaaagtttcatcttcattagatgtatatgtatagttgcatggcttcattttactctgaagtatagtttttagttatttttattattttgggattacaaagagataacagaaatcattccaataagccaaaaatgatttacgcacaaattgaggtgctcacatatttatttccctccttttggaatttatttcctcttccttcattttgaaagaatctgaggatattaggaagaagcttagttcttaaataatataaaatttaagttgccgattatcttgtaagaatcaggcggaaacaat

SEQ ID NO: 137101 - DNA, 601 bp, Human
ttcattagatgtatatgtatagttgcatggcttcattttactctgaagtatagtttttagttatttttattattttgggattacaaagagataacagaaatcattccaataagccaaaaatgatttacgcacaaattgaggtgctcacatatttatttccctccttttggaatttatttcctcttccttcattttgaaagaatctgaggatattaggaagaagcttagttcttaaataatataaaatttaagttgccgattatcttgtaagaatcaggcggaaacaatacatgtatcatgyggttcaagatgtagagtccagttttgtcaaaagtctgaaactgcaactttctgatctttgtttttctttacttttcatacctcattttctttatttcaacatgacttaatcttttggaggcgattttattttattttatttttaaaaccaaaaatgctctgggactccctagcttgtctctgtctctcttctatctttttttgtttcttctgaacattgcttgaatagaggccttccctttccccttttctctccctccgtctgtcttcccttctttttttcctctccatttctctcctt

SEQ ID NO: 137102 - DNA, 601 bp, Human
tttctttatttcaacatgacttaatcttttggaggcgattttattttattttatttttaaaaccaaaaatgctctgggactccctagcttgtctctgtctctcttctatctttttttgtttcttctgaacattgcttgaatagaggccttccctttccccttttctctccctccgtctgtcttcccttctttttttcctctccatttctctcctttcctccccccttctttcttcttttctgatctcagaattttagaaatggagatattaaattattacttattttaaaggaaaattctyagaccgaacttaccagttcacacttccagatctgactagatgaaactcgtctaagaatgctttcagcaataaaaatagaactgatgttgtgtttggtgatggtgaaagttttctgttagttttgttttatatcacaactttccagagtagagggtaatgttaggatataagatttttttgatttgtaataaaggagaactttatttggggctactctcaaactgtaaagaaaataatttctgggaattagtttgagaagtttaacaatggtaagcttaggtttaatgtaacatttagatg

SEQ ID NO: 137103 - DNA, 601 bp, Human
tagaaatggagatattaaattattacttattttaaaggaaaattctcagaccgaacttaccagttcacacttccagatctgactagatgaaactcgtctaagaatgctttcagcaataaaaatagaactgatgttgtgtttggtgatggtgaaagttttctgttagttttgttttatatcacaactttccagagtagagggtaatgttaggatataagatttttttgatttgtaataaaggagaactttatttggggctactctcaaactgtaaagaaaataatttctgggaattagtttsagaagtttaacaatggtaagcttaggtttaatgtaacatttagatgtacaggtattatattaatagatatttctaacatggagaattataaactgaagggagagaaaacataattgttaaaccagtcagggaaaaaagtctttttagaatatcttgatgtctgtgggcatcttgatttattaggtgagcaaaatgaagaaacttaccattatccagattttccatggaatatgtagtggtattttgtgtattttgatatctatcccatatttaacttgtgacttctttgccaaccgaaca

SEQ ID NO: 137104 - DNA, 601 bp, Human
agtttgagaagtttaacaatggtaagcttaggtttaatgtaacatttagatgtacaggtattatattaatagatatttctaacatggagaattataaactgaagggagagaaaacataattgttaaaccagtcagggaaaaaagtctttttagaatatcttgatgtctgtgggcatcttgatttattaggtgagcaaaatgaagaaacttaccattatccagattttccatggaatatgtagtggtattttgtgtattttgatatctatcccatatttaacttgtgacttctttgccaacygaacatggatactctgtaggaaactttgcatcttttgtatggatctggctttaatttcctttttaaaatttgaaccttaaatttactgtaatccaatgtattacactgaaatttactaaaaaatctacagaaatccatttagaattaatttataattttgattttaaactcataaagttatacatgtatgtgttctcatgcatgcgcacacacatgtccttacacatatgtgtacacacatttataatctaattttcaaagcatttggtagctctagagatgttcccaattattttcttt

SEQ ID NO: 137105 - DNA, 601 bp, Human
ggtcgatcttggctccctgcagccttgatctcctgggctcaaaccatccttccacctcagcctcccaagtagctgagaccacaggcatgtaccatcacacctggctaatttttttttttttttttttttagtagggtggggtctccctatgttacccaggctggtcttgaactcctgggctcaagtgatctttctgccctggcctcccaaagtattgggattacaggtgtgagccactaacaaaacacttgacttcttcttaggcagaccctctgctttgtttgattttttttttttttttaagtctggatcatttctttttagcctttacagcatttcaaatacgttggttattttatttaaaagtttaaagagtaatttattcattttttgctgtataaaaaagtgcatgcacactaactgtgaaggaaaagtaatttggcctttgaggacgtaggtggtgattgttgttgttttttgaactggttttaagtttgacaaccagaagatagatttggattatattcaggaattcagatagaaatagtaatagatgtgcccttatgaatcagtcaaattagttgacagttaatgggcgagt

SEQ ID NO: 137106 - DNA, 601 bp, Human
tttttttttttaagtctggatcatttctttttagcctttacagcatttcaaatacgttggttattttatttaaaagtttaaagagtaatttattcattttttgctgtataaaaaagtgcatgcacactaactgtgaaggaaaagtaatttggcctttgaggacgtaggtggtgattgttgttgttttttgaactggttttaagtttgacaaccagaagatagatttggattatattcaggaattcagatagaaatagtaatagatgtgcccttatgaatcagtcaaattagttgacagttratgggcgagtgaccttgcaatggaaaacactgaaattggagctgggagtcatgagtctgcctctggctttcacactcactagttatgtggctttgggcaagtcaagtaggtccttgtgcttctgaaaaaaccaaaactgtcatgcttatggtctgtattctcatagctcactttctctgtgtgtgtaagtgaatgtgtgtgtgtgtttaaactcagaggatttaaatcagaattaatgcttaaaaatctcatgcaacaattacttattaaatatcttggcattcttcctgaagagtaaaa

SEQ ID NO: 137107 - DNA, 601 bp, Human
gacagggaatttaaaataattaaatgctcaagtggaaaagatggaaaacatgttctatcacatgggtaatatcagcagaattggaaactattaacataagaaagaatcaaatggaaatgccagtaatgaaaaatacggtactagagatgaagaatgccattaacagattcaccagtagactcaacaaagttgagaaaagaatcggtgaatgtgaagataaatcactggaaattacccaaacttactcacaaaggggaaaaaaatagtggaaaagagggggaaaaaccacacaaaacaaacrgtgcatccaacagctgtgggacaatttcaagtgatgtaatatgtgaaaatggaatcccagaaggagaagagagatggaaagatatgatgggggtgggagtgggtgaggggtggggtcttgagacaaaaagtatttgaagggtaatggccaactattttccaaaaataattacagacatcaaaccacagcttcaggaatctcagagacactaggtaggatgaatacccttatcctccaaaaaacaaacacacatatatacctactgagatacattaaaattcaaagataaatggaaaatgt

SEQ ID NO: 137108 - DNA, 601 bp, Human
aagaaggacattacataaggataaagaggttatctcaccaagaagacatagcatacacgtaacagaaagtatgtgtatgcagctaacaattagagcctctaaatgtatgaggcaaacactgttagaactgaaaagagaaatagacaaattcacaattatagttggagatgtcaacactcagaatcaataaaacaaatagatacagaacattactaaaaaattgaagatttgaacaacattgtcaaacaacttgacccttttgatatttgtggaacacttcagaaatttggaatacaacagytgaatatacagtcttctcaagtgcacatgggttagttaccaggatagaccatattctggattaaaaaatcaaccttaaatttttttaaaaaatttaatttatataaagaatgttttctattcatagtggagttaaactacaaatcaacaatagaaaaatatctggaaaatcccccaaatatttagatattcaatagtacacttctaaataattcatggatcaaagaggaatcacaggagaaattagaaaacattttgaattgattgaaaagaaatataccaaaattgacaggatacagct

SEQ ID NO: 137109 - DNA, 601 bp, Human
gtatgaggcaaacactgttagaactgaaaagagaaatagacaaattcacaattatagttggagatgtcaacactcagaatcaataaaacaaatagatacagaacattactaaaaaattgaagatttgaacaacattgtcaaacaacttgacccttttgatatttgtggaacacttcagaaatttggaatacaacagctgaatatacagtcttctcaagtgcacatgggttagttaccaggatagaccatattctggattaaaaaatcaaccttaaatttttttaaaaaatttaatttatayaaagaatgttttctattcatagtggagttaaactacaaatcaacaatagaaaaatatctggaaaatcccccaaatatttagatattcaatagtacacttctaaataattcatggatcaaagaggaatcacaggagaaattagaaaacattttgaattgattgaaaagaaatataccaaaattgacaggatacagctaatgcaggggttggagagaaatctatagcatgaaatgcttatagtagaaaaaaacaaacaaacagaggttagagggaaactatagtattacatgcttatagtag

SEQ ID NO: 137110 - DNA, 601 bp, Human
cattgtcaaacaacttgacccttttgatatttgtggaacacttcagaaatttggaatacaacagctgaatatacagtcttctcaagtgcacatgggttagttaccaggatagaccatattctggattaaaaaatcaaccttaaatttttttaaaaaatttaatttatataaagaatgttttctattcatagtggagttaaactacaaatcaacaatagaaaaatatctggaaaatcccccaaatatttagatattcaatagtacacttctaaataattcatggatcaaagaggaatcacargagaaattagaaaacattttgaattgattgaaaagaaatataccaaaattgacaggatacagctaatgcaggggttggagagaaatctatagcatgaaatgcttatagtagaaaaaaacaaacaaacagaggttagagggaaactatagtattacatgcttatagtagaaaagggaaatggcttcaagtcagagatctaagtttttaccttaaggtagcaaaaaaaaaaaaaaaaaaagagcaaattaaatccaaaatgcataaaacgtagaaataacaaaggtaaaagcagaagtcaat

SEQ ID NO: 137111 - DNA, 601 bp, Human
caagtgcacatgggttagttaccaggatagaccatattctggattaaaaaatcaaccttaaatttttttaaaaaatttaatttatataaagaatgttttctattcatagtggagttaaactacaaatcaacaatagaaaaatatctggaaaatcccccaaatatttagatattcaatagtacacttctaaataattcatggatcaaagaggaatcacaggagaaattagaaaacattttgaattgattgaaaagaaatataccaaaattgacaggatacagctaatgcaggggttggagakaaatctatagcatgaaatgcttatagtagaaaaaaacaaacaaacagaggttagagggaaactatagtattacatgcttatagtagaaaagggaaatggcttcaagtcagagatctaagtttttaccttaaggtagcaaaaaaaaaaaaaaaaaaagagcaaattaaatccaaaatgcataaaacgtagaaataacaaaggtaaaagcagaagtcaatgaaattcattactgtagtagaggtcctagccaatatagtagggcaagtaagggaaataaagggaatattgtttaaaaaggaa

SEQ ID NO: 137112 - DNA, 601 bp, Human
tgacaaatttcttattaaactatatctgtgagagaagacattatcatatacacttttgttcccatatagaatcaagtataggattcatttatgtatttttgattgactgattcttattatgagccgctaaaatgttcaaacatattttttaaccccgcatcaaaatgatagctttttttaaaggttagtatattgtatatttagattgaaggtactaagtaggattagagaattttcacagttgacaagagttttaaaaatcattcggaaagtaaaactcatgttccttaagagaaatctrttatggttgttacggttagcaaaatctattatcaccaagcaaggatttatattaccattctttttatttcttctcactatgattgtagtgattgtaattttgtcatactccctcaaattttttattttatatactggtgttattaatccaatgtgacaattatgaagtcatttggattactactattatgttatcatacccttgtatactttgtagaaaactcttggctagattttccttttgtggtacaatagtgtttgaaaaggtgttcccaaaatacctaaccttatcagaattatt

SEQ ID NO: 137113 - DNA, 601 bp, Human
cagtaacgtggtctaagtaaaatattctcttttttaattatgtagtcctcctcgccatcctcatcacagcctcattctagccactgcagaacgaaggcctcatcattgtgtcaccatgcatccctgccctgggtcaaacgtaaccatgtaggccctgcaaaggctaccagtccatctctccgtcttcgtcgctggcgacccttcttacgtctaccatctttgggtctccattctgttgtaagtttagtcaatcttccgtctcttcttccagtgacaagggctgtcttttttttttttttttcttaacttcggtcttcagagtgcttttctcttggttcactcaaccattagctttttctcccccaataagattgcaagcatatctctatgctttgcattctagcttgacttttgccagtgcctcagaacatccatctttccactccatatcctgccaacataacggcacctgccttttgatgagcactgatccacattcatgataatgtttaagtctggttaattgttaaagtgaatatgtgttctgttacccttcagctttctgaattcatttagttgactcaggtcaacaaatgctgtg

SEQ ID NO: 137114 - DNA, 601 bp, Human
tggttaattgttaaagtgaatatgtgttctgttacccttcagctttctgaattcatttagttgactcaggtcaacaaatgctgtgtaccttctgagttctttgccatctattactttattattattatttttttatgtttctgagcatgactttagtctcttgccatgctctggggttactttacttactctattctcaatctaaatccttcatggtgtagggtgtttcatctaagctattattttattccctgaggtggctcaggtacttggtttaatcttgatctgatctttcctgccyattcagtttctaaagatcttttccaagtaggaaatgaagattttctccttgtgtattgatgtaggcttcccacaaatttatgatttctcttttataggctaatgatatctgcaaactattaaaaatacatttttcttataatcttgctaattatcttaaatgttgagactgatgatgcaattctagtaattatcataattgagatacactacagaattaagcaactacagctcttgtctttctgatgttttggactattaaaggcaatgactgtggtttggcagagcctccctagaaatg

SEQ ID NO: 137115 - DNA, 601 bp, Human
tgatatctgcaaactattaaaaatacatttttcttataatcttgctaattatcttaaatgttgagactgatgatgcaattctagtaattatcataattgagatacactacagaattaagcaactacagctcttgtctttctgatgttttggactattaaaggcaatgactgtggtttggcagagcctccctagaaatggaatatcttaaagctttggtgtgtgccatacatttataagaaatttgacatttctataaattatgatggcttttgaagccagaggaggaagtctgattacacrtacatttaatgcttaagaacaattaaaagtcaacggcaagcattctttccttccccttatttacccttctagtgttatactcaaactgtgaagtggtatctttccttaaatatttgcttccaccaaatatcagtatggtcatcaaatacttttccatttctgctgagtatcaacaaactcacatctctttctatttcattatcctcattgggtcacgacattcttcatttttattcgttcatccatttgatatttgttgcttctctactgtgccatatgccatttgacacagtgagagat

SEQ ID NO: 137116 - DNA, 601 bp, Human
aaagccaaaatggtgtttggatgtaaagtggaattttaatttttccttcatatatatatatatatatatatatatatatatatatatatatatatatatatgaaggaaaaaagatcccatctatagccttttttttttttttgccctttgtgtagttatttcttggtcattttttgaaacaagcacttgctgaaatttgctttttatttatttttcttgtttttagtggaataacttttaagcaattaaataattacagatttttagactctgagactaattgaagctgactgaaggaaarggcttatcacaggttctgaggttttgtggaaggcttagaagttttgagctttgcttatcttttataatagtttgaaggcttttcataccctttttagaattttgtatttttagtatgcacttttagattaaaggtgcaatgatgcacaattttgagtcactacatttggtaattgcttacatttgcaataatgtagtattgttattggagtaatacataaggtttatataacacttaacagtttacaaagtactttcatgcagctcatttaaacctcgaggtggataagaaacccaaggc

SEQ ID NO: 137117 - DNA, 601 bp, Human
ttgccctttgtgtagttatttcttggtcattttttgaaacaagcacttgctgaaatttgctttttatttatttttcttgtttttagtggaataacttttaagcaattaaataattacagatttttagactctgagactaattgaagctgactgaaggaaagggcttatcacaggttctgaggttttgtggaaggcttagaagttttgagctttgcttatcttttataatagtttgaaggcttttcataccctttttagaattttgtatttttagtatgcacttttagattaaaggtgcaaygatgcacaattttgagtcactacatttggtaattgcttacatttgcaataatgtagtattgttattggagtaatacataaggtttatataacacttaacagtttacaaagtactttcatgcagctcatttaaacctcgaggtggataagaaacccaaggcttacagggattgggtccatattcagttctctgactccaattgtactacttttacctctagcatggttgtatttactggcacaatataaaaaatagaagctataagatgtgtaattcttaagaagagatggtgttaaggta

SEQ ID NO: 137118 - DNA, 601 bp, Human
gaagcagattttctactctgaattgtgaatagtaaataataactagtggaagaggaaataaagagtgctgggacttaacagacacattctgttaacttcaagaaagtagatttggccagagcaaacatatgtaggattcataaccagagactataaatctgattgtgactttcagaatgagagacttacagagcaaacaataacatctaaaatatatttaaaccaaaagaaaacctctctaatgatctcaatgggaaggaaagagttatcttaaaaaaaaactcggttttactagttagakagctgtcttggctcagaggctaaaagggcagttagaaggaaggacatatatcaagggtaagctacatatgaagaatgatgctcttttggagcatgccaagatcaacacaaaaggattttaaaattggtttgaagtaagaacttcataaaacaaaggcagaactactgaggtcttgtttggtttagatattctttatcaagaagaatgatctgatggaaaattagaagcctactggaaattagattttttaaatgagtttaaataatttcagagtggtaaagaatagccataatctttgag

SEQ ID NO: 137119 - DNA, 601 bp, Human
aaggaaggacatatatcaagggtaagctacatatgaagaatgatgctcttttggagcatgccaagatcaacacaaaaggattttaaaattggtttgaagtaagaacttcataaaacaaaggcagaactactgaggtcttgtttggtttagatattctttatcaagaagaatgatctgatggaaaattagaagcctactggaaattagattttttaaatgagtttaaataatttcagagtggtaaagaatagccataatctttgagatgtcagagcaataataggtacattacaaagatggrcagttgctgattcattgcaaaggaaactggcagtaactctgatgcagatctaataaattcaaaaggaatattgagcaagaagagtattgagttagtgagtagaaaatagtgattaagagattagcactgggcacagtggtgtgttcctgtagtcccactttctgtagtgggaagctgaagcacgattgcctgagcccaggagtttgaggctacagtgtgctatgattgcacctgtgaacagccactacacttctgcctgggtgacatggcaagacgtcatctcttaaaaaaaaaagaaaa

SEQ ID NO: 137120 - DNA, 601 bp, Human
ataaaacaaaggcagaactactgaggtcttgtttggtttagatattctttatcaagaagaatgatctgatggaaaattagaagcctactggaaattagattttttaaatgagtttaaataatttcagagtggtaaagaatagccataatctttgagatgtcagagcaataataggtacattacaaagatgggcagttgctgattcattgcaaaggaaactggcagtaactctgatgcagatctaataaattcaaaaggaatattgagcaagaagagtattgagttagtgagtagaaaatartgattaagagattagcactgggcacagtggtgtgttcctgtagtcccactttctgtagtgggaagctgaagcacgattgcctgagcccaggagtttgaggctacagtgtgctatgattgcacctgtgaacagccactacacttctgcctgggtgacatggcaagacgtcatctcttaaaaaaaaaagaaaagaagacactatataacttttaagaaagaagtcatttcaaagttcaatttgctctctgtgggttcttgcattggtagattcaaccaactgtggattgaaagtattagaaa

SEQ ID NO: 137121 - DNA, 601 bp, Human
aataataggtacattacaaagatgggcagttgctgattcattgcaaaggaaactggcagtaactctgatgcagatctaataaattcaaaaggaatattgagcaagaagagtattgagttagtgagtagaaaatagtgattaagagattagcactgggcacagtggtgtgttcctgtagtcccactttctgtagtgggaagctgaagcacgattgcctgagcccaggagtttgaggctacagtgtgctatgattgcacctgtgaacagccactacacttctgcctgggtgacatggcaagaygtcatctcttaaaaaaaaaagaaaagaagacactatataacttttaagaaagaagtcatttcaaagttcaatttgctctctgtgggttcttgcattggtagattcaaccaactgtggattgaaagtattagaaaataaataccaatacaacaataaaaaacaaattttgaaaacaacataacaactatttacatagcatttatattgtattatgtatgataagtaatctagagatgatttaaagtatttggaattgtgtaggttatatgcaaatactataccatttaggtagagtatgtc

SEQ ID NO: 137122 - DNA, 601 bp, Human
gactattgccaaatggcaattaaaaaaaaattcccccaacattagaagctttccttttcctctcatttattcatttataatcagaatggactcatggattcctactttacttgaatgattataatccatgatatcatgtatttttatgctcaaattactgcagacttggcctttgaaaggaaccccttcaaactgcagccttgatgtcctgggctccagcaatccccttgtcacagcctcctgagtagctgggactgtaggcctgtgccaccatgcctggctatttttttttttttttttggtaaattggggtctagctatgttgcccaggctggtcttgaactcctgggctcaattgatcctcctgctttagccttccaaagtgctgggattacaggcatgaggcactgcacacaggccatagttttaatttttaagagttcttctgttctctgagtttgcatagcatttgaaaatatggcattctgttcttttatgtatgtagaatttcctcattttaaggatagtaataatacaggaatacctcatttgactgtactttacatatatttcattttttacaaattgaaggtttatggca

SEQ ID NO: 137123 - DNA, 601 bp, Human
ataatccatgatatcatgtatttttatgctcaaattactgcagacttggcctttgaaaggaaccccttcaaactgcagccttgatgtcctgggctccagcaatccccttgtcacagcctcctgagtagctgggactgtaggcctgtgccaccatgcctggctatttttttttttttttttggtaaattggggtctagctatgttgcccaggctggtcttgaactcctgggctcaattgatcctcctgctttagccttccaaagtgctgggattacaggcatgaggcactgcacacaggccrtagttttaatttttaagagttcttctgttctctgagtttgcatagcatttgaaaatatggcattctgttcttttatgtatgtagaatttcctcattttaaggatagtaataatacaggaatacctcatttgactgtactttacatatatttcattttttacaaattgaaggtttatggcaatcttgctttgagcaagcttattggcaccattttttccaacagcatgtgctcactttgtgtttctgtgtcacgctttggtaattctcccaacatttcaaacgttttattattatatctgt

SEQ ID NO: 137124 - DNA, 601 bp, Human
caacttgctgaaggctgagatgatcattagcatttttaggaataaagtgttttttaattaaggtatgtatattgttttcttagacataatgctaatgtatacctaatagactacagagtaatataaacataacttttatatgcactaggaaacaaaaaaatttgtgactcattttattgtgatacttgcttcattgtggtattctggaagctaacccacaatatctctcaggcatgcctgtacattttttagaagttttaatttctgtatagtctctcttttttaagcctgtacatttttwaaaagtttttatttctgtggctgggtgtggtagctcacgcctgtaatcccagcacttggggaggccgaggtgggtggatcacaaggtcaggagatcgagaccatcctggctaacatggtgaaaccccatctctactaaaaatacaaaaaattagctgggtgtggtggtgggtgcctgtagtcccagctgctcgggaggctgaggcaggagaatggcgtgaacccgggaggcagagcttgcagtgagctgagattgcgccactgtactctagcctgggcgacagagcgagactctgtctca

SEQ ID NO: 137125 - DNA, 601 bp, Human
tttatttctgtggctgggtgtggtagctcacgcctgtaatcccagcacttggggaggccgaggtgggtggatcacaaggtcaggagatcgagaccatcctggctaacatggtgaaaccccatctctactaaaaatacaaaaaattagctgggtgtggtggtgggtgcctgtagtcccagctgctcgggaggctgaggcaggagaatggcgtgaacccgggaggcagagcttgcagtgagctgagattgcgccactgtactctagcctgggcgacagagcgagactctgtctcaaaaaaaaacaaaaacaaaaacaaaacaaaaacaaaaccagtaaaacagtttttatttctgtatagtctctgttttttaagctccatcattcacgtcgttggccattgttgggtatttgacagtagctgatactcagttatctgcaccaaaaagcatctcgtgatgtttgtcatgtcgcttgtctcttgtacaactctgttgtcacctttctctgggggcttgtgatcacactatgcaaaaaacaagttctgaatgaattggttagttactaccaaaaagtcaggccactattttcttccccgtccagc

SEQ ID NO: 137126 - DNA, 601 bp, Human
gttatctgcaccaaaaagcatctcgtgatgtttgtcatgtcgcttgtctcttgtacaactctgttgtcacctttctctgggggcttgtgatcacactatgcaaaaaacaagttctgaatgaattggttagttactaccaaaaagtcaggccactattttcttccccgtccagcctggaagtggcacagcccgtttggactggggtttttaggttacatgacccatgtacaaggtgcagctttttcctgcctcttttagaaggggcctgtaagtgtgacagtctctgagcctcatggattcwtctgcagcgtatgcatttactgaaattacacgcaaagttgttggcaagtgacagttttgtggtagtagtgtttggaacaacagcaaattttacattttattgttttggcaaaatttttctgtgaaggaccaagtagtaaatattttaggttttgtgggctacatactgtcttttaaaaacataaaaaccagtcttagcttaaaggaggcattaaaaatacactgagggctggatttggcccatggattagaataacagtaaaaatcataattaatctttgttctatactgctattataaa

SEQ ID NO: 137127 - DNA, 601 bp, Human
acccatgtacaaggtgcagctttttcctgcctcttttagaaggggcctgtaagtgtgacagtctctgagcctcatggattcatctgcagcgtatgcatttactgaaattacacgcaaagttgttggcaagtgacagttttgtggtagtagtgtttggaacaacagcaaattttacattttattgttttggcaaaatttttctgtgaaggaccaagtagtaaatattttaggttttgtgggctacatactgtcttttaaaaacataaaaaccagtcttagcttaaaggaggcattaaaaatrcactgagggctggatttggcccatggattagaataacagtaaaaatcataattaatctttgttctatactgctattataaaaatagactgtacggttttgacatttcaggatcagttgtttaacaatcttagtctataataattgaaattaattatatgttactttaaacagctgcattcaaaggaaaattgctcactgccattttttgtttttattttattatgttattattttatttttttagagacagaatctcactttgtcacccaggctggagtgcagtggcatgatcatagctt

SEQ ID NO: 137128 - DNA, 601 bp, Human
ttgttttggcaaaatttttctgtgaaggaccaagtagtaaatattttaggttttgtgggctacatactgtcttttaaaaacataaaaaccagtcttagcttaaaggaggcattaaaaatacactgagggctggatttggcccatggattagaataacagtaaaaatcataattaatctttgttctatactgctattataaaaatagactgtacggttttgacatttcaggatcagttgtttaacaatcttagtctataataattgaaattaattatatgttactttaaacagctgcattcraaggaaaattgctcactgccattttttgtttttattttattatgttattattttatttttttagagacagaatctcactttgtcacccaggctggagtgcagtggcatgatcatagcttgctgcgtccttgaactcctgggctcaagtgatcctcctgcctcagcctcccaaacagctgggactacagacttgtgccactatacctggctaatttattaattctttgtaaaggtggggtctcactgtattgcccaggctggtgttgaactcctggcctcaagcaatcttcttaaattaca

SEQ ID NO: 137129 - DNA, 601 bp, Human
tctataataattgaaattaattatatgttactttaaacagctgcattcaaaggaaaattgctcactgccattttttgtttttattttattatgttattattttatttttttagagacagaatctcactttgtcacccaggctggagtgcagtggcatgatcatagcttgctgcgtccttgaactcctgggctcaagtgatcctcctgcctcagcctcccaaacagctgggactacagacttgtgccactatacctggctaatttattaattctttgtaaaggtggggtctcactgtattgyccaggctggtgttgaactcctggcctcaagcaatcttcttaaattacaggtgtgagccaccacacccagccataactgagtttattagctctttagtctcatgaatgacacacacacagaaatgatggaaaccaggaaaatacatatattaagccaggtgctgttgcatgtgcctgcagtcccagctacttgggaagctgaggcaggaggattgcttgaacgcaggaggttaagttcagcctggggaatataagtgaggccctgtctctaaattaaatagaagaaagaaaaatacaaaag

SEQ ID NO: 137130 - DNA, 601 bp, Human
gtatgtgactgtagtcccagctactagggaggctgagataggagatttgcttgaacccggaaggcagaggttgcagtgggccgagattgcaccactgcactccagcctgggtgacagagggcaagactctgtctcaaaaaacaaacaaacaaacaaaaacttactgtatcttatacttttgtacaaagcaaattagggcacccatgttcacttttctggtgttctttatttctcatttggaaaaggaagtttgcagtgtaaaattagtatgaattagaaaaatatgaaatgtttatcattkgtaagtaaaacacttttacactgaaaaatcatacttttttttttcctccataggatgccatagaagtttgcaagaagtttatggagcgcgaccctgatgaactaagatttaatgcgattgctctttctgcagcatagcttgtcaataatggaaacaccaaaaactgtattatttgcaactaaattttctctgccatacactaactcaaaaattttgatattttcattaacttgatgattaaactttatgtgagttaaactttgccttaacctgtgttttatgttatttttgctccaggtt

SEQ ID NO: 137131 - DNA, 601 bp, Human
caaactaaagagaattgaaagtaaggcttactaatagttcccttcccagttatccagctaggagacgggattggcaaggagaactgaaaaacacaaaaaatgcccctcctctcgcactcccttccccacaacaatttagctattcatttcaatgttatctagaaaatcttttgctattaagattttatcttttcttcactctgttttgatggcagaggtaagcagcagcaaagtatccaaaaaaagggccacatataatcgctaactgaaaacccaggtcctagatcactgaaatactatygtacttcaaagttcgttatttacatttctttttgttatctgccaacgtgaaagaaacatcacattacttaaaacctccactgaataagttattgtccaccaacagtttcagattgctttccgatttgttttcatgttacagagcaccaataaggtacagataaaatgaaaagtgctaaggaagatctttgaccaaaaaaaaggcaaataggtcacacaaagtaagaaggccggtgccctttatctctcttatctagttctgcgaattaagaattttactaaaatgaaatgcctcacttag

SEQ ID NO: 137132 - DNA, 601 bp, Human
tggcagtgagctgagatcgcgccactgcactccagcctgggtgacagagcaagactcgatctcaaaaaaaaaaggaaaaaagaaaaaatctaagcatcccaatggccgaaacctactgagaagacggacacttactacaatagtttcacttctagatactacctaagtaatatctaagtatggacataggaaacagtaaacatctccaaataccaaactagctactatgaagagctctaaaacgagaaatcaataaagtactaaatggataacaactaccccaaacctaagggtggggtartcttacaataacttctacctctaaggaaaaaaaggtgagtttccagctctttcccaggaagatatatgcaccccaaatttctctgttccctgtgtgtcatctcttggttctaactgtaaccatggcaacaggaaacagcacaaaagacagcagaaccctgtaagggccagggttaaaaggggaagtgaaaaatacatatactttaaggcccaagaacatgcggttttggagttaacagtggcagccaaaaaagccttgagagaagaacatcaaagaatacaaactaaagagaattgaaag

SEQ ID NO: 137133 - DNA, 601 bp, Human
atggaattatctgccatctttcaaaaaggaagagggactgtatttactacatggaatgatcaccaagataaataaagtgagaaaagcaaagtgcagaatgagcatagtgtcttattgtgtaaaacaaacaaaaacaaaaaatgtgaagaatatataggtgtatatgcttgtaaaaggatatactgtctcgggatgaataaacaagactgttgcctttgggaaggggaactcatggataaaaagaggatggtaagaaaagaaagacttcactctctgtgtaccttttgaattttgtttcatrtgtatgtacatgtgttaacccattttaaacaatgattttttaaaaaaggctctgcaccagtacgaattatttaacaatattcgtcttaatctaaaagcattgcacgccatcaaaattttaaatgaggcttcagtgaattcaactagacaaaatgtttctagaaaaaatcaggccgggcacagtggctcgcacctgtaatcccagcactttgggaggccaaggcgggggtggatcacttgaggtcaggagttcgagaccagcttggccaacatggcaaaacctcaactctacaaaaaatac

SEQ ID NO: 137134 - DNA, 601 bp, Human
caacagacacccatgtacacagaataagtacatacaaggaattaattgtatcactggaaacaacctaaatgtccaataagtgttggctgaatgatggtacatctacacaatggaattatctgccatctttcaaaaaggaagagggactgtatttactacatggaatgatcaccaagataaataaagtgagaaaagcaaagtgcagaatgagcatagtgtcttattgtgtaaaacaaacaaaaacaaaaaatgtgaagaatatataggtgtatatgcttgtaaaaggatatactgtctcggsatgaataaacaagactgttgcctttgggaaggggaactcatggataaaaagaggatggtaagaaaagaaagacttcactctctgtgtaccttttgaattttgtttcatatgtatgtacatgtgttaacccattttaaacaatgattttttaaaaaaggctctgcaccagtacgaattatttaacaatattcgtcttaatctaaaagcattgcacgccatcaaaattttaaatgaggcttcagtgaattcaactagacaaaatgtttctagaaaaaatcaggccgggcacagtggctcgca

SEQ ID NO: 137135 - DNA, 601 bp, Human
gacatggcaaggagatttacactaacagctttttagaaaatcaaaagtcaagaataaaggtctccatggtcaagaaggtgttgctgtctgaatggttaattccctaaggtctatatccagctctcccaaagctgcatgaccagctctgtcatagagtacctaggcaactccttgccagttctattaaaacatgatcataattggaagaatgacagcccaagcatttcctcaagaatgtgtactttagaatttctttttcctgtaatgggagcttttcaaaaacaaaaataaaagcagctaytaggtcttattggcaaatgtgtcagaatagcctttcggagagattcactatgcctgaaaacaaacacaagaaacaggtgtgcttccctgaatatacaaccaggatttaatttgggaccagtattgttatgaaaccaggttgagaataaccttgtaaatatgacaaaatggtaaaaagaaactgaaatatgaatttcagataaatatcagaatactgttattatctggctttgagtaacctgaaatcagtaagattactcaaataccactacattgtaggagtctaacaaaacattttttg

SEQ ID NO: 137136 - DNA, 601 bp, Human
cgggtgcggtggctcatgcctgtaatcccagcagtttgggaggctgaggcaggcaaatcacctgaagtcgggagttcaagaccagcctgaccaacattgagaaaccccgcctctactaaaagtacaaaattagccgggcattgtggtgcatgcctgtaatcccagctactttggaggctgaggcaggagaatcacttgaactgggaaggcggaggttgcggtgagccgaaatcatgccagtgcactccagcctgggcaacaagagtgaaactccgtctcaaaaaaaaaaaaaaaaaaaaaatttaaatttttgggggtagggaggtctcttcctctttagagagaccctttaatgaccaaaagatacaaagctagaatggagaattctcagtatgaactttctcttctatgccttttctagaaaggcaggacctgcccaaatgcaatttttaaagctcagatttttgcccccctcagattgtgacagattttcaaaatatattcaagtgcttgaaaaaaatgttaagctgtatgtactactacatgagacaaattccataagcttcattaaaatggtttcccctaagattattatatactt

SEQ ID NO: 137137 - DNA, 601 bp, Human
gtgcagcccaggcaccaggagtagaaaaagttccccaggtgattctaacaaacagctaagagtgagaaccactgctctacaacatttggacttccaccaacctctctgacctcatttctactactttctctcttgttcacttaactccagtcatgctggcctccttgctggttccttgagtatggcaggcacatacatacctcatggtttttgctatttcttttgtctagagtgctagttctctcctgcatcttctacagatatttactcaagcattacctttgatgtgagttagtgaggycttccctggccattctatctaaaatcacaacacctactcccaccccaacattctctatctatccctttttcgggtcgtatttttctccttgaaacttatcactttccaataaaccatatattttatttatcttgtttgctgcctgaatataagctccatgagagtagggatttttgtctgtttttgtctccagcatttagaatagcatctggcacataactggtacccaattaatatttaatgccccagaaaggccttccctgactcctccacctaaatttaatctccccattattttcc

SEQ ID NO: 137138 - DNA, 601 bp, Human
cctctttgatacattcaggatggtcagagatagtcacagaagagtgggtacaaaaaaaacctttcagtagaagagccagtgagatttagaccaaaaaaagagaaagtcagaaatgccttttataaatacaaaaataatataaatatataatataaatataatatacacaatatataagtatataatagatatgatatgtggtactttgtttacaagatttaagtgttgatgcttccttgcagagctctgaaagaagatacagacagaaaaaaagttttttctattcaaggagagtaggtgrgcaacttgtattgcaaatcctatgaatcccaagaaggcctaattctgtcttagatcaggatgtgaatttaaatgtacaactaaattcctctacatataatctggcctctttcacccagaaatggttattagcacagtgaaagtgaatttagttctttgtctttgtcactgacaaaggatacctattaatgcagccattatcccccaattaaataggacagtgcacaattccagaggtgataaacatgttagtaaaacacatagacaacaattcttcaggcatttttaaaactgtttgttt

SEQ ID NO: 137139 - DNA, 601 bp, Human
tctattgcttgtgcctaactgaagtcaatcaaccataaaaaatattcattgaatgtagtttgaatgtccagtcccatgctgaactgccaatctcaccattaccaatgtctttgtgtggtttgaataaggagaaagtgtttctggccttgaagagccaggaaaagactcaacttaaaagagtaactcatatgttcaagaacttaagagtttctcttcagtacataaaatttcctcctctagacaatttcctaccatctcttacagtaaattcttcctttaaatagcaagccatttagaagtmaccaaaactataccctgaccctttcatccctgcataccaaatggaacaaaaacacagtaaaaccaattttaaacatctagaatagtcagctaggaattcaaatcaggaagggaaactttggactctagacccaaattcgcttcaaataatacttaaggaacttataaatatatttctaagggattgggcccctcaaagttacaaaacatggggaagagttaaaactaccactttatcattattgccagaggtagttgctttaagaactgtcttacaaaggtcagcattttattgggtctt

SEQ ID NO: 137140 - DNA, 601 bp, Human
gggcatgatggtgcacgcctatagtcccagctactcgggaggctgaggcaggagaatcccttgaaaccgggaggtggaggttacagtgagccaagctcgtgccactgcactccagcctgggcaacagagcaagactccgtttcaaaaataataataacaataataaataaataagtagaaaaacaaaaagtagagatatgagtatttttggagatgaagatctaagtaataccagcaattttaacaaataccttatacagtgatagtaaaaattgacaaaacttgctaatactaaattttyccagagtaaaagactaagctgatttgaataaagtgatggaagttctaaatactctttgtgggcaagaagtttgtacccagaacatcctgtattgtgcctagcacagagaaggtgcttcacaagaaaagtctggtgaataaaggaataaaatagctctggagatataaaaggacttaataatatccagtcaaattatttcattttacagatcaaggaactgaaccccaaagcagcttagtggcttgcccaatgtgttaataatacacacaggaagccagcagcggagtttagaacagtacc

SEQ ID NO: 137141 - DNA, 601 bp, Human
aaacaggctgggtgcagtggcttatgcctgtaatcccagcactttgggaggctgaggcgggcagatcacttgaggtcaggagtttgagaccagcctagccaacatggtgaaaccctgtctctactaaaaatacaaaaattagccgggcatgatggtgcacgcctatagtcccagctactcgggaggctgaggcaggagaatcccttgaaaccgggaggtggaggttacagtgagccaagctcgtgccactgcactccagcctgggcaacagagcaagactccgtttcaaaaataataatamcaataataaataaataagtagaaaaacaaaaagtagagatatgagtatttttggagatgaagatctaagtaataccagcaattttaacaaataccttatacagtgatagtaaaaattgacaaaacttgctaatactaaatttttccagagtaaaagactaagctgatttgaataaagtgatggaagttctaaatactctttgtgggcaagaagtttgtacccagaacatcctgtattgtgcctagcacagagaaggtgcttcacaagaaaagtctggtgaataaaggaataaaatagctc

SEQ ID NO: 137142 - DNA, 601 bp, Human
gagccgagatcatgccactgcactccagcctgggtgacagagtgagactctgtctcaaaaaaagagaaagttctttatattgtattttgactccaacaaaagcaataaaggcttctgttacatatccagatgaaatatctcaagagggtaactacagttagaaaaataatggttttttacttaggaactaaaaaaagttttatagcagtttccagagtggaagggaaaacgaaccctacagtgttagtgttccatataagagcatcattttcttctaaagaaagatttaagataggaacayttctctgtagcataaaatgtgggactgatgtgacaaagagcaggtaaacaattccaatcaaacttggtgactatgatggcatagggaagataattcactgaatgaaattgcctattgggtgacatgacagatacttccgagtatacatatagtgcttgtacttttgatggaatacgtcatctatgttaaagttggcgtaagcctagatccaaaggttactttccaaccacaatacttattacctgaaccaaaccctaagacaagaacagatctgagataaaatacacaggcatctgatat

SEQ ID NO: 137143 - DNA, 601 bp, Human
ttgtgattcctcagaataggcccattcctgccttggagcattgtacgtgtcattttctgtctgaataagtcttcccctagatgttctcagggcacactccttcaccattgctaagactttccttgtcaccatctctgtgaggtcttccctgatacccttaaaaatgaattcctggctgagcgtggtggctcacgcctgtaataccagcactttgatatgccgaggcgggtggatcacttgaggtcaggagttcaagaccagcctggccaatatggtgaaaccccgtctctactaaaaacayaaaaatcagctgggcgtggtggcacacacctgtagtcccagctactcaggaggctgaggcaggagaatcgcttgaacctgggaggtggaggttgcagtgagcagagattgcattactgcactccagcctggatgacagagcaagactctgtctccaaaaaaaaaaaaaaaaaaaaaaaaaagcaattccctccgttaacaaccacaatcctattcctgcttcatcatttttttttctatagcgcataaagtcatctaccatcctgtatctttttacaatctgtcttctctaactggaaaa

SEQ ID NO: 137144 - DNA, 601 bp, Human
aaatctacatatgactaccaccaggaaccatgagttaatccccaaattattttgagacaaaatcttctgaaaaagcaaagccaagacacaagtattttttggttttactagtttaatcatggcctctgatggaacctccagtaaaatcccaactccctctgagtgaaagccttacaatggccaaaagggtcctgcacaatctggacttgattacctctctggcctcatttccaactacgttttcctgatctcactatgtaccagctacactgccgttctttgttgtgattcctcagaatargcccattcctgccttggagcattgtacgtgtcattttctgtctgaataagtcttcccctagatgttctcagggcacactccttcaccattgctaagactttccttgtcaccatctctgtgaggtcttccctgatacccttaaaaatgaattcctggctgagcgtggtggctcacgcctgtaataccagcactttgatatgccgaggcgggtggatcacttgaggtcaggagttcaagaccagcctggccaatatggtgaaaccccgtctctactaaaaacacaaaaatcagctgggcgtg

SEQ ID NO: 137145 - DNA, 601 bp, Human
gtgaaacaccatctctactaaaaatacaaaaaaaattagccagatgtggtggcgcacacctgtaatcccagctacttggaaggctgaggtgggaggatcacttgaacccaggaggcagaggttgcagtgagccaagatggtgccattgcactccagcctggatgacagagtgagaccccgtctcaaaaaaaaaaaaagttcaaagcatacattattaaaataacctaatagagtagatgtctatctagcctccaataatatataagtgtgagtacatcttgcaaataatacagtttttttwaaaaaaaagacaatttaggatgagaagtcagtaataaagcagggccacccaggaataaatacctataggcaggattttctattacgttctttgaatttaaatgccatacctaagatctatatttcagggaaattttctgtactaatataaaggtttaaatctacatatgactaccaccaggaaccatgagttaatccccaaattattttgagacaaaatcttctgaaaaagcaaagccaagacacaagtattttttggttttactagtttaatcatggcctctgatggaacctccagtaa

SEQ ID NO: 137146 - DNA, 601 bp, Human
gagtcccctggcttttatagaagccaaattcaacaggcagttctctttggccatctatacttcagccaagccatttaaaaatatttcttgctaacatgattcggctatggaagggacccaaggaatgaatttcaaaggagaaagtctaattagtcttagggcatacaatttgaaataagttcattaacttggaaactgaaaaggcccacctgctccaggggatttggtctcctacaagggcaactgattatgttcagcattaactattactatccagcagtaaagaattcagtattcccaygagatacttttcttcctgaaaggcacctagacctccttccaactttaaaagagaagggaggtatatgtatgtttttaatcttctcctttacagtcttaactaaaaaagcctaactactatttacatggaccacgtgccttacctagaaacaatctgcagaaaataaattccctcttctaacattattaaaaataagcaaaattctatgttaatgttacagttctaagtaaacgaaatggaacaaaggatgggcaggaatttctcagttttaaatgttcattccaaaattcatgactcaag

SEQ ID NO: 137147 - DNA, 601 bp, Human
caatgaaggtttgattttatgcattagttaagaacaaaaaatttggctctggagaggtggattataggcacagctctacactgagtaatcctaaaataccaatttgaacttattttgaggttaaaaaaacttcaaactgatctaacaatgaacaatttatgaattatctaagcccaggaaaaggccaaattttaataactggtttattttaatgccttaattgttgttactcatccttggttcattattataaccagaaaaaagaaactactactttgatcttgaccattttttcccacckttttttgcttctgacttattttgtagctacatcttttcccttcttctaatttttaaaaatctctaacctcacagccagcagaactggagaatctgtctcagactctgaggagctcttaaccaaacaacctgctggaaaggaaattgactaggacagcacaagtctaattaatttcactcatagcaggaaccatgggcaaagtgttcatcagcaaagtagcctagtgctacatgaactctctagcacttcatgccaactgctgcagatgaccagcagaaaaaaattttagaaaagaggaga

SEQ ID NO: 137148 - DNA, 601 bp, Human
ctcacaaatattcactgactacttaaataataaacacggagattaataaactacagttgcactttcacagagtaatactcataaatgaaatgagatgttattcccatggtcataaacactatcttacaggaatttccttttttttgagacggaatctttctctgtcgcccaggctggagtgcagtggcgatcttggctcactgcaagctccgcctcccgggttcatgccattctcctgcctcagcctcctgagttgctgggactacaggcacccgccaccatgcccagctaattttttgtrtttttagtagagacagggtttcaccatgttagccaggatggtctcgatctcctgacctcgtgatttgcccaccttggcctcccaaagtgctgggattacaggcatgagccaccacgcccggccaggaatttacaattaaagaatctgtgaaatcacaaatgaagctaacatggtgtgctgtctcacttaagctagcaacctaagcactgcagtggcatttgggcctccctggcttgtgcaattcatgattccatgataacatgaagaaaagaagccaaatgctactgtggtcacctccaa

SEQ ID NO: 137149 - DNA, 601 bp, Human
atccaactcaaaattcttccctccaacagcctttctaaataccaaagccattaaaaaaactggtgaacttggggatgagggagtgggactggggagatgtaggtcaaggggtacaaagttgcagatgggtaggatgaattcatctagagatctactgtacaacatgagggctatacttaataatatcgtattgtataatggaagtttgccagaagagattttaggtgcttttaccacctacgcgggaacacacacacacgcgcgcgcgcgcacacacacacacacacacacacacacacacacacggtaactgtcagataatggatatgttaattggtttgattatagtaatcatttcactatgcatatgcaaatcaaaacattatgctgcatacctcaaatatatacaatttttactattttttttgagacagggtctcactttgtaacccaggctgcagcacagtggcgcaatcttggctcactacaacctctgcctcccaggctcaagcaatcctcctacctcagcctcctgagtagctaggactacaggcgtgcaccaccataccaccttgctaattttttgtatttttttgtggag

SEQ ID NO: 137150 - DNA, 601 bp, Human
gtaacaagaacgaaactccatctcaaaaaagaaaaagaaaaaaaaaagaaatgtgtggaccaggcacggtggcttatgcctgtaatcccagcactttgggaggccaaggcaggcagatcacttaagttcgagaatggcctgaccaacatggtgtaatcctgtctctactaaaaataccaggcgtgctagtgggcacctgtaatccctgcttctctggaggctgaggcaggagaatcactttaacccaggaggcagaggttgcagtgagccgagatcgtgccactgcactccagcctgggcratagagtgagactctgtctcaaaaaaaaaaaaaaaaaaagtgtgaataatcttttatagataataatatacataatcttttatagatattttaccaatctggcaacaatattctaagactaaaataaaagaggcaatatgaaggaagcacagacaaaagtaaattatcattacgcagcacagaattccaggccagacttctaaatagtgttagagatgccaatctgttacggagagatcaaaacaaaattcagacagaataggttcaactaagttgtaaatgtcattagtcaaatgcatg

SEQ ID NO: 137151 - DNA, 601 bp, Human
ttcaaactgtgatctgtttacataacatctaacctcatgtaaaaccaactaaattctcatttcttcattcaggcaactgagtataatctgtgacgttagatttacacagaattcacactccaagtttatcagacataaaagaactgccacattttatgtatttattatagatgctatcactctagtatttccttcttttacttggtaattaaaaaggagaggggataccaaattatgcaaactatattttacatatttagtgtggtattataagaaactgcctccaaagttttctaatcayttgcaactactctgttgcaatacagaaggctggctgggcgtggtggctcacatctgtaatcccaacactttggcaggctgaggcaggcggatcacttgaggtcaggagttcgagaccagcctggccaacatggtaaaaccccatccctactaaaaatacaagaattagccaggcctggtggcatacacctataatcccagctacttgggaggctaaggcaggagaatcacttgaatctgggaggcagaggttgcagtgagccaaggttgcgccactgcactctagcctgggtgacagagc

SEQ ID NO: 137152 - DNA, 601 bp, Human
aagcattacaggttagttccaagttattggtcatatttttaggttgagtggtgggtttagtatattctcatgctttataacctacaatgatgttacctattgaatcaccatttgtgtaggtcaagaacaagcaaatattggtattttcatccagtacaaataatatattcaaataatccaataattaaaggataaaaaggtaaaaatgaatagattcatttatttaaaatttagcaaaaatacctattcccatgctatgaagtgtgtgtgtgtgtgtgtgtgtgtgtgtgtgtgtgtgtgtataaaactattagtttaaaaaatttagagacagggtctccctctgttgcccaggctggagtgcagtggtagcggtgtgatcacagctcactgtagcctccaactcctgggcttaagcaatcctcctgcttcaccctcccaagtagctaggactacaggcacgtgccatcatacctggctaatttttaatttttttgtagagacagggtctcactatgttgcccaggctggtctcgaacttctgggcttgaatgatcctcctaccttggcctccgaaagtgctgggattacaggttatagt

SEQ ID NO: 137153 - DNA, 601 bp, Human
atcatcctctgagtggggaaacaaatcttagggattggggagaagcattacaggttagttccaagttattggtcatatttttaggttgagtggtgggtttagtatattctcatgctttataacctacaatgatgttacctattgaatcaccatttgtgtaggtcaagaacaagcaaatattggtattttcatccagtacaaataatatattcaaataatccaataattaaaggataaaaaggtaaaaatgaatagattcatttatttaaaatttagcaaaaatacctattcccatgctatraagtgtgtgtgtgtgtgtgtgtgtgtgtgtgtgtgtgtgtgtataaaactattagtttaaaaaatttagagacagggtctccctctgttgcccaggctggagtgcagtggtagcggtgtgatcacagctcactgtagcctccaactcctgggcttaagcaatcctcctgcttcaccctcccaagtagctaggactacaggcacgtgccatcatacctggctaatttttaatttttttgtagagacagggtctcactatgttgcccaggctggtctcgaacttctgggcttgaatgatcct

SEQ ID NO: 137154 - DNA, 601 bp, Human
ccatcctcacgccaactctacttgtccgccaacacaggaaaagctcccacagggtaaacaccaattctttcacccttccccacaggtcatgtttccacagaccgcagggcctagaagggcagaccattgagttctctctctgatgtacctaaacaatgaaagtccgtttcccaatgtgcgttttggggaccactaatcttgcaggtgatccttgagaaaaaggattccagggttaactaaattggagaaatgctgtctatcataattcctgttagaaaattcacagtaacattaatatgcyacatgttctgagaaatcctgcagtaagatagcaactatttgtcttggttaaactcagtatttttcataagactttcccaccaacctaatatctgttgatatttcaccttattttgggaatcactgaccgaattattttaggtaatcatcatatgtctttgattctaagatctgcatttttatttccacacttgaacacttctcaaattgaaatgtgtcatgaagtacaatttattctactattaagctattaattctctcataattttgaagaaatactgtttatttcaataactactaa

SEQ ID NO: 137155 - DNA, 601 bp, Human
agattgcgctgtctacctggtggtcagtggcagcaacagtggctgctgcttctggaaattaaacggagtcttacaacaagcaggatcttaggattgcttcaggcgtttgcgtgggggtcccagaaaagggcactgtgctgaagccagagagcggtatgcctcagccaccaagtggggatgtgacaccaccattgacttccacccagaggtctccaagacatccgaagcatgactaggagaaatgtggagaaatgggttaccaaagggagtgagcaagggatgaattcaacagccacctagrtagcctaattttccactgttaggtataaagggtgtcaatgcaagaaacagaagaacccttaatatgcataagaatttgcttgttagacaatgagcagactggtgacttgcctgtggctgtcgtcatctgaaaaccaagactttgagccactatattctcaaaaacaaaaagcagaatgttccccaggcccccaacactgcctatgttccttatattcaccggtgatgctagtcataaaaaggagcatgggctccctcggccagaagccctgagcttctgcctggctttgccactcaccag

SEQ ID NO: 137156 - DNA, 601 bp, Human; identical to SEQ ID NO: 24331

SEQ ID NO: 137157 - DNA, 601 bp, Human; identical to SEQ ID NO: 24332

SEQ ID NO: 137158 - DNA, 601 bp, Human; identical to SEQ ID NO: 24333

SEQ ID NO: 137159 - DNA, 601 bp, Human; identical to SEQ ID NO: 24334

SEQ ID NO: 137160 - DNA, 601 bp, Human; identical to SEQ ID NO: 24335

SEQ ID NO: 137161 - DNA, 601 bp, Human; identical to SEQ ID NO: 24336

SEQ ID NO: 137162 - DNA, 601 bp, Human; identical to SEQ ID NO: 24337

SEQ ID NO: 137163 - DNA, 601 bp, Human; identical to SEQ ID NO: 24338

SEQ ID NO: 137164 - DNA, 601 bp, Human; identical to SEQ ID NO: 24339

SEQ ID NO: 137165 - DNA, 601 bp, Human; identical to SEQ ID NO: 24340

SEQ ID NO: 137166 - DNA, 601 bp, Human; identical to SEQ ID NO: 24341

SEQ ID NO: 137167 - DNA, 601 bp, Human; identical to SEQ ID NO: 24342

SEQ ID NO: 137168 - DNA, 601 bp, Human; identical to SEQ ID NO: 24343

SEQ ID NO: 137169 - DNA, 601 bp, Human; identical to SEQ ID NO: 24344

SEQ ID NO: 137170 - DNA, 601 bp, Human; identical to SEQ ID NO: 24345

SEQ ID NO: 137171 - DNA, 601 bp, Human; identical to SEQ ID NO: 24346

SEQ ID NO: 137172 - DNA, 601 bp, Human
ggaggagttctggtgtctggactgcacccagagcaattaaccccgggtccctgggagtggattccgggattgctgtgtttaaaggtcccccaagtgatgctaatgtgcagccagggctgagaaccactgcattagcttccttgatctgcacaacgcctccatgaagagtagggctgggactgcctctctattttatggctgagaggctgaggcctagagagacttgagtggcctccccaaagtggcacagcttgtcaggggctggaacgtgggtctcctgattatctcacccattgtcacrtccactatggacctgtgagcttcccgccacgggcaatatgtatgtatagagagaaaggcaggatatcaaggcagaatggagggaggttcagccatgagaacctggtgagtattgacagatgatgtcatcatctacgtggcagaaaagagaagcaatggaaaagctattattttattttattttgcttcagagatggtgtcactctgttgccccagctggaatgcagtgtagtcctgaactcctgggctcaagaaatcctcccacctcagcctcctgagtagctgagactacagccatgta

SEQ ID NO: 137173 - DNA, 601 bp, Human
gatgtcatcatctacgtggcagaaaagagaagcaatggaaaagctattattttattttattttgcttcagagatggtgtcactctgttgccccagctggaatgcagtgtagtcctgaactcctgggctcaagaaatcctcccacctcagcctcctgagtagctgagactacagccatgtaccacgatgcccagctaatttatttctttattcatgtatttatgtatttatttatttatttattttttgagatggagcctcactctgtggccaggctggaatgcagtggcgtgatcactgcragctctgcctccctggttcatgccattctcctgccttggcctcccaagtagctgggactacaggcgcccaccaccacgcccggctaatttttgtatttttagtacagacagggtttcaccttgttagccaggatggtctcaatttcctgaccttgtgatccacctgcctcggcctcccaaagtgctgggattacaggcatgagccactgtgcctggcctaattttttatttttagtagacatgaggtctcactgtgctgcccagcctggtcttgaactcctggtctcaagtagtcctccc

SEQ ID NO: 137174 - DNA, 601 bp, Human
ctcagcctcccaaaacactgggattacaggtattagctaccacacctggcccaaaaagttattagacccaataagataattcaggaagtccaagaggtcaaaacaagatcaaaatacccaaaccccctaggtttcctacatgctagcaataaccaatcaaaaggatagttgaaaagatcccattcaaattcatcagaaaagtgatagagcatctgggaataaatataacaaatatgcagcaaaaacttgagaaatgattagaaaaaagtcaatattgtattatcaagttgtcagatcttccacccaaattattccagtctcagtaggattcaggaaacttgaaaaagaagttcccaatcttgaatctgagttgcatctagaagaataaatataaaattgctaataatttgttgtgaaaaggatataagtgaagatacgtgggagatacttatagggagatgaatgcagggttggttatgtacattattgtacatttcctaagatcaattaatgtagtatagaagaggtagaagaagggccagaaagatcagtggaacaaaatagaactttatggtacagatggcatttttaatctgtggag

SEQ ID NO: 137175 - DNA, 601 bp, Human
ggcgtggtggtgcatgcctgtaattctagctactcaggaggctgaggcagaagaatcgcttgaacctaagagagaaatgtagtgagccaagatcactccactgcactccagcctggacgacagagtgagactctgtctcaaaaaaaaaaaaaaaaaaaaaaaaaagaataatgctgtctaatgctgatgaggtggagagaaatgctattgatttggatgataaattggtagattcttttaggagacgaagttttcagtatctattaaaatttaaagtgcccatttccttagatccagtacmtgagaatatattgtaaggagctaataggacaagtatacaaagataaatatatggggatattttagataattatttataatggcagaaagttggaaacaatctaaatgtctttcagtaggagattggttcaataaattatggtacatttccttcaatgactgtgcagtcctcagaagagattaggctgatctttaccaattgacgtgaaaagatgatgatattaagtgaaaaaaaaacaggttgctggctgggcatggtggcttatgcctataatcctaacactttgggaggccaaggtag

SEQ ID NO: 137176 - DNA, 601 bp, Human
aaaaaaaaaaacctcatatacacacacatccgtatttatctccattgtaggggaagaaaaagaatgggactatcagccgggcatggtggctcacgcctgtaatcccagcactttgggaggccgaggtgggcggatcacctgaggtcgggagttcgagaccagcctgaccaacatggtgaaacctcatctccactaaaaatacaaaattagccaggcgtgatggtgcgtgcctgtaatcccagctactcgggaggctgaggcaggagaatcgcttgaacctgggaggcagagctggtggtgrgccaagattccaccattgcactccagcctgggcaacagagcaagactctgtctccaaaaaataaaataaaataaaataaaataaaaagaatgggaatatatgctatgaattctttgtggggtttttttggtgaatatttatggagtgtttgctgtgtagcaggtgttgctctaagcagttttcttatatcaaacacacttaattctccccagcaacctatgagagaggtaatattcccattttacagatgaacaacagagaggttaagtaacttgccaaggccaaacagctcgtgaatag

SEQ ID NO: 137177 - DNA, 601 bp, Human
agaaagcatgagattcagaggggtgcaattacttgtccaaggtcacacagctcatcagggaaggagctggtacccaggcccagatgtgtgggtcacacacccagactccaggccacctcccagatctgaggccgctcctctggagtcaagtctgtgcctgggagaagcaggaaggaccactggacctgctgtcagtggggcaggcacaggctttttccagtcccaggctgccccctactggcagcaggacaaacagcaggtgcctgggcccagctaggataggaagggtgaggatgggccyaagcaggctgacacagggctgagtcctcctctccccgctccagttctctgtggacattgactcggagctggtggaggagctgccggccgaaatcgagctgtggctggtgctggtggccgtgggtgcagggctgctgctgctggggctgatcatcctcctgctgtggaaggttagtagcccagcccactcctgctccgggacctccaccagcacactcaccagcccttcctccaacccacgtctccccatcctggtcctcccttccatctcacccccacccttcctccctgtcctctccac

SEQ ID NO: 137178 - DNA, 601 bp, Human; identical to SEQ ID NO: 24347

SEQ ID NO: 137179 - DNA, 601 bp, Human; identical to SEQ ID NO: 24348

SEQ ID NO: 137180 - DNA, 601 bp, Human; identical to SEQ ID NO: 24349

SEQ ID NO: 137181 - DNA, 601 bp, Human; identical to SEQ ID NO: 24350

SEQ ID NO: 137182 - DNA, 601 bp, Human; identical to SEQ ID NO: 24331

SEQ ID NO: 137183 - DNA, 601 bp, Human; identical to SEQ ID NO: 24332

SEQ ID NO: 137184 - DNA, 601 bp, Human; identical to SEQ ID NO: 24333

SEQ ID NO: 137185 - DNA, 601 bp, Human; identical to SEQ ID NO: 24334

SEQ ID NO: 137186 - DNA, 601 bp, Human; identical to SEQ ID NO: 24335

SEQ ID NO: 137187 - DNA, 601 bp, Human; identical to SEQ ID NO: 24336

SEQ ID NO: 137188 - DNA, 601 bp, Human; identical to SEQ ID NO: 24337

SEQ ID NO: 137189 - DNA, 601 bp, Human; identical to SEQ ID NO: 24338

SEQ ID NO: 137190 - DNA, 601 bp, Human; identical to SEQ ID NO: 24339

SEQ ID NO: 137191 - DNA, 601 bp, Human; identical to SEQ ID NO: 24340

SEQ ID NO: 137192 - DNA, 601 bp, Human; identical to SEQ ID NO: 24341

SEQ ID NO: 137193 - DNA, 601 bp, Human; identical to SEQ ID NO: 24342

SEQ ID NO: 137194 - DNA, 601 bp, Human; identical to SEQ ID NO: 24343

SEQ ID NO: 137195 - DNA, 601 bp, Human; identical to SEQ ID NO: 24344

SEQ ID NO: 137196 - DNA, 601 bp, Human; identical to SEQ ID NO: 24345

SEQ ID NO: 137197 - DNA, 601 bp, Human; identical to SEQ ID NO: 24346

SEQ ID NO: 137198 - DNA, 601 bp, Human; identical to SEQ ID NO: 137172

SEQ ID NO: 137199 - DNA, 601 bp, Human; identical to SEQ ID NO: 137173

SEQ ID NO: 137200 - DNA, 601 bp, Human; identical to SEQ ID NO: 137174

SEQ ID NO: 137201 - DNA, 601 bp, Human; identical to SEQ ID NO: 137175

SEQ ID NO: 137202 - DNA, 601 bp, Human; identical to SEQ ID NO: 137176

SEQ ID NO: 137203 - DNA, 601 bp, Human; identical to SEQ ID NO: 137177

SEQ ID NO: 137204 - DNA, 601 bp, Human; identical to SEQ ID NO: 24347

SEQ ID NO: 137205 - DNA, 601 bp, Human; identical to SEQ ID NO: 24348

SEQ ID NO: 137206 - DNA, 601 bp, Human; identical to SEQ ID NO: 24349

SEQ ID NO: 137207 - DNA, 601 bp, Human; identical to SEQ ID NO: 24350

SEQ ID NO: 137208 - DNA, 601 bp, Human; identical to SEQ ID NO: 25416

SEQ ID NO: 137209 - DNA, 601 bp, Human; identical to SEQ ID NO: 25417

SEQ ID NO: 137210 - DNA, 601 bp, Human; identical to SEQ ID NO: 25418

SEQ ID NO: 137211 - DNA, 601 bp, Human; identical to SEQ ID NO: 25419

SEQ ID NO: 137212 - DNA, 601 bp, Human; identical to SEQ ID NO: 25420

SEQ ID NO: 137213 - DNA, 601 bp, Human; identical to SEQ ID NO: 25421

SEQ ID NO: 137214 - DNA, 601 bp, Human; identical to SEQ ID NO: 25422

SEQ ID NO: 137215 - DNA, 601 bp, Human; identical to SEQ ID NO: 25423

SEQ ID NO: 137216 - DNA, 601 bp, Human; identical to SEQ ID NO: 25424

SEQ ID NO: 137217 - DNA, 601 bp, Human; identical to SEQ ID NO: 25425

SEQ ID NO: 137218 - DNA, 601 bp, Human; identical to SEQ ID NO: 25426

SEQ ID NO: 137219 - DNA, 601 bp, Human; identical to SEQ ID NO: 25427

SEQ ID NO: 137220 - DNA, 601 bp, Human; identical to SEQ ID NO: 25428

SEQ ID NO: 137221 - DNA, 601 bp, Human; identical to SEQ ID NO: 25429

SEQ ID NO: 137222 - DNA, 601 bp, Human; identical to SEQ ID NO: 25430

SEQ ID NO: 137223 - DNA, 601 bp, Human; identical to SEQ ID NO: 25431

SEQ ID NO: 137224 - DNA, 601 bp, Human
gcccccgctgtgccacgtttctcccctaacccacttctcagatgtctttcccatcccccaggtcacagcctacaatcgggacagctttgataccactcggcagaggctggtgctggagattggggacccagaaggtacctctagctgtgccccatcccttccccaccaatgccagtcttggggaatctctcccggagggggagggggctgtggacaggagaggcttggagaggagtggagcagggcatcctggaaagtggggacaaggctctcagggaatgggtgctgggctgggattccrggctctggagttctgttactcgctgcgttgcagagactattgggacttggcttgttggggtctgtgatggatggggcattgaggggcctgaaggggtgtgcagggatgtggggaggagcttcaaggaggctttgcggggcagagctggggctgggtgcagcctgaggtgtccacctggccttcccaggccccctgctgccataccaagccgagttcctggtgcgcagccacgatgcggaggaggtgctgccctcaacacctgccagccgcttcctctcagccttggggggactctgggag

SEQ ID NO: 137225 - DNA, 601 bp, Human
cccctaacccacttctcagatgtctttcccatcccccaggtcacagcctacaatcgggacagctttgataccactcggcagaggctggtgctggagattggggacccagaaggtacctctagctgtgccccatcccttccccaccaatgccagtcttggggaatctctcccggagggggagggggctgtggacaggagaggcttggagaggagtggagcagggcatcctggaaagtggggacaaggctctcagggaatgggtgctgggctgggattccaggctctggagttctgttactcrctgcgttgcagagactattgggacttggcttgttggggtctgtgatggatggggcattgaggggcctgaaggggtgtgcagggatgtggggaggagcttcaaggaggctttgcggggcagagctggggctgggtgcagcctgaggtgtccacctggccttcccaggccccctgctgccataccaagccgagttcctggtgcgcagccacgatgcggaggaggtgctgccctcaacacctgccagccgcttcctctcagccttggggggactctgggagcccggagagcttcagctgctca

SEQ ID NO: 137226 - DNA, 601 bp, Human
gctgctcaacgtcacctctgccttggaccgtgggggccgtgtcccccttcccattgagggccgaaaagaagggtaggtgtgcaaccctagaggacttcctgaaagaggaggatgcagcttgtggcgggcatagaacaagggtctccctaatttccaggtggggctttaccacgcacatctccacctcccagcttcacacccctcaccactctcctctggctatacccgcatctccttgtccttccagagcctagaccctagttaccctgaactctgtacttcctggtgcctcatgaggacrtaccagatacatccattaaaagacattccttagtagggagggtaagaccccctagaagaatggggtgctctgtgtactctcaccatgatctcagatctctgggaggactgtgactcctgccagaccccagctgtgccatgttcctcccttaatcctccctcttaggcgtctccctcatcccatccccaggtcatagcctacaattaggaaagtttcaacaacccctggcagagtggtgcctcgtgccccctgcccccactctgctgacagtgacttctatctggtcccagggtatacatt

SEQ ID NO: 137227 - DNA, 601 bp, Human
agggtaggtgtgcaaccctagaggacttcctgaaagaggaggatgcagcttgtggcgggcatagaacaagggtctccctaatttccaggtggggctttaccacgcacatctccacctcccagcttcacacccctcaccactctcctctggctatacccgcatctccttgtccttccagagcctagaccctagttaccctgaactctgtacttcctggtgcctcatgaggacgtaccagatacatccattaaaagacattccttagtagggagggtaagaccccctagaagaatggggtgcyctgtgtactctcaccatgatctcagatctctgggaggactgtgactcctgccagaccccagctgtgccatgttcctcccttaatcctccctcttaggcgtctccctcatcccatccccaggtcatagcctacaattaggaaagtttcaacaacccctggcagagtggtgcctcgtgccccctgcccccactctgctgacagtgacttctatctggtcccagggtatacattaaggtgggttctgcctcacctttttctacttgcctgaagatggtggcatcccccgatagccacgcccgc

SEQ ID NO: 137228 - DNA, 601 bp, Human
ctgtgcccagggccagcctccacttctgtcttgctacgacaccttggcaccccacttccgcgttgactggtgcaatgtgaccctggtgaggagggaccctgggtccgggggtggggtggggcatggcccccatcccagtcccccttccctcccatgctgcttcctatctccgtctctctgattgctccagtcaccatttctttccctgatgctctcagtattgcccacaggcttagtctgaggatacacacacacacacacacacacacacacacacacacccctgaagttctacctttcycccacaagagggcaacagagtccgcaatccgcatgtggggtctccaactcccgcgccccagatctgcccaggtcaacagctatatcacagtccagttcccaaaccctttccctaccaagggcctctgcgtgacagctctgtctgcttttctgtaaggtgccacctagcaaacccacttacaacaaggatctgatagctcttcacactataaaccaaagatgctcacaacagctctttggatactgagctgaggttcacaggatcccacggctggtgtacactgttcctgtgaattgacca

SEQ ID NO: 137229 - DNA, 601 bp, Human
gtttcccctactcatggccttacccctcctatgtgcccccagccctcttcctctcccaataccctgaaccctagattccaggaggcagatgtgaaataagttatgttccttttattcccactgcactgagccaatggcggtcttggcacccctgactgcttgcctggcctgcctcattaattgcagtggcacttggccacccttcgaacccccttgataagccgcttgtgcccctgtttggagcccagtagtgacctgtgctgtccaaaggggcgctgcccagagcgccacctctgctgtygttgcctcttgaccttgagcttggacttggaggcctgcttcttgcccagggtgaaggagcctgaggcccccctgccggtcacctgctgagcccttgtccaccagccccttgagcacacgcttgaagtgataggcatttcgggccatgtcgtagcccgtggtggaaacagccttcttcagggtggccagggacacatacttgcaggtccccttgtccgccacagccctcaggatcaccttggacgtgctgggcttctggcagggtttggcacaggtgcgttgcccagtcgctgtcttgcta

SEQ ID NO: 137230 - DNA, 601 bp, Human
ttctgttttcaattttatagaatttttccccatggggatcagtgatttttcatgtacatttcactaggaagattttattcctcaatttttttggactgaaccaaatttaaacactaacatctactggcactggggatattctcttgtgaccagtatttcctccacatccagccttccccgggtcaactctgtagctctgatgttgtcagaaaaatctgctgcctcagtcaatgtgaaatcaataaccgttttaccatgtgcaacgttagccttggctggtttggatttcacgttgatgtayttctacaaaatccaatttttcacttgttcaatgtctgccacttttcagattatccacaagttatgattctgctgcctgcttttcacctagatcagatttcagcggtcacagagtcctccaggccccacgaccctctcctggggatttctgtgccagaggcagtgctttcgggactgtgtgttggtggtggagtgggtgtgggtgagacctaggccacgtgtgtgtgtgtctgtgcgtgtgcctgagtgtgtaggaatgcctgccgtttgtctgcccaagtgctgatgtggaaggaccgtg

SEQ ID NO: 137231 - DNA, 601 bp, Human
ctcaagtgatccacccgcttcggcctcccgaagtgctgggattacaggtgtgagccactgcgcccggcctggtggtaggtgttattatctccatttggcagttgagcaaactaaggcatggagtggttaagcaacttgcccaagacacacagccttgaacccaggctgtctacacccacagcccatgtcttgaccactgggcactgagcaggcaccatagagctttcttttttttgttttttttcttcttttttttactttgagatggagtctcttgcgatctcagctcactgcaacctcygcctcccaggttcaagtgaatctcctgcctcagcctcctgagtagctgggattacaggtgcccaccaccacacctggctaatttttatttttattttttgtagaaacagggtttcaccgtgttggccaggctggtctcgaactcctgacctcaagtgatctgcctgccttggcctcccaaagtgctgggattataggcatgagccaccacgcccggccccatagagctttctgtttgttttctgcccctgcatcatgtgtctgagtctctccccacataagtggtggggaggaccgcagg

SEQ ID NO: 137232 - DNA, 601 bp, Human
tagattttcagaaaagttgcaaggatagtgcagactttctttctttccctgtcccccttcttccccccttccttctctccttcctttcttgtttcttctgccctttctctcactgtctttccatacttccctcttgctgccttcacttttccctttttcagcttctctgcctctcggtggctgcttccctccgctttcccgcaacttccgtgggtccttctcattgccccctcacgactcctagtctccccatcccttatccaaaggagggcccctagagtttccagcccctgccgcctayccccaagccctctgcgacttgatcgaggatcgcctgctgaaatgcccacgaaatcacctcgattcggaggtttcctaacaacccacagccttccccttcctctctcagctcaccccgatcctcatccgggaccgcggcgcactgcgcacatcgcgccccaaatgcttgcacacccggggctggaaggtcgcctggtccctctgagggtcatctaggccaacttctctaactccagacagtacttttcttagaagttttcctagattttggcttccagtccatgccttttcctccctcggg

SEQ ID NO: 137233 - DNA, 601 bp, Human
tgcaggccagatgggtgctcagtacacagccccagggttgggcgggggcccgggagaggcatggtgcagggtggctggctgaggcggctgctgctgtaagtggggtccactcaggttctgtgcgtgataccaggagttggtggggtcgtccaggtagctgggggaggcactgtatgggagcggcgggggcagctgactgcgggcaggggccggagtggagtgggaagaggtgtcccagagggcgggtgatggtggtgagttgcaggccatggaatcactgttattgggactgtgctccagyggcacctccccgttcttgtagagtttcttgaacttggaacggcggttctggaaccagattttcacctgggccagagaagaaaggggtagctagttagcctctcagaatgctaaaacaaccctgggaagaacctagccaagaaaaagaaaggccagaacccaatttcacataagaatcaggcaaaaaacaggcctcctgactcccagtttcttggatctgggatagaattgtggctaggaacgttcagctgcctgggtccaaattctgctctgtcacttactaagcgtgaccttgggcaag

SEQ ID NO: 137234 - DNA, 601 bp, Human
agtaccaagagacacctgtatttttgctgccagaggggctctgaactgcctccagggcctccctctttctctttgtggtatctgtgactccccacaggcttcaggagggtccctgtacgcctctgagccggagggacataaggacactcccctccacccccaactaactgaagctagttaggcttttcttggtacattctgcttcttggcctctcctttttaagggaccaggtttcctagagaggagatctagacccaggtaggaagtgtgtgtgtgtgtgtgtgtgtgtgtgtgtgtgtgttgcaagggaggacagcaaaaggctcagaagtgcaagctttggtgtggagagcaggggtactggcagacagtcacccctgcctcagatcagaggggagcatgctggcctttccagtatgtgttcctgcaagtgtgagggagcgcgctcccctctcggggaggagttcctccgcattccctctctggctgttgtgtcacatctggaagtttgtgtaggagtttctccaagctcagagcccagcacagctttttctcatttggaaatcacaggctggcatttgggatgccgagagaggggga

SEQ ID NO: 137235 - DNA, 601 bp, Human
taccaagagacacctgtatttttgctgccagaggggctctgaactgcctccagggcctccctctttctctttgtggtatctgtgactccccacaggcttcaggagggtccctgtacgcctctgagccggagggacataaggacactcccctccacccccaactaactgaagctagttaggcttttcttggtacattctgcttcttggcctctcctttttaagggaccaggtttcctagagaggagatctagacccaggtaggaagtgtgtgtgtgtgtgtgtgtgtgtgtgtgtgtgtgttgcaagggaggacagcaaaaggctcagaagtgcaagctttggtgtggagagcaggggtactggcagacagtcacccctgcctcagatcagaggggagcatgctggcctttccagtatgtgttcctgcaagtgtgagggagcgcgctcccctctcggggaggagttcctccgcattccctctctggctgttgtgtcacatctggaagtttgtgtaggagtttctccaagctcagagcccagcacagctttttctcatttggaaatcacaggctggcatttgggatgccgagagagggggagt

SEQ ID NO: 137236 - DNA, 601 bp, Human
agcttcagttttcaattcagctggaagcctctctccccctacacccacgcactgaagcgtggtgaggggggaaccacagggaaataggcttgtggggtgggggggggggttctgctgggggaatccccctttgagctttggagcagggcggagcccctacatcccatgttaccctaggggttgccgaatccgatagacaccaggagcctctctgtgggatgggtgaggcaaggacctatccccctacctcctcatttactagaaggccaggactcctgggtccaggcccattttctcctcmacgttccttagtctcacatttccaggctcctaggtgggaatggggccgctggagggcctgcttgccttctcagcccatgcccagagcccctgtgcccctagaggtgtcccagccacccccctcctctccctactttcctcacccttgcggctgccaggctaagcaagggctctatctagataaagccccacacagaggactcatttgtggagataacatgctctagttctctctcccaggagggaggaaaggaggagggatggaagtggggttcctctctctgccgtttcctttttctct

SEQ ID NO: 137237 - DNA, 601 bp, Human
tatggcaaccagtgtcccccgttcccttggttaccatggggatctgtcacatggttttcccccaacctgataacctgtgggtctccctgattctcctcccctgcataaggacaagacaacagcctcagtcaggggagatcatgtgagaggggtctttttaattaccatgacaacaaatccacaccacctggtgacacatcctcctgtcgttatggcaacagaagaacatcacacagtgacatactgccatgttcccaaggaaacaagccctactctgagaagggtgaaagaccccccccccattaattattcctctattcagagtgtcccaaattgtcgtgtgccttggtctcttccctgtccgtttatgcttacgtgtcgtggaaggagagctgtacagggtgggcaggatgttacttggaagtaggctgaattgccaagggacccttaagaaggggctgacatgatcaagagctgtgcatgaggttattcgggggcaggctttgcctgtaagaggcctccagtctgagcctgggtaaggtggggacagaaagaggggcaactcctctgtgaggtcacttctgtaccttcccccagttat

SEQ ID NO: 137238 - DNA, 601 bp, Human
ggcaaccagtgtcccccgttcccttggttaccatggggatctgtcacatggttttcccccaacctgataacctgtgggtctccctgattctcctcccctgcataaggacaagacaacagcctcagtcaggggagatcatgtgagaggggtctttttaattaccatgacaacaaatccacaccacctggtgacacatcctcctgtcgttatggcaacagaagaacatcacacagtgacatactgccatgttcccaaggaaacaagccctactctgagaagggtgaaagaccccccccccatyaattattcctctattcagagtgtcccaaattgtcgtgtgccttggtctcttccctgtccgtttatgcttacgtgtcgtggaaggagagctgtacagggtgggcaggatgttacttggaagtaggctgaattgccaagggacccttaagaaggggctgacatgatcaagagctgtgcatgaggttattcgggggcaggctttgcctgtaagaggcctccagtctgagcctgggtaaggtggggacagaaagaggggcaactcctctgtgaggtcacttctgtaccttcccccagttataag

SEQ ID NO: 137239 - DNA, 601 bp, Human
gggatctgtcacatggttttcccccaacctgataacctgtgggtctccctgattctcctcccctgcataaggacaagacaacagcctcagtcaggggagatcatgtgagaggggtctttttaattaccatgacaacaaatccacaccacctggtgacacatcctcctgtcgttatggcaacagaagaacatcacacagtgacatactgccatgttcccaaggaaacaagccctactctgagaagggtgaaagaccccccccccattaattattcctctattcagagtgtcccaaattgtcrtgtgccttggtctcttccctgtccgtttatgcttacgtgtcgtggaaggagagctgtacagggtgggcaggatgttacttggaagtaggctgaattgccaagggacccttaagaaggggctgacatgatcaagagctgtgcatgaggttattcgggggcaggctttgcctgtaagaggcctccagtctgagcctgggtaaggtggggacagaaagaggggcaactcctctgtgaggtcacttctgtaccttcccccagttataagcagttcacctctgtcaagggaaacaaggcaggaag

SEQ ID NO: 137240 - DNA, 601 bp, Human
tcagtcaggggagatcatgtgagaggggtctttttaattaccatgacaacaaatccacaccacctggtgacacatcctcctgtcgttatggcaacagaagaacatcacacagtgacatactgccatgttcccaaggaaacaagccctactctgagaagggtgaaagaccccccccccattaattattcctctattcagagtgtcccaaattgtcgtgtgccttggtctcttccctgtccgtttatgcttacgtgtcgtggaaggagagctgtacagggtgggcaggatgttacttggaagyaggctgaattgccaagggacccttaagaaggggctgacatgatcaagagctgtgcatgaggttattcgggggcaggctttgcctgtaagaggcctccagtctgagcctgggtaaggtggggacagaaagaggggcaactcctctgtgaggtcacttctgtaccttcccccagttataagcagttcacctctgtcaagggaaacaaggcaggaagacctgaatggggacacacatctggcttctaggcagggagacttattgattggttgattcgttcattcattcattcagtcttcccag

SEQ ID NO: 137241 - DNA, 601 bp, Human
aaggcaggaagacctgaatggggacacacatctggcttctaggcagggagacttattgattggttgattcgttcattcattcattcagtcttcccaggtattgatcatctgctccgtgccaggcactacagcaagctccgtaggggatctaaagacgtatcagaatgcccctgcctgtcaggagccccagctcagcaggggaggtcgacaagtgcacagattactaacacggtggaactctgccattagaggggtccaagcagatgtcctgggagcccctcttcctcagagatctactgcstccacacagagacattcactcactggggctccttccagacccccctttccctgcagaggagaggaggggacctgcatggggaaagcagaccagttcttgagggtaactgtgtctttccctttccaaatgatggctcccttcctgtccccctttttccagggtgacccctggctgacccccattctggggagagatccactgcactccggctctactcagaaaaacaattccgtggaaacagagcactttttatttcctccctgtcatctgcctacccccaaaaacctagaacttttttct

SEQ ID NO: 137242 - DNA, 601 bp, Human
tcattccagaagcaagattccacctgctctgggccctacagagtctggcttggtgggtcatgccaggagctgccacaatacctcccccatccccattccccagggggtctctggtctcctttccccaatctcctgctctctgatcttttctagcctctttactcttccccacccttctcatattttccttaaagaaaataggatacttggtcatttaaccgtgagtccagtgcctggaaccttctaaggtccggaggccgttttgtacattctcctgctgatgggctggaaatgagtcacyccatagaatccactgtatggaaagacccagggtttagaaagaacccctctctcctgcttgctgttttggctggtctgggctggaagccacaagcaggtgtgatggcggcaatggcctcttgggggagggggtagacattgtccactctgcacggcttgggagctatgcccagcatggtgcctgacacataatgggtcctcaatatttaaatgtgtgaatatgcctagtggtcatttgagggtgttgagaggttgggaggctggtggtggaagagggagccccgggctctggtgctgtagc

SEQ ID NO: 137243 - DNA, 601 bp, Human
atagaatccactgtatggaaagacccagggtttagaaagaacccctctctcctgcttgctgttttggctggtctgggctggaagccacaagcaggtgtgatggcggcaatggcctcttgggggagggggtagacattgtccactctgcacggcttgggagctatgcccagcatggtgcctgacacataatgggtcctcaatatttaaatgtgtgaatatgcctagtggtcatttgagggtgttgagaggttgggaggctggtggtggaagagggagccccgggctctggtgctgtagcagsggggactgcagctgtggacgtctgccttacacctagtgccagggcggtcatgacaggcagttctgcctgcctgagcagctatggtgtgcagaggaaactatcatagatcaggagcttggaaaccaccgtctcatcctgccttctcgggtgaccttcagcacatgacttcggcatttctgggcctcaacttcctcgagttctggggaagaaaatgatctaccccagatatttcacagggctgttgtgagcatcaactgtggcattgtgtgaaagtgcttggtaaactgtaaggcaggcata

SEQ ID NO: 137244 - DNA, 601 bp, Human
ctgggggctggtctgcgtgtatgtcagggccctggcaccacacctgcttagcctcagatggagccaggaggtaaacgaggaggaggtgttagggcggggtcggggggccggcctcagctccagccttggccagctgtttccttgactgccagtacctggtttgagcgcatcagcatgttggtcatccttctcaactgcgtgaccctgggcatgttccggccatgcgaggacatcgcctgtgactcccagcgctgccggatcctgcaggtgagtgtgtgtgtgtgtgtgtgtgtgtgtgtggtgtgtgtgttgggggttggcccctcttaatcttaataccctctactcctctgcaagaggccctgacccaactggtggggactagggtgggactagagggtattccctcacccacgtctcagtttcagccacctcttgtccccacatcaggcctttgatgacttcatctttgccttctttgccgtggagatggtggtgaagatggtggccttgggcatctttgggaaaaagtgttacctgggagacacttggaaccggcttgactttttcatcgtcatcgcagggtgaggacctgggctgg

SEQ ID NO: 137245 - DNA, 601 bp, Human
ttgctactgacatatctgttctaacatctgagacatatctggttctcaaacttggctacccattggaaccacctggggagttttaaaaagtactgatgcctgggtgccacctccagagattctgatttcattgctctggggctcagcttggatgtaaggattttttcaacccctccagtgatcctaacttgcagtgaaatttgaaaatcactattccaggatgtgaccttccaacatcctgagtctggagtttccccactcaggcctcatgctcctggtgcccacaaatccctgccctgcscagtcccttccccattcttggttctgccctgctcaccctatatgcctcgagcactcgtgccatctctcccttcctgggccctctccctggagagcccactccccagtctcacccctgttccccttcccatcctgcagccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgag

SEQ ID NO: 137246 - DNA, 601 bp, Human
ggaaggggtgctgcgtctctgcaggtgtgcgtgtttagggacagggaatttgagagattgcaggataacaccatgttcaatagcaatatcttggaatttcatagagcttggttccagtcttagccttgctctgaattagctgagtgatcttgggcaaatgtttgacctctgtggacctgagtttccttacctgtctgatggagattacaatagcatcacctcctgaggctgtcttaaaaataaaatgagataatgcttggaaaataactgagcgtggcgcttggctcataggaatgcctcygtatgtggtggctggcattgtgattcacttttcttcaggacatttcctcttcctgtccccacccctacaggtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggc

SEQ ID NO: 137247 - DNA, 601 bp, Human
agggaatttgagagattgcaggataacaccatgttcaatagcaatatcttggaatttcatagagcttggttccagtcttagccttgctctgaattagctgagtgatcttgggcaaatgtttgacctctgtggacctgagtttccttacctgtctgatggagattacaatagcatcacctcctgaggctgtcttaaaaataaaatgagataatgcttggaaaataactgagcgtggcgcttggctcataggaatgcctccgtatgtggtggctggcattgtgattcacttttcttcaggacrtttcctcttcctgtccccacccctacaggtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccct

SEQ ID NO: 137248 - DNA, 601 bp, Human
cccagctctgtgctggccttctggaggctaatctgtgacaccttccgaaagattgtggacagcaagtactttggccggggaatcatgatcgccatcctggtcaacacactcagcatgggcatcgaataccacgagcaggtaggagagtgggcagaggcagggctcctgccagctgcttttcgcctggggctggggccttctacctccctccgcacccctcctcctgagctcagcttcctctccatgctgctagcccacctggcaggtaggaggggaggtgggtgatggagcaatgcatggrgattctctagagggagtgcttaaagtctctgagtatggaggtcgcctcaggtaggccacagggtatgttctacccaggaaggctgctcagaggaggctggctttgaaggatgtgaacaagtggtgagcatcagcatgtggggagaggcgcgtcactgggagatgtttgggtctttggagaaggtgtagtgcggagggcgggtgttggaggtcctgtggcatccatctgacccactaagtccgggtgtgactgattggaggcaggaggggccatgtaaacaggggtgcagaggggagggtt

SEQ ID NO: 137249 - DNA, 601 bp, Human
ttcttcttgctcaggctcctgaggaagggcggagacagcccagggctcccactaagtcctcagcagcagggaggcctcactcagtgacagcagtgtctgctccagggagggttttgtccgcatacctggtgctgagggccccatgggggtgagcgggagtccccagcaggctgggcagatgactgacagctgtccagcgggctcaggggtgcggagagtaagaagtcccagaagctgccatggccctgtgcttgcaggcactgcggcgtgaacgtcccgccatctgggccctggagcctgrgcaggctgggagtggggggttgccagggaaggcagcaaggagatgtggggggctgagacagagacacagagtgggcacagagagggagacagagacacatgggggaatggggacacagagggagacagagaggagactgatgggggcgagacagaggcacggagggcaagatggagacgggggaggagggcaggaagagagacgcgcaggcaggggagaaaggatatggagggagagatgagccacagcggagacagacagagacaaatggagccacagagacacacagggagacagaga

SEQ ID NO: 137250 - DNA, 601 bp, Human
catacctggtgctgagggccccatgggggtgagcgggagtccccagcaggctgggcagatgactgacagctgtccagcgggctcaggggtgcggagagtaagaagtcccagaagctgccatggccctgtgcttgcaggcactgcggcgtgaacgtcccgccatctgggccctggagcctgagcaggctgggagtggggggttgccagggaaggcagcaaggagatgtggggggctgagacagagacacagagtgggcacagagagggagacagagacacatgggggaatggggacacagarggagacagagaggagactgatgggggcgagacagaggcacggagggcaagatggagacgggggaggagggcaggaagagagacgcgcaggcaggggagaaaggatatggagggagagatgagccacagcggagacagacagagacaaatggagccacagagacacacagggagacagagacacagagagggagctgaagacagagaccgagtcccagatgcaaatgagggcagagacggggtgggatggggagacagagactcccctggagctggctgcatgaggaggctcacggcttcc

SEQ ID NO: 137251 - DNA, 601 bp, Human
cagagactcccctggagctggctgcatgaggaggctcacggcttccctgcggtgcccttaatgaggcaattgtgtccattgatcccggaatcgattggatgggggggcgggcactggaaagggtgttgctggtgctttgccagaggaggagtccctgccctccctcctggccgtcaccgctgccctccccaggccctgtcctctcccaccatcccctggctgactcatcattcgcttgtcccgtccccccaacctgcgctaccccaccatcctcctgactgaggaagcacctatatgtgayaccccaccccgcccggggctggccccatgctgtcctctgtctcctgcttcctccaccccttaaccaccagctggaggagaactggcaggattgggtttgcccagagggctggtgagaaggacaagaacccaggagactgaggagagagcaagaaaatgacctgatgtcgaagtgtgatctgatatggggccagcctacatgtgtgccccatccgctcagggcggtacatggagtccagaacctttttccaattcatccttttgcactggagttgggcctaagcagtgatttgctggtaaa

SEQ ID NO: 137252 - DNA, 601 bp, Human
aggagcccttaacccagaccagagaaggaattcagggagggctccgtgtaggaggtgacctctgggctgagtctgaaggaagagtaggacatagccagtgaaggtgaagggcagggcacagtatgagggctccggcagtggtccaggcagttcatactacatcttcatccctggaaatggagagcagagggctggggagagctggctggtagctggatctgcaggacccaatcagttggaaacatgggttgagaggaggcagcaaggatgactcccaggtttctacctggggtgggagcartgtggcttgagcagatgtgggctgggagacatgttgcatacaaggtgcctgcgggccatcctgaccatatccagcaggctgtcggagctcagaaaagaagttgccttctcttctgtgtcctgcctggctctgcactggggccagacctctccaggaagaggggagtgcaggagtggggccttggagacacaggagcttcctaacatctccttcctggctctgggtcatggtggggtgggggacaggtgctagtctaatgttctagaagagggacaacagcatatggggagaggggagcta

SEQ ID NO: 137253 - DNA, 601 bp, Human
tggaaatggagagcagagggctggggagagctggctggtagctggatctgcaggacccaatcagttggaaacatgggttgagaggaggcagcaaggatgactcccaggtttctacctggggtgggagcagtgtggcttgagcagatgtgggctgggagacatgttgcatacaaggtgcctgcgggccatcctgaccatatccagcaggctgtcggagctcagaaaagaagttgccttctcttctgtgtcctgcctggctctgcactggggccagacctctccaggaagaggggagtgcagkagtggggccttggagacacaggagcttcctaacatctccttcctggctctgggtcatggtggggtgggggacaggtgctagtctaatgttctagaagagggacaacagcatatggggagaggggagctacatgtagcccagtggtctcctgggctgtagacggggagaggagggggagggaccagggtagatggccttgcaggctgagagaggacagggcaggtgatgactctgctcattgctcacactctggggccatcctgtcactccagatacatgtccagagagggtttctattta

SEQ ID NO: 137254 - DNA, 601 bp, Human
aggtgcctgcgggccatcctgaccatatccagcaggctgtcggagctcagaaaagaagttgccttctcttctgtgtcctgcctggctctgcactggggccagacctctccaggaagaggggagtgcaggagtggggccttggagacacaggagcttcctaacatctccttcctggctctgggtcatggtggggtgggggacaggtgctagtctaatgttctagaagagggacaacagcatatggggagaggggagctacatgtagcccagtggtctcctgggctgtagacggggagaggarggggagggaccagggtagatggccttgcaggctgagagaggacagggcaggtgatgactctgctcattgctcacactctggggccatcctgtcactccagatacatgtccagagagggtttctatttataagtgagtgagtttggctgttcaaggcgagagaagctgggggtggggcaggaggaggtggtccagatatggtaagtctgaactttgaaggaggtcatagactccttttcagttctgctgaaggctggggaccctctccccagaaaatccccatatgcctggacaccctaaa

SEQ ID NO: 137255 - DNA, 601 bp, Human
aggtggtccagatatggtaagtctgaactttgaaggaggtcatagactccttttcagttctgctgaaggctggggaccctctccccagaaaatccccatatgcctggacaccctaaatgtggcctttgagggcaaaggttgatggacacctcccaccccagccagtcccttggtctccagatagaggagccctggctgaagagctagggctgaggaccaagcagagctttgggggatgatcctttgcagctgactggccccagacattcaaaggctatctggtgtgggagggagaggggcmttgttttggagatgtctgctaaggtgttctcttgttcttttagtcatcccctggctccaggctctcccagttctgcaaacaaggggagcatatcctgtgcacagcacactagaatagaatattagaatatcagggggttgggggctgagccagaaacacccaagaaatgtaggttctggtggaaaagtcattctgtttcatggatgattatgccaaatgccgcaagagaggcttcaggggacaaaggagagctgctcatccccagctctccttcggaagggcttcacgaaggtggtggct

SEQ ID NO: 137256 - DNA, 601 bp, Human
gactccttttcagttctgctgaaggctggggaccctctccccagaaaatccccatatgcctggacaccctaaatgtggcctttgagggcaaaggttgatggacacctcccaccccagccagtcccttggtctccagatagaggagccctggctgaagagctagggctgaggaccaagcagagctttgggggatgatcctttgcagctgactggccccagacattcaaaggctatctggtgtgggagggagaggggcattgttttggagatgtctgctaaggtgttctcttgttcttttagkcatcccctggctccaggctctcccagttctgcaaacaaggggagcatatcctgtgcacagcacactagaatagaatattagaatatcagggggttgggggctgagccagaaacacccaagaaatgtaggttctggtggaaaagtcattctgtttcatggatgattatgccaaatgccgcaagagaggcttcaggggacaaaggagagctgctcatccccagctctccttcggaagggcttcacgaaggtggtggcttttgaacggagcctcgaaagatgaatggaattgacagtggcttg

SEQ ID NO: 137257 - DNA, 601 bp, Human
gaatgagtctggagtcccacagaagctttctgcttttaggcacgggggaaggagattggagaagtaatggatgcaggcataactgataggccagggcccaggggagccgggggcgggggtagggggtgacaggggggcggcgggggagcacatcaaagaatcaaagtgcaggtggaggaacggctggctcccttccaggagaggaagagagacagtgggatgcacaacacagagctctttggaggagggacgtggagccccccatgtaagcctgcaacgaggggccaggtggggagtaggkctgggggctgcagagtccagaaggattgaggcagctcctgggggagagaggagacctaagaagggaggaaccagggactgtgaataaaggcatgaaacagccatggggccaccacccacagggaatcacttgtccagtcagcacatgttcgtgcctctctctagcgatactcagcacttccagagccgcagaggagaggaggagggcaagggcacttacctgggctggggctgggcagggcaggagctcttgaaagtcttcgtcagaagggcagcctttatgtggcctactgtggcccac

SEQ ID NO: 137258 - DNA, 601 bp, Human
gtgttccctgacttcccacacctccttgaagacttgcctcccactgacccagtgaccctcactgcctcactgcagcctgtctgcgcccctgtcctgggtgggtgggagcagcaggcaggcccatcagaagcagaggtgaggtgagctgaggagtctgaacagaagagcagagatttcagggtcagtggagcaggtggaagctggggcgatggcagctggctggggtcgggcttgggcagagcacgagtgactggtccaagcctctgctcagctctgacgaggcctgtccagcccctcatgmcctctctgcaagaggcacatcactgtctgccagagctggctctcaggcctcctgcctggactgctgcagtatcctaattggtttctgtctctaccctccaagccgtccacacgctgccaccactgcagccagattaatcttcttcatacactgctttgtacatctccttcctcccttcccacccgcccccagggcctcagtggcagcgtggtaggcagagacttgtccagagggagcagaggaaggctgttccacctggccctgccgaccttgtagccttctctcccaccagcccctctc

SEQ ID NO: 137259 - DNA, 601 bp, Human
cagaagagcagagatttcagggtcagtggagcaggtggaagctggggcgatggcagctggctggggtcgggcttgggcagagcacgagtgactggtccaagcctctgctcagctctgacgaggcctgtccagcccctcatgacctctctgcaagaggcacatcactgtctgccagagctggctctcaggcctcctgcctggactgctgcagtatcctaattggtttctgtctctaccctccaagccgtccacacgctgccaccactgcagccagattaatcttcttcatacactgctttgyacatctccttcctcccttcccacccgcccccagggcctcagtggcagcgtggtaggcagagacttgtccagagggagcagaggaaggctgttccacctggccctgccgaccttgtagccttctctcccaccagcccctctcaccctctgatctgggcagacaacttgattcttggttctgcactgtgccctgcacaccccttcccttgctgtccccagctggggacaccctccatggacatcctcccaggctgtcctccccactggcccactgacctcagccgggattgagctcccgtgg

SEQ ID NO: 137260 - DNA, 601 bp, Human
tcagggtcagtggagcaggtggaagctggggcgatggcagctggctggggtcgggcttgggcagagcacgagtgactggtccaagcctctgctcagctctgacgaggcctgtccagcccctcatgacctctctgcaagaggcacatcactgtctgccagagctggctctcaggcctcctgcctggactgctgcagtatcctaattggtttctgtctctaccctccaagccgtccacacgctgccaccactgcagccagattaatcttcttcatacactgctttgtacatctccttcctccyttcccacccgcccccagggcctcagtggcagcgtggtaggcagagacttgtccagagggagcagaggaaggctgttccacctggccctgccgaccttgtagccttctctcccaccagcccctctcaccctctgatctgggcagacaacttgattcttggttctgcactgtgccctgcacaccccttcccttgctgtccccagctggggacaccctccatggacatcctcccaggctgtcctccccactggcccactgacctcagccgggattgagctcccgtggctcctgggttttgccc

SEQ ID NO: 137261 - DNA, 601 bp, Human
cggtcctgccttctgtgagcttggccctggggctggggtttctcacagcctttcactcctttgttctgtagagcagcctcccaggaggtagtgttaccctgtttaacagaagaggccactggggatctgagaggcaaagggaattgcccaaggtcacataggaagaaagtctcagagttggtggcacctttctaacaccagtgtttggcacacagaaggcacttttagggctagttgatggagcagctatgaggcttggggagccccggtgctgggaagtactgagcagcttaacgctgcygcaaggtgacagccggaggggaggggagtggaggtgttaggaaatgggagatggagatttacagtcaacatcagcacagacaagagacctgggacctctgggtgggataagctcaggctgcctggcctcatttcaccgaaacctccactgggccttgacatctgtgaacagcaggaaggatgcaggctagacccgggaagggacttccacagctgggggtggccagtgaggggtggctggctccagcctgatgagtttgtgtgctctctgtgtgagctctgtctgggtatatggtggggg

SEQ ID NO: 137262 - DNA, 601 bp, Human
acaccagtgtttggcacacagaaggcacttttagggctagttgatggagcagctatgaggcttggggagccccggtgctgggaagtactgagcagcttaacgctgctgcaaggtgacagccggaggggaggggagtggaggtgttaggaaatgggagatggagatttacagtcaacatcagcacagacaagagacctgggacctctgggtgggataagctcaggctgcctggcctcatttcaccgaaacctccactgggccttgacatctgtgaacagcaggaaggatgcaggctagaccygggaagggacttccacagctgggggtggccagtgaggggtggctggctccagcctgatgagtttgtgtgctctctgtgtgagctctgtctgggtatatggtgggggcgatgttgtggaaaaggtcttgagggcagagatgtagagggaggcacaacggacctggctctgcacctctccaggagggtgatgtgacctccatcaaggcaccatacccctcggagcctcagtttcccagactatctaggaggctcacagccctccctcgtttgttgtgagcagggaggaaatgaaatcccacg

SEQ ID NO: 137263 - DNA, 601 bp, Human
ggataagctcaggctgcctggcctcatttcaccgaaacctccactgggccttgacatctgtgaacagcaggaaggatgcaggctagacccgggaagggacttccacagctgggggtggccagtgaggggtggctggctccagcctgatgagtttgtgtgctctctgtgtgagctctgtctgggtatatggtgggggcgatgttgtggaaaaggtcttgagggcagagatgtagagggaggcacaacggacctggctctgcacctctccaggagggtgatgtgacctccatcaaggcaccayacccctcggagcctcagtttcccagactatctaggaggctcacagccctccctcgtttgttgtgagcagggaggaaatgaaatcccacgaggaggtcttcagcctagttggcctgtggtgggcactgccagatgttggctccacccctgccccttttcagccgtaattacagctctggtccctggggcaactttgttgctaagattgtgtctctatgtcctcgtcctgcattcgcagatcgttcccagcctccaatttagtaacttggacagacctggctatctgggggaggagggctct

SEQ ID NO: 137264 - DNA, 601 bp, Human
actctaagtgttgcagggagactagagagagcaaggcagggccgagggagtgcgccaggcccctttccacctgcatcaggctgccctgcttttccaggcctggagtcacttggctgggcaaaacaggggttccagcctttgctggcacagcccttgacaaggttcaatgaggcaagccttatgggacggcaggcttctcaggagcctggcatcatccttctccataagcctctcggtggtgtgcaggagagtgaggtgtgcacgtgtccacaagccatcagtacagactcctgagagcccmgtggataacatcggggagtgaagagaacagtctccttttccacgcacagtagtagtcggacttttagaattcactgattgagtaaatacatgacatcaaaagctactgtgttttcagcaacttttaaaagaacgtttcattaatttttatttttagcagctttttgggggtatagtttatatgccatgaaatttgcccattataagcgtacctcagctgtgtcttcacatcgagttggtctttattcctagaactctgttgatttgaatataattttagaagacacgttgtgtatccagt

SEQ ID NO: 137265 - DNA, 601 bp, Human
gggccgagggagtgcgccaggcccctttccacctgcatcaggctgccctgcttttccaggcctggagtcacttggctgggcaaaacaggggttccagcctttgctggcacagcccttgacaaggttcaatgaggcaagccttatgggacggcaggcttctcaggagcctggcatcatccttctccataagcctctcggtggtgtgcaggagagtgaggtgtgcacgtgtccacaagccatcagtacagactcctgagagcccagtggataacatcggggagtgaagagaacagtctccttytccacgcacagtagtagtcggacttttagaattcactgattgagtaaatacatgacatcaaaagctactgtgttttcagcaacttttaaaagaacgtttcattaatttttatttttagcagctttttgggggtatagtttatatgccatgaaatttgcccattataagcgtacctcagctgtgtcttcacatcgagttggtctttattcctagaactctgttgatttgaatataattttagaagacacgttgtgtatccagtccaccgtgtatctggattcacaagcccctcaccatcac

SEQ ID NO: 137266 - DNA, 601 bp, Human
tgcaggcttggttgggcagctggccagcgaggcagtgagaagcaaggagaggtgtctgatggaatgagtgcctcatttgaatgtttcattaacccatactttttgagcagctactatggacttggcctctgccctccagaccagacacctagtttgtccagacatccatcaggtggacagtggggtcctttgagccaaccatatctcttcttgcttccccagccctctgcctggccacacccctcccttcttcaaccagaaccaggctgaggttgctcatgatccccccaccccgtgccayaccacctagacccttggctggggagactccacaaacccttaggcattcaagtgctgcctctctcccaactaagcctttctctgtgtgttcacccctcaccttttctcccctgaactcccggacttgctgcctggataatttattttggcactgaagcatttaaggcctcttgtggttattcagccgttttgtgtgtgtacaacgtgtttctagcagacactgagctcctgggaggcggggcgtgtggctggcatgtttttgcagctcctttaatgcctggtgcattgctaggcacttcat

SEQ ID NO: 137267 - DNA, 601 bp, Human
gatgagacagggttcgtcattcgtccttctgaggactctagggtgcatcctcagtcccagtcccagactcgggtaggcagcatgaaaggaattacctctggtgtttcacatttggccagagaggttgagaatcttgctgaaggtcacagagtgagtgacaggataggctgaggattaacccgggtgtcccgggctcaggctgaggctccaggtgtctcctcaactgtgacaacccttcctgggtgtctgcgtgtcttccttctgcctatcaccatgtgtgtgactgggaatgcgtgcattcttctctctctctctctctctgtgtgtgtgtgtgtgtgtgtgtgtgtgtgtgtgtgtctggaaggaagcaagagtagccaactgttgtccaagagaaagctgccaagtccacagagtaattgtggaatacatgtgacgttgtgtggggcttgacgaccgggtgtgcctgtgaggccttggcgatcgccctctgacatccgccagcattgtcatgctgctggcctgggcccgctaggcttgcattgtagcctaggtcaagatgggccatgcagctcccagcaggagatagggcggaacccac

SEQ ID NO: 137268 - DNA, 601 bp, Human
cgtccttctgaggactctagggtgcatcctcagtcccagtcccagactcgggtaggcagcatgaaaggaattacctctggtgtttcacatttggccagagaggttgagaatcttgctgaaggtcacagagtgagtgacaggataggctgaggattaacccgggtgtcccgggctcaggctgaggctccaggtgtctcctcaactgtgacaacccttcctgggtgtctgcgtgtcttccttctgcctatcaccatgtgtgtgactgggaatgcgtgcatttttctctctctctctctctctstgtgtgtgtgtgtgtgtgtgtgtgtgtgtgtgtgtctggaaggaagcaagagtagccaactgttgtccaagagaaagctgccaagtccacagagtaattgtggaatacatgtgacgttgtgtggggcttgacgaccgggtgtgcctgtgaggccttggcgatcgccctctgacatccgccagcattgtcatgctgctggcctgggcccgctaggcttgcattgtagcctaggtcaagatgggccatgcagctcccagcaggagatagggcggaacccacaccacaggcctcccattgagt

SEQ ID NO: 137269 - DNA, 601 bp, Human
tccttctgaggactctagggtgcatcctcagtcccagtcccagactcgggtaggcagcatgaaaggaattacctctggtgtttcacatttggccagagaggttgagaatcttgctgaaggtcacagagtgagtgacaggataggctgaggattaacccgggtgtcccgggctcaggctgaggctccaggtgtctcctcaactgtgacaacccttcctgggtgtctgcgtgtcttccttctgcctatcaccatgtgtgtgactgggaatgcgtgcatttttctctctctctctctctctgtstgtgtgtgtgtgtgtgtgtgtgtgtgtgtgtgtctggaaggaagcaagagtagccaactgttgtccaagagaaagctgccaagtccacagagtaattgtggaatacatgtgacgttgtgtggggcttgacgaccgggtgtgcctgtgaggccttggcgatcgccctctgacatccgccagcattgtcatgctgctggcctgggcccgctaggcttgcattgtagcctaggtcaagatgggccatgcagctcccagcaggagatagggcggaacccacaccacaggcctcccattgagttt

SEQ ID NO: 137270 - DNA, 601 bp, Human
cttctgaggactctagggtgcatcctcagtcccagtcccagactcgggtaggcagcatgaaaggaattacctctggtgtttcacatttggccagagaggttgagaatcttgctgaaggtcacagagtgagtgacaggataggctgaggattaacccgggtgtcccgggctcaggctgaggctccaggtgtctcctcaactgtgacaacccttcctgggtgtctgcgtgtcttccttctgcctatcaccatgtgtgtgactgggaatgcgtgcatttttctctctctctctctctctgtgtstgtgtgtgtgtgtgtgtgtgtgtgtgtgtgtctggaaggaagcaagagtagccaactgttgtccaagagaaagctgccaagtccacagagtaattgtggaatacatgtgacgttgtgtggggcttgacgaccgggtgtgcctgtgaggccttggcgatcgccctctgacatccgccagcattgtcatgctgctggcctgggcccgctaggcttgcattgtagcctaggtcaagatgggccatgcagctcccagcaggagatagggcggaacccacaccacaggcctcccattgagtttgt

SEQ ID NO: 137271 - DNA, 601 bp, Human
tctctctctctctctctctgtgtgtgtgtgtgtgtgtgtgtgtgtgtgtgtgtgtctggaaggaagcaagagtagccaactgttgtccaagagaaagctgccaagtccacagagtaattgtggaatacatgtgacgttgtgtggggcttgacgaccgggtgtgcctgtgaggccttggcgatcgccctctgacatccgccagcattgtcatgctgctggcctgggcccgctaggcttgcattgtagcctaggtcaagatgggccatgcagctcccagcaggagatagggcggaacccacascacaggcctcccattgagtttgtggcccctgaatctgagacccagagctggggctatgggtttcacgtggccctttcctggggcccctgcccctgggtgcatttcctcctggagcctttggggcagggtcctccccatgggcctgagcatccagcaacccctccgcacaagcttgctattcctgctcctcctctccctggtgtcccatgtttggaggactggatcgaggggctcagtgataagccagctgcctcacatcccaccctgccctgcagcccgaggagcttaccaacgccctag

SEQ ID NO: 137272 - DNA, 601 bp, Human
acccctccgcacaagcttgctattcctgctcctcctctccctggtgtcccatgtttggaggactggatcgaggggctcagtgataagccagctgcctcacatcccaccctgccctgcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcaggtatgactaccccccggcactgactctcasttgaggaatggtagcaggggtggcttggggccaggggccatgccacctattcccctggggtggaggggtctggagtcaggccccactgaccccacaggacctgccactcctcctaggtggggggctctctgtgtccccatgccccctccatctctctcttggccccaccttgctcctgttgaccttgggctcacctcttcattgcccaggcccctctttagtctcctctctccacttctacctcttgtccttgaccccacccaggcctgggatgggcgagggtgagattggctttagagg

SEQ ID NO: 137273 - DNA, 601 bp, Human
agtgataagccagctgcctcacatcccaccctgccctgcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcaggtatgactaccccccggcactgactctcagttgaggaatggtagcaggggtggcttggggccaggggccatgccacctattcccctggggtggaggggtctggagtcmggccccactgaccccacaggacctgccactcctcctaggtggggggctctctgtgtccccatgccccctccatctctctcttggccccaccttgctcctgttgaccttgggctcacctcttcattgcccaggcccctctttagtctcctctctccacttctacctcttgtccttgaccccacccaggcctgggatgggcgagggtgagattggctttagaggagttggaagaggtatgaggcctagccagctgcccggctcgaaaagtgcttggaaatcatctcagacaccagcaacttg

SEQ ID NO: 137274 - DNA, 601 bp, Human
cagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcaggtatgactaccccccggcactgactctcagttgaggaatggtagcaggggtggcttggggccaggggccatgccacctattcccctggggtggaggggtctggagtcaggccccactgaccccacaggacctgccactcctcctakgtggggggctctctgtgtccccatgccccctccatctctctcttggccccaccttgctcctgttgaccttgggctcacctcttcattgcccaggcccctctttagtctcctctctccacttctacctcttgtccttgaccccacccaggcctgggatgggcgagggtgagattggctttagaggagttggaagaggtatgaggcctagccagctgcccggctcgaaaagtgcttggaaatcatctcagacaccagcaacttgctttagggtttccaagaccttgggaaagtgctccgtcc

SEQ ID NO: 137275 - DNA, 601 bp, Human
tgctccgtccccgcaaggcctggggccaggagaaccactttattgcttttggaattggctttagatttcattagaagagaacaaagcaaatattccataacttgatgcagttgcattggccagatttagggagggagttgtctactgccaggatgtgatctctggcagggaggagagggcggagggggccggggctgtcacccaaatcctcactatcttggaggctcctgcttagaggtctgggggcccacctgtgccccattttctctcgacgtgcccacccagccaggcccttgggtgmtactgagtcctctccgagggagtagggggagagggtgaaggtgcagggggctcaggctgcctgccccctttgcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcaggtgagggcggcatggcaccttgccggctgagagaccggc

SEQ ID NO: 137276 - DNA, 601 bp, Human
agggcaccatctccatccctgccagactggtggatgggccggagaaggaagggacttagaatcctctgtgtgcacgtgtgtggggcaccccgtgtgtgcgtgcctgtgctgaggtcccggaggagtcccagacgtccggcttcagtggagtcaagatctggccgtagaccatactcccccatctcccaccccttcaccccttgccccaggcccctgttggagaccccgcaagctgtctcagctcaggacaagtccttggaggatgtggggatgggatgtggctcttgccaaaatgtaccartattttaaatcacctctgagcctttggccccttcatcacccacttgggtccggctggcgctgtcagggctggctcccggtctggccccacgatgagcctgtgctctgctgttccctgccccagcaccagaattcggggcgaagccagcattcctgtgggaccccatggtgctgcatatcccgagcagccccctggagatcccacttgataattaaaggcctcgttagggctgtaaactgagttaatgaaaatgatcccctgagatgccaattacccaatatttatgtccttatcaaaagt

SEQ ID NO: 137277 - DNA, 601 bp, Human
gtcggcagagcctggggcggcccacgagatgaagtcaccggtagggggtgcatgtgggtaccctgatggtgggagatattccaaggaggacaggaggaagagaggatggaggcaggcgggtccaagggcacagcccctgccccatgggctggatggggcctgggtgtgcctggacaagcccctggggaatctgcgccggtgatgcaaaccagggtaggagccctagcctgggggctgaaaacagggcctaagctgacctcttctgtaccctagctgagtgacctcgggcaagacgccaccrctctgatctgcttctgtaaaatggaggtggggtgtccatacctcctcaagactgaataataataatagcagaccctcatctaggtactgactctgtgccagacactgttctaaacactactccgaagcattctaaatgcatttaatcctcacaccaaccctgggaggtaggtaccacaatgatccccattttacagagggggcctgagcctcagattgcagaagggaatggcagagccagcattttaatccaggaggctagtgttggtgcccatgctctcatgattttatttatttttaa

SEQ ID NO: 137278 - DNA, 601 bp, Human
cctctgcctcccaggttcgagtgattctcctgcctcagccacctgattagctgagattataggcatgtgccaccatgtccggctaattttttgtatttttagtagagatgaggtttcaccatgttggccaggctggtctcaaatacctggcctcaagtgatccacctgccttggcctcccaaagtgctgggattacaggcatgagccactgcacctggcccatattttctttatccagtcatccattgatggatactaggttgattccatatattggctattgtgaataatgctgaaatgwagatgggaatgcccgtatctcgtccacatactgatttcaaatcctttggataaatacccagtgctggaattgctgggtcatatggcaactctatttttaggtttttgaggaacctgcataccgttttccataatggctgtattaatttacatttccaccaacaggacacaagggttcccttttcttcagatcctcaccagcgcttgttatctttcatcactttcataatagccaatccaacaggtgtgagataactcattgtggttttaatttgcatttccctggtgattagtgacgttg

SEQ ID NO: 137279 - DNA, 601 bp, Human
ttcgagtgattctcctgcctcagccacctgattagctgagattataggcatgtgccaccatgtccggctaattttttgtatttttagtagagatgaggtttcaccatgttggccaggctggtctcaaatacctggcctcaagtgatccacctgccttggcctcccaaagtgctgggattacaggcatgagccactgcacctggcccatattttctttatccagtcatccattgatggatactaggttgattccatatattggctattgtgaataatgctgaaatgtagatgggaatgcccrtatctcgtccacatactgatttcaaatcctttggataaatacccagtgctggaattgctgggtcatatggcaactctatttttaggtttttgaggaacctgcataccgttttccataatggctgtattaatttacatttccaccaacaggacacaagggttcccttttcttcagatcctcaccagcgcttgttatctttcatcactttcataatagccaatccaacaggtgtgagataactcattgtggttttaatttgcatttccctggtgattagtgacgttgagcatttcttcatgt

SEQ ID NO: 137280 - DNA, 601 bp, Human
cccagctcagcagggaggacaggcagggggctgggctggaggcaggggtggggagaggggagagcggggttggggatgcaggggaggagagggaggaggtggagaggcaaggggtcctcagggatggggagggggcctggcaaggttgacagggagatgaggaggtggctttaggaataaaggaagagaggcagggcagagcttgggccccaggtgggagagggtagacaaggagtgaggctcgtgactctgctgaggagccaggagccggggaacctggaggcctggtcctgctcatackccagtgtttgttctgcagagcaaaggggaacgggtccgcgcgtggatccgagcccgactccctgcctgctgcctcgagcgagactcctggtcagcctacatcttccctcctcagtccaggtaagtgacagggcaggggtctgacctgtgtcccgacctcttcttctcacgggaaattaccgctggtgatgctgtcagggatttgagaagtggcaccctgcctggggtgtgagcagggtggcctcagctgggagggctctggaggggcaggggctgcgggcggtgcctctcgttgccacct

SEQ ID NO: 137281 - DNA, 601 bp, Human
acgtggcggtggtccccaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcaggtgactccctccccagcactggaacacctccaagaggtggccccctccgcagggacatctcccaccgccagcactccctgccacgaaacaaaagccygcacaggccagcatcctgtctgtgacccccacaggcgatcctgtccccgccccagacaacactcagattacggccgcagtaatttccctccaggtgcacacctgctttcctcctcttcaacatgacatattcctcagggccgctgcaccatgtgatgtaaggtgactgcagccctgtgcagcacacagcacaaggggccacgagcaggactctcacagtcttcagctgcggctctcccttgtgtggcctctaggggtgacactcagcccctccccgtgaggtgacaggctcctcttgctg

SEQ ID NO: 137282 - DNA, 601 bp, Human
gtccatggtctctgacagcggcaccaagatcctgggcatgctgagggtgctgcggctgctgcggaccctgcgcccgctcaggtgactccctccccagcactggaacacctccaagaggtggccccctccgcagggacatctcccaccgccagcactccctgccacgaaacaaaagcccgcacaggccagcatcctgtctgtgacccccacaggcgatcctgtccccgccccagacaacactcagattacggccgcagtaatttccctccaggtgcacacctgctttcctcctcttcaacawgacatattcctcagggccgctgcaccatgtgatgtaaggtgactgcagccctgtgcagcacacagcacaaggggccacgagcaggactctcacagtcttcagctgcggctctcccttgtgtggcctctaggggtgacactcagcccctccccgtgaggtgacaggctcctcttgctggctttccccatcttcaggcgcctgccagtgaccaccccccggtgacatttctcctgaccagggatccaccctctcaggaatccctttccaatcagccagtcaccacccccaactcagattttt

SEQ ID NO: 137283 - DNA, 601 bp, Human
atgtaaggtgactgcagccctgtgcagcacacagcacaaggggccacgagcaggactctcacagtcttcagctgcggctctcccttgtgtggcctctaggggtgacactcagcccctccccgtgaggtgacaggctcctcttgctggctttccccatcttcaggcgcctgccagtgaccaccccccggtgacatttctcctgaccagggatccaccctctcaggaatccctttccaatcagccagtcaccacccccaactcagattttttttttttaatagggatgatgtggactaatggmgatgcttccctgactgtgatagtccatctccctctgccccttcccctctctgcctgctcccctacaagtttatctcctggtgcccccaacccacaatacactgcatctctagggaacgcctcacttgagttgaatcctccccactcccaacccaaacaggtcgtacatttgacatcctgggatggaggtggagatgtggggcatggggatctctgccacttgttttgagagattacaataggggtcctgatggcaggggtcccatgaaaagaggacttgtgttctgccaccagaggccag

SEQ ID NO: 137284 - DNA, 601 bp, Human
attcagcagatctgggctggacctgagaagatgtgtttctagcatgttcccagatgatgctggggactcccacttggcacacgcctggcctaaccgttggtggaagatgaatgactgttacccgcctccaccctttcccactgcccgccccgattacctttcctccccactcttggaaaggaagggggtgtcggcaggggagactcttgtcagtgtttccctgacttgactggccccagagcagagcaccccacactcactcaaaatgtgcccaggctggcgtgggggtggggctcaggastcctgggcttcctgtggtcacagctcacttttctctgtctctgggaatgtgtgtccagctcttcaaagggaagtttttcgtgtgccagggcgaggataccaggaacatcaccaataaatcggactgtgccgaggccagttaccggtgggtccggcacaagtacaactttgacaaccttggccaggtgagccccaggctcagaggtggggctgtggtgaaggaggctggagggggcacagggccatgcttagtgatacctgctgactccggtggaggtgggctccacgaagagatcagccc

SEQ ID NO: 137285 - DNA, 601 bp, Human
cctgctgactccggtggaggtgggctccacgaagagatcagcccttcacaccctctgctgtctaaccaccagcatgtcgcaaagcccagtccatcccacagtgccccaaaaagtgggcccatggggtctctagccgtccttaaagatgaagaaacagaggctcagagagggtaaggggcttgcccagggccacagagctacatggtggagcaggaagcacacgtggcagtgggggcaggcagccctggatgtgaatcctgtgcaaatcctgaccccaccattgtcagctcaatgacctggtgcagctgacttaccagggcctcagtttcattaactggtgaatggagtcataatagaatctcctcggaggtcacaataaggatgcaatgagatgatgtgtatatttctttaacatggtggaagggacggatatattgtcaagataattcctttcctcactccatatttgcagaaacagaaatgcagaaaatgaaattgctcgctcagttttgattcccagacccactctggttttggtttctggatttccagggtttttgtgtcccttctcctacctggcggagggcagagggtgtgacca

SEQ ID NO: 137286 - DNA, 601 bp, Human
acttaccagggcctcagtttcattaactggtgaatggagtcataatagaatctcctcggaggtcacaataaggatgcaatgagatgatgtgtatatttctttaacatggtggaagggacggatatattgtcaagataattcctttcctcactccatatttgcagaaacagaaatgcagaaaatgaaattgctcgctcagttttgattcccagacccactctggttttggtttctggatttccagggtttttgtgtcccttctcctacctggcggagggcagagggtgtgaccatctctcakggcccctccagctgcagctcagttatggaaccctgagagggagggctctcctggagcctggagtgtgactccagcttgacccctcaagggctggggtacttggagctgatgcaggaggcactttgggggcaggtgataggtgattcagccacacatcctagacttcaaatgtctccttctcctcctccccatcaggccctgatgtccctgttcgttttggcctccaaggatggttgggtggacatcatgtacgatgggctggatgctgtgggcgtggaccagcaggtagggctgaggtgg

SEQ ID NO: 137287 - DNA, 601 bp, Human
ttcacaaatcgtcttccttccgccgataagatgggtgcggtggcctgagttttcctttggtgtgttcacatgtgagtaccaccaaatgagtgaggggttgccgtgcccctgcctcccctctgccctcagctctatctccctcggcctgggagtggcactctgaggcggggggagagtgtgggagttgcagacgagggtggaggtgggagggggcctgtgttccctgtgaagagcgggagctgctccaggatgtgggggagacactggcctctgggcagcaatgggaggtgccgttctccaygtccccaaccctcactatcagcacccccaaggccttctgctcggctcagggtaggggtccgggttcggcttccctgtggatatctgcagctgagcaggtgcagtgtcccctgtggccaccgtcccactcctgctccatcctccccacccccacctcacagtcaggcagatggaattcttttggcaggcggcacttgtggcccctgcctgcccagctggctccccttctggggtctgtagctgtctcaggtgcagctgaggccacaacgcaggagaagcggacatctgttctgatgaccgg

SEQ ID NO: 137288 - DNA, 601 bp, Human
gcaccccacccataggcagagtgaggtgggagctgaggggaagccgcccctgaggggccctgcccagcgcacctggtccggccagtgaccaatgtcgtgtttcgttcttttagatctaatgctggacgatgtaattgcttccggcagctcagccagcgctgcgtcaggtactgcgtctggggtgtgggctcatgcgtgtggggacatgctcttcactccctccccgtggctcattgattctatcctcttggggtgaaagggtgagggtccctggggcccccaagagggcaggggctgaagygctgggctctgcagcatcccgcaggcctgcgccaaactggacgggaggcgagggcctgaggcctctctgccgacgccctttggagagcccaccttcccagcaagggcttccttggccggccaagctccccacctcctgccacctcttccctcctgtgcctcctccttgtagctcaccggtcgattattagagctgcaaatctctcctgtctccttttgtctgaggggagactttgatccaagggagcaggatgagaggagcagagaggggaaggatttgttttaaaaatgtaacaatgaa

SEQ ID NO: 137289 - DNA, 601 bp, Human
cacagggctagcccacagagacttttccaccttgggtgttatcccagaaatcaacacatgcagactctcatggctcctaagacgtgactcacccactcagtgctaaacactctcgtgacccttgcactgcactcccattccgggtaccttctgctgtgctcctgaagtggatagaccccactgtatcctggggtggcacacgcaggcatgtacaccagttaccttccctggctgttggtgaggactcagagaccccgaacaagggctcaggtcatcccatatcccacttcctaggacctgkagttctgcgtggcctatgccagagcttttcaaacttccatgtgcataagaatcacctggaaagcataaacacagattcctggggcttaccccagaggttctcctacagcagtgcagatgcactgatctacccaccagggtgatggggacagagtcaaacgcagtccagggctgctgagaatcaaacacgtgcaccgcacctccctgctagcactcctgtcctggtgctgctcccagcaggggcgggagagccagaccctagggaaaggcagaagagcggagcctgtgattatctggggaa

SEQ ID NO: 137290 - DNA, 601 bp, Human
ccaggagcaggctgggcagtgcctcattagaaactgggtgagtccaacaggtggggccctcccagcttgagtctgggatggagcagagccccaaggcctcccctcttgctctcactgacatgagggtacaggaggcccaggccccgccttctggaggccctctgggtgggtcagtgcagccagccaagaagatgtccaatttccaatctccggttttatctccaaatcccagctctgtgtaatctcctctgctcccccgaggggctgagcttggtgaaggagcaaaagcctttgcctcccygttgatggcgcgtcctctgagcctgaggagaccagttgtttttcatcgtattgatctggccttgctgcggaacactgagtcgagggtgttatgaggggctggtggattttggaggctgcctaggggagggggctcacctggcgtctaatgtaggtggggggctctgcatgtcctgatccatcctgccctcaactgcagccagtacaacagatgcttggagggggacacgcccagacggctgcccccaccaaggggcagcgtggggagggcgaggatggtgatgattatggaatgtttcag

SEQ ID NO: 137291 - DNA, 601 bp, Human
ggggccctcccagcttgagtctgggatggagcagagccccaaggcctcccctcttgctctcactgacatgagggtacaggaggcccaggccccgccttctggaggccctctgggtgggtcagtgcagccagccaagaagatgtccaatttccaatctccggttttatctccaaatcccagctctgtgtaatctcctctgctcccccgaggggctgagcttggtgaaggagcaaaagcctttgcctccctgttgatggcgcgtcctctgagcctgaggagaccagttgtttttcatcgtatygatctggccttgctgcggaacactgagtcgagggtgttatgaggggctggtggattttggaggctgcctaggggagggggctcacctggcgtctaatgtaggtggggggctctgcatgtcctgatccatcctgccctcaactgcagccagtacaacagatgcttggagggggacacgcccagacggctgcccccaccaaggggcagcgtggggagggcgaggatggtgatgattatggaatgtttcagttctggcgttagaggctggtggctgtgagggactgggggtggaggggtgcgg

SEQ ID NO: 137292 - DNA, 601 bp, Human
cgtggggagggcgaggatggtgatgattatggaatgtttcagttctggcgttagaggctggtggctgtgagggactgggggtggaggggtgcggggggcaggggcctgacgcttgctctgctcttccccctgccccatcagaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccaggtaggagygagtggaccagccatctggcccccccacctccagctgaggaacctctgggcaaggttaacacagcctgagccagggtacctctgtgccaagcaagtgctaggcacactacatgggttcctcttgtgccccttggaggtgggtatcatctttgttttatagatgaggacactgaggctcagagatgttagttgatgtggccaaggtcacacagaaagggagtggaggacctggtttcttcacccagcaaatgttgagcgtctactatgagctgcactctggatctttgagggtaaaaaggc

SEQ ID NO: 137293 - DNA, 601 bp, Human
catcgggctgaacgtggtcaccatggccatggagcactaccagcagccccaggtaggagcgagtggaccagccatctggcccccccacctccagctgaggaacctctgggcaaggttaacacagcctgagccagggtacctctgtgccaagcaagtgctaggcacactacatgggttcctcttgtgccccttggaggtgggtatcatctttgttttatagatgaggacactgaggctcagagatgttagttgatgtggccaaggtcacacagaaagggagtggaggacctggtttcttcayccagcaaatgttgagcgtctactatgagctgcactctggatctttgagggtaaaaaggcagatggatgcctgcccttctggagttgagattctagcgaacgtccagctccagagctcacctgtgaccttgccacttctccagtcagcctcccttggctgccttccagccgtcggtttccctgtccatccaatgagggggttgaatttgtaatgcacaaggccccttccagtcctggcatgccgtgtcatctagtacattctcatgtgatctcctcaccatctcccaaggagaaagatcct

SEQ ID NO: 137294 - DNA, 601 bp, Human
gcactaccagcagccccaggtaggagcgagtggaccagccatctggcccccccacctccagctgaggaacctctgggcaaggttaacacagcctgagccagggtacctctgtgccaagcaagtgctaggcacactacatgggttcctcttgtgccccttggaggtgggtatcatctttgttttatagatgaggacactgaggctcagagatgttagttgatgtggccaaggtcacacagaaagggagtggaggacctggtttcttcacccagcaaatgttgagcgtctactatgagctgcrctctggatctttgagggtaaaaaggcagatggatgcctgcccttctggagttgagattctagcgaacgtccagctccagagctcacctgtgaccttgccacttctccagtcagcctcccttggctgccttccagccgtcggtttccctgtccatccaatgagggggttgaatttgtaatgcacaaggccccttccagtcctggcatgccgtgtcatctagtacattctcatgtgatctcctcaccatctcccaaggagaaagatcctttagcataaggttgattcattcatgtgaataag

SEQ ID NO: 137295 - DNA, 601 bp, Human
cccacaggttactgtgcccctgtgctgtgccctctcccctgaccgtgctgggctgtgccacgctgtgccatgcttctggggaagctgggagtgttcctgcccactgggtatctgtagaaagtgcagccttggagcctcagttgagtgcaagaggcagtcaggggttcttctagactgagatcacctccagaaaagagctggaaggcagggctgctgagattgcccctctgatgagaagggtgtgtggaggaggagcttggggaggggagaggggatttgtaagaatctggaagagaaaagrggggatggggcagaagataagttagcagggggaccttagggggtggagggaaggaggtatcagatccagggaggaaggcctccagagacagtgtaggtggccagggagcccgctgccaagctgcagtctctctatctgctcgtgtccagcacacacttgccagtcctcagtttggtggctttttaagccatggagcccactgggcatggtgagtgctgtcaggagccactgatttctgtcctgagagagatagaaggctccagctgggagtggattttgagaacttggtgtgaaatagga

SEQ ID NO: 137296 - DNA, 601 bp, Human
gctttgctggcctttcttcattttttttttttttggtatcatctttttgagagtcgcaagccctcggtcctcccgctccctccctgggtggtggtagtgtgggaggggctggggaggctcctggggtatctttagaatgcgtttctgtgtctcctcgctttgtcagtgtttgctctggctcttcagtgcctgccgcagcctctctgatcagagcagggggttgaagtgggtgcggggaggcactgtcagcttgtttggggaaagggtggggagagagaagggatgcctttttcccgccccmctgtgcttcgtgaaaagggggaagtggggactgagagagagcgcgtgtgtgcgtgtgcacgcgcgtgtgcgctgtcctggtttctcatgcctgatcatctctctccctgtctagatccctctagctgagatggaggctctgtctctgacgtcagagattgtgtctgaaccgtcctgctctctagctctgacggatgactctttgcctgatgacatgcacacactcttacttagtgccctggagagcaatgtacatacacactgccctcactgctcccggccacccccggggctggactgg

SEQ ID NO: 137297 - DNA, 601 bp, Human
ctccctccctgggtggtggtagtgtgggaggggctggggaggctcctggggtatctttagaatgcgtttctgtgtctcctcgctttgtcagtgtttgctctggctcttcagtgcctgccgcagcctctctgatcagagcagggggttgaagtgggtgcggggaggcactgtcagcttgtttggggaaagggtggggagagagaagggatgcctttttcccgcccccctgtgcttcgtgaaaagggggaagtggggactgagagagagcgcgtgtgtgcgtgtgcacgcgcgtgtgcgctgycctggtttctcatgcctgatcatctctctccctgtctagatccctctagctgagatggaggctctgtctctgacgtcagagattgtgtctgaaccgtcctgctctctagctctgacggatgactctttgcctgatgacatgcacacactcttacttagtgccctggagagcaatgtacatacacactgccctcactgctcccggccacccccggggctggactggctgcagggctccagatcggcccagggagggtcctggggccgcctcctctcagtttgctgccaggctccacccaga

SEQ ID NO: 137298 - DNA, 601 bp, Human
agtactgggcaaagcagaagtggtctgtgccttcttgaaatttgcacccagttccttgttccactgaggaggcctggagaccagaaggggtagtgcttgcccagggtcatgcctatctggtcggaggtagaaccccagtctctggtctttccttcctcaccaaccagagctgcctcccaattcttctccccactttggactgagctatggggcacaaggcaggttttaagtgtcttcacttttggccaagcctagggcccaccttccagagcccagattctttttttttttttttttttttgagtttcgctcttgttgcccaggctggagtgcaatggcacaatcttggctccccgcaacctccgcctcctgggttcaagtgattctcctgcatcagcctcccgagtagctgggattacagacatgcgccaccatgcctggataattttgtatttttagtagagatggggtttctccatgttggtcaggctgagctcgagctcccaacctcagatgatctggccgcctcggccacccaaagtgccgggattacaggcgtgagccaccgcgcccggccccagagcccacctgtgataaggcc

SEQ ID NO: 137299 - DNA, 601 bp, Human
tagaaccccagtctctggtctttccttcctcaccaaccagagctgcctcccaattcttctccccactttggactgagctatggggcacaaggcaggttttaagtgtcttcacttttggccaagcctagggcccaccttccagagcccagattctttttttttttttttttttttgagtttcgctcttgttgcccaggctggagtgcaatggcacaatcttggctccccgcaacctccgcctcctgggttcaagtgattctcctgcatcagcctcccgagtagctgggattacagacatgcrccaccatgcctggataattttgtatttttagtagagatggggtttctccatgttggtcaggctgagctcgagctcccaacctcagatgatctggccgcctcggccacccaaagtgccgggattacaggcgtgagccaccgcgcccggccccagagcccacctgtgataaggccacagcccatgccatgtgtgtgtcctgaggcatgagcgtggacacatgagaatctcaatcccacatgcttgggggagcaggcacagtccttattcattctgcaaatagtcactaagcagcctctgtgt

SEQ ID NO: 137300 - DNA, 601 bp, Human
gccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggccyacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctcccca

SEQ ID NO: 137301 - DNA, 601 bp, Human
gcccccatccccacgggacctgaagaagtgctacagcgtggaggcccagagctgccagcgccggcccacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccrtccagcgactccaaggatcccttggcctctggcccccctgacagcatggctgcctcgccctccccaaagaaagatgtgctgagtctctccggtttatcctctgacccagcagacctggacccctgagtcctgccccactttcccactcacctttctccactgggtgccaagtcctagctcctcctcctgggctatattcctgacaaaagttccatatagacaccaaggaggcggaggcgctcctccctgcctcagtggctctgggtacctgcaagcagaacttccaaagagagttaaaag

SEQ ID NO: 137302 - DNA, 601 bp, Human
aatggtgttactattcagtgtcaggaaatgagctacaaacctcacatcctaaaaactcttcaagtctttttgaaaaatactatgtcattccttcaataattagttatttcgcctcctttgatcaccatgtatttaagcaggtgtgctaggtgcttgagaaacaaaaataggacacatcacctgcctttgataaggtccacagaaataacgccaacgcaggctgaaagctaaactccttgtcagtctcaagaagccaaggacctatcacttgcaccctagaactccaaaaggttcacagagycgaggtgagggcgcccaggtcactgctcgggtgctagagttaacaggtggccaaatgcacgtataaacagcagtctaagaaggaaactcagacggaaaaagtgttgccaactgtcacctacatcttcccaaccccgccccccaatcctttttataaataaacggagggtttttgaagggaactgtccaaggttacaacctgatacggaggaatgctttggtttgggataccaacgaaattgtttatatatttattgagtactgccacacaacatctaaaagttgacaaagtgtcaaccaa

SEQ ID NO: 137303 - DNA, 601 bp, Human
gccggcacggtggctcatgcctgtaatcccagcactttgggaggctgaggcgggcagatcacgaggtcaggagattgagactatcctggctaaaatggtgaaaccccgtctctaccaaaaatacaaaaaaattagccaggcgtggtggcacgtgcttgtaatcccagctactcaagaggctgaggcagaatcgcttgaacccgggaggcggaggctgcagtgagtcaagattgtgccactgcactccagcctgggtgacagagcaagactccgtctcaaaaaaaaaaaaaaaaaaaaaaaaggcgcaaacaaagcactcacagaaaactaaacacagaattcactctacatattggccaaagggagacaatttctggatactgagcaacacacaatttatgatcttatgtgaaaactgatggccgggtgtggtggctcacatctgtaatcccagtactttgggaggctgaggcgagtggattgcctgagctcaggagttcaagaccagcctgggcaacaaggtgaaaccccgtctctactaaaatacaaaatatatatacatattagctgggcggggtggcacgtgcctatagtcccagct

SEQ ID NO: 137304 - DNA, 601 bp, Human
ctcacacccataatcccagcactttgggaggccgaggccggcggatcacctgaggttgggagttcgagaccagcctgaccaacatggagaaaccccatctttactacaaatacaaaattagctggccatggtggcacatgcctgtaatcccagctactcaggaggctgaggcaggagaatcctttgtatctgggaggcggaggttgcagtgagctgagatcgcaccattgcgctccagcctgggcaacaagtgtgaaatgccatatcaaaaaaaaaaaaaaaaagaaagaaaagaaaaagmaaataggttggccgggcacagtgtctcacacctgtaatcccagcactttgggaggccaaggcaggtggatcacctgaggttaggagttcaataccagcctggacaacatggtaaaaccccatctctattaaaaatacaaaagttagcgaggtgtggttgtgagcacctgtagtcccagctactcaggaggatgaggcaggagaactgcttgaacccgggaggcagaggttgcagtgagccaagatcgcgctactgcactccagcatgggtggcaaagcaagaccccatctcaaaaaaaaa

SEQ ID NO: 137305 - DNA, 601 bp, Human
cgccaccatgcccagttaatttttgtatttttagtagagacggggtttcaccatgttggtcagggctggtcttgaactcctgacctcaggcaatccaccacctcggcctcccaaagtgctgaaattacaggcatgagccaccatgcgtagcgttcttttgtgatttttaactaaataaaaatatgagtgtcactacagcagggacacataatggtatctcatttagatattcacattcagaaatctcaaatttaaaaaaagatgtcttaatccagagctagtctttgtctttaaaaaaaaatgtcttaggagcttaagtaataattaactaacaaattattatttcataaagcaacaaccataccccttcccatcccactcccgccagaaaacaaacatagattgttcatttcagaaagtgtctgaatgactaggtgcaggggcatatctctatctactctggctaggggcagtgtgaacattattcgaatcgttaaccatggccaggtgtggtggctcacacctacaatcccaacactttgggaggctgaggtaagaaaatgtcttgaggccaggagttcaagacaagcctgggcaacac

SEQ ID NO: 137306 - DNA, 601 bp, Human
gtggttatatggcagaatattctcattttttaggagataaatatgttaagtactgagaggcaaagtatcataatgtctgtaatttaaatatgttaagtactgaggggcaaagtatgtctgcaatttaaaatggttcagcaattaaatatgtgtatgtgtgtatatgtgtatccacacccacacatccacatatacagacagataaataaaacaacaactactgaatctatatagtgggtatacaaatgacaaatgtactttccatttttctatatgtttgaaagtttacctaataaaaagytgggaggggtggtggtggatttactgaaaaagtttactaaccttacaaaaaaaaaaaaaaaaccctagctggacgtggtggctcacgcttgtaatcccagcactttgggaggccgaggcaggcagatcacttgagctcacaaattcgagaccagcctgggcaacatggtgaaacccgtctttacaaaatatcaaaaattagctgggcgtggtggtgtacacctgtagtcccatctacttgggaggctgagacggaaggatggcttgagcccaagaggcaacagttgcagtgagccaagat

SEQ ID NO: 137307 - DNA, 601 bp, Human
acttaaagcttggccgggcgcagtggctcaagcctgtaatcccagcactttgggaggcgaggtgggcagatcacgaggtcaggagatcgaggccatcctggctaacacagtgaaacctcgtctctactaaaaatacaaaaaaattagctgggcatggtggcgggcgcctgtagtcccagctactcaggaggctgaggcaggagaatggcgtgaacccgggagatggagcttgcagtgagccgagattgcgccactgcactccagcctgggcgacagagcaggctgtctcaaaaaaaaagaraaaaagaaaaaacacttaaagcttaacctttattaacttgtttgttccatctaaagtgcctacctcttcactgctgcttgcttggttaaaaaaaataaaattatggccaggcgcagtggttcatgtctgtaataccagcactttgggaagcagaggcaggaggatcacttgaggccaggagttcaagtgcccatcctgggcaacacagcaagacccccatctctacacacacacacacacacacacacacacacacacacacacacacacacactagctgggcatgatggcatacacctg

SEQ ID NO: 137308 - DNA, 601 bp, Human
cttagcaatttgacctttagcatatccatccatccaaccaacaaatttctgttaattatctactgcatcctagttggtgggagaataaaagcaataggttagtttgacacagcgctgaaagtgctacaagagggcaagaggactgtaagctgtggaaggatataaaatgtgcccaaaccacagtcgggtgttaaggctttccagaattgaaacctgaaagataaataaaataaggcaacagaaaagaagagaaagtgagtgccaagcaaagggacagcttttaggaaggcctggagagagratactttttacaaaccaaattcaaaatgttcactgtggctcaaaaagaaacagatgagactgacaagattggggcagccagatcacaaggtcttgtatgttaggaacttaagtcattttcaagagctttagaaagagcaactggccaggcacggtgcctcacatctgtattctcagcattttgagaagctgaagtgagaggaccacttgagcccaggaatttgagaaaaagccactaagggcttgtggaatgatctgatcagatttccattttggagagatgggcggtttataggttggc

SEQ ID NO: 137309 - DNA, 601 bp, Human
ggcacctgtaactccagctactcaggagcctgaggcaagacaatcacttgaacctgggaggcgggagttgcaatggaccgagattgtgccactgcactccagcctgagcaacagagtgagactctgtctccaaaaaaataaaaataaaataagggtaaataagcactttgcacttaaatgtttcttcagtaagccaagataacaaactttaatgcttgagacatttaatttggctgctgagaattctgtttaattcctggcccttggctaggttaaggatggttaaaactgagccaattayggactgaattcctatcccaagataaaagtattttttaaagagttaaaactagggtcaggcacagtggctcacacctataatcccagcactttgggaggccaaggtgggcagactgcttgagcccagaagtttcagaccagcctgggcaacatggtgagatcctgtctctacaaaaattacaaaaattaactggacatggtggtgtctggcttgatgcctataatacttgtgacagtacctacagtacctgctacttgggaggctgaggtggaaggatcacatgagactgaagtcaaggct

SEQ ID NO: 137310 - DNA, 601 bp, Human
gggccgggcacagtggctcacgccagtaatcccagcaatttgggaggccaaggcgggcggatcacaaggtcaggagatcaagaccatcctggccaatatgctgaaacccggtctctactaaaaatacaaaaattagccgagtgtggcggcgcttgcctgtggtcccatctactggggaggctgaggcagaagaactgcttgaacccaggaggcagaggctgcagtgagctgagatagtgccactgcactccaggctgggtgacagagcgagactccgtctcaaaaaaaaaaaaaaaaaaaagaatatgatgtaccattactacagtgaaaattggccaggcgtggtggctcacgcctgtaatcccaacactttgagagaccgaggtgggcagatcacctgaggtcagcagtttgagaccagcctgaccaacgtggagaaaccccgtctccaataaaaatacaaaatcagccaggcgtggtggcgcattcctataatcccagctacttgggaggctgaggcaggagaatcgcttgaacccaggaggcggaggttgcagtgagccgagatagcgccattgcactccagcctgggcaataagag

SEQ ID NO: 137311 - DNA, 601 bp, Human
taaatgtaaaacatgctcaagcacactactgatctgacaaaagcaaattaaaataagaagtggtggccaggctgggcgcggtggctgacgcctgtaatcccagcacttcgggaggccgaggtgcatggatcacgaggtcaggagatcgagaccatcctggctaacactgtgaaaccccgtctctactaaaaatacaaaaaaaattagccgggcgtggtggcgggcacctgtagtcccagctaccgggaggctgaggcaggagaatggcaggaacccaggagatggagcttgcaatgagccragaactcgccactgcactccagcctgggggacagagtgagactccatctttaaaaaaaaaaaaaaaaaaaaaaaaaagtggcagccaggcacggtggctcacgcctgtaatcccagcactttgggagactgaaggggcagatcatgaggtcaggagttcaagaccagcctgaccaacatggtgaaaccccgtctcacttgatcttagccaaaggctgagaaatgatgaaaccccttctctactgaaaatacaaaaatgagccaggcatggtggtgcgcacctgtagttccagctactcgg

SEQ ID NO: 137312 - DNA, 601 bp, Human
atagaaaactggtgtggtgtgtgagggtgggactgaaaacaggagggttgagtggaagtctaaaatcactagttagtaatatccctagtaggtagacagtcccacaccagactggccaggtggccttccttgctcacccacacaggaaataagaggtttgttttctcaataaactcaaccagaaattttagactaggaacactctaggcacagccaggcaggtgccaaatgacaagtggaattacatgaaggtctaaagtctacgtactaaacagtaatagggcctccttcctgccttcayccaggttgcaataatgtaaatatctaggcttacctaccactccaccagccacacctcaaagagactatccttctctggaaaaactcaagtgtctctacgaaaggaccatgggatattgaaatctgggttgccaagaggcagtaaactgtatccaggcacacaaagcttccaaccctccttttttagtgtctcacttttaaaacatgaaggataattaagaattataaggcactttaagttctagcctgaaagagagaaaccaaaactataagaaataaaaatgggactctgacaaaacag

SEQ ID NO: 137313 - DNA, 601 bp, Human
gatctggccaggcatggtggctcacgcctgtaatccctgcactttgggaggccgaggcgggtggatcacaaagtcaggagatcgagaccgtcctggctaacatggtgaaaccccgtctctactaaaaaaatcagccaggcgtggtggcgggtgcctctagtccctgctactcgggaggctgaggcaggagaatggcgtgaacccaggagatggagctcacagtgagccgagattgcgccactgcactccagcctgggcgacagagcaagactccgtctcaaaaaaaaaaaaaaaaaaaaaagaaaattataacagatccatactatggaaagtatgtaatagaaaactggtgtggtgtgtgagggtgggactgaaaacaggagggttgagtggaagtctaaaatcactagttagtaatatccctagtaggtagacagtcccacaccagactggccaggtggccttccttgctcacccacacaggaaataagaggtttgttttctcaataaactcaaccagaaattttagactaggaacactctaggcacagccaggcaggtgccaaatgacaagtggaattacatgaaggtctaaagtcta

SEQ ID NO: 137314 - DNA, 601 bp, Human
agttcgagacaagcctaggcaaaatagcaaaaccctctttttaaaaaaaacaaaaaaatgaaaataaattattggaataaaagtatcagtggtgtttaatatgaaaaaagtttgtcctgccattaaaaagcaaatatgcagaaaggggcatgtacaaagacattcattgaagggctatttgtaacagttcacaactggaagataacttaaatgtctatcaacagacagtggataagaaaattataatagatctggccaggcatggtggctcacgcctgtaatccctgcactttgggaggcygaggcgggtggatcacaaagtcaggagatcgagaccgtcctggctaacatggtgaaaccccgtctctactaaaaaaatcagccaggcgtggtggcgggtgcctctagtccctgctactcgggaggctgaggcaggagaatggcgtgaacccaggagatggagctcacagtgagccgagattgcgccactgcactccagcctgggcgacagagcaagactccgtctcaaaaaaaaaaaaaaaaaaaaaagaaaattataacagatccatactatggaaagtatgtaatagaaaactggtgt

SEQ ID NO: 137315 - DNA, 601 bp, Human
aagcaaatgtctcttaaaaaatttttttttctaaagaaaaaatattggcattttgttggtaactgctgaagttgaatgatgggtatatgggagttcaaatatattctactattctcggtaatcatcaatgtttagatatttctgtaaaaaaaaaaaaaaaaaaaagttggccaggcatagtggctcatgcttgtaatcccagcactttgggaggctgaggtggacagattgcttgagctcaggagttcgagacaagcctaggcaaaatagcaaaaccctctttttaaaaaaaacaaaaaaatgaaaataaattattggaataaaagtatcagtggtgtttaatatgaaaaaagtttgtcctgccattaaaaagcaaatatgcagaaaggggcatgtacaaagacattcattgaagggctatttgtaacagttcacaactggaagataacttaaatgtctatcaacagacagtggataagaaaattataatagatctggccaggcatggtggctcacgcctgtaatccctgcactttgggaggccgaggcgggtggatcacaaagtcaggagatcgagaccgtcctggctaacatggtgaaa

SEQ ID NO: 137316 - DNA, 601 bp, Human
cagttgctcacgcctgtaatcccagcactttgggaggccgaggcaggtgggtcatgtggtcaagagatggagaccactctggccaacatggtgcaaccccgcatctactaaaaatactaaaattagccaggcgaggtggcacccgcctgtagtcccagctactcggaaggctgaggcaggagaatcacttgaacctggtaggcaggggttgcggtgagcgagattgcgccactgcactccagcttgagcaacagagggagattctgtctcaaaaacaaaacaaaacaaaacacacacacamaaaaaaaaaacagaagttgggccaggcacggtggctcatgcctgtaatcctagcactttgggaggccgaggcaggtggaccacctgaggtcaggagttcgagaccagcctagccaacatggtaaagccctgtctctactaaaaatacaaaaattagctgagcctggtggtgggcacctgtaatcccagctacttggaaggctgaggcaggagaatcacttgaacccaagaggtagaggttgcactgaggtgagactgtgccattgcactccagcctgggcaacaagagtgaaactctgtc

SEQ ID NO: 137317 - DNA, 601 bp, Human
aaacatctactgactacttactatgtaccaggcacagggaacatgactatgagtatccaactagccctgccttccaagtgttcattggctagaactgaatgcaagcagatgatgtaaggttacgttaaatagaaaagcagaaactatgaagtctgagtaagttatttcaacattttgccttgatatataagcaaagactaagaattaataggaaaatgtaattattttttggcctgctttgaaaatgatgctcccttggctaacttaactactatatctgggaaagtaaccaaaaaaaaawttttttttttggagatggagtcttgctctgtcacccaggctggagtgcagtggtgccatctcagctaactgcaacctccatctcctggcttcaagcaatactcctgcctccaagcaatactcctgcctcagcctctgcgtagctgggactacaggcatgggctaccacgcccagctaatttttttgtatttttagtagagacggggtttcaccatgttggccaggatggtctcgaactcctgacctcaagcgatctgcctgtcttggcctcccaaagtgctgggattacaggtgtgagtc

SEQ ID NO: 137318 - DNA, 601 bp, Human
tatccaatccatcagcaaatctaccttcagatctgaccgcttttcatcatttccaccaccatcctggtgtgtgccacaatcatctaatgcctggattactgcaacagtgaaagtctcctaattagtcttcttacttccaccctaatcctctacaatatattctagaggatctaggaggattctttaaaaagtcagccagccagcctgtccaacatggtgaaattcggtctctactaaaaacacaaaaattagctgggcgtggtggcaggctcctgtaatcccagttactgaggaggctgargcaggagaatcgcttgaacccaggagacggaggttacagtaagctgagatcacgccactaaactccagcctgggcgacagaacaagaccccctctcaaaaaaaagcaggccaggagcagtgactcatgcctgtaatcccagcactttgggaggctgaggcgagcagatcacctgaggtcaggagttcgagaccagcctgaccaacatggagaaaccccgtctctactaaaaatataaaattagctgggtctggggcgcatgcctgtaatcccagctatttgggaggctgaggcaggagaa

SEQ ID NO: 137319 - DNA, 601 bp, Human
tggggggtggggggacacagtttcattctgttgctcaagctggagtgcagtggcaccatcttggctcactgcagcctctgcctcccggattcaaatggttctcgtgcctcagcctcctaagtagctgggattacagtcatgcacaaccatgctcagctaatttttgtatttttagtagagacgaggtttcaccatgttgaccaggctggtcttgaactcctgaacccaagtgatcctcctacctcggcctcccaaagtgctgggattacaggcgtgagccaccacgtctggccaagcccartctttagtgtacttatgagaagaaatgttttacttactctggtcagcatagtttttcgctttcagctcaagttgtcttgtttgagattctaaagattccactcgggtctgtaagtcctttttttcctgttcttgagagtcttcaaattcaatgaatttctaataaagaagaacaatataaatttaatcagagaaattaaactttacattttcaactcctgttatttcttggaatcaataatcacaattaggtattaactacttagatctcagaattatgaccttgggttgatttttagtt

SEQ ID NO: 137320 - DNA, 601 bp, Human
ggctaattttgtattttcagtagagacggggttctccatgttggtcaggctggtctcaaactcctgacctcaggtgattcgcccgcctcgacctcccaaagtgctgggattacaggtgtgacccaccgtgcctggccttgtctctatttaaaaaaaagtacaatcaaattaggatttaaacattacctccaatagttaaattttctttcttgaacagaaaaggttcaactcttgaaatgtaccaaaagcttgcaattgccacaagaccatttctccagatgaatagtattcatagtaatgygactacagtactatatctattagtggatgccctgtggagtccatcatgcagtcctccgagatttcaaatttttttattcttttgagacagggtctcactctcttacccagcctggagtgtagtggtgcaatctcagctcactgcaacctccacctcccaagctcaagtgatcctcccacctcagcctcccaaatagctaggactacgggtgcgcaccatcatacccagctaatttttgtatttttggtagagacggggtttcaccatgttgcccaggctggtctcgaaaccctgagttca

SEQ ID NO: 137321 - DNA, 601 bp, Human
gtacccaggctgggcgcagtggctcacacctgtaatcccagtactttgggaggccgaggcaggcggatcacctgaggttgggagttcgagacaagcctggccaacatggtgaaactccatctctactaaaaatacaaaaattagctaggcatggtggtgcatgcctgtagtcccagctacttgggaggctgaggcaggagaatcacttgaccccagggggcggaggttgcagtgagccgagctcacaccactgcactccagcctgggcgatagaacaagactccgtcttaaaaaaaaaaaagacagaaagaaaactttgtgtaccctgcagatatcaacaagaaaacttaatacgtaaaacaatgaaaggtaggctgagtctgtcaactgtgtctttagtgtttggttctaaaagattatataatcccttcatgctaggcatagtggctcatgtctgaaatcccagcactttgaagcccagaagtgcgagaccagcctgggcaacataatgagatcttgtctctatctatctatcttatctagctatctagctatctagctagctagctagctatctagctatctatctagctatctagct

SEQ ID NO: 137322 - DNA, 601 bp, Human
atgcaaaaattttccgggcgtggtggtgggcgcctgtagtcccagctactcgggaggctgaggcaggagaatggcgtgaacccaggaggcggagcttgcagtgagccgagatcacgccactgcactccagcctgggcaacagagcaagactccgtctcaaaaaaaaaacaattagccacgtgtggtggcatgtgcttgtagtcccagctactcggagcagaggtgagagtactgcttgagcctgggaggttgaggctacagtgagccatgatcacaccactgcattccagcctgggcaatrgagctggaatgtctcaaaaaaattaagaaataagtaatttttaaaattaaaaataagaagctttgattcatattgcagatttaaaaaaaaacaaaaaacaaaaacctaaggtggtaaagtgaaaaaacagtcaaataatttccccccagaaaaagtgggggaatgtttaagtgtggtaaaataaaaactctgaagaaaatttaagatacacttagaattcatattacaccagttaaggcttagaaaaaaacaaaaggaagagaaaggaaaacaattcactagaaaagagaaaaagactcc

SEQ ID NO: 137323 - DNA, 601 bp, Human
tagactcaacttttcaacattgttaaatcatgcaacatgatagattccatactatcaaaagctgtaaagtgtgtcttttaattcagttcctatttctttactttttcttgcttctcaaatagcaaataactttaaccaaaatttccccttttaacaaaggaagtagtctttagagcagaacttgaatttttattgtggctattttttaaaagggatgtgtgctcctaaaatatgttcatgagaattgacaaactcagtcttttaaaattaaagacactaatacactgtataaacatgaaaactagaaaaggcatccagcactcaaacaaatggcactcaacaaaaaaattgcatccacctctcctcccactacaggtactgcgaacagtcatctcagtgcccctaaataaatgtttattttaaattaaatgttgggttacatttactttgtcacaaaattcatattttctttttttgttttagactgagtcttgctttattgcccaggctggagtacagtggcgtgatcttggctcaatgcaacctccgcctcccaggttaaagcaattctcctgcctcagccttccaagtaggtgggatt

SEQ ID NO: 137324 - DNA, 601 bp, Human
ctgaggtgggaggatcacttaaacacaggaattagaccctcatctcttaaaaaaaaaaacaaaaaaaaaacctgtactccccaaaaaacatagccaccaaattaagaagtactcactaaaaaaaaaatatcactgtcatctaaatcttttcatcttctccacaaaaggcaatggctctatactcagggaagaataagttgtaaatccaaggagcctgagggcaacagaagcttcctaagagagaatcaaataataaatgattctatatcagctctgtgtgctaatatgctgtaaataatgsttcaaattcataagttatgacaagcaaaatggaatttactactaacccttacttctccaattctattgacattagaaatggccaaactattatatgccaaaaagcactaaaattctttgacctacttccttaaatatattctaagaaaactaccaatagaagggaaaacttgtagatgtaaaaaaatatttactgcaatatgattcagtataccagaaaaaatgaccaaccaaccaacagaagtttttggtttttttattttaaatttcttacatttattttaccctgattcacctcttc

SEQ ID NO: 137325 - DNA, 601 bp, Human
ggctctctcaaatattaactttgatatgaaatgatacttggcaactttaaaatggtttatgtgctgtgaaaattcttaatttatcaatcaccttgtgttgaaggtctgttttaagccttatttaattcctttaaataaatttaattaattaaataaaatttaaacattcctttaaaataaaaattatgttattgtttatgttaatatctcccccaactttctatctagtggagtgcttattcttatgaccaagaaataagaagtgttttccttctaataataatgtttcaaagtgaaggcytgcaggtattttactagactaagatcctgacacaagatgtaaaaagcaaaggaatgttacatgggggacaaaaaaggtagaaaggtcaaagtataaggatctaacacatttgacttcagtgccaacaacatttttccatttaattcaaaaagacgaattttcatttaaaggaaggaagggcggaattaaagaagagtctaaatataacagcttaaaatcacagccacgggtgcagtggcatgcacctgaggtgggctccctcacgggagggctgaggtgggaggatcacttaaacacagg

SEQ ID NO: 137326 - DNA, 601 bp, Human
gtctctactaaaatacaaaaaattagccaggcatggtggcacactcctgtagtcccagctactagggaggctgaggcaggggaatcgcttgaacctgggaggtgggggctgcagtgagccgagattacaccactgcgctctagcctggcgacagagcaagagtccatctcaaaaaaaaaaaggatagtttacgtctgttattataaatgattttctgaatgtttttctggtggtatattctctcctgcctaacacccacagcaagaacctgaacagaaactgttttatgactttgtgtatatcatgttttctttacatatactgtgatcctaaattttattattatctttgtaggtacttacaatataaatcatgtaacataaagatcatatataattgatcatataatacatagaaaatattagaaaatatacacacatacaccaagatcaaataatacaaattcagaacctttcttttctgaaaatacttacaataactcagtacaacaacatatccaatgaactcagcttactcaaggcctaagtcccataagatggtataaacacttttgagaagtcattttaaagtgtggaagagc

SEQ ID NO: 137327 - DNA, 601 bp, Human
ttccatctcaaaaaatatatatataaatacataaaataaaatggtggattttatgatatgtgaattagatttcaatttttaattttattttatttttaaatagagacagggtctcgctattttgcccaggctggttatgaactcctgggctcaagcaatcctcccgcctcagcctcccaaattcctggaattataggcacgagccaccaggcccagcctggatttcaattttaaacagagtcatttgaaacctatcccttaacacaagtatgagcaaattatgtcttaatttaataacctrttttttaaagaaaaagtcaaatggtaagggatcaaaaagaaaatctcaacatttatgttataagagaaggacatttcattaaaatgtccttctcttctcttcctcagataattcacagtagaaagaataggcagatggttgctaagccttaggcagaatcattcctttgcctcaacacttgggcaaaataacatactaatggcccccactaaggctgttaagctgaggcaaagactggccagatgttaaccaaaacagtttcctcttttgcttgggcaaatagctaggctatccacccca

SEQ ID NO: 137328 - DNA, 601 bp, Human
aaacccaaggaatatcttcccaaagtggttgttcattatactcagctcttcaaaactgtattactacagactttcagatagcaaagttagagttttggttgtttctagctctagcaggatatataggcaattgaaatgggggtggagggtatcccataaaacaatattatccggttatgaaaaggaaggaagtactgacacatgctacaacatgaatgaacctttatgctaggtgaaagaagccagtcacaaaagaccatatattgtatgatcctattattatgaaatgtccagaacaggyaaatctatagagacaaaaattagattagtggttttcagggacaaggggaagcagaaaagcagaagtaagtgtaacaggtatgagggggtggttcttcttggggtgataaaaatgttctggaattagtggtggcgattgtacaaccttgaaaattgtactaaaaaccgctgaattgtacacttcaaaatggtgaattttggccgggtgcggtggctcaggcctgtaatcccagcactttgggaggccaaggcggacagatcatctgagatcaggagtttgagaccagcctggccaacatga

SEQ ID NO: 137329 - DNA, 601 bp, Human
tgcctgttattttcataagagctaaaggtcttaaaattacaggtctcaaacttttactatctctttcacacacaaaatttcatgtttttaatgcacaaaaagtggtattttaagatattttcaacttactgttacatattagaaacttgtatgctggccgggcacagtggctcacgcctgtaatcccagtactttgggaagccgaggcaggcgtatcacctgaggtcaggagttcaagaccagcctggccaacatggcgaaaccccatctctacaaaaaatacaaaaaaatttagctgggygtggtggtgcatgcctgtaatctcagctacttgggaggctgaggcaggaggatcgtttgaacctgggaggtggaggttgcagtgagccaagactgtgccaccgcactccagcctgggccacagggcgagactacatctcaaaaaaaaaaaaaaaaattgtatgctgaccacgtctatcttttcgctaagtttttgatacaaaataaatcataaagtatacttaaattaacctctgtctcagcttttcatataaatgtattttgtctgtaacctgttaaataacaggaaaaatactgaatt

SEQ ID NO: 137330 - DNA, 601 bp, Human
gggaggccaaggcgggctgatcacctgaggtcagcagttcgagaccagcctggccaacatggtgaaacccctctactaatactacaaaaattagctgggcatggtggtgcacgcctgtaatcctagctactcagaaggctgaggcaggagaatcactttaacctgggaggtggaggttgcagtgaggtgagatcacaacattgcactctagtctgggcaacaagagcgaaagctctgtctccaaaaaaaaaaaaaaaaaaaaaaaaaaaggcttgtgggaaggagacatataacagaatayaccattaattttgggagatttccaatatttatctaaatgaatatgaccattgttcacataagcttaggttcatccataaaaattccttaaagttctagtaatcattttgttctccttaagcattttgaattatttctatcattaattccttcagcctccattcacagctttctaacccatcagggttactttttgctaaatttacttccatttggcaacacagtcttactttcacctcagaaataacatttgataaactatcaatccattctctaaccatctctttcaaaaggtgaaatg

SEQ ID NO: 137331 - DNA, 601 bp, Human
gggcgaggtggctcacacctgtaatcccagcactttgggaggccgaggcaggtggattacctgggcaagagttcgagaccagcctggccaacatggtgaaaccctgtttctactaaaaatacaaaaattagccaggcgtcatggcaaatagcagtaatcccagctactcgggaggctgaggcaggaggatcgcttgaatctgggagatggaggttgccgtgagctgagactgtaccactgcactccagcctcggtgacagagcgggactttgtctttttaaaaaaaaaaaaaaaaaaaaaaggcagaagaaggtaggtaattaaggttgaatgaggtcattaaggtggggccctgatccaacagggctggtatccttataacagcaagagataggcaaaaggccatattaggacacagaggtaaagcagccacctgcaagccaaggagaaaggcctcaggagaaaccaaatctgcttgtaccatggatctcagatttccagcctccagactgtgagaaataaatttctgctattgaagccacccagtctgtaatattttgttatggcggccctagctgacttataccattaagcaaacctc

SEQ ID NO: 137332 - DNA, 601 bp, Human
cagaatacaatctgtgtggatattctccaaaacatgattttaaattgttttatgattatagattataaaggtttttatactcttctaaagaaaaacaacaacatagtttctaccagacgcaggataagagatcacacaaactagggagaaaaaaaaacaaacaaaaaaacgggctaagactggaaccatatgtatcatgggaaatataggactagcaaggggaaagagagaggaattatttttttcatgtaacaaatattgtataaaactataaaaattatatttatctgggtatgtgaamcccagactgaccatgacatacaaaaataattttcacattaagataacagaaacaaaagcaacatgaaaggctgacagggaatcataaaaaggttaaaaaaccctcaagtacattttctaatttcctttgaggagactgtgctgaaactgttaatttaaaatactgaaaactcatgcaaaaaacctacttttgagttattttaacacattataatttgtgcttatattatttgttatgagcttaatgcaaataagtcctttacaatggataatagatgtagagaccctttaccaataactt

SEQ ID NO: 137333 - DNA, 601 bp, Human
ggattgcctgaggtgaggagctcaagaccagcctggccaacgtggagaaaccttgtctctactatattaaaaatacaaaagttagccgggtatggtggcacacacctgtaatcccagttacttgggaggctgagggaggagaatcgcttgaacccaggagatggaggttgcagtgagccgagattgcgccactgcactacagcttgggcaacagagcaagactctctctctcacacacacacacacacaagcaacaacagaatatagctacaatataataatgtaaatacaatctttgtarcattaatatgcttactgtatacagaatacaatctgtgtggatattctccaaaacatgattttaaattgttttatgattatagattataaaggtttttatactcttctaaagaaaaacaacaacatagtttctaccagacgcaggataagagatcacacaaactagggagaaaaaaaaacaaacaaaaaaacgggctaagactggaaccatatgtatcatgggaaatataggactagcaaggggaaagagagaggaattatttttttcatgtaacaaatattgtataaaactataaaaatt

SEQ ID NO: 137334 - DNA, 601 bp, Human
gatatcaattctgtgatacttcatgctttgggtatggttattaagctaagattgtaataatcaaatctcacgtgtcaaggctaacagggaaaaattctacaccctaccccaagaaagtgctaaccacattattcaaatgcaatgtgtggtggggttttctgttccttaaaagcaatggctagtattaaaacatttttttaaataaataaataaacagcaacgtccaggcacactggctcacacgtgtaatgccagcactttgggaggccgaggtgggtggattgcctgaggtgaggagctyaagaccagcctggccaacgtggagaaaccttgtctctactatattaaaaatacaaaagttagccgggtatggtggcacacacctgtaatcccagttacttgggaggctgagggaggagaatcgcttgaacccaggagatggaggttgcagtgagccgagattgcgccactgcactacagcttgggcaacagagcaagactctctctctcacacacacacacacacaagcaacaacagaatatagctacaatataataatgtaaatacaatctttgtagcattaatatgcttactgtatac

SEQ ID NO: 137335 - DNA, 601 bp, Human
aaatcaaactgaaactaatataacaaagtgactgtcaggcttaatcaatctcaatttaaattttcaaaaggttttagaaggcctaaattaaggctttgcagtggctcacgcctgtaatcccagcactttgggaggtaggaggtttgcttgaggccaggaatttgagatcagcctgggcaacacagcaagacaccagctctagaaaaaaaaatacaacaactagcaggcactcgcctatagtccctactgctcaggaggcagaagtgggagaactgcttggacccagaagttcaaggctgcwgtgagctatgatcatgccactgcactccagcctgggcaacagaatgagacccctcaaaaaaaaaaaccactttaaaaataaaagaggtcaggtgcagtagctaatgcctgtaatcccagcactttgggaggctgaggtgggaggactgcttgagcccaggagtttgagaccaacctgagcaacacagggagaccctgtctctacaaaaaaatttttaaaaattagctgggtattttgggatgcgcctgtagtaccagctacttgggaggctgaggtgggaagatcgtttgagccagggag

SEQ ID NO: 137336 - DNA, 601 bp, Human
tattgttccaggattaaagaacagagaaaaacagaaacaaacatattatttattttactttttctcaaggcaaaatatataacaaagcttacctaattctactatgagctgtggattctagttgatcactccctgagagctgatgaagttttgttctttctaaatgttccatataattatggatcatctattttaaagaaagaaaaaatacacaatatttaaggctaatacctggaataaaatcatagtgttataacaaggaaaacattttggtacaattttcttatctatcagactactygattccaagtaagagaatattaaggaatgaaaaaaattttaagggaaagtaatatgcaaatgcttacatttaaggatgctggtgtccacaaaagtagctaatatcttgcttaggatggcaaaaaaaaaaaaaaaacccactttttttacaatatgtgatgctattaaaataatattgatataaagaacacaaattagtaaacagacactgggaaagaagtcataaaagaccattggttaaaaataatagatggcatttgagaaagccattcactaaaatgagacacaacaaagaaattaa

SEQ ID NO: 137337 - DNA, 601 bp, Human
tctttttaatggtaaaaaccgtttctacttttctgtgctattctctcctgcagcattccaaccacagtggagagctttttgaatcagcctaactattgttccaggattaaagaacagagaaaaacagaaacaaacatattatttattttactttttctcaaggcaaaatatataacaaagcttacctaattctactatgagctgtggattctagttgatcactccctgagagctgatgaagttttgttctttctaaatgttccatataattatggatcatctattttaaagaaagaaaaaatacacaatatttaaggctaatacctggaataaaatcatagtgttataacaaggaaaacattttggtacaattttcttatctatcagactactcgattccaagtaagagaatattaaggaatgaaaaaaattttaagggaaagtaatatgcaaatgcttacatttaaggatgctggtgtccacaaaagtagctaatatcttgcttaggatggcaaaaaaaaaaaaaaaacccactttttttacaatatgtgatgctattaaaataatattgatataaagaacacaaattagtaaacagaca

SEQ ID NO: 137338 - DNA, 601 bp, Human
agcctctaaaatacagaagatggctcttacagggtgtaagtagagtgagcaacagtaaagctacagagattaatgactacccccacaagcaggcatggatatttgtcacccaagactacaaagaaaagaaagggcaacatctgacaaaacaatagtgaataggctttgtaaagctttcacaactttgatgtgtaaataatggggaaaaaggcattccttaacctaaaagtcttaaattttttcactttaaaacatattttgttttaggaggaaaatatttaaattgtcagttcccatgagmtattatcaaaaattacaaaaatgatacctgaaactctatcattcaaaggataattaaaacaaaataagcttacggcctgtatctaactgactgcaagtccaagcataaaagatatttgtccctaaatgctcagaagctaaatgcagaggttgtataaacttggagccggtgctctactcttgctcttcttttactttgaacattctgcttaaaacaagaccacactgaccttgtacttgtgtgtaagtacaatatgaaaatccttttctttagttagtggtttccaaacataaagctata

SEQ ID NO: 137339 - DNA, 601 bp, Human
taataagtccatgaaaaaagaggcgttatttattatttccttagtgcatagataatatagtacctattgtacacatacacattcccatatactatagaaccctgttctttcttgaaaatgactgacccttattttaaattacatcttttcttcttctttgattttaaaatgccctttctttcattaaatgatggtgacagtgataagtagctagatttccttttcatattcattctggacaaaataaaaagttgtcaatctgatgttttccccccatattttgtgaaccgaaaatccaagsggactaagagctactagctgacttttatttattttctaacataccttaatgagttaagcaaaaggtgactgggaatttaatgactgaatataatggaaagctctctaactcaaaatgcaaagacaaccaggaagatgatatacagacttcataagactccctcacactaatagaaatcaaaatataagccattcattttcacacataacaaatattgaaaaagtttaaaactattgggggagggagtcttctatgaatccaaattttactttccaaaaagtaaacaaaatcagttgacaa

SEQ ID NO: 137340 - DNA, 601 bp, Human
gaaataaaatttaaaaacagaactttgatttagggggaaaattcaaaagcaggaaggcagtacaataagagggtagtttttgtttgtttgtgtcttgctgtgttgcccagactgaagtacagtgggacgatctcggctcactgcaagctctgcctcccaggttcaagcaattctcctgcctcagcctcccaagtagctgggattacaggcattaccaccacgtctggctaatttttgtatttgtagtagagacaaggtttcaccatgttggccaggctggtcttgaactcctgacctcacrtgatctgcctgcttcggcctcccaaagtgctaggattacaggtgtgagccaccacacctggccaagagggtaaattttaacaccaaatctaagtttgcgactatgagctgccgggacaaccaaatgacaaaaattaaagtgactagtcagctaccatgtttacaccagttattcccaaatgctgttcagcaacaaagtttttataataagtccatgaaaaaagaggcgttatttattatttccttagtgcatagataatatagtacctattgtacacatacacattcccatatactatag

SEQ ID NO: 137341 - DNA, 601 bp, Human
acccaaaggaaacactaaaaaccttaactctagatactcacatttaggtaaaatccatctaagtgtaaacagaatggtagcttcaagagaattcaaattattaaaggaaaggtatgaatgtcctaactctgagtatatttcaaaggaagaggatactgtttcactgttgatgctagagggcttccatggacccaggtcaacccctgacctagcacgtaggagaaagtcacagatatcctgttatccccagtgcccagcatatcaagcctgacatgtagcaggcttttttttttttttttttgagatggagtctcgctgtgttgcccaggctggaaggcagtggcaccatcttagctcactgcaacctccacctcccgggttcaagcaattctcctgcctcagactcctaagtacctgggattacaggtgtctgccaccatgcctggctgatttttgtatttttagtagagacaagatttcaccatactggccatgctggtcttgaactcctactcctgaccaagtgatccgcctgcctgggcagagtgctgggatttcaggcatgagccaccacacctggcctgtagtaggctcttaacag

SEQ ID NO: 137342 - DNA, 601 bp, Human
ctattgaactgtatacttacactattgaactatatacttaaaaatggttaaaatggtcatttttttcctccctgtggagaccacatcagaggtcataagatggtaatttttatgtgtttttaccacacacacaaaataaacgtcattactttcagtttcacttgagatactgcagtaaaagcaatctggtctttgtgccattttcttatgggttttagatatcaggctaaaagtctataagctcttcaaaatattttcagttgttccatttaccaaatgcaccatgtgcttagtgctatayagaatatatatgtcatggattatctggcattgcagcataactattttctaacagactataaactatgtttacaactagagaaaatgaattatcccattcagttcaacttacagacactacatgccaatgtagtgttttcctgagtagcctaacttctgaaataagtcatataaaggcaagcaactctgctacctaagtttgtctcttagatttgagggttttaagccaaatgaaaataaagacaaaactacaaacaagtaactagccccacataggatccctcactattaacacaaatat

SEQ ID NO: 137343 - DNA, 601 bp, Human
attatttaatgagtgcagagttttagatttgcaagatgaaaaagctctggtgctgttttacaataatatgaatatacataacactattgaactgtatacttacactattgaactatatacttaaaaatggttaaaatggtcatttttttcctccctgtggagaccacatcagaggtcataagatggtaatttttatgtgtttttaccacacacacaaaataaacgtcattactttcagtttcacttgagatactgcagtaaaagcaatctggtctttgtgccattttcttatgggttttaratatcaggctaaaagtctataagctcttcaaaatattttcagttgttccatttaccaaatgcaccatgtgcttagtgctatacagaatatatatgtcatggattatctggcattgcagcataactattttctaacagactataaactatgtttacaactagagaaaatgaattatcccattcagttcaacttacagacactacatgccaatgtagtgttttcctgagtagcctaacttctgaaataagtcatataaaggcaagcaactctgctacctaagtttgtctcttagatttgagg

SEQ ID NO: 137344 - DNA, 601 bp, Human
ttctcctgcctcagcctcccgagtagctgggattacaggcatgcgccaccatgcccagctaattttgtatttttagtagagacgaggtttctccatgttggtcaggctggtctcgaactcctgacctcaggtgatccgcctgcctcagcctcccaaagtgctgggtttagagatgtgagccactgcgcccggccgggaaaccatttttgaaagaggtctttcttcttggtatcccaggcagtggtgacataaagcttctaagattagcagaaaagcacttagatgggaaatcggacaaagyatttggccaggggcacaatattcttgcattatacctcactaactgcctccaactaaagacagaatgaggctaagcacagtggctcatgtgtgtaatcacagccctttgggaggccaagacaggtggatcacttgaggtcagaagtttgagaccagcctggccaacatggtgaaaactcatctctactaaaaatacaaaaattagctgggtgtagtggcatatgcctgtagtcccagctacctgggcggctgaggcacgagaatcacttgaatccagaagggggaagaggttgcagtgagc

SEQ ID NO: 137345 - DNA, 601 bp, Human
atatgcctttgaaactatgtcaaaaataaataatttgaggtcaatcttggaattctcatttacctcttaaatatagagaaattatttcttcttcctccttattattccagtcccccactccccacaaaaggcaggttattttcacctcagaaaaaattgtatttagtaatttaaaagttcacaacatatgaagtgtggcaaaggcctactttccaaattcatttgtggatctgggagcatgaaataaaataaccaggagacagtctagatatcatggggtgaaaagagaaaaaataaaaawaaaaaaaaaaaataaccaggagagagctgaacctaaaacaggaaagggaccatgatacctcagcaatcccaaggtttcaggctacaaggaagtggttaatttagatctacttagaagaaaattatgttttaaatttatcctaggctatccaaataaaatgaaatttacttatatgtaacttacttcccttttatacttaccacataaaaatattttacactctttaaaatagcccaatgtgtgggctatatttctgacaactagatcccagagatacagcatgagagctgagaagggaaa

SEQ ID NO: 137346 - DNA, 601 bp, Human
aaagtgatatgcctttgaaactatgtcaaaaataaataatttgaggtcaatcttggaattctcatttacctcttaaatatagagaaattatttcttcttcctccttattattccagtcccccactccccacaaaaggcaggttattttcacctcagaaaaaattgtatttagtaatttaaaagttcacaacatatgaagtgtggcaaaggcctactttccaaattcatttgtggatctgggagcatgaaataaaataaccaggagacagtctagatatcatggggtgaaaagagaaaaaawaaaaaaaaaaaaaaaaaataaccaggagagagctgaacctaaaacaggaaagggaccatgatacctcagcaatcccaaggtttcaggctacaaggaagtggttaatttagatctacttagaagaaaattatgttttaaatttatcctaggctatccaaataaaatgaaatttacttatatgtaacttacttcccttttatacttaccacataaaaatattttacactctttaaaatagcccaatgtgtgggctatatttctgacaactagatcccagagatacagcatgagagctgagaa

SEQ ID NO: 137347 - DNA, 601 bp, Human
tcttgaattggtaactggcacccaatataaaatataaaagtatctgatagaaacctactaattccagcaaattcatttgtttggagttgagtcaaaaagactgacagtattaattaaaaaaaaaaaaaactgacagtatttaacacctctggagccaaagagattgatagtgaaaacaactacaagtccctctgagcaccatttgcattgtctttgctttgatgtatactcgattaaaaaataagtggtatttggctggacacggtcggctcatgcctgtaatcccagcactttgagaggytgaggtgggcatatcacttgagcccaggagtttgagatcagcctgggaaacctggtgaaacactgtctctactaaaaatgccaaaaattagcccagcatggtggtgcacgcctgtagttccagctacgaggaatgctaaagcatgagaatcgcttgaacccaggaggcagaggctgcagtgagctcagattgcacccatgttatcatgtacatgaattctcattctttaaaagtttcaaacgtaacacacattaaaaaatataaaataaacagtctgtatttctgataaacagtgttgat

SEQ ID NO: 137348 - DNA, 601 bp, Human
aattatatatttttataatttattaatttataatattttaattataaattatatatactatatataattcccttaagggagtatcagcaggaattattgccacatcgatttagctattgatgctgaagtggtagctttagatccaccttggctaacatcagaaagttcaacctacaaatagaagtaatttaaaagaaattttaattgagtaatttattctaaagtactttaaaaattggttaagaaataaatttgcccagagaaagtcacaatttttttaaaaggcaataaagagtcaccrattatcaataaataatctctctagctcctctgcaaataattgggaaatatttaagtaaatcgtatttttccaggcgtacatgaaattcttcttttttttctaagacagagtctcgttcttgtcacccaggctggagtgcagtggcataatctcagctcaatgcaacctccaccttccaggctcaagcgattctcgtgcctcagtcccctgagcacctatgattaccggcgtgcgtcaccatgccccactaattttttgtatttttggtacagacggagttttgccacgctgcccaggctg

SEQ ID NO: 137349 - DNA, 601 bp, Human
gcagtggctcacgcctgtaatcccaacacttttggaggccgaggcaggcggatcacctgaggtcgggagttcaagaccagcctgacaaacatggagaaaccctgtctctactaaaaatacaaaaaattagccgggcatggtggcgcatgcctgcaattccagctactcgggaggctgaggcaggagaaacacttgaacccgggaggcagaggttgcagtgagctgagatcgcatccagtctgggcaacaagagtgaaactccatctcaaaataataataataataataataataataatatatcagggttagggtaaattaagtgaatttatcattcactaaatgtatgaccttgggtaagtaatgtattctttctaaacctttgttttatcatctgtaaaatatagataacagtatctacttcttaagattcttattaagttattctacattatggcttagcaatgtgtttcacacatactaagaatttaaaatattaactattattataatagtaactatttgtataattctaaatacataattatatatttttataatttataactattataatagtaactattagtataattataat

SEQ ID NO: 137350 - DNA, 601 bp, Human
caaaataattataaacaattgtccagtggctatcaaaaatgaagcagttcttttggagcacccaggttttaagaaaagagaaactgacaaaaagtttacagccaccaccactaataataataataataataataataataacaataggccgggtgcagtggctcacgcctgtaatcccaacacttttggaggccgaggcaggcggatcacctgaggtcgggagttcaagaccagcctgacaaacatggagaaaccctgtctctactaaaaatacaaaaaattagccgggcatggtggcgcrtgcctgcaattccagctactcgggaggctgaggcaggagaaacacttgaacccgggaggcagaggttgcagtgagctgagatcgcatccagtctgggcaacaagagtgaaactccatctcaaaataataataataataataataataataataaatcagggttagggtaaattaagtgaatttatcattcactaaatgtatgaccttgggtaagtaatgtattctttctaaacctttgttttatcatctgtaaaatatagataacagtatctacttcttaagattcttattaagttattc

SEQ ID NO: 137351 - DNA, 601 bp, Human
ataggatctacagataggtttcaagaggtatatgcaaattgaaattgtatgcaaaaatttgtgtacaatgtatttctctgggaaaagaatcatagcttttatcagatattcaaaggggtttgcagctccaaaataattataaacaattgtccagtggctatcaaaaatgaagcagttcttttggagcacccaggttttaagaaaagagaaactgacaaaaagtttacagccaccaccactaataataataataataataataataataacaataggccgggtgcagtggctcacgcctgtmatcccaacacttttggaggccgaggcaggcggatcacctgaggtcgggagttcaagaccagcctgacaaacatggagaaaccctgtctctactaaaaatacaaaaaattagccgggcatggtggcgcatgcctgcaattccagctactcgggaggctgaggcaggagaaacacttgaacccgggaggcagaggttgcagtgagctgagatcgcatccagtctgggcaacaagagtgaaactccatctcaaaataataataataataataataataataataaatcagggttagggtaaat

SEQ ID NO: 137352 - DNA, 601 bp, Human
tccaactccagacttaatgcaccaaactttgggcagtgagaataggtcatctatattttaacaagcaatccaggtgagttacatactcattgaaatttgatcactattataggatctacagataggtttcaagaggtatatgcaaattgaaattgtatgcaaaaatttgtgtacaatgtatttctctgggaaaagaatcatagcttttatcagatattcaaaggggtttgcagctccaaaataattataaacaattgtccagtggctatcaaaaatgaagcagttcttttggagcacccargttttaagaaaagagaaactgacaaaaagtttacagccaccaccactaataataataataataataataataataacaataggccgggtgcagtggctcacgcctgtaatcccaacacttttggaggccgaggcaggcggatcacctgaggtcgggagttcaagaccagcctgacaaacatggagaaaccctgtctctactaaaaatacaaaaaattagccgggcatggtggcgcatgcctgcaattccagctactcgggaggctgaggcaggagaaacacttgaacccgggaggcagag

SEQ ID NO: 137353 - DNA, 601 bp, Human
ccgaggcaggcggatcacgaggtcaggagttcgagaccagcctggccaacatggtgaaaccccgtctctactaaaaatacaaaaagtagccaggcatggtggcaggcacctatgatcccagctacttgggaggctgaggcaggagaattgcttgaacctgggaggcggaggttgcagtgagctgagatcacgccactgcactcccacctcagcaacggagctagactccatctcaaaaaaaaaaaaaaaaaaaagcggggagagggggcagattccagccacgcacatgcctgtaatcccrgctgaggcgggaggatcccttgagcccaacaagaccctgtctctttgaaaaaagagaaaagagtagggagtagggaggagtagacagagtctaagtccaactccagacttaatgcaccaaactttgggcagtgagaataggtcatctatattttaacaagcaatccaggtgagttacatactcattgaaatttgatcactattataggatctacagataggtttcaagaggtatatgcaaattgaaattgtatgcaaaaatttgtgtacaatgtatttctctgggaaaagaatcatagct

SEQ ID NO: 137354 - DNA, 601 bp, Human
atgaggctttatccagtgttcagggctcacttgtccttcttctatgtgaagacacagagttcctcccctccagaggatgcagcaacaaggcaccaacttgaaagcaaagagcagccctcaccagacacctgaccctgccagcaccttgatcttggccttcctagcctccagaactgtgagaaaattaatttctgttctttataaattggccaggtgcagtggctcatgcctgtaatctcagcactttgggaggccgaggcaggctgatcacctcaggagtttgacaccagcctggccaacrtggcaaaaccccgtctctactaaaaatacaaaaaaaaattagctaggcatggtggtgggtgcctgtaatcccagctactcgggaagctgaggcaggagaatcacctgaccctgggaggcagaggttgcagtgagctgagattgcaccactgcactccagcctgggctacagagcgagactccatctcaaaaaaataaacaaggctgggcgcagtggctcacgactgtaatcccaggactttgggaggccgaggcgggtggatcacctgaggttgggagttcgagaccagcctgaccaaca

SEQ ID NO: 137355 - DNA, 601 bp, Human
gttgccaatgtgatagtattaagatggggccttcaagaggtgattaggccataagggcttctcccttataaacaggattggggtccttatagaataatgaggctttatccagtgttcagggctcacttgtccttcttctatgtgaagacacagagttcctcccctccagaggatgcagcaacaaggcaccaacttgaaagcaaagagcagccctcaccagacacctgaccctgccagcaccttgatcttggccttcctagcctccagaactgtgagaaaattaatttctgttctttataarttggccaggtgcagtggctcatgcctgtaatctcagcactttgggaggccgaggcaggctgatcacctcaggagtttgacaccagcctggccaacatggcaaaaccccgtctctactaaaaatacaaaaaaaaattagctaggcatggtggtgggtgcctgtaatcccagctactcgggaagctgaggcaggagaatcacctgaccctgggaggcagaggttgcagtgagctgagattgcaccactgcactccagcctgggctacagagcgagactccatctcaaaaaaataaacaaggc

SEQ ID NO: 137356 - DNA, 601 bp, Human
acaacagatatttctaagtactatggggcttctaaatacttcataagaaaagaaagtttggggccaccaaccttaaacattttatcactcattactgcattatgaggtaacacagtgtacaaattatattcagaattacttcattcttgttaatacaaacagcataaaggaattttgtggggtgatgtatattgattctggtgaattttactgcactgaatatacattttaaaattcttctaacattttttcatctgctcctcaaatttgccagggagttagtttctcaaactaattatgycttaaaagaaacttttcaggtataatttgatgtaaactaaaattaaaacataaaattaaatataaaaatggagtattccttaagaattaaactttcaggccagacatggtggctcatgcctgtaatcccagcactctgggaggccaagacaggcgaatcatgaggtcaggagtttgagaccagcctggccagtatagtaaaaccccatctctactaaaaatacaaaaattagtcaggcatggtggtatgcgcctttagtcccagctactcgggaggctgaggcaggagaatcacttgaac

SEQ ID NO: 137357 - DNA, 601 bp, Human
gcaagaggattccttgagcctaggagttccaggacagcctacacaacgtagtgagatctcacctcaaaaaaaaaaaacagtaattgaagtactgagtccatatataatgattcaaatttgttatcactgaattacacagaagagaagccaaggactttttttttttttttgagacggagttttgctttgtcactcaggctagagtgcagtggtgcaatcttggctctccgcaacctccacctcccaggttcaagcaattctcctgcctcagcctcccaagtagctgggattacaggtgcaygccacaatgcccagctaatttttgtagttttagtagagatggggtttcaccatgttggccaggctggtctcgaactcctgacctcaggtgatctgcccacctcggtctcccaaagagctgggattacaggcatgagccaccgtgcccggccaggaacatttttatttaccatctttgaccaaaaatattcataagtaactaaacttacagtaatatattaaaatattctaatctgaactattctagagataaatgtatcaacatctacaaaatggaaaagatagtttgtagtctgtttct

SEQ ID NO: 137358 - DNA, 601 bp, Human
attagccatgaagccagtagacaagacagataattctgtaaactggagggtatacaggacatttttgaaaaggtacaaagtcctcagtgggcttagaaaattcaccgtatgatccatatattatcctacttggcttgcacgtctttgggtgcatgaatatactgctactgcgtcctcaccatcacctaaatgtgactcagtctgtcccactataatatgttgtgaatttccttgtattgtacttctattgttggtctttttgcatcaatgatacaacagcaacaacattttaaaattatcrttaaaagattaactggcaatgtacagagcttactcttaagggaaaacactacaaaaagtcatgaggataccaaatggaaacacatgatggtgcctttgagtctgcatgagacccggatgaagtagaaataaagcctttccgagatggcaaaaataaataaataaagtttacattaaatgtacacattcccaatgaagagttatcttaatatatggtgtataaattgaatatataaccaataggattatctaaaatttcattttgaaatgatcaataactctttataagaaaaacataaag

SEQ ID NO: 137359 - DNA, 601 bp, Human
ccctttattttaaaaaaggtaattttccaaatgatttaaaaattacttaaaacaaaaacagccaacctaggaatgctacatattctgtgtacctggactcatattttgtctatattctaattttctcaaagatcagggtacttacaccagaaagaattaaatatcagaaatagattaatcatctacctatgtattatctacaaactgaaaccaaacaaaacaaaataaaagtcccaaaaaagtttccaaattctaactccaaaatgatcttcggcaagatatttgctttaaacactaatgytaaatttttattcctttgtagatacaatggctgggaatgttaactttttaacaaagttatagagacagaagaaataagaatgtagactggttgaaaacagtttatatagtaactatgtttgctataaactctcaagcagttagataagcgtggaagctgaaaatatatgaaaggcaaaaaaatagttgagcagaaaaaaatgatgagaaagcattagatgagaacagcagccaagaacacctagcttaaaaagcagtaatattaaaatattcaaaatcatacacaccagaatattcccct

SEQ ID NO: 137360 - DNA, 601 bp, Human
gaagaaagctattaatttgcttttcctaagaaactgaagaaatgaaataacacactagggaatatcactcaaaaaacaaaaaatcaaagcaaaacaaaacaaaacaaaaaaaacccaccagtcactcatcttcaaggaattgtgagctaataatgttggaaaatcacatacaatggaagaagtaataatcataacccaagtaaacaggaaagaaatctttctaaagaaaactacatacgacaaaggagttaacatgtccctttattttaaaaaaggtaattttccaaatgatttaaaaatyacttaaaacaaaaacagccaacctaggaatgctacatattctgtgtacctggactcatattttgtctatattctaattttctcaaagatcagggtacttacaccagaaagaattaaatatcagaaatagattaatcatctacctatgtattatctacaaactgaaaccaaacaaaacaaaataaaagtcccaaaaaagtttccaaattctaactccaaaatgatcttcggcaagatatttgctttaaacactaatgttaaatttttattcctttgtagatacaatggctgggaatgttaa

SEQ ID NO: 137361 - DNA, 601 bp, Human
tacttggtttccaacagttgtgtattttctaatataagattctcaacttcccgacccattcctatcaaacgaaaaaagataaagactttgaaaataaatgcatcaataattatatacatttaaaatataagctatagtcacaagttttattttagaaattttatctgtcctttattaattttattttgtctataatttcatttgatggacctactttaatagattataaaattataaataattattcattacgaacaaggctaaagattttgttggcctatttcttttttaaatctgaatyggcttgctagggaatgaggccaatttttaatatctgttagtctatatttctcatagataatatttcaaaaggatcaagacttttctgccaaatattctaatattccaacactacatagggtaaaaaagaacagctttaatatggatcgaaattgtttctaaatcacatctgacctcgtaggcttttgcctaaaaattagaccttattaatagagaacaggcaaaaacaaggctaaagaaagatagaaccccaaggcagatgaaaccttaccaaagaaattatggtcttaaagcccatgca

SEQ ID NO: 137362 - DNA, 601 bp, Human
gtagtgagctgagatcgcagaactgcactccagcctcggtgacagactgagactctgtctcaaaaaaaaagactaggggtatgctaaggatattagcaagaagctcatatttattcttctgtacttatgttcacaacaatatgaactaattgactagtactaaagttctagacttcatctttttaatactgttaaataatttttattattaagctttcatatttctaaatcaaaatttgaaacgaaacaacaataacaacaaccaaaaaccccaaaatgtcccagttggtcctcaaacttraacatgcaactacaggtaagagcacagaggcacagagggaaaatgagcacactgcatggagctagaaagctcagcatctggataccatgcagaagcatgagctatcctattcatgaccataaacatgtctcctgacttttaaaaatctttatagtattatatccaaagcttacgtaggaagatcttcccgaaacaccaaaacatggtaaggtaagaaaaaaagtccaaaattgtaaacctacatcatcgtcatcttttgctttttgccttgcatcttcagcttctgcccgagctctagtg

SEQ ID NO: 137363 - DNA, 601 bp, Human
attgttatctacatagatttaatacactattgtaagtttcacctaaaaatgttgctctaccattattttaattcatgctctgtaacaatcgtcactcagaaaatagttataagttagttccatttatctcaaattaccaaaccacatactcacccaagaccagcattaagggtaaacttattacctagttaccaaggtactcaactataagagtcgctaaaataccaacataaatgcaaacagatggagacaactgtattagccagaattactcttagacagagtatgtgaatatagagtragcacaggggtaagacctcaagggaacatggctcaagtcaacgtcctataggctttcattatccacattttggatcaaagctgaaaggtttgggacataagaaagacactaagcttagcccttagcagtcctcctcctttgttgttctgttatagaaactgggcctctcctttcaataaagttaaacaacaaatgataaagatcttaagtttataacacagcaagcccactagtaggtatgtactctggaaaggctactgctcctgcccacctggagacttctactgtaatgtttgtaac

SEQ ID NO: 137364 - DNA, 601 bp, Human
gcttcttttcttgacggacggagtaacatgagacgtgggtgcattgtacttcagattaacaggtggttcaggcttcttagtcgtgttacttgaggagctgaaaagtcggctgaaactaaaagaagacagtatgtctgtgtgtcacatgtactatgagaaacaatccttgattttccacaaactttaatgttgaagaaaatttcagagtacttttacaaggcaatgagttagaaattggcaaaaacagtttttgtagtcatacgctgtagccttagcagtaactcgtagccaaactcagacwttcagtgaagagaaactattgcttagaatggcgggtgcctgttctttaactagcaatttgtataatgaaagcaagaagctcttaaatagaggaaacttctcctactgaataaatatattttggtttttttgctagctcctacttggtgcaaggtaagagcgattgttaaaccgcaaggttatggctgtgtgatgtgaatggaagcttagtatgccagttctaaaaacagcttattataatcaagtactggaacacatattaccatgttaacacacattttatacattttctgattaagct

SEQ ID NO: 137365 - DNA, 601 bp, Human
gaaaggttaatttgcccaagtgtttgtacctaatgagtagtaaagtcaggatggaaaaccaagtcctctgacaccaacagaaatgttcaaacatttaggataaaggctcatttacctctaaaggccattcacatttctattaataggtatttatcaatgttgtcataccagcaaaaatgaggcatttaaaaaaaaatccttctcttttataaaaactgaaaagcaattttcataaaaacttttgactacaagtaatttacttaaagacagccaagttacagaaatgatttttttttttttktttttttttttttttaaagatggaatctcactctgtcacccaggctagagcaatggcatgatctcggctcactgcaaccccgcctcctgggttcaagcgattcttctgcctcagcctcccaagtagctgtgattacagccacacaccaccacgcccagctaatttttgtatttttagtagagatggggtttcaccatattggccagactggtctcgaactcctgaccttgtgatccgcccacctcggcctcccaaagtgctgggattacaggtgtgagccaccgtgcctggcccagaaat

SEQ ID NO: 137366 - DNA, 601 bp, Human
ctgaaaggttaatttgcccaagtgtttgtacctaatgagtagtaaagtcaggatggaaaaccaagtcctctgacaccaacagaaatgttcaaacatttaggataaaggctcatttacctctaaaggccattcacatttctattaataggtatttatcaatgttgtcataccagcaaaaatgaggcatttaaaaaaaaatccttctcttttataaaaactgaaaagcaattttcataaaaacttttgactacaagtaatttacttaaagacagccaagttacagaaatgatttttttttttytttttttttttttttttaaagatggaatctcactctgtcacccaggctagagcaatggcatgatctcggctcactgcaaccccgcctcctgggttcaagcgattcttctgcctcagcctcccaagtagctgtgattacagccacacaccaccacgcccagctaatttttgtatttttagtagagatggggtttcaccatattggccagactggtctcgaactcctgaccttgtgatccgcccacctcggcctcccaaagtgctgggattacaggtgtgagccaccgtgcctggcccagaa

SEQ ID NO: 137367 - DNA, 601 bp, Human
tctgaaaggttaatttgcccaagtgtttgtacctaatgagtagtaaagtcaggatggaaaaccaagtcctctgacaccaacagaaatgttcaaacatttaggataaaggctcatttacctctaaaggccattcacatttctattaataggtatttatcaatgttgtcataccagcaaaaatgaggcatttaaaaaaaaatccttctcttttataaaaactgaaaagcaattttcataaaaacttttgactacaagtaatttacttaaagacagccaagttacagaaatgattttttttttkttttttttttttttttttaaagatggaatctcactctgtcacccaggctagagcaatggcatgatctcggctcactgcaaccccgcctcctgggttcaagcgattcttctgcctcagcctcccaagtagctgtgattacagccacacaccaccacgcccagctaatttttgtatttttagtagagatggggtttcaccatattggccagactggtctcgaactcctgaccttgtgatccgcccacctcggcctcccaaagtgctgggattacaggtgtgagccaccgtgcctggcccaga

SEQ ID NO: 137368 - DNA, 601 bp, Human
tcctaatgccagaaaacgtgctagaagtgatttaaaacttgagtaaatcaatatctgcttaggaagattgatataggttagattttagatcccattaacttgtttcagaaaataaaaatgcaaactgatttggtaaactttggagttataaggtaaaatattattaaaatgattttgaaaataatttgccattattttggccatttaaattttcataagatgagttgctatgtatatataccacagttaacatatctacctatatgtcagatactttacagataactgtataattgggtcyaatcacctttgagataggttatcagattaattttacagacagagaaactgggggctctgaaaggttaatttgcccaagtgtttgtacctaatgagtagtaaagtcaggatggaaaaccaagtcctctgacaccaacagaaatgttcaaacatttaggataaaggctcatttacctctaaaggccattcacatttctattaataggtatttatcaatgttgtcataccagcaaaaatgaggcatttaaaaaaaaatccttctcttttataaaaactgaaaagcaattttcataaaaacttt

SEQ ID NO: 137369 - DNA, 601 bp, Human
tgcatattacctgtttgtacttctgaggcagactccagccaaaagcctgcactctaccgtcttccttctgaacatgtgcttttacctgacgatactgctctctcttttgttctctgcgtgaggctaaactagcttcagttctaaaaggaaaaaagattttcctaattacatgaatacgtttaattacgtttatccccagttttatctctcctctgtcactaaaacagcaaaaacaacaaaaatttacatgatttcaaattagtttatttcaactataacagctccttaaaaagtgttatawtaggccgggcacggtggctcatgcctgtaatcccaacactttgggaggccgaggagggcagatagcctgaggtcaggagttcgagagcagcctggccaacatggtaaaaccccgtctctgctaaaaatacaaaaattagccaggcacggtagtgcggacctataatcccagctacttgggaggctgaggcaggagaatcatttgaacccggtggaggttgcagtgagccaagatggtgccactgcactccagcctgggggacaagagcaaaactccatctcaaaaaacaaacaaacaaag

SEQ ID NO: 137370 - DNA, 601 bp, Human
agctcaaaaagaggctctaattcacacatatgtgcacacgtgcacatgcatatgtgtttgtacatgaacatgtgagtcttttggggtaggaattatggagtagacagataaaattcctgaagacctgaacttaattttaaatgaacagtttgaaaagttccatgccaataattttttcaacaatgatgctggttttttaaaaaatgaaatcttcaaatattaaaccagaattgctctggttacagcagagcgggtacctcaaactccatgcacttagccaccctttattgactcctccccycctcacagactcagagcatttcatttgagttctacagctctagaaaacagcctgaaaaccaccaccctccatgcttaaatgtgtgcccagtccatgcggctgagatgagcagggctgggatgcgtacagtgaatccttcatgcccacgcacactcaacttgccctcttctttcctgctggatgctcttaccacatgtgcatattacctgtttgtacttctgaggcagactccagccaaaagcctgcactctaccgtcttccttctgaacatgtgcttttacctgacgatactgctctctc

SEQ ID NO: 137371 - DNA, 601 bp, Human
gccgagacggtgccactgcactccagtgtgagtgacagagtaagactccatctcaaaaaaaaaaaaaaaaaaagactagcctgaccaacatggtaaaaccccgtctctagtaaaaatgcaaacaattagccgggcgtggtggcaggtgcctgtaattccagctactcgggaggctgaggcaggagaatcacttgaacctggaaggtggaggttgcagtgagccgagatcatgccattgcactccagcctgggtgacagagtaagactctgtctcaaaaaaaaaaaaaaaaaaaaagtagawctcatattaagtattccacaataaaatataaaaaagaacttcattcctttttatggctgaataatattccaacatatggatatatcacatacacttctttaatttttaaactaatgttttaacatcacataatgtttaatccaaaactttagaagacctttccttattaattaatccaaacagtcctctggctcccagttattttctcatattcccattgttttattttcttcacagtatttttcactacctgaaaatatcttctttattcaatggtttccagtttgttttttaatcttc

SEQ ID NO: 137372 - DNA, 601 bp, Human
acttcgggaggacgaagcgggtggatcacctgaggtcaggagttcaagactaatctgactgcccggggtggtgggtcacacctgtaatctcagcactttgggagaccgaggcgggcagatcacgaggtctaggagttcgagaccaacctggccaatatggtgacaccccatttctaccaaaaatacaaaaattagccgggtgtagtggctcgtgcctgtagtcccagctacttgggaggctaaggcaaaagaatcacttgaacccaggaggtagaggttgcagtaagccgagacggtgccmctgcactccagtgtgagtgacagagtaagactccatctcaaaaaaaaaaaaaaaaaaagactagcctgaccaacatggtaaaaccccgtctctagtaaaaatgcaaacaattagccgggcgtggtggcaggtgcctgtaattccagctactcgggaggctgaggcaggagaatcacttgaacctggaaggtggaggttgcagtgagccgagatcatgccattgcactccagcctgggtgacagagtaagactctgtctcaaaaaaaaaaaaaaaaaaaaagtagaactcatattaagtat

SEQ ID NO: 137373 - DNA, 601 bp, Human
aaattaagaaaatacttctattaacacaagtgcaaataaacataaaaatgtcagaaaataaacttttttttttttttttttgagacagagtcttactctgtcgcccaggctggagtacagtggcatgattcagctcactgcaacctccgcctccttggcttaagtgattctcctgcctcagcctcctgagtagctgggactaccggtgtgagccaccacgcctggctaatttttgtatttttggtagagacagggtttcggtatgttggtcaggctggtcttgaactcctggcctcaaggratccaccaacctcagacaagtcctaggattacaggtgcgagccaccacgcctagccagcttctgttcttagtgagctcctcagcagccacaggttaaaaacaatctattatatctgacaacatcagccaaaaaaaaattcttttaaatcatcaagactactgctactacttgaagtataagcttctatccattactgttaaaaattaaatgccccaagtatataggttgattaagatattagtaaaacattaaaaactaagcatttataatataaaaatatttacaatataaaaataaat

SEQ ID NO: 137374 - DNA, 601 bp, Human
actgcaagctccacctcccaggttcacgccattctcctgcctcagcctcccgagtagctgggactacaggcacccgccaccacgcccggttaattttttgtactttttagtacagacagggtttcactgtgttagccaggatggtcttgatctcctgacctcgtgatccacccgccttggcctcccagagtgctgggattacaggcgtgagccaccacgcccggcctacagtatcttctttcaagttctttcaaccttgttacttaagatctaaattaagtccataatgaggcatctgagygtagccttagactctatacagatggcaggtaaagagaatggatatacctggtggtttatccatcactggagaagcaccatttgtactaggggaagtggcagctcccgtcacaccttctgcagaacaaccaaccactgtgatgcctcctaacaggctgtctgtctctgctgagctgttgcttgtcatacttccacataaagatgctttgtctacctgaccagattctgaaagatcttctcctgcagggtagtctgtttctcgtgcacctgaaaaataaatcttcttgtaacagcaaagtaa

SEQ ID NO: 137375 - DNA, 601 bp, Human
actattttctgcttccatttctacaaagtaaataaaacactattccaagtctgggcttttctcctccaattatttccccacacaaacccctgttatagaattccattccatctacccactccttcacactgtaccatgaaattaagaattcttcattccatttaacagtcattacagcattttttttttttttgagacagagtcttgctctgttgcccaggctggagtgcggcggcgtgatcttggctcactgcaagctccacctcccaggttcacgccattctcctgcctcagcctcccragtagctgggactacaggcacccgccaccacgcccggttaattttttgtactttttagtacagacagggtttcactgtgttagccaggatggtcttgatctcctgacctcgtgatccacccgccttggcctcccagagtgctgggattacaggcgtgagccaccacgcccggcctacagtatcttctttcaagttctttcaaccttgttacttaagatctaaattaagtccataatgaggcatctgagtgtagccttagactctatacagatggcaggtaaagagaatggatatacctgg

SEQ ID NO: 137376 - DNA, 601 bp, Human
acagggaacctggggacgggggatggtgccagctgtggccctggctcctggggcctccaggaagggaagaaggaaccagggcagagcccacagccaggagctcaccttctccaggttggtgttgtccagccagagggtctccaggtatctgccaaaggactggaaggcattgtccgggatgcttttcagggggttgtgggacagcttcagctcctccaccacccgtagcttgctcagggcagctgaggggtagctggacagctggttcctgtccacgtggaatttggcgaggttctccacrtcgtccagggccccgggctgcagggagctcaacgcgttttccgacaggtagagccagcgcaggtccttggctccctggaaggcgcctgcgcgcagctcacggatcttgttgttgttgagctgcaagatgaagaggttgaccagcggggagagcaacccccggggcagctcagtgaccttgttgtggtccaggtagaggtaggtcagctcggtcaggtcgtcgaaggcacctgcgcgcagcacgcggatgtcgttatgggacaggtacaagtagataagttgcttgaggccgcggaaggca

SEQ ID NO: 137377 - DNA, 601 bp, Human
aacagggtctctttgtgggcctgatctgcccagctcctctggaaggctcctcaataaacaaaccttcctttatggggtggtaggtttactggagacgggaaaaacagcagaggaggggtggaaggcccaacaggaagaggtggctgctgctcacagttgggggtttggaagcactggagatggccctagggggccttttgtggggccagggcagtcccactccttttatatgtaagaatcctaggagggcagtggtcgagactggcagcagacagggattagggtagggatgtgacaaggygaggaagggaggtggcagagctgctcaccttggagatagccagagggacagggaacctggggacgggggatggtgccagctgtggccctggctcctggggcctccaggaagggaagaaggaaccagggcagagcccacagccaggagctcaccttctccaggttggtgttgtccagccagagggtctccaggtatctgccaaaggactggaaggcattgtccgggatgcttttcagggggttgtgggacagcttcagctcctccaccacccgtagcttgctcagggcagctgaggggtag

SEQ ID NO: 137378 - DNA, 601 bp, Human
cctgaacctgagccatagcactttgaggagtttcccagttttcaaagcagtatgaccaagtgatctcagataatccaatctacacaaccccctttgagacagatggtgttattttcttttttttttttttttcctttttttttttttgagatggagtctcactgtgttgcccaggctggagcacagtggcacgatctcagctcactgcaagctccgcctcccgggttcacgccattctccggcctcagcctcctgagtagctgggactacaagtgcccgccaccatgcccggctaattttyttgtatttttttagtagagacgcagtttcaccatgttagccaggatggtctcgatctcctgacctcgtgatctacccgcctcagcctcccaaagtgctgggattacaggcgtgagccaccacgcccagccaggtggtgttattttcaatatgcaaatggggaaacggaaaaagcgcagtcctttgccctgggtcacagcagtgggtaaacagtagccacaggaccacacccagctcctcttcccctggcaccacaatccctgcacaaacactgggactgtggggctgccagagtttggcc

SEQ ID NO: 137379 - DNA, 601 bp, Human
tggagggtagctggttcaagcggttgttctccaaatggacgtgtttcagcgtggttacacccaggaaggcaccatctgagaactggggagcaaggtgggagcaaggtgggagcaaggtggtcatgagtgaatgagtaagcacccgagtgccagaggggcaggatccttccctgaacctgagccatagcactttgaggagtttcccagttttcaaagcagtatgaccaagtgatctcagataatccaatctacacaaccccctttgagacagatggtgttattttcttttttttttttttttcctttttttttttttgagatggagtctcactgtgttgcccaggctggagcacagtggcacgatctcagctcactgcaagctccgcctcccgggttcacgccattctccggcctcagcctcctgagtagctgggactacaagtgcccgccaccatgcccggctaatttttttgtatttttttagtagagacgcagtttcaccatgttagccaggatggtctcgatctcctgacctcgtgatctacccgcctcagcctcccaaagtgctgggattacaggcgtgagccaccacgcccagcca

SEQ ID NO: 137380 - DNA, 601 bp, Human
ggtacacttccaggggttattggtaagggcgagggtctccaggctgtcgaaggggaagttggagggtagctggttcaagcggttgttctccaaatggacgtgtttcagcgtggttacacccaggaaggcaccatctgagaactggggagcaaggtgggagcaaggtgggagcaaggtggtcatgagtgaatgagtaagcacccgagtgccagaggggcaggatccttccctgaacctgagccatagcactttgaggagtttcccagttttcaaagcagtatgaccaagtgatctcagatamtccaatctacacaaccccctttgagacagatggtgttattttcttttttttttttttttcctttttttttttttgagatggagtctcactgtgttgcccaggctggagcacagtggcacgatctcagctcactgcaagctccgcctcccgggttcacgccattctccggcctcagcctcctgagtagctgggactacaagtgcccgccaccatgcccggctaatttttttgtatttttttagtagagacgcagtttcaccatgttagccaggatggtctcgatctcctgacctcgtgatc

SEQ ID NO: 137381 - DNA, 601 bp, Human
tgggaggccgaggtgggtgcatcatctgaggtgaggagttcgagaccagcctgaacaacatggggaaacctggtctctactaaaaatacaaaattaactgggcgtggtggcacatgcctgtaatcacagctactcaggaaggctgaggcaggagaatcgcttgaacccgggaggcagaggttgcagtgagccaagctcacgccattgcactccaccctgagcaacaagagcgaacaaacaaacaaaaacagttatgtagatttgatccagtactagtgatgtgaccatttccaacttagcraaacagaaattgtgattaaatctggaacatcgtatgcatttagtattttatcttctaatcaatttaaaacacaagtaaatttctgtcttcttttctacagaacaaatcttttccatcttgctcattaagtggcctcaatgattacttttcttaatagaatgttttattttgcctttacagcctcagaaaaagtactcctggcatactttcttggcctaattttaggttgcacttcatgccaagaaacagaaaaaaattaaatttctttaaatacaccagagatgagcaacacaacaaatt

SEQ ID NO: 137382 - DNA, 601 bp, Human
aaaaattttttttttgccaggcgcggtggctaacgcctataatccctgcactttgggaggccaaggcgggtggatcacgaggtcaggagattgagaccatcctggcaaacacagtgaaaccccatctttaccaaaaataccaaaaaactagccaggcatggtggcatgcatctgtagtcccagctacttgggaggctgaggcaggagaattgtttgaacccaggaggcagaggttgcagtgagccgagatcgcgccattacactccagcctggtgacagagtgagactccatctcaaaaawaaaaataataattaatcagctgggcacactattgcacacctgtactcccagctacttttgaggctgaggcagaaggatcaattgagcccaggagtttgaggttgcagcaagctacaactgcaccactgcactccaccctgggcagcagactgagaccctacctcaaagaaaaaaaaaaaaagaagaagaagaaacaagtatttgtcataaagcagtaaacagtttgagtcaataaacctttactgattatcacatacagggcagtgttctaaaattgtggaaaacacaaataaggaatgg

SEQ ID NO: 137383 - DNA, 601 bp, Human
tgaactctgcccctcgtaactgctcctttatgaaatcatctctgactctaaagttacatactgcttcttctgtttgccaacaccctggtcagcctctattacagtctttgtttacctccttacctcccttactatattgaaagcccctcaaaggcagacacaagtatccaattctgcccctggcacccacagggaacagtactcaacacaaggaaccatgtaaataagtgtttgttggctgggcacagtggctcacacctataatctcagcattttgggaggccaaggcaggagaatcacytgaagcatttgggaccagcctggacagcatagcaagacgctatcccttaaaaaaattttttttttgccaggcgcggtggctaacgcctataatccctgcactttgggaggccaaggcgggtggatcacgaggtcaggagattgagaccatcctggcaaacacagtgaaaccccatctttaccaaaaataccaaaaaactagccaggcatggtggcatgcatctgtagtcccagctacttgggaggctgaggcaggagaattgtttgaacccaggaggcagaggttgcagtgagccgagat

SEQ ID NO: 137384 - DNA, 601 bp, Human
ctacttttatttttagttagctacattttaaacagtatcacgaatcacagtatgatttttccctaaaatataaaaacatttcatagtgttcatgcaccacctaaaaaataacaatctaagtttaacagcctactcttctatgatttggcatctttctttccagtaccacctccagccataccaaaccacttcaagttccccgaaccagccatgttcttgcaaattacattatactattgcacatggtgtttattctgtttgcatgttctttccttctcattttgtctacctgaactctgcycctcgtaactgctcctttatgaaatcatctctgactctaaagttacatactgcttcttctgtttgccaacaccctggtcagcctctattacagtctttgtttacctccttacctcccttactatattgaaagcccctcaaaggcagacacaagtatccaattctgcccctggcacccacagggaacagtactcaacacaaggaaccatgtaaataagtgtttgttggctgggcacagtggctcacacctataatctcagcattttgggaggccaaggcaggagaatcacctgaagcattt

SEQ ID NO: 137385 - DNA, 601 bp, Human
tatccacgtgccatggtggtttcctgcacccatcaacccatcatctacaatcggtatttctcctaatgatatccctccctttaccccggaccccctgacaggccccagcatgtgatgttcccctcccctctgcccatatgttctcattgttcaactcccgcttacgagtgagaacatgcggtgtttcgttttctgttcctgtgttagtttgctgagaatgatggtttccagcttcatccatgtccctgcaaagtattccatggtgtatatgtgccacattttctttaaccagtctatcatygatgggcatttgagctagttccaagtctttgctattgtgaatagtgctgcagtaaacatgcaagtgcatgcatctttatagtagaatgatttataatcctttgggtatatacccagtaatgggattgctgggccaaatggcatttctagttctagatccttgaggaatcgctacactgtcttccacaacagttgaactaatttgcactcccaccaacagtgtaaaagtgttcctatttctccaaatcgtctccagcacctgttgtttcctaactttttaatgattgccattctaactggc

SEQ ID NO: 137386 - DNA, 601 bp, Human
cgtgcccaaatattttttctttctttttttgtgttctgttttctatttatttattttttattatacttaagttctgggacacatgtgcagaacgtgcaggtttgttacttaggtatccacgtgccatggtggtttcctgcacccatcaacccatcatctacaatcggtatttctcctaatgatatccctccctttaccccggaccccctgacaggccccagcatgtgatgttcccctcccctctgcccatatgttctcattgttcaactcccgcttacgagtgagaacatgcggtgtttcrttttctgttcctgtgttagtttgctgagaatgatggtttccagcttcatccatgtccctgcaaagtattccatggtgtatatgtgccacattttctttaaccagtctatcatcgatgggcatttgagctagttccaagtctttgctattgtgaatagtgctgcagtaaacatgcaagtgcatgcatctttatagtagaatgatttataatcctttgggtatatacccagtaatgggattgctgggccaaatggcatttctagttctagatccttgaggaatcgctacactgtcttccaca

SEQ ID NO: 137387 - DNA, 601 bp, Human
ttttttttttttggaaacaaagtcttgctttgtcgttcaggctggagtgcaatggcgtgatattggctcactgcaacctccacctcccagattcaagcgattctcctgcctcagcctcccaagtatctgggattacaggcacctgccaccacacccagctaatttttatatttttagtagagatggggtttcaccacgttggccaggctggtctcgagctcctgacctcaggtgatccacccgcctcagcctcccaaagtgctaggattacaagtgtgagcatcacacccagcccgaatayaattttttaaaacaactattgcaacataattcacctacataaaatgcatccctttgaagggtaagagtcaatggttttcattatattcacagtggtggcaaccatcaccataatcaattttaggacactttcatcaccccaaaaagaaaccatatacacattagcagtcactcccctcatccccataccaacaccccacagccctatgtattacctcataaataataataatcacaaccttgaccacaaccactcaatccagttagtccttgtggatagacggctgtctttccagtcaat

SEQ ID NO: 137388 - DNA, 601 bp, Human
tatagttttgcctttcccaaaatgtcatatagttggaatcatatatatgtagccttttcaggttggtttctttcatttagtaatatgtatttaaggttcttccatgtctttttatggcttgatagctcatttcttcttagcactgcataatatttcattgtctgggtgtattacagtttgtttatccatccacctagtgaaggacatcttggttccttccaagttttggcaattatgaataaagtggctataaaaatctatgtacaggtttttgtatggacataagtttacaactcatttsggtaaatatcaaggagcaggactgctggattatatgaagagtttgtttagttttataagaaactgccaaaccgtcttccaaagtggctgtaccattttgcattcccaccagcaatgaatgagagttcctgttgctccacatcttcatcagcatttggtactgttggtgttctggattttggccattctaataggtatatagtggttatctcatggttgtttcactttgcatttccctaatgacacggaaggtagagcatcttttcatacgcttatttgtcatcactgtatcttctttgat

SEQ ID NO: 137389 - DNA, 601 bp, Human
aaaaaattagccgggcgtggtggcgggcgcctgtagtctcagctacttgaaaggctgaggcaggagaatggcgtgaacccgggaggccgaacttgcagtgagcagagatggcgccactgcactccagcctggggtgacagcaagactctgtctcaaaacaaacaaaaaaaatcttaaagtacagagttcccctgctgggcacagtggctcgcgcctgtaatcccaccacttagggaggcaaagacaggaggatcgcttgagcccaggagttcaagaccgccctcagcaatatagagagacytcgttctccatataaagggaaaaaaagaaaaagaaaaaaagaaaaaagtgcagagttcccatataccccctgcccctccccacagcctccccgcatcaacatctcacacttgagtggtacgtttgttacagatgatgagcatacactgacatatcattatcatccaaaggccatagtttgtttaaattagggtcactcctactgcacattctataagttttgacaattgtataatgacatgtacctaccattatagtatcatacagaatagtttcacctattcaaattcacctccctcca

SEQ ID NO: 137390 - DNA, 601 bp, Human
gaccatcctggctaacacaatgaaaccccatctctactaaaaatacaaaaaattagccgggcgtggtggcgggcgcctgtagtctcagctacttgaaaggctgaggcaggagaatggcgtgaacccgggaggccgaacttgcagtgagcagagatggcgccactgcactccagcctggggtgacagcaagactctgtctcaaaacaaacaaaaaaaatcttaaagtacagagttcccctgctgggcacagtggctcgcgcctgtaatcccaccacttagggaggcaaagacaggaggatcscttgagcccaggagttcaagaccgccctcagcaatatagagagacctcgttctccatataaagggaaaaaaagaaaaagaaaaaaagaaaaaagtgcagagttcccatataccccctgcccctccccacagcctccccgcatcaacatctcacacttgagtggtacgtttgttacagatgatgagcatacactgacatatcattatcatccaaaggccatagtttgtttaaattagggtcactcctactgcacattctataagttttgacaattgtataatgacatgtacctaccattat

SEQ ID NO: 137391 - DNA, 601 bp, Human
cagagaattcccggccgggcgcggtggctcacgcctgtaatcccagcactttggggggtcgaggcaggcggatcacgaggtcaggagagtgagaccatcctggctaacacaatgaaaccccatctctactaaaaatacaaaaaattagccgggcgtggtggcgggcgcctgtagtctcagctacttgaaaggctgaggcaggagaatggcgtgaacccgggaggccgaacttgcagtgagcagagatggcgccactgcactccagcctggggtgacagcaagactctgtctcaaaacaaaaaaaaaaaatcttaaagtacagagttcccctgctgggcacagtggctcgcgcctgtaatcccaccacttagggaggcaaagacaggaggatcgcttgagcccaggagttcaagaccgccctcagcaatatagagagacctcgttctccatataaagggaaaaaaagaaaaagaaaaaaagaaaaaagtgcagagttcccatataccccctgcccctccccacagcctccccgcatcaacatctcacacttgagtggtacgtttgttacagatgatgagcatacactgacatatcattatca

SEQ ID NO: 137392 - DNA, 601 bp, Human
aagagaaagtaaagaatcaaggatgacgcgggatttctggcttaaacaattagaaggctggaaataatcattactgagacagttacaactccagggaaagtagatttttttattgtgtttttttacccctgtaaatagactattttttagagcagttttagcttcacagcaaaattgagcagaaaagtacagagaattcccggccgggcgcggtggctcacgcctgtaatcccagcactttggggggtcgaggcaggcggatcacgaggtcaggagagtgagaccatcctggctaacacartgaaaccccatctctactaaaaatacaaaaaattagccgggcgtggtggcgggcgcctgtagtctcagctacttgaaaggctgaggcaggagaatggcgtgaacccgggaggccgaacttgcagtgagcagagatggcgccactgcactccagcctggggtgacagcaagactctgtctcaaaacaaacaaaaaaaatcttaaagtacagagttcccctgctgggcacagtggctcgcgcctgtaatcccaccacttagggaggcaaagacaggaggatcgcttgagcccaggagttcaa

SEQ ID NO: 137393 - DNA, 601 bp, Human
aatgaggggaaatagagttgttaatttcctaaacattatacaaaaaatcagaaaacttcaaaataaaatgatttgccttcattcctagggtaagttcctgatcttaaaatagcacctcaaaggcaagatcttctttttggcctggaatccttctggccttgagtccctgggtagctagctcctgtttgtgttgaattttccacacctatatgcttcaacaaatcaatccatggtcctgccatatagtacatccatcactcattaaaaaaaataacaaaaacaggccagccgtggtggctcrcacctataattccagcactttaggaggctcaggcaggtggatcatttgaggtcaggagttcgagaccagcctagccaacatagcaaaaccctgtctatactaaaaaatacaaaaataagctggtcagtagaggcacgtacctgtaatctcagctacttgggaggttgagacaggagaatcgcttgagccttggaggcagaggttgcagtgtgccgagatcgcgccactgcactccagtctgggcgacagagtgagaacctatctaaaaaaaagaaaaacaggccaggtgtgtggctcaca

SEQ ID NO: 137394 - DNA, 601 bp, Human
agccattctttttgttaaaggaactctaaatgtttgcacttcaaaaatatttgtccactgaaagtaatcaaaccaaaaaatgtcatagaaagcatatgattctcacaccaacgttctggaaaaggaagtatacatccctgctatatacagggaactggaggtctcaggtggaaccttccttcctacctgagaccagtttgtactattgccaaaggcttattggattttacgataggtctgccaagaaaggagaaattaaactaacaagcataatgaaatcacttaaacattaattaaggamtctaaatgctataatctcattaatatatgagaaacactttaacagttacagctacaacaatagctacacagtagcaagaacagaactcaatgggagtgggaggggggaaaaaagggctcccaaaagacaatgaggggaaatagagttgttaatttcctaaacattatacaaaaaatcagaaaacttcaaaataaaatgatttgccttcattcctagggtaagttcctgatcttaaaatagcacctcaaaggcaagatcttctttttggcctggaatccttctggccttgagtccctgggt

SEQ ID NO: 137395 - DNA, 601 bp, Human
ggaggtgatgacatgcaagtgtcagatttttttataatctaaaaaatccagaaaacaccttgaaaaaccaaaagaaaatcagcctgtaagtaagtagccaaaacaagactttactcatggagcagcccctaatcagagtcaatttacacacatttctgctcatttacacagtcatatttaaagcagggaaattgcacaggtgacagtaagtcctgttggcatcctttaaagactacattgtttgcaatgtattattaagtcttatggccccaactacactgtatgcatatagcactctatragtaatctgttcagctttcatttcccagtgaaaaaattctacaaatatacatgagactaaacactgacaacagaatctaaatatgaggtatgcccctcctgttactgctttgaaattcttttttttttttttagacagagtcttgctctgttgcccaggctggagtgcagtggtgcggtctcggctcactgcaaccttcacctcccgggttcaagagattctcctgcctcagcctcctgagtagctgggattacaggcacgcaccaccatgcccagctaatttttttgtattttcagtag

SEQ ID NO: 137396 - DNA, 601 bp, Human
caggtggatcacctgaggtcaggagtttgagatgggggggggggggggtatcatttggttgcccaggctggtcttgaacccatggcttcaagcgatcctcccacctcagcctcccaaagtgctgggattataggcatgagccatcatgcccagccagacttttcaaataatggatattctaaaggattgagagttaagtgaaactggcattttattttactgtgcaggcatgttggtgaagaactcaatgataatcagtatattctagtgtcattcccttggttcatgctaaggcacgagyagttttaccctccattgcctctgtaccaccttagagacccaagggtccacaggccacacttaacgaatttgtgagctagctgaaatggcttcttaaacaactaatatatagccaagccaggatttaaaccaagttgtatctgacactgaaatctataactcctcactatattacacagcttcaatacttctcagcacaacatgcttgctaacatgtttattcatactcataacccaatcctgcaattccagaacaggccccagaggaagataagtcccaaaggatacattttacattgta

SEQ ID NO: 137397 - DNA, 601 bp, Human
cgggcatggtgactcacgcctgtaatcccagcactttgggaggccgagacaggagacaggaggatcacatgaggtcaggggttcaagaccagcctcagcaacatggaaaaaccccatctcaactaaaaatacaaaaagttagtcaggcgtggtggcacatgcctgtaatctcagctactcaggaggctgaggcaggagaatcgcttgaacctgggaggcagaggttgcagtgagccaggatcgtgccattgcactccagcctggataacaagagagaaactctgtctcaaaaaaaaaaaawtttttttttttagagatggggagtctcaggccggacgcagtggctcacgcctgtaatcccagcactctgggaggccaaggcaggtggatcacctgaggtcaggagtttgagatgggggggggggggggtatcatttggttgcccaggctggtcttgaacccatggcttcaagcgatcctcccacctcagcctcccaaagtgctgggattataggcatgagccatcatgcccagccagacttttcaaataatggatattctaaaggattgagagttaagtgaaactggcattttattttac

SEQ ID NO: 137398 - DNA, 601 bp, Human
aaactagtaatttgaaaaatgaaaatgacattgcattttatatcatcaaaaaaccatatttgttaatatcactgctcatttcatctcaggaaagtcttttaagtgtcggaaactgttagccccatagtggtggactcagattttccaaaattccaatttttcattagtaaattcaaattttgtcatcggcaacaaatactgtcaattgttctccttgaagtgactggcccacttccttcacttttgcaaatatagttgccaaatacccaagtctaaataatcacagtttgtcagtcattcycaagtaaaaatagtgttccataaaaaagcagttattttaactcatgactcaaagaatttcacaagtatttttctttttctttttttttttttttttagcagagtctcactctgtcacccaggctggagtgcaatggtgagatctcagcttactgcaacatccgcctcccaggttcaagtaattttccctgccttagtccctgagtagctgggattacaggcacccaccaccacacctggcaattttttatattttttagtaaagatggggttttgccatgttggccaggctgatcttgaa

SEQ ID NO: 137399 - DNA, 601 bp, Human
tggtttcaggattcatttgtgatcttaaaaaccagaggtcctgaaaatcttttatgtaagttttacaaatcaatatttaccatattagagattaaaactcagaagttttaaatatttaaatgaatttttaaaaattaataacataggccaggcacggtgactcacacctgtaatcccagctacttgggaggctgaggcagaagaatcgcttgaacccgggaggcagaggttgcagtgagctgagatcacaccattgcactgcagtctgggtgacaagagtgaaattccatctcaaaaaaamaaatcaataacatacccatcaaaaagtatcacaaacacattttaatgaaaaattaacttttccaaaacaaaaaaattgtttagtgagaggagaattcacattgttttacattttcacaaatctcttcaatgtctggctaaatagaacatggctagtcttagaacttgcctctgcactcagtctgttgggaatatactaagtaaagcagatgaagaaaatccagcttcacaaagatatgcagttacaaaaggaaggagtattttaataacattttcaggtaactgtgcatactctttaaat

SEQ ID NO: 137400 - DNA, 601 bp, Human
gtccgggcacagtggctcacacttgtaatcccagcattgtgggaggctgaggcaggtggatcatgaggtcaggagatcaagaccagactggccaacatggtgaaaccctgtctctactaaaaatacaaaaattagctgggcatcatggtgggcacctgtaatcaatccctgctactcgggaggctgaggcaggagaatcacctgaacctgagaggtggaggatgcagtaagccaagatcacgccactgcactctagcctgggtgacagagcaagactccgtctcaaaaaaaaaaaaaaaaagtgggccaagcacagaggctcacgcctgtaatcccagcactttgggaggccgaggcgggtggatcacctgaggtcaggagttcgagaccagcctggccaacatggcgaaacccagtctctactaaaaatacaaaaattagccaggcgtggcggcgggcacctgtagtcccagctacctcaggaggctgaggcaggagaatcacttgaacctgggagacggaggttacagtgagccaggatggtgccactgcattccagcctggatgacacagcaagactctgtctcaaaaaaaaaaaagt

SEQ ID NO: 137401 - DNA, 601 bp, Human
atttcatcatattttttgttttttgttttaagacagggtttggctctgttacccaggccggaatgcagtggtgcaatcataactcactgcagccacaaattcctgggctcaagtaaccctcctaccttgccctcctcagtagctaggaccacagttacacaccaccatgcccagcaaatttttatagagacagggtctcgcttttttgcccaagctggtctcaaactactggcttcaggcaatcctcccacctcagtctcccaaagtgctgggattacaagtgtgatccatgacacccaakgatatttcatcatatttctatttactgaaatttggtaactggcaaattgtgcatttgtcaaatttcagtccactagattattaccctagccctaatttccaaagaaagcattacagtttttctggaagaaaaacgattttggattaagggaattgactacaatacattggaccaattacaactaacaacttctaacacattcatcttttacacttgaaataaaattatcatttaaacttttaacacttaataggaatgttagtcaaagtgaagaaaactgaaagtgagatgttaactact

SEQ ID NO: 137402 - DNA, 601 bp, Human
gaatggactctcaaatttgtgcagaacattcaccttcagcagattctagattcccactccaaaatattttgattaataaatctgtggtgaggcccagcattctccttttttttttggttttttttttttttgagacggagtctccctatgtcgccaggctggagtgctgtggcatgatctcggctcaccacaaactctgactccttggttcaagcaattctcctgcctcagcctcccgagtaactgggattacatgcacacaccaccacgctcagctcatttttgtatttttagaagagamggggtttcaccatattggtcaggatggtctcgatctcctgatcttgtgatccgcctgcctcagcctcccaaagtgctgagattacaggtgtgagccaccccacccggccggcaatctacatttttaatgagaacccaggtgattccagctacactttgaggcacagatctagaaagatgcacaccaaaaagttaacagtggtcttctctcgagcataagattttcaattgtttgggaggagtgaaggagtgaggatgtggggaaaataatatacataaagcatgtgtatgacttgtgtag

SEQ ID NO: 137403 - DNA, 601 bp, Human
aaaaatgttggctttacctcatttgtgacctttgctccaaaaagccaacctgctcctcggggactgatagcccaggtatccacatcttcaggatctgaccaaaccagatcacaaaatgctcctttatgaggaatttcctgattccgttcgatggttcgaatttgatccagtgttttgatatcaggagataaaccaccatggacacacaaaatctgctcatctattaactagcaaaaaaggataacaaagagttgaacatataacctcaggcatatctaaactcatcagtgaatactaaagmtatcaatataattgagatgacaactagataaaaatatgcaatgtgttattggcaggaacgtacatgagactttaaaaatagaaacttacagctgctactgtgagcatgtcaaaaactttggtacagtatctccaggcattagcatttccatatttggtttggcactcatctgtgaaagaaacagaagggttttaattaatgaatctgctaataaaaataaacaatatatccaatactagagcagccttcagtacaacagaaattcagcttaaactaggatagcaagatatgacacatatt

SEQ ID NO: 137404 - DNA, 601 bp, Human
atcccagctactcgggaggctgagacaggagaatcgcttgaatccaggaggcagaggttgcagtgagccgagattgcaccattgtactccagcctgggcaacatgagcgaaactcttgtctcaaaaaaaaaaagattcatgttattgtctcttgtagaggaaactaataaagtgtctgtatctgtgtgatttgaggtctttgagaaaaaaaaaaaaaagtattgcctatcttggtcttgccattttgttacttaactacagtacttgaaaggaaaggggctggccgggtgcggtggctcayacctataatcccagcactttgggaggctgaggcgggtggatcacctgaggtcaggagttcaagaccagcctagccaacacggtgaaatcccatctctactaagaatacaaaaattagccaggcatggtggcgcacacctgtggtcccagctactcaggaggctgaggcaggagaatggcttgaacctgggaggcagaggttgttgcagtgagccaagatcacgccactgcactccagcctaggcgacagagcaagactccatctcaaaaacaaaaaaaaaaggaaagaacatttacttta

SEQ ID NO: 137405 - DNA, 601 bp, Human
tcttgggcccaaatgaacactgtaccgtagtcttctggaaagcaaatgtgcttcctgctatgtaatcgctaacattcacattacatgatttgctgtagcttgatcttccttagcctactaccactgtggcagtaggttttaggtggtatcatagtgccttttgattaatttaagtatttaattttcatcttctttctttggatctatttggcttttcaaatgaacagagatttctgttaaaaagaaaaaaaagatttgacgtaggctgggcgcggtggctcacgcctgtaatcccagcacyttgggagaccaaggtgggcagatgacctgaggtcaggagttcaagaccagcctcaccaacatggtgaaaccccgtctctactaaaaatacaaaattagccaggcgtggtggtgtacacctgtaatcccagctactcgggaggctgagacaggagaatcgcttgaatccaggaggcagaggttgcagtgagccgagattgcaccattgtactccagcctgggcaacatgagcgaaactcttgtctcaaaaaaaaaaagattcatgttattgtctcttgtagaggaaactaataaagtgtct

SEQ ID NO: 137406 - DNA, 601 bp, Human
agctatttctcacatcaacaacgcatgctttaaagcagtagtagtcaccaataacataccccaggaggacaagatgaagcaccattccaaaatacaggtgatcaacatctctatgagccttgcagaagccatcaggaaaattcacaatgaagaatccgtttcttacctattcagtcatgtccctttataatacagtaacttctgaggctttttaagaataaaatccaccccaccccttgttttcccttggtatttgatgacgaattcagcagaagacccagcttgctccagtgtagctttstatatcccacatcaggtatatctgagcttatccgaaatgaagaaagaaggattgagattaactgctgggacttcctatctgcattgtctcattctggcttccttgatgattctgtgagccttgcagctttaactatagctcagctgttacaagatttcagacttttgaggatgttgtgtgggggtgtttgactgtgactggagaagctcagactactctgcatgtgaatgcttcagggttttctttgttgagaacaaccagcagcaaagccaacccatgtgtgagcagttctccccaagg

SEQ ID NO: 137407 - DNA, 601 bp, Human
cagctatttctcacatcaacaacgcatgctttaaagcagtagtagtcaccaataacataccccaggaggacaagatgaagcaccattccaaaatacaggtgatcaacatctctatgagccttgcagaagccatcaggaaaattcacaatgaagaatccgtttcttacctattcagtcatgtccctttataatacagtaacttctgaggctttttaagaataaaatccaccccaccccttgttttcccttggtatttgatgacgaattcagcagaagacccagcttgctccagtgtagcttkctatatcccacatcaggtatatctgagcttatccgaaatgaagaaagaaggattgagattaactgctgggacttcctatctgcattgtctcattctggcttccttgatgattctgtgagccttgcagctttaactatagctcagctgttacaagatttcagacttttgaggatgttgtgtgggggtgtttgactgtgactggagaagctcagactactctgcatgtgaatgcttcagggttttctttgttgagaacaaccagcagcaaagccaacccatgtgtgagcagttctccccaag

SEQ ID NO: 137408 - DNA, 601 bp, Human
ctggtccagctatttctcacatcaacaacgcatgctttaaagcagtagtagtcaccaataacataccccaggaggacaagatgaagcaccattccaaaatacaggtgatcaacatctctatgagccttgcagaagccatcaggaaaattcacaatgaagaatccgtttcttacctattcagtcatgtccctttataatacagtaacttctgaggctttttaagaataaaatccaccccaccccttgttttcccttggtatttgatgacgaattcagcagaagacccagcttgctccagtgwagctttctatatcccacatcaggtatatctgagcttatccgaaatgaagaaagaaggattgagattaactgctgggacttcctatctgcattgtctcattctggcttccttgatgattctgtgagccttgcagctttaactatagctcagctgttacaagatttcagacttttgaggatgttgtgtgggggtgtttgactgtgactggagaagctcagactactctgcatgtgaatgcttcagggttttctttgttgagaacaaccagcagcaaagccaacccatgtgtgagcagttctc

SEQ ID NO: 137409 - DNA, 601 bp, Human
tctggtccagctatttctcacatcaacaacgcatgctttaaagcagtagtagtcaccaataacataccccaggaggacaagatgaagcaccattccaaaatacaggtgatcaacatctctatgagccttgcagaagccatcaggaaaattcacaatgaagaatccgtttcttacctattcagtcatgtccctttataatacagtaacttctgaggctttttaagaataaaatccaccccaccccttgttttcccttggtatttgatgacgaattcagcagaagacccagcttgctccagtstagctttctatatcccacatcaggtatatctgagcttatccgaaatgaagaaagaaggattgagattaactgctgggacttcctatctgcattgtctcattctggcttccttgatgattctgtgagccttgcagctttaactatagctcagctgttacaagatttcagacttttgaggatgttgtgtgggggtgtttgactgtgactggagaagctcagactactctgcatgtgaatgcttcagggttttctttgttgagaacaaccagcagcaaagccaacccatgtgtgagcagttct

SEQ ID NO: 137410 - DNA, 601 bp, Human
gggagatgtgaaggatctggtggccatccttgcggatgacatggttgacacttgtggcacaatctgccatgcagctgacaaacttctctcagctggagtcaccaaagtttatgctatcttgactcacagaatcttctctggtccagctatttctcacatcaacaacgcatgctttaaagcagtagtagtcaccaataacataccccaggaggacaagatgaagcaccattccaaaatacaggtgatcaacatctctatgagccttgcagaagccatcaggaaaattcacaatgaagaatcygtttcttacctattcagtcatgtccctttataatacagtaacttctgaggctttttaagaataaaatccaccccaccccttgttttcccttggtatttgatgacgaattcagcagaagacccagcttgctccagtgtagctttctatatcccacatcaggtatatctgagcttatccgaaatgaagaaagaaggattgagattaactgctgggacttcctatctgcattgtctcattctggcttccttgatgattctgtgagccttgcagctttaactatagctcagctgttacaagatt

SEQ ID NO: 137411 - DNA, 601 bp, Human
tgcagacaggctgaatgtggactttgccttgattcacaaagaaggccaatgaagtcgaccgcatggtgcttgtgggagatgtgaaggatctggtggccatccttgcggatgacatggttgacacttgtggcacaatctgccatgcagctgacaaacttctctcagctggagtcaccaaagtttatgctatcttgactcacagaatcttctctggtccagctatttctcacatcaacaacgcatgctttaaagcagtagtagtcaccaataacataccccaggaggacaagatgaagcaccrttccaaaatacaggtgatcaacatctctatgagccttgcagaagccatcaggaaaattcacaatgaagaatccgtttcttacctattcagtcatgtccctttataatacagtaacttctgaggctttttaagaataaaatccaccccaccccttgttttcccttggtatttgatgacgaattcagcagaagacccagcttgctccagtgtagctttctatatcccacatcaggtatatctgagcttatccgaaatgaagaaagaaggattgagattaactgctgggacttcctatctgca

SEQ ID NO: 137412 - DNA, 601 bp, Human
aataactttggttctcttgtatttacatctttgaagaccatgatcgaagcaatatttccacaacgatagcagtaattaggagcagaccatactgtcaccagcttctcatcaaacataaatttatagccttcgtgcactagttgatgtgctctgcagatgagttttaagttgttgatatgaacaaactgcaatttagaaaggcactgtaagtacttagcacttaaaaaacaatcggcctacataatcatttaaataaaataccaaatcctattactactaaaggcatcaagattatagaacrcactctataattatctccaacaatttaataagtttaggcaaacagcaattttggcctgagtcaagtgcacaactatggaaactgtacagctacataaacagttagaaatttctggaagaaaaagcattcaataggtactatgaaacaaaattttgtgttttctgatttaataataaagatattgctatcagtatctaccatttactgaaggtttagtatatgtagatgttgcaataattctgaaagagattattcttttgcaacttaaggaaacaaaagctcagactagataaataactt

SEQ ID NO: 137413 - DNA, 601 bp, Human
ttttcctttcagttctttagggtacaagggctttatctggatggtcctttcagagacatgctttggcgttacaagaaggactaggcagagctaagaagggataggatttctgaaatagatagtattgtaatttccattttatagaggagaaaatgagactcagagagggtaagtgatttgtccaatgtcgcacatctagttagtgtcagaatcagacgttgaaatcagtttctgaaaatgtcttcctttttcattgaattgtgctggtacccatgtagaactggaaaataattcaggtacrttctggttttctctgattttcccatgttggattgcatttgaaatgggaatagagcagatggaaaaacaactttttaacttttttttttttttaagacagaatctcactctgtcacgcaggctggagtgcagtggtgcaatctcggctcactgcgacctccgcttcccaggttcaagcaattctcctgggattacaggcgtctgccatcatgcccgtctaattttttttttttttttttttttgtatttttggtagagacggggtttcactatcttggccaggctggtcttgaactcctga

SEQ ID NO: 137414 - DNA, 601 bp, Human
cctttttcattgaattgtgctggtacccatgtagaactggaaaataattcaggtacgttctggttttctctgattttcccatgttggattgcatttgaaatgggaatagagcagatggaaaaacaactttttaacttttttttttttttaagacagaatctcactctgtcacgcaggctggagtgcagtggtgcaatctcggctcactgcgacctccgcttcccaggttcaagcaattctcctgggattacaggcgtctgccatcatgcccgtctaattttttttttttttttttttttgkatttttggtagagacggggtttcactatcttggccaggctggtcttgaactcctgacctcatgatccacctgccttggcctcccaaagggccgggattacaggtgtgagccaccgcgcctggccaaaaacaactattttacactttccagaaattatatttttcctcctaaaagtgaacatgggtactctgagtgacagaaagcttaatagtaaataggaagaacatatatgttaaggcaaaggcttcaacagaaaattgtgttgagtcttttagaaataaactacattagaatcttaga

SEQ ID NO: 137415 - DNA, 601 bp, Human
gtctactttgcagttttacttccacaatataaacttaaaggcaaaaacgaggttgaatcttgaatccacaatgaaaaaagccccaccacaaaataaagaaaacaccgaaaactttaattttctgtgtaaaccaaatatgtacagatattgaggagacagttttgccagccaaaaatatcattaaaaagttattgagaatccaaatattttaaatcctcaattattacttggtttggatttttaaggagaaaggaaaaaatgggaaagacaaagactcataataaaaattgattgaaaatgsttttaacagatgaaatcttccatgccttatgttaactgttattgcagtgtgtgttttaaacacataaacaaaaatgcatcctaggtagttttcaacagctggattaaaagaaaaaggcttctgccagtacttctaatcagaaaattcaaggcatacttttatttcccaaatattgcaattaaccacagtatatctgtatttatattatggacattaaccagaaagcttgtaactgacagtttcacttggaaaacacaaggcaaggaaaaatttctccaaatgtctattttaatatatctt

SEQ ID NO: 137416 - DNA, 601 bp, Human; identical to SEQ ID NO: 34186

SEQ ID NO: 137417 - DNA, 601 bp, Human; identical to SEQ ID NO: 34187

SEQ ID NO: 137418 - DNA, 601 bp, Human
tatagtatatgcaccattagagaataaaacagattaatatcatctatttcaaaaacaatagaatctggagttttcattagctgtagtacttcacactttgtgtgtagtgtagagtgtgctcaatacacacttgtggaataagtgataaaaaggtttccttctggctgttctgaactagggagttttaacttctaaaataggctaggaacccacttaccagtgtgttttttttaaaaaaaacagttaattattaaatttatttcacttgttttctatggaaaaatagctttattatgttttsaattttttttttagcaattgctgagaaaaaggtacagaggtagaaataatatagatatagctctgttaccctgtctaaaaagcaaactttctgaccttgtttcttccaggtcagcctttcaaacacagaatttcagaaataagttatgcttataaattaatggccttttgtttaagtttttaaaaagtgaaagcaaagaatttctgttctaggcctgacaggtcaactgcttttgctttttcttttttaaagacagggtctcgctctgtcacacaggctggagtgcagggatatgttatc

SEQ ID NO: 137419 - DNA, 601 bp, Human
gcacgccaccacacccagctgatttttaaattttttgtacagacagggattcaccctgttgtccaagctggtctcgaactcctggcctcaagtgatcctccagcctcagcctcccaaagtgctgggattacaggcatgaaccactacacttggctaactactttcaaaagagaaaaaatattgtttaaaatgtaaatcatactgaaatacaattaaatttagaatctagaaattgttcatagagaaaaccaactttaaaaatattgaagccccctgaaaacaggcaactggaataacactrtttttactagatttagaatatatgaaactctgatctattatttactgcaactgcttataataataatagggaaacttcagaagaagtgtaaggcaatatctttagtgctgtgagggcaggctagaattccttaaacaggacataaaatgtgtaaggaacaaaagagaagactgatagattcagtggtagaacttttgtttatcaaagtacttaataaagactgaaaacatcaacatgatacaactattcagtaaagatgggatcagatataattatcaatagatattaaatctagaggaa

SEQ ID NO: 137420 - DNA, 601 bp, Human
caaagcagtgaatattcagtaagctaattaaaatttgtaagtaagatttccttattaaaaaaactattaaaataagaagaagcccgttaaaataataattagagcaggaaaaaagaagatgactatcaaattacagtactttttttcagctatacataaaggccttttcagttgctttggcagtagacagaaggcagaagtagattcctactgcaagtatgcagttggtaaaccagaaacaagttgaaggaaaaggcagctattttgttaaaacggttctttcacatgtcttaaaagaagrctacagaccctctgttctaaaagctctgattgtgtatcccagtggaggtgggacatcattaaacagtgcgcagagaataaaagagcaggttgtaaaaaatgggagctttgaggatgctatagcatgaagtacagatgaggcatatctgcaagatttaaagaaaacagggaagcttccgatttttttgttgctgttgttctctacaaacaatcagcaccatgattggtgtggtgcttaaagcttgctccagtgatgtcaggtattatatttattttagaattgactattttgaggaaatct

SEQ ID NO: 137421 - DNA, 601 bp, Human
tggcagtagacagaaggcagaagtagattcctactgcaagtatgcagttggtaaaccagaaacaagttgaaggaaaaggcagctattttgttaaaacggttctttcacatgtcttaaaagaagactacagaccctctgttctaaaagctctgattgtgtatcccagtggaggtgggacatcattaaacagtgcgcagagaataaaagagcaggttgtaaaaaatgggagctttgaggatgctatagcatgaagtacagatgaggcatatctgcaagatttaaagaaaacagggaagcttcygatttttttgttgctgttgttctctacaaacaatcagcaccatgattggtgtggtgcttaaagcttgctccagtgatgtcaggtattatatttattttagaattgactattttgaggaaatctctaacactcagttgatacgatacccaaacaaggataaagagacaattttcaggctgggcacagtggctcacacctgtaatcccagtgctttgggaggctgaggcgggtggatcgcctgagctcaggagttcaagaccacctgggcaacctcgtctctactaaaatacaaaaaattag

SEQ ID NO: 137422 - DNA, 601 bp, Human
agtatgcagttggtaaaccagaaacaagttgaaggaaaaggcagctattttgttaaaacggttctttcacatgtcttaaaagaagactacagaccctctgttctaaaagctctgattgtgtatcccagtggaggtgggacatcattaaacagtgcgcagagaataaaagagcaggttgtaaaaaatgggagctttgaggatgctatagcatgaagtacagatgaggcatatctgcaagatttaaagaaaacagggaagcttccgatttttttgttgctgttgttctctacaaacaatcagyaccatgattggtgtggtgcttaaagcttgctccagtgatgtcaggtattatatttattttagaattgactattttgaggaaatctctaacactcagttgatacgatacccaaacaaggataaagagacaattttcaggctgggcacagtggctcacacctgtaatcccagtgctttgggaggctgaggcgggtggatcgcctgagctcaggagttcaagaccacctgggcaacctcgtctctactaaaatacaaaaaattagccgggcgtggtggcacacgcctgtagtcccagctactc

SEQ ID NO: 137423 - DNA, 601 bp, Human
aatggatgccatgtgtggaatatagtacaaagaggggtttactttctattgagaggatcaggaaagaccttctagagaagatgatgtgtagaacctggagaaggatgaataagactttgggagaaaggatattctaagcagaggaaactcagaagcaaaaaacagatatgttaggagaacagtttaataagtctggagcctgtgttattatgtggggggtgggggattttattataagacttaaggctacagactgtgaagactcagacaagcctgaactaaaaccccaactcctccccartttattagctcagtgaccttgggcaagtcattttacctcactgtgcctccttttctcaagtgtgtagttgggataaaaatagcatgtactggctgggcatggtggctcacacctgtaatcccagcactttgggaagctgaggcgggcggattgcttgaggtcaggagttcaataccagtctggccaacatggtgaaaccctctctctactaaaaatacaaaaaattagctgggcatggtggcgcatgccggtggttctagctactcaggaggctgaggcaggagaattgcttgaatccag

SEQ ID NO: 137424 - DNA, 601 bp, Human
cagtttaataagtctggagcctgtgttattatgtggggggtgggggattttattataagacttaaggctacagactgtgaagactcagacaagcctgaactaaaaccccaactcctccccagtttattagctcagtgaccttgggcaagtcattttacctcactgtgcctccttttctcaagtgtgtagttgggataaaaatagcatgtactggctgggcatggtggctcacacctgtaatcccagcactttgggaagctgaggcgggcggattgcttgaggtcaggagttcaataccagyctggccaacatggtgaaaccctctctctactaaaaatacaaaaaattagctgggcatggtggcgcatgccggtggttctagctactcaggaggctgaggcaggagaattgcttgaatccaggaggcggagtttgcagtgagccgagattatgccagtgcactccagcctgggcagaagagtgaggctctgtctcaaaaagaaaaaaaaaaaaatagcatgtacttcctagggttgtgggagtttcagtaagataaagcacgtgtaaagcacctagcagagtgcctatcacagagtaagtg

SEQ ID NO: 137425 - DNA, 601 bp, Human
cttctcagtaaataaattttaaacagtttaaaacagagtatgttttctgactacagtggaatcaaactagaaatgacaaacagataactagaaagtaacagataaccaaataaaattccatatgtttagaaattaagcaatataacccttgggttaatgaagaaatcacaatagaaattagaaaataactgaatgacagtgaaacgataacataccaaaactcatgggatacagctaaagccatgtttagaaagaaatttatagctttatatataatatatacatgaatgtgtatgtggtrtgtgtatgtatgtatatactgtacatatctgtatatatgtgcaggtatatacgtgtgtgtgtgtgtgtgtatatatatatatatacatgcacacagtaggtccatttctaagaatttaatctacaaacacattatctatgtacaatgtttcttgctccagtctttataatagcaaaagactgataattcaattcaatctctgcctcctgggctcaagtgatcctcccaactcagcctcccaagtagctaggactacagacatgagccaccatgcctggctaatttttgtattttttgtag

SEQ ID NO: 137426 - DNA, 601 bp, Human
agataaccaaataaaattccatatgtttagaaattaagcaatataacccttgggttaatgaagaaatcacaatagaaattagaaaataactgaatgacagtgaaacgataacataccaaaactcatgggatacagctaaagccatgtttagaaagaaatttatagctttatatataatatatacatgaatgtgtatgtggtgtgtgtatgtatgtatatactgtacatatctgtatatatgtgcaggtatatacgtgtgtgtgtgtgtgtgtatatatatatatatacatgcacacagtargtccatttctaagaatttaatctacaaacacattatctatgtacaatgtttcttgctccagtctttataatagcaaaagactgataattcaattcaatctctgcctcctgggctcaagtgatcctcccaactcagcctcccaagtagctaggactacagacatgagccaccatgcctggctaatttttgtattttttgtagagatggggtttcaccacattgccctggctggtcttaaactcctaagctcaagcaatcttcctgcctctcaaagtgctggaattacaggcatgagccacc

SEQ ID NO: 137427 - DNA, 601 bp, Human
cccaactcagcctcccaagtagctaggactacagacatgagccaccatgcctggctaatttttgtattttttgtagagatggggtttcaccacattgccctggctggtcttaaactcctaagctcaagcaatcttcctgcctctcaaagtgctggaattacaggcatgagccaccgcacccatccagtgctgtcctttcctatcatgtattttgataaactggtactttaacttcagatgactgtacgttctgtgtaggaaggcagagaagtcactcagactctgctccagcactatttaktaacagtgtgaccttgagcaaattatttaatgagtccattttttatctataaaatgagaataatgataatttgctcaggggattcaggggttaatgaaatcatgtatgaagagtgcctagtacagggcctggcatctcaggaatgttcattaaatgccagttgtcatccattcaacctacattttcttgccgggcatacagagtcttgtaaaggatccaaaagaaagagggagcaaaggttctgacatccagccaactagcgtggtaagtattcacaggctccctgaaggtatgagccag

SEQ ID NO: 137428 - DNA, 601 bp, Human
atgagaataatgataatttgctcaggggattcaggggttaatgaaatcatgtatgaagagtgcctagtacagggcctggcatctcaggaatgttcattaaatgccagttgtcatccattcaacctacattttcttgccgggcatacagagtcttgtaaaggatccaaaagaaagagggagcaaaggttctgacatccagccaactagcgtggtaagtattcacaggctccctgaaggtatgagccagggaggggcatgagggtgtgtctgttcttagtctctgatggacctatactgtgtrtatatatatatagtattctttactccaaaaatgcatgagattcatttttgatgagaattaattatatatgttgaaagcttactatgctttttgaggataggtatacccactttaacaattaaatgaaagttttctggatttttgaaaagaaaagaagactgcagtgggtatgtggtaaggagtagtggttgaataaataagcgtttcccttaaacaagaggcgtgactataggatttcttttcataggacactgaatgcatgttgatgttcttatttacagggattagatttacgtgaaa

SEQ ID NO: 137429 - DNA, 601 bp, Human
agcctgggaggttgaggctgtggtgagccgtgattgtgccactgcacttcagcctgcgcaacagagcgagaccctgtctcaaaaaaaaaaaaagtaggactgtggtggatatctttgtacatttatctgtaaatattttctcaagataagttttagtaatctgggcaaagggtatgctaatgtttgctggcttactctccagaaaggttatgctaaataataagtaaactgtatctacctcccttaggtttatttctttaatctgaacttaaaagattctatagctgacagatttgttgtytgtgtagctacaaaaggtcactgtgacacatggaagttgttacccgaatgagtcctgtttttagcccaaaaaaagtctttacgcataacccagtatgaggggttcccatgctgtgctcacatagagaagttaaaatgtaaccagagttagcctgaacacttaaggcagcactctgcaaacttggggggacgcatactgtacagaggagctgaaggttttccaaagaggactcaggtatgcacggtttcatggttttcactggccagctttccttacgtatatgtgtacgccttcctaaat

SEQ ID NO: 137430 - DNA, 601 bp, Human
aaaaagtaggactgtggtggatatctttgtacatttatctgtaaatattttctcaagataagttttagtaatctgggcaaagggtatgctaatgtttgctggcttactctccagaaaggttatgctaaataataagtaaactgtatctacctcccttaggtttatttctttaatctgaacttaaaagattctatagctgacagatttgttgtttgtgtagctacaaaaggtcactgtgacacatggaagttgttacccgaatgagtcctgtttttagcccaaaaaaagtctttacgcataacccagtatgaggggttcccatgctgtgctcacatagagaagttaaaatgtaaccagagttagcctgaacacttaaggcagcactctgcaaacttggggggacgcatactgtacagaggagctgaaggttttccaaagaggactcaggtatgcacggtttcatggttttcactggccagctttccttacgtatatgtgtacgccttcctaaatccacctgccccagaaagtggctgtgatggaagcattgtgttggttttcttttcccttcctgcccttttcttactttatgaaagaaagg

SEQ ID NO: 137431 - DNA, 601 bp, Human
ggcttactctccagaaaggttatgctaaataataagtaaactgtatctacctcccttaggtttatttctttaatctgaacttaaaagattctatagctgacagatttgttgtttgtgtagctacaaaaggtcactgtgacacatggaagttgttacccgaatgagtcctgtttttagcccaaaaaaagtctttacgcataacccagtatgaggggttcccatgctgtgctcacatagagaagttaaaatgtaaccagagttagcctgaacacttaaggcagcactctgcaaacttggggggacgcatactgtacagaggagctgaaggttttccaaagaggactcaggtatgcacggtttcatggttttcactggccagctttccttacgtatatgtgtacgccttcctaaatccacctgccccagaaagtggctgtgatggaagcattgtgttggttttcttttcccttcctgcccttttcttactttatgaaagaaagggatactcccacctggttcattgccccgaggtatgagaccctcttgggtgcccaacaagagacattatgaaatattggtgataaccaaacctcctttaatc

SEQ ID NO: 137432 - DNA, 601 bp, Human
tcacatagagaagttaaaatgtaaccagagttagcctgaacacttaaggcagcactctgcaaacttggggggacgcatactgtacagaggagctgaaggttttccaaagaggactcaggtatgcacggtttcatggttttcactggccagctttccttacgtatatgtgtacgccttcctaaatccacctgccccagaaagtggctgtgatggaagcattgtgttggttttcttttcccttcctgcccttttcttactttatgaaagaaagggatactcccacctggttcattgccccgargtatgagaccctcttgggtgcccaacaagagacattatgaaatattggtgataaccaaacctcctttaatcagcactgtacaaccaccccactcccaattaagaaatgcatgtatgatgaaacctacatttgatggtcaaaataagtatatttttatttatcaaaataagtatttgtattgctttgattagttttaaactaactataatgatggtttagtccagaaggaaatattaaatatgtagagccttataattacaggaaataaaaacaattttaaattttcaatttccatatatt

SEQ ID NO: 137433 - DNA, 601 bp, Human
ccctttctgaactccactgctatagatctcaggctccgtttcagctctgtcccctgcactcagcagcaacacctggggagaacctgcgagccccccttcaggctttcccttgcccagagcttctcccgcttcctcttcctcagccagaacccaccagcccttcaggtgccttgctcctgctcctccccaggtaccaatgccttccccatctcactgcccgctccttccccaacagaaatgttctctcagatgctacctttcctctcctttttctgtagaataggtttctcttccctctgtmactataaaaagggggtttagaggttaagaagggaaaagggaattaagttacagaagagatcaaaagtttctgggatctcggagtggtccagggagagggaggcaggcttgcatttttggcttatttgtggccacacaagctattggagttttctgcttctgaattgtggagtttcaataaaagcactatggaattgaattggattgaaacggaggtcccgttcaagtttgaccttgcctcagaagcctcctctgatttctcagacctgctgggatatctcttcctccaaatcctgttgct

SEQ ID NO: 137434 - DNA, 601 bp, Human
agctaatagttaccaggtaaatggtatgtgccaaagccattaatgcacccaacagttctgtgaggaagatactactatttatattgttattctcattttataggaaaggaaacactaaaataactaaaacaatctgtccaaagtcactcagcttagtaaatagcagagcgtgaatttgaaaccggattctgagtccaaagcacgtaaccattatgtgatacttcccacatctgactcaactccctccaagtcagagattctaaggagataatgagtaaaagctttttgaagaaggtaaaaragctaggtaaaaggtgaatctagttattgtattatgtggaaagcatttttacttttaaaagcaattgtcaatctatagctgaattgcgtgggggaaatacacggttgtagtgtatgcgagagaccagatccctttcaggctgctccttggccttgcagaaaagttccagaaaatcagcggactgcataatgtgcactactcattcccctaatcaccagaggcttggtctggtggctgataacaatgaacatcagtagaagagggagagtacttgtgcttttattctcatttttaattgat

SEQ ID NO: 137435 - DNA, 601 bp, Human
cataatgtgcactactcattcccctaatcaccagaggcttggtctggtggctgataacaatgaacatcagtagaagagggagagtacttgtgcttttattctcatttttaattgatcttaaaattcttccatggccctttgccttgggcacaatccagagtcatgaatccttgatatgcggctcaacagagaggcacaggacagcgtagtccctttcccttcaccagtttcctgcctgcctttctattctgggaccactgtacagaccattccagttcagagatggagcaagctctgctcrccttcatgcactgcgcatgcagcctggccccactgtgagctctgtgcaggaggggccccatgacctgcagcctttgaggcttcctactgggtgagcttagggcttcttttgcaactaattatatccatctgtttttaaaaggtgaaaaaaaaatcctgaatttaggtgtcgattgatacattaattaccccatctcagttgcagcagtgtggtcttaatagctgattgctgcaatacccaaatctgtaatatcagaatgtgatgtgcatattttaatttgagaaatagtttaacattttt

SEQ ID NO: 137436 - DNA, 601 bp, Human
aacctctaggtaatcccatcaaacaattgatgtcaaggaaacagtgcccacagtagcttcggatgagtggccattaattttaattgccttgatattaaagattaagaagtattgggactagcagaataaaaacgatctgatgtcaagcaaatccacttgctaaagcttccccaggctgctggtgatattaaaattttactgtgagaattaaataaacctttattagtgatgactgttgtttgattggtccaggggtatgcataaacagaggattcttacatatctagagatgagaccttcratggtacagagattcctcaattatgaaactgttaataaagctgtaatctgattttccaggctaggtttcattaatgtattatagcttctctgattgtcaaggtaatattaactacaaagtactgaatccaacagagaattgtttggaagaagagaattctaagatgggcctttgttgctaaattcagagttggggaattttcattaattatgcttaagaaataccaaattccctctcaaccaagactatcctcctttgcactatagatatgttcaatatttaactctttctaaggcctga

SEQ ID NO: 137437 - DNA, 601 bp, Human
tgtggcagaacatttatatggaaatctctttaaaaatgagaactcactataaatctgggagtcatccacacagagaggatatttgaaattttgaatatggataaggttgctctaggtgcaagagagaagaaggccaagagctgagtcctggagaaaactcactgtcttcctctctctctctctgtctgtctctctcatgtatcagggaagagcagatgttggaggagaaggagtataatgtcacatacaccatgtaagagcctgctctaggcaagaggggtggtaattacaagtatcagayactgctgagaggtcagactagtcagagagacaaggccattggatttgggactggtgtcatgccagtataaccactcccatctaccacctagcccttgaaattgttcacattaaaatgagaaaatgtctgcaaggtgctctgcataatggtcattcaccaaatgatagttattagagctactgtatttgatatgaagaaaagaagggatacatacagtcttctagggggaaaaaatgatggtagaacagaaacagctaggaagcgctgatctgtagcacatttacttcctgatgggctttg

SEQ ID NO: 137438 - DNA, 601 bp, Human
tatggaaatctctttaaaaatgagaactcactataaatctgggagtcatccacacagagaggatatttgaaattttgaatatggataaggttgctctaggtgcaagagagaagaaggccaagagctgagtcctggagaaaactcactgtcttcctctctctctctctgtctgtctctctcatgtatcagggaagagcagatgttggaggagaaggagtataatgtcacatacaccatgtaagagcctgctctaggcaagaggggtggtaattacaagtatcagatactgctgagaggtcaractagtcagagagacaaggccattggatttgggactggtgtcatgccagtataaccactcccatctaccacctagcccttgaaattgttcacattaaaatgagaaaatgtctgcaaggtgctctgcataatggtcattcaccaaatgatagttattagagctactgtatttgatatgaagaaaagaagggatacatacagtcttctagggggaaaaaatgatggtagaacagaaacagctaggaagcgctgatctgtagcacatttacttcctgatgggctttggcttgtttctgtctga

SEQ ID NO: 137439 - DNA, 601 bp, Human
gctctaggcaagaggggtggtaattacaagtatcagatactgctgagaggtcagactagtcagagagacaaggccattggatttgggactggtgtcatgccagtataaccactcccatctaccacctagcccttgaaattgttcacattaaaatgagaaaatgtctgcaaggtgctctgcataatggtcattcaccaaatgatagttattagagctactgtatttgatatgaagaaaagaagggatacatacagtcttctagggggaaaaaatgatggtagaacagaaacagctaggaagygctgatctgtagcacatttacttcctgatgggctttggcttgtttctgtctgacgaacctatgctcatggttgctgcatgggtcctcggcaagtatgcctgcatgtgtatatgtgcacatgtgtgcactccataatccccaggatggacagcatatgggcagcagcaaggccaatgttgtcttcctcacatggctcccttgccagggctctctgctccttccagaaggatgagtgccataggttgaagaatgggaattctatttccaaagcaattaaagacttggcagagatggtcaaaa

SEQ ID NO: 137440 - DNA, 601 bp, Human
tgtcatgccagtataaccactcccatctaccacctagcccttgaaattgttcacattaaaatgagaaaatgtctgcaaggtgctctgcataatggtcattcaccaaatgatagttattagagctactgtatttgatatgaagaaaagaagggatacatacagtcttctagggggaaaaaatgatggtagaacagaaacagctaggaagcgctgatctgtagcacatttacttcctgatgggctttggcttgtttctgtctgacgaacctatgctcatggttgctgcatgggtcctcggcargtatgcctgcatgtgtatatgtgcacatgtgtgcactccataatccccaggatggacagcatatgggcagcagcaaggccaatgttgtcttcctcacatggctcccttgccagggctctctgctccttccagaaggatgagtgccataggttgaagaatgggaattctatttccaaagcaattaaagacttggcagagatggtcaaaaagggtgcccacagtgtaaattgggttggaaggcttcaaactacatactactccttacgtctcttcagggcccctatgaatagctgttaagta

SEQ ID NO: 137441 - DNA, 601 bp, Human
aatgatggtagaacagaaacagctaggaagcgctgatctgtagcacatttacttcctgatgggctttggcttgtttctgtctgacgaacctatgctcatggttgctgcatgggtcctcggcaagtatgcctgcatgtgtatatgtgcacatgtgtgcactccataatccccaggatggacagcatatgggcagcagcaaggccaatgttgtcttcctcacatggctcccttgccagggctctctgctccttccagaaggatgagtgccataggttgaagaatgggaattctatttccaaascaattaaagacttggcagagatggtcaaaaagggtgcccacagtgtaaattgggttggaaggcttcaaactacatactactccttacgtctcttcagggcccctatgaatagctgttaagtataataccttcagggtagaacagtgaccccacccagcctgatatcacagcaatatgcccctttgacaggattattaagaaattattgaaaagtatttttaaactgttgctttaataaaagagaggtcagatccttttatatagtgtgtgggtatactttcttataaattgccatgtggc

SEQ ID NO: 137442 - DNA, 601 bp, Human; identical to SEQ ID NO: 34188

SEQ ID NO: 137443 - DNA, 601 bp, Human; identical to SEQ ID NO: 34189

SEQ ID NO: 137444 - DNA, 601 bp, Human; identical to SEQ ID NO: 34190

SEQ ID NO: 137445 - DNA, 601 bp, Human; identical to SEQ ID NO: 34191

SEQ ID NO: 137446 - DNA, 601 bp, Human; identical to SEQ ID NO: 34192

SEQ ID NO: 137447 - DNA, 601 bp, Human; identical to SEQ ID NO: 34193

SEQ ID NO: 137448 - DNA, 601 bp, Human
gaaatataaaataggattttataatagtcttaataactagaaagttttaagctaggataaaaatggggtgtatactttaggtctttatctttcctgagagatgaaattggtagaaacgttattttattgctagatttcactttagaaatgaatcaccctgatctttgttaggcccctatttaatattctaaatgcaggtctaatctctctgcttttttttaatggaagacttcttagtagaacttcacttatttagcacattgtttgcccatggttataatccaatatgcttgtgccaagrcgtattttggaattcaagctttttcagaatttggaattaaaatttagaatctaaatttcagaactgagaaagacattgctcagaatttagaaaggtaaacatacatgttgaccctgctggttacatgccattccaatatagtctggagagaatcctgtaattccatgcattaatatttctgtacttttacatttaagaacatgaatattctcactaagtggaataaataaagactataaagagctgtgtgtctgtttagagcaggtgttatcactacgagagcttctctaagacttacca

SEQ ID NO: 137449 - DNA, 601 bp, Human
agaccaccatcaccttctactccttctcacaccatcccaggataattattctctcatttgagattaagaagttatttggtttattttattatggttatataaatatagtttactgctaaagcaaggtatatcattccattttctatctcgtacccctttttgctcttcctggggtaaacccttgctttgtttttgtgttttcttagtttgcactgtgcctattatcatttccttcccaactttctgacataaagatgaaagccctattgacacaattttctacagtgtcagatataccaartaatctcacggttccatttttctttctttttttctagaaccctccatcttcttcttgtctaacagttgctcttcagtcttgctatacatacagtaatacctgaagaatgtttggaggatatttggtgtgggatttttcttttttttttttctttttcttttttgtagagatgggctctcgctatattgcccaggctagtctcaaactcctgggcccaagcaatcctcttgcctcagcctcccaaagtgctgggattataggcatgatccactgtgcccagccctatggggaatatttgtt

SEQ ID NO: 137450 - DNA, 601 bp, Human
tattgaaaatatttctccagagctttttaattctatggttatttatttattgtagtatagaacttttatgatttcttccatcagggtgcattctgaatcatgcttagtgagagatggtttttaactccactttaacagttagcatctatgttttacatcagtgtcaatgtcacttttgtattatatacgacaccaacattttattatctgagtgatgagaatgtttatttttgtggaaatggagatctcatgagactttaagcagattgctggccttctcctcgatttccttgattgattyctgaagtggaactgcagtgctaagtggaattccctgggaagcttgctcaagtaagtaagcatgagaaatgctgaatgaaataaagtgcagcaagcagggataaatatcatgggcatcttcagagcctttgtgcaggtaacatgcacagagattctctgagagagtcagtctcagccagtggtcctacacttccatgaccctgcagtgcgtttgttcttagagtggctttcagggctggctctgccacagcctctttgggaaaccatgcatgacctcttgctgctccttaccaagctcctt

SEQ ID NO: 137451 - DNA, 601 bp, Human
tttctccagagctttttaattctatggttatttatttattgtagtatagaacttttatgatttcttccatcagggtgcattctgaatcatgcttagtgagagatggtttttaactccactttaacagttagcatctatgttttacatcagtgtcaatgtcacttttgtattatatacgacaccaacattttattatctgagtgatgagaatgtttatttttgtggaaatggagatctcatgagactttaagcagattgctggccttctcctcgatttccttgattgattcctgaagtggacctgcagtgctaagtggaattccctgggaagcttgctcaagtaagtaagcatgagaaatgctgaatgaaataaagtgcagcaagcagggataaatatcatgggcatcttcagagcctttgtgcaggtaacatgcacagagattctctgagagagtcagtctcagccagtggtcctacacttccatgaccctgcagtgcgtttgttcttagagtggctttcagggctggctctgccacagcctctttgggaaaccatgcatgacctcttgctgctccttaccaagctccttaggctttgctt

SEQ ID NO: 137452 - DNA, 601 bp, Human
cttccatcagggtgcattctgaatcatgcttagtgagagatggtttttaactccactttaacagttagcatctatgttttacatcagtgtcaatgtcacttttgtattatatacgacaccaacattttattatctgagtgatgagaatgtttatttttgtggaaatggagatctcatgagactttaagcagattgctggccttctcctcgatttccttgattgattcctgaagtggaactgcagtgctaagtggaattccctgggaagcttgctcaagtaagtaagcatgagaaatgctgratgaaataaagtgcagcaagcagggataaatatcatgggcatcttcagagcctttgtgcaggtaacatgcacagagattctctgagagagtcagtctcagccagtggtcctacacttccatgaccctgcagtgcgtttgttcttagagtggctttcagggctggctctgccacagcctctttgggaaaccatgcatgacctcttgctgctccttaccaagctccttaggctttgcttggtagaggcagaatgttgtggttgttttcatcttaaatgctaacaatatatgaattatgtggt

SEQ ID NO: 137453 - DNA, 601 bp, Human
ctcatgagactttaagcagattgctggccttctcctcgatttccttgattgattcctgaagtggaactgcagtgctaagtggaattccctgggaagcttgctcaagtaagtaagcatgagaaatgctgaatgaaataaagtgcagcaagcagggataaatatcatgggcatcttcagagcctttgtgcaggtaacatgcacagagattctctgagagagtcagtctcagccagtggtcctacacttccatgaccctgcagtgcgtttgttcttagagtggctttcagggctggctctgccrcagcctctttgggaaaccatgcatgacctcttgctgctccttaccaagctccttaggctttgcttggtagaggcagaatgttgtggttgttttcatcttaaatgctaacaatatatgaattatgtggtggatacactgcctcaaagtgacatttatcgaatatttttgtagctacgggttgagagtaagggtctgaggccccactgggttcaagtcccccttctttatttgtaagctcttcttttgtaaatggagcagtcacagggggcttcactctgatacctaatggagaccgtgcct

SEQ ID NO: 137454 - DNA, 601 bp, Human
aagcagggataaatatcatgggcatcttcagagcctttgtgcaggtaacatgcacagagattctctgagagagtcagtctcagccagtggtcctacacttccatgaccctgcagtgcgtttgttcttagagtggctttcagggctggctctgccacagcctctttgggaaaccatgcatgacctcttgctgctccttaccaagctccttaggctttgcttggtagaggcagaatgttgtggttgttttcatcttaaatgctaacaatatatgaattatgtggtggatacactgcctcaaaktgacatttatcgaatatttttgtagctacgggttgagagtaagggtctgaggccccactgggttcaagtcccccttctttatttgtaagctcttcttttgtaaatggagcagtcacagggggcttcactctgatacctaatggagaccgtgcctgcagtgctcggtacctggtatgtggttaaaactgacataactgtcagagcctctcccaggcgggctgactctgggaatctgccctgcagtcttggagggaaggcacgtccagataggtttgatgagcaactacaattgccaaagtt

SEQ ID NO: 137455 - DNA, 601 bp, Human
tgggaaaccatgcatgacctcttgctgctccttaccaagctccttaggctttgcttggtagaggcagaatgttgtggttgttttcatcttaaatgctaacaatatatgaattatgtggtggatacactgcctcaaagtgacatttatcgaatatttttgtagctacgggttgagagtaagggtctgaggccccactgggttcaagtcccccttctttatttgtaagctcttcttttgtaaatggagcagtcacagggggcttcactctgatacctaatggagaccgtgcctgcagtgctcrgtacctggtatgtggttaaaactgacataactgtcagagcctctcccaggcgggctgactctgggaatctgccctgcagtcttggagggaaggcacgtccagataggtttgatgagcaactacaattgccaaagttagtttctctgacctccaagatgggagaactttctaatattttcttttaggaaagttgtccattgcataactgatacacgagtacatatcctttagtacaggattcagatacagcgagcaacagaaaagcccttcttaacctccaccctcagtcccagccctgcc

SEQ ID NO: 137456 - DNA, 601 bp, Human
aaaccatgcatgacctcttgctgctccttaccaagctccttaggctttgcttggtagaggcagaatgttgtggttgttttcatcttaaatgctaacaatatatgaattatgtggtggatacactgcctcaaagtgacatttatcgaatatttttgtagctacgggttgagagtaagggtctgaggccccactgggttcaagtcccccttctttatttgtaagctcttcttttgtaaatggagcagtcacagggggcttcactctgatacctaatggagaccgtgcctgcagtgctcggtacctggtatgtggttaaaactgacataactgtcagagcctctcccaggcgggctgactctgggaatctgccctgcagtcttggagggaaggcacgtccagataggtttgatgagcaactacaattgccaaagttagtttctctgacctccaagatgggagaactttctaatattttcttttaggaaagttgtccattgcataactgatacacgagtacatatcctttagtacaggattcagatacagcgagcaacagaaaagcccttcttaacctccaccctcagtcccagccctgccccca

SEQ ID NO: 137457 - DNA, 601 bp, Human
catgcatgacctcttgctgctccttaccaagctccttaggctttgcttggtagaggcagaatgttgtggttgttttcatcttaaatgctaacaatatatgaattatgtggtggatacactgcctcaaagtgacatttatcgaatatttttgtagctacgggttgagagtaagggtctgaggccccactgggttcaagtcccccttctttatttgtaagctcttcttttgtaaatggagcagtcacagggggcttcactctgatacctaatggagaccgtgcctgcagtgctcggtacctgktatgtggttaaaactgacataactgtcagagcctctcccaggcgggctgactctgggaatctgccctgcagtcttggagggaaggcacgtccagataggtttgatgagcaactacaattgccaaagttagtttctctgacctccaagatgggagaactttctaatattttcttttaggaaagttgtccattgcataactgatacacgagtacatatcctttagtacaggattcagatacagcgagcaacagaaaagcccttcttaacctccaccctcagtcccagccctgcccccagtcc

SEQ ID NO: 137458 - DNA, 601 bp, Human
tacgggttgagagtaagggtctgaggccccactgggttcaagtcccccttctttatttgtaagctcttcttttgtaaatggagcagtcacagggggcttcactctgatacctaatggagaccgtgcctgcagtgctcggtacctggtatgtggttaaaactgacataactgtcagagcctctcccaggcgggctgactctgggaatctgccctgcagtcttggagggaaggcacgtccagataggtttgatgagcaactacaattgccaaagttagtttctctgacctccaagatgggagwactttctaatattttcttttaggaaagttgtccattgcataactgatacacgagtacatatcctttagtacaggattcagatacagcgagcaacagaaaagcccttcttaacctccaccctcagtcccagccctgcccccagtcccactgttggggagcagttggagctctaacctctcttctttcgtcctgtgcattcatgtgtgcatgtgtgcacgtcttcagaagatataatggtgggctgtgtatgtcttcttaatacctttatcactctggaactttctttttattaatatgttg

SEQ ID NO: 137459 - DNA, 601 bp, Human
aagtcccccttctttatttgtaagctcttcttttgtaaatggagcagtcacagggggcttcactctgatacctaatggagaccgtgcctgcagtgctcggtacctggtatgtggttaaaactgacataactgtcagagcctctcccaggcgggctgactctgggaatctgccctgcagtcttggagggaaggcacgtccagataggtttgatgagcaactacaattgccaaagttagtttctctgacctccaagatgggagaactttctaatattttcttttaggaaagttgtccattgcrtaactgatacacgagtacatatcctttagtacaggattcagatacagcgagcaacagaaaagcccttcttaacctccaccctcagtcccagccctgcccccagtcccactgttggggagcagttggagctctaacctctcttctttcgtcctgtgcattcatgtgtgcatgtgtgcacgtcttcagaagatataatggtgggctgtgtatgtcttcttaatacctttatcactctggaactttctttttattaatatgttggggtgcggggaggtctccatattcagtgattattgtaat

SEQ ID NO: 137460 - DNA, 601 bp, Human
cacagggggcttcactctgatacctaatggagaccgtgcctgcagtgctcggtacctggtatgtggttaaaactgacataactgtcagagcctctcccaggcgggctgactctgggaatctgccctgcagtcttggagggaaggcacgtccagataggtttgatgagcaactacaattgccaaagttagtttctctgacctccaagatgggagaactttctaatattttcttttaggaaagttgtccattgcataactgatacacgagtacatatcctttagtacaggattcagatacagsgagcaacagaaaagcccttcttaacctccaccctcagtcccagccctgcccccagtcccactgttggggagcagttggagctctaacctctcttctttcgtcctgtgcattcatgtgtgcatgtgtgcacgtcttcagaagatataatggtgggctgtgtatgtcttcttaatacctttatcactctggaactttctttttattaatatgttggggtgcggggaggtctccatattcagtgattattgtaatttttatgacagtccagaataggcatgtcgattttttttaatttttgat

SEQ ID NO: 137461 - DNA, 601 bp, Human
tcttggagggaaggcacgtccagataggtttgatgagcaactacaattgccaaagttagtttctctgacctccaagatgggagaactttctaatattttcttttaggaaagttgtccattgcataactgatacacgagtacatatcctttagtacaggattcagatacagcgagcaacagaaaagcccttcttaacctccaccctcagtcccagccctgcccccagtcccactgttggggagcagttggagctctaacctctcttctttcgtcctgtgcattcatgtgtgcatgtgtgcaygtcttcagaagatataatggtgggctgtgtatgtcttcttaatacctttatcactctggaactttctttttattaatatgttggggtgcggggaggtctccatattcagtgattattgtaatttttatgacagtccagaataggcatgtcgattttttttaatttttgatattataaacagtgctgcaatgaatgcactttttcttttcattctttccctctcctttgccatttgcactgtgttttcatgaaaccatcaggttaatctttatctcaaggaagcccttcatccctgtccat

SEQ ID NO: 137462 - DNA, 601 bp, Human
cttggagggaaggcacgtccagataggtttgatgagcaactacaattgccaaagttagtttctctgacctccaagatgggagaactttctaatattttcttttaggaaagttgtccattgcataactgatacacgagtacatatcctttagtacaggattcagatacagcgagcaacagaaaagcccttcttaacctccaccctcagtcccagccctgcccccagtcccactgttggggagcagttggagctctaacctctcttctttcgtcctgtgcattcatgtgtgcatgtgtgcacstcttcagaagatataatggtgggctgtgtatgtcttcttaatacctttatcactctggaactttctttttattaatatgttggggtgcggggaggtctccatattcagtgattattgtaatttttatgacagtccagaataggcatgtcgattttttttaatttttgatattataaacagtgctgcaatgaatgcactttttcttttcattctttccctctcctttgccatttgcactgtgttttcatgaaaccatcaggttaatctttatctcaaggaagcccttcatccctgtccatc

SEQ ID NO: 137463 - DNA, 601 bp, Human
taatggtgggctgtgtatgtcttcttaatacctttatcactctggaactttctttttattaatatgttggggtgcggggaggtctccatattcagtgattattgtaatttttatgacagtccagaataggcatgtcgattttttttaatttttgatattataaacagtgctgcaatgaatgcactttttcttttcattctttccctctcctttgccatttgcactgtgttttcatgaaaccatcaggttaatctttatctcaaggaagcccttcatccctgtccatcctgttcttcagtcyatccacttagttttcctatgattattttagcaagcaggtggttaatttccaaggaatgtagttacttctttgggatttttttaagtgatgtattagttttctgtgtattttattacttgtttgagtgcaccattacccccgtctcccggggtatcagttcatctgcttgcatgcttggtgcctctctctcctgctgtcagctttcctgatgtgctgggtatttccacgtgtgtgttggtttttttttttttttaggtaccctaggcattagtcttttaaggctgcattcttgcagcctgt

SEQ ID NO: 137464 - DNA, 601 bp, Human
ccatcaggttaatctttatctcaaggaagcccttcatccctgtccatcctgttcttcagtccatccacttagttttcctatgattattttagcaagcaggtggttaatttccaaggaatgtagttacttctttgggatttttttaagtgatgtattagttttctgtgtattttattacttgtttgagtgcaccattacccccgtctcccggggtatcagttcatctgcttgcatgcttggtgcctctctctcctgctgtcagctttcctgatgtgctgggtatttccacgtgtgtgttggtttttttttttttttaggtaccctaggcattagtcttttaaggctgcattcttgcagcctgtcccacatgagataggaggagggcaagacctggatgtgcacagggcaggatgggcccataactggtctgtgtggtgtgtgggtggcaggaactccctgttctttgtgggtatggccatgccttccctattcaaacgaagccacacacctgtcttttcctgcgaggcgtcttctgctgctttcttggagctggggagcatctactcttcccttgtcctcccgctcctccctgttcctccct

SEQ ID NO: 137465 - DNA, 601 bp, Human
cagggcaggatgggcccataactggtctgtgtggtgtgtgggtggcaggaactccctgttctttgtgggtatggccatgccttccctattcaaacgaagccacacacctgtcttttcctgcgaggcgtcttctgctgctttcttggagctggggagcatctactcttcccttgtcctcccgctcctccctgttcctccctcaggtctctgtcgcttctaaggcactccacccttggtcttctcccaccttgcaccccccacactgctgcctgcctgcacagggggactgtgattgcccccytcagtgtgagcctgacctgcttcatgcctttcaaggagagcattcattgccaagctactcatggaacatctcctcagatcctcagcgtgctatgacttcattttctgtaatactgtttttcatgtttcttccccttctctgcatttatagctgtgcatatgcttgaggtggaaggccaccacttccttttggttaacaacaccaatcagctgatggtcatggctacgtgaaggaactcacagtgagggctcaggaagagcctggctagagcaggctgcatcgcaggccttggcgttaggt

SEQ ID NO: 137466 - DNA, 601 bp, Human
ccataactggtctgtgtggtgtgtgggtggcaggaactccctgttctttgtgggtatggccatgccttccctattcaaacgaagccacacacctgtcttttcctgcgaggcgtcttctgctgctttcttggagctggggagcatctactcttcccttgtcctcccgctcctccctgttcctccctcaggtctctgtcgcttctaaggcactccacccttggtcttctcccaccttgcaccccccacactgctgcctgcctgcacagggggactgtgattgcccccttcagtgtgagcctgwcctgcttcatgcctttcaaggagagcattcattgccaagctactcatggaacatctcctcagatcctcagcgtgctatgacttcattttctgtaatactgtttttcatgtttcttccccttctctgcatttatagctgtgcatatgcttgaggtggaaggccaccacttccttttggttaacaacaccaatcagctgatggtcatggctacgtgaaggaactcacagtgagggctcaggaagagcctggctagagcaggctgcatcgcaggccttggcgttaggttccccaaatcactgc

SEQ ID NO: 137467 - DNA, 601 bp, Human
tcctccctcaggtctctgtcgcttctaaggcactccacccttggtcttctcccaccttgcaccccccacactgctgcctgcctgcacagggggactgtgattgcccccttcagtgtgagcctgacctgcttcatgcctttcaaggagagcattcattgccaagctactcatggaacatctcctcagatcctcagcgtgctatgacttcattttctgtaatactgtttttcatgtttcttccccttctctgcatttatagctgtgcatatgcttgaggtggaaggccaccacttccttttgrttaacaacaccaatcagctgatggtcatggctacgtgaaggaactcacagtgagggctcaggaagagcctggctagagcaggctgcatcgcaggccttggcgttaggttccccaaatcactgctggtgatcttgtagctctgtcatgaagtctgtcctgcttattaggataccgagggtccaaattcatagattcttagaagcctgtttaaatatgcagagtatctaattcaacccgattagaaacgggctcagaaaggtgaagggatttgtccaaccactgagtgatgctgctgggatt

SEQ ID NO: 137468 - DNA, 601 bp, Human
ccctcaggtctctgtcgcttctaaggcactccacccttggtcttctcccaccttgcaccccccacactgctgcctgcctgcacagggggactgtgattgcccccttcagtgtgagcctgacctgcttcatgcctttcaaggagagcattcattgccaagctactcatggaacatctcctcagatcctcagcgtgctatgacttcattttctgtaatactgtttttcatgtttcttccccttctctgcatttatagctgtgcatatgcttgaggtggaaggccaccacttccttttggttarcaacaccaatcagctgatggtcatggctacgtgaaggaactcacagtgagggctcaggaagagcctggctagagcaggctgcatcgcaggccttggcgttaggttccccaaatcactgctggtgatcttgtagctctgtcatgaagtctgtcctgcttattaggataccgagggtccaaattcatagattcttagaagcctgtttaaatatgcagagtatctaattcaacccgattagaaacgggctcagaaaggtgaagggatttgtccaaccactgagtgatgctgctgggattagaa

SEQ ID NO: 137469 - DNA, 601 bp, Human
gggactgtgattgcccccttcagtgtgagcctgacctgcttcatgcctttcaaggagagcattcattgccaagctactcatggaacatctcctcagatcctcagcgtgctatgacttcattttctgtaatactgtttttcatgtttcttccccttctctgcatttatagctgtgcatatgcttgaggtggaaggccaccacttccttttggttaacaacaccaatcagctgatggtcatggctacgtgaaggaactcacagtgagggctcaggaagagcctggctagagcaggctgcatcrcaggccttggcgttaggttccccaaatcactgctggtgatcttgtagctctgtcatgaagtctgtcctgcttattaggataccgagggtccaaattcatagattcttagaagcctgtttaaatatgcagagtatctaattcaacccgattagaaacgggctcagaaaggtgaagggatttgtccaaccactgagtgatgctgctgggattagaactctcaaaactaggtgtttctaatccagaaccagaatccctatccactactctaataaggcgtaaaagaggatctgctgtcctgcc

SEQ ID NO: 137470 - DNA, 601 bp, Human
actcatcaccaatggttacacaaaacttgttttgatctttgtggcttttgcattgagaagttaagcatatacaataggaattagacacaatcccaaaccaatgagagactcaagtgagaagagctgaagcttttatgcatgccttccttccatagagataaatttactatccagagtgaactagagcctcgtggaaagtgagtgccgagcccctagctgtgagtgtctctgtccttcccacatcagacctccatgtctgtggctgtccccctacggggcagaactgctgctctctgcttgygttgctgtcgtgagggttgggagtggacaggtgtggacagatctcagacccgtttccctcctgttatggaaatgtttgtgaggcaggtgggacttcaatgatttggtcaaggaaaggcagcttggcagctggggagaagggctcaggctagaaaggcaagcgtttgtgagggatgatttccccaaagaagccagcagtgtgtaaggtattccccggagcttgtttcttctcagaagactctggaagctgtgtcagtgtctgttatggaggaatggagtatcagtccgatcaggctttcat

SEQ ID NO: 137471 - DNA, 601 bp, Human
acctgtaacaaatgtgtgagtgaagactggcacctccccacgatggcctttctgtgatgccatcaagagcaccagggagctctccagatatggagatggacagatgtctaaggcccctgaaatgagcctgctgtacagatgattccagaactctgtcagtgtgaagaccaaacacaattaagcacattaaaatacttacggtaaagtgtttctttcactttagatgtgcaaaaacttaaagagagagagacttatgagaagactcagggaagaaatgtaagataaaggtgttaagggagayaaactccacaaaattgtaaagtgaagctgctgtggggagtagagcccagacccagataatatgcaggcatgggtccaagggaggctttgcacaccaggcgggggaggtgcagggccatggatgaatggtcttgggaaaacggcaaatcgtttggaaaaaaaaacaaaactttgctctttatatcaaaataaattccaagctgaacaaagaataaaaatatagcattgaaataatgaagctattaaaagaaaacttaggtgagttttaaaataattgtgaagaggcctgtctaaatgtgat

SEQ ID NO: 137472 - DNA, 601 bp, Human
agcaccagggagctctccagatatggagatggacagatgtctaaggcccctgaaatgagcctgctgtacagatgattccagaactctgtcagtgtgaagaccaaacacaattaagcacattaaaatacttacggtaaagtgtttctttcactttagatgtgcaaaaacttaaagagagagagacttatgagaagactcagggaagaaatgtaagataaaggtgttaagggagacaaactccacaaaattgtaaagtgaagctgctgtggggagtagagcccagacccagataatatgcagrcatgggtccaagggaggctttgcacaccaggcgggggaggtgcagggccatggatgaatggtcttgggaaaacggcaaatcgtttggaaaaaaaaacaaaactttgctctttatatcaaaataaattccaagctgaacaaagaataaaaatatagcattgaaataatgaagctattaaaagaaaacttaggtgagttttaaaataattgtgaagaggcctgtctaaatgtgataaaacatatgaatttatattcacactcatcacaagattgataagcatgatttcctaaaattttaagc

SEQ ID NO: 137473 - DNA, 601 bp, Human
ttaaagagagagagacttatgagaagactcagggaagaaatgtaagataaaggtgttaagggagacaaactccacaaaattgtaaagtgaagctgctgtggggagtagagcccagacccagataatatgcaggcatgggtccaagggaggctttgcacaccaggcgggggaggtgcagggccatggatgaatggtcttgggaaaacggcaaatcgtttggaaaaaaaaacaaaactttgctctttatatcaaaataaattccaagctgaacaaagaataaaaatatagcattgaaataatraagctattaaaagaaaacttaggtgagttttaaaataattgtgaagaggcctgtctaaatgtgataaaacatatgaatttatattcacactcatcacaagattgataagcatgatttcctaaaattttaagcaaatccccataaaatgaaaaaatatacaaataagtgaaaaaaatggtaagatatatttaatttcaatacttgtggtaaaacatcaatagctttaatatgcagcgagttttttcaaatcaataagaaaaaagacacagatgggtgctgacagggccgtttggtaatatc

SEQ ID NO: 137474 - DNA, 601 bp, Human
agaagactcagggaagaaatgtaagataaaggtgttaagggagacaaactccacaaaattgtaaagtgaagctgctgtggggagtagagcccagacccagataatatgcaggcatgggtccaagggaggctttgcacaccaggcgggggaggtgcagggccatggatgaatggtcttgggaaaacggcaaatcgtttggaaaaaaaaacaaaactttgctctttatatcaaaataaattccaagctgaacaaagaataaaaatatagcattgaaataatgaagctattaaaagaaaacttaggtgagttttaaaataattgtgaagaggcctgtctaaatgtgataaaacatatgaatttatattcacactcatcacaagattgataagcatgatttcctaaaattttaagcaaatccccataaaatgaaaaaatatacaaataagtgaaaaaaatggtaagatatatttaatttcaatacttgtggtaaaacatcaatagctttaatatgcagcgagttttttcaaatcaataagaaaaaagacacagatgggtgctgacagggccgtttggtaatatcttttaaaatttaaaacacaag

SEQ ID NO: 137475 - DNA, 601 bp, Human
ccaggcgggggaggtgcagggccatggatgaatggtcttgggaaaacggcaaatcgtttggaaaaaaaaacaaaactttgctctttatatcaaaataaattccaagctgaacaaagaataaaaatatagcattgaaataatgaagctattaaaagaaaacttaggtgagttttaaaataattgtgaagaggcctgtctaaatgtgataaaacatatgaatttatattcacactcatcacaagattgataagcatgatttcctaaaattttaagcaaatccccataaaatgaaaaaatatayaaataagtgaaaaaaatggtaagatatatttaatttcaatacttgtggtaaaacatcaatagctttaatatgcagcgagttttttcaaatcaataagaaaaaagacacagatgggtgctgacagggccgtttggtaatatcttttaaaatttaaaacacaagtgctttcactcaacaacttcacttttaggaacctatcacacatataaattgacaaaagtggagaaatattcattgcaacattttattttataatagcaaaaaaaaatcactaagggaagtacagttgattcatatgtt

SEQ ID NO: 137476 - DNA, 601 bp, Human
tcgtttggaaaaaaaaacaaaactttgctctttatatcaaaataaattccaagctgaacaaagaataaaaatatagcattgaaataatgaagctattaaaagaaaacttaggtgagttttaaaataattgtgaagaggcctgtctaaatgtgataaaacatatgaatttatattcacactcatcacaagattgataagcatgatttcctaaaattttaagcaaatccccataaaatgaaaaaatatacaaataagtgaaaaaaatggtaagatatatttaatttcaatacttgtggtaaarcatcaatagctttaatatgcagcgagttttttcaaatcaataagaaaaaagacacagatgggtgctgacagggccgtttggtaatatcttttaaaatttaaaacacaagtgctttcactcaacaacttcacttttaggaacctatcacacatataaattgacaaaagtggagaaatattcattgcaacattttattttataatagcaaaaaaaaatcactaagggaagtacagttgattcatatgttggaatcctatgcagtcttctaaaaaatgtggaatttatttcatacaccaaata

SEQ ID NO: 137477 - DNA, 601 bp, Human
ttgctctttatatcaaaataaattccaagctgaacaaagaataaaaatatagcattgaaataatgaagctattaaaagaaaacttaggtgagttttaaaataattgtgaagaggcctgtctaaatgtgataaaacatatgaatttatattcacactcatcacaagattgataagcatgatttcctaaaattttaagcaaatccccataaaatgaaaaaatatacaaataagtgaaaaaaatggtaagatatatttaatttcaatacttgtggtaaaacatcaatagctttaatatgcagcragttttttcaaatcaataagaaaaaagacacagatgggtgctgacagggccgtttggtaatatcttttaaaatttaaaacacaagtgctttcactcaacaacttcacttttaggaacctatcacacatataaattgacaaaagtggagaaatattcattgcaacattttattttataatagcaaaaaaaaatcactaagggaagtacagttgattcatatgttggaatcctatgcagtcttctaaaaaatgtggaatttatttcatacaccaaatataacaatgtccaagttctactagt

SEQ ID NO: 137478 - DNA, 601 bp, Human
gaacaaagaataaaaatatagcattgaaataatgaagctattaaaagaaaacttaggtgagttttaaaataattgtgaagaggcctgtctaaatgtgataaaacatatgaatttatattcacactcatcacaagattgataagcatgatttcctaaaattttaagcaaatccccataaaatgaaaaaatatacaaataagtgaaaaaaatggtaagatatatttaatttcaatacttgtggtaaaacatcaatagctttaatatgcagcgagttttttcaaatcaataagaaaaaagacayagatgggtgctgacagggccgtttggtaatatcttttaaaatttaaaacacaagtgctttcactcaacaacttcacttttaggaacctatcacacatataaattgacaaaagtggagaaatattcattgcaacattttattttataatagcaaaaaaaaatcactaagggaagtacagttgattcatatgttggaatcctatgcagtcttctaaaaaatgtggaatttatttcatacaccaaatataacaatgtccaagttctactagtgaaaaagcaagatgtaacatatcattgtatt

SEQ ID NO: 137479 - DNA, 601 bp, Human
gtaaatatgtagcatgatctggaagtgtaagcaccaaattaagaacagcagtttttagggggaggggaatagaattggtttagagaaaaaggtgaaattaacatttttattctgcctacttcagtgtgcctgcagtatttacaatgatcaggagtgtgtacttttttcaatttagaaaaatgataataataaggtttgcttggggggaaagggtaagtaggatgagaccaggaagagaagtaacttagaaacacatcatgcatcatgactgctggcaccattctgtcctccaatgaagagygaggctttgagaggttcagcagctcacccaaaggtgtacagccatggtctcaaacatgcttgcaccctgctgtcactcaggtcctgaagcccaggccacctccaaggacactggggtgctctggggtgcagcctgccttcagatgtttcttaaagccactcctactccaccccacccagtgcaggagccaagattgaggaccaccatttgacagctagttcataggatttcatagcacacaaacacatctttaaaggctgatgaggtttccaccaaattgggatttattggtatgctggg

SEQ ID NO: 137480 - DNA, 601 bp, Human
ctgcaaagacactgggcaggccagagtggctcctccccatttgatatgtgtgtgtgtgtgtgtgtgtgtgtgtgtgtgtgtgtgtgagattgagagagagagggctcgtgtttttctgttgcgaacagtcctttccacgggaacttatattctcctaaggtttgccactctgcagaacttttggaggaaggctttagagtgagaatgtcagtgcattctcagcgtgcaactgtaagacttgcaggaggtgaatgcacatgaaataattctcagaggaagaatatgtgcactggtcagatargaaaactgacctgtaacattttctacacaagaggatttgaatggttttcgtctttaagatttttttttaacattatgcttagtccaccatgctttattctgtcagaccatttgtcatctgcatgcttcatgagaaatgtttttttctcgtgagaaggacgtaagcaatttcgctcctggttgagagtttggtccatagtttcttggtgtctgtgggttggcttctgggcctcgctggctgcagctgatggtgaccagaagggctgttcttgtgagtcattaggggatgggccgctgctgc

SEQ ID NO: 137481 - DNA, 601 bp, Human
tgcaaagacactgggcaggccagagtggctcctccccatttgatatgtgtgtgtgtgtgtgtgtgtgtgtgtgtgtgtgtgtgtgagattgagagagagagggctcgtgtttttctgttgcgaacagtcctttccacgggaacttatattctcctaaggtttgccactctgcagaacttttggaggaaggctttagagtgagaatgtcagtgcattctcagcgtgcaactgtaagacttgcaggaggtgaatgcacatgaaataattctcagaggaagaatatgtgcactggtcagatagsaaaactgacctgtaacattttctacacaagaggatttgaatggttttcgtctttaagatttttttttaacattatgcttagtccaccatgctttattctgtcagaccatttgtcatctgcatgcttcatgagaaatgtttttttctcgtgagaaggacgtaagcaatttcgctcctggttgagagtttggtccatagtttcttggtgtctgtgggttggcttctgggcctcgctggctgcagctgatggtgaccagaagggctgttcttgtgagtcattaggggatgggccgctgctgct

SEQ ID NO: 137482 - DNA, 601 bp, Human
tctgttgcgaacagtcctttccacgggaacttatattctcctaaggtttgccactctgcagaacttttggaggaaggctttagagtgagaatgtcagtgcattctcagcgtgcaactgtaagacttgcaggaggtgaatgcacatgaaataattctcagaggaagaatatgtgcactggtcagataggaaaactgacctgtaacattttctacacaagaggatttgaatggttttcgtctttaagatttttttttaacattatgcttagtccaccatgctttattctgtcagaccatttgycatctgcatgcttcatgagaaatgtttttttctcgtgagaaggacgtaagcaatttcgctcctggttgagagtttggtccatagtttcttggtgtctgtgggttggcttctgggcctcgctggctgcagctgatggtgaccagaagggctgttcttgtgagtcattaggggatgggccgctgctgctacctccccaccccagccacctccatcagcactgtgccatactcgcccagaagagcccctggactcatcgcctgcccccatgtttacacttgttaataaaatctctagaattgt

SEQ ID NO: 137483 - DNA, 601 bp, Human
ttaagatttttttttaacattatgcttagtccaccatgctttattctgtcagaccatttgtcatctgcatgcttcatgagaaatgtttttttctcgtgagaaggacgtaagcaatttcgctcctggttgagagtttggtccatagtttcttggtgtctgtgggttggcttctgggcctcgctggctgcagctgatggtgaccagaagggctgttcttgtgagtcattaggggatgggccgctgctgctacctccccaccccagccacctccatcagcactgtgccatactcgcccagaagrgcccctggactcatcgcctgcccccatgtttacacttgttaataaaatctctagaattgtggcttagacctgtaaacatccagttccaagaagtggctctaaagccctctctgggggcagagtggttgtcagaagcagaccaggcctcggggtctagattccatccttcactggaactgctgggggctggtagtaccccatctgcaaaatgaggttaaaaatacctaacccttgggttgctatcaagctcagagatgctgtatgcaaagcaccaatcagactggctcacaaagaataggc

SEQ ID NO: 137484 - DNA, 601 bp, Human
ctttattctgtcagaccatttgtcatctgcatgcttcatgagaaatgtttttttctcgtgagaaggacgtaagcaatttcgctcctggttgagagtttggtccatagtttcttggtgtctgtgggttggcttctgggcctcgctggctgcagctgatggtgaccagaagggctgttcttgtgagtcattaggggatgggccgctgctgctacctccccaccccagccacctccatcagcactgtgccatactcgcccagaagagcccctggactcatcgcctgcccccatgtttacacttkttaataaaatctctagaattgtggcttagacctgtaaacatccagttccaagaagtggctctaaagccctctctgggggcagagtggttgtcagaagcagaccaggcctcggggtctagattccatccttcactggaactgctgggggctggtagtaccccatctgcaaaatgaggttaaaaatacctaacccttgggttgctatcaagctcagagatgctgtatgcaaagcaccaatcagactggctcacaaagaataggccctctgtcaaatgttcatggttgagtgcgggatgtcaa

SEQ ID NO: 137485 - DNA, 601 bp, Human
ccatcccctgaggagcccagaagggatatgaacttccacccacctctcccctttcccagttctcagtgccactccttgcctaagtgcacggtaacactcgccactatttcatgtgttgatacctgcagctcccaattttcttaagaggatctgaccctgggaactgatgagggcaccaggagtgccctctcctttgacatgagaccttgagtcttgtccatggggccctggcctggcccttttcatccccaaggctgtaacattctcctgcacaacacaacacacgtgcacacacacacagacacacacacacacacaaaataatgttacttctcagtcacccgggaactgacatggttcccagttatttccttgcagcagccctccaagcggtaacacagccttggagaaagctactaagtcatgtatccttggggtaagcacacttggttcagaatagtttctgaaagaacaaaccaggtttttgctcaagagggttttgagggactggagaaaaccttagtgcttgttcctttctcttcggttaaaaaaaaaaaatccaacatagtttccttgaaacatttggaacctgaggttttgt

SEQ ID NO: 137486 - DNA, 601 bp, Human
tctggctgtatgctaagctctctagagagctttacaagggagagattctgagtgttagggctgggaaaagagcactctgtgtgatcctaacctgcagctgaaatgcagaaccactgttctcagctggagcttttcattgttttttgtttgtttgttttgttttgttttgttttgcttgtgaattgagcttactaatggaagcaggagcttgttctgtttagcgatcgtgagaaccacctaggcagcggagcctgcccttagaatctgcttcactgggctgtactgggctgggcattggcarttttaggacacatctagatgtgtcccaagcaatctgatattttgatgtttatcttacagagaagcatgtgtttagaaggcagatagctgtgcttctgttcttctgattttcgacagagacatcagaaccttccacagtcattttagtctaagtcctgaaatcgttcactgccagccctgagtctagctggactatatgcctctggttggacacgtctgccacctctgagaactgtgtggatgtaactcttctgtcttctggctcgttgtgtttccaaggagaagcttgaggcccagtaat

SEQ ID NO: 137487 - DNA, 601 bp, Human
tgacagcaaccatagggtttttctttgtgaaaaaaattataaaatacagaacagtgcagtaccacccaaattaataaatgttgttattttaccatttatgcctttatttttcctaaaagaacagtcccaataaagtggaagctataaccttttatggatgaggaagtggagagtaatctgctcaaggctggctagctggtgagcagcaggcctggctcaggcccctctggtgcccctgatttaggcttcatggccttctctaccctgcaggaattatgctggctcagctgtgcaggttggygactgcaaatatcaacccctctaataggaaaccaggcagatttttctcatgctatcagctgatttttggtatatgtaaataaaacctatgtttttgagagtagcaggaaacattttgttagaaaaccaaatgaatacagggagatatggctatcaggagctgagactgatattataattttccaagtactagtatctgtgtattgatttttacagtaatttgtactttcccatccagcttgtttgtgaccactgaggcccttggtgaatatcttagaagtcactcaaaatggataaagaa

SEQ ID NO: 137488 - DNA, 601 bp, Human
gacagcaaccatagggtttttctttgtgaaaaaaattataaaatacagaacagtgcagtaccacccaaattaataaatgttgttattttaccatttatgcctttatttttcctaaaagaacagtcccaataaagtggaagctataaccttttatggatgaggaagtggagagtaatctgctcaaggctggctagctggtgagcagcaggcctggctcaggcccctctggtgcccctgatttaggcttcatggccttctctaccctgcaggaattatgctggctcagctgtgcaggttggcractgcaaatatcaacccctctaataggaaaccaggcagatttttctcatgctatcagctgatttttggtatatgtaaataaaacctatgtttttgagagtagcaggaaacattttgttagaaaaccaaatgaatacagggagatatggctatcaggagctgagactgatattataattttccaagtactagtatctgtgtattgatttttacagtaatttgtactttcccatccagcttgtttgtgaccactgaggcccttggtgaatatcttagaagtcactcaaaatggataaagaat

SEQ ID NO: 137489 - DNA, 601 bp, Human
atcatggcaggaggtgaaaggcacttcttacatggtggcagcaagagaaaatgaggaagaagcaaaagaggaaacccctgataaatccatgagatcttgtaagacttaatcactattacaagaatagcatggaaaagactggcccccatgattcaattaccccccttccttgggtccctcccataacatgtgggaattctgggaggtacaattcaagttgagatttgggtggggacacagccaaatcatatcacccacccctggccccttcaaatctcatgtcctcaaatttcaaaaccartcatgccttcccaatagtcccccaaagtcttaactcatttcagcattaacccaaaagtccacagtccaagtttcatctgagacaaggcaagtcccttccatctctgagcctgtaaaatcaaaagcaagctagttacttcctagatacaatgggggtacaggtattgggtaaatacacccattccaactgggagaaattgtccaaaacaaagaggttacagggccaatgcaagctgaaatccagcagtgcagtcaatttttaagctccaagatgatctcctttgactccaggtcacacagc

SEQ ID NO: 137490 - DNA, 601 bp, Human
atcaaagaagatgtaagtaaatggaaaagtagtccatgttcgtacattggaagactcaatgttgttaaaatgttcattctgccaagcttgatctgtagattcaacccaatcccaatcaaaatcccagcaagctgttttgtagctaatgatgaaatgattctgaactttacttgggaaggtaaaagatctagaatacccaacacaatacccactaaaaaggacaaagttggaggactcacactactcaatttcaagtcttactagaaacagatacaatttctgcccttatgggacaaacagccattcatcaaaaattcacatgctagaaagtaaaggtaaattaagtcaaaacagtggtcagtggtacaaaaggaaagcatgttagttttgactgtggggacagggacatgtttatcctgagctcaaagggtagcctggacagtggaggatttttagcagagaaaagggccacagcttagaacatgtaggaagggagcaaggtgggggcattgacagccagagctactcaaaagagatgtggaggaaaaggatgttatgtggttttggagacaagtaggcatgtgtgggaggctgagacgtg

SEQ ID NO: 137491 - DNA, 601 bp, Human
tgcagtgggaaattaaaaagctgcttgcttcacagagtaagggaatgttagtagatgcttgaaaagtaccctgagggagctggtcagaggtgctctgtaaagttgcatctgttgctagcaccatgagcagctgtctgaccaggaggcctgggaacagggacagagagagctggcacccttctttcctctgccctacacattggcctttccgccattaagaccatctctgcttgactttttcagtctcctggctggcaattagcatcttgaggtctccattaagatcttttcaaggatgctsttcctatttggttcaatcttctggttgaatttgatacatgttatgatgtaggactttttaaaaaaacataaaacaatcaggaaaacctcgctatacccattccagcaattcaagaccaagttcatttttggtaaaaacacttgggaaagggcatttccaggctggctaagcactaaatggcacagccctgtccactgactccctcctcaactggtgtgtgttctggagggatccatgtctcagagcattacttcattttgaatgtgcaattaaaagaggccccgtgctgctggggatctc

SEQ ID NO: 137492 - DNA, 601 bp, Human
tctcagggctgaggccccttgataactaggacagatgggttaataaaaagggatacagagacataggctacctcttctggttcaatgccaagctagaaaatcctgaaatgaacacagatttatgagataggagtaatatatttaagaacacagtcttacatagagataactattttcccaaaacatccaaggtaaatttatatatctttatggatgaggttgggtcttttcagggaaggttggggagacggaagggaaattacttattatcagtcctcatgattcatggattccatatctccgcattcatctattcatttaaatctgtttgcaaccccaaaatcaatactcacagcacttttgcagtcatttgtgacgtgcacaaagcagtgaaaaatttaagtcacccaacacatacgttgaggtcgcacaaggtgacactctgctttcttgttttagctcttataaacacattttcttttctcttggcccatttagtccatggtttttgcatttttgtgcttttctggggtgattttgctatttaaaaatggccccaaacacaatgctaaagtacttactgtctggtgtctctaagtgc

SEQ ID NO: 137493 - DNA, 601 bp, Human
ttttcagggaaggttggggagacggaagggaaattacttattatcagtcctcatgattcatggattccatatctccgcattcatctattcatttaaatctgtttgcaaccccaaaatcaatactcacagcacttttgcagtcatttgtgacgtgcacaaagcagtgaaaaatttaagtcacccaacacatacgttgaggtcgcacaaggtgacactctgctttcttgttttagctcttataaacacattttcttttctcttggcccatttagtccatggtttttgcatttttgtgcttttytggggtgattttgctatttaaaaatggccccaaacacaatgctaaagtacttactgtctggtgtctctaagtgcaagaaggttgtgatgtgctttacagagaaaatacgtgtgttagggaagctactttcaggcatgagttattgtgctgttgaccatgagttcaaggttaatgaatcaacaatatatatgaaataaatatctttaaatagaaatacacataaaacaaggttctgtattgattgattgacaaaaaagttgtaaccagaggatcacaaaaacctaacaccatatttcccca

SEQ ID NO: 137494 - DNA, 601 bp, Human
gcttctttggtgtggggcagaaagaatcaaagcctgtagaataaatctgactccgttctagatttaactcctcatggtgtatcacgtgcaaggtgaagcctgactggcactagggaggattttgaggtaaggaagcattgtctttggttcagtccaagccctcactgactttccaccatcttcaggtgggggtgggcatgtccgtctgtctcccagcctcatgcacacacatgtgtgcacacacatgcacacacatgcatgccttcttatgaagtgtgggtctggctgcccgtgctttttycttcatctcaccatgacttatccttccctcttctattcaaagttcccacttgagagggtccagttgccctgggcacccctccacactccccactcatgactgaaattagttacagtggctttggtatactgtcatcccctttcaccagtgaagaactctattgctatagtgcccaggtcacacaaagctgggccgggtcgccagcgttcccgattctcacctctgtgtccctgggtttcctgctctctggcccagtggaaccacctccacggggtaccattcctttccagccttgtcttt

SEQ ID NO: 137495 - DNA, 601 bp, Human
tcattagtattagtatattttatatgtggcccaagacaatccttcttttatcagtgtggcccagggaagccaaaagattggacacccctgggctagagcaataaaatgggcacatcagatttgtgtccacaacagctgacacagtggtttccagtcaggggtaagttacccttagggaacacttggcaatatctggagacgatgtttggctgtcatgattggggaatggggtgctactggcatctagtggggagaggccagggatgctgctcaatagtctgtactagatgagacagccccygaccctacacacataacagagaaggatccagcccaaatgtcaagagtgccaaggttgagtaaccccgagctaatgtgatgaatggtgccagatggaaatgggtgggaccatcataaggagggggaacagggtaaaggcaaccatcttaatttgtaaattgagtgtgggggatgtgttttgaccacatgcttttgaaaagggaagctgttcattctccagaagcccagcggagatgttggatggatggggccacccatagctgcattcatggacagctggacacgggcccaggaaatcttg

SEQ ID NO: 137496 - DNA, 601 bp, Human
gaacacttggcaatatctggagacgatgtttggctgtcatgattggggaatggggtgctactggcatctagtggggagaggccagggatgctgctcaatagtctgtactagatgagacagcccccgaccctacacacataacagagaaggatccagcccaaatgtcaagagtgccaaggttgagtaaccccgagctaatgtgatgaatggtgccagatggaaatgggtgggaccatcataaggagggggaacagggtaaaggcaaccatcttaatttgtaaattgagtgtgggggatgtgwtttgaccacatgcttttgaaaagggaagctgttcattctccagaagcccagcggagatgttggatggatggggccacccatagctgcattcatggacagctggacacgggcccaggaaatcttggcagcgtcactggggccggtgcacttttaagaggagcttgggtgatatgaaattgtttggacaaaatgagtgagaggtcttgaaataatgtcaaggcaggaagaatgcattgacttggagtggctgccaagagcaagcatttgcaggttgttttggggaagcagaactggctgtgt

SEQ ID NO: 137497 - DNA, 601 bp, Human
cacataacagagaaggatccagcccaaatgtcaagagtgccaaggttgagtaaccccgagctaatgtgatgaatggtgccagatggaaatgggtgggaccatcataaggagggggaacagggtaaaggcaaccatcttaatttgtaaattgagtgtgggggatgtgttttgaccacatgcttttgaaaagggaagctgttcattctccagaagcccagcggagatgttggatggatggggccacccatagctgcattcatggacagctggacacgggcccaggaaatcttggcagcgtcaytggggccggtgcacttttaagaggagcttgggtgatatgaaattgtttggacaaaatgagtgagaggtcttgaaataatgtcaaggcaggaagaatgcattgacttggagtggctgccaagagcaagcatttgcaggttgttttggggaagcagaactggctgtgttctctttgtcctgtgcacagttggaagacgggaaatggaggaggagagatggggaaggagagatggggaatcagataagaaagtgttttccaacagaagcatcggcacacattggagtgagttcccttccctta

SEQ ID NO: 137498 - DNA, 601 bp, Human
gcgatgtgatgtggatggagaggttccttgtgagcctcactccaccttcagggtagggaattgtcagtaaggaaaggaaggaccaggtgagacttccaatacctgagagatggcggtggcttccacgagggcagcctcaggagctatggggagacatgatggcttgggaatatattttaaagaaaagctactcagaggacctggagaccagctcatctaacctgcttcaagattctccatccctgtgactgcatcagatggagctcagctcctgcacaagctcatggcttccctgcatcastgtgagtggccaatgcttctggtagaaagcacattcctttctgacttggtgagagggaagactcctgaaagcagccagggtctcatcctcagcaactgtggtgctcaatgtcatttcctcaattaggagagactgagggaggaagagatttgctgagggagtggcaggaggagtcaaaagcctcatctggagtatgtggaggtcaacttgtctgttacacatccaaggggggacgtcagataagcagacatgcagatcaggagctcagtggagagaaataaatacccattaaccaacaaa

SEQ ID NO: 137499 - DNA, 601 bp, Human
tgacactgagtgcagcacattcttctgccacctgcttgcgaacatatctgcaatgcaccatcaaagccacacagagtgtccctggcgtgtgcctggaggttgctccgggtctgcagatgctccccaagacccgaccacagcctgtctcacttcctttccattcacttcaatatgggattcatgcccaagtgccagcaccgatgtaatgattagtgacaagccaatgaatttttaaaatagtagctatgttaagatttatatgaattaaaaagtatttgctctcattttatttaaaattttkttcctacaaagttactgtctcagtttgagctgatggtgcagtctgctgttctgcaactacataaaaagtaacctgggccctgcagaggggacacaagcatcggggccaggtacacagtgacaggggtatttgagctgggtctgtaaggatgactgagatggctgggaggaagagctgcacgcctcagcagaaagcacacgtggtgagaacaagaagggaaagccacagcatcccggtgcagtccagtgtggtctgtggactgggcatgttggaataggcaggaagggctgatgtgcgctt

SEQ ID NO: 137500 - DNA, 601 bp, Human
gctccccaagacccgaccacagcctgtctcacttcctttccattcacttcaatatgggattcatgcccaagtgccagcaccgatgtaatgattagtgacaagccaatgaatttttaaaatagtagctatgttaagatttatatgaattaaaaagtatttgctctcattttatttaaaattttgttcctacaaagttactgtctcagtttgagctgatggtgcagtctgctgttctgcaactacataaaaagtaacctgggccctgcagaggggacacaagcatcggggccaggtacacagygacaggggtatttgagctgggtctgtaaggatgactgagatggctgggaggaagagctgcacgcctcagcagaaagcacacgtggtgagaacaagaagggaaagccacagcatcccggtgcagtccagtgtggtctgtggactgggcatgttggaataggcaggaagggctgatgtgcgctttgagggaggaccgggcagctggagagggaggcgtcaggaagcaggagggcagaaggtgaggagtgaagggcagcagtggaaaggacagggttacgccaagcagtggtcatggatatgg

SEQ ID NO: 137501 - DNA, 484 bp, Human
ttttgcttctgaaatgtatttatttactgcaagcagtgtctctcctgtgtcagatgtcctcgtgggctgggaaccggcactatctctttagcacgggccctgcagatgggaagtggcgttgcccaggaagtggtctggagaagcggggagaagacagcctatgggccccaggcctcgggagccrgggagggtgtcactcttcatgtctcaggcagtggcttgttgctatcatagccccgggctggaggtgggaaggccttatggtgaccacaagtcacagttccgtgtgggccctcaacgtggcctcacttcacctctggggctcagcaccagcgtgtgactgactgctcgaggcagcgtctcgcagctcaggtgggtgaggtggtggtagcgtcctccttggtaatatcactgtgatgaggagcaaggcttctctaacattgtctggactcaggaggagcagttggtttgttctcatgtagat

SEQ ID NO: 137502 - DNA, 601 bp, Human
acacactgataggcacttgattttatggcttcctaatatctcttgcagaactttctgtgtcaacactcatatagttgcatcacccgttctttggctatctggtatcacctgctatgcaccacaatttatttaactagtacctattgatggacacatttgctgtttatgaataaacgctgctaacaacattgctctagacctatcgtatactacacttgtatgcaacgtctgcaggataaactttgaaagggttgggattgccacagcaaaggatatgtgtgtttatttttttattttttatttttttgagacagagtcttgctctgtcacccaggctggagtgcagtggcatgatctcagctcaatgcaacctctggctccaaggttcaagcgattctactgcctcagcctcccaagtagctgggattacaggcatgtgccaccacacctggctaatttttgtatttttagtagagatggggtttcaccatgctggccaggctggtctcgaactcctgacctcaagtgaaccatcctccttggcctcccaaaatactgggattataagcgtgagccaccgtgcccggccatgttattttta

SEQ ID NO: 137503 - DNA, 601 bp, Human
ctggtatcacctgctatgcaccacaatttatttaactagtacctattgatggacacatttgctgtttatgaataaacgctgctaacaacattgctctagacctatcgtatactacacttgtatgcaacgtctgcaggataaactttgaaagggttgggattgccacagcaaaggatatgtgtgtttatttttttattttttatttttttgagacagagtcttgctctgtcacccaggctggagtgcagtggcatgatctcagctcaatgcaacctctggctccaaggttcaagcgattctmctgcctcagcctcccaagtagctgggattacaggcatgtgccaccacacctggctaatttttgtatttttagtagagatggggtttcaccatgctggccaggctggtctcgaactcctgacctcaagtgaaccatcctccttggcctcccaaaatactgggattataagcgtgagccaccgtgcccggccatgttatttttatttatacacttgaaagtacttaagtaatgtgtaaaggtctttctggttttatttactgaatgaatgagtgaataagttttgatcctgttttaccatgc

SEQ ID NO: 137504 - DNA, 601 bp, Human
tgaaagggttgggattgccacagcaaaggatatgtgtgtttatttttttattttttatttttttgagacagagtcttgctctgtcacccaggctggagtgcagtggcatgatctcagctcaatgcaacctctggctccaaggttcaagcgattctactgcctcagcctcccaagtagctgggattacaggcatgtgccaccacacctggctaatttttgtatttttagtagagatggggtttcaccatgctggccaggctggtctcgaactcctgacctcaagtgaaccatcctccttggyctcccaaaatactgggattataagcgtgagccaccgtgcccggccatgttatttttatttatacacttgaaagtacttaagtaatgtgtaaaggtctttctggttttatttactgaatgaatgagtgaataagttttgatcctgttttaccatgccaggactcgagatagattggaaatgccttctgcatcattttcatttttcctcggtatggtttactctgctttgctctccatgtggcagggtcaggctctggagcaggccatcatcagtcagaagcctcagctggagaagctgatc

SEQ ID NO: 137505 - DNA, 601 bp, Human
tattttttatttttttgagacagagtcttgctctgtcacccaggctggagtgcagtggcatgatctcagctcaatgcaacctctggctccaaggttcaagcgattctactgcctcagcctcccaagtagctgggattacaggcatgtgccaccacacctggctaatttttgtatttttagtagagatggggtttcaccatgctggccaggctggtctcgaactcctgacctcaagtgaaccatcctccttggcctcccaaaatactgggattataagcgtgagccaccgtgcccggccatrttatttttatttatacacttgaaagtacttaagtaatgtgtaaaggtctttctggttttatttactgaatgaatgagtgaataagttttgatcctgttttaccatgccaggactcgagatagattggaaatgccttctgcatcattttcatttttcctcggtatggtttactctgctttgctctccatgtggcagggtcaggctctggagcaggccatcatcagtcagaagcctcagctggagaagctgatcgctaccacagcccatgaaaaaatgccttggttccatggaaaaatctct

SEQ ID NO: 137506 - DNA, 601 bp, Human
ctgggttctgtttgctatcctcagtggttcagtgtaaatctaaattgtagaaggttctgagatacaggccaacgtggtcagtcagttgtccagagaaggtaaagaactgtctttgggaggtgtcaaccttgttccctcgagggggtctggtcaaggtggctcagtggggcagttgtccctgggggaaatgatcccctggtcacctctcagtgtccctacagagatgcttaccttggaaacataaccagaaacagcgatgcagcctcatggtttggcaattggtgaatccccagccgacttygtaaacttttcctagatttagaagcgttttctctgcctgtccatctattcaaaggaatttcctcagacttcactgtcataccttgtattttaaaaatgatcttagctgagtgcagtggcacgcacctgtagtcccagctactcctggcaggaggatcgcttcatcctcactatgatctcactatcgtttgaggctagtttgagaccagcctgggcaacatagtgaggccctgtctcaaaaaaagaaaaaaagaaaagaaaaattgaccacaatactcttaaaaaaaaaaaaaaaaaagga

SEQ ID NO: 137507 - DNA, 601 bp, Human
agcctcatggtttggcaattggtgaatccccagccgacttcgtaaacttttcctagatttagaagcgttttctctgcctgtccatctattcaaaggaatttcctcagacttcactgtcataccttgtattttaaaaatgatcttagctgagtgcagtggcacgcacctgtagtcccagctactcctggcaggaggatcgcttcatcctcactatgatctcactatcgtttgaggctagtttgagaccagcctgggcaacatagtgaggccctgtctcaaaaaaagaaaaaaagaaaagaaaaattgaccacaatactcttaaaaaaaaaaaaaaaaaaggaagaaggaagagtggcccaggttgccacgcggcagtgcctagagtgatggtctttagtgggatgcagccccagccagcagcagaatgctgtggggagggaagacattgcccctcagtggaggcacctatggctatttttgctgaggtttggcttcttaccatctcagcaataatttccaacatgaatgtcatgggaccatgcacatagcatcttggcatgtgaagtcaacccaaaatagcataatccacacgatgaggctg

SEQ ID NO: 137508 - DNA, 601 bp, Human
ggtgaatccccagccgacttcgtaaacttttcctagatttagaagcgttttctctgcctgtccatctattcaaaggaatttcctcagacttcactgtcataccttgtattttaaaaatgatcttagctgagtgcagtggcacgcacctgtagtcccagctactcctggcaggaggatcgcttcatcctcactatgatctcactatcgtttgaggctagtttgagaccagcctgggcaacatagtgaggccctgtctcaaaaaaagaaaaaaagaaaagaaaaattgaccacaatactcttaaaaaaaaaaaaaaaaaaggaagaaggaagagtggcccaggttgccacgcggcagtgcctagagtgatggtctttagtgggatgcagccccagccagcagcagaatgctgtggggagggaagacattgcccctcagtggaggcacctatggctatttttgctgaggtttggcttcttaccatctcagcaataatttccaacatgaatgtcatgggaccatgcacatagcatcttggcatgtgaagtcaacccaaaatagcataatccacacgatgaggctggccaacttctgctggttaag

SEQ ID NO: 137509 - DNA, 601 bp, Human
ggaggcacctatggctatttttgctgaggtttggcttcttaccatctcagcaataatttccaacatgaatgtcatgggaccatgcacatagcatcttggcatgtgaagtcaacccaaaatagcataatccacacgatgaggctggccaacttctgctggttaagaagcctgctcatagcctctttggccacgaagctgtttcttttttcggagttgtctattcccgaaaacagcagttgcatccttcatggccatgacttttgctctctccttcctttctgggagatgtatataaaccccrtgcagaaggctgggaggtgcagctcttgtttgatgaacatgccttgttccctatctgccctgtacagactgacatctcatgtgtcctcacagcacatgtccctgacactgaggcttatggtttatgcaagagagtctcaaacttgccgtgcttcctattcagctggtgtcagagctaaccaggcatgggcctgtgagagaggggcctgggcttctgtgttttcatcgagcaccctctccttagttgtcttcttctcctgggttcttattcctgggttcttattctcctgggttcttattc

SEQ ID NO: 137510 - DNA, 601 bp, Human
tgctccctccacacctgcagggctcacctgtggactgatggtgcatagcaccccatgcccaggcctggcatcaggcagggtattagtgagagggaagagcagagctaagcctgggcagcaagacccagcttcagaacccatgttcccatgatggttgtagaaccttagactaagggaaactttccccaggctctgctcctctgggtctgtgactgtcttgaggattcaatgaaaatacacaccacgtacaccgcacagcacatgtggtcatcactgatgtagcttttcttctctcttcagygctctttctccatcatgagcaccaggaaagtctccttgtcagggtatcttatggtgtttttaacagagaaagtgtgaggaaacaccttggaggggtttgccacctggcaatttcacctcttgacaacctttcatctcctacagaacctggctggggttcttggctgttgctgggtgtgtaaaccttccttgttgcagtgtagtgggcgtgttatactgtgagtgtttgaatatggttgtgtatgcttgtggagagcagggagagtttgccagcatactggatacagtccaagtctaccat

SEQ ID NO: 137511 - DNA, 601 bp, Human
cctgaatacaacgtctcccaagtccaggttgcctagacgttggtccagattctttcatctttagaagtgtttgtttgtgtgtttctttcatgggaaatagagctaaaaggctccagggaactcttgtaaaccatcaccagatcctgtggctgccctctcagtgtgagtgcgtcagctcctgattcactgtgggagtctgtcctatattcccctgttgggtcaggccaacgttgcaggaagtcccagacctggttttgaatcatccaaatctgccctacttgcagatagttttataaaatgyacattatttgcaacgaatagccacagcacaaggtctttggagtcagaactagattccagtcactgctggatgtcctcactgagccagctgctgtttttttcccactgttcttctcgggccttcattcagattctcctaacgaatgtgctcatgtctactttccaatcatcatgtcagctaatccatccatggaccaacattactggagtctgtagttgcatgaagcactaagtgccaggcaccattctggactttgggaagggagaagtgaatcagcaagcacctgccctcatggaccct

SEQ ID NO: 137512 - DNA, 601 bp, Human
cagctgacattcggtgggctctgcctggctgccacatcatcggtttgctgtggggagttgtgcctgtacatatacttgcaaaccaaatgtgttgatttttttatcgtgatttcagggccttcactttctcatgcctgagcatcagtcagtttgtctccgctctgatctcctgtccaccccacccaccgtgcttttacctgggtcctgtacaggcctgtgggctggcccttaagaggttttcaatgaatgcttgtcacctaaatcaatgaattgtttggatccattctccatctcccagctygtttttgctttccacttcctgacatgtagtaataccactgtagttctgtatgggggcagctccacacctgtctatgttggggagggaatggggattcttgcacctctttctacctcctcttaaatcattactgatggacagatgcagggacacagcaatagatatagaaatataaaaacatgacactgcgcactctatggtttgtaagattcactttctctgggtaggaggcagtgtggcctgttaacaacataccattcgggttgtctggcctcaaatgctggctccaccttatcacca

SEQ ID NO: 137513 - DNA, 601 bp, Human
gatctcctgtccaccccacccaccgtgcttttacctgggtcctgtacaggcctgtgggctggcccttaagaggttttcaatgaatgcttgtcacctaaatcaatgaattgtttggatccattctccatctcccagctcgtttttgctttccacttcctgacatgtagtaataccactgtagttctgtatgggggcagctccacacctgtctatgttggggagggaatggggattcttgcacctctttctacctcctcttaaatcattactgatggacagatgcagggacacagcaatagawatagaaatataaaaacatgacactgcgcactctatggtttgtaagattcactttctctgggtaggaggcagtgtggcctgttaacaacataccattcgggttgtctggcctcaaatgctggctccaccttatcaccagctatgggaccttgagcaagttactcagtggtctgtttccttcatttctttgtctgtaaaatggctttaatgtcatctctgactcttagagtcattgagggttatagagtatcataaaccgaaggcctgctgcacggtgcttggcaccgaacgaagcagcttc

SEQ ID NO: 137514 - DNA, 601 bp, Human
atgaatagatagagtgagagtcactggccataaaaggattcacactaggcttttgcttttatgaagtgacagacttaaataaagaataattatttcggccgggcatggtggctcatgcctgtaatcccagcactttgggaggctgaggcgggcaatcacaaggtctagagatcaagaccatcctggccaacatggtgaaaccccatctctactaacagtataaaaattagctgagtatagtggtgtgtgcctgtagtcccagctacttgggaggctgaggcaggagaatctcttgaacccrggaggcggaggttgcagtgagccaagattgtgccactgcactccagcctgggcaacagagcaagactccatctcaaaaaatatatatattattattattattatttcacagagggggttggaagtttatttttgcattgcaagccataaactaatcaagaggattttactagtttggtggataatatgggtaaacaaaatcccagcgattactcttcacactttcatcgtgagtaccaatatgctgtctccaccattcagatgccagcatttcagtctgagaatcgctttacgtggaaag

SEQ ID NO: 137515 - DNA, 601 bp, Human
cggatcccagttttctctcctcagaactatatgtgaaatccacttacagtgagagtacacctgagctagagggcatttaccacttaagggggctaaacttattgtttttcaaacaagaactcgggtgtggaggagcttgtccaaggcaggaaggcaaaaccaggtccctgatgttgtctggggctaagcagaaacagcagccagcaaccaaatccatctccagatggatccatctccacaaccacaggcccctccctattccccatgcaagatgcagcaccagggcatgtccatgtgaaawctcagaacacacagaggcgtccatcagctttcccctctcttgtgtcctgtccacagagcttacccacaccattcaggagtgactttgagaaggtagttacagggcctttgcacatgtgcttgaagaataacgaatataaacagaggctctttgtggaggggctgggcagtgtgggtcagtggttgtccctcacagccgcctgtggcatttctggaggtgatgttcatcacctggcctttgctatataagcactgcccttgtctggggtctagctggccagaagcgagcactggaggggga

SEQ ID NO: 137516 - DNA, 601 bp, Human
ggcaaaaccaggtccctgatgttgtctggggctaagcagaaacagcagccagcaaccaaatccatctccagatggatccatctccacaaccacaggcccctccctattccccatgcaagatgcagcaccagggcatgtccatgtgaaatctcagaacacacagaggcgtccatcagctttcccctctcttgtgtcctgtccacagagcttacccacaccattcaggagtgactttgagaaggtagttacagggcctttgcacatgtgcttgaagaataacgaatataaacagaggctcttkgtggaggggctgggcagtgtgggtcagtggttgtccctcacagccgcctgtggcatttctggaggtgatgttcatcacctggcctttgctatataagcactgcccttgtctggggtctagctggccagaagcgagcactggagggggagtcctccagcccacgtttggtgggtgagggtcagagtgctgccttgttggtgacgtcagggaccaaggcaagggagaggagctgagtggggaaggagatcccctgcccccagaggccttgtatagcagcacagtttgctattttgagaagct

SEQ ID NO: 137517 - DNA, 601 bp, Human
ggagtcctccagcccacgtttggtgggtgagggtcagagtgctgccttgttggtgacgtcagggaccaaggcaagggagaggagctgagtggggaaggagatcccctgcccccagaggccttgtatagcagcacagtttgctattttgagaagctagtcacagctgtctgtgaaaaatgaatttgttaggaaaaggaaacaaagcttactttataaaaattatatatcccttccccaaaagggaggatccaggattgaggggtccgaagcatatacaatttgaagactctcttattttttwaaaaatataaaattaggcatacaatagaatgtattttttggactaaggaaaaaaattcaataaattagaatttttttaaaggctggtcaatactacaagcatacaaactttagaaaagataatgtaatattttaattaactgcctgacacgtctctataacaccttttgtttcctccatgtccttgacttcactgtgtttgactacatcttagttcaacaatatttaataatatatttgtctatatatagaaaaagagactattcattccttcctctaggttcacacttcattattaata

SEQ ID NO: 137518 - DNA, 601 bp, Human
cacgtttggtgggtgagggtcagagtgctgccttgttggtgacgtcagggaccaaggcaagggagaggagctgagtggggaaggagatcccctgcccccagaggccttgtatagcagcacagtttgctattttgagaagctagtcacagctgtctgtgaaaaatgaatttgttaggaaaaggaaacaaagcttactttataaaaattatatatcccttccccaaaagggaggatccaggattgaggggtccgaagcatatacaatttgaagactctcttatttttttaaaaatataaaatwaggcatacaatagaatgtattttttggactaaggaaaaaaattcaataaattagaatttttttaaaggctggtcaatactacaagcatacaaactttagaaaagataatgtaatattttaattaactgcctgacacgtctctataacaccttttgtttcctccatgtccttgacttcactgtgtttgactacatcttagttcaacaatatttaataatatatttgtctatatatagaaaaagagactattcattccttcctctaggttcacacttcattattaataatatcatgtacatt

SEQ ID NO: 137519 - DNA, 601 bp, Human
tctggaggaggctgtgatcaactcctctctgaccctcatccacttggttcacacaatgtggtttattgccattgtgcacagccaattctcccacacacatcgctctgctaaaatgtaatgggatgtggccttcatttcatcttataaatgatcttagaatggaaatgctctaaaaagtccatgccaggcaaaattttaaagatggaagtattgtttctttgtattaagtgtattgtttttggctaagagtccttgtaaatcttacaaagccaagaacaatttcaaggtgacctttaagacrcataagtggctgctctccaaatagctcgattaatgttaaaaataaaaggtagtatttcagatttgtggatggagtcgtccaaccagtaagtcaccaatgctattttaactacagtttctaccttctgactttagaaaaaaaagttacaaaaacagtcattcattcaacaaaataggcatgttttcaaccagacatgcagcaggcattgtgataggacttggctactgtgaggaataagtcagaccttagtccctgccctcaccggactttgactgcagggggaagatgacaaacgcaagc

SEQ ID NO: 137520 - DNA, 601 bp, Human
gctctccaaatagctcgattaatgttaaaaataaaaggtagtatttcagatttgtggatggagtcgtccaaccagtaagtcaccaatgctattttaactacagtttctaccttctgactttagaaaaaaaagttacaaaaacagtcattcattcaacaaaataggcatgttttcaaccagacatgcagcaggcattgtgataggacttggctactgtgaggaataagtcagaccttagtccctgccctcaccggactttgactgcagggggaagatgacaaacgcaagctgatgtgctgcraagtctgcaatgcatggcagtaggtcccctccaccacgacactgggcctacgcagcatgatcttgattttgttttcatttacttgtttatagtccccacccccacttgtgctggatgcacaagggcagagatggggctgttgccttcacgagtgcaacccagcacctagaacatggtcttggtgggaaaaatctctctgggtaaaggaacattctggctgctaacttgaatggtggccactacttggataggaggagggacaacatggttcatcgggcctgtctcaggtgcccaggctgg

SEQ ID NO: 137521 - DNA, 601 bp, Human
gaacattctggctgctaacttgaatggtggccactacttggataggaggagggacaacatggttcatcgggcctgtctcaggtgcccaggctggactatcatctagtgtgtcgctaactataggaactgggaagtggccttcagagcaagtgggctgactggatttggcagagcttgacacctcaccaggcagatgcaacaaaagagcagggcagacccagccatcccattactgggtatatacccaaaggactataaatcatgctgctataaagacacatgcacacgtatgtttattgcrgcactattcacaatagcaaagacttggaaccaacccagatgtccaacaatgatagactggattaagaaaatgtggcacatatacaccatggaatactatgcagccataaaaagtgatgagttcatgtcctttgtagggacacggatgaaattggaaatcatcattctcagtaaactatcgcaaggacaaaaaaacaaacaccgcatgttctcactcataggtgggaactgaacattgagaacacatggacacaggaaggggaacatcacactctggggactgttgtggggtgggaggagc

SEQ ID NO: 137522 - DNA, 601 bp, Human
tggggtgggaggagcggggagggatagctttaggagatatacctaatgctaaatgacaagttaatgggtgcagcacaccagcatggcacatgtatacatatgtaactaacctgcacattgtgcacatgtaccctaaaacttaaagtataataataataaaataaaataaaataaaaaagaaaaaaaagagagcagggcagcaagagattcacggggtagcatgggtatggtggccagggcaggcctggatgcctgcaggagagggagggaagtgaagcggtggatgccgagtgggtgtgcrggagcccgggcatctacagaaccccagtccgagccccaggaggcagcaccatgtcatggtcacgtggtgccctgagaccattttggtgccctgagattctatggatggtggcagagttttccttgatggtggcagactggccgggtggtggagggattggcacgtggctgccccaggccacaccatgaggtgttgagagagatcctggctgctcagctgccccgagtgtgcagcatggagcaggggcggctgctctgacggctcacagcaggagaggcacctggagagctgggctgtgat

SEQ ID NO: 137523 - DNA, 601 bp, Human
gagggagggaagtgaagcggtggatgccgagtgggtgtgcaggagcccgggcatctacagaaccccagtccgagccccaggaggcagcaccatgtcatggtcacgtggtgccctgagaccattttggtgccctgagattctatggatggtggcagagttttccttgatggtggcagactggccgggtggtggagggattggcacgtggctgccccaggccacaccatgaggtgttgagagagatcctggctgctcagctgccccgagtgtgcagcatggagcaggggcggctgctctgacrgctcacagcaggagaggcacctggagagctgggctgtgatcaggcccagtagtttgcagatgtctggagagaaactgagtcagagaggaagcccaggaggttgtgagcctcagcgatctgagaggcatgcatgttgaagagtgagtgaggaggatgggaagcctgcaggcttggtgggtcctaaagttgcaagaacatcactgtcccctgcagctaagtgggcctgatgtactccactcaggccacagttgctgtacatgatctcttgggaccctagaagtgctcctttccatgatagct

SEQ ID NO: 137524 - DNA, 601 bp, Human
gaggttgtgagcctcagcgatctgagaggcatgcatgttgaagagtgagtgaggaggatgggaagcctgcaggcttggtgggtcctaaagttgcaagaacatcactgtcccctgcagctaagtgggcctgatgtactccactcaggccacagttgctgtacatgatctcttgggaccctagaagtgctcctttccatgatagctctttaatacattagttaaaacgattcccaggaagcccttgttccaagtatgcaggatcagataaaaagcgcagaaaccctcagagcagggaccgackgtgagtgcagtttgccctcagaggccttggtagtcaccccttcccaacccccatgccaccactgaatccccatgtggcttgttcttatatgccctgcagctgaaattcaggtgccctcctgaccttccttcccctgtccattttgaaaagaaataagcagtgtaatctttgagtcatcccttttgtactagccaagttccaggtgcagcatgacacactcgttatctccacctctcttctccccttcctttccctcatgtctgcacacactcccatcccctcacttcttccccctacagc

SEQ ID NO: 137525 - DNA, 601 bp, Human
tgcctgattgatattaatctgtgggaatcctgagtattcgatgctgggaacactttcctccagagttgaaggggatttcctcttcacaggtccttgctttaaggtgggaatcccacatccaggtgctcactgggctgctggcctgagattctgtccctgtccacagctgtgctgatattggcattggccctttggccaaacccactttaattgctctcatttgccactcactttttgctgttcaagtttcaactcactttttgtcctatacttcaatttcaaaagtgaatttgcggcttakgaaaaaccttttccttgttcattgaggaatgagactgtgttaggctgtcacgagcctcctttgccacaacaaaaactctgttccatcagtgctttcatatgctgccgtaattgatcaaagtatgccattttatttgacacatgtggttttgcagacctaggtcatcataaagagtcatgacctgtctgaagttaaaacttcaaagagagttgtgggctgatgtcaatatcacttcattgatgctgatcaaagtctccttgaagctgaaagacaagatgcgttaaataattccaccttcat

SEQ ID NO: 137526 - DNA, 601 bp, Human
cattgaggaatgagactgtgttaggctgtcacgagcctcctttgccacaacaaaaactctgttccatcagtgctttcatatgctgccgtaattgatcaaagtatgccattttatttgacacatgtggttttgcagacctaggtcatcataaagagtcatgacctgtctgaagttaaaacttcaaagagagttgtgggctgatgtcaatatcacttcattgatgctgatcaaagtctccttgaagctgaaagacaagatgcgttaaataattccaccttcatgaactaaagcagagggagaraatgagagggcgtttgtaataaaatgttttaaacgacaggtgtgttaaaacagcttggtgtggcctcagatagggattgtgtactgatcttgctcttctttgtgtggaatgcacatgtgcctcagtagtgctatggcgcaaggcagaagcactcagaagttgcattatctatatctttcatggatcagtaaagctggcatttctcctgcctcttgctgacatacacactgttcaggacctcattcgctcccacatcctcctcttcccctctcccagctctctttgagaaaccactgttgg

SEQ ID NO: 137527 - DNA, 601 bp, Human
taaagctggcatttctcctgcctcttgctgacatacacactgttcaggacctcattcgctcccacatcctcctcttcccctctcccagctctctttgagaaaccactgttgggagatggctctgagtgagaactgcccacccaacccagcacaggccccctctgtccatctgcccagcccaccttagccacagtgagcattcatcctttgcacatctaatgcacacagccaatcccaggcatcttccttccccttgtatgagtctgacaactgacccggtgatactctactctgccatggaaaaaaaatggcaggggagaatgagaacacctagtgggctggaatgtgcccggcttttctgttccgtctacagcagatacaggcagtgtccccgtagccctggggaggccaccttgagtgcctcactacttcttacatcctcactttccccttggtgcccgggcatcacctctgtatattctctctcccctaggagggtgcaggagagtagaggagtccagcccttccaggccatgccccagcagagtcaacatgcctcacctttggatagtgttctagtgtctgtgaggcacaaggcctg

SEQ ID NO: 137528 - DNA, 601 bp, Human
ctctgtccatctgcccagcccaccttagccacagtgagcattcatcctttgcacatctaatgcacacagccaatcccaggcatcttccttccccttgtatgagtctgacaactgacccggtgatactctactctgccatggaaaaaaaatggcaggggagaatgagaacacctagtgggctggaatgtgcccggcttttctgttccgtctacagcagatacaggcagtgtccccgtagccctggggaggccaccttgagtgcctcactacttcttacatcctcactttccccttggtgccygggcatcacctctgtatattctctctcccctaggagggtgcaggagagtagaggagtccagcccttccaggccatgccccagcagagtcaacatgcctcacctttggatagtgttctagtgtctgtgaggcacaaggcctgctcaccccagaggccaaggctgcctaccctgggaaagtagacatgccgcaggtcaaggactgtctcaagaccagttaggacagcttctcagcatcatctcaagctcaagccctggaaatctcaggctttgcaatagcaaaacacaaatctgttaactta

SEQ ID NO: 137529 - DNA, 601 bp, Human
acaactgacccggtgatactctactctgccatggaaaaaaaatggcaggggagaatgagaacacctagtgggctggaatgtgcccggcttttctgttccgtctacagcagatacaggcagtgtccccgtagccctggggaggccaccttgagtgcctcactacttcttacatcctcactttccccttggtgcccgggcatcacctctgtatattctctctcccctaggagggtgcaggagagtagaggagtccagcccttccaggccatgccccagcagagtcaacatgcctcacctttgsatagtgttctagtgtctgtgaggcacaaggcctgctcaccccagaggccaaggctgcctaccctgggaaagtagacatgccgcaggtcaaggactgtctcaagaccagttaggacagcttctcagcatcatctcaagctcaagccctggaaatctcaggctttgcaatagcaaaacacaaatctgttaacttactcctcccaagacaattactgggaaaaaatattttgtaaatattcaaaggcttctgtgaacagcctgaggccagatgaccctgaaggcggaaggcagcaagccagac

SEQ ID NO: 137530 - DNA, 601 bp, Human
tagacatgccgcaggtcaaggactgtctcaagaccagttaggacagcttctcagcatcatctcaagctcaagccctggaaatctcaggctttgcaatagcaaaacacaaatctgttaacttactcctcccaagacaattactgggaaaaaatattttgtaaatattcaaaggcttctgtgaacagcctgaggccagatgaccctgaaggcggaaggcagcaagccagacaggagccaggagccttgcctgtgtgcacgccctctctgggtgtctgtagagccataagcctgggtgggtgtsctgatgccaccaccagggcaaagctctcagtaagaggacacagccaagaggaggagcaagccttccaaatcagtttgtctcctatgtttaattaaaaatagcctggtccaggatctgcctgcagccaacagatacctcacagttgctggtggttaatgtcgcgagccttctggtctttgccacctacagatgctgggcctgtgggtttcctttctctgctcttgtttcctgccacctgccacagggggctgcccaggccacatgtccatggtcactacctataccttccagttacctgtt

SEQ ID NO: 137531 - DNA, 601 bp, Human
aaaacacaaatctgttaacttactcctcccaagacaattactgggaaaaaatattttgtaaatattcaaaggcttctgtgaacagcctgaggccagatgaccctgaaggcggaaggcagcaagccagacaggagccaggagccttgcctgtgtgcacgccctctctgggtgtctgtagagccataagcctgggtgggtgtcctgatgccaccaccagggcaaagctctcagtaagaggacacagccaagaggaggagcaagccttccaaatcagtttgtctcctatgtttaattaaaaatrgcctggtccaggatctgcctgcagccaacagatacctcacagttgctggtggttaatgtcgcgagccttctggtctttgccacctacagatgctgggcctgtgggtttcctttctctgctcttgtttcctgccacctgccacagggggctgcccaggccacatgtccatggtcactacctataccttccagttacctgttgccaggactggccagggctgcttggtggagcacaggaagagaggggatcgcctgcagaacctgtcctcttgaagagcctcaaggaagtgaggcctttgca

SEQ ID NO: 137532 - DNA, 601 bp, Human
ccaagacaattactgggaaaaaatattttgtaaatattcaaaggcttctgtgaacagcctgaggccagatgaccctgaaggcggaaggcagcaagccagacaggagccaggagccttgcctgtgtgcacgccctctctgggtgtctgtagagccataagcctgggtgggtgtcctgatgccaccaccagggcaaagctctcagtaagaggacacagccaagaggaggagcaagccttccaaatcagtttgtctcctatgtttaattaaaaatagcctggtccaggatctgcctgcagccarcagatacctcacagttgctggtggttaatgtcgcgagccttctggtctttgccacctacagatgctgggcctgtgggtttcctttctctgctcttgtttcctgccacctgccacagggggctgcccaggccacatgtccatggtcactacctataccttccagttacctgttgccaggactggccagggctgcttggtggagcacaggaagagaggggatcgcctgcagaacctgtcctcttgaagagcctcaaggaagtgaggcctttgcagaaactgcttgttccaaagcaaagggca

SEQ ID NO: 137533 - DNA, 601 bp, Human
ggaggagcaagccttccaaatcagtttgtctcctatgtttaattaaaaatagcctggtccaggatctgcctgcagccaacagatacctcacagttgctggtggttaatgtcgcgagccttctggtctttgccacctacagatgctgggcctgtgggtttcctttctctgctcttgtttcctgccacctgccacagggggctgcccaggccacatgtccatggtcactacctataccttccagttacctgttgccaggactggccagggctgcttggtggagcacaggaagagaggggatcrcctgcagaacctgtcctcttgaagagcctcaaggaagtgaggcctttgcagaaactgcttgttccaaagcaaagggcactctctgtttcctctgggttgctctctatttcctcctggtaccagctctctttttatactgcttttattgtgaaatataaaacaaacacataagagtgcataactaaataggtacaacttaatgaatgattatcaagcaaacacaacccagtcaagaaatgaaatgcacccagcattgcaggagaccactccgccctcacacactcatacccatctgtacag

SEQ ID NO: 137534 - DNA, 601 bp, Human
ccttggggtgcatagtgcacacatttcatacacctaggggtggaattgctcattcacgaggtctgtgaatgaataagttcagtttcaggagactgttccaaattgttttccaaagtgggtgagcccatttatgctcccacaagcaacgtaggaggggccttgctgctccccactctcagtagcacttagaatgatctttctaacttccaccagtctgaagagcgtggaatggtacttccctggggtcttcattcatgtttgccagatgcctaatgaggttgatggcatcatctctcagggmaacctgtgcttgtctgtctcagtttttaacaagaaaatgtcaatcaagacatagggtaagatggagtacagcagattggacatggattcagaaaccagagttcagatcccatttattactactatctttttttctggagagatggcgtctcactctgttgcccaggctggagtgccatggtgcagtcttggctcactgcagctttcacctcctgggctcaagtaatcctcctgccttggcctcccaaagtgctaggattacagatgtgtgccactgcacctggttcagatcccatgtatt

SEQ ID NO: 137535 - DNA, 601 bp, Human
tttatgctcccacaagcaacgtaggaggggccttgctgctccccactctcagtagcacttagaatgatctttctaacttccaccagtctgaagagcgtggaatggtacttccctggggtcttcattcatgtttgccagatgcctaatgaggttgatggcatcatctctcagggaaacctgtgcttgtctgtctcagtttttaacaagaaaatgtcaatcaagacatagggtaagatggagtacagcagattggacatggattcagaaaccagagttcagatcccatttattactactatctttttttctggagagatggcgtctcactctgttgcccaggctggagtgccatggtgcagtcttggctcactgcagctttcacctcctgggctcaagtaatcctcctgccttggcctcccaaagtgctaggattacagatgtgtgccactgcacctggttcagatcccatgtattatctccatgaccttgaggtcacagacgtaaaagattaaattataggaaatactttggagtgacatattgtcaccattctttcaaggccaacttttataggcatatgcatccactcttactgctgtag

SEQ ID NO: 137536 - DNA, 601 bp, Human
tcccacaagcaacgtaggaggggccttgctgctccccactctcagtagcacttagaatgatctttctaacttccaccagtctgaagagcgtggaatggtacttccctggggtcttcattcatgtttgccagatgcctaatgaggttgatggcatcatctctcagggaaacctgtgcttgtctgtctcagtttttaacaagaaaatgtcaatcaagacatagggtaagatggagtacagcagattggacatggattcagaaaccagagttcagatcccatttattactactatctttttttytggagagatggcgtctcactctgttgcccaggctggagtgccatggtgcagtcttggctcactgcagctttcacctcctgggctcaagtaatcctcctgccttggcctcccaaagtgctaggattacagatgtgtgccactgcacctggttcagatcccatgtattatctccatgaccttgaggtcacagacgtaaaagattaaattataggaaatactttggagtgacatattgtcaccattctttcaaggccaacttttataggcatatgcatccactcttactgctgtagtatttgg

SEQ ID NO: 137537 - DNA, 601 bp, Human
ctggggatgatgcagttccatcctctcttctaggatccgagccagagacaacaacggctcctacgccctgtgcctgctgcacgaagggaaggtgctgcactatcgcatcgacaaagacaagacagggaagctctccatccccgagggaaagaagttcgacacgctctggcaggtacccagcctcctctccccaccttgtgggtagagtacagggcacgtggggctccttgtcccatggactcttagacatgagaggaactggaccacccactgcccacagtgtggtccccaggccagcagyagctctggagctcatgagaaacacacacctggaccacacctgggctcctgccccacctgcccatcagaccccactttcagcctccaggtggcttctgtgtttgagaagcactggtccagaggccgtcatgtgaggtgaacgaaggttccatggcttgttcagggccactcagccctcagtgccacaaggtgatgtaagtgcagggctgtgttcagagtttaacaagacactctctttggagatctagaaaatatttcttcctaggatattctaactagagcccagaacagcctttcagac

SEQ ID NO: 137538 - DNA, 601 bp, Human
cgagggaaagaagttcgacacgctctggcaggtacccagcctcctctccccaccttgtgggtagagtacagggcacgtggggctccttgtcccatggactcttagacatgagaggaactggaccacccactgcccacagtgtggtccccaggccagcagcagctctggagctcatgagaaacacacacctggaccacacctgggctcctgccccacctgcccatcagaccccactttcagcctccaggtggcttctgtgtttgagaagcactggtccagaggccgtcatgtgaggtgaacraaggttccatggcttgttcagggccactcagccctcagtgccacaaggtgatgtaagtgcagggctgtgttcagagtttaacaagacactctctttggagatctagaaaatatttcttcctaggatattctaactagagcccagaacagcctttcagacaaagacacacaaaataaaggaatggatgcctggggaaggaggcctaggaacagccaagcaggactttgttggtggtgtgagaggctgaattagacagcaaatgtcaggtgccctcctcattgtaaatcgagtctctctctg

SEQ ID NO: 137539 - DNA, 601 bp, Human
gatgaaggaaataaccgtaacagtacttcgtgcatcatcttcgcagagcatcctataaactgtagtaggttcagaaacagggagaaagccaaccgactctgccaccaccccaccgccccagagcaccagctaccttgaacatgtgtgggtgaggggcataatcagggcgtgttccaatgtcctcacccaagcccagctggggccacacatgcagtcaatgttgaggaaaggactcaactcaaaatcctgtcttttcaaaaactgagactacagagccttagcccctttaaagcacttaaasttactacttccaaatgtgatttgctttctagtgctgtaattggaaaaaaaaaatactccttttttgaatgctggatatgatcatattaaaaaatgttagtcacaacatttacattgtcttttgattttgtggctcattgccatttgtcatcattaaccacaggcttctttcttttaacgatattgattcgaaagagtatttaacctttctacactcaaagccccaaagcacatcagggaggtgagtagggaatgtggccttctggaatgcaaaggcacctggagtcctctatgccagctt

SEQ ID NO: 137540 - DNA, 601 bp, Human
agtatttaacctttctacactcaaagccccaaagcacatcagggaggtgagtagggaatgtggccttctggaatgcaaaggcacctggagtcctctatgccagcttaatgctccaaggtcccaggccccatcacttataaacagccattcattcaccttctcctgaaagggcattttatgtgtgtggcgttctgtcaccatttcaaaggctgagcactcaccatagtgttaagcatctctaattattgagaatgtccttcccaagaatctttactatttgtattgattcccctggtagatyatagcattcatccctaattaaatattcctcattgtatattttctaggcactgtgtttaggaaactacgtcaaaaatgccagcaatacgttccaatttcccatgcatgatttcattgatttttcttgacagcgttctaaggtacttctgtaccctacccaactccagggccccagtgctatttcacggagagttggtgattgccataataccctatttcaatattctttactgtagaccagggatctgcaaacccacagaccaactctggctctcagcctgtttctgtgtagtccctgaag

SEQ ID NO: 137541 - DNA, 601 bp, Human
gtatttaacctttctacactcaaagccccaaagcacatcagggaggtgagtagggaatgtggccttctggaatgcaaaggcacctggagtcctctatgccagcttaatgctccaaggtcccaggccccatcacttataaacagccattcattcaccttctcctgaaagggcattttatgtgtgtggcgttctgtcaccatttcaaaggctgagcactcaccatagtgttaagcatctctaattattgagaatgtccttcccaagaatctttactatttgtattgattcccctggtagatcrtagcattcatccctaattaaatattcctcattgtatattttctaggcactgtgtttaggaaactacgtcaaaaatgccagcaatacgttccaatttcccatgcatgatttcattgatttttcttgacagcgttctaaggtacttctgtaccctacccaactccagggccccagtgctatttcacggagagttggtgattgccataataccctatttcaatattctttactgtagaccagggatctgcaaacccacagaccaactctggctctcagcctgtttctgtgtagtccctgaaga

SEQ ID NO: 137542 - DNA, 601 bp, Human
tcaaaaatgccagcaatacgttccaatttcccatgcatgatttcattgatttttcttgacagcgttctaaggtacttctgtaccctacccaactccagggccccagtgctatttcacggagagttggtgattgccataataccctatttcaatattctttactgtagaccagggatctgcaaacccacagaccaactctggctctcagcctgtttctgtgtagtccctgaagagaatggtttgtatgctgttaaaggtgttgttttggataaataaataaataaacaaaggacacagatayggtatgaggcccacaaaagcctaaaataccactttctggccctttacagaaaaaatttgctgcccctagcccaagaggggggatccctagctgtgggcccacttccccagccacccttgtggagtggacttaagcacataaaagcatttatgtgtcttggggccacttcgaaagcccaacagtcagtcagtagctctcagtcactatttgtctatttcctgaccttggtatttaccactttcttacttttttctctttcagctagtcgagcattattcttataaagcagatggtttgtta

SEQ ID NO: 137543 - DNA, 601 bp, Human
agagggtcgaaagaagtacctgcagaaagcgtgctcacttctcaagcagcagcacatcctgatctcattgattgatctgcagtggggaggggaaggaagtggtttcctcagatagagcagtaattgtccatgctctctctaaccaggaaatgttaattttggaggccgtccacaacttccaggttcccatcctgcggtaagtgtcactaggaataccactgaatgagaagctgttgcatatttcacaaatgaaaagcatgttttagctaacaggagtagtaggcattgatattttgattgygcttcaaaacatactccgtgatgagctgggattgctagtgagtgttaggcagaatcagcctcctattagtgataaactaaccacattttcttttctttttttcttttgctttttttttttggagatggagtgtctcactctgtcaccctgactggagtgcactggtgcaatcacggctcactgcaacctctgcctcccagcttcaagccattctcatgcctcagcctcccgagtagctgggattacaggtgcctgccatcacacccggctaatttttgtattttttagtagagacgaggt

SEQ ID NO: 137544 - DNA, 601 bp, Human
ttacaggtgcctgccatcacacccggctaatttttgtattttttagtagagacgaggttttgccattttggtcaggctggtctcaaattcctggcctcaagttatcctcctgcttcgacctcccaaagtgcttggattacaggcatgagccaccacactctgcctagccacattttcttaacttcttgtctagatgaaattctcttcatttttggagaatatacacaatgcgaatgaaacccaatattaaatcagaagtaggcctcttgcaatatttgagaaatgggaacatattttttarcttcatccttgagccgtctatgttaacacacgtaattcacaggacctcagctgtctcctccctccagcctgttaggaggtcaggtacagatttatgctctaagcaggaattattttcctgctcttttcttggggctacatatggccttttttttttttttttttttttttttttgagacggagtctcgctctgttgcccaggctggagtgcagtggcgcgatctcagctcactgcaagctccgcctcccgggttcacgccattctcctgcctcagcctcgcgagtagctgggactacagg

SEQ ID NO: 137545 - DNA, 601 bp, Human
ggtctcaaattcctggcctcaagttatcctcctgcttcgacctcccaaagtgcttggattacaggcatgagccaccacactctgcctagccacattttcttaacttcttgtctagatgaaattctcttcatttttggagaatatacacaatgcgaatgaaacccaatattaaatcagaagtaggcctcttgcaatatttgagaaatgggaacatattttttagcttcatccttgagccgtctatgttaacacacgtaattcacaggacctcagctgtctcctccctccagcctgttaggargtcaggtacagatttatgctctaagcaggaattattttcctgctcttttcttggggctacatatggccttttttttttttttttttttttttttttgagacggagtctcgctctgttgcccaggctggagtgcagtggcgcgatctcagctcactgcaagctccgcctcccgggttcacgccattctcctgcctcagcctcgcgagtagctgggactacaggcgcccgccacaacgcccggctaatttttttatatttttagtagagatggggtttcaccccgttagccaggatggtctc

SEQ ID NO: 137546 - DNA, 601 bp, Human
aaatcagaagtaggcctcttgcaatatttgagaaatgggaacatattttttagcttcatccttgagccgtctatgttaacacacgtaattcacaggacctcagctgtctcctccctccagcctgttaggaggtcaggtacagatttatgctctaagcaggaattattttcctgctcttttcttggggctacatatggccttttttttttttttttttttttttttttgagacggagtctcgctctgttgcccaggctggagtgcagtggcgcgatctcagctcactgcaagctccgcctcycgggttcacgccattctcctgcctcagcctcgcgagtagctgggactacaggcgcccgccacaacgcccggctaatttttttatatttttagtagagatggggtttcaccccgttagccaggatggtctcgatctcctaacctcgtgatctgcccgcctcggcctcccaaagtgctgggattacaggcgtgagccaccgtgcccggcccatatggactttttatgccctttaatgccatctgtgaagtgcgccctctgcacctcactttttgcctggtaacccttgaaaaacaaaatctg

SEQ ID NO: 137547 - DNA, 601 bp, Human
ctttttattttcatattacttggtgtttttaccgacattttagcatataattgagcatccactcatgaaatagattgcctaaagtatttactagaaacaacagaaataaaagacataaaacccttgagattttatttagtaataattttccaagtttactcatactcaagaagttctcaatcgtgttgaccatagaacagaaagatttaatgcagtgttcgagaggaagaaaaggtttattttacacttgaataaagtaactatgtctgtttttcatgtttacccaaggcaaaacaccccyacagattactcacagtggctaaagaaatacctagaaaataagttttggtgcatctttagactacaggagaacatgtcagaaaaaagttgaagaaaatatcagtgaccacctaaaaataaagaagtatatgtgtagataacaaccataacatcatcaaaagagaaatgagaaactgggagtaagtagcactaatgctgacacatagattaatagctttagtatacaaagagattctaaaaataattaacaaaaatattaactgtctactaggataattggcagggaatatcagtagtagtt

SEQ ID NO: 137548 - DNA, 601 bp, Human
attgcttatcagaaatattttagagctaatatgtatattttcacaaacaaatggggaactttccattatgtaatcagtcatgagaaaagaattgtgagaattatgtcaaatgtcccatcatgttagctaagagataaataactttcttgaacttgttaatttgctcagtgtacatagttgttttaataattcaggcacaaaaaatacatgttagaacttgaactacctatagcatctagatagttaatgaaaagtatgtttagatttgaagatgattatgaatcagataatttaaattttycataaaattactaacaggctgatgcattttaaacttgtctttagaaattagtagcttactgccaagcacagtggctcatgcctataatcccagcactttgggaggccgaggcaggtggatcacttgaggtcaggagttcaagactagcctggccaatatggtgaaaactcatctctattaaaaatacaaaaattagccaggcgtggtggcacacgcctataatcccagctactcaggaggctgaagcaggaaaatcacttaagcctgggaggtggagattgcagagatcgtgccattgcc

SEQ ID NO: 137549 - DNA, 601 bp, Human
tagtaaatggatgttaggacacttggcaatactctggaatcaggaaactctgaatggacctatcagttccacagaccaataattttttcctcttttgttcacttttggatcaccagcttttaaacataggcactcaaagaatgcttgtcaaatacattttctattcgcagttaaaccttaccaataggaaatcagggataataatttataactggacttattattgcagagtgatatccttacctgaatttataaaatttaaagaaaagtcaccagttgttcttttggaaggtagaaagcraaggtggctaatgccatctagcggtggactgaaggtttgagcctgttctgagtattagcaaaaatgaagaaagtggaatggtcaacatttcatttacaccttgttgctcactgtgcagaacagatgacacttattgattgggacagaatggctctctcaaatgcaaacataaagaataaaaggttaatagtaatgtagaccggaaatatattttttattaaaattaaatgtcattacattttttaagaatagtatttttacaatttatcattatgccactgtgctcattctttacaaact

SEQ ID NO: 137550 - DNA, 601 bp, Human
cttaccaataggaaatcagggataataatttataactggacttattattgcagagtgatatccttacctgaatttataaaatttaaagaaaagtcaccagttgttcttttggaaggtagaaagcgaaggtggctaatgccatctagcggtggactgaaggtttgagcctgttctgagtattagcaaaaatgaagaaagtggaatggtcaacatttcatttacaccttgttgctcactgtgcagaacagatgacacttattgattgggacagaatggctctctcaaatgcaaacataaagartaaaaggttaatagtaatgtagaccggaaatatattttttattaaaattaaatgtcattacattttttaagaatagtatttttacaatttatcattatgccactgtgctcattctttacaaactcctcaaatttttctttttaactgagcattttcttttagagattgttttggttattgttctactaagtggcatattcaccaagtgctttgggaaagatgaagcatggattttgcatcttcatctttatcataaagtaactactgttcttttaactgactcaataggaaacctcccat

SEQ ID NO: 137551 - DNA, 601 bp, Human
ccaccgaagataaagacttgggtggagacttggaaaacatatgtgcgttggagttgggaagtaggtaggagcagctgatgagtactaattttcctctttaaataatgtccatgtaatatgaaattgaagagcacaagttaaagaaggaaaatgcttccaaggcgaacatgcaaatcatcagcgatctttggtaggtgggaataggatgtgcaagggggtgagtggggaagcagctctatccaggccagtagagttgactctcaccacaccctctgaacacctcacagagtcccttgagttstagcagcacaagcttgctttagcccttgcaagatccaaataattgcccgaagaatgagatcagccttattttcttccctgtttttcgtaattctttcctttgtctttcctgcaaaagttaaactgtgattattggaaaataaaaataattatgcagatcaacttaacagttttgtggatgaagaaaaacaacctgttgtcctttatgtactttagtcctcccctgcccaagggaaccggcaagagagtactgtgtcattcaatccgtatgagccagaacttgcaccctgggctgcagaca

SEQ ID NO: 137552 - DNA, 601 bp, Human
tggcaggcagcaggcaccacatgcccatgagcagtgatggtgctattgaatgaaatggtctttcccacctccctcacccaacgacgttggaaatgtccctgccactcttcagaatttctcatcccttgcaacattgatgctactctgagttcatattcccatgaagatcatgttcttggaaggatgaatcctggtgtggggtccagccccaggtcgtatgtttcttgactgcattgcaggcccccagagagaagccctacccatggacacagaggtgtacgagagcccctacgcggacccygaggagatcaggcccaaggaggtttacctggaccgaaagctgctgacgctggaagacaaagaactgggctctggtaattttggaactgtgaaaaagggctactaccaaatgaaaaagtaagttgctatgttccaccagcctcaccctcacatgagctcaggttctagacatgactgagaataacaaaatgtaacctggcatgactaaaccctttttttattaatgctaccattcttgttaatttctggtactattataatgaaagcgtccattacctttaatggcaaaaactgcaattac

SEQ ID NO: 137553 - DNA, 601 bp, Human
tgttaatttctggtactattataatgaaagcgtccattacctttaatggcaaaaactgcaattacttttgcaccaacctaatagtacatgcaccttatggaaaattaggaaatagaaacaagcagaaacataagaaaataaaaacatcaaattggcatggtggctcatgcctgtaatcttagcaatttgggaggctgggataggaggattgtttgaggcctggagcttgagaccagcctgggcaacatagcaagaccctgtctctacaaaaaaaataaataaataaataaataaataaaayataaaaaattagccagacatagtagtgcacacatatacttccagctgctcaagaggccaagaagccaaggctgcagtgagccatgattgcaccactgcactctagcctgggtaacaaagcaaggccctgtttcaaaaaacaaaacaaaaaaaagaaaagaagaacatcatatttgtataataccatcccaacactactactgttaactaaacattactactgttaacttaatcttattgtatatatttttagatctttatttgtacacacagatattatttaattaaaacaaaatcattc

SEQ ID NO: 137554 - DNA, 601 bp, Human
gcatggtggctcatgcctgtaatcttagcaatttgggaggctgggataggaggattgtttgaggcctggagcttgagaccagcctgggcaacatagcaagaccctgtctctacaaaaaaaataaataaataaataaataaataaaacataaaaaattagccagacatagtagtgcacacatatacttccagctgctcaagaggccaagaagccaaggctgcagtgagccatgattgcaccactgcactctagcctgggtaacaaagcaaggccctgtttcaaaaaacaaaacaaaaaaaaaaaaagaagaacatcatatttgtataataccatcccaacactactactgttaactaaacattactactgttaacttaatcttattgtatatatttttagatctttatttgtacacacagatattatttaattaaaacaaaatcattccattataacaatagtttttacatttattttctttaattttatagttacatctcatttttcttacatgaaaattattgattccaaatatgattagtataattatttattggctttatcctatgatttcagataacaatacatattatacaacagt

SEQ ID NO: 137555 - DNA, 601 bp, Human
tgcttggttgggacattcttcagtactgttcttcaccattctttttattttatattattttttagaaacagtgtttcactgtgtcacccaggctggagtgaagtggcaagaagctcactgcagccttgaactcctgagtccaagtgattctcccacctcagcctcccgagcagctgggactacaggcttgcactgtcacgcctgggtgattttttttagagatgggggtctcactatgttgcccaggctgaccttgaacttctgacctcaagcaatcctcccctttcaacctcccaaagtrtggggattgtcagcatgagccaccatgcccagcccccaccattcttttttagtaatggagtattactctcattgtctataaaataagggaatataggttggaaggccagccatccattacaggcttctgaagacacattgccactctgtggcaggtatttccgtgggactgtttccacagggggattatgcttcacaggataagattatctagaagtgaggcattttggaaagtttcttgtgtgttatgatttctcttgcagagttgtgaaaaccgtggctgtgaaaatactgaaaaacg

SEQ ID NO: 137556 - DNA, 601 bp, Human
aggctggagtgaagtggcaagaagctcactgcagccttgaactcctgagtccaagtgattctcccacctcagcctcccgagcagctgggactacaggcttgcactgtcacgcctgggtgattttttttagagatgggggtctcactatgttgcccaggctgaccttgaacttctgacctcaagcaatcctcccctttcaacctcccaaagtatggggattgtcagcatgagccaccatgcccagcccccaccattcttttttagtaatggagtattactctcattgtctataaaataaggraatataggttggaaggccagccatccattacaggcttctgaagacacattgccactctgtggcaggtatttccgtgggactgtttccacagggggattatgcttcacaggataagattatctagaagtgaggcattttggaaagtttcttgtgtgttatgatttctcttgcagagttgtgaaaaccgtggctgtgaaaatactgaaaaacgaggccaatgaccccgctcttaaagatgagttattagcagaagcaaatgtcatgcagcagctggacaacccgtacatcgtgcggatgatc

SEQ ID NO: 137557 - DNA, 601 bp, Human
aacttctgacctcaagcaatcctcccctttcaacctcccaaagtatggggattgtcagcatgagccaccatgcccagcccccaccattcttttttagtaatggagtattactctcattgtctataaaataagggaatataggttggaaggccagccatccattacaggcttctgaagacacattgccactctgtggcaggtatttccgtgggactgtttccacagggggattatgcttcacaggataagattatctagaagtgaggcattttggaaagtttcttgtgtgttatgatttctsttgcagagttgtgaaaaccgtggctgtgaaaatactgaaaaacgaggccaatgaccccgctcttaaagatgagttattagcagaagcaaatgtcatgcagcagctggacaacccgtacatcgtgcggatgatcgggatatgcgaggccgagtcctggatgctggttatggagatggcagaacttggtcccctcaataagtatttgcagcagaacaggtattgtcaggtgcccccacacatctggaagctatcccctaagggacagggcccacccctggatgggccgagcagcctgatttc

SEQ ID NO: 137558 - DNA, 601 bp, Human
ataagggaatataggttggaaggccagccatccattacaggcttctgaagacacattgccactctgtggcaggtatttccgtgggactgtttccacagggggattatgcttcacaggataagattatctagaagtgaggcattttggaaagtttcttgtgtgttatgatttctcttgcagagttgtgaaaaccgtggctgtgaaaatactgaaaaacgaggccaatgaccccgctcttaaagatgagttattagcagaagcaaatgtcatgcagcagctggacaacccgtacatcgtgcgsatgatcgggatatgcgaggccgagtcctggatgctggttatggagatggcagaacttggtcccctcaataagtatttgcagcagaacaggtattgtcaggtgcccccacacatctggaagctatcccctaagggacagggcccacccctggatgggccgagcagcctgatttccttgggaagccttcccaccctcctgtgccttcctttattggtccatactcagggaccttgacagagggacagggagacatagtctttggattcagctctgttagctctagttgttcagagaagaact

SEQ ID NO: 137559 - DNA, 601 bp, Human
acaggcttctgaagacacattgccactctgtggcaggtatttccgtgggactgtttccacagggggattatgcttcacaggataagattatctagaagtgaggcattttggaaagtttcttgtgtgttatgatttctcttgcagagttgtgaaaaccgtggctgtgaaaatactgaaaaacgaggccaatgaccccgctcttaaagatgagttattagcagaagcaaatgtcatgcagcagctggacaacccgtacatcgtgcggatgatcgggatatgcgaggccgagtcctggatgctrgttatggagatggcagaacttggtcccctcaataagtatttgcagcagaacaggtattgtcaggtgcccccacacatctggaagctatcccctaagggacagggcccacccctggatgggccgagcagcctgatttccttgggaagccttcccaccctcctgtgccttcctttattggtccatactcagggaccttgacagagggacagggagacatagtctttggattcagctctgttagctctagttgttcagagaagaactcatttgacagttttgtcttttttttcttcctgtagt

SEQ ID NO: 137560 - DNA, 601 bp, Human
aaagtttcttgtgtgttatgatttctcttgcagagttgtgaaaaccgtggctgtgaaaatactgaaaaacgaggccaatgaccccgctcttaaagatgagttattagcagaagcaaatgtcatgcagcagctggacaacccgtacatcgtgcggatgatcgggatatgcgaggccgagtcctggatgctggttatggagatggcagaacttggtcccctcaataagtatttgcagcagaacaggtattgtcaggtgcccccacacatctggaagctatcccctaagggacagggcccaccyctggatgggccgagcagcctgatttccttgggaagccttcccaccctcctgtgccttcctttattggtccatactcagggaccttgacagagggacagggagacatagtctttggattcagctctgttagctctagttgttcagagaagaactcatttgacagttttgtcttttttttcttcctgtagtcattcagtcttggcctagtgatagactcagcctcagaatatcttgacatggaatctcctttctcactgggaagaacactttctttttaaagaaacattttaaataaatgct

SEQ ID NO: 137561 - DNA, 601 bp, Human
tgtgttatgatttctcttgcagagttgtgaaaaccgtggctgtgaaaatactgaaaaacgaggccaatgaccccgctcttaaagatgagttattagcagaagcaaatgtcatgcagcagctggacaacccgtacatcgtgcggatgatcgggatatgcgaggccgagtcctggatgctggttatggagatggcagaacttggtcccctcaataagtatttgcagcagaacaggtattgtcaggtgcccccacacatctggaagctatcccctaagggacagggcccacccctggatgggcygagcagcctgatttccttgggaagccttcccaccctcctgtgccttcctttattggtccatactcagggaccttgacagagggacagggagacatagtctttggattcagctctgttagctctagttgttcagagaagaactcatttgacagttttgtcttttttttcttcctgtagtcattcagtcttggcctagtgatagactcagcctcagaatatcttgacatggaatctcctttctcactgggaagaacactttctttttaaagaaacattttaaataaatgcttttctaagagg

SEQ ID NO: 137562 - DNA, 601 bp, Human
cgagtcctggatgctggttatggagatggcagaacttggtcccctcaataagtatttgcagcagaacaggtattgtcaggtgcccccacacatctggaagctatcccctaagggacagggcccacccctggatgggccgagcagcctgatttccttgggaagccttcccaccctcctgtgccttcctttattggtccatactcagggaccttgacagagggacagggagacatagtctttggattcagctctgttagctctagttgttcagagaagaactcatttgacagttttgtctttyttttcttcctgtagtcattcagtcttggcctagtgatagactcagcctcagaatatcttgacatggaatctcctttctcactgggaagaacactttctttttaaagaaacattttaaataaatgcttttctaagaggtgacagttaagtcttatctgtttggctgaccttatgttctcatgagtgatgacttctgaaaataccaatcactgctaattgattacatccatcaagggagtaattgtgttcttctcatctaaagctgttgttgagatgaagaaactcacttggagtaagacag

SEQ ID NO: 137563 - DNA, 601 bp, Human
agtcattcagtcttggcctagtgatagactcagcctcagaatatcttgacatggaatctcctttctcactgggaagaacactttctttttaaagaaacattttaaataaatgcttttctaagaggtgacagttaagtcttatctgtttggctgaccttatgttctcatgagtgatgacttctgaaaataccaatcactgctaattgattacatccatcaagggagtaattgtgttcttctcatctaaagctgttgttgagatgaagaaactcacttggagtaagacagaatgatggccacygaggagcttgcctcatttgctgtgctacgtttgtacttagattgtctctttagtctccatggaagggaggtgttcttaccctgactttgtaggtgagaaactgattctcagggttagttctgtgacctgtgtgatactggaacaaggatttgaggtggtgcctggctatctgtgagccaggcctgactactctgttatactgcttttcttgcaattccaagcatgccaggaaactcaatcccattgaacaccaggagaatatggcattgagtcctgaagagctatatgctaacaaagtta

SEQ ID NO: 137564 - DNA, 601 bp, Human
ctttttaaagaaacattttaaataaatgcttttctaagaggtgacagttaagtcttatctgtttggctgaccttatgttctcatgagtgatgacttctgaaaataccaatcactgctaattgattacatccatcaagggagtaattgtgttcttctcatctaaagctgttgttgagatgaagaaactcacttggagtaagacagaatgatggccaccgaggagcttgcctcatttgctgtgctacgtttgtacttagattgtctctttagtctccatggaagggaggtgttcttaccctgmctttgtaggtgagaaactgattctcagggttagttctgtgacctgtgtgatactggaacaaggatttgaggtggtgcctggctatctgtgagccaggcctgactactctgttatactgcttttcttgcaattccaagcatgccaggaaactcaatcccattgaacaccaggagaatatggcattgagtcctgaagagctatatgctaacaaagttatttgtcaccactcgtgagttttgttgtttaagaagagggaaggagtagattcacccactgcctgcgtgaggagcatggttgttt

SEQ ID NO: 137565 - DNA, 601 bp, Human
taattgtgttcttctcatctaaagctgttgttgagatgaagaaactcacttggagtaagacagaatgatggccaccgaggagcttgcctcatttgctgtgctacgtttgtacttagattgtctctttagtctccatggaagggaggtgttcttaccctgactttgtaggtgagaaactgattctcagggttagttctgtgacctgtgtgatactggaacaaggatttgaggtggtgcctggctatctgtgagccaggcctgactactctgttatactgcttttcttgcaattccaagcatrccaggaaactcaatcccattgaacaccaggagaatatggcattgagtcctgaagagctatatgctaacaaagttatttgtcaccactcgtgagttttgttgtttaagaagagggaaggagtagattcacccactgcctgcgtgaggagcatggttgtttgttgtgaaatgggtcactgtctgttatagctgatgagatcattatgactttcagacatgtcaaggataagaacatcatagaactggttcatcaggtttccatgggcatgaagtacttggaggagagcaattttgtgcacag

SEQ ID NO: 137566 - DNA, 601 bp, Human
gaaactcacttggagtaagacagaatgatggccaccgaggagcttgcctcatttgctgtgctacgtttgtacttagattgtctctttagtctccatggaagggaggtgttcttaccctgactttgtaggtgagaaactgattctcagggttagttctgtgacctgtgtgatactggaacaaggatttgaggtggtgcctggctatctgtgagccaggcctgactactctgttatactgcttttcttgcaattccaagcatgccaggaaactcaatcccattgaacaccaggagaatatggmattgagtcctgaagagctatatgctaacaaagttatttgtcaccactcgtgagttttgttgtttaagaagagggaaggagtagattcacccactgcctgcgtgaggagcatggttgtttgttgtgaaatgggtcactgtctgttatagctgatgagatcattatgactttcagacatgtcaaggataagaacatcatagaactggttcatcaggtttccatgggcatgaagtacttggaggagagcaattttgtgcacagagatctggctgcaagaaatgtgttgctagttacccaacat

SEQ ID NO: 137567 - DNA, 601 bp, Human
aatgatggccaccgaggagcttgcctcatttgctgtgctacgtttgtacttagattgtctctttagtctccatggaagggaggtgttcttaccctgactttgtaggtgagaaactgattctcagggttagttctgtgacctgtgtgatactggaacaaggatttgaggtggtgcctggctatctgtgagccaggcctgactactctgttatactgcttttcttgcaattccaagcatgccaggaaactcaatcccattgaacaccaggagaatatggcattgagtcctgaagagctatatrctaacaaagttatttgtcaccactcgtgagttttgttgtttaagaagagggaaggagtagattcacccactgcctgcgtgaggagcatggttgtttgttgtgaaatgggtcactgtctgttatagctgatgagatcattatgactttcagacatgtcaaggataagaacatcatagaactggttcatcaggtttccatgggcatgaagtacttggaggagagcaattttgtgcacagagatctggctgcaagaaatgtgttgctagttacccaacattacgccaagatcagtgatttcgg

SEQ ID NO: 137568 - DNA, 601 bp, Human
tgagtcctgaagagctatatgctaacaaagttatttgtcaccactcgtgagttttgttgtttaagaagagggaaggagtagattcacccactgcctgcgtgaggagcatggttgtttgttgtgaaatgggtcactgtctgttatagctgatgagatcattatgactttcagacatgtcaaggataagaacatcatagaactggttcatcaggtttccatgggcatgaagtacttggaggagagcaattttgtgcacagagatctggctgcaagaaatgtgttgctagttacccaacattaygccaagatcagtgatttcggactttccaaagcactgcgtgctgatgaaaactactacaaggtaagtacaacttagctaatattcagagcagcaggtggtaaaaaatgcaagataaatgtacgttttctttattttattattggtatggtttcaaaaagcagttttgctactgaaaaataactatgtaagatatgttcttataatctttgattttactgtttaaaaaataaaaataatatcacaccttgagatttactcaaagtagtatattctaaattatgtttcatggaatgatcagga

SEQ ID NO: 137569 - DNA, 601 bp, Human
acaaagttatttgtcaccactcgtgagttttgttgtttaagaagagggaaggagtagattcacccactgcctgcgtgaggagcatggttgtttgttgtgaaatgggtcactgtctgttatagctgatgagatcattatgactttcagacatgtcaaggataagaacatcatagaactggttcatcaggtttccatgggcatgaagtacttggaggagagcaattttgtgcacagagatctggctgcaagaaatgtgttgctagttacccaacattacgccaagatcagtgatttcggactytccaaagcactgcgtgctgatgaaaactactacaaggtaagtacaacttagctaatattcagagcagcaggtggtaaaaaatgcaagataaatgtacgttttctttattttattattggtatggtttcaaaaagcagttttgctactgaaaaataactatgtaagatatgttcttataatctttgattttactgtttaaaaaataaaaataatatcacaccttgagatttactcaaagtagtatattctaaattatgtttcatggaatgatcaggaatcgaggtattaagtgaagatttg

SEQ ID NO: 137570 - DNA, 601 bp, Human
atggttgtttgttgtgaaatgggtcactgtctgttatagctgatgagatcattatgactttcagacatgtcaaggataagaacatcatagaactggttcatcaggtttccatgggcatgaagtacttggaggagagcaattttgtgcacagagatctggctgcaagaaatgtgttgctagttacccaacattacgccaagatcagtgatttcggactttccaaagcactgcgtgctgatgaaaactactacaaggtaagtacaacttagctaatattcagagcagcaggtggtaaaaaatrcaagataaatgtacgttttctttattttattattggtatggtttcaaaaagcagttttgctactgaaaaataactatgtaagatatgttcttataatctttgattttactgtttaaaaaataaaaataatatcacaccttgagatttactcaaagtagtatattctaaattatgtttcatggaatgatcaggaatcgaggtattaagtgaagatttgttttgaaaaaagaagaatgggattccttcattaagttaatttgaaaagtttgcattggacagcttgattcttgcaggatttcc

SEQ ID NO: 137571 - DNA, 601 bp, Human
tattttattattggtatggtttcaaaaagcagttttgctactgaaaaataactatgtaagatatgttcttataatctttgattttactgtttaaaaaataaaaataatatcacaccttgagatttactcaaagtagtatattctaaattatgtttcatggaatgatcaggaatcgaggtattaagtgaagatttgttttgaaaaaagaagaatgggattccttcattaagttaatttgaaaagtttgcattggacagcttgattcttgcaggatttccccgaagcccttttcatgctactyaacattacgaatctcagtagagggtttactgcactgcatttctcaaaccagattcatccatggcatccttttctgataggacatttcataacatgtggtggaacactgtcccacagcatggagctattggagcttggagctccagtactgcagttcagagctccaatattgcagcttggagctattccaaaataactttctaatgaacacctacctatacatgcaaaagttagaaagtgaagatttaccaaataaactcgtcatctgtgtatgtccactacatatgtagaaattgttcta

SEQ ID NO: 137572 - DNA, 601 bp, Human
cacaccttgagatttactcaaagtagtatattctaaattatgtttcatggaatgatcaggaatcgaggtattaagtgaagatttgttttgaaaaaagaagaatgggattccttcattaagttaatttgaaaagtttgcattggacagcttgattcttgcaggatttccccgaagcccttttcatgctacttaacattacgaatctcagtagagggtttactgcactgcatttctcaaaccagattcatccatggcatccttttctgataggacatttcataacatgtggtggaacactgtyccacagcatggagctattggagcttggagctccagtactgcagttcagagctccaatattgcagcttggagctattccaaaataactttctaatgaacacctacctatacatgcaaaagttagaaagtgaagatttaccaaataaactcgtcatctgtgtatgtccactacatatgtagaaattgttctattggcttaactggtatccagaagagttgaagtgtcaaaaaatagatgcagtgctggaaagaagagatctagatagttatgtgactgaagctaaaagaaatatgccccttg

SEQ ID NO: 137573 - DNA, 601 bp, Human
tttgaaaagtttgcattggacagcttgattcttgcaggatttccccgaagcccttttcatgctacttaacattacgaatctcagtagagggtttactgcactgcatttctcaaaccagattcatccatggcatccttttctgataggacatttcataacatgtggtggaacactgtcccacagcatggagctattggagcttggagctccagtactgcagttcagagctccaatattgcagcttggagctattccaaaataactttctaatgaacacctacctatacatgcaaaagttagraagtgaagatttaccaaataaactcgtcatctgtgtatgtccactacatatgtagaaattgttctattggcttaactggtatccagaagagttgaagtgtcaaaaaatagatgcagtgctggaaagaagagatctagatagttatgtgactgaagctaaaagaaatatgccccttggtttggtgaggcagagattatcaagaattaagggtggacttccagcaaaacataaagtagaaactagttctgggtgcaggtttggacttcctaaaaaataatttcacagtgaccaatccccttg

SEQ ID NO: 137574 - DNA, 601 bp, Human
attggacagcttgattcttgcaggatttccccgaagcccttttcatgctacttaacattacgaatctcagtagagggtttactgcactgcatttctcaaaccagattcatccatggcatccttttctgataggacatttcataacatgtggtggaacactgtcccacagcatggagctattggagcttggagctccagtactgcagttcagagctccaatattgcagcttggagctattccaaaataactttctaatgaacacctacctatacatgcaaaagttagaaagtgaagatttaycaaataaactcgtcatctgtgtatgtccactacatatgtagaaattgttctattggcttaactggtatccagaagagttgaagtgtcaaaaaatagatgcagtgctggaaagaagagatctagatagttatgtgactgaagctaaaagaaatatgccccttggtttggtgaggcagagattatcaagaattaagggtggacttccagcaaaacataaagtagaaactagttctgggtgcaggtttggacttcctaaaaaataatttcacagtgaccaatccccttgctaatataacttga

SEQ ID NO: 137575 - DNA, 601 bp, Human
caccatcttgagcacaaaggccaggcgagagtacagcaggggtcaggctggccctcctcaccccattcttcatacagtagcttcccagaaggaagccccttcagaggtgaaccactgtgagaaaggcatcagcatgggcctggatagaaatagcagggaaacagagcaaggaagacagcagcctaggatgaccagcatgggacatgctggagaaagaagcctgttgtaatgctggatgtacctcatcatgatcattacagaaaagaagacagcctgtctgaaacaaggacacagaggagayagagaaaatgaaacatgaatgctgggcaccttatccactgctgtataacaaatcaccccaaacttactgccaaaaacaccaccaggtgttggtttccctgccgtcctgctgtgtgggcagggccaggtaggcagggttcagtgcgtctgctcacacaggggattgcacagtggcccgagggacaggaggaccgtttccactctgctcactcacactactcagccactgagcagctggttagacacagcccatgctggagacctctgcggggctgtcagccagctcacctgcacatggcct

SEQ ID NO: 137576 - DNA, 601 bp, Human
ataaagcctttcccaggtaagcaaacactgagggaattcatcaccactagactgatcctagaagaaatactcaaaggaatcttaaacgtggaagtaaaaggacaatatttaccatcataaaaacacacaaaagtataaaactcactggtaaaccaaacatacaaataatcctgttaaatagtgggctaagaacatagatagacatttctcaaaagaagatatacaaatggccaacaggtatatgaaaaaatgctcaatatcaccaaacagcagggaaatgcaaattacaaacacaatgagmtaccatcttaccccggctagaatggctgttattaaaaagactttttttaaaaaaatgctttgcagatgcaggaaaaaaaggaactcttatacactgtttgtgggaatgtaaattagtatagtcactacggaaaatattagagagacttctcaaaacaaaaacaggctgggcacggtggctcacacctgtaatcccagcagttttggaagcccgaggcgggcagatcacaaggtcaggagatcaagaccatcctggctaacacggtgaaaccctgtctctactaaaaatacaaaaaattgg

SEQ ID NO: 137577 - DNA, 601 bp, Human
atatacaaatggccaacaggtatatgaaaaaatgctcaatatcaccaaacagcagggaaatgcaaattacaaacacaatgagataccatcttaccccggctagaatggctgttattaaaaagactttttttaaaaaaatgctttgcagatgcaggaaaaaaaggaactcttatacactgtttgtgggaatgtaaattagtatagtcactacggaaaatattagagagacttctcaaaacaaaaacaggctgggcacggtggctcacacctgtaatcccagcagttttggaagcccgaggcrggcagatcacaaggtcaggagatcaagaccatcctggctaacacggtgaaaccctgtctctactaaaaatacaaaaaattggccaggcctggtgacaggtgcctgtcatcccagctacctgggaggctgaggcagaagaatggcatgaacccaggaggcggagcttgcagtgagctgaaatcacactactgcacactccagcctgggcgatagagtgagactccatctcaaaaacaaaaagaagaaaaaaaaactaactacacatagaattaccatatgatccagcaagtctactattgg

SEQ ID NO: 137578 - DNA, 601 bp, Human
tctcgttgtgtcacccaggctgcagtgcagtggtgtgatctgagatcactgcaacctctgccttctgggttcaagcaattctcctgcctcagcctcccaagtagctggaattacaggcacccgccaccacacctggctaatttttgtatttttaatagagatggggtttcctcttggccaggctggtctcaagctcccgatctcaagtgatctgctctcctcagcctcccaaagtgctgggattacaggcatgaaccaatgtgcccggcccacaattttattcttaatggaatttctcccwctgctttgcttttaggcccagacccatggaaagtggcctgtcaagtggtacgctccggaatgcatcaactactacaagttctccagcaaaagcgatgtctggagctttggagtgttgatgtgggaagcattctcctatgggcagaagccatatcgagtgagccagtcctgcttcattttctcactgtggggccattagaacagataagcaccagattgtctttacaacaacctgaaaatcctaatctgagtctctcattatcttttaccagtaagcagttaatgtgccctcagtctattc

SEQ ID NO: 137579 - DNA, 601 bp, Human
tgcttttaggcccagacccatggaaagtggcctgtcaagtggtacgctccggaatgcatcaactactacaagttctccagcaaaagcgatgtctggagctttggagtgttgatgtgggaagcattctcctatgggcagaagccatatcgagtgagccagtcctgcttcattttctcactgtggggccattagaacagataagcaccagattgtctttacaacaacctgaaaatcctaatctgagtctctcattatcttttaccagtaagcagttaatgtgccctcagtctattccaaactragaatgaaatatctgatgctcactgaagagtgtgtttttcccattgtgtgtcaacacatgtaaatatacacaaaatataacccagatcattactcattagagttgaaatagaaataatgactatttacagtatcttaattacattttttagatcttttaattaaaacatatataccaaaaagggcacaactcttagcatgcagtacagtggttttccacaaatgaaacatacccatgaaatcagcccccagatgaagaacagaaccccagaagcctgtttcctctgcacacacagccttc

SEQ ID NO: 137580 - DNA, 601 bp, Human
tgacctcggactctggccagctcacagatacattggctaaggttgcacttccctagaatctacctcatccttgaagtggtggcctcagtccaccctgactgccgtcatacgtctcgcttagtggatcccaggtgctgttatgcttttaaagtacacctggcattattcttaggtgatgttcagggcagctcagcaaggaaggaaaatgcattgccactgaaaattaggagtacagttttgccaggctcagcagcctgcttgtgcgtgcatagcacggtgaccccaagccgccatctccagytccctggtactgaactgtgcacacagagcccacacagctgagaatcgatgtggtttgtgatcaggaggacatcacaaatcctggccatggatttgatgctttgcggaatcaggtttgccttcagatacagctgacattgccagagcctctgaaagatgagggctattccaaatgctgcagatgccacctgggattccgagacctcccctccccaccctgggagtatcactctaccacaattgtgagtgacagggaaataatctcattctgtatctagaaaccacccagggggcagccaca

SEQ ID NO: 137581 - DNA, 601 bp, Human
catctccagttccctggtactgaactgtgcacacagagcccacacagctgagaatcgatgtggtttgtgatcaggaggacatcacaaatcctggccatggatttgatgctttgcggaatcaggtttgccttcagatacagctgacattgccagagcctctgaaagatgagggctattccaaatgctgcagatgccacctgggattccgagacctcccctccccaccctgggagtatcactctaccacaattgtgagtgacagggaaataatctcattctgtatctagaaaccacccagggrgcagccacaaaggcagcaggcaaactgtgggtatatgcttccctgcccctgctgctgccgtggctcaggagaggagcctggcctgggccccggagcatcttctccaaccccaagtgttagtgcaacagggagagctaagtgtcagcaagagggaagtgctactcatggatctaagaggatgtttattcctaagtcttggcttaattctcccagtgcctaaactagaatcgtaagaaccattggcaggtaggcactggcagcactggaccctggggagggcagcccttgggcacgtggcag

SEQ ID NO: 137582 - DNA, 601 bp, Human
acagctctttatcagactttgatttatttcccaacaaagctatatttctgaaggttacagtgtttctagtagtgacctcaaacagggttgggggaggtggggagatgttctgaaacttttgaagcagctgtgtttgtctggggtaatacctgagctcgttgcctcacgccaaggaaatcaaagatgcagacacacaagaagtgagtttaagagcagaggtttaataggcaacagaaaagagaaaagctctctttcctgcagagagacaagggctcccaagtggttcttccggctccgtgtsgaaatgcaagggttttatagacgagcttgagtctgattacatagggcccaaagatcggttggacagccaggccatttacataacacgaaaagaaactggctgccccaccctaatcttttattatgcagatgaggtctctccttggccgacgccatgttgcctgctttttttttttttttttttttgagacggagtctcactctgtcgcccaggctggagtgcagtggcgcgatctgggctcactgcaagctctgtctcccgggttcacaccatactcctgcctcagcctcccgagtagct

SEQ ID NO: 137583 - DNA, 601 bp, Human
acacacaagaagtgagtttaagagcagaggtttaataggcaacagaaaagagaaaagctctctttcctgcagagagacaagggctcccaagtggttcttccggctccgtgtggaaatgcaagggttttatagacgagcttgagtctgattacatagggcccaaagatcggttggacagccaggccatttacataacacgaaaagaaactggctgccccaccctaatcttttattatgcagatgaggtctctccttggccgacgccatgttgcctgctttttttttttttttttttttgagrcggagtctcactctgtcgcccaggctggagtgcagtggcgcgatctgggctcactgcaagctctgtctcccgggttcacaccatactcctgcctcagcctcccgagtagctgggactacaggcgcccgccaccacgcccagctaatttttttgtattttttagtggagacggggtttcaccgtgttagtcaggatggtctcgatctcctgacctcatgatccgcccgcctcagccttgttgcctgcttttttactgcacacgtggcaacaaggaaagtggaagagggaacctccatgttg

SEQ ID NO: 137584 - DNA, 601 bp, Human
tggctgctgggcagatgaacccccagagcaagatccaaaggtgctctttgtaccatttggatccccacagttggagcagagccccctgttttgcaaagatgctgaagtgtgttctctttgactgtagaagtttaggagcaagacagaggctgtccctctgggtggacacatgctcctgtaccagaggcttggccaccatatcccctctcggaacacacttggtggccagagacaaagcccctctcagtgacaccctgggaggcccgtgtccccagacatgaccacagatggctgaccacastgatcaattcgagcagttttatcattttgctcactattgaaagctataagagaaaccatgtattttgatgccatttgacaaagctacccattttgatttgtagaagccactctgctcttataatgatgagtgagtcttggtcctgatgcgcgttctatggctgttctcttgtgtcgacattgaatcatatgaaattgccattgatataggtcaaaatggctgaatgtggacggtttcctacaatttaacctcacattctgtttcactttttcacttattgtatttcaacttcacccactt

SEQ ID NO: 137585 - DNA, 601 bp, Human
gcagatgaacccccagagcaagatccaaaggtgctctttgtaccatttggatccccacagttggagcagagccccctgttttgcaaagatgctgaagtgtgttctctttgactgtagaagtttaggagcaagacagaggctgtccctctgggtggacacatgctcctgtaccagaggcttggccaccatatcccctctcggaacacacttggtggccagagacaaagcccctctcagtgacaccctgggaggcccgtgtccccagacatgaccacagatggctgaccacactgatcaattsgagcagttttatcattttgctcactattgaaagctataagagaaaccatgtattttgatgccatttgacaaagctacccattttgatttgtagaagccactctgctcttataatgatgagtgagtcttggtcctgatgcgcgttctatggctgttctcttgtgtcgacattgaatcatatgaaattgccattgatataggtcaaaatggctgaatgtggacggtttcctacaatttaacctcacattctgtttcactttttcacttattgtatttcaacttcacccacttgcaatatatc

SEQ ID NO: 137586 - DNA, 601 bp, Human
ttgcctgtggcacagaagcatattgtgtgccgcatatctgaacctggggctaaaacactcccagttctaatgcaaaaagtctcctactttagggtggacatgaatcaccgggaggtcttgttaaagtgcagatatgggttatttaggtctacagtaggccgacactatttttgacagccttgtggtcaccctggggtggggggcacagggaccacgctgtgagctgcaggccctagagttagccaccagggagcagcaccactggtactcagcctgcagaggccctgcttgtgatcagcawtttttcacaagcacattgacaaacaagaatgcatctcttccattccagtgtggaaaacaggcccggattcgcagcagtggaactgcggctgcgcaattactactatgacgtggtgaactaaccgctcccgcacctgtcggtggctgcctttgatcacaggagcaatcacaggaaaatgtatccagaggaattgattgtcagccacctccctctgccagtcgggagagccaggcttggatggaacatgcccacaacttgtcacccaaagcctgtcccaggactcaccctccacaaagcaaa

SEQ ID NO: 137587 - DNA, 601 bp, Human
aatgaaaaacacaaaactctcaccagaaaaactttagaatggcaagtgaaattttttttaaatgacacatttcacctaggactggagaagacagagaaaaatatattgtaatgtgctttataacacatataatatatgaaataacacaaaagttcaaaggcctgcagagaaaatgctggtgtcagtctttacccggtgccatccaaacaaggacagcacataggggtcagcctgttctcagtcactagacaagacctcaggacagaaagaggagctgccgagctttgccaacgctgacctyctgttaaggacaacaaactcccgaagcggcctgactcctgagctacatctcatcttggacttttaactccgtttcccagtgggctgtcattctggaagacgtgcagagcctctcactgatttgactgtctcattggcttagcagttatagtttccacattaatggaaaatttgcataaatgttacattaatgaaaaatacaaaatgaatccgtttgtcaggccctgttctcctctgggaaaacagaacacagttttgggcctacccagaccctgggtggccaaaactgtggactggtcat

SEQ ID NO: 137588 - DNA, 601 bp, Human
atttattgtcaaatgctttagtactaaaagccaaaatgacttaaatcagtgttttatttcccagcattaactcattataaatttaataaaatgtaattcaatatgaaagttaataaatatccttcaagtatcattgaggagaaacactgttctgtcattctacattcctcaattaatagctaaaggaatgtcaccagagcgttgcctaacagagcaaccagcaagcaaactgccatgtaacataatatttcaatgacagtgataggctaacaaaagcatggatgatttttatttctcttgkatttttcaattatgtggcaatataatgtcactgcttttatcttggagataaattataataaaaaatctctaatagccaggcacagcggctcatgcctgtaatcccagcactttgggaagccgaggcgggtagatcatgaggtcaggagatcaagaccaccctggctaagacggtgaatccctgtcactactaaaaatacaaaaaattagccgggtgtggtgacgtgcgcctgtagtcccagctactcgggaggctgaggcaggaacccaggaggcggaagattgcagtgacccgagatcg

SEQ ID NO: 137589 - DNA, 601 bp, Human
ggctaatgaagaaggttggttttaatcaattttcttagaagtgtatttttctagattaaaaaaaaataataatgttggccaggcacggtggctcacgcctgtaattccagtactttcggaggctgaggcgggcagatcacctgaggtcaggagtttgagaccagcctgaccaacgtggagaaaccccgtctctactaaaaatacaaaattggccaggcgtggtggcacgtgcctgtaatcccagcaactcaggaagctgaggcaggagaatcgcttgaacccagaggcggatgttgcagtsagccgagatcgcgccattgcactccagcctaggcaacaaaagcgaaagtctgtctcaaaaaaaaaaataaaaaataaaatgatgttgtttccttacaattcattaaaatgcgtttattgctttcagaaggtataccatattctgaagaagtcatttattgtcaaatgctttagtactaaaagccaaaatgacttaaatcagtgttttatttcccagcattaactcattataaatttaataaaatgtaattcaatatgaaagttaataaatatccttcaagtatcattgaggagaaacact

SEQ ID NO: 137590 - DNA, 601 bp, Human
agggaatggatttgttcccaggagaggggggttgttataaagccagagtgcagctcaggttatcccgtcttcacaagcgtccacttcctacttgcgctcctctgccacgttatgatgcagcatggaagccttcactggaagctagggccgtgaccttcaattctcagcccgcagaaccgtgaactaaatacacctcttttcttgataaattacccagtctcacatattcttttataataacaaaacacagactaagacagatgggtaagcaacatagttctatccagcttcccaggagggrgactggcaggcccctggcaaccgctctgaaacaaaggacttcgcaccagtgtgggacccacaggctatctgtcaccaaaaggctaagaagaacaaataaattctccagtcctttcttcaaaagaattgctgtaattcttttacatttaaaaaatgacatttctttatgctgggaactgtcatttatttcaagagaacagtgtgtgccttgcatccagctctcactgcaagaccatgcacttcggtcgcatcctcccagccctaccaggtaggaaatgctctgcttcccaagggggaaaca

SEQ ID NO: 137591 - DNA, 601 bp, Human
tggacattctctgtgctagccactatttgggtgcttggctctggaactgtctcatcaagaaaagctgctcgaagtttagaaagcagctcagaactcaaatgaggactgggaagaaatgcttctaagaaaataagcattacatgggaactatctaatggtttctgtccttcagccaatgcacttctcccctgcttctgccatctgggaccatgtcaagggcaaggctgctgggggatattggtaactaccccagtgtccaccttgagcttctgaaggagacggcagcaagcaacagcccagsgggccaggctgccctggatgctcacctgatgtggtgcaggacctcctggcactggttgtggtactgctggagccaggctttgagctggttgggggcaaccaccagcaaagggtgaagcggctttcccaaagatgcctggaacaaaaaatgcaagtgccgactcgacgacagaacatctcaataaaaactggagtgccaagaggcatggcggatgatgtgtaaaccgctgaaactcagaacgcccatcaagtgccacacttaccaaggcgcgttctctctgcagcaagatacttggcaagc

SEQ ID NO: 137592 - DNA, 601 bp, Human
catgagttaaatcatagtcactatgatgaggaaacagcagtcaaatataaagagccaaaccaaagcctctaggccactgggagaaacccagcaggtgaatgctgcctccggctcaggcagcacgggccacggatggctccagcagaggggactccttccccttggggtgaggatggtgccacctgccagctagccacacacctgctatggacattctctgtgctagccactatttgggtgcttggctctggaactgtctcatcaagaaaagctgctcgaagtttagaaagcagctcagaastcaaatgaggactgggaagaaatgcttctaagaaaataagcattacatgggaactatctaatggtttctgtccttcagccaatgcacttctcccctgcttctgccatctgggaccatgtcaagggcaaggctgctgggggatattggtaactaccccagtgtccaccttgagcttctgaaggagacggcagcaagcaacagcccagggggccaggctgccctggatgctcacctgatgtggtgcaggacctcctggcactggttgtggtactgctggagccaggctttgagctggttggg

SEQ ID NO: 137593 - DNA, 601 bp, Human
cgcagctcccgcttctccctgcgctcctccatctcctcgatgtcgccagcaaacagggctttcagtgggggaatcagcttgggcattgttggaaagtctccaaagcagacctagaagacacaatagaagacaaggacatgtctcagaggggcaggggtgggggacaggagctggaagggatgcagtcatgtgctcacacagcagcgccaacgccccttccttggcacaagccaacaggccacagctgaaatggaaaaaagaatggcatggagggaaccctctaaaggggcagaggctcccyaggcctggctaagggcctccggagagggaagggagagcagtccagatgctctcaaaatcaagctcctgaaaaacgaggcctggctccggctctgccccttcattccggaaggccaagggtcaggcctggctttcccactcacaagaggcaaccacctgtctcacaggtctgtgctgaggctcaaatgccatgactgtgtgagcagtccaggcctaaaaggattctcagaaatttccagtgaactgagactgaagactagttggcccctgcaggaggtgggtctcaccagcaaacccaggg

SEQ ID NO: 137594 - DNA, 601 bp, Human; identical to SEQ ID NO: 26995

SEQ ID NO: 137595 - DNA, 601 bp, Human; identical to SEQ ID NO: 26996

SEQ ID NO: 137596 - DNA, 601 bp, Human; identical to SEQ ID NO: 26997

SEQ ID NO: 137597 - DNA, 601 bp, Human; identical to SEQ ID NO: 26998

SEQ ID NO: 137598 - DNA, 601 bp, Human; identical to SEQ ID NO: 26999

SEQ ID NO: 137599 - DNA, 601 bp, Human; identical to SEQ ID NO: 27000

SEQ ID NO: 137600 - DNA, 601 bp, Human; identical to SEQ ID NO: 27001

SEQ ID NO: 137601 - DNA, 601 bp, Human; identical to SEQ ID NO: 27002

SEQ ID NO: 137602 - DNA, 601 bp, Human; identical to SEQ ID NO: 27003

SEQ ID NO: 137603 - DNA, 601 bp, Human; identical to SEQ ID NO: 27004

SEQ ID NO: 137604 - DNA, 601 bp, Human; identical to SEQ ID NO: 27005

SEQ ID NO: 137605 - DNA, 601 bp, Human; identical to SEQ ID NO: 27006

SEQ ID NO: 137606 - DNA, 601 bp, Human; identical to SEQ ID NO: 27007

SEQ ID NO: 137607 - DNA, 601 bp, Human; identical to SEQ ID NO: 27008

SEQ ID NO: 137608 - DNA, 601 bp, Human; identical to SEQ ID NO: 27009

SEQ ID NO: 137609 - DNA, 601 bp, Human; identical to SEQ ID NO: 27010

SEQ ID NO: 137610 - DNA, 601 bp, Human; identical to SEQ ID NO: 27011

SEQ ID NO: 137611 - DNA, 601 bp, Human; identical to SEQ ID NO: 27012

SEQ ID NO: 137612 - DNA, 601 bp, Human; identical to SEQ ID NO: 27013

SEQ ID NO: 137613 - DNA, 601 bp, Human; identical to SEQ ID NO: 27014

SEQ ID NO: 137614 - DNA, 601 bp, Human; identical to SEQ ID NO: 27015

SEQ ID NO: 137615 - DNA, 601 bp, Human; identical to SEQ ID NO: 27016

SEQ ID NO: 137616 - DNA, 601 bp, Human; identical to SEQ ID NO: 27017

SEQ ID NO: 137617 - DNA, 601 bp, Human; identical to SEQ ID NO: 27018

SEQ ID NO: 137618 - DNA, 601 bp, Human; identical to SEQ ID NO: 27019

SEQ ID NO: 137619 - DNA, 601 bp, Human; identical to SEQ ID NO: 27020

SEQ ID NO: 137620 - DNA, 601 bp, Human; identical to SEQ ID NO: 27021

SEQ ID NO: 137621 - DNA, 601 bp, Human; identical to SEQ ID NO: 27022

SEQ ID NO: 137622 - DNA, 601 bp, Human; identical to SEQ ID NO: 27023

SEQ ID NO: 137623 - DNA, 601 bp, Human; identical to SEQ ID NO: 27024

SEQ ID NO: 137624 - DNA, 601 bp, Human; identical to SEQ ID NO: 27025

SEQ ID NO: 137625 - DNA, 601 bp, Human; identical to SEQ ID NO: 27026

SEQ ID NO: 137626 - DNA, 601 bp, Human; identical to SEQ ID NO: 27027

SEQ ID NO: 137627 - DNA, 601 bp, Human; identical to SEQ ID NO: 27028

SEQ ID NO: 137628 - DNA, 601 bp, Human; identical to SEQ ID NO: 27029

SEQ ID NO: 137629 - DNA, 601 bp, Human; identical to SEQ ID NO: 27030

SEQ ID NO: 137630 - DNA, 601 bp, Human; identical to SEQ ID NO: 27031

SEQ ID NO: 137631 - DNA, 601 bp, Human; identical to SEQ ID NO: 27032

SEQ ID NO: 137632 - DNA, 601 bp, Human; identical to SEQ ID NO: 27033

SEQ ID NO: 137633 - DNA, 601 bp, Human; identical to SEQ ID NO: 27034

SEQ ID NO: 137634 - DNA, 601 bp, Human; identical to SEQ ID NO: 27035

SEQ ID NO: 137635 - DNA, 601 bp, Human; identical to SEQ ID NO: 27036

SEQ ID NO: 137636 - DNA, 601 bp, Human; identical to SEQ ID NO: 27037

SEQ ID NO: 137637 - DNA, 601 bp, Human; identical to SEQ ID NO: 27038

SEQ ID NO: 137638 - DNA, 601 bp, Human; identical to SEQ ID NO: 27039

SEQ ID NO: 137639 - DNA, 601 bp, Human; identical to SEQ ID NO: 27040

SEQ ID NO: 137640 - DNA, 601 bp, Human; identical to SEQ ID NO: 27041

SEQ ID NO: 137641 - DNA, 601 bp, Human; identical to SEQ ID NO: 27042

SEQ ID NO: 137642 - DNA, 601 bp, Human; identical to SEQ ID NO: 27043

SEQ ID NO: 137643 - DNA, 601 bp, Human; identical to SEQ ID NO: 27044

SEQ ID NO: 137644 - DNA, 601 bp, Human; identical to SEQ ID NO: 27045

SEQ ID NO: 137645 - DNA, 601 bp, Human; identical to SEQ ID NO: 27046

SEQ ID NO: 137646 - DNA, 601 bp, Human; identical to SEQ ID NO: 27047

SEQ ID NO: 137647 - DNA, 601 bp, Human; identical to SEQ ID NO: 27048

SEQ ID NO: 137648 - DNA, 601 bp, Human; identical to SEQ ID NO: 27049

SEQ ID NO: 137649 - DNA, 601 bp, Human; identical to SEQ ID NO: 27050

SEQ ID NO: 137650 - DNA, 601 bp, Human; identical to SEQ ID NO: 27051

SEQ ID NO: 137651 - DNA, 601 bp, Human; identical to SEQ ID NO: 27052

SEQ ID NO: 137652 - DNA, 601 bp, Human; identical to SEQ ID NO: 27053

SEQ ID NO: 137653 - DNA, 601 bp, Human; identical to SEQ ID NO: 27054

SEQ ID NO: 137654 - DNA, 601 bp, Human; identical to SEQ ID NO: 27055

SEQ ID NO: 137655 - DNA, 601 bp, Human; identical to SEQ ID NO: 27056

SEQ ID NO: 137656 - DNA, 601 bp, Human; identical to SEQ ID NO: 27057

SEQ ID NO: 137657 - DNA, 601 bp, Human; identical to SEQ ID NO: 27058

SEQ ID NO: 137658 - DNA, 601 bp, Human; identical to SEQ ID NO: 27059

SEQ ID NO: 137659 - DNA, 601 bp, Human; identical to SEQ ID NO: 27060

SEQ ID NO: 137660 - DNA, 601 bp, Human; identical to SEQ ID NO: 27061

SEQ ID NO: 137661 - DNA, 601 bp, Human; identical to SEQ ID NO: 27062

SEQ ID NO: 137662 - DNA, 601 bp, Human; identical to SEQ ID NO: 27063

SEQ ID NO: 137663 - DNA, 601 bp, Human; identical to SEQ ID NO: 27064

SEQ ID NO: 137664 - DNA, 601 bp, Human; identical to SEQ ID NO: 27065

SEQ ID NO: 137665 - DNA, 601 bp, Human; identical to SEQ ID NO: 27066

SEQ ID NO: 137666 - DNA, 601 bp, Human; identical to SEQ ID NO: 27067

SEQ ID NO: 137667 - DNA, 601 bp, Human; identical to SEQ ID NO: 27068

SEQ ID NO: 137668 - DNA, 601 bp, Human; identical to SEQ ID NO: 27069

SEQ ID NO: 137669 - DNA, 601 bp, Human; identical to SEQ ID NO: 27070

SEQ ID NO: 137670 - DNA, 601 bp, Human; identical to SEQ ID NO: 27071

SEQ ID NO: 137671 - DNA, 601 bp, Human; identical to SEQ ID NO: 27072

SEQ ID NO: 137672 - DNA, 601 bp, Human; identical to SEQ ID NO: 27073

SEQ ID NO: 137673 - DNA, 601 bp, Human; identical to SEQ ID NO: 27074

SEQ ID NO: 137674 - DNA, 601 bp, Human; identical to SEQ ID NO: 27075

SEQ ID NO: 137675 - DNA, 601 bp, Human; identical to SEQ ID NO: 27076

SEQ ID NO: 137676 - DNA, 601 bp, Human; identical to SEQ ID NO: 27077

SEQ ID NO: 137677 - DNA, 601 bp, Human; identical to SEQ ID NO: 27078

SEQ ID NO: 137678 - DNA, 601 bp, Human; identical to SEQ ID NO: 27079

SEQ ID NO: 137679 - DNA, 601 bp, Human; identical to SEQ ID NO: 27080

SEQ ID NO: 137680 - DNA, 601 bp, Human; identical to SEQ ID NO: 27081

SEQ ID NO: 137681 - DNA, 601 bp, Human; identical to SEQ ID NO: 27082

SEQ ID NO: 137682 - DNA, 601 bp, Human; identical to SEQ ID NO: 27083

SEQ ID NO: 137683 - DNA, 601 bp, Human; identical to SEQ ID NO: 27084

SEQ ID NO: 137684 - DNA, 601 bp, Human; identical to SEQ ID NO: 27085

SEQ ID NO: 137685 - DNA, 601 bp, Human; identical to SEQ ID NO: 27086

SEQ ID NO: 137686 - DNA, 601 bp, Human; identical to SEQ ID NO: 27087

SEQ ID NO: 137687 - DNA, 601 bp, Human; identical to SEQ ID NO: 27088

SEQ ID NO: 137688 - DNA, 601 bp, Human; identical to SEQ ID NO: 27089

SEQ ID NO: 137689 - DNA, 601 bp, Human; identical to SEQ ID NO: 27090

SEQ ID NO: 137690 - DNA, 601 bp, Human; identical to SEQ ID NO: 27091

SEQ ID NO: 137691 - DNA, 601 bp, Human; identical to SEQ ID NO: 27092

SEQ ID NO: 137692 - DNA, 601 bp, Human; identical to SEQ ID NO: 27093

SEQ ID NO: 137693 - DNA, 601 bp, Human; identical to SEQ ID NO: 27094

SEQ ID NO: 137694 - DNA, 601 bp, Human; identical to SEQ ID NO: 27095

SEQ ID NO: 137695 - DNA, 601 bp, Human; identical to SEQ ID NO: 27096

SEQ ID NO: 137696 - DNA, 601 bp, Human; identical to SEQ ID NO: 27097

SEQ ID NO: 137697 - DNA, 601 bp, Human; identical to SEQ ID NO: 27098

SEQ ID NO: 137698 - DNA, 601 bp, Human; identical to SEQ ID NO: 27099

SEQ ID NO: 137699 - DNA, 601 bp, Human; identical to SEQ ID NO: 27100

SEQ ID NO: 137700 - DNA, 601 bp, Human; identical to SEQ ID NO: 27101

SEQ ID NO: 137701 - DNA, 601 bp, Human; identical to SEQ ID NO: 27102

SEQ ID NO: 137702 - DNA, 601 bp, Human; identical to SEQ ID NO: 27103

SEQ ID NO: 137703 - DNA, 601 bp, Human; identical to SEQ ID NO: 27104

SEQ ID NO: 137704 - DNA, 601 bp, Human; identical to SEQ ID NO: 27105

SEQ ID NO: 137705 - DNA, 601 bp, Human; identical to SEQ ID NO: 27106

SEQ ID NO: 137706 - DNA, 601 bp, Human; identical to SEQ ID NO: 27107

SEQ ID NO: 137707 - DNA, 601 bp, Human; identical to SEQ ID NO: 27108

SEQ ID NO: 137708 - DNA, 601 bp, Human; identical to SEQ ID NO: 27109

SEQ ID NO: 137709 - DNA, 601 bp, Human; identical to SEQ ID NO: 27110

SEQ ID NO: 137710 - DNA, 601 bp, Human; identical to SEQ ID NO: 27111

SEQ ID NO: 137711 - DNA, 601 bp, Human; identical to SEQ ID NO: 27112

SEQ ID NO: 137712 - DNA, 601 bp, Human; identical to SEQ ID NO: 27113

SEQ ID NO: 137713 - DNA, 601 bp, Human
aactccactttcccccgccacaatctcctcccttgcctccccctccccacctcccacctacccacccccgccagccccactgcactgctgaagccttcctccagccactgctccctcctcacacaggacagctacaccctggtgcccacaaatgaagtccagacagcttagtcccatagacagagccctctgcaccctgaccgcaaccaaccgtcctcccatccctggaacccacagctctgccagtctgctggccaaacagccccattctgccctcatctccaggcctcgttccagcatyccccaggctggaatgtcctcatcccaacagaagtctactctccttcagggcccagctgaaatccctctcccacaggcacctgccttgatgcctcaggctctaggcgcagggactgcggccaggctggggcacctgcccttcttccccctgccctggcttcccctcctgggtggggagctctgtgtagtggtcccctccacccctccattctgccctgcggcaggtgtgtgtgcactcattaacaccctgccccacactggactgcgggctccttgagggcagacacattgtctcagagac

SEQ ID NO: 137714 - DNA, 601 bp, Human
accacagccaccgtcatgccctgctcgccctgccccggacccagccctgcccaggcaccgaagagcgaggtgagcaacagggccggccccagggccccacccatgtccaccggagggtcctgcggagagaccagaacaagcacagggagagagacagaggtttggagagaggcagatggacagacaggagggacagagggacacacatacggaagatgaaagagaagaggggaaaacctccctccccgaagagaggcagagagagagggagacagacagacacggacaaagagaaagagayagaggttagttgagcatcccaagggcatcccagaagagcaagggctggggaagaacaggagccatgaccgggacccagccctccagtctactgatgccttccaaaactcagccagtgggttctgccctaggaagtcatactgaaaatgctagtctggggttcaagtgcatggatttgagtcagacagatctgagttcgtgtcccagttctgccactaactggctgtgtgatcttagggaagtcacttagcctctctgagccatgttttcttgcctgaaataatcacagcagtgtgaggac

SEQ ID NO: 137715 - DNA, 601 bp, Human
gcgggcacggaactgggcctggggcggccctgagctgctaaacaccacagccaccgtcatgccctgctcgccctgccccggacccagccctgcccaggcaccgaagagcgaggtgagcaacagggccggccccagggccccacccatgtccaccggagggtcctgcggagagaccagaacaagcacagggagagagacagaggtttggagagaggcagatggacagacaggagggacagagggacacacatacggaagatgaaagagaagaggggaaaacctccctccccgaagagaggcrgagagagagggagacagacagacacggacaaagagaaagagatagaggttagttgagcatcccaagggcatcccagaagagcaagggctggggaagaacaggagccatgaccgggacccagccctccagtctactgatgccttccaaaactcagccagtgggttctgccctaggaagtcatactgaaaatgctagtctggggttcaagtgcatggatttgagtcagacagatctgagttcgtgtcccagttctgccactaactggctgtgtgatcttagggaagtcacttagcctctctg

SEQ ID NO: 137716 - DNA, 601 bp, Human
cttgggggtgaggaccacagcagagcctccgctgatgctgaggatgggcacatgggtctgggaggagatgaagtcaaggatctgggccaccgcctcggtgtccacgttgtcctcaaagacaatgccgtggacgtgggcagcacccaggaggccgcagatctgggtgaggaggctgctggggttggtggtgttgaccccaactgtgagcggctggatctccaggggtaggtccaggaagctctggggggtgaggcgggcacggaactgggcctggggcggccctgagctgctaaacaccacrgccaccgtcatgccctgctcgccctgccccggacccagccctgcccaggcaccgaagagcgaggtgagcaacagggccggccccagggccccacccatgtccaccggagggtcctgcggagagaccagaacaagcacagggagagagacagaggtttggagagaggcagatggacagacaggagggacagagggacacacatacggaagatgaaagagaagaggggaaaacctccctccccgaagagaggcagagagagagggagacagacagacacggacaaagagaaagagatagagg

SEQ ID NO: 137717 - DNA, 601 bp, Human
tggaagatgaggggttggataagggacagagggactctctgctcagctgtgggcacaagaggaggcggggacaaaataagaggacactgagggcccctgggctcacccccttctcaccatctcccagaggcggtgccggttgagggcgatcaccaccatggtgggctggaccaggtacccaccagggctgaaggagaagtctcggccctcccaggtgacattcagtaggtgcctgccagaggggagagatgcctgcagccctgccaaggaccaggcaccccctgcctctgcctcaccgccrccaccgacagcaggtggcattgattgtgtttattgttcaaagtgcttccctatattggccccacgatccttgccacaccctgacacctgctgtttgttcagatgaggacactaaggcccagacaggtggggtaatgtggccccaggcacgcagctagtgggaggtgtggctggccagcccaaactcactgccagccagctcccccgaagcgctccccacctccctacccctatgccccgggcaggtgcccacctgtagaaggcctcccgggcagggctgacgggcccagggtgaacacgg

SEQ ID NO: 137718 - DNA, 601 bp, Human
tgggctcctactcaaacctccacagcccagctcaaatatcccatcttctgggacctctttcccagtttcctcctttgaaggcagaactaattcctgttcctcatctccaatcccacaatcttttgcacacgtctactcaagcacttgtccctgcatattgtttacaagcctgtctggccagcatggtcatgggttactcctgcaggggcaggaccaggagataggagcgcttgaaatgttctatagtagagggaagccggggtgttatgggagcccagagcagggcacctcacccacccckgggcacctggaggcttcccagtggaggagatgtttgtttcagctgagacctggaagatgaggggttggataagggacagagggactctctgctcagctgtgggcacaagaggaggcggggacaaaataagaggacactgagggcccctgggctcacccccttctcaccatctcccagaggcggtgccggttgagggcgatcaccaccatggtgggctggaccaggtacccaccagggctgaaggagaagtctcggccctcccaggtgacattcagtaggtgcctgccagaggggagagat

SEQ ID NO: 137719 - DNA, 601 bp, Human
gcatctgagagccacatggggcctgggcagcaggtgggcaggcagggcaggtgaggagggagtggggtggggcctacctccccaatcatgccgttccatacgccgcgcacccgcttgccatgcttgccgttggtcaccaggtacaggtcgtaggagaatttgaccactctggccagcttcttgaggatgtcgatgcagaatcccttacagcagagcttggtgtagggggccacgtccccgctgctgcagccatgccgccatgagaccaccgggagtcagagtatgtcgtggcccagccccrccccagccactcctccagcctggcacgtggacccctgccccacacccaagcatgggacatacacgacacctgaccatcacacggcagcacccagctcacactagcctcccagggccctccacagacctgaaggtgtggttgctctgcctgcggcagggcacggtgttggggacacagcctcctgtgccagggtcagggctctccacgatgacaaagggccgctcttccagcgtggccaccgtcaggtgccgactgtccaccacaggctgcagagaggcactgtagcgaggccacacgggg

SEQ ID NO: 137720 - DNA, 601 bp, Human
cccagggaactggagacatccaccccaggcctcagacaagactgtttctgtctcctagagtaagaaatcactactgctggctgggcttggtggctctcgcctgtaatcccagcactttgggaggacgagacgggcggatcgttcgagaccagcctggccaacatggcgaaaccctgtctctactaaaaatacaaaaattagccaggcatggtgacacatgcctgtagtcccagctactcaggagcctgaggcaagagaatcagttgaacccaggaggcggcagttgcagtgagctgagagygcaccactgcactccagcctggatgacagagcaagactcattctcaaaaaaaaaggaaagaaaagaaatcactactattggccaggtgcagtagctcacacctgtaatcccagcattttgggcggctgaggcaggtggactgcttgagtccaggagtttggagaccagcctgggcaacatagtgaaaacctgtctctacacaaaatacaaaaattagccaggtgtggcggcatgcacctgtggtcccagctactcaagaggctgaggtgggaggatcacttgagcccaggagtttccagg

SEQ ID NO: 137721 - DNA, 601 bp, Human
tgctctgtcacccaggctggggtgcagtggtgtgatcatggctcactgcagcctggatctcctaggttcaagcgatccttccacctcagccccctgagtagctgggactacaggcacaccaccacacctggctaatttttgtatcttttgtagagatagggtatccccatgttgtccaagctgatcccgatctcctagacttaagcaatcctcacaccttggcctcccaaagtgctgggattacaggtatgagccacctcacctggccgctctcattattatatggtttgagaaatcagatttttttttttttttttttttgagacagggtctcactctgtcacccaggctggagtgcagtggcacaatcatggctcactgcagcctcaaactcctggactcaagggatcctcctgcctcagcctcccaagtagctgggattataggtgtgtgccaccatgcctggctaattttttaaaaactttatttatagagacaggatcttgctgtgttgcccaggctggtctcaaactcttgacttcaagtgatcctcccacctcagcctcccaaagtgctggggttatagccatgagccaccaca

SEQ ID NO: 137722 - DNA, 601 bp, Human
acaggccgtaagcagcgccctccgctcagggacccgccacgattgtccctgcctggtcccaaggcatcatcagtcttctataagtctcaggaagtagctaactgtgaagcatctcccatgcgccaggcactgtgctttgcagatgaatgagtggtctgagcgcccaggttgactcattctcctaatcactctagctagcacctggcacatgaaggttccaacctgggcacacctgtgggggggactctgaccctcttcaaccctgccaccctggtgagccatgccacttctcaggacgttrgcttttttttttttttttagaaacaggatctcactctgctgcccaggctggagtgcagtggtgccatctcggctcactgcaacctctgccttcttggctcaagcgatcctcccaattcagcctcctgagtagctgggactgcaggcgcgcaccaccacgcccagctaattcttttattttctgtagagatgggttttcgccatgttgcccaggctggtctcaaacttctggactcaagggatccactggcctaagcctctcaaagtgttgagattacaggtgtgagccatgagccgggcc

SEQ ID NO: 137723 - DNA, 601 bp, Human
tcaccatgtcgcgggctgcctgcagcatcttgagcacgctggcctgggccgagctggccgtgaggtccgggctggcctgccgcggtgggctggcgaggctctgcaccccgctgaagcagctgtagatgccctgggcagtagggagacgacaggccgtaagcagcgccctccgctcagggacccgccacgattgtccctgcctggtcccaaggcatcatcagtcttctataagtctcaggaagtagctaactgtgaagcatctcccatgcgccaggcactgtgctttgcagatgaatgagtsgtctgagcgcccaggttgactcattctcctaatcactctagctagcacctggcacatgaaggttccaacctgggcacacctgtgggggggactctgaccctcttcaaccctgccaccctggtgagccatgccacttctcaggacgttggcttttttttttttttttagaaacaggatctcactctgctgcccaggctggagtgcagtggtgccatctcggctcactgcaacctctgccttcttggctcaagcgatcctcccaattcagcctcctgagtagctgggactgcaggcgcgcac

SEQ ID NO: 137724 - DNA, 601 bp, Human
ggtccaggggagctgcttacgcccgccgtggtcaccatgtcgcgggctgcctgcagcatcttgagcacgctggcctgggccgagctggccgtgaggtccgggctggcctgccgcggtgggctggcgaggctctgcaccccgctgaagcagctgtagatgccctgggcagtagggagacgacaggccgtaagcagcgccctccgctcagggacccgccacgattgtccctgcctggtcccaaggcatcatcagtcttctataagtctcaggaagtagctaactgtgaagcatctcccatgcrccaggcactgtgctttgcagatgaatgagtggtctgagcgcccaggttgactcattctcctaatcactctagctagcacctggcacatgaaggttccaacctgggcacacctgtgggggggactctgaccctcttcaaccctgccaccctggtgagccatgccacttctcaggacgttggcttttttttttttttttagaaacaggatctcactctgctgcccaggctggagtgcagtggtgccatctcggctcactgcaacctctgccttcttggctcaagcgatcctcccaattcagc

SEQ ID NO: 137725 - DNA, 601 bp, Human
ggctgctggcgggggaccggctggtggaggtgaacggcgaaaacgtggagaaggagacccaccagcaggtggtgagccgcatccgcgccgcactcaacgccgtgcgcctgctggtggtcgaccccgagacggacgagcagctgcagaagctcggcgtccaggtccgagaggagctgctgcgcgcccaggaagcgccggggcaggccgagccgccggccgccgccgaggtgcagggggctggcaacgaaaatgagcctcgcgaggccgacaagagccacccggagcaggtaagcggggcccragccgcgcaggctggcatggagtgggaggaggatccggagagacccaggtgccccggccgtccagccccgcgcccgccgtcgtttttctgaaactcgagctgcgagggggagaccgcttccgcccgccgaccaggcgccctgacacatcctaggcaggcctggggctgcgtcccgcgacctcctctccttcccaggctgtgctgggagcttgagcgcctttgccgcctgcacctcttgttccctggcctttgggagggcggcgcaggggaacccagcccccttccctcgggtctgtgggt

SEQ ID NO: 137726 - DNA, 601 bp, Human
tggcacacagtcagtgcctgatcgatggtcactgtgggttaagaatgatacgttgtggccaggtgtggtggctcacacctgtaatcccagcactttgggaggccaaagtgggaggatcgcctgagcccaggagtttgagaccagcctaggcaacatgacaagaccctgtctctattaaattttttcttttttttttttaagagttatatgctgttccatggcccttctccatctggcagcctgttctcaccactgcctccctacccccaaaaccacacccagggtccgaattcccctctarcctctaagccttcacaccctgacacttctgtcccctcccagggagcctgtccttaatccagtaggcagagttagcatttcctttccttcactttttttgtttttgtttttgtttttgttttttttgagacagattccacccaggctggagtggtgtcgcaacctcgcctcgctgcagcctcgacctccagggctcaatcgatcctcccacctcattctccctagtagctgggactacaggcatgcaccactattcccagctaatttttaaattctttgtagagatggagtttcaccgtgt

SEQ ID NO: 137727 - DNA, 601 bp, Human
taggcactctacctatgacataaagatgttgacatgcatttctttctttctttctttctttctttcttttttttttttttttttttcctgagacagtcttgctctgttgcccaggctggagtgcagtggtgtgatctcggctcactgcaacctccgtctctcaagttcaagcaattgtcctgcctcagccttccatgtagctaggattacaaacacccgccaccacaccctgctaatttttgtatttttagtagagacggagtttcaccacggtggccaggctgggtggcacctgtcacarcaccctgctaatttttgtatttttagtagagatggggtttcaccacattggccaggctggtttcaaactcctgacctcaggtaatccacctgcctcggtctcccaaagtgctgggattataggcatgagccaccacacccagccaatatgcatttcattgtcccccagacaaattagctattgttttctctattttgtaggttgacagtaagtgttcaatacatgatagctactatttgtgtctagcactgtgctaagtactaaccttgcctgtctcatttaatccacatgaccaccagt

SEQ ID NO: 137728 - DNA, 601 bp, Human
tccagggcttccaggtgctcctgtccctagcagggcatccttgcagtgcctcagcccataagtggcaggctcctgtccccatcccttctcacgtgatgtgataggtcaatctggaatctggtaaccaagtatctacccccgccctcactccccagaacctgcacagagagcccccctcaagggtggtcttcactgttgaccgaagccttcccctcatggtaggacaactcaccatgtccccagactcctaggcaatgtttaggtccctaggccctagaaaaggacaagagttacagattcyctgaggtccaggtcacctcggggtggtgtgggaacacacagagaatgctggccaggttcaagtcccactcactgctgggtgctgagagctctgaattctccgagacaggctgcagcctctccctgtgctaaggtcaggggaacagcaatggccaggggtatttagaggagtgtgtttggggcagtctcaggcagcacaggtctgtgctgtccgggcagcagccaccagcttcgcgaggctcccgggcactcgagatgtgctggtccacatgcagacgtgctgtgtgtgcaaaatgcacac

SEQ ID NO: 137729 - DNA, 601 bp, Human
gcgatctcggctcactgcaagctccacctcccaggttcaagcgattctcctgcctcagcctcccaagtagctgtgcaccaccacgcccagctgatttttgtatttttcttttttagtagagatagggtttcaccatgttgaccaggctggtctcaaactcctgtgctcaagtgatccacttgcctcgtcctcccaaaatgctgggattacaggcatgagccaccacacctggcctatttttcttttctttctttctttctttttttttttttttttttttttgagacggagccttgctctrtcacccaggctggagtgcagtggcgtgatctcggctcactgcaacctccgcctcctgggttcaagcggttctcgtgcctcagcctctggagtagctgggaccacaggtgtgcaccaccacatatgtctaattttcatatttttagttgagacagggtttcaccatgttggccatgctggtcttgaactcccgacctcaggtgatccacctgccttggcctcccaaaatgctgggattacaagtgtgagccactgcacccggcctatttttcctttttcaaatgtgatgactagaaaatct

SEQ ID NO: 137730 - DNA, 601 bp, Human
aaagccagccagcattttgtgaaagtgagagtctccagcctgtccagccctgggtcaccccggcccagctgcgctgcccatcggctgcatggcctcatgttccctcctgttgattctggctctctgccagtctcctctctgagcagatcctgattttgtcttgaacttgggtctcccaggctgtcgtcgtcactggaggtcccactttgccctccggaactcactggggctatgttccttttgagtctcctcctcccaccatgcttcggacccctctgtagctggctcctcctaagatccygggggccacacaccaagcccaacatgcctggacgtcactcccatttatcccctttccccagaggcagaacccagccctgccccagcttggcggtgagggtccaagagcaatggtggctgagctcggccaggtaccccacacctccccatcttctcctctcagtgctgggcctggagaccacaggccaggccccacagatccccaggggggctgccccaagggactcccctgccagccccagcctccacccaggctgggatgggctggcttgatgggctgactcagcaactggcactgaca

SEQ ID NO: 137731 - DNA, 601 bp, Human
catgttccctcctgttgattctggctctctgccagtctcctctctgagcagatcctgattttgtcttgaacttgggtctcccaggctgtcgtcgtcactggaggtcccactttgccctccggaactcactggggctatgttccttttgagtctcctcctcccaccatgcttcggacccctctgtagctggctcctcctaagatcctgggggccacacaccaagcccaacatgcctggacgtcactcccatttatcccctttccccagaggcagaacccagccctgccccagcttggcggtragggtccaagagcaatggtggctgagctcggccaggtaccccacacctccccatcttctcctctcagtgctgggcctggagaccacaggccaggccccacagatccccaggggggctgccccaagggactcccctgccagccccagcctccacccaggctgggatgggctggcttgatgggctgactcagcaactggcactgacacctcctggagacagctgggaggctcctgctagggaggggtgaggaggaacaaggctggtctcccttgaagagtgggaaccccccttcccatgtga

SEQ ID NO: 137732 - DNA, 601 bp, Human; identical to SEQ ID NO: 29565

SEQ ID NO: 137733 - DNA, 601 bp, Human; identical to SEQ ID NO: 29566

SEQ ID NO: 137734 - DNA, 601 bp, Human; identical to SEQ ID NO: 29567

SEQ ID NO: 137735 - DNA, 601 bp, Human; identical to SEQ ID NO: 29568

SEQ ID NO: 137736 - DNA, 601 bp, Human
acctttgttgacctccgtctctaaccctagaagcctcacatctcacgcacagatctccgcccacccccgtacaccaccgggatctcgccagcaggaagacaccccttcagtctcacccttctccagccctgccccagctctgctccgacccctactcagcgctcgcaggcctccccgcgctcccatccagccccaaaggcgccctgctcctactcggggtgctcccggcgggaggcagccgggtccgaggccacgccgaccagccccaccagcgccagcagcgcgaagccatggctgggarcagcaacctgcaagtggatctgttcctagctactgctccgcagggcaagcccgctcctgcccgggcccgcccacaagcgaggccccgccccaaaccccgccccctgcgctccgggaaagcggagccttgcggctccaccccgactcccgagagaatcccgcccccaaaagagagacccgcccttaactacgccccaccgtcgaagccccgcccctcggagcatccggggtatacgcgatttaatacatttctccccaggcctcaccttccctccaaatcccggaagcctagggttggaag

SEQ ID NO: 137737 - DNA, 601 bp, Human
gataacctgaggtcaggagttcgagaccagcctgaccaacatggtgaaaccctgtctctactaaaaatacaaaaattagctgagcgtggtggtaggcacctgcaatcccagctacttgggaggctgaggcaggagaaccgcttgaacccaggaggcagaggttgcagtgagcgaagatcgcgccattgcactccagcctgggtgacagagcaagactctgtctcaaaaaaaaaaaaaaaaaaaaaaaaaaagacgacgacggccggccctcggagatggggagaaatgtggccagctgacraggccgtggcttcccccgactggaattatatcagggcggcttctttatcttctcaggtcaagcacaacccacagccctggcctccaacccttcgacacttgggaccctcaggtcccagccagtctgaggacctgagggccaccctctgaattcacaggtgccttagctctagtgcccaggaccatgctctggggaaaggggagcagcaggacagggagggggcacggctgggaattcacgggaaagagaggtggaaatgggcctgctcccactcttagaaagacagtctcaggcactggt

SEQ ID NO: 137738 - DNA, 601 bp, Human
cccagcactttgggaggctgaggcaggtggataacctgaggtcaggagttcgagaccagcctgaccaacatggtgaaaccctgtctctactaaaaatacaaaaattagctgagcgtggtggtaggcacctgcaatcccagctacttgggaggctgaggcaggagaaccgcttgaacccaggaggcagaggttgcagtgagcgaagatcgcgccattgcactccagcctgggtgacagagcaagactctgtctcaaaaaaaaaaaaaaaaaaaaaaaaaaagacgacgacggccggccctcrgagatggggagaaatgtggccagctgacaaggccgtggcttcccccgactggaattatatcagggcggcttctttatcttctcaggtcaagcacaacccacagccctggcctccaacccttcgacacttgggaccctcaggtcccagccagtctgaggacctgagggccaccctctgaattcacaggtgccttagctctagtgcccaggaccatgctctggggaaaggggagcagcaggacagggagggggcacggctgggaattcacgggaaagagaggtggaaatgggcctgctccca

SEQ ID NO: 137739 - DNA, 601 bp, Human
gtccacgtgggcctgggggtgctgctggggaacagggtggcagctggtggggtcgagagagagaggctgggacgcccccaggtcctccccttccccagacagagcaggagagttcaggaccctgggctgagaacacaaggcttccaccctctgcaaggaaaaagagcactcactccttgggtggctcgcgcctgtcagcccagcactttgggaggctgaggcaggtggataacctgaggtcaggagttcgagaccagcctgaccaacatggtgaaaccctgtctctactaaaaatacaaarattagctgagcgtggtggtaggcacctgcaatcccagctacttgggaggctgaggcaggagaaccgcttgaacccaggaggcagaggttgcagtgagcgaagatcgcgccattgcactccagcctgggtgacagagcaagactctgtctcaaaaaaaaaaaaaaaaaaaaaaaaaaagacgacgacggccggccctcggagatggggagaaatgtggccagctgacaaggccgtggcttcccccgactggaattatatcagggcggcttctttatcttctcaggtcaagcacaacccaca

SEQ ID NO: 137740 - DNA, 601 bp, Human
gtggggtcagtaggatgcgggccacgtccagagccacgttcccctgccccagaatcacggctgtgtcacagctcaggtctggctccagctggaggggaaaggtcttgatagggtcccccggcctcgctccactcagctcatctcagtctgcaggtgcctcatgcctggtccccactgtgccctggggcttccccacaccgggaaagtccacaactctggtccctcctcccccacctggacccagctctcccccgaggccctccacagctggcctcccgcctcagtcagcacaatgtcacakctcgccactggatggcagctccctcttcccccaggtctggcatccaagggctgaggggcggggaggaagaggcagcgggcgtgctccccatactcacctcctggttctcaggaagcccgttgtaccagcccacgaaggcccgggcggagcacacacctggcagctcctcaccaggaatttccagggcccgatggtcctctgccccgtagctctgatgaaagatggcaggcccgagacccacagccttcagcaccagcactgataggccgggcagccccccaggctcccagcggcctcctt

SEQ ID NO: 137741 - DNA, 601 bp, Human
gcccttcagagagcctctgcctgggcaccacggggaaacagaggcactgagcccagcttggagaggtaaggcctgaaccctgcagacaagggcactctctcctcagggtgaccccacctccaaccccgccagccctgacctaccactcacctccaggtgctcaggtggggtcagtaggatgcgggccacgtccagagccacgttcccctgccccagaatcacggctgtgtcacagctcaggtctggctccagctggaggggaaaggtcttgatagggtcccccggcctcgctccactcagytcatctcagtctgcaggtgcctcatgcctggtccccactgtgccctggggcttccccacaccgggaaagtccacaactctggtccctcctcccccacctggacccagctctcccccgaggccctccacagctggcctcccgcctcagtcagcacaatgtcacatctcgccactggatggcagctccctcttcccccaggtctggcatccaagggctgaggggcggggaggaagaggcagcgggcgtgctccccatactcacctcctggttctcaggaagcccgttgtaccagcccacgaa

SEQ ID NO: 137742 - DNA, 601 bp, Human
aggaagctcatggcactgcccttcagagagcctctgcctgggcaccacggggaaacagaggcactgagcccagcttggagaggtaaggcctgaaccctgcagacaagggcactctctcctcagggtgaccccacctccaaccccgccagccctgacctaccactcacctccaggtgctcaggtggggtcagtaggatgcgggccacgtccagagccacgttcccctgccccagaatcacggctgtgtcacagctcaggtctggctccagctggaggggaaaggtcttgatagggtcccccrgcctcgctccactcagctcatctcagtctgcaggtgcctcatgcctggtccccactgtgccctggggcttccccacaccgggaaagtccacaactctggtccctcctcccccacctggacccagctctcccccgaggccctccacagctggcctcccgcctcagtcagcacaatgtcacatctcgccactggatggcagctccctcttcccccaggtctggcatccaagggctgaggggcggggaggaagaggcagcgggcgtgctccccatactcacctcctggttctcaggaagcccg

SEQ ID NO: 137743 - DNA, 601 bp, Human
ccaggcagcagctactcccaggggctctgccccaccccaaccccttaaggagaggccccctccacctggaaccctggctcctcccactctggccccagcaccttaatggtgaaggccacttgcaggggtccacgccggcccactagccacactgtcttcactcgactctgcctcagtacacccagggctgccttcgtgatgtccgttctctggcacaaaaggagggccttggagtcatcagacactgaccgaggaaaggggactctccatttggtcatgtccccaccgtgggcctggagarggctggcggctcaaaattgcgccactgctcccccctggtggccagatggagcattgctgccaactctgcaaatggctccaactaatagcacaccaggcccacactttcattcaacaagtatgtagtgggcctctaccatgtgctcacccccatgcaaagagcttggaggggcggggtggtcaatggtgaggaaaagagacaaggagcaggccctctcagagcttgtgatctgctggggagagaaatactcatcaaatactcatcaatgtgtgtaaaattgccgtggcgatgatatgcggt

SEQ ID NO: 137744 - DNA, 601 bp, Human
ggccggtgaggaagctgtcagtcatggttgtggctatgacacctgtaggtcctctcttcacccagccgctgcagtagaggcctgagagggggtaacaaaaggggaagggagggaggtggctggataccaccctggccatcctgtgcccacaatctacacccacgtgcacgcacacagacaccccacgcctcttggcagactgtcggctgagcctgctgtggccgctggtccactgccctggattcttctctccctgtttttaccaggccgacccccttacacctcagtttccctgtagatraggggatccctaagcttaggagctgaggcttgctcccctgcagtttcagtaggcccttggtaaatgtttaccaagtgaattaatcactagataggtatgtgggcacttagtaaaactggacgctccctgaggacacaggctgccttattaatctccaatcccagcactaagcacagggcctaacccagaaaagacctcagtaaacgtttgttgaatgacttaatgacccgacgtatgtcacatatgtcctagccagactggaacttctctcagggccaagaggagggcggcactgggtcc

SEQ ID NO: 137745 - DNA, 601 bp, Human; identical to SEQ ID NO: 137736

SEQ ID NO: 137746 - DNA, 601 bp, Human; identical to SEQ ID NO: 137737

SEQ ID NO: 137747 - DNA, 601 bp, Human; identical to SEQ ID NO: 137738

SEQ ID NO: 137748 - DNA, 601 bp, Human; identical to SEQ ID NO: 137739

SEQ ID NO: 137749 - DNA, 601 bp, Human; identical to SEQ ID NO: 137740

SEQ ID NO: 137750 - DNA, 601 bp, Human; identical to SEQ ID NO: 137741

SEQ ID NO: 137751 - DNA, 601 bp, Human; identical to SEQ ID NO: 137742

SEQ ID NO: 137752 - DNA, 601 bp, Human; identical to SEQ ID NO: 137743

SEQ ID NO: 137753 - DNA, 601 bp, Human; identical to SEQ ID NO: 137744

SEQ ID NO: 137754 - DNA, 601 bp, Human; identical to SEQ ID NO: 32368

SEQ ID NO: 137755 - DNA, 601 bp, Human; identical to SEQ ID NO: 32369

SEQ ID NO: 137756 - DNA, 601 bp, Human; identical to SEQ ID NO: 32370

SEQ ID NO: 137757 - DNA, 601 bp, Human; identical to SEQ ID NO: 32371

SEQ ID NO: 137758 - DNA, 601 bp, Human; identical to SEQ ID NO: 32372

SEQ ID NO: 137759 - DNA, 601 bp, Human; identical to SEQ ID NO: 32373

SEQ ID NO: 137760 - DNA, 601 bp, Human; identical to SEQ ID NO: 32374

SEQ ID NO: 137761 - DNA, 601 bp, Human; identical to SEQ ID NO: 32375

SEQ ID NO: 137762 - DNA, 601 bp, Human; identical to SEQ ID NO: 32376

SEQ ID NO: 137763 - DNA, 601 bp, Human; identical to SEQ ID NO: 32377

SEQ ID NO: 137764 - DNA, 601 bp, Human; identical to SEQ ID NO: 32378

SEQ ID NO: 137765 - DNA, 601 bp, Human; identical to SEQ ID NO: 32379

SEQ ID NO: 137766 - DNA, 601 bp, Human; identical to SEQ ID NO: 32380

SEQ ID NO: 137767 - DNA, 601 bp, Human; identical to SEQ ID NO: 32381

SEQ ID NO: 137768 - DNA, 601 bp, Human
tgacacactttccctgtcgctgacggggtgatgcagcttttactagtttgtggtttagaatggtcaaatggtcattttcatctgttaacacagaggaacacttttctttttcttgtttttgaagtgagtggtataagaataagctttggaggcgaccccccgaaaaatgagcttgatggggattcgaaaatgtttactgggtatggtgatttgggccattataggttagccgcagtcatacaattgagggtattattaaaggagtttcattttaaggccgattaagaacttgagtggactytgggcatcattttctgctagtatacactggccaaattttgggctttgagaaacttttgcgtttgagtcctgaagcaccgtactagaacatggtggctgtaatcgatcagtaaaattagacaaattttaaatgtccctgtccccttccccccaattaaagtagattgggggaaagcgagtagggacatttaaaatttgttgtccttactgtatgcgggacacttcatttagggcgtggcttcagaaaacagtcaacccctttttcttaactaggtagcgactagaacgctgcgttctggga

SEQ ID NO: 137769 - DNA, 601 bp, Human
actgaaataaacgttagattttggaaataattttccttacatgtagttagtttgaaatctctgtgtggcaaaatacaggtagaatcctcatatggggttgatgctacttaaacatttttcctttataaagaaaccctgatggaggagagcctgtttccgtgtttatggagaagggtggtaacttctatctaaataacttgttggtagatttatgtactctgtaagtttgatagaaaaggtacaaaagcactacatttctctttgagaataatcaacaagatagaacgtagaaataagatamcagattatttgaagttagatgttaaagcagcatttcaagaatgtgggtgataactggtaagaattacaaagaatcactatatagttcactggaattgatgaaaactctacaaattatggtagtaagctatgacttggtggccttaaggcaatctaacaacacagtagaatttttctgaggctcactttgccctgcaaataaattggtacttaaccacagactaaaatttaagttgatgacagctgggtgcttatagcgggttagggattcagtttactgtgtctcagaaagtgaccagat

SEQ ID NO: 137770 - DNA, 601 bp, Human
agtggaggagacttggtgtccaacagagtctaggctgggttcattacatgattcatgagccaggtaagctatgctatgttatagtaaagcagtaattgttgaaatattggtggttatggttgtcaaaattttaaaaatatcattgacatcaaatgatatctgaaagtaactgttctgataagtttttttttttaatgactaatttcttgactctggagagagttccaattttatggtaaataaaataccacagcagtgaaagtaacacattattctacttggaaaataatgtaagaagtaaaaaaaaaaaaaaaaaatgtattttaaaatctgtatcattgttaacagtatcccaaagcattttatcataaatatatcctaagacaagtgttcttatctatgtgtggaaattgatttaatttaaagtgattcttcagccctctgaaaggatatataccacatgaagtttaaatgaggtaatagcatatgaactcaactgtgcttatgggtaccttatgctattatgtggtattaaccaaaagtttttcaggtgttaaatagtaaactctactaaaactttgtgggttttctagactaaaac

SEQ ID NO: 137771 - DNA, 601 bp, Human
ttttttttactttttccttttaaggacttcaaaaaaaaaaaaaagccaggcgagatgaaatctgcaggctccagtctgcctggtaacaccccaacaaaagcggcagatttgaggcattgtcatcccccgcacccctccccacgtggccttctggcacgagccgctggctcgccgcctcatttacatcagaaagcgggtgccggccaataggcgcgcagcctcgcgccagctggcggcgccgcacccaccagcctatataagggcgcgcagcgtagtaggggcgcactcgctggtggtgggygcgccgtgctgagctctggctgtcagtgtgttcgcccgcgtcccctccgcgctctccgcttgtggataactagctgctggttgatcgcactatgactctggaagaagtccgcggccaggacacagttccggaaagcacagccaggtgggtttcagggcgctgagaaagccgctggtcggtcggcgaccgtcagggttttccagggtgggaatccgcggggtaggaggggagcgcgggggtccgggcgccagatcccggttggagagccggggtgcaggcgctgagccgggattggagtgt

SEQ ID NO: 137772 - DNA, 601 bp, Human
tcatacctacaaagcatttagactaggaccagtaacagcagaaatttggttgaacttgtttctttatgcaaacttttatttttaatacagttagaatatttcacttataaaaatagatttacaggccaggcacagtggttcatgcctataatcccagcactttgggaggccaaggcgggtggatcacgaggtcaggagttcaagatcaggctggccaagatggtgaaaccccgtctctactaaaaatacaaaaaattagctgggtgtggtggtgggcacctgtaatcccagctactcgggwggctgaggcagagaattacttgaacgcaggaagccgaggttgcagtgagccaagatcgcgccacttcactccagcctgggcgacagagcgaaactccatctctaaaaaataaaagaaaacaaaaaatagatttacataacagaaataagacaaatcctttggcattttgtgaagctcaaaataaattttggccattggggtggagtcaagttagggaaaaacatttctacttttgagctaccagtcctttttatgatctctaaaagaaaaaactgtggcttaaggacatttttttccccg

SEQ ID NO: 137773 - DNA, 601 bp, Human
actatggtccagccaaatttacacatcaaattattcatccttggctgggcatggtggctcacgcctgtaatcccagcactttgggaggcgggcagatcatgaggtcaggagattgagaccatcctggctaacatggtgaaaccctatctctactaaaaaaaatacaaaaaaattagctgggcatggtggcgggtgcctgtagtcccagctacttgggaggttgaggcaggagaatggtgtgaacccaggaggcagagcttgcagtgagctgggatcgcgccactgcactccagcctgggcracagagcaagactccgtctcaaaaaaaaataaaaaataaaaaagtcatcctatacaagtgaataaacaagaagcacaagttaaaataatgtgaggtaagttatttgccctgtctcttccccctctctccctgctgttactaaaataggagtattgagttaaggcattctaagaatttttacctcgtattataaagaggggactaagtgggaaatactgtgaaaacaagtaaagatacatttaactttctaacaccgttgtcaggaatgtaaaataatacagctgctgtggaaaacactgt

SEQ ID NO: 137774 - DNA, 601 bp, Human
tgtagtcccagctacttgggaggttgaggcaggagaatggtgtgaacccaggaggcagagcttgcagtgagctgggatcgcgccactgcactccagcctgggcgacagagcaagactccgtctcaaaaaaaaataaaaaataaaaaagtcatcctatacaagtgaataaacaagaagcacaagttaaaataatgtgaggtaagttatttgccctgtctcttccccctctctccctgctgttactaaaataggagtattgagttaaggcattctaagaatttttacctcgtattataaagargggactaagtgggaaatactgtgaaaacaagtaaagatacatttaactttctaacaccgttgtcaggaatgtaaaataatacagctgctgtggaaaacactgtggcagtttttaaaaaaattaaaaataagattaccatatgatccagcagttccacttcttggtatatacccaaaataattcaaagcagggtctcaaagaggtatttgtatatgcatgttcatagcagcattattcacagtagcttgccaaaaggtagaagcaacccaagtgtccatcagtggataaatgggtaaacaa

SEQ ID NO: 137775 - DNA, 601 bp, Human
atcccctcatcccttcatcttcatagctcgaaattaaactctctctagtcaccctagctgaaaatgagaatgtttatatctaaaatcctattacagctactttgaaccacccatgggccacttactagttttggtaatatggtaatctatttgattataaactcctgagggcaaagactgtgtcttactctgtgtttgtatgcctcccactgcctaccaaaatacacaatttgtgtatacaatattgcatgtttgttgaatgaatgaactagcttacttgtaacagaaacaaagtggcttccaaggttatttctgattttacctaatgcttatgcatatctacagacacatgcatatccttttgcatttctttttactacccttttacctctactatgatttactgcagtgaagtggtgcacaaaagcttccccccatccgtctgcattttaaatcctttcagctgcttccctcttactactcagaagaactcagctcttactagtcagttcaaagaccattcaactaatgatattgacctattgatctcttttattgctctcttcttatacgcaatatttttgtttcactcagtgaaacc

SEQ ID NO: 137776 - DNA, 601 bp, Human
actacactcaaaatgaaaaacaatggttgtatgggtactggaagtacagtttttactgaatgcatattactctcacatcatcttaaaagccaaaaaattataagtcacgccattgtaagttggagatcatctctaatttctagcttatagttgctcattttgggactgctttcattttttaagtaattttctttctgtctttcttttcttttcccttttttttttttttttttttttttttttgagacagggtgtcactgtgttgcccaggctagtcttgaactcctgggctcaagagatmgtcctgcctcagccttccaaagtgccgggattacaggcctgagccaccacacacagccattttgtaaattaattttctaatgcacttattattggctgtgttttatgctttttgttgaaagtattcataaagctgtatcagaccataggaatgatttatactaaatcaacatctaagtattaaagacttggttttgatgtattttctaagaaaattaattgaaagtagagtagtagttatatgactggcctagtagccattaatttttgtaaagtacatgtattagagttctccagagaa

SEQ ID NO: 137777 - DNA, 601 bp, Human
agcaaatgataaatggtcaaataacagaacaaaagtaagtcttcctacagaaacaagcacaagcagagagccatatttcaaaatcagttcaacccagaagttcaagttcttgtgtacatttttataaattttgtttgaatcaacatacaatattttttttaagatttaatacaatgagaagtttcctcaatataattagatgtaaaatcagtaaccgttactgaattaactattgaaagaaatgttcgtttattaaagtctcctactcccccaatacaactggattttaccttcccttttratagtgatcactttgttatatgacctatatctattttttattatttaatttttataacttgcctccagatttttatcttactaaaagtataatactctaagtaggtatgtgttctgaagattcctctctgttcccaaatagatgtgtgaatttctaaaatcaatttctattctaatttccagtcttttcagatcacagacaggcttgtaattcaggtcagtgtagtttaagatgcctatttaataaaaacatagaagttgggaagatagattgctaatttttaaaaattcatttaacatc

SEQ ID NO: 137778 - DNA, 601 bp, Human
cttgttgttacacagctataatccttgaaggtagagtcagaaatttggaattcctaatactcatcctttgggccctctcttccttgattggtcttctcttttttccccccttctggttaacactagatggtaaaatcaaatgtctgaaaaacaaacaaacaaaaaacaaaaacaaatgtctgaaccttgatgctgaagaggggctaagggagatccaaaaataaaaggcagagcaaaataaagaacaacaaaaggagaaattaagaagaaaaataagaaagggttgcacatggtaggaagygatagaaaatcttgggttatctatccttgaataatttttttttttaatcagcatgggccaaagaggaaaaattaagcccctgttatagtggacctgagatttgtttgaatctttgttctaccacttaattgtgttaccatgggaagcattaacctgtctgtcacttttctcagctataaaatggggccagacctatttgttttttcctttgggtagagattgatgtgaagactggcacataataaatgttcattaagtacatttcacttttcaagttgccctgtgaatattaagtacatg

SEQ ID NO: 137779 - DNA, 601 bp, Human
gtcagaaatttggaattcctaatactcatcctttgggccctctcttccttgattggtcttctcttttttccccccttctggttaacactagatggtaaaatcaaatgtctgaaaaacaaacaaacaaaaaacaaaaacaaatgtctgaaccttgatgctgaagaggggctaagggagatccaaaaataaaaggcagagcaaaataaagaacaacaaaaggagaaattaagaagaaaaataagaaagggttgcacatggtaggaagcgatagaaaatcttgggttatctatccttgaataatttttttttttaatcagcatgggccaaagaggaaaaattaagcccctgttatagtggacctgagatttgtttgaatctttgttctaccacttaattgtgttaccatgggaagcattaacctgtctgtcacttttctcagctataaaatggggccagacctatttgttttttcctttgggtagagattgatgtgaagactggcacataataaatgttcattaagtacatttcacttttcaagttgccctgtgaatattaagtacatgaggattaagagctttatccgttttgtttactgcta

SEQ ID NO: 137780 - DNA, 601 bp, Human
tctcaaagaagagtcaactgtagtgcttattttcaaggagaggaatccatgaaaggaagggcagatttggcagggattctggacttattagcccagtgtccctggatcaatccaataaatcatttgccatcttacaaggagatttcagaattttctgctgctgggaaatggatttggattgcccagatggtcattgggattgctagttgtagaggttcaccttgtccatttcattaatatctgtttaccctacccctagctagaccccacattttacacagtcgaatttttcggactccartaattgcctcatggtcttgctgctcaccgtttctgtcaccactactctaattcaggccacttggattactgcagaaactccccagtgatcttcctctcttgttgtcttgtgtttgtttgatctaataactacaaacaaaatgatctctctaaaaaccaaatcacatcgtgtcattcccctatttaaaattcctcaatatcttcccacctgggagactgatatattcaaaatctttcctaaacacattgtacagtataatgtctttttaccgtggtgaaagctgcaccattattttatgta

SEQ ID NO: 137781 - DNA, 601 bp, Human
catgcccagctaatttttttgtatttttagtagagatggggtttcaccatgttggtcaggctggtctcgaaatcctgacctcaagttatccgcccgcctcagcctcccaaagtgctgagattacgagcatgagctaccgtgcctggccataccttgacattttctatcagattatgacaaaattttaaaaataaagaatgagcaaaaattatagattacagccatgtaatttaataggttacgtggcatttagggatatataagagagtatacttttcaaataaataaccactcaaaaatrtgtgtgtctaggaaagttcagtgtgtactagaaataaagatatgcatggtaagtattgacaaagacacaagtctgcattaatctctcagaacacagtaatagaaaactaaaaataaaattttattttcctgttagcataagttgaaaactgtgctatttaatacagagtttgaaagtagagactcttgagtgaaatatatacattcattgcaaattgaaacacctcaatattaaaataatggggaattgtacaaataggcagaaacatattgctttaaaccagttgtttgaaaggcacat

SEQ ID NO: 137782 - DNA, 601 bp, Human
agcttaggggccatcactacatatggttagagaagcctgtgaaatggttaccactataaacaggcttcactacaatctttgattttaaagtgatttatgtcagtatccgaagaggtgttcaatctagtttcacttttatttagcagactggtagaattcaagtcaaatcaagtagatagcaggatagtacagtgagtaaggagtaaaccagttgcctttttcttcccctctctgctttctctcccctcatcccctccttactccttctgctcttccttcgctttcctaaagaaagggcagyctttattcattagtgtagtagataccaccataaaagactataggtgacaatcagtatatattttaaagatttaaaaactgaaagctttgtaaactctttctttaaattttagcttactttttcacttaaaaatgaaaatcttaaaactgttcctgtcatgaaaaattcctattacttgactaacttgtttctaaagtactttattaaatttctcaataattcgtttatttaaatgtaggtgcatactttgtcatttccaaaaaaggatttctggtgattccttgcctataattaatttgc

SEQ ID NO: 137783 - DNA, 601 bp, Human
attaggagttgttaatacaaactctagggaaaaccatgaggctggatagatacagaaccttaagttctaacaagactgtctcgtagtaggcctttccctgatgggaaaaaataatgggcattctgtacatattttctgatagctctattttcttacatatcaaagcaaaattttacccacttctggtctgataatctgtaaggataaaactaagtttatttaatctgattttttttcattgtcatttccaagttgtgtttgtcacatatatttagtttgttttgtgtatttgtagaagaartgtttaaattgtattaatttaaagacatcaggattgtaacaaagttaatagcaacttctgatcacaagatttaatataaattggaagtaacagctgatttgtatcacttcaccaacaaagaaacacatgtgtgttcttaatcctaatattcttccttataaatccccccagatctcactttccacttctaattagactcttaaaatactctgtttttgataaaactttgcaaatgtttagttatgaggaaatttgatgtgccttaacatactccaagtttggctttccttgagaagcaga

SEQ ID NO: 137784 - DNA, 601 bp, Human
cgctacgtcttaaagcattcacatttaagaagaaatactagttctgtaaatcagtatttagtaatcttattcatagttttaattatttgccaacttttgggtttttttttttacctttgtaattaaggtgattatagtaaggcctacttcattaaaaaatgtgtattaggaaaatagaactaaacttatcaaatggtgggtgaattttgaaatttttgaataggtggtatgaatagtgatcattcaacatgtattaggcaaaagctatgtgtaatgacaactgtacatgatactattaggkatagatatgaaagagacgcaatttttgcctttaaaagatgatggtatagcaggataaacagccatgcccgaataactacactacatgttaaactgtgttaaatgccatgatgaactgtatctaatctcagttctagctctgaggtatgtgtatgtacctttgtcaaatcacctaacttcttgaaccatattcatctggagaaggaggtgatttaatcagatgacttttaaagtcttacctagcttttaaaaaaaatactgtgattccttaaaattaagttagtgaaattcatcccaagta

SEQ ID NO: 137785 - DNA, 601 bp, Human
cattaaaaaatgtgtattaggaaaatagaactaaacttatcaaatggtgggtgaattttgaaatttttgaataggtggtatgaatagtgatcattcaacatgtattaggcaaaagctatgtgtaatgacaactgtacatgatactattagggatagatatgaaagagacgcaatttttgcctttaaaagatgatggtatagcaggataaacagccatgcccgaataactacactacatgttaaactgtgttaaatgccatgatgaactgtatctaatctcagttctagctctgaggtatgwgtatgtacctttgtcaaatcacctaacttcttgaaccatattcatctggagaaggaggtgatttaatcagatgacttttaaagtcttacctagcttttaaaaaaaatactgtgattccttaaaattaagttagtgaaattcatcccaagtaataggggaaataatggtgttaaaatattgcatagtcagcttctgattaattataccagtgaacaggcttgttgatggaaataatggaaagccttactctaactgatcccatttcctggtgcttgtgaccagtactaagaatggaaatgc

SEQ ID NO: 137786 - DNA, 601 bp, Human
tgaacaggcttgttgatggaaataatggaaagccttactctaactgatcccatttcctggtgcttgtgaccagtactaagaatggaaatgcagctcaacaaccctgtccctaacggtggggtgacacatggaaagaaaaatctgcccagagaagcaaggtcacccctgacctcaggcagcagagcttgactataaccccattgaagaactgggtaacagtaatttgaagagaatggagctttcaaacttgctttatgtaagacttctaaaatggatgttttgtgggtttcttcccctagarttgagcacatttttcatcttactgaataagatggtaaattagactaattggttagatttgtaaaaatcatttacttagcatgattttttttttattattttacagctgacatgggctttgcccgattatttaattcacctttgaagcctttagcagatttggatccagtggttgttacattctggtaccgagcccctgaactacttcttggagcaaggcattataccaaagctattggtgagtagaactaattaaaattccatgagtttttaaaagtttctttaaaagacacacattcct

SEQ ID NO: 137787 - DNA, 601 bp, Human
gagctgggaggatcgcttgagcctggtaggcaaaggttgcaatgagtcatgatcgcaccactctactccagcctaggcgacggggagacactgtctcaaaaaatataaataaataaaaaataaaagtaagagcaaggcctaacccaacattctactacctagaaatactatcagtagcaataggggtatatcattccacatacttctctctgcatagaaagatatcaaaaatctttgtaattaaatgggatcatattatgcattctatttaaaattttatatttaatttataaaactacarttttgaagtcctttaacttaagacaaatgtttcttttaccaaaagaaatactaacttctaaaagagccccctaaaattaaaggaaagacattatgaaaaacaatttagcactttaggacattttaatccacttttctgtttttgataatatcagttacctccctattataaagaatgaggaaattagtgctcttacacttcttcccctaccaacctctcaatctataagcagaattagtaatatcttcatcactttgtcaatgttgacattgttttgtttgctaaccatagttcccacag

SEQ ID NO: 137788 - DNA, 601 bp, Human
agaaaatgagaatttcttcccttttatcaaaacaagaagcttgctattactacacttgttgattcaaatattattgagcaaagtcttttctcctcccaaatttggtctgtatagcatgccaattcctactatttcctttgcctggttagctcagtagctacctataagcatcacacattttgagaagtagatgaaacttatatgtttttaatttggaaagccattttataaggagtttggcaggcaggtgaacactaaagagactttccatgaattgggcacaatctaaaaaaaaaaaaamaacaaggtaggaaaaagaaacttatttacaataattagaaatttatctgcaataatagcctgatcagctgactcagagttaatgattaatgtatgggtcaggattttgaagaaaggaagaatggtaaaattgacaaaggtgagagagaatagcagttataaagacagaagagttactagatgggagggagttaagcaaggttcaataagttatttttcctgttgactggactttttctttaaaaagcagtgtagctttgcatacattttttctgtgaaatagggtcttgctatgttgtca

SEQ ID NO: 137789 - DNA, 601 bp, Human
aagtagagtgaagataaggatggagaaaaaagggcagatggaaatgttttataggaagtgtataagcaagggaaaactaaagattatcttaaaatttctagcatgagaaattgataaaacacagaaattggagcaaggaaaatagttaaggagaaaattccatttaggagtgtagtgtatgtttagtttacaatatgtgatgtctttggaggatagttaccaaatatttttacaagtaagttcaaagaaaagcaagcctctaaaggccatttaaaagctaaaggttttgcgaggccgcggygggcggatcacctgaggttgggagtttgagaccagcctgaacaacatggagaaaccccgtctctaccaaaaatacaaaattagctgggcatggtggctacatgcctgtaatgtattacaggcatgggattacatgcctgtaatcccagctactctggaggctgaggcaggggaatcacttgaacctgggaggcagaggttggggtgagccgagatcgcaccattgcactccggcctgggctgttaacaagagcgaaactccgtctcaaaaaaaaaaaaaaaagagctaaaggtgctgtta

SEQ ID NO: 137790 - DNA, 601 bp, Human
aattatatcctaccctattgtgcaaatagttattaccccttcttccattgattgcttatgtaaagaaatatatttaacaaggtgaaaggagggctgtatcataaaaagaagtatagtttaaagccactgaggggaagatcttagatttctcattgaagaaattgattgctgacttaaccaagaaatttggtagaaaaggggaaataagcagttttactaatagaaagaggacatttaataagataaatagaaatatgtataacttattcttctctagtgacagaaattgaggcagcttatwgtaaaacatacagaaagtttgcagtttaaaatttaaaatataaacagatatataaagttatataagggataaggaattatgtttacacttcaagatatttactgttgctgaacatttatttgaagacagcttttttgtgtggaggttgaacggataggaaatgtaatgaacgtggtaataacctttttaaaaattctcaagaataggaacttaggcaacataaaaatttatcaatgtatttcacagataaagattgggaagatataaaaaagatgcctgaacattcaacattaatgaaag

SEQ ID NO: 137791 - DNA, 601 bp, Human
ctgcagccttatcaagtatatggaaaaacataaagttaaaccagatagtaaagcattccacttggtaagcattggttaacagtattaatgaaatgcattttttccttaattgactagcccaactgaggcttttttggatcaatttatgtggttacttagctagcactcagagtgctttcatggtaaatgcagagatcttgttagtgcataccaataaagacaataaactatttgctcttccagactcatatcatggtttgacagactaatgtttggtcacattagattttctaaagatagygatggtaacaaatctgtcaaaacatttataaaattacatgtattgtttttcgtctgtttaagattttaaaagttccagagaagtatcaagaagaaagtacttctcaccattgataaatagattgttttgtatttcagctctttgaaagactgtttacaaagttcttaatttccaaaatacctcttataaccttaaatgttaacagtcattcagcgattatatgtgctatttgatttttctggaagaatgtgatagatgccatatttatcagtgtgtaatggaaaaatgatttaacctaga

SEQ ID NO: 137792 - DNA, 601 bp, Human
aacattgtaacctcctatctcttgtcagtgtgtctttgtagtcacacgttacggttcccatagaaacctatgtatggcaggtaaccttttggttattgggatgttttgattaaaacaattgcgttataatgcaagtattaaatgaattgtccctactcacgggctagtactagtgatcgtctttggaattccaaggactttctttgaagagtactcccagattgtttttcactttgggtggctctccattgctgtagaccttgaatctctttttcttttcttttctttctttctttctttyttttttttttttttttttttttttttgagacggagtcttgctcttgtctcccagactggagtgcagtggtgtgatctcggctcactgcaacctccgcctcctgggttcaagcgattctcctgcctcagactcccgagtagctgggagtacaggcgcccgccaccatgcccggctaatttttgtacttttagtagagatgcagtttcaccatgttggacagattggtctcgaactcctgacctcaggttgatccgcccacctcggcctcccaaaatgctgggattacaggcgtgagccacc

SEQ ID NO: 137793 - DNA, 601 bp, Human
ttgtaacctcctatctcttgtcagtgtgtctttgtagtcacacgttacggttcccatagaaacctatgtatggcaggtaaccttttggttattgggatgttttgattaaaacaattgcgttataatgcaagtattaaatgaattgtccctactcacgggctagtactagtgatcgtctttggaattccaaggactttctttgaagagtactcccagattgtttttcactttgggtggctctccattgctgtagaccttgaatctctttttcttttcttttctttctttctttctttctttyttttttttttttttttttttttgagacggagtcttgctcttgtctcccagactggagtgcagtggtgtgatctcggctcactgcaacctccgcctcctgggttcaagcgattctcctgcctcagactcccgagtagctgggagtacaggcgcccgccaccatgcccggctaatttttgtacttttagtagagatgcagtttcaccatgttggacagattggtctcgaactcctgacctcaggttgatccgcccacctcggcctcccaaaatgctgggattacaggcgtgagccaccgctc

SEQ ID NO: 137794 - DNA, 601 bp, Human
cggccgaatctctcaacttctcttctcagtccgttttaagggccctgtttctttcaagtcaggctttttttggctttgctcttgggcatgtggaactaaatgcttctgacagccccacacattcttcttcagggctggttctttacctgtggcttgactttatgctggtaatacagaaatattttatgccagtaatacataaatgatgtacattataaaataaacaatatcaacacagagatttatagaggtaaaaagtcttaagttttctttttcccgtcttattgttgtcctattcctrtttctttcttcagaggtaaccataatatagggtgtatccttctggattttttccatttaatactgtagatgaaatatataaccctgtatgttaaaaaaaccatttcatgaatgcctactaagtaccaggtactattttaatcactagggttgcaaaaataagagacagacgctttcaagatgttcatagtctaccaggacaagcaattacagtgcagtgtgataagtaccatgatagagtcagtaatcagtgagggatgtaggagcctcatgcatgacctaatccattcattcatttgct

SEQ ID NO: 137795 - DNA, 601 bp, Human
tctcctcccctcctccctcccttccccttcgcctccctcccttttcttttcttttctcttttcttttcttttctttctagcagtgactttattttctcttttttttgctgttgtcttaagaacaccttttgtcttcctttctcaagacatgctcttctgaggactggttgttcctttgcagggcggttgcttcccaccctggacttttcctaggtgccattgtgtctccaggtcgtgatgtctttgtggctgactgtcctcctttgctgtcctgttctgacagaatactctctcctgtcartgttttttctgctacttacctcagcaccagttttgtgtcagatcctatccgcctatcttcatagatgtttttatttttattttttgtagagacggtgttttgctatgttgcccaagctggtcttgaactcctgggctcaagcagtcctcccaccttggcctcccaaagtgttgcaccgcccccgatgtcatagatgtttatagattataataatttttccgcactaatgcctggtgtggtggctaacacctgtaatcccagcactttgggaggctgatcacctcaggtcaggagttcgag

SEQ ID NO: 137796 - DNA, 601 bp, Human
ccgtggtgctatctcggcttgaaaccgggaggtggtggctgcagtgaggtgagatcacaccactgtactccagcctgggcaaaagagtgagactcggtctcagaaagaaaaaaaaaaaaaaaagaattaatgtttatagaagggctcatgaatttcaaaacttgcttcctgtggtacacgggagaaactctagtacaagttgaggggtgccattaaccagaaagatggtaaagagagagggggcaacttacaagtatgtttatattgttctgagagaggttgtggctgttgcacagcttaraatgagaaggaagagactgactttacatgccttcaaaagtaagatcttaactttggcagaaatactataattttccaatatagaacacgtctgttttcaatataaatgtaaaaacacatttaaaaaaaaccagccctgtaggatttaaaacgtatctccattcttggttttctgtagtatttgtcatatatcgtttagagttaatcatcctggcttttgatcagaaacccagaaatacacagtaaccccctaattccccaaacacctgtcttgagattttaattcttgctgcaaacagca

SEQ ID NO: 137797 - DNA, 601 bp, Human
gaatgagaaggaagagactgactttacatgccttcaaaagtaagatcttaactttggcagaaatactataattttccaatatagaacacgtctgttttcaatataaatgtaaaaacacatttaaaaaaaaccagccctgtaggatttaaaacgtatctccattcttggttttctgtagtatttgtcatatatcgtttagagttaatcatcctggcttttgatcagaaacccagaaatacacagtaaccccctaattccccaaacacctgtcttgagattttaattcttgctgcaaacagcrtttgtttcccaaggcttctctagaatgtgaattgttctttgagatatcccagggaggaagagtattaaaaggttactccttttcaaaagttggcattgcaatttagaatggttacaaagtttatcaatgaaaatgaacttgatgcctgagctataattgaaatctttatagcgtctctgctgtttgtccattgtgttacagagcattcattgaaaacttcttccatttctgacatgtccagttcccacccctcaaaaaaaaattatgaaaactacaaaacttcagaacatcatttgaaat

SEQ ID NO: 137798 - DNA, 601 bp, Human
agtctgactggaacttgtgtgagcatcctggtggccacagtgaaaggaaatcatcctcagctctatgctgtcattttcaccatgcataaagaagataccagtttcttttccttaatatgtcccccatttcacacttggggctttgaattggttacattgaaaggtgtagtaggtgatgtgctcagtggcattcatgtggtacattgaacagtggttcttgtttggctgtttatcatgtccttaaataaagtgaaagtacaacaatcaaaaacaattctgtggaggatcaaactgacatggkttattatatattttctagttgtgagaataagcacacttcatatccctcaaacagtcattcaggaatataagtgatctcaggtggattttttggtgaaagatgtatagaagatagtttgaagttactgttacagatgcgcttggagtgccagtattttgtcaattaaaggtggctttagagaccgagagagatggttggttagttcaaaatcagtatcctgcatggcaagcttgttctagatcaggggttggtaaactacagcctgtgggccacatctggctctttgcctgattttgcaag

SEQ ID NO: 137799 - DNA, 601 bp, Human
gtgaagagagagaatatcagagactgccatttttgataaggtggtcagggaagcctatgtgagatgacatttgagcagagatacaaacgaaagtgaaggagtgaaccagctaggcaaatattttgggaatgaaccttatttggggagaaacagcaagtgcccccttgagataccgagtagcagcagggagggcagtgtgaatagggggttgggtagggggatgcgtagtgacagaggtattaaagggccagattgtgtagggccgtatagactgtggtgcactttggattttattctgagkgagatgaaaaaccattgcaaagttttgagcagggacatgataccatttaagttagattgtaagaggatcactaggactgctgtgtagaggatagacaggggacaaaggtagaaggtgggtgtctgtgtgctctgtgtgctaggtaggcattgcgaagtgctgtggctgttggatgaatcagtggttcctgccttgaggaggtcttagtagaatagcagaagaaagagatcactgtaatgcactgctgctgacagagaagcaaaggtgccctgggatggggtaggaggggtacctgatcca

SEQ ID NO: 137800 - DNA, 601 bp, Human
taaaatatactctagaaattaattactctttatcagattccagagctcttcctcataatgttatagctgtatagtgctgttcacatagtgtgaatatgatgcagtttggttaccagtcttctgtgtttggacatttaggtagcttccaatattttgcaattacagtacaaataatgtggctatgaataaccttgtgtatgtatttttatattgcaggaggtttaatttgggaataaagtcctcaaatttggatttctgggttgaaggataaatgtatatgtaatcttgttagacgctgctraattccccttcatagagattgtaccattttgcattactctgagcagtgtgtgagtgcccgtttctttatagcctgctagttagaggatattgtgaagctttcaaatttttgccaatctaataggtgaaaaatctttgtgtagtttaattatatttattttctttattatgactaaagttgaggatcttttatgttcaagggaaatttttatattattttgagaattgtctattgcccttttttctatagaatttttgcaccttttctgttcattttttaaaagtttttctttgccttagg

SEQ ID NO: 137801 - DNA, 601 bp, Human
agatttatcaagcttttaattgaattgggcatgggttttgagtcaaggtcagattatttatagagggattcaccaatattttattctagtacttgagtagttttcattttttacatttagatttatgatacgctacaaatttattctgatatatatggtgtgaggaatagatctgattttgtcttcttctgaatagtgattgagttgtaccaacaccatttataaagttcatctttacccagttattagtgatgccaccattgctgtatattagatttctgtatgtagctgggtctatttytgggcgttccattccattctgttgttctgtctgttcatatgctattcacacaattttaatcatgaggctttgttttaatatttggaaagggcatttctccctcttagctcctcccttgcacatttactgagctggtcttttgtgtttgcttttccacatgaacttcagcatcaatttgttgagctccattaaaaagctgtgtaatttttattggaattgctttatatttacaaatcaactctgacaacctgatgaagttgtgatgtcttagccaagaacagtcgaatgttcgtctgcttt

SEQ ID NO: 137802 - DNA, 601 bp, Human
gtatgtgaagactagtttgtttactttatatcttgctaccttgcttaattctttaattgtttgagttaattttgtcattgattcctggagtttttcaggtttactaacatgtcatcaaccactagagagttgttgttctttttttccattgtttgtgcctttaattgttttctgttgtctaattgccttggtgaataccttcagaaaaatgttaaatagtggaaaaggtagtgggcattcgtatctggttcctgaccttaatgagaatgtgtgtagaatttgccctttaggatgttggcayttgcactcaccgtgtgtatgtgcgtgcatgcacatgctcttacactaattcattcttgttctgtcttaagttatgttaagaaagtatgcgtctactcctatttattctatatatatattaggaatgaatactgaattttgttgagggcttttttggcctcctgtggaggcaattatatgactttcttgttagacttatgaatatggtgaattatattactagatttcctaatcggaatcattattgcattcctggtataaactccttttttgaggtggagttttgctctgtcgcccaggc

SEQ ID NO: 137803 - DNA, 601 bp, Human
gtataaactccttttttgaggtggagttttgctctgtcgcccaggctggagtacagtggcacgatctcggctcactgcaacctcggcctcccagattcaagcgattctgccgagtagctgagactataggcacgtaccaccatgctgggctaatttttgtatttttagtagagatggggtttcaccatgttggccaggctgatcatgaactcctgacctcaagtgatccgcctgcctcagcctcccaaagtgctgggattacaggcgggagccaccgcgcctggcctggtataaactcttmatgtggtgttggagtctgttaatattttatttcagaatttggcattaatattcatatgtgatattggtttgtaatgttcctattttgtgtgatcacagtcaggttcagttattaatattacacttgatttataaaaaaggatttggcaatattttttcatgtttaaaaaaattgatgtaatattgggattatctggtttgtataggtttgatagacttgcctcttgatatcatctgggttttttgggggagggtagtttgataacttttttcagttcttctatggaatttagttggccta

SEQ ID NO: 137804 - DNA, 601 bp, Human
ctcttaaaatgtgtagattcaggtcttttattttcaggaagtttttttagagtattattttaaatattctgttttagtgttttgaatatcttcttccagagtttgatgtatatgtatcttggaggtatatgtatttctaattatataaatatttgaccctctttgcctaatttgttttattcacttcaactttgaccctttatacttctttttaaatttcactttcttatggttgtttttctacttttcctcaatgccctttgtaaaattttcatttgaatctattattctcccttggacrtcttaattccttctctactatgactttttctttcttttgtttctttcctgggttcaagccactcctgtttcattactttctttttttttccttttctatttttactcttctttggggtcttgaactgtaagaggtcctggaacataaatttgagaattgttgcatcatacagtagtggtttacgtggggaatttcagaagtactgaggcctttgacctagcctcagaaattgcagtggtctgaagtggtacatgggctttgaatattttaaatgatagccaggagattgtaatgtttagg

SEQ ID NO: 137805 - DNA, 601 bp, Human
gcactggatagaacttcctttagaatattgcgtagaaattataagattagatattcctcccttgttcctgatttcagggggaaagcattcagtccttcaacattaagtgtgattttagttgttttcttgtagacgacttaccaggttgaaaaatttttcttctaagtctaggagtttttaatcactgtgataagtttaataaagttgctaccttagcattcattttaggcctaacataaattgttcgtaattcagtcatgccctgtcacctttggcctagttagaacttcccctccctgcmgttgtttgcaatatggcctacttgtgcctcatctcactgacccaaaatgcaacacaccatgagctgccgatcacagtaaaacctaatggtcagcctcagaagtcatgtgaataagttcccattcacatttgttttctttaaccaattcacaagaaggaaagcataaggaataatgtcccttaaaggtgtagttccacagttcttctttctccctctccctcctgctccttccctctcctgtctcaggacctcctgtctgtctctgtttggcactctaacctctctgggacctatgagtaa

SEQ ID NO: 137806 - DNA, 601 bp, Human
tgatttcagggggaaagcattcagtccttcaacattaagtgtgattttagttgttttcttgtagacgacttaccaggttgaaaaatttttcttctaagtctaggagtttttaatcactgtgataagtttaataaagttgctaccttagcattcattttaggcctaacataaattgttcgtaattcagtcatgccctgtcacctttggcctagttagaacttcccctccctgcagttgtttgcaatatggcctacttgtgcctcatctcactgacccaaaatgcaacacaccatgagctgcygatcacagtaaaacctaatggtcagcctcagaagtcatgtgaataagttcccattcacatttgttttctttaaccaattcacaagaaggaaagcataaggaataatgtcccttaaaggtgtagttccacagttcttctttctccctctccctcctgctccttccctctcctgtctcaggacctcctgtctgtctctgtttggcactctaacctctctgggacctatgagtaataaacttctttcgtttcatgtattttgccttagcttcctcattgtgtctccattgagacacacatact

SEQ ID NO: 137807 - DNA, 601 bp, Human
cataccttggaagagagggcaaaaacaatgtaggtctctttttccagctattaacatatattctaataggatagataccttgagagaataattagtcaataagaaagataatgacaggcacctctatggatgcttaaaatgggggcagaaagaaattaatgctaaagtggtaatttgaagcctagggtcttagtggaaagatagcaatagccatggtaaagcagtttggacagttactgtggatagcatctgtcacttttgataagagtacatgtttgcataatgatttatgggttaagtktctttagttatgtgatctcatttgatgtatacaacaccataaggtggcttattattcagatgacactggtcacatggggacaagttccaaagggagcaagcaaggacagaaaaaacaattattttccgtaatggttaagaaacggaaaggttcttatagtcacaaatggcaagtgaacagtaaagctggttcaagaaatcctgattctagtctagggctccttctcctatagtgtttattattttgtttttactcaaaatggaaatacttaaagatgcagagtagttcataattagagta

SEQ ID NO: 137808 - DNA, 601 bp, Human
ctttctctcttccctctcatcatagattaatcacttagttgcaagggaccagtaaattaacagaatggtgaacattttccttttcttggtgcttttgctggatgactagtggtttctgctggaacagagatgaaccatctcaaggttatgaaaattcctgactgtggcaaatgtgaaagagtgtctttttaattcctgggaaatactaagacttcttctctaaggtgcttatttgtaaagtaaaaaggtgaccttaatttccagtgctatgcagtgaacacaatttttgtggaaactagtyctaggatttgaaatgaagactatatggtctctgttaatctgtattggtaaacgcactgcactttattgagagttctggtcgttaaccagcggaattactagtattatagaaatttattaaggatggcttattggagttgacttgtaatttcagtcatttctttgtaattacgaggtaaaagatgatttgtcttgagtttaattatttctgtaagttaaaataaggaatttgtaaagcattcctcagttttatgttcagttatctaggaaacatgcagcaaagaaaggatgtgagataatt

SEQ ID NO: 137809 - DNA, 601 bp, Human
ttttggaatttcttgcaaagtcagtattgccctatagattgaccttacagaaagtccttattgtgtgtttcaaagtcttctttgtaaattaaaatatgaaagctgttgttactctgctgatagttctgataactcatgctaactaaatagttaagggagtggaagaatacagccagcattccatcatctggaaggaaaatagtgaggtggcagatccctgcctgactcagctttcaccatgccataaataatatcattttcccaagcaatactgtggaatgcaaaaagaaagaaaaatgtaaaaaaaaaaaaagtggactgagatgaagaaagccaatttatagttgtaataaataatattttgtgtcaaaaaggaagaacaaattgacaagaacttggagaaataccagctatggataaagggaaataaaaatgatggaaatccagatggtatagaactaaagatccaaatgtaaacagcagctgtttacattaattatcttgtggatggagtccctcactgagctgatatgctgttacgttagtgctttcaggttttgggttgaatcacttaggtatgcctacacacttgctttgagaa

SEQ ID NO: 137810 - DNA, 601 bp, Human
actattttaattattgaagctatataatgttttaatatctgataggggatgttctctacccttattcttctttttcagaattgtcttgtctgtctttgtttgcttttctataagaactttcaagtaagcttgtctagttcctaagagaattgtcagggatactcaagaaacacctgccctttgtgatcaattctaagagccccatctgtattataaatctggagactgggttttagaccttattctgacattaactggctctgtaataaaaagattaaattcatgttttactattttataratgtttgcaggtgcttttaagagagttattttgtactgacaatttttttggtttctatattctcatcactaaatagagctattttaaaaatcctcaatttcagtctggtcaacatggcgaaaccctgtctttaccaaaaatacaaaaaattagccaggtgtggtggcacacacctgtagtcctggctacttgggaggttgaggtgggcggatcacttgagcctgggaggtggaggttgcagtgagccaggattgtgccactacactgtagcctgggcgacagattaagaccctgcctcaa

SEQ ID NO: 137811 - DNA, 601 bp, Human
ttgtttgtatgctaaatggaaatagaggcagcataacttaatgtgatgtgaggtttatgttttcactgtttaaaaacacaacatgaccagaccaaatcagaaccacagagtcccaattccagatttctgggagggaaacctggcccattttaggtagtgtctgtccccattcagtcagctgtggccaggaggttggggtaagagattaaaccttacttgtgtttttaccaaagtcaaatagtatccccaaatcggcttctgtttcagttatcatcacagattacattttaggaaatgtgtrtatatttttcttctggattctaatttgatcttgtcgaacgttttgtagttttaaaatgcgtaacagtttacttcctccagtaaagtgtcagagagtacctgtgtccctccccatcctggccaacaccgggatttttcatatgtttaatctttgctcatctaacaagttaaaatggtatggcattgcagctctaatttgtatttcttctataatttatttatttttttaagacagtctcactctgtcacccaggctggagcgcagtggcatgattatggctcactgcagccttgacctcct

SEQ ID NO: 137812 - DNA, 601 bp, Human
gcataacttaatgtgatgtgaggtttatgttttcactgtttaaaaacacaacatgaccagaccaaatcagaaccacagagtcccaattccagatttctgggagggaaacctggcccattttaggtagtgtctgtccccattcagtcagctgtggccaggaggttggggtaagagattaaaccttacttgtgtttttaccaaagtcaaatagtatccccaaatcggcttctgtttcagttatcatcacagattacattttaggaaatgtgtatatatttttcttctggattctaatttgatsttgtcgaacgttttgtagttttaaaatgcgtaacagtttacttcctccagtaaagtgtcagagagtacctgtgtccctccccatcctggccaacaccgggatttttcatatgtttaatctttgctcatctaacaagttaaaatggtatggcattgcagctctaatttgtatttcttctataatttatttatttttttaagacagtctcactctgtcacccaggctggagcgcagtggcatgattatggctcactgcagccttgacctcctgggctcaagtgattctcccacctcagcctc

SEQ ID NO: 137813 - DNA, 601 bp, Human
atgtgatgtgaggtttatgttttcactgtttaaaaacacaacatgaccagaccaaatcagaaccacagagtcccaattccagatttctgggagggaaacctggcccattttaggtagtgtctgtccccattcagtcagctgtggccaggaggttggggtaagagattaaaccttacttgtgtttttaccaaagtcaaatagtatccccaaatcggcttctgtttcagttatcatcacagattacattttaggaaatgtgtatatatttttcttctggattctaatttgatcttgtcgaacsttttgtagttttaaaatgcgtaacagtttacttcctccagtaaagtgtcagagagtacctgtgtccctccccatcctggccaacaccgggatttttcatatgtttaatctttgctcatctaacaagttaaaatggtatggcattgcagctctaatttgtatttcttctataatttatttatttttttaagacagtctcactctgtcacccaggctggagcgcagtggcatgattatggctcactgcagccttgacctcctgggctcaagtgattctcccacctcagcctcccaagtggct

SEQ ID NO: 137814 - DNA, 601 bp, Human
gtacttgcatccctgccgggctcactgtggggtgttaatcccagtgcactcagctgttatttcagaatggatgtctaactggaaagatactaggtagtcattcaaaaggacctcaaaggagcaggcgagtttttttttttttttttttgctttctaccgcagtgattctagattattttgggctttgcttgatttctggaccaataagctttgctgaactgcagttttaatgaagttcatgatatcaccaatctctacaaagtgatttatttaactaatctctaataataaaatatttcarcctgacagctgactttttaagaagcatgtgattaatagtagtttgagtgataattaattttcaggaaagattccagaatattggaaatatttttgtttttttgcgggagtgaatctgttttatttatgaattttatggtaattttaccttacagtgtgtcttagctcaggctgcgtaacaaaataccacagactgtatagcttaaacaacagagatttattttctcatagttctggaggctatgaagtccacgaacacagttccagcagggttcagttcctggtgagggccatctttctg

SEQ ID NO: 137815 - DNA, 601 bp, Human
tataatttcacctttatttttctaggccatttaccaagccacctgaaatttgctttgttttaaattattgttattattatttactgttagtcttgtgctttatgtctttaaatttaacttcaggtatttttatgtaattgataatattcttttgtcactgttttgtgtgccttagcatttatttcatgtcatattttcttgcagatttatttatttgctctttttgagtcacattccagtggaatccaaggtccataaaaacaaggaattgtctgccttttactgcattttatattcagcrcttaggtactagcatatagtaggtatccaataaatattcttgcataaataaatcctatagacactactttgcatgcttttccatttagtgtcatgtcagaaaaatgttatcacataattaacaagtcttctaaaatactgcataggtcattgcataataatttatagctctaacatagtttgctttaaatcagttccttcctttggctgatttagttgcttctgtgttttattacatacataacactgaagggaacatcttcgtgtataaatctttgtccacatttgtgttcattccttt

SEQ ID NO: 137816 - DNA, 601 bp, Human
ccatttagtgtcatgtcagaaaaatgttatcacataattaacaagtcttctaaaatactgcataggtcattgcataataatttatagctctaacatagtttgctttaaatcagttccttcctttggctgatttagttgcttctgtgttttattacatacataacactgaagggaacatcttcgtgtataaatctttgtccacatttgtgttcattcctttattcatatattactgtattactagaagaagaattagttacattgatttaggtaatttaaggctcttaacatataatgacawcaaaagtattccaatttatactttttaaaatataaattttcaaagggcctttttctcctggaatttcattcttaatactattttcttctcattttgtatttactccccttggccataccatcaaatgctcttctattctagtccttcagttccagcgagggctaatttatggcctctgctccaaggtctaactctgcatttgttagatatctggtggttcccccggtacctcaagatcaccatctccaaaagtgtaattatttttccatcaaaacctgctctttgctgttctgttccctt

SEQ ID NO: 137817 - DNA, 601 bp, Human
gctcagctttggcttatcagaaaatgtctattttgccttcctttttaaatattaaaccttttatttttatatagtaataatctcacagaacatggcaaaaaagaagttcacagttccatgtacccttgcccagcttccccaaaggtgacatcttttatagcttgtagtacaataccaaaaccaataaattgatactggtacgtactaacgaccttattcactgttcactgtattttaaactgcaggtgtgtgtgtgtgagtgtgtaaagttctctgcagttttagcacatgtgtagattcktataaccgctgccaccttcaagatacagtactgtcccatcaccacaaaatctcccttgtgcaatttctttgtaccctcagccatcctattccttgtccctggcccctgttcttcatctctattagttgtatcattttcagaatgttacatacatgaaatcataccatatttaacctttgtgattacttttttcactaagcaaaatgtctttgaggtctgtccgggttgttttatgtatcaattgttcattcctttgtattgctgagcagtttacaattgtatggatataccagagttggt

SEQ ID NO: 137818 - DNA, 601 bp, Human
ctctttggtgaaatgtttattttttttttgctcatttcataattggattgtttacttttttttttaaaaaaagctagttttgagagttctctctctagtttttttcattagacaaagaatcttgtatgacagtcattttccccacacctcagcattctaaacatgtcagttcatcatattctgactttaattatttttgataaaatttagccttcttaaatgttgcccttattgcagttttctgcaagtcatatgtctcattttcctctggttgctttgagtattttctctttgtctttgrtttttagcaatttggctatgatgtgcctaggtgtgatttttctttgtgtttactatctttgggtttaatgagcttcttcgatctgtgggttgatgtccttcattacatttggaaaattatcagattattatttcttaagatatcttttatccggttctctccttgtcttctgggactccagtatattcaagccatttattatttctcagctcttgggcagtttccttgtttgttttccatttttctctctctgcagctcatagaaccaccttctgctatgtccagttttctgttaagctc

SEQ ID NO: 137819 - DNA, 601 bp, Human
ctttgtgtttactatctttgggtttaatgagcttcttcgatctgtgggttgatgtccttcattacatttggaaaattatcagattattatttcttaagatatcttttatccggttctctccttgtcttctgggactccagtatattcaagccatttattatttctcagctcttgggcagtttccttgtttgttttccatttttctctctctgcagctcatagaaccaccttctgctatgtccagttttctgttaagctcatcgaatgagttctttctttctgaaattgtaatttccatttytagcttttctatttacctattttgttattttactctgatgaaatcttccaactgctcatgttcacctgctcatctttctcactaagtcttttagtacatttatcatagttatgtctactggttgcaacatcaggatcatatatggatgtaccctctgttgactttttaaaaatggaccatgtttgtctcctccttgtgtcccattatttctatttattattattatttttttgagacatctcactctgtcacccaggctggagtgcagtggcgcgatctcatcccactgcaacctctgcc

SEQ ID NO: 137820 - DNA, 601 bp, Human
ttgttttttgtttttaatagaaaactggcttgtttcagagcagttttttgttttgttttttttttgaaacagggtcttgctctgtcgcccagactggagtgctgtggagtgatctcagctcactcactgcagtgtcagcctcccgggctcaggtgatcctcctgcttcagccttctgagtaggtggaaccacaggagtgggcccccatgcctagctaatttttaaattatttgtagagatgaggtctccatgtgttgcccaggctggtctcaaactcctaggcttaagagataatcctacstaggcctctcaaaatgctgggattacaggcatgagccaccgtacccagctgagttcagtttaagtggtagttaccacaagtgattccattctggtttggtgtggtctactggggcctagtacaggagctcagtccgaaataatgtacccctccccacccccccgtcccccttaaactgtgttgaacagtagtaaatgcttgaatgaattgaagagtggttgatgtggtccagatcgttgcctgggttatcagattctctggcgagggactgttagcccagaggtatgggccactcatgga

SEQ ID NO: 137821 - DNA, 601 bp, Human
gagaatgtgatacacataggtgttcagtgaatgtcagctaacgttatttttgttttagcttacagcagtatctcttctgctacttgttttgtatttatttatgtttgtttactcttccccaccagataaactttctggggggcaaagaccttactatttgacattgtttttgcctcactttctataagaggtcaattatgtgttgaattgtatggtggggccagctaaaatgtgttcatactggctctgactttaaaaggtgcggaaccgttgtagcaatggggtatcgaagctcaggtartcaacctgagagaccaagaaagaggagaaacacaaagattgctgtcttgttatgctagacatatgctttttgctaaaaaattcatattcgacattcttacgagatatatttctctgaatctaggagtggttacatttctatagtgtcttgcaatctcataaatagaacattatacgtgaatagttaaaaacattgatgatgtgatctcatcgatagaagtgaaaagaagaacatagaatttcagcctggtttaggaggtaaggctggaaaaataagtggggaaatagagctatatctcga

SEQ ID NO: 137822 - DNA, 601 bp, Human
atttagtagtagtagtttaatacttaggcctagagacagcaggattatattttgttgctaccatattgaggtcattatttggaacctgagtgaacaaggataagtacatctgtgatgggattttagcggggagaggtccttaaagattacccagtctgttcctctagtcagtgatttgttcatttattcaaatatttgagtgtctatatgcttttctttgcagtatttcttttcccagatgttggtaataacaccttcagtacaactatctcaagccaaaaatcttagaagagtactgtcmaacctagtagccactagccacatgttactatttaaatgaacattagttaaaatgaagtaaaatatggagttcctcactcacattagcacatttcaagctggatccatgtggctggaggctgccctctgggacactgtcactgtgtagaacatttccatcactgcgggacattcatttggacagcactacctcagagcactccttgactccaggggagtcagcatccccatccccatccacttaatcttccgagacctacgtctgtcagatttgttccctttaaagaatcctcccttgtct

SEQ ID NO: 137823 - DNA, 601 bp, Human
cagggttgggctttggttttaccagggggaggggcaggcacagtgactgacacataactacatatatatgtgtttattgagcaggtagaggcatggatggatggaggccatagcaggttgcagtttgaaggcaagagacctttggatacctggaaactagacgacaggagggcatttgtgacacagggagtgtaacagatgcaaggccagaggtaggaagttacagggcaattctgcttctggacagtagccacaggagagcactgtcagcaccattcagagtgtagccatgtatggaaayagaattggagtgatggtgttgcatagaagcatgcttccctgttctggccagtattgcagctcgtagtagaggtgctgtgtttccacttagcagccttaacctgtgacttcaaaggagttactgatatgctctccattgtcaaatgaggctacgtattcacaaagtctagttaattcttcaagacttttatggttcttgacttatgttagaaatgttagcagctcagcagcaaagaaaaaggcatgtgtccgtgcccaaaaggagacaatccaatgtagatattacttacttactcctttt

SEQ ID NO: 137824 - DNA, 601 bp, Human
aaatagaattggagtgatggtgttgcatagaagcatgcttccctgttctggccagtattgcagctcgtagtagaggtgctgtgtttccacttagcagccttaacctgtgacttcaaaggagttactgatatgctctccattgtcaaatgaggctacgtattcacaaagtctagttaattcttcaagacttttatggttcttgacttatgttagaaatgttagcagctcagcagcaaagaaaaaggcatgtgtccgtgcccaaaaggagacaatccaatgtagatattacttacttactccttttttttttttttttttttggtagaggtggggttttgccgtgttgcccaagctggtctcaaactcctgggctcgtgatctgcctgctttagcctcccagagtgctgagattacaggtgtgagccacaccgtgcctggcaagaacagttgctttctagtcagactcatcctgactcttctttttcctagctgtgtgatcctaaaaaactcactttttgatcctaatttcttcatttttaaatggagatattacctgcctgtgaggactaagttaaatgtatatgacatgttagctctatgc

SEQ ID NO: 137825 - DNA, 601 bp, Human
ttccttgtccttaggcgtagttagctggatataaccatctcttaagtgaaatgtatagggctggttaccctcaaaatcatcaagtcgaatcagctgatctagtagaggtaaaattaggcctggataatctaaacccagggataattttctgtatttggaaataaggtgatcacttatgcagattacttaggaaaaagctcacttttctcttttactcagcatcaagagcatgcagtacagctgctctgaaggaagagaagaaaattgtgtgctgctttagttttaaataagtaaaataggwtgtataaaatggagtatcgctgaatgatcattctattttttttttttgtactgttaaaaggatggttgcggtcttaactatgtgagttcttagaatctactggcctacatagaattcatgggggtccagataattctttttagtagactcaaagttgcttttcttccataatgaaatggcacagttatctgttttctcatgcctggacctcctttcccaagcttgatgcctcccacccttgtttgaccttcctgaagctgcaccccgccccacttctgggccgctgttctctcgctttct

SEQ ID NO: 137826 - DNA, 601 bp, Human
atctcttaagtgaaatgtatagggctggttaccctcaaaatcatcaagtcgaatcagctgatctagtagaggtaaaattaggcctggataatctaaacccagggataattttctgtatttggaaataaggtgatcacttatgcagattacttaggaaaaagctcacttttctcttttactcagcatcaagagcatgcagtacagctgctctgaaggaagagaagaaaattgtgtgctgctttagttttaaataagtaaaataggatgtataaaatggagtatcgctgaatgatcattctattttttttttttgtactgttaaaaggatggttgcggtcttaactatgtgagttcttagaatctactggcctacatagaattcatgggggtccagataattctttttagtagactcaaagttgcttttcttccataatgaaatggcacagttatctgttttctcatgcctggacctcctttcccaagcttgatgcctcccacccttgtttgaccttcctgaagctgcaccccgccccacttctgggccgctgttctctcgctttcttgcgtctaccttgtattaaaattatctgcatttatt

SEQ ID NO: 137827 - DNA, 601 bp, Human
ataaaatggagtatcgctgaatgatcattctattttttttttttgtactgttaaaaggatggttgcggtcttaactatgtgagttcttagaatctactggcctacatagaattcatgggggtccagataattctttttagtagactcaaagttgcttttcttccataatgaaatggcacagttatctgttttctcatgcctggacctcctttcccaagcttgatgcctcccacccttgtttgaccttcctgaagctgcaccccgccccacttctgggccgctgttctctcgctttcttgcrtctaccttgtattaaaattatctgcatttatttgttaccctcacaagactgagtaccttcacaaacaggcattttcttattcatttttatgtgttcagtgtttaaagaggggctgacttctacaagatgcttggtacagtcttgctgagtgaatggatgcatgttcactaaaattttcttgtatgtattcttcccaagtagaccataattctgagtaggaaaccatgtcatgcttcttgttacctcatagctctagcacattggtatacaacattgatcagtttgctctgtagcattgct

SEQ ID NO: 137828 - DNA, 601 bp, Human
gttaatgtccagtgtcctggaaacaccttctagggcgtatttggcagttattaaatctgttactattttatccctgtagctactattagaatatttataaaatgatctccaagacttttattgaatttgaatattgttatgggaaaaatcgatacaaatgctcttattagctacagttcttatgtgaatgattactattatttgattcagtctgtaggcagtaacaaaacctaaaatatatgtgttgttgagtaaatgaattgagcagttcagttgaatacacttagacttgactttttcyttttctgcccttcagctattatttactgtgagtccttgaagttaatttcagaggtttttcaggatagggggttggaattatacaggatttcacacaccttattagctccttacttaaaataattaaaaaagaactagttcagggattagagctcccttgaaattgttgaaatgtgaaatttgaatttaagactttcttgaagacttgaatgcattttgcctactggtaattaattttttttcttttctttgtagttttagttttgattgctgttaactactactgataactgagccaaag

SEQ ID NO: 137829 - DNA, 601 bp, Human
cttattaagctgagatctcagtcttcttacctctgtttttgcccatttactttttatttcctggaatttaaccaattctttgttatctgaatctttctagtaatgaatgggtatgagaagtcaagatttaaaaacttaaacctaatcagttggccggacacggtggctcatgcctgtaatcccagcattttgggaggccgaggtgggtggatcatgaggtcaggagatcgcgaccatcctggctaacacagtgaaagcccatctctactaaaaacacacaacaattagtcgggtgtggtgrcatgtgcctgtaattccagctgcttgggaggctgaggcccgagaatggtgtgaacccagaaggcggagcttgcagtgagccgagatcgtgccactgcactccagcctggcgacagagtgagactccatctcaagaaaacctcaaaaaaccaaaagcaaacctagtcagttttacaataatttactctgaactgaggtggtggtgatcgtgatagtggctaaaatgaggtttttgaattatttatggatttcagtgagctgtcttactctaattttaaggggtaattgaggagcaatgaga

SEQ ID NO: 137830 - DNA, 601 bp, Human
taagatgatattgaaagagaacataaggtagaagaaaggctattataccagaattagaagctggaagattgatctctaatcctagcttgccttgaccttgggcatatcattacatattaatttaccataggaaaattgaacttgatttccatactttcactttacaggtaatttttcaggaatgtatctgtgttctctgaccaagtttaattaagctagaaatcagtatcacatacccaagaaattccaaaatattttgaaattaatgatcacagcctgaaaatccatggttaaagaggarcttacaaggcaaaatactttgaattgaatgaaaaggaaagcgtaacgtatcaaaatatatgcgatgcacctaaagcactactttaaggggaaatttatagtgttaaatgcttatattagaaaataaaagttaaatagcttttgggcttttcctgtatgtcatgatgggttacaggctgattgtagttctgataaatggtttctttcacttcctatccaatttatatgaaaaggggagatagttaaatttttttgtcaggcaagcatttattttttaacacggatactgtctagtatttgt

SEQ ID NO: 137831 - DNA, 601 bp, Human
atttcttttatcatgatatttagtcctgtgtgtggctaacagtcgacttatttttacttgaccttcatgttagaatgtacatattaaataaatgttcagtgatctcctactttgtcatactcagattatctgttgccacagatttgttttttttggtttttgtttttgttttgatttttttttgagacggagtctcgctctgtcaccaggctggcaggcagtggtataatctcggctcactgcaacctctgactccctggttcaagcgattctcctgcctcagcctcccgagtagctgggrttacaggcatgtgccaccatgtccagctaatttttgtatttttaatagagacagggtttcaccatgttggccaggatggtctcgatctcctgaccttgtgatccccctgcctctgcctcccgaagtgctgggattacaagtgtgagccactgtgcccagcccacagattcatttttaaactgctttattgtggaataattgacatacagtaaactatgcttatttaaaatgtataatttgataagttatttgaaatatgtatacacccatgataccatcaatgtagttgaactggtgacc

SEQ ID NO: 137832 - DNA, 601 bp, Human
ttacaggcatgtgccaccatgtccagctaatttttgtatttttaatagagacagggtttcaccatgttggccaggatggtctcgatctcctgaccttgtgatccccctgcctctgcctcccgaagtgctgggattacaagtgtgagccactgtgcccagcccacagattcatttttaaactgctttattgtggaataattgacatacagtaaactatgcttatttaaaatgtataatttgataagttatttgaaatatgtatacacccatgataccatcaatgtagttgaactggtgaccrttgtttcctcatggcccttggtcatttttcccttttgtttccctcctaccctcacataacggctgctctgctttctgtccctatagataagtttatatttcctagaatgttatgtaaatggaataatacagtatgtagtattttcgtctggctttcattcagcatagagattcatctcttgttgttgcatgtatcagtagttcattccatgttatcattgaatagtacctcactgtatggatgtaatgcagtttgtttgtccattcacctgctaatggacacttggattgtttctagttt

SEQ ID NO: 137833 - DNA, 601 bp, Human
taacggctgctctgctttctgtccctatagataagtttatatttcctagaatgttatgtaaatggaataatacagtatgtagtattttcgtctggctttcattcagcatagagattcatctcttgttgttgcatgtatcagtagttcattccatgttatcattgaatagtacctcactgtatggatgtaatgcagtttgtttgtccattcacctgctaatggacacttggattgtttctagtttttggctgttacaaataaagctgcatgaacattcatatacaagtctttatgtgggcayatgcttttatttattttgggtaaatatctaggagtagaatggctggatcgtgtgataagtgtatgtttaactttttaagaaacttgcaaaccattttccaaagattattttgtttctcttgagcagtggatgatagttccagttcatccatgttctcataagcactctgtatgaacagtctttttaagtttagccattctcatcagtgtgcagtcatatctcctgcggttttaatttgcctctccttaatgactaatgctgttgagcatttttcatgtgcttgcttgccatctgcataac

SEQ ID NO: 137834 - DNA, 601 bp, Human
cctatgaatgagctaaggttatgcacatacatgccatacacaacctgcttataagtgtctcattttaatggagaaatatgcttagcatatgctgcagccttaaatggaaagtagattacatttaatcccaaatcaaggaaatggagattgttgttcttccttgtctgaaatgtcaccttaaactgctgttttccttagtttacccacagcagcatttctgtaagtctccttggaggctgggtatatattctagtcttatgcacacagcttcctggcagacatcaaatggaatttgacttascagatgtcgtactgaatcatggtctgcagagatgcggatggatcacatccttggctggggaagtggggtggatacaaatatctgggtcaactcagtggttaaccaaaggttagtcatgttataaaaagtcatgtatatcaaaaatacaaaacagagtaagatagggggtctgaagcttatgcatgcaatcagcaacaaggcagtgtcaggagttgaaggaccagacaaaaccatctgtttaataagataataaaatctgatataaaaggaaccttggaaatgtaaaccacctccttcctt

SEQ ID NO: 137835 - DNA, 601 bp, Human
aaaggacttagaaataaaatatgggtatattttaaaaatattttttatctaataggaatttagtgatttatttaactttaaaaagtctgaattaaatgaacataacacagagcataaagattaattgaagcatagatatgtagagcgtggcaagttgtagaacagcagcttttttcagagctccctttaccctgtccatggctagaagagaagggcagggagaccaaaggcttgatcttcacaggctcccacaccacttctgtatccccacccatgatacgttgttcttcacttttactcygagatttcttcccacaacagagaaactgcaagacaggagctaatggtgaaaaccctggtggagagaaatcttgacctagacttcaaatccctaccttttcagttagaaccatattagcttctacctggaggatctttatatgccattttgtggcccttgaaagacaaactgtgtcccagaatgtcctctaaaaataggtacttgacaaggtttttcattacattattccatagacacaaagttgcctttttctgggagacttattatttagttgttgaggctgtatagcaaaagctaagt

SEQ ID NO: 137836 - DNA, 601 bp, Human
tcccacaccacttctgtatccccacccatgatacgttgttcttcacttttactccgagatttcttcccacaacagagaaactgcaagacaggagctaatggtgaaaaccctggtggagagaaatcttgacctagacttcaaatccctaccttttcagttagaaccatattagcttctacctggaggatctttatatgccattttgtggcccttgaaagacaaactgtgtcccagaatgtcctctaaaaataggtacttgacaaggtttttcattacattattccatagacacaaagttgcytttttctgggagacttattatttagttgttgaggctgtatagcaaaagctaagtgacgttttaaaatggtggaatgctgcttctaagccttgagtgagagcttcactcttccatcctcaaacgtctgttgaatagcttcccgatgctgagcaggatgctggggggtctgtgatgccgtgtcatctcccattccccactgagaatggagtatttctagttgcgttttaatttccaggaatgagacatacctttaatgtagtgcttatcacactgtgttgtaactttatttatatgcctgtc

SEQ ID NO: 137837 - DNA, 601 bp, Human
tccactcttttgttctgttcaggttctcagtggattggatgatgcccacccaccttggtgagggtggatctttttttactcagtccactgattctagtgctgatgtctttcagaagcaccctctcacagactcacccagagataatgtttcagcagctctgggtatctcctagcccagtcagcttgacacataaaatgaaccattacattattctaaagttacagtgttctcacactatgcatgaagttgttcagtattattcgaaggtaggtgtgataagctaaaaatgtatatatctayagtaagctctagagcaactactatgaaaaacgtaaaaagaataaaaaccagttgtggagatgaaatgacatcataacaaataactgaaagaaagcagaaaaagagcttttggaccaaagaacaggtgggacaaatagaaaaccactagcaggatgtgttaaagaaaaaattatttaataagacttgttaaagcatggtaaagacttttattcaggaccattgcagaaggtagaggagccactgcaacagcatcttgcagtaggggagagagattgggttcaactctgaatacagcatggg

SEQ ID NO: 137838 - DNA, 601 bp, Human
cactatgcatgaagttgttcagtattattcgaaggtaggtgtgataagctaaaaatgtatatatctatagtaagctctagagcaactactatgaaaaacgtaaaaagaataaaaaccagttgtggagatgaaatgacatcataacaaataactgaaagaaagcagaaaaagagcttttggaccaaagaacaggtgggacaaatagaaaaccactagcaggatgtgttaaagaaaaaattatttaataagacttgttaaagcatggtaaagacttttattcaggaccattgcagaaggtagrggagccactgcaacagcatcttgcagtaggggagagagattgggttcaactctgaatacagcatgggcaagtggggacttatagccaaggatcagtgagagggtcagtggatggaaaagtactaagaggaggacgtcaggggttaggagaattctggctgacgcctaagaggattcttgctgaagatagccagggtgatgcgatgtcatctgggggatggtggacagttaggaacctgatgagatattgaggataaacaaattttgaggatggcaaggaatgttcttgctaaacacattt

SEQ ID NO: 137839 - DNA, 601 bp, Human
aaaattagaaggaaaaacttgtaaacactaatcaaaataaggaatgaccgttatatcaaagtagactttggaacaaagattattattaggggtaaatgggacattacataatgataatgggatcatttccccaagaagacttaataatcttaaatatgtggctacattcaacaacagatctttaaaatacagaaacaaaaactgatagaactcaggggagaagttgacaaatacacaattattgttgacgtcttcaacaactcctctctgaggacagtaggaagtaaaattcgctacccartttgctgtaaacacatataaatgctgaatagagtataaccaagaaagtagaaagtagaaagcacattgatatgattttgaaattctttaatcatttggctttaattggaagagtaccaattggagaagttcagtgccagtattcaggcatttaattgtacaacatgtaaaattagaggagaaatttaggtttagattaattgcatgagaaataaaattagaggacaaatgttagtatcttattttggtaatataaaattaattaaaattatattactatcaacatcttatactatacttt

SEQ ID NO: 137840 - DNA, 601 bp, Human
acgaaggctaagaattcttaagagaatcctcgcaaatggcagtaggaagtaaaattagctacccaagttgctataaacacatacaaatgttggatagagtataaccaagtatgtgtgtatgcacttatatatgtatatatttatatttaaaatagatatacctaatgctagatgacgagttagtgggtgcagcacaccagcatggaacatgtatacatatgtaactaacctgcacaatgtgcacatgtaccctaaaacttaaagtataataataaagaaaaaaaaaccctaaaaaaaaaawaaaataaaatatatatgtattttaaaacattgccatgcttgaacgaatcagcaatcttccctaggtgttaggagctgagagagttggagggaagatgcttagagctagaggccagggtttaatgctgcccgtacatggaaatgtgtttcaggccaacctgatggaatgagctagaactgagacctcagaataaatgctgggatgttcaaagggctgtcaaatcccgtaaaagttgggtagaaaacctgcgctcgccaatcctgagaaatagcttgccatctgcctggggctccaaatagt

SEQ ID NO: 137841 - DNA, 601 bp, Human
cgtaaaagttgggtagaaaacctgcgctcgccaatcctgagaaatagcttgccatctgcctggggctccaaatagtaagaaaacaaaacaaacaaatgtgttagggagaaattagaaccacagtcttggccaggggcacagcaaaagaaaacataaaattgttctacaaggaaacttttctaaaacaaggtgcagagaacaaccccctacccccaccatgagaaagagtttgcagtaagaggttagacacactagcaagtgtcagcaggtgctgcacatgtgtgagggcacatgcacacasagaattagcacagcaagtatgaattaaggtaggtaattaagctacctggctcctcccaggaggagatgccaaggtaggattacaagttcaaggatcctgaatggatcacctgggttccttcctgcctcctttgcatgaacacagtcttacctcttcctgctggctggagtcagtttcctctgccagtacggagattcctcttttcattttctattccatggtaacatgagtccaaagtaccgtggtggcatccagaacttgcagttcagtgggatctttgccttgttcctgctaagtgtg

SEQ ID NO: 137842 - DNA, 601 bp, Human
cattttctattccatggtaacatgagtccaaagtaccgtggtggcatccagaacttgcagttcagtgggatctttgccttgttcctgctaagtgtgtgccccatttcagacccccagccctgcagtgtccactggtgcagaatgggaagcacaaagttcccctgggctgttggtggtgatcattaagtagggcttttcttgcctccagccctaggcgcctaagcccacatgtcctcctccttgggatcccactgccatctagaggcctctgatgtataagtgtactgtgttgtggagtatsaccatcctttcagagtgtctggcaagcttgtgcttcagtgtgccttgaaaaggctggcccagcgttcattgggatggacccgcgttgggtggtttgatatgtgatgtgaccattggatcctgtcgatgggcccacgctcgacgtccttcactgtaaagtgggtcccctcgtcagatgcgatgatgtgtggggtccatcaggctgataattctgggtggacttatcgatgatgcaggctggcggattttgcctgctttgtgttcagtgtctctttggtgggaaactttccagtggaggtta

SEQ ID NO: 137843 - DNA, 601 bp, Human
cccacgctcgacgtccttcactgtaaagtgggtcccctcgtcagatgcgatgatgtgtggggtccatcaggctgataattctgggtggacttatcgatgatgcaggctggcggattttgcctgctttgtgttcagtgtctctttggtgggaaactttccagtggaggttaacaagtgatacagaaatcttcaccctgtgcccactcccgaatttctacccacatggcctttatccagatctccttgttcctcatcttccagttctttttatttcagtaccttgaccatacaaccaggctgtggccactgcccacacatctgcacgcatttcagatcaagctacgcggtgtcatgaactggtgtcctgcccacagctccacctgctgggaagattttcctttccactgtctctgagggccatcctgagtactgctgcagcacacacagtccatttttgactaacaccatgtgctgagctgatccgtctgaaaaaccaagctcaggctttccttcctccttcccctggatgtatgagtctgctgcctgtgtaacctaggcacacaggggaggggcactacagctcttgggggtgacttggagg

SEQ ID NO: 137844 - DNA, 601 bp, Human
tcagggcatttattttgtaaggaacatgtttgaaaaggggcattttaattatcctgtaaatgtttttacctcagcaataatgtttacatagctagtaatcatggctctcaggcatgatgagttttactgttgttaagttttgttttgtttttatacttaaagttctagggtacatgtgcacaacatgcaggtttgttacataggtatacatgtgccatgttggtttgctgcactcactaactcgtcatttacattaggtatttctcctaatgctgtccttcccccagccccccaacccccracaggccctggtgtgtgatgttccctgccctgtgtccaagtgttctcattgttcaattcccacctatgagtgagaacatgcagtgtttggttttctgtccttgtgatagtttgctgagaaggatggtttctggcttcatccatattcctgcaaaggacatgaactcatccttttttgtggctgcacagtattccatggtttatatatgtcacattttcttaatccagtctatcattgatggacatttgggttggttccaagtctttgctattgtgaatagtgccgcagtaaacatacgtg

SEQ ID NO: 137845 - DNA, 601 bp, Human
cacctatgagtgagaacatgcagtgtttggttttctgtccttgtgatagtttgctgagaaggatggtttctggcttcatccatattcctgcaaaggacatgaactcatccttttttgtggctgcacagtattccatggtttatatatgtcacattttcttaatccagtctatcattgatggacatttgggttggttccaagtctttgctattgtgaatagtgccgcagtaaacatacgtgtacatgtgtctttatagtagcatgatttacaatcctttgggtatatacccagtaatgggaycgctgggtcaaatgctatttctagttctagatccttgaggaatcaccacactgtcttccataatggttgaactaatttacactcccaccaacagtgtaaaagcattgctatttctccacatcctctccagcatatgttgtttcctgactttttaatgattgccattctaactggtgtgagatggtatctcattgtggttttgatttgcatttctctgatggccagtgatgatgagcattttttcatgtgtctgttggctgcataaatgtcttcttttgagaagtgtctgttcatatcctt

SEQ ID NO: 137846 - DNA, 601 bp, Human
tgctttggctcgccctccatgggctgcacccactgtccaaccagtcccaatgagaggaaccaggtacctcagttggaaatgcagaaatcacccatcttctgcgtcgatcatgctgggagctgcactgcagaccagagctgttcctattcggccatcttggaacagaacttatttttattttttaccaccaatatctctgctgggtcatacagccttagcagccaggctgtttgcaccacagcctagacctgctgaagggtcctttcttgccttgagccccactcaaaactggcagctgccrtgtcatgcagtctgtagaccagagccatatcacaggtgtgttgcccccagaacccaacctaatcagcactgggcttcctcagcattgggggatgcaagatataacaaattgtcttttccttaggaggagatacccagcatgcctctgagcactgggtccctcagaacttcaccgcagttgccagaccctgaatcttcacagggcttatctgccaccctctggagcatgtgtgtcttaccaagggctcctgtgtgctggccaccctgtgcttagtctgtccagtcagcatgacggtgttgc

SEQ ID NO: 137847 - DNA, 601 bp, Human
gccctgtaggggagaggcctctgcagcatattccagctcagccaagtgcaagcccagagagtcccaattgagggacttgcaggtaggttgtttagactcaacaatatcataggcattcatctagaattccccatcccagttttcagaatgctgggttttctctcttagggcccagacctgcatacttcacttgccttggctgagatttaaacatttccagctcttactctcacaactggaccttggaaatgggaaacccacagcttttcattctgtctgcccatccaattcagatggtggygaagactgctttgtacccactaggaaggccctgttgccctcacatttagctgttaactgcttgttaactgcagttcagtatcccgttatccttatgcagggcattagtacaattttagcactgactagccaactccgctgcttttctggaatttttccactgaatctgcattattgccttggacatgaaaggtatcccttcatttggacattttccaggtcaccgtcactgtaatctttagcaatcgagccatgacctgtgccagggactaccctcctatcaggatggcatcctcaactg

SEQ ID NO: 137848 - DNA, 601 bp, Human
agggactaccctcctatcaggatggcatcctcaactgcagagtggtctgtgagcatgtcccagatcccccatctcaccacctgctttctcagatcattctcagggcacttgggtttgtctgggtctgagcaacagacaccaaggtgggatcacagctataggatttgattaaggatatcacctatgtgaaagaaaagggggtagaaactggggaggctgagagagccatcaaaccacagtgcaaacctgacccttgcagtggggaggagagggggttgggtgttagcgagctttcctagtstgccatgaggtctaagggagattcagcagagccgatgaggggttcttgtctttaattcacctttgtcagcttttctcggttatttcatcctgatttcttgctgcagactagttttgtcattctccatttcatgtggtgggagttatccatttccatagttgaagacagcagccagaccaagctggatagcatagtcccacctccaaattcttagggaaggaccctggcccagtttcagccatgtctgggatctagttcacagttaggtgaaccaggttttatctctctaaactgagacat

SEQ ID NO: 137849 - DNA, 601 bp, Human
cctctcagagctccctgttgctctaaaatagagtgtatttatagaaaatgtgaggtatagtgaggtcaacagattaggagacaattgccatagaaaagatagcttgttacagttcccaagaggagggggtcacagcacaccacgcagggccacataggaagcacagggtccttgaggaggcagagcgggacggggagctgtgggccggagtcttttttgtggtttctgtgggaaggagtggacaaaggggaagcagagtcaggattggcgggtttgaataatttcagtgggctctcagctygggggctgtttctacttgtctagtagtttggccatggggtgatgtgcaggtgggtagtggctaggagtgtgagagccacatcgaggaggtgataggtgtgataggtgtgtgggctctggattggttggtttgcattttgaagagggccctcttgggtgagctgttttccatctattggaattagtaaccttgggaggatggcaccaagctgtccacccccatgatccaaaagtttcccactgggccccactttcaatacctgagatcacatttcaacatgagatttggagagaacaaaca

SEQ ID NO: 137850 - DNA, 601 bp, Human
ctgcaatctctgcctcctgggttcaagggattctcctgcctcctcctcctgagtagctgggattacaggcatgtgccaccacgcctggctaaatttttttttgtatttttcgtcgagatggggtttcaccatgttagtcaggctggtttcgaactcctgacctcaagtgatccacccaccttggccttccaaagtgctgggattataggcttgagccactgagcccagcatatcatctcctttttgaggagaggggtgaaagggatgcctaggatgttggagaaggcttttctgaagtgtytggtgatccttgactcttatttaagtctgaggcactaaaagctggtgcactctgggtgcttggggagattttgacaggtgttactgcctgggtggcagtttcagcaggggaaagcctccctccccagtgttcatatttgtagatcttttctcttcaaacattccccaggaaggaatgctccagtgtttttggatgggagtaaaagccaggctgcctgtgttctaggagccaagtggaacaagaggttggggagctgtctcaccagtcattgtagactttgatttagtattcctgtttcca

SEQ ID NO: 137851 - DNA, 601 bp, Human
gcctcaaatccatcctcctgacctactaaaattaggggtttatgtagcaggaagaaaggtaactatatgtgagaaaacaggaattagggagagataaggaagaggagttggtcaacagggaacaggtggtcttaagcagtcatgatgggtgaggagtctgacttctcatggtccagatgagatgatctagtaagttttagttttttaatactacctggaaggccggatggatggttgcctgagaaagcaattcagataagacaaatgtaacttgctcaggcttcaagactcggagggtcartttctacgtttattcaaagaaaccataaacaccagttctgtgggacaactggggtgatgtcataatggtggcctttcctgtctcttaatctggttaagtggtcttcaggtttgtggcttgtgtctcctctcttgctcttgatacatgtggactttttgcctttcctctctctcctcatttcagtgaagagagaagtcagaaatatggaatatattatttttctatgaagtgagattatactatacatgtaccttcaggctctataaaactcactaaagtaattcactgtttgttgcattt

SEQ ID NO: 137852 - DNA, 601 bp, Human
aggaaaagatcctttctccttctgtatttcccagtatgaaattgaccactgcacctgtactgggcttgtgatgcttaactttaggcaatgaagatgtgatgctcttaccaactcacaaattattagatgagatcaaatgtacagatttaaaatagtgttaatttttaaaagcttttgaaaatgaagataattggtaattttttaaactatcaattattatgaattattttgttaaacttgaataggaccaattgttttgttttttaagtgtaatagattgaaaactagttaacacctgtawtatgcctggcacatagtacctacttaataaatatctgttgattgaataacatcccaaatgaaccatagtataaagccaaacaatagatttgctgattttaacctactaaaagttaaaatgcagatactgatttccgcattgaggtgaacagatcagctggttattttatgtatatggtaccacgtatatattggcatgcatagatgtatggcaaatgcaagctaggaagaaaaggctgcttcttattctcattttgaatattaatattaaatatctgaagaatattttataagactcaaa

SEQ ID NO: 137853 - DNA, 601 bp, Human
tatggtaccacgtatatattggcatgcatagatgtatggcaaatgcaagctaggaagaaaaggctgcttcttattctcattttgaatattaatattaaatatctgaagaatattttataagactcaaatatgcatgaaaatgctttttccttcaaagctttttgaagttgcactattttcccccaaacttttacatttattttctgatcttgttttctcacttcatcctgctccttttcagtttaggtggtttatgtggcatttttggtgacaggttttcacagttaaatttttcagaaaytctgttaataactagaaaatcttccatgaaatgtcccatattggtagcctcaagcgaagggcaaatttttttttaactcaactacttttatttatcttgaagaaacgctgcaggtaagtatcggtttctttaatagagttgtactgtattgttacggatatatttttaataatatctataatcattagctaaggcaaaagtatgtaaagaaattacataaaatgttttttaaaataaaattttcctggaatctaagctcttatgattgacttttggtagtggtaattgataaaaatatac

SEQ ID NO: 137854 - DNA, 601 bp, Human
tgctagtctcttatgagacctactgctaaaatgtcatctgggggtgaaaaagccgtaatgaccaccggttaggcagagttgtggagggggctgaacccgggaggaagcagaaggaagccagttgatgaggaaaggcaaaagaaggatgtacaaagagaagcaagaacatgagcgagaccgcaaggcccacaaggtggaggcagcagctgcttcttgacctgcccaggatggctttcccctcccatttgtggtgcagggcttgggtgtcctcacagtgacccttcctcacttcaggttcgtkgagtgcatctggggcttacaacccaaagagcattacagaaagagaagcacagtgatatatactgccaaggatataattttggaaaacgaagataattgagtgcaatgaactgaatgtttgtgtctcccaacaattccgcgttgaaatcctaatcctcattgtaatggtctttagagctaggattttggggaagtaagaggtcatgaggtggagtcctcatcaataagattagtgcccttattaaaaaggcctgagagagacaccttgccccttctgcctagtgatgccaaagcaatgagg

SEQ ID NO: 137855 - DNA, 601 bp, Human
atctcgtatcaggtacatgattgtgattatcagcagcctaaagtagtagtcttccttaaaagatgccgttttatgggagtagacattctctgttttaatctactattcttttacacacgttgtctggcaaaataaataaaaatataaatataaatgtgagacaggtggaaaaggaaaaatatgtgacctgtaatcaagagaaacagaagtcagtcagtagaagcaagacccacagatgaccccaattttggaaataactgatgagtactttagaatagttatgaaaaatttattgaggggkcatccagtttctggtctggcttttaaagagtttggaagtcactcctgtctacacaataagaggaagttcaataatctgaaaaccagccttttgaaagatccatgtaagaactgaagttacaggacaaactgatgcccccaaatttggaaagtaagtacaggggacagcaaataactttgaattgggttctgcttagaagttaaccacatttataattttaaaaataattgataagtcacatcaacatgattataaagtaggaaacagatatgcagttattacaacctgctacaagacaac

SEQ ID NO: 137856 - DNA, 601 bp, Human
catccaaatcagacacttcacttcaagggccagaaattttgtcaccgttaaatttttaacaggctttttagggaattgaaatctttccagtgagactatattgaatttggtaacagtcatagaaatgaaagagaggaaatttgtaacatgaatgacgatatagtttaaaaagatcaccacattcaaaggtttgtccaataattttttttaagtctgttttaattttcagatttttttctttgagtgttacttctgatacagtacagtgtgagcaatcagagtggctgggggaggatagccrcttggcaaacagttttaggtgtgttacttggttttccagctagggaattttgatttttttttcttcaaataatgacagtttagtgttaattaacattaaaccgggagtgctttttcatcattttccttgattaataatctgaatgctcttgttcctgtcagctagttgatcaattaaaatcacagtatcttgtaatcagattcctactggtattatgatgtagtttcaatataatttgcttaaaaaggagatgacatttgtgccaaggatgacaaaacttctttttaatacctcatatgt

SEQ ID NO: 137857 - DNA, 601 bp, Human
cgctcctcccccataaaattcttctcaggatgtcacaaagaaaggagttagaaatttagtgagccctgccgaaaaaaaaaaatttggcgacattaatggtactattaagataatatagaaaatttagcatagaaacacacaaaagagtcaactttacaaaattccgttaatcagaaaaaattgtaatactttgaacatatttttatacagatggtatttcattgtacatatggttttatagcccatactcactgtacagtaaacatctgtattcttataagacacatttttgaatagctgkagattattatattgatacaccataattatttaaccattttactaatgttggacatatagttatttgtgggggaacgctattataaattcttactcaaaataattacatacatctctggttgtttttgatttttttaaaaaagatttcttatgtcttaggagtcatcaggcttcttcataatgagcagggatagtcgtcataaatggcccaaaatcctgtgactccattaattttaaatatgcttctctctttgcaaatcattataaaatctatttaattttcatgtgtggagtaattgta

SEQ ID NO: 137858 - DNA, 601 bp, Human
tgtgattatcagcagcctaaagtagtagtcttccttaaaagatgccgttttatgggagtaaacattctctgttttaatctactattcttttacgtacgttgtctggcaaaataaaaatataaatatgagataggtggaaaaggaaaaatatgtgacctgtgatcaagagaaacagaagacagtcagtagaagcaagacccacagatgaccccaattttggaaatggctgataagtactttcgagtagttatgaaaaatttattgaaggggcatccagtttctgatctggcttttaaagagyttggaagtcactcctgtctacacaataagaggaagctcaataatctgaaaaccagccttttgaaagatccatcaaagaactgaagttacaggacaaactgatgcccccaaatttggaacagaaagccttgtgggaaccgtttcagggttgcagaaacttggtgagttgctggaggctcattgaggacaagtttgagagttaaaagctccagaagggcccagtcagaggggcttccacacttgtgtgtttttctgccagcaaccttaccaggttcttacattgaagattggagaaaaatct

SEQ ID NO: 137859 - DNA, 601 bp, Human
agcaagacccacagatgaccccaattttggaaatggctgataagtactttcgagtagttatgaaaaatttattgaaggggcatccagtttctgatctggcttttaaagagcttggaagtcactcctgtctacacaataagaggaagctcaataatctgaaaaccagccttttgaaagatccatcaaagaactgaagttacaggacaaactgatgcccccaaatttggaacagaaagccttgtgggaaccgtttcagggttgcagaaacttggtgagttgctggaggctcattgaggacaartttgagagttaaaagctccagaagggcccagtcagaggggcttccacacttgtgtgtttttctgccagcaaccttaccaggttcttacattgaagattggagaaaaatctctttgttcgtccattcaggagaggggaatggactttaaaacaagcccaaaacatctgggcacggtggctcacacctgtaatcccggcactttgggaggctgaatcatgaggtcaggagttcaagaccagcctggccaaggtggtgaaaccccgtctctctaaaaaaatacaaaaattagccaggcgtggt

SEQ ID NO: 137860 - DNA, 601 bp, Human
gaaggggcatccagtttctgatctggcttttaaagagcttggaagtcactcctgtctacacaataagaggaagctcaataatctgaaaaccagccttttgaaagatccatcaaagaactgaagttacaggacaaactgatgcccccaaatttggaacagaaagccttgtgggaaccgtttcagggttgcagaaacttggtgagttgctggaggctcattgaggacaagtttgagagttaaaagctccagaagggcccagtcagaggggcttccacacttgtgtgtttttctgccagcaacyttaccaggttcttacattgaagattggagaaaaatctctttgttcgtccattcaggagaggggaatggactttaaaacaagcccaaaacatctgggcacggtggctcacacctgtaatcccggcactttgggaggctgaatcatgaggtcaggagttcaagaccagcctggccaaggtggtgaaaccccgtctctctaaaaaaatacaaaaattagccaggcgtggtggtgggcacctataatcccagctactcggggggagaggcagagaattgcttgaacccagcaggcggaggttgc

SEQ ID NO: 137861 - DNA, 601 bp, Human
gaaacttggtgagttgctggaggctcattgaggacaagtttgagagttaaaagctccagaagggcccagtcagaggggcttccacacttgtgtgtttttctgccagcaaccttaccaggttcttacattgaagattggagaaaaatctctttgttcgtccattcaggagaggggaatggactttaaaacaagcccaaaacatctgggcacggtggctcacacctgtaatcccggcactttgggaggctgaatcatgaggtcaggagttcaagaccagcctggccaaggtggtgaaaccccrtctctctaaaaaaatacaaaaattagccaggcgtggtggtgggcacctataatcccagctactcggggggagaggcagagaattgcttgaacccagcaggcggaggttgcagtgagcagagatcacaccactgcattccagcctgggcaacagagtaaaactgtctcagaaaaaaagcgcccaaaacatttgactctttttaacatgcctgccctcaaaagaaattatttcaacagagcctaacagactgagattttaccagagcttaacagacctggttggagggaaatacccaactcc

SEQ ID NO: 137862 - DNA, 601 bp, Human
aaagcaacaacaaaattttagagcattcaaaatatgggaccatatcaaatcgtctgacacatacgtaattggaatctcagaacaaaaggagaaaaagagaaggaatagagcagaagtagtaatggaagataagttttgaatattgatgatagatatcaactaacagacacaagaaactcagcaaattcctgaaagtataaagaaaaccacgtcataataaaattgctaaggaggccaaggcaggtggattacttgaggccaggagttcgagagcagcctcgccaacatgatgaaaccccamctctactaaaaatacaaaaattaggctggtacagtggtgcatgcctgtagtctcagctacttgggaggctgaggcatgagaatggcttgatcctggtggcagaagttatagtgagctgaaattgcaccactgcactccatcataggcaacagagcaagactctaaaaaaacacaaaaaacaaaaaccaaaaaccaaaaattttgctaaaggaacagagatgaagagaaaatcttaaaagaagaaagaggaaaaatatacatcatgtaaaagaagggaacaatgttaaggatgacagctga

SEQ ID NO: 137863 - DNA, 601 bp, Human
ctgatgatgttcaaatgtgtgtcttcagttctgacctatctcctagtttcaaacttatatacaactgtacaactgtccactcggtgtcttcacttggatttctaataggtatctctaatcccacatgtctaaaatttcacttatgatttctttctctctttgccagccatcccctatctgtcttagcaagtggaagctctcctcttacagtgcttttgattgtcttctttctctcctatcagagacatccagtccaatagtgaaatgacgtcagtcatcttcaaaatgtgtagcaagtctrtatgcctgttagctgccctgatgtcactattccgatccaagtcactatgcctcttgccttctgttggatttccagtcactccccaccgacccccgccccaacacaaagggaagggcatctatttctctgtcctcttcttctacccttttccccatcactcactagcctttagccacactggcttccttgatgttgctgacatacaccaagcacatatttgtcttcagcctggaaggttctttccctagatattcatcttccccctcttcagtcacttgataccatcctatcagagagggc

SEQ ID NO: 137864 - DNA, 601 bp, Human
tatgcctcttgccttctgttggatttccagtcactccccaccgacccccgccccaacacaaagggaagggcatctatttctctgtcctcttcttctacccttttccccatcactcactagcctttagccacactggcttccttgatgttgctgacatacaccaagcacatatttgtcttcagcctggaaggttctttccctagatattcatcttccccctcttcagtcacttgataccatcctatcagagagggcttttgtgaccactgaaataccaccacccacttccttccactctgtyctctataaaaaatattgctttattttccccatagcacttattttcaccagacatattgcttgtttattgtctgttttcctcaaccataatacacccttcatgagaacaggggctgtgtccacaagtatatttcttcaagcaacaaggacaaggcctgatacacagtcgatgcttgaatatttgctgaaaaaatgaatatgcttaataatcaatgtctgttatctaagttcttaaaatgcttagaatattgtaaagaagtattttaaaagttcattatagttaattatggttgacttttct

SEQ ID NO: 137865 - DNA, 601 bp, Human
ttcatcgtcaatacttccattaaagtttttaatttaaaagtacagttaatatacaaatatatcccaattttgttagttatgttttctccgatctgtaactcactttcatggtatttaaaattatttattttaaataaatactaccatatataatctatagttccttgtaatagtcccattaaaatagattaggtacagaaaaagactacatcaagaaaaaaacgagatcatactaattaaagaaataaatacagtccaaaacatgttttctaataaatagacaagtatacaccccaaaccygatactcattccttatgactatgacaactgtgactaaagactatggactttcctagagaagagccttcccaactacataatacaatcactgctggtcttgtatatacaacagagggttgaattacgaccagaagggggaacttgtgagacaaagtaacaaaagtaagaagccctttgcttgttcgcttggcttgccagcagaatttcaacaaaatcccttgtcaacaaaacttcacaaagtgcctgactcaaggactgagagcagccctctggaagaatgccctaaagatgatacacggg

SEQ ID NO: 137866 - DNA, 601 bp, Human
tattttaaataaatactaccatatataatctatagttccttgtaatagtcccattaaaatagattaggtacagaaaaagactacatcaagaaaaaaacgagatcatactaattaaagaaataaatacagtccaaaacatgttttctaataaatagacaagtatacaccccaaacctgatactcattccttatgactatgacaactgtgactaaagactatggactttcctagagaagagccttcccaactacataatacaatcactgctggtcttgtatatacaacagagggttgaattasgaccagaagggggaacttgtgagacaaagtaacaaaagtaagaagccctttgcttgttcgcttggcttgccagcagaatttcaacaaaatcccttgtcaacaaaacttcacaaagtgcctgactcaaggactgagagcagccctctggaagaatgccctaaagatgatacacggggtagagcgcaggttctaaatcactgcattttccaaatacagaagataatgtctaaggattttgcttttatcatctgtaaccagatgtatcctcacattttactctattgtaacttgtattaggtt

SEQ ID NO: 137867 - DNA, 601 bp, Human
ttattcatcagaaaatatagctctttccatttttttctcttcagacacttgtcagctttcagcagctggcaaaatattaattatgcaagtctctaaattttatgtccctttataaattgagaacttctgagtggaaatgtagtatcagttgcatgtttttcaaatagggttaggcatcggacctagaagcaaatgttgcttgtccttttctgcttatgcagcatcgagctgagagtacatgatgttgttctcaacaatagttggtgtgctttgagagtattgctgtcacttttgcaagagrctattgtgtacactcccatagtcttggtgtatatgctgtccctattaattagttttctgtacagccgaaggggatgggatgggagcttttaaagttggactggagtatgtgtgtatatataaatttattttaaactatgaatggtcaagcagaaacacaataattggtttcattttgtgactatgtcagacattcagaaataaagaactgatagacttgaatatgaagcatttggaacgtggtgctcatctacaaaacacccagcatttcaccaaatggattctataaaacagtagttct

SEQ ID NO: 137868 - DNA, 601 bp, Human
tcagttgcatgtttttcaaatagggttaggcatcggacctagaagcaaatgttgcttgtccttttctgcttatgcagcatcgagctgagagtacatgatgttgttctcaacaatagttggtgtgctttgagagtattgctgtcacttttgcaagaggctattgtgtacactcccatagtcttggtgtatatgctgtccctattaattagttttctgtacagccgaaggggatgggatgggagcttttaaagttggactggagtatgtgtgtatatataaatttattttaaactatgaatgstcaagcagaaacacaataattggtttcattttgtgactatgtcagacattcagaaataaagaactgatagacttgaatatgaagcatttggaacgtggtgctcatctacaaaacacccagcatttcaccaaatggattctataaaacagtagttctgaaagatgttattaggcgtttccaggcccagtcactatgagaacatgatatgttagatgcttctcttgcagattgccagtgcacattagcttattaatgactttaagacaccccaaggcatagaaacatgtttaatccttctag

SEQ ID NO: 137869 - DNA, 601 bp, Human
caggaagcatttgttggctttgtgcttgttaacaagaaacactggcatagatcatgtgtttttcattcagctgatagttgttgagcactggctgagcacaagcagtgcagaggtgaaaggcagaactccaactctcctagagcttagatgaatgaaggcaagattagagttccctgacgagtcctgtgatccaggtcagcttagggcattgtggagcacagagggggtcaaatgctcttacagagcccagtctacatcctgagttagccaggactcagttcttatgtttttgttcacttaytccgaaatcttttctgagtacctactataagccaggcatgctctagacattggagactgatatagcagtacacagagctaaggggaatccttgtctttgtggatcatatgttctagtggtgggagacagatgagaaacaagatgaatacatacaagtgcataatttattacttggtgattagtgctagtcaggaaaatacagcagagcagggataagaggggtgtgtgatcacatgtgtgatgaggtgatggcatttagccagggctgctaggaaagcctcacttagaaggtgacatttg

SEQ ID NO: 137870 - DNA, 601 bp, Human
tgatccaggtcagcttagggcattgtggagcacagagggggtcaaatgctcttacagagcccagtctacatcctgagttagccaggactcagttcttatgtttttgttcacttattccgaaatcttttctgagtacctactataagccaggcatgctctagacattggagactgatatagcagtacacagagctaaggggaatccttgtctttgtggatcatatgttctagtggtgggagacagatgagaaacaagatgaatacatacaagtgcataatttattacttggtgattagtgctagtcaggaaaatacagcagagcagggataagaggggtgtgtgatcacatgtgtgatgaggtgatggcatttagccagggctgctaggaaagcctcacttagaaggtgacatttgggtgtagagctagaggaagtgagggagcaaaccatgtgagtttctggagcagaagtggtctacgcagaaggaactggaaatgcaaaggcctggggagaagggggatgcttgggtatgtctgagaaacagtgaggaagccagggtagttggagtgggacatacaagcgagaggttaataggagatga

SEQ ID NO: 137871 - DNA, 601 bp, Human
tatatactcaagtagagttgctgggtcatatgtttaattttggggggaaccaccacacagttttccacagcagttgtaccattgtacattctcaccaacagcgcacagggttccaatttctccacattcttaccaacacttttctgcgtttttgtttttgttttttaaatagtagcatcctaatgggtatgagaggtggtggtgagagggatttcagtcattcttaaaactgttaaaatgattgaaatcatggcagatttgtaagaggagaaatggtaggtaaagcacttgggctttggtytgcccctgtgagtgctcaggagtgtcagtcagctactactgtgaggaagggggtgcccatgcctgaggcagagggagcagagcagctgtgcagaagcacagagtgtgaggaagtgggagagtgtggggctgcaagtagtgcattctggctggagcaccaggcaagggcagaaatgaggtgcggccagttagaaaggctactattaaaaagtcaaaaaataacagatgttggcaatgctgcagagaaaagggaatgcttacttactgtaaacatggtgggaatgtaaattagttcagccac

SEQ ID NO: 137872 - DNA, 601 bp, Human
ttggatactgtgttcactacctgggtatgggatcattcattccccaaactgcagtcactcagtatacccatgtaacgaacctgcacatgtaccctctgaatctaagataaaagttgaaattattttttaaaaaaccggggaaaaaagaaatgaagtgcagtgcacagggccctctgtgtcatacacatacacatacacatacacatacttattagattttatcttgaaatgacgaggagcagtaaagaatttaaatagaaatgacgtagtcagttctttctgttagatcatttggcagcartgtgatgcatgggttcgggggtgggaggtgaatctaaaagctattgatgtaattcaggagagaaacgagggtctggggcaagatggcggtgggtgtagaagggacaagacttggtgttgagttagccgtagagagagggagctgtcacaatgacaccatttctggcttgggcttcattttggatggtgggtgcttttcaacatggggatgcaggtttgaggtaaggtgaaaaggagttatatttcagcttgtacaggatttgagaatcttaacagacgtcaacatggagatgttcagtag

SEQ ID NO: 137873 - DNA, 601 bp, Human
ggatactgtgttcactacctgggtatgggatcattcattccccaaactgcagtcactcagtatacccatgtaacgaacctgcacatgtaccctctgaatctaagataaaagttgaaattattttttaaaaaaccggggaaaaaagaaatgaagtgcagtgcacagggccctctgtgtcatacacatacacatacacatacacatacttattagattttatcttgaaatgacgaggagcagtaaagaatttaaatagaaatgacgtagtcagttctttctgttagatcatttggcagcagtrtgatgcatgggttcgggggtgggaggtgaatctaaaagctattgatgtaattcaggagagaaacgagggtctggggcaagatggcggtgggtgtagaagggacaagacttggtgttgagttagccgtagagagagggagctgtcacaatgacaccatttctggcttgggcttcattttggatggtgggtgcttttcaacatggggatgcaggtttgaggtaaggtgaaaaggagttatatttcagcttgtacaggatttgagaatcttaacagacgtcaacatggagatgttcagtagct

SEQ ID NO: 137874 - DNA, 601 bp, Human
agaatagcgagggggaaaaacctacaactttgtgttaattcacgatgaaaagattcatatgtggtctacctcataactctatactcttttttaaaaaattacaaatatagtatttgttttaaaggcttctttgaatacagtcagtattagaagccccaatttaggttactgacagttattttaaaaatagtttcttacctaaaacttacagagccactctagagatatggtccaactgagacagtgttacacataccttgtgtgacacaagcacctggtgttcttaggattgatgcctgtaaaatcctggtgattctgctgatttaaaaattttgttaaccttctcagaaatagcatttaccgaaagcctttaggctgcaggctttaaaataatgttaatgtcgacaagcattgtatagttaactgatagtcatttgatgatacaccctgaaattgtcagtttcaacaaaattgaaactatcaacgatcccttttttaaaattttactttcagtatcttgaatgaaagactcagattgagctggagaaaatatgcttaaaaagtacaaaatataccacttcatatttattttgagaaaaat

SEQ ID NO: 137875 - DNA, 601 bp, Human
ttctgtagtgttaggggttttgaagagtgaaaatatagtcagcaaattaaccttctgttactggaaaatggtaggacacgttatcaggacgagacttccaagaaaaacaatggaaaataaatagtgcaaaaaaataatatgaagagactaactaaaaatgctctttctaaacacccctcctgccttctcccagctcagcactttcttcccatacctgctgtcacctcttgtcccatatccctctttcacacactgtctctccatcccttgtggtatgtcctgtcctctccccacctctgtrccctcttgtggagctcatcctttggcctctgacaagcacaggctgtggtgaccagtggtcctcacagccccgggccagctctctggtgattctcctgtgagaaccttccaggagcctgcgagttctccacttccattactaccctctcagcagtcctaccctcaggggccctttggcccatctcagggagtgcatagaatttttcttggtcctaattcctgtcctttctcagggtccacagggagatgtttggagccaccctttgttgcagctgtgctaggaaagtgcagttcaaactac

SEQ ID NO: 137876 - DNA, 601 bp, Human
ttcttggtcctaattcctgtcctttctcagggtccacagggagatgtttggagccaccctttgttgcagctgtgctaggaaagtgcagttcaaactacaccactttctttccgcacagacagggagaggctctcagaaaaacaggccaaactgatggcagaggagcaagatgccacgcctttttatggaaaaagtagacttttctggaggttttagcacacttatttaaaaaaattaagaatatgtatgaatatagcattatgagccaaatattttaatttatggctttgcatttgttcartaggcattttcctggggcagtttcatttttacttagcagtgaagcctcaaacacaatgtaacatgtaggcttgctcatgaaaactttctacctgccgttgctaagaaacctcactggaaattctgttctaaggaaaaaaaatcagataacccaatgaaccactacattgattagatcatgataaaatatttgtagtgatttatagttgtagtgatttatagtatgaaaactgatttgactttcacatatatatgtgtgtgtgtgtgtattcagtcttatggaaaataaagcatatctttg

SEQ ID NO: 137877 - DNA, 601 bp, Human
gcctcaaacacaatgtaacatgtaggcttgctcatgaaaactttctacctgccgttgctaagaaacctcactggaaattctgttctaaggaaaaaaaatcagataacccaatgaaccactacattgattagatcatgataaaatatttgtagtgatttatagttgtagtgatttatagtatgaaaactgatttgactttcacatatatatgtgtgtgtgtgtgtattcagtcttatggaaaataaagcatatctttgacttttttttttttttttttttttgagatggagtctcgctctgkcgcccaggttggagtgcagtggggtgatcttggctcactgcagcctttgcctcctgggttcaagcgattctcctgcctcagcctcctgatatctttgactttttaatagtgtgtttaaggatagcagtgccagcccaaatttgctttttcattaatatagcaatatttggggtatataacatataaattttcacatttgaacttaaatatggcactgtaacaatattgtcttaatataagaagtacaaagtgactgaaaaaaaaatttttttttttgagacgaagttttgcttcactctt

SEQ ID NO: 137878 - DNA, 601 bp, Human
tttttttttttttttgagatggagtctcgctctgtcgcccaggttggagtgcagtggggtgatcttggctcactgcagcctttgcctcctgggttcaagcgattctcctgcctcagcctcctgatatctttgactttttaatagtgtgtttaaggatagcagtgccagcccaaatttgctttttcattaatatagcaatatttggggtatataacatataaattttcacatttgaacttaaatatggcactgtaacaatattgtcttaatataagaagtacaaagtgactgaaaaaaaaatttttttttttgagacgaagttttgcttcactcttgttgtccaggcaggagtgcaatggcgcagtctcagctcattgcagcctctgcctcccgggttcaagcgattctcctgcctcagcctcccaagtagttgggattacaggcatgtgccaccaagcctggctaatttttgtatttttagtagagatggggttttaccatgttggtcaggctggtctcaaactcctgacctcaggtgatccacctgcctcggcctcccaaagtgctgggatcacaggcatcagccaccatgcccagccta

SEQ ID NO: 137879 - DNA, 601 bp, Human
tcattgaaatgctgatatgaagtaatataaaatgttctgcctccttttgaaggtagtcttcaaaagcattaatagaaaacagtgtttactttgtatcatgatggttttgatcatgacttgatttatatgacagttttggacctctgctagctccatcattggttttatgataaatgagctacttatatgaagacttaaaatattctttagaccacagtaattgcctgtgacagtgctttaaaatgaaatggccacaggtgaataaagtttctgtgtaggttacttccagtttgaaaatacrtagttcatcactatttttccttacattgatgccccataaacattttgcttctttcctaattgaacttatagatgttgggcaaaccttattgagaaaaagagataagagtacttactaatttttatcctaatgatattgaagctccagtgtagaagtgaatgtgttcttagtaagaatccatccatctctgtgtatggccccatgttggaataagcaaaaaatttcctgaagtgattgagatattataaattgctgaatatgagtcatgttgtgattttttttttctgagcaattttctat

SEQ ID NO: 137880 - DNA, 601 bp, Human
aagggatttgtgttttgaaaattgttcgttttgggcccagaaattagacttaggccactgagaggaataattctctaagggcaagtatttattaatatttttatatgtcagctgtatttaaaaatgaccatccagtttgctttacagattagagcgctttatttaggagaaatgcttagcattttgtgagttgatagccttagggttttgaggcattgaggtgtgttggcccagtaggagtgacagtttggtctggaggagaatttgaaaatcgaaaacagcattaaagggaagagaacatgagaacagtttgcagactgtgctgttgtaagacaccatggctggttccgggaaagaggatgcaaaggacttggtcacacacagtcttcttgtgctcatggctttgggagatttaattgggatatatcttggaaaagttgctaggttttgcagaatattcaagtgaagaaaaaagaaagataccaatcttttgagtggaaaaggaacaaatatttaaaaagcatatttaccttaatcctcatgcttttttatagttacaggggaaaatgctggggcttacctgcctttaaaatgtgcctgt

SEQ ID NO: 137881 - DNA, 601 bp, Human
aaacaggattaccaccctcatggagaggacaatatagtgagggacacaggccttaaataatcatgcagccctcggaaatgcagaaagagggagagaagtttcaaaatgttcatataggtccgcttcatatggaaatagaaaatgaggcaagatattctttatttcccaggatttcagaaacccaaatcatgctcaatttgcagttgacaaatctgaaggaaaaattagtttagaaaatttggggattaaaaaacccatgtttttgaacttttgtctcctttagtttaatgctttaaaagcmttaaaaacttaattacacaaataaatatgaagttttaaatatgtagttacactgttggtaagtttagtgaaggacaagtacagagcactctgagtgagatgacctggtgtgtgacagtgtacacacagtgaggggtcaaggaagacctctctaaggaggtgtcatgcaggctgggttccaagggagggtagcagaagttagctcaacagtgggaaggtgctacggggaggctggagaggtgtggggggcagatgaggtggcgtgcttccgaattgaggaggcttctaggtagcagtgtct

SEQ ID NO: 137882 - DNA, 601 bp, Human
cttctgtcttggcatgctctctttcctttcctggacatcaggagcaaaagcgtatagatggcaccacccgtgaggtgaaaaaggttagaaaagccagaaacaggcgccaggagtggaatatgatggcatatgacaaagagcttagacccgacaacaggttgtctcagagtgtgtaccatggagcgtcttccgagggatccctgtccccagatactaggtgtgtgtgtgtcactgctccctcagccctgatgcttgggcaactgggtactacctggttttattatcatttgaaatgcatcartagcttcggggtttatatggcccttgatgtcttaagattttccttaaaaattgtttatctgtattttgattttgaaataatacttgaagacagtgttattttacattgggttcctttgattttagaaaatctctctgacttaaaatgtattgttgagttcatctagatgtagtgttttaacactgattctgaatttggggtaactgcttatgacttaagtttttactttaataatcatttaattctttctcttagcatggaatgttgaatttcctttgccacttggtatctaaaaatgat

SEQ ID NO: 137883 - DNA, 601 bp, Human
aaaaaatgatgaacaaaagagagatttacttcttatttcagataacttatatattctgatttcaggagaagaattctattggcgtttacttaaaaatttattagcagttaagtaaaaatatttcttgcaggcgtgaatgatgtggtcattaagtcacacttgtcaccaaaggcattcattgaacaacaggaaatgactagtcaattttaacgtttgattcagttttctatttctgcttttgtaaagttgtagtcttccatttgcataaactctcatcggcatttaaaaatttgaatagagrattcttacaatatgtgatcaagaatgtttcaaaacaacagcaacctggactttgggttgtatctgtgccctttttttctacctttgtaaaactcagtgtttagcacaaactcttaacgtattacgtgccttcaatgttcccaccccagaaggtctataagtcattgggaggatgtgaggcaagttctggtaatttttctgtacaaacttctatttgttaaatattagagaattattggagctttaactgagttttagcctcatttgaattttagtgtgagtttatttctatagaaagtag

SEQ ID NO: 137884 - DNA, 601 bp, Human
actgtcttactaacgcccacggcactgccgggctgccacacttgggtccttcctctcctcctgagggcttagcaggaatcccgtccctgcaccccatgtctcagctctgctccactaatccaagatccctttcctttcggagtttcacacccagtttgtgtgcaaagaaaactatggaaagaaggcctttccatagtgcaccgcattgctttctgccctttttgttaagtacatttcttctgtttaagaaaaatatgattcactctactgcattctcgatttcttttcctgttcttactgktaatatttatccagttaacctgccattttatattttctaattatatgctgtcagtttcattgccactgaaatcttctgtcttatatcctgtttctaaatggaatggtttctttcatagccttcttagagaaaacgtatgctgaaatactgtgaaaaggaggctctgctgtttcctgcttgccggtctgtctgacttattcacttcaaagctgtgaatctgaatccatgtaacactggggcttgctgccgacttataataattatgttgttgcttggaatctctcacggggctatacctag

SEQ ID NO: 137885 - DNA, 601 bp, Human
tgcttgagcccaggagtttgagagcagcctgggcaacatggcaaaactctatccctacaaaaaatgcaaaaaaaaattagctgagcatgttggcctgagcctgtagtcccagctactcaggaggctgaggtgggaggattgcttgagtgtgggaggtcaaggctgcagtgagccgtggtcacgcccctgcactccagcctaggcgacagagcgagacccgtctcaaaaaaaaaaaaagaattgaaattaggaagtttttacttaccttgaaaccagaaacccaataactgaagtgatcgaytaattaattggatctcttctctgcattctgctctaaggggaaaagtataaatgaaagaaagtgagctcatattaatgatttctttaaaaaaaaaaaagagtttgtgctggacttgtcatatttgcttgatgtcctaagccagtggtttttcagaatctataatattcaacagcataacccttttgtcagatgaaagtcccgcgttgaccccctgaccacaaaacacatggaaacagagcatctcaggtggaattgggtggggagtctgccctcgcctgtcttgggctgcccagagagccc

SEQ ID NO: 137886 - DNA, 601 bp, Human
gccctcgcctgtcttgggctgcccagagagcccctgggaacctccagcccacaccatggattcttaaccaggtcccaacccaggttggtcgagggtccctgacatgttatgggaatatccaagagcttctcgcctgtggggagctgcacagacttggtcacagtttagtcatctcatctggaagtgaccaagcaaggagcctggctgcagcccgccagctcagcatcagggatgtccttcagaggagctgtgatgctgctgcctctgcgtttttcttgtgtgcccatgaaccaggcccacrgtgtggcccacgcacccttctaaagaccccagggtcctctgtgtacctggacatcattgacacacttttattttgtcaagataaaaaagtcctagaggtatattagctcatgaatatcaagttcggggtcattgtaggacggtgttggatttgccttttttttttttaacaccttataagccctgtctaccaagagtagatacataacctgtatctaatctcgaggaaacatctgatacacccaaatcgacagacattctgcaaaatagcttcctatattcttcaaaaacgagaaggttg

SEQ ID NO: 137887 - DNA, 601 bp, Human
tcaggctgggttccctgtgggcatttgcttagtaaatgcctgttgatggtttttgcaagagaattcagcagctcaacagtaatgaaagtgaagaacagagtccattttccttcctggggccattggggatgacactcaagatacttgccagtctctccagtgtgggcaccagccggccagaacagatgcgagcagtccatgactctgggagctacaccgctgagctgggcagagctgcggcacagggcctgggctgcaaaggagccctgctcctttagtttcctgacacctgtgtcctgartgagccgcaggagttcttagctcctcagcgagcaacagagagcactttagatggcacctttcaccacttggtcagaattttaaaagcttaggtttaggtgaaagtagatattgacagctattcacctttcacggtgctggggccagattagggatcactcccgtgaggagggccttcaccctgttctagaagcacatggttgtcctcctgttgttggcacattaaatgataaaaagcacctcatgagattcccttgatcagccctgcagctgtagtacagtgctgtgccctcacctccac

SEQ ID NO: 137888 - DNA, 601 bp, Human
tcccgtgaggagggccttcaccctgttctagaagcacatggttgtcctcctgttgttggcacattaaatgataaaaagcacctcatgagattcccttgatcagccctgcagctgtagtacagtgctgtgccctcacctccacccttcctgttgttcccacgtgggcaataccagggacccatggggaaactcaagaatgacagcttctatattttgtaattctggatgaaagataactgtgttgaacaaacaggtgctccaggctttgattatagatacgacttcaaaaatatgctaagaygcttgacttattaaggactttaacctactcaacagtatttcatatccattgtggttagttactcagttatgttgagaagaatctggagctaaaagcagagatgtttgaggtgacggtaggaatgtgagcaggatggtgatgggggtttttgttaaaatgcatctgagcaagtcagccagccccgaagtcccctcagtgtgtgtgtctcgagtggctacctgttgggcttgtgggcagtgattgtacagagcctgtccattgggtgcagtcatgtagatctgaagccctgaaaagcctcat

SEQ ID NO: 137889 - DNA, 601 bp, Human
gccagccccgaagtcccctcagtgtgtgtgtctcgagtggctacctgttgggcttgtgggcagtgattgtacagagcctgtccattgggtgcagtcatgtagatctgaagccctgaaaagcctcatgtctgcatcccctttccaaggctgcttccctggtgtgtctgttctctcctctgtcccaggtgctgggagcgtcctcttcagcgtcttttcctagagctggtcaccactaggctgtcactataaattccttgaatataagtaacagttattaatgaacttctaaatttctaatttttctctctctctctttttttttttttttgttgttgttaaaaagggcctactacattggcgctattcttaggacttctgcaacttttaaagtcttacttgtctttcttgttgcttttgtattaggagttccccgtgtgggtctagaactcccctttggtaatgcttctttgtttttttatggcccttctgttctcaggatggagagaacacagaagctactatccatgtcaggatttattctatttatatcttattacaataaaattagtggcactttattcataaatattcatgagcctgt

SEQ ID NO: 137890 - DNA, 601 bp, Human; identical to SEQ ID NO: 92399

SEQ ID NO: 137891 - DNA, 601 bp, Human; identical to SEQ ID NO: 92400

SEQ ID NO: 137892 - DNA, 601 bp, Human; identical to SEQ ID NO: 92401

SEQ ID NO: 137893 - DNA, 601 bp, Human; identical to SEQ ID NO: 92402

SEQ ID NO: 137894 - DNA, 601 bp, Human; identical to SEQ ID NO: 92403

SEQ ID NO: 137895 - DNA, 601 bp, Human; identical to SEQ ID NO: 92404

SEQ ID NO: 137896 - DNA, 601 bp, Human; identical to SEQ ID NO: 92405

SEQ ID NO: 137897 - DNA, 601 bp, Human; identical to SEQ ID NO: 92406

SEQ ID NO: 137898 - DNA, 601 bp, Human; identical to SEQ ID NO: 92407

SEQ ID NO: 137899 - DNA, 601 bp, Human; identical to SEQ ID NO: 92408

SEQ ID NO: 137900 - DNA, 601 bp, Human; identical to SEQ ID NO: 92409

SEQ ID NO: 137901 - DNA, 601 bp, Human; identical to SEQ ID NO: 92410

SEQ ID NO: 137902 - DNA, 601 bp, Human; identical to SEQ ID NO: 92411

SEQ ID NO: 137903 - DNA, 601 bp, Human; identical to SEQ ID NO: 92412

SEQ ID NO: 137904 - DNA, 601 bp, Human; identical to SEQ ID NO: 92413

SEQ ID NO: 137905 - DNA, 601 bp, Human; identical to SEQ ID NO: 92414

SEQ ID NO: 137906 - DNA, 601 bp, Human; identical to SEQ ID NO: 92415

SEQ ID NO: 137907 - DNA, 601 bp, Human; identical to SEQ ID NO: 92416

SEQ ID NO: 137908 - DNA, 601 bp, Human; identical to SEQ ID NO: 92417

SEQ ID NO: 137909 - DNA, 601 bp, Human; identical to SEQ ID NO: 92418

SEQ ID NO: 137910 - DNA, 601 bp, Human; identical to SEQ ID NO: 92419

SEQ ID NO: 137911 - DNA, 601 bp, Human; identical to SEQ ID NO: 92420

SEQ ID NO: 137912 - DNA, 601 bp, Human; identical to SEQ ID NO: 92421

SEQ ID NO: 137913 - DNA, 601 bp, Human; identical to SEQ ID NO: 92422

SEQ ID NO: 137914 - DNA, 601 bp, Human; identical to SEQ ID NO: 92423

SEQ ID NO: 137915 - DNA, 601 bp, Human; identical to SEQ ID NO: 92424

SEQ ID NO: 137916 - DNA, 601 bp, Human; identical to SEQ ID NO: 92425

SEQ ID NO: 137917 - DNA, 601 bp, Human; identical to SEQ ID NO: 92426

SEQ ID NO: 137918 - DNA, 601 bp, Human; identical to SEQ ID NO: 92427

SEQ ID NO: 137919 - DNA, 601 bp, Human; identical to SEQ ID NO: 92428

SEQ ID NO: 137920 - DNA, 601 bp, Human; identical to SEQ ID NO: 92429

SEQ ID NO: 137921 - DNA, 601 bp, Human; identical to SEQ ID NO: 92430

SEQ ID NO: 137922 - DNA, 601 bp, Human; identical to SEQ ID NO: 92431

SEQ ID NO: 137923 - DNA, 601 bp, Human; identical to SEQ ID NO: 92432

SEQ ID NO: 137924 - DNA, 601 bp, Human; identical to SEQ ID NO: 92433

SEQ ID NO: 137925 - DNA, 601 bp, Human; identical to SEQ ID NO: 92434

SEQ ID NO: 137926 - DNA, 601 bp, Human; identical to SEQ ID NO: 92435

SEQ ID NO: 137927 - DNA, 601 bp, Human; identical to SEQ ID NO: 92436

SEQ ID NO: 137928 - DNA, 601 bp, Human; identical to SEQ ID NO: 92437

SEQ ID NO: 137929 - DNA, 601 bp, Human; identical to SEQ ID NO: 92438

SEQ ID NO: 137930 - DNA, 601 bp, Human; identical to SEQ ID NO: 92439

SEQ ID NO: 137931 - DNA, 601 bp, Human; identical to SEQ ID NO: 92440

SEQ ID NO: 137932 - DNA, 601 bp, Human; identical to SEQ ID NO: 92441

SEQ ID NO: 137933 - DNA, 601 bp, Human; identical to SEQ ID NO: 92442

SEQ ID NO: 137934 - DNA, 601 bp, Human; identical to SEQ ID NO: 92443

SEQ ID NO: 137935 - DNA, 601 bp, Human; identical to SEQ ID NO: 92444

SEQ ID NO: 137936 - DNA, 601 bp, Human; identical to SEQ ID NO: 92445

SEQ ID NO: 137937 - DNA, 601 bp, Human; identical to SEQ ID NO: 92446

SEQ ID NO: 137938 - DNA, 601 bp, Human; identical to SEQ ID NO: 92447

SEQ ID NO: 137939 - DNA, 601 bp, Human; identical to SEQ ID NO: 92448

SEQ ID NO: 137940 - DNA, 601 bp, Human; identical to SEQ ID NO: 92449

SEQ ID NO: 137941 - DNA, 601 bp, Human; identical to SEQ ID NO: 92450

SEQ ID NO: 137942 - DNA, 601 bp, Human; identical to SEQ ID NO: 92451

SEQ ID NO: 137943 - DNA, 601 bp, Human; identical to SEQ ID NO: 92452

SEQ ID NO: 137944 - DNA, 601 bp, Human; identical to SEQ ID NO: 92453

SEQ ID NO: 137945 - DNA, 601 bp, Human; identical to SEQ ID NO: 92454

SEQ ID NO: 137946 - DNA, 601 bp, Human; identical to SEQ ID NO: 92455

SEQ ID NO: 137947 - DNA, 601 bp, Human; identical to SEQ ID NO: 27329

SEQ ID NO: 137948 - DNA, 601 bp, Human; identical to SEQ ID NO: 27330

SEQ ID NO: 137949 - DNA, 601 bp, Human; identical to SEQ ID NO: 27331

SEQ ID NO: 137950 - DNA, 601 bp, Human; identical to SEQ ID NO: 27332

SEQ ID NO: 137951 - DNA, 601 bp, Human; identical to SEQ ID NO: 27333

SEQ ID NO: 137952 - DNA, 601 bp, Human; identical to SEQ ID NO: 27334

SEQ ID NO: 137953 - DNA, 601 bp, Human
gcaggatcgcattctttagatttatggaatcacgttaggacaaccgtcgtccagaatttaaaatctagatatctgaatctcagaatcttgaaagttactgagagccacgaaatcccgtattaaaaggtgcctataatataatccagttaaaaattttaaaatttgaagtttttcctcctttgtaaaaacgaaacaggacgaaatctgggttttttgcttctccattacttgggaagaaggaaaccaggagttttgtttagcgagtgtaaagcccctctcccttcgttcgaccaaccctctrccgcagaaggttgtcaagcaaacgctttgagcgtttccacacaccgggtcgacggagcaaggatctgggctttgcctcgctcttccgaaggcagctgcccaacgcttggccgggcttagcctgccctcagctcaccgccacgaagaacgcgactaaaaccctggaaggcatgccacccgttaccggccagaactctcgtcttgggatctcccacactcacctggcaccaccctccgcgcggctctgcacccacagccccggcccgcccccccccccccaccccggaaagctgcgtccggg

SEQ ID NO: 137954 - DNA, 601 bp, Human
aaaacgaaacaggacgaaatctgggttttttgcttctccattacttgggaagaaggaaaccaggagttttgtttagcgagtgtaaagcccctctcccttcgttcgaccaaccctctgccgcagaaggttgtcaagcaaacgctttgagcgtttccacacaccgggtcgacggagcaaggatctgggctttgcctcgctcttccgaaggcagctgcccaacgcttggccgggcttagcctgccctcagctcaccgccacgaagaacgcgactaaaaccctggaaggcatgccacccgttacyggccagaactctcgtcttgggatctcccacactcacctggcaccaccctccgcgcggctctgcacccacagccccggcccgcccccccccccccaccccggaaagctgcgtccgggctggagccactggaacccgcgccaaggcccggaatcctatgcgtagcaggggcctcggagatcagcacacgccctccagctgctatttaacagagtagaacactgaggccctgcgaggggacaaggacaggccctggatctcccagtgaatggccagggaacgaacccgggccagaggggccgc

SEQ ID NO: 137955 - DNA, 601 bp, Human
gaagaaggaaaccaggagttttgtttagcgagtgtaaagcccctctcccttcgttcgaccaaccctctgccgcagaaggttgtcaagcaaacgctttgagcgtttccacacaccgggtcgacggagcaaggatctgggctttgcctcgctcttccgaaggcagctgcccaacgcttggccgggcttagcctgccctcagctcaccgccacgaagaacgcgactaaaaccctggaaggcatgccacccgttaccggccagaactctcgtcttgggatctcccacactcacctggcaccaccmtccgcgcggctctgcacccacagccccggcccgcccccccccccccaccccggaaagctgcgtccgggctggagccactggaacccgcgccaaggcccggaatcctatgcgtagcaggggcctcggagatcagcacacgccctccagctgctatttaacagagtagaacactgaggccctgcgaggggacaaggacaggccctggatctcccagtgaatggccagggaacgaacccgggccagaggggccgcgccgcgaggatctcaggttaggaccaagttccggctcagggacagcag

SEQ ID NO: 137956 - DNA, 601 bp, Human
tgtaaagcccctctcccttcgttcgaccaaccctctgccgcagaaggttgtcaagcaaacgctttgagcgtttccacacaccgggtcgacggagcaaggatctgggctttgcctcgctcttccgaaggcagctgcccaacgcttggccgggcttagcctgccctcagctcaccgccacgaagaacgcgactaaaaccctggaaggcatgccacccgttaccggccagaactctcgtcttgggatctcccacactcacctggcaccaccctccgcgcggctctgcacccacagccccggccmgcccccccccccccaccccggaaagctgcgtccgggctggagccactggaacccgcgccaaggcccggaatcctatgcgtagcaggggcctcggagatcagcacacgccctccagctgctatttaacagagtagaacactgaggccctgcgaggggacaaggacaggccctggatctcccagtgaatggccagggaacgaacccgggccagaggggccgcgccgcgaggatctcaggttaggaccaagttccggctcagggacagcaggaaaggaactcagaaattggacacccatgaag

SEQ ID NO: 137957 - DNA, 601 bp, Human
acaccgggtcgacggagcaaggatctgggctttgcctcgctcttccgaaggcagctgcccaacgcttggccgggcttagcctgccctcagctcaccgccacgaagaacgcgactaaaaccctggaaggcatgccacccgttaccggccagaactctcgtcttgggatctcccacactcacctggcaccaccctccgcgcggctctgcacccacagccccggcccgcccccccccccccaccccggaaagctgcgtccgggctggagccactggaacccgcgccaaggcccggaatcctatrcgtagcaggggcctcggagatcagcacacgccctccagctgctatttaacagagtagaacactgaggccctgcgaggggacaaggacaggccctggatctcccagtgaatggccagggaacgaacccgggccagaggggccgcgccgcgaggatctcaggttaggaccaagttccggctcagggacagcaggaaaggaactcagaaattggacacccatgaagcaaacgtgtcccgactgcccgccccttcccccggagacgcgcccacccggccaccgctctcttcccactcccccatt

SEQ ID NO: 137958 - DNA, 601 bp, Human
cagggaacgaacccgggccagaggggccgcgccgcgaggatctcaggttaggaccaagttccggctcagggacagcaggaaaggaactcagaaattggacacccatgaagcaaacgtgtcccgactgcccgccccttcccccggagacgcgcccacccggccaccgctctcttcccactcccccattacccacagccctcactccccgctgcgggaaggggctgcttggctgcctctgggggtcttcagagctaccctggtcccgggggattggaggaggaggttacctatcctgcgtcgkctttaatccgtgcaccactatccatcaaatagagacagatcctgggcctctcaaagacggatgattgggggtggtgattggcctatccctaaatatctaccacgcaaggactcttgagagatccagaccccggtacagtcgagggacctggggcccaaaaagggaaagcggctacctctaccacacagttgggaagcgcagtcctaaaggagacgcaggttggagactccgctaagcggagaagccgcagtggggccatggcaagtcaccttccctttcgggcctaggaatactcattcg

SEQ ID NO: 137959 - DNA, 601 bp, Human
aggactcttgagagatccagaccccggtacagtcgagggacctggggcccaaaaagggaaagcggctacctctaccacacagttgggaagcgcagtcctaaaggagacgcaggttggagactccgctaagcggagaagccgcagtggggccatggcaagtcaccttccctttcgggcctaggaatactcattcgaaagatggggggactggagtgccgagtggctgtggcagccacgattggggtttggaaaccatcctgaaaggcccggggagccagtctcctggaacttctccctcccyattcccacaaaaaccaagcgccctctcggccaattctcaccctctcaggacaaaaaagtgagatgagcccgtcctttcacctgcgagtccaagcccttggcagaggcctgaaaagtccgaaaactccgagttcgggcgctgaggtctcccgagccggttcctgaactctccgggcctcagtcgatcggggtgcggagggggccgacccgggggatctccaagcgccctccccgccctgacgctgtggggctcctaccgcgccgccacagctgctcctacctggggaggtgcgcccgggcc

SEQ ID NO: 137960 - DNA, 601 bp, Human; identical to SEQ ID NO: 92371

SEQ ID NO: 137961 - DNA, 601 bp, Human; identical to SEQ ID NO: 30272

SEQ ID NO: 137962 - DNA, 601 bp, Human
agagttactttcaggaatgacagttcctggaagttgctgtggtctctctcacccgccattccctgtatatgaaatatgaagtggttaaaagccgggcctttgagttcaaatctcagttccaccactactagctgtgtgaacatgggctgcttacttagcctccgtgaacccttttccccatttgaaaacggggcttgaaaacaacagttctttccacatggagttgttatggggatcaaatgagattctcagatagagctctgagcccagcacttggcacacatgagtcggtaaatgcgtrctccctcttctgttgggactgccatattcttcattacgaccccagcccccagcataaggcctggcctgcactatgattctttggtttagagatagctcaccccatctttcctttcccttcatcaatgctactcaactgattttgtatcatttgtgataggttttttaaatgtttatttatttatttatctatgttagagacagggtcttgctctgtcacccaggctggaggttttctcttactgtttttttttttttttcctggttttttttttttttttttttgagacagggtctctgt

SEQ ID NO: 137963 - DNA, 601 bp, Human
gctagtataataaatacagtaaggggttttttcagtttttgctcctaagccacaggactccagcctttcttctgcaacattgttttctagagggaaattcccactcttaatttgaaggagcagtctgtttttcctcttggaatgccgaagttgtagaaatatctagagatactgaagccatagaaacaaagctgtactgaccaggtgcagtggctgattcctgtaatcccatcactttgggaggctgaggaaggcagattgcttgagctcaggaattcgagaccagcctgggccacatagygagaccctgtctctaattccattgagctggaatctaggtggctgcagcctttaggaaagggatctggccagctctgctagagacactgtgcaactttagtcaggtcagtctgggccttgggatcttcatctagacaatgagagctctgttgcccaaggtcactttcagttctaatgttctttgaactttccagcatcaagtcctgactctaccatcttatgatttgtctaagagcaggagtagtgatctcagcactgacatttctggacccaagaagtttttatttttttttttcaagac

SEQ ID NO: 137964 - DNA, 601 bp, Human
cagttatataacttaaaatcttccttaactctttgatccaatgtttttaatatttacaatgcaaaacaaaggaaaaaagtcccatttttttttcttttggcatgttaagagaaaaaaatagggggaggtctcccatctccaaacaaccttttcttcctttcagactttcttgccttttctgttcctcttccttggaggtccttaaggtctctgtcagtctatgttgtttttaaagatggtgatgtcggctgggcgcagtgactcatgcctgtaatcccagcactttgggaggccaaggcgkttggatcacctgaggtcaggagttcaagaccagcctggccaatgtggcgaaaccttgtctttactaaaaataacaaaaattagccgggtgtcgtggtgggtgcctgtaatcccagctacttgggaggctgaggcaggagaatggcttgaacccgggaggcattggttgtagtgagccgagatcacaccttctgcactccagcctgggtgaaagagcgaaactctgtctctaaataaataaataaataaagatggtgatgtcatagtggttgctccagaattttttcctttttttgagaat

SEQ ID NO: 137965 - DNA, 601 bp, Human
cactccagcctgggtgatagagcaagaccctgtctcttaataaaaaaaaaaaaaaatagagcaaggaaaccacagttctggagtccgctccttgctgactagccttgactgacttgagtggggggacactggcactgtccagaagggaatggctcacaggatggtcaccggtggtttttggcttggccatgctacatcctggaagagtacagctcgtgccaggtctcaggtcccatctgctctgtgacctgcctccttaaaattccttcatgtgttcttttgaatgtaaaaaaaattttasttgtaaaaataacattacagaaagtttagaaaatgagaaaagggaaaaaactgacccataatccctctatagcagttctttttatatatttcctcctgaagtctttttatattcttgttttattgcctgctggtactatttagtgaacatcgagttctgtgcctgcttgttttagttaacattatagcacaaacttttaccccaccttatgcttaaagattttaatagcaacgtaatatttcttttggtgcatgtactatactgtacctaaccattcctctacttttggatacggaagtt

SEQ ID NO: 137966 - DNA, 601 bp, Human
gtccacaaaggcaaagctatttccataatgatactcaaatgttatttgtcctttccatcatcattctcacaagtatatagtggagttttccagaggctaggtgatgtgtgatgacatcattcctctggcagcggctcacctaatggaaggtgtgttgtgtgtctttttaaagaacagttttattgacacaccatccaattcacccaatcgagggtacaattcagtggtgtttagtaatatttacagagttgtgcaaccattaatacaattaccgttagaacattttttatcacccccaaargaaaaactacctattagcagcactcctcaattgccccaattctcccaggcctaggcaaccacttaccgatttttttttttttttgagacagagtctcgctctattgcccaggctggagtgcagtggtaggatcttggctcactgcaacctccacctctcaggttcaagcaattctcctgcctcagcctcccgagtagctgggattgcagtcatgcaccaccctgcccagctaatttttgtatttttagtggagacagggtttcaccatgttgaccaggctgatcttgaacttctaacctc

SEQ ID NO: 137967 - DNA, 601 bp, Human
cccccaaaggaaaaactacctattagcagcactcctcaattgccccaattctcccaggcctaggcaaccacttaccgatttttttttttttttgagacagagtctcgctctattgcccaggctggagtgcagtggtaggatcttggctcactgcaacctccacctctcaggttcaagcaattctcctgcctcagcctcccgagtagctgggattgcagtcatgcaccaccctgcccagctaatttttgtatttttagtggagacagggtttcaccatgttgaccaggctgatcttgaactyctaacctcaggtgatccacttgccttggcctcccaaagtgctgggattgtaggtgtgagccactgcgtccagcctcaaatttctgtctctataaatttgcctattctggatattgcatataaatagaatcatacaatatgtggtccttcgagcctgacttctttcatataacattgtgttttcatttatgttgtagcatatatcagtacttcatttctttttttgactaactcataattcaattttatggctatactacattttatttacccatttgtcagctggtggacatttgggttg

SEQ ID NO: 137968 - DNA, 601 bp, Human
aatgtctattcagatcctttgtcagttttaagaattggattatttttctttatatattcttttgaaatttaattattttttcatgtatagccttccaatgaattgtctttatatattttaagtacaagtcctttagtagataaatgattgtaaaaaactttcctagtctttgggttgtctttttcactttcttttttttttgtgagatacggtcttgctctgtcgcccaggctggagtgcagagtggtgcaatatcggctcactgcaaccctggcctcctgagctcaagcaatcctcccacctcagcctcctaagtagctaggactataggcatgcgccatcagactcagctaatttttgtattttttgtagagacaagatctcactatgtagcccaggctggtctcaaactcctgagctcaagcgaacagccaaccttggcctcccaaagtgctgggattacaggcatgagccaccatgcctcgccctttttcacttacttgatagtgtcctctgaattacaaacatctttaattttgatgatgtccaaattatctttttttcttcttgtgtttatctatttatatgtttaaaaatttct

SEQ ID NO: 137969 - DNA, 601 bp, Human
tactcccactgcccagagacaacagcttttcagtttgcttgtccctccttggttcttcagttgtgctcctgcaggctttgcttttacacacgagcgatatagcatcattctgaattgtgcagcttaaaagatgaacgttgggctgcttgctctctttacatcatttttaacttaattctcacatccctagcgtccaatgcgaatttttgtgaatgatgaccgccatgtgatggcaaagcattcttccgtttatccaacacaagaggagctggaggcagtccagaacatggtgtcccacacrgagcgggcgctcaaagctgtgtccgactggatagacgagcaggaaaagggtagcagcgagcaggcagagtccgataacatggatgtgcccccagaggacgacagtaaagaaggggctgggtaagtgaggttttccgttgtccttttcttttttgtagggtagccagggtagaggttggcacctgttttctaagaaactccagcctctctggggacctctgggttgtggtcagactgaattcctcactgagctgggtgttggtctgtccctcagggaacagaagacggagcacatgaccag

SEQ ID NO: 137970 - DNA, 601 bp, Human
gggtttcgccacgttggccagagtggtcttgaactcatgacctcaaatgacccgcccacctcggcctcccaaagtgctgggattacaagcatgagccaccacgcctggccgtttttatttttttaagatgaggaaggtttcgctctgtagcccaggctggagtgtggttgcgcaattatggttcactgcaacctccacttccagggctcaggtgatcctcccattgcagccccctgagtagctaggactacagtcatgtactaccaccccgagctaaaagatcttttaaaaaaaaaaaaaacatttatttgtttcattgtgaaagtattgcgtaaataatggcttctgtttattgagtgtttgctaaagtcaggccctcagccagatgtgctcttcatgtgtgttatttcatcctcctctaagtgggacagatgatgtgacagagctgcagggcagctgaggagtggatcccaagacccacggctgggctgtttggaggcatcagaacctctgccagctgttgcctcctcaggacacagtccccctgaatttatttataggataagcaaaaaagaagtgtacaatcatctataaatctttg

SEQ ID NO: 137971 - DNA, 601 bp, Human
catttgtgagaaaccattcctttttttttttttttttttttttggaggtggagtctcgctgtgtcgcccaggctggagtgcagtggcgccatcttggttcactgcaagctccgcctcctgggttcacaccattctcctgcctcagcctcccgagtagctgggactacaggcacctgccaccacgcccagctaattttttgtatttttcgtagcatctctggtctttaccaggtgaagtttcatctgtgttagccaagatggtctcgatctcctgaccttttttttttttttttttttttttaagggaggcaaggtctcttgctctgttgcccaggcttgggtacagtggtgcaatcacagctcactgcagcctcaagcaatcctcccacctcagcctcctgagtatctgggaccgcaagcatgtgccaccatgtctggctaatttttaaaattttttgtacatacgaggtttcattatgttgtcctggctggttttgagctcctggccttaagctatttgcttgcctcagcctcccaaagtgctgggattacaggcatgtgccattgagcctggccaataattattccttaaagatgaaaa

SEQ ID NO: 137972 - DNA, 601 bp, Human
caggcgtgagccactgcacctggcctaacattgcttttttgtttgtttgttgttttgtttttgtttttgtttttgagatagagtctcgctctgtcgcccaggctggagtgcagtggtgtgatctcagctcactgcaagctccgcctcccgtgttcacgccattctcctgcctcagcctcccgagtagctgggactacaggtgcctgctaccacgcccggctagttttttgtatttttagtagagatggtgtttcaccgggttatccaggatggtctcgatctcctgacctcgtgatccacycacctcggactcccaaagtgctgggattgcaggcatgagccacggctcccagccctaccattgcatttttaagcaccgtttggaaatcgcttctttcactagttatccctctttcaagtacccaaaacgtggccaaagacctggccaattagagagaccctgacatcccaggtgaaatcacttccgggtcatcatactcaagaggttggcctttctgttgcaggaataggtggagccagataaaattgttgattgctttgaggagaaagtgttttgaaagttgcattttattttttaggc

SEQ ID NO: 137973 - DNA, 601 bp, Human
tgctaccacgcccggctagttttttgtatttttagtagagatggtgtttcaccgggttatccaggatggtctcgatctcctgacctcgtgatccacccacctcggactcccaaagtgctgggattgcaggcatgagccacggctcccagccctaccattgcatttttaagcaccgtttggaaatcgcttctttcactagttatccctctttcaagtacccaaaacgtggccaaagacctggccaattagagagaccctgacatcccaggtgaaatcacttccgggtcatcatactcaagasgttggcctttctgttgcaggaataggtggagccagataaaattgttgattgctttgaggagaaagtgttttgaaagttgcattttattttttaggctgtaacagaagacaagtacgaaatactgcaatctgtcgacgatgctgcgattgtgataaaaaacacaaaagagcctccattgtccctgaccatccacctgacatcccctgttgtcagagaagaaatggagaaagtattagctggaggtagggaggccgagacacgccggcaggactttgaaaatgtggtgttccctcactattc

SEQ ID NO: 137974 - DNA, 601 bp, Human
acctcacgctaataatgtgctcgcagtccatggcccgccgctcgcatgcctgtcttcaggccttatccaaacccctggtgtgcagatggcagagaagataaacgctctgcttggccgcagcataggctggcatagcgcccttgttgctgtttacctttggttctcatagctgattccgactaccaaagcccttctagttgatcaacgtagggacgctggacctttgaccaacaggactctctctgtcaagggctggggctagggcagtcccgcctggtgggcggagttggtcccctttgcygcagatgccttgggatggctgttgtgtgatgcagagagggagttcatttcctctccctcggcctttttaaattttttcctattgaacattttagcatagctaatttattgggagaacatggggaggaggcaagggaagaggattagaagataggctccacctatctctcccctccctcatgagattattccttttagaataactccccacttttgtttttatgtttgttttattttttctttttctttcttttttctttttctttttatttttggagggggcctccaatttttacaattt

SEQ ID NO: 137975 - DNA, 601 bp, Human
ccacctggggtcccctccgaggctgggtaaggcatgttgctgtggctactgggggtggtgtgtgcagagtcttttggatatcccaggaacacttgatggtcacggggcaggagtggcctcttgacgcgtggctggtgtgtactctccagagctgcctgtggagctgctcctgcttgccacacctggggttggggttggggcagtgtgggtcggggccctctgcagggtcgcacagctcaatcccaggagtgggggctgaccaggaggtgggaatgatccctctgggaaggtttgtagatastctcacgcaggaccagttcttggcagttgcacccttttttttttcagcttgcagttgaggtggtttttatatttgtaaataaatggttagattttaagtaagaagtactacatcataaccttagcttggtctctgagctcacacagcctgctaggatgtcatgtctggtccttgaaggcccctgtcctagatgccctggctcaggcttagccctgaggctttgactttacccgactggttggctatgagtcccacgtgtgccccgacccactcatgcagtgacagctccccagtggcggc

SEQ ID NO: 137976 - DNA, 601 bp, Human
aggctgggtaaggcatgttgctgtggctactgggggtggtgtgtgcagagtcttttggatatcccaggaacacttgatggtcacggggcaggagtggcctcttgacgcgtggctggtgtgtactctccagagctgcctgtggagctgctcctgcttgccacacctggggttggggttggggcagtgtgggtcggggccctctgcagggtcgcacagctcaatcccaggagtgggggctgaccaggaggtgggaatgatccctctgggaaggtttgtagatactctcacgcaggaccagttyttggcagttgcacccttttttttttcagcttgcagttgaggtggtttttatatttgtaaataaatggttagattttaagtaagaagtactacatcataaccttagcttggtctctgagctcacacagcctgctaggatgtcatgtctggtccttgaaggcccctgtcctagatgccctggctcaggcttagccctgaggctttgactttacccgactggttggctatgagtcccacgtgtgccccgacccactcatgcagtgacagctccccagtggcggccggccccatcctgtaggct

SEQ ID NO: 137977 - DNA, 601 bp, Human
ggtggttactggtccttgttaatttgccccaaaaagtggacctttcaggccagaagtccgcacaggaagctgggtgctgccctccgagccgtgtcggggagggccttgtggatgttgtcccagcatcctataggctacactggggtggccttgggttgataacgtgctgttcagaggggaggcacaggaagggggcacattgctggaaggccctcactagagtcagtggagactctggcaagggctggcagtgtatgaagagcagaggccctgcctcagtcctgccactcctcccatgtgrctggaatgcccatagctgagtttgtcggtcttcttttctgttttccctgagaacgtaaaacagcaggggccgatcctgacaaagcacggcaagaacccagtcatggagctgaacgagaagaggcgtgggctcaagtacgagctcatctccgagaccgggggcagccacgacaagcgcttcgtcatggaggtgcgcagcctgaagctgcctgctggggcagtcccatggggaggcctggggtccccctgcccctggagggaggcactgagtcatctccatctgcactttccaggtcgaagt

SEQ ID NO: 137978 - DNA, 601 bp, Human
ggcatgggaggccccatgcacaacgaagtgcccccaccccccaaccttcgagggcggggaagaggcgggagcatccggggacgagggcgcgggcgaggatttggtggcgccaaccatggaggctacatgaatgccggtaagggccctcatactgcactgtccccgccttccccacgtgcatgctctgggaacaaatgtgtggggctcctggggtgggccggagacactgctggaccccggtaaccctgtctttccctttccaggtgctgggtatggaagctatgggtacggaggcaactckgcgacagcaggctacagtaagtgtgcgtttctgtctgtctgacctgggaagcagctgcagtgtagcgtctgggcctgagttagcaaagggtggccagagcagcctcgaggaggctgtagaaggggcacacacctttttgcggtgattaggtcagacggcccttgacccccaccccttcccggccccacagtgggattgattgtgttaatacacgaactcgtgtaactgcaaagttccttaaaagttagaattttaaatttctctgctttaagccatgcgaagcaccaatcttgtgaatac

SEQ ID NO: 137979 - DNA, 601 bp, Human
cgccttccccacgtgcatgctctgggaacaaatgtgtggggctcctggggtgggccggagacactgctggaccccggtaaccctgtctttccctttccaggtgctgggtatggaagctatgggtacggaggcaactcggcgacagcaggctacagtaagtgtgcgtttctgtctgtctgacctgggaagcagctgcagtgtagcgtctgggcctgagttagcaaagggtggccagagcagcctcgaggaggctgtagaaggggcacacacctttttgcggtgattaggtcagacggccctygacccccaccccttcccggccccacagtgggattgattgtgttaatacacgaactcgtgtaactgcaaagttccttaaaagttagaattttaaatttctctgctttaagccatgcgaagcaccaatcttgtgaatacgcttttccggccagtgcacagctcttgtcttgagaaggagccttcattggggggttacaggagcagagaaatctaaaacatgaatttcaaatgtggcgctctgtgccctttttcaaaagaattctaatttcttctctctgctctgtctcccccttttgtaggt

SEQ ID NO: 137980 - DNA, 601 bp, Human
cccacgtgcatgctctgggaacaaatgtgtggggctcctggggtgggccggagacactgctggaccccggtaaccctgtctttccctttccaggtgctgggtatggaagctatgggtacggaggcaactcggcgacagcaggctacagtaagtgtgcgtttctgtctgtctgacctgggaagcagctgcagtgtagcgtctgggcctgagttagcaaagggtggccagagcagcctcgaggaggctgtagaaggggcacacacctttttgcggtgattaggtcagacggcccttgaccccyaccccttcccggccccacagtgggattgattgtgttaatacacgaactcgtgtaactgcaaagttccttaaaagttagaattttaaatttctctgctttaagccatgcgaagcaccaatcttgtgaatacgcttttccggccagtgcacagctcttgtcttgagaaggagccttcattggggggttacaggagcagagaaatctaaaacatgaatttcaaatgtggcgctctgtgccctttttcaaaagaattctaatttcttctctctgctctgtctcccccttttgtaggtgactttt

SEQ ID NO: 137981 - DNA, 601 bp, Human
ctgggggcggctcctcataccaaggcaaacaaggtgggcctggagcccctggtggcacagcatggggggcctggcagctgctgtgaagcgggatatggacctggtgggagcagacagcagcgtgggcagggctgcagtggcaggtgggccctgtgagaacacgcactcggatgcactggcagctgctaaggctttcgggagcagccggagagccagcagtgtccccacgcttaacccctggtacctgtgtgaaatgtgggtgacaccaaggccaaacagctgttcccccggttctggccartagctcagccttgggctcaggtagcttctcccagaaacgagggtcacagtggtcccacctctcagagtcttggtgccagcctgatccagtgatgtgtggtaggcaggcagagccgcacaggagcccacaagtcttgcccacctgcatcctggccgaggcttgggtgtgggctgcctaacctgagccccgctggctgggcccctcggctctaatccaccactctctctcctaggaggctactcacagtcgaactacaactccccggggtccggccagaactacagtggccctcccagctcc

SEQ ID NO: 137982 - DNA, 601 bp, Human
gggctgcagtggcaggtgggccctgtgagaacacgcactcggatgcactggcagctgctaaggctttcgggagcagccggagagccagcagtgtccccacgcttaacccctggtacctgtgtgaaatgtgggtgacaccaaggccaaacagctgttcccccggttctggccagtagctcagccttgggctcaggtagcttctcccagaaacgagggtcacagtggtcccacctctcagagtcttggtgccagcctgatccagtgatgtgtggtaggcaggcagagccgcacaggagcccayaagtcttgcccacctgcatcctggccgaggcttgggtgtgggctgcctaacctgagccccgctggctgggcccctcggctctaatccaccactctctctcctaggaggctactcacagtcgaactacaactccccggggtccggccagaactacagtggccctcccagctcctaccagtcctcacaaggcggctatggcagaaacgcagaccacagcatgaactaccagtacagataagcccccgcggggcggagatttctaccttctgcacttactccccatcagaagatcgagtttta

SEQ ID NO: 137983 - DNA, 601 bp, Human
ataacgcagttacaaaagaaagggcaggtgaggcctgggtaaccccagccatggaccgtcagtggctggagggagcttcgtgtctgtgctggagctgcagcctgctcgccatctggaggctcagtggagtggggagttggggttctcataccagcagatttccctagagcgtgattctcccatctgaggcaatcttgcctcccaggggaaattttgcaatgtttggaggatgttgtcacagctagtagcgggtgctctgggatctggtggatagatgccaaggatgctgtcaagcatactrtactgcccagaacagtggcccatagcagggacctgccctatcaaaatatcaggtgtatggaggtggagtcccaacgctagagcagcccttctcagctccaccctgcccggggagggaggaggagctctggtttcagagcagtgccgggattgcctttccccaggatctgtgtcggccatccaggaagaactgtactggccaagcctgggaccacacgtctgcagagatcctgctctgctggcctgagccccaggccttggcctcctgtgcttgggtaaccatggccactgggaaaagcaa

SEQ ID NO: 137984 - DNA, 601 bp, Human
ttcgtgtctgtgctggagctgcagcctgctcgccatctggaggctcagtggagtggggagttggggttctcataccagcagatttccctagagcgtgattctcccatctgaggcaatcttgcctcccaggggaaattttgcaatgtttggaggatgttgtcacagctagtagcgggtgctctgggatctggtggatagatgccaaggatgctgtcaagcatactgtactgcccagaacagtggcccatagcagggacctgccctatcaaaatatcaggtgtatggaggtggagtcccaacrctagagcagcccttctcagctccaccctgcccggggagggaggaggagctctggtttcagagcagtgccgggattgcctttccccaggatctgtgtcggccatccaggaagaactgtactggccaagcctgggaccacacgtctgcagagatcctgctctgctggcctgagccccaggccttggcctcctgtgcttgggtaaccatggccactgggaaaagcaaggaccgtgtttgactttcttggagaggtgaaagaggtgaaagaacaagttgtgtgctagaaaacttttgaggaatt

SEQ ID NO: 137985 - DNA, 601 bp, Human; identical to SEQ ID NO: 137969

SEQ ID NO: 137986 - DNA, 601 bp, Human; identical to SEQ ID NO: 137970

SEQ ID NO: 137987 - DNA, 601 bp, Human; identical to SEQ ID NO: 137971

SEQ ID NO: 137988 - DNA, 601 bp, Human; identical to SEQ ID NO: 137972

SEQ ID NO: 137989 - DNA, 601 bp, Human; identical to SEQ ID NO: 137973

SEQ ID NO: 137990 - DNA, 601 bp, Human; identical to SEQ ID NO: 137974

SEQ ID NO: 137991 - DNA, 601 bp, Human; identical to SEQ ID NO: 137975

SEQ ID NO: 137992 - DNA, 601 bp, Human; identical to SEQ ID NO: 137976

SEQ ID NO: 137993 - DNA, 601 bp, Human; identical to SEQ ID NO: 137977

SEQ ID NO: 137994 - DNA, 601 bp, Human; identical to SEQ ID NO: 137978

SEQ ID NO: 137995 - DNA, 601 bp, Human; identical to SEQ ID NO: 137979

SEQ ID NO: 137996 - DNA, 601 bp, Human; identical to SEQ ID NO: 137980

SEQ ID NO: 137997 - DNA, 601 bp, Human; identical to SEQ ID NO: 137981

SEQ ID NO: 137998 - DNA, 601 bp, Human; identical to SEQ ID NO: 137982

SEQ ID NO: 137999 - DNA, 601 bp, Human; identical to SEQ ID NO: 137983

SEQ ID NO: 138000 - DNA, 601 bp, Human; identical to SEQ ID NO: 137984

SEQ ID NO: 138001 - DNA, 601 bp, Human
gtctcttttgcatgtccctggatgtggttagaggacatattcccttatacatacagcatctgaaaggaaaggtcatattagcatccatgagaaaaggtgacatttctaagtgtcacgggccacaggaggtcccgggtggtagaagatgaggattgcttgaccacagtctcccatatgctcgtgctccactgggcgacatttattttgtgtacctgtctcgaggcctaagtaggtgtcagaaccttgccttggagtcatgctggggactggggagatgcgcgtcatcttcgggtggctgttctcggtgccctcgagcttctctcgggcagcgcatagctgcgctgccacctcacgttccacatgctgaccctgccttgccatggtccctctcgcagcccatggagtccatgcatgagaagggcatgtcggacgacccgcgctacaaccagatgaaaggaatggggatgcggtcagggggccatgctgggatggggcccccgcccagccccatggaccagcactcccaaggtacagaactgcgttccttcctgccttgtgtttgtcatactccagagtcctcagatcattttcctcccctggg

SEQ ID NO: 138002 - DNA, 601 bp, Human
ctgctgggctgaggtgccttcagcatgtgccctccaggtgcccctggttgactcaagagaaggatgccatttggctgtgccctgtctcagagtaggagctggtgtagggggaagaggctgtaaaaatcacagacatatgctgccgagtgaccagtgggctgacctttctctgcaggttacccctcgcccctgggtggctctgagcatgcctctagtccagttccagccagtggcccgtcttcggggccccagatgtcttccgggccaggaggtgccccgctggatggtgctgacccccaggccttggggcagcagaaccggggcccaaccccatttaaccagaaccagctgcaccagctcagagctcagatcatggcctacaagatgctggccagggggcagcccctccccgaccacctgcagatggcggtgcagggcaagcggccgatgcccgggatgcagcagcagatgccaacgctacctccaccctcggtgtccgcaacaggacccggccctggccctggccctggccccggcccgggtcccggcccggcacctccaaattacagcaggcctcatggtaagactggctgccctggcc

SEQ ID NO: 138003 - DNA, 601 bp, Human
ggggcagcccctccccgaccacctgcagatggcggtgcagggcaagcggccgatgcccgggatgcagcagcagatgccaacgctacctccaccctcggtgtccgcaacaggacccggccctggccctggccctggccccggcccgggtcccggcccggcacctccaaattacagcaggcctcatggtaagactggctgccctggccctcaggtgtctcagagcgaatggctggggcgtgggtggcggggtggacagaccgtgctctgttgccgactgggttccccggtttgggattgcacrggcccatactgcacttctgggtgctcgggtggtgggggcagctaaatgctgcttccccagctccccgcttcccctggggccgctggttaataggtgtatctgctgtgtcccctggagccagggctgcccacggggctgggcgcaggcataaacctgggacgcactgttttctcttttgtttctccctacatgtaggtatgggagggcccaacatgcctcccccaggaccctcgggcgtgccccccgggatgccaggccagcctcctggagggcctcccaagccctggcctgaaggtgagc

SEQ ID NO: 138004 - DNA, 601 bp, Human
agcagcagatgccaacgctacctccaccctcggtgtccgcaacaggacccggccctggccctggccctggccccggcccgggtcccggcccggcacctccaaattacagcaggcctcatggtaagactggctgccctggccctcaggtgtctcagagcgaatggctggggcgtgggtggcggggtggacagaccgtgctctgttgccgactgggttccccggtttgggattgcacgggcccatactgcacttctgggtgctcgggtggtgggggcagctaaatgctgcttccccagctccycgcttcccctggggccgctggttaataggtgtatctgctgtgtcccctggagccagggctgcccacggggctgggcgcaggcataaacctgggacgcactgttttctcttttgtttctccctacatgtaggtatgggagggcccaacatgcctcccccaggaccctcgggcgtgccccccgggatgccaggccagcctcctggagggcctcccaagccctggcctgaaggtgagctccctcttctatggtggtgcacccgtgcccttactccccatctcaagcttgggtccttgagatga

SEQ ID NO: 138005 - DNA, 601 bp, Human
gagtagctgggactacaggtgccagccaccacgcccggctaattttttgtatttttagtagagacggggtttcaccatgttagccaggatggtatcgatctgaccttgtgatctgcccacttcggcctcccaaagtgctgggattacaggcgtgagccaccgcgccctgccgccagtgctgagttttatcatcagagagagaaacccaaccgcggcaggcaaagggtgtccctttattgttttcataatagtctcgtttttattttatgtattatatttatttttttgagatggagtctcrctctgtcacccaggctggagtacagtggtgcgatctcagctcactgcaacctctgtctcctggattcaagcgattcccctgctttggcctcctgagtagctgggattacaggcatgtgccaccacacctggctaatattttttgtatttgtagtagagatggggtttcactatgttggctgggctggtctcgaactcctgacctcaggcattttgtcctcctcagcctcccaaagcgatattctaggtttttttttttttttttttttttgagacagcgtctcactctgttgcccaggct

SEQ ID NO: 138006 - DNA, 601 bp, Human
tacaggcgtgagccaccgcgccctgccgccagtgctgagttttatcatcagagagagaaacccaaccgcggcaggcaaagggtgtccctttattgttttcataatagtctcgtttttattttatgtattatatttatttttttgagatggagtctcactctgtcacccaggctggagtacagtggtgcgatctcagctcactgcaacctctgtctcctggattcaagcgattcccctgctttggcctcctgagtagctgggattacaggcatgtgccaccacacctggctaatattttttrtatttgtagtagagatggggtttcactatgttggctgggctggtctcgaactcctgacctcaggcattttgtcctcctcagcctcccaaagcgatattctaggtttttttttttttttttttttttgagacagcgtctcactctgttgcccaggctggagcacagtggcacgatctcggctcactgcaagctccgcctcccgggttcacgccattctcctgcctcagcctcccgagtagctgggactacaggcggcccctcaccacgcccggctgattttttgaattttttttgttagta

SEQ ID NO: 138007 - DNA, 601 bp, Human
caggcaaaatccagaagctgaccaaggcagtggccacgtaccatgccaacacggagcgggagcagaagaaagagaacgagcggatcgagaaggagcgcatgcggaggctcatggtatggtcctgccttcttgacgtgcgctcttctacatgtgtagctggtactgcgggctccaggggtcactccccagggttacgccaaggcatttcacagctcggagttagaggtgggacagagggaaaagagcaggcgcgggcttgggagtcagtcctgggctcggatatttgctgatctctctgatsatcagaatgactgtgtgacctcaggccacttagccggctcctctgccttctctggaaaatggaggtggtgcccccttccctcgttctgtgagagccaggtggtgtgatccagacccccgacccctagcataaacatctctgaccatttatttgtgactgagtcgctggttgggcagatattggcagcgtgttctgggccaggtgctgctctgtgtacggggacatggcccctgcctttgtgggggctcctggttgtgcttgaggggcagatacgcgaatgaagcaaacagagtagtggat

SEQ ID NO: 138008 - DNA, 601 bp, Human
agtgcggacaaaggttgaggtggcaggcagccatgtgccagggcagccggtagccctgggctcccagaacagcgttgtgtggggcaggaggtgaggtcagagcttacaggggcaggtgggaggtgggacctttcagaccattgggaggactctgggttgagttctgatcatgaaggggagcctcacccgggagggttttggctgtggggtgatgtgatctgatgtattcttagaaaggtggggggctgctgtaggaggtggtgggagggatgcaccttggacttggtggagagaaggcttygggtttggggtgtatttcgtggacagagtgggtaggactggctcatggcctctgtaaatggctgctggcgggactgtctgcctagcgggtgcccttggaacctagcccttggtgggttttgaggaaatgattcctgaatgaggagtcgattgccgtgtgaagggctggtggcacggcacccgcgtgagctacgcgtgccctcagtgcgcttctggattgactggccatgggtgctcacagacatgcacattgtgccaccacattgcagtaacccccatgcttttgtaggctgaagatgag

SEQ ID NO: 138009 - DNA, 601 bp, Human
gataacttagcccaggaggtccaggctgcagtgcactgtgtttgtaccactgcattccagcctggggagctttttattacttgagacagggtctctctctgtcagccagttctgtctcacagttctgaagccatctggaggactcaagaaaaaagtaatgggccaggtgcggtggctcacatctgtaatcccagcactttgggaggccgaggcaggcagatcatgaggtcaggagttcgagaccagtctggccagtatggtgaaacccagtctctactaaaaatacaaacattagccaggygtggtggcaggcttctgtagtcccagctactgggaggctgaggcaggagaatcacttaaacccgggaggcggatcacaccactgcactccagcctgggcgacagagtgagactctgtctcaaaaaaaaaaaaaaaaagtcatgaagtgggaaagtgcatgaagtgggagcttgtgctcagtcctgctgtggctgcctgtcctgtggagtgttgagaacaggcaccggcacttgctgctgcttgtgggttttcttgttctcggacagtggtactcagcctctgttgtgtgttctagtcacc

SEQ ID NO: 138010 - DNA, 601 bp, Human
agccagttctgtctcacagttctgaagccatctggaggactcaagaaaaaagtaatgggccaggtgcggtggctcacatctgtaatcccagcactttgggaggccgaggcaggcagatcatgaggtcaggagttcgagaccagtctggccagtatggtgaaacccagtctctactaaaaatacaaacattagccaggcgtggtggcaggcttctgtagtcccagctactgggaggctgaggcaggagaatcacttaaacccgggaggcggatcacaccactgcactccagcctgggcgacagagtgagactctgtctcaaaaaaaaaaaaaaaaagtcatgaagtgggaaagtgcatgaagtgggagcttgtgctcagtcctgctgtggctgcctgtcctgtggagtgttgagaacaggcaccggcacttgctgctgcttgtgggttttcttgttctcggacagtggtactcagcctctgttgtgtgttctagtcacctggggagctctctattattattactactattatttgagacagggtctctctgttgtccaggctggagtccagtgatgaggtcatggctcaccgcagccttgac

SEQ ID NO: 138011 - DNA, 601 bp, Human
aaaagagggagaaagtggaaacgtctaagtccttgtttcttatccatggaattgatctggaaggatggacaggaaactgataccagtggaaaactgtgaagagaaaaacttaggctggagcacagaagaatggggagagcccacatgatgctcttcagttttcgttaaaaaaataaaaatgggccttgggaggccgaggcgggcagatcacgaggtcaggagatcgagactgtcttggctaacacagtgaaaccccgtctccactaaaaatactaaaaattagctgggcatggtgatgggyacctgtagtcccagctactctggaggctgaggcaggagaatggcatgaacctgggaggtggagcttgcagtgagccgataccgcaccactgcactccagcctgggcaacagagtgagactccatctcaaaaaaataaataaataaaaataaaaaataaaaatgggccgagcatagtggctcacgcctggaatcccagcactttgggaggccaaggcgggtggatcacatgaggccagaagtttgagaccagcccggcctgaattttcagctatgagtgtctggactatttgaaaattaca

SEQ ID NO: 138012 - DNA, 601 bp, Human
tcgttaaaaaaataaaaatgggccttgggaggccgaggcgggcagatcacgaggtcaggagatcgagactgtcttggctaacacagtgaaaccccgtctccactaaaaatactaaaaattagctgggcatggtgatgggcacctgtagtcccagctactctggaggctgaggcaggagaatggcatgaacctgggaggtggagcttgcagtgagccgataccgcaccactgcactccagcctgggcaacagagtgagactccatctcaaaaaaataaataaataaaaataaaaaataaaaatgggccgagcatagtggctcacgcctggaatcccagcactttgggaggccaaggcgggtggatcacatgaggccagaagtttgagaccagcccggcctgaattttcagctatgagtgtctggactatttgaaaattacaatgtatatgccagttaccttaaagaaacaggtgttgggagactgaggcagagaattgcttgaacccaggaggcagaggttgtagtgagccgagagccgagatcacgccactgcactctagcctgggtgacagagcgagactccgtctcaaaaaaaaaaaaa

SEQ ID NO: 138013 - DNA, 601 bp, Human
tggctcagaagaagaggaagaggtaagagtgcatttcctggctttcaaggctctcagtgcccactggcagtgacttccaccctgtgtgttgtgaccgtctcctgccctggctgggcatcttgtggggcagggaacagcagggcccaggcctgcccgaagtcggtgctttagagctgtcctatccaatagggcagcttctggcgacatgtgaccatttccattttaaattaaatcagtcacattacataaaatttaagactcattttctctttcacactggctgcatttcaggtgcttggcrtcccttatctgggaatggtctgcctcatttgcccattttttttttttttttttgaaacggagtctcactctgtcacccaggctggagtgcactggtgcaatctcagctcattgcaacctccacctcccgggttcaagcaattctcctgcctcagcctcccaagtagctgggactacaggcgcctgccaccacgtccagctagtttttttatgtttagtagagatggagtttcatcatattggccaggctggtctcaaactcccgacctgaagtgatccacctgcctcagcctcccaaagt

SEQ ID NO: 138014 - DNA, 601 bp, Human
gctccctccctttccactaccctccctggggaaactttccagccttgtgtgtcatcttccagagatgctgtctgcattagcaagcaaaatgtgcatatttttgtcttcatttgcatacatatctccagtgtacattggtgtgcaccttgttattttcactgaaccttccctcttggaggtcatcctgtgtccgtgcagagtgcttccagtctggtcctcagcgtgcagtgtcatactgcgtcacgttatattctcattttcgtagcctgtcctttggtgacaagcgtttaggttatatttstcatcttttgctcctgtaacacatcacagttaacacagtaatctcttcattgcttatggtaaggaattaatagatcctgttaaaaagcaagtgagggctgggcgtggtggctcaggcctgtaatcccagcactttgggaggccaaggcaggtggatcacttgaggtcaggagttcaagaccagcctggccaacttggtgaaaccgcatctctactaaaaatacaaaaattagctgggcgtggtggcgtgcacctggagtcccagctacttgggaggctgagacaggagaatcgcttgaaa

SEQ ID NO: 138015 - DNA, 601 bp, Human
gtggtgtgaaacggcgagcgtcaggagcttagatctaggagccggcagccctggactccgctctttcttctggggatgaggtagcaggtcctgtgtgagggtgaaaagttggtggctctgaagctcttcacctgggcctgacttgggacagtcacgaaacagagctgctcatgctcttaatgcggcctgccatccagagctcattacaaggccccacaagacaaccagtacaactccaaccaaagaacagctctctctggttttcaatttggttgtttcttttcttttcttttttttttttgaaacggagcctctctgttgcccaggctggagtgcaatggcgcgatctcagctcactgcaacctctgcctcccgggttcaagtgattctcctgcctcagactcctgagtagctgggactacaagtgcgtgccatcacgcccggctagtttttgtatttttagtagagacagagtttcaccatgtcggccaagctggtctcaaactcctgacctcaggtgatccgcccaccttggcctcccaaagtgctgggattacagatgtaagccagtgcacccagccccaactttctttaagacaac

SEQ ID NO: 138016 - DNA, 601 bp, Human
tccatttcatgttgccataaaggaatacctgagactaggtgataaagaaaagaggtttagctgggcgcggtggctcactcctgtaatcccagcactttgggaggccgaggcaggcggatcacctgaggtcaggagtttgagaccagcctgaccaacatggtgaaaccctgtccctaccaaaaatacaaaaaaaaattagccaggcatggtggcgcatgcctgtaatcccagccactcaggaggctgagacaggagaatcacttgaacctgggagacgggggttgcagtgagccaatatcgygccattgcattccagcctgggcaacaagaatgaaacgccttctcaaaaaaaaaaagaggtttatttggctcatgattctgctggctggaagactgggcacctggtgagggcttcaggcggattccactcctggtggaaggcaaaggggagccagtgtgtagagatcccatggggagggaggaggcgagggaggcgggggtgccgggctccttttaaccatagctcccacgagagttcagagagcaggaactcattcatcccccatccccagtacagtacaggccgttcacgagggttcac

SEQ ID NO: 138017 - DNA, 601 bp, Human
gacccttgctcctggctcttctccctcccagtgcagatgctccgcacacctccggcttctcccttggtgcgctgactgtccccatcactccagggaggtttcactgttcctgagtcagcggaagcacagggtcaggccctacgggccaggtccggtggctccaagatgccatcagggacccagcctcccccaggtttctgcccagtcattcttgggtgactccaaccctcaggctccttacctcatggttgcaggacggctgcactgcctccctcgcctcatgcaggagagtgggcaggaragagttctaggagagtgggcagggcaaaaggcagcagaagcgcaaggctgctgagcctctgctccccacgcttcttcaggaactctccccagccttcaccacagccatgcgtccttctgtctattggctgtgccgcctggttggctgtggcttccagcggggctggagatgggttcatggtggacacagcacctccctcgtggagctgcttgggggcaaaccacgagtagtccctgggactccagcttcgagccctgtctttacggaccaccccgtctagactttctgagtggcttccct

SEQ ID NO: 138018 - DNA, 601 bp, Human
cactggggaggagacaggagtgagcatggtggccagcactcagaggccagctcaggcgcctgagatggggacccaggaagaggggagcctgtcagccaccaggaatgtgcagatggcggtgcaggctgcgtggttccctcaggccccggccgccgctggcctgcactgcttcctcttccccctgcagcgcgtgttctgcgtggtgaggtctggggacgcgccagcggccctgccagcccctttccccactacccctgtgaggacgagccctcccgccgtgtcactgggcagttgcaggggrtgcctgtgcccctcttgccacctggccacccggctccaaaagccgagctgtgcatcctgcttcccttgcagggatccccagcagcaagacgggcctttgtcccccagctccggagtgggaagttcaacgtcttgctgacgacgtacgagtacatcatcaaagacaagcacatcctcgccaaggtaacgtgtccctgtgggaaatgccaggccatgggccgagtgctcacacgtgggtcacgctgcccgtctcctccaaagcccctacaagtttcttcccggagtcccacctgcatgtgcg

SEQ ID NO: 138019 - DNA, 601 bp, Human
agggccaggatctgatgctatagttttgtcactttctgagccgagcaaaagctctgccaaaggattgccagggaagcaatagaagaaaagttttggcgtcgtctcattttcctttaacttttttaattaaaacattttaaaagttaattattagtagaggagtaggcgccgtgggaggtcagggtttctttcacctggttccacccaggctgaatgagagtcccttggggctcccggtggcagagccctccctgagaatcacccgctataagccccatgtggtcagcctggcccctgcagygctcctggcatgagcttggcgtggggtgggtctgtggacactccagtttgtgttactcgtggagaagcagcatgcccgctgccgggggtctttctggtgaggcacagggagcagagtgctctgggtactgcggttccatgtcccaggaattacatggagggaaccagatcctcacagtttcctaaggaagagggtgccctgcctggctcccagaaagcataaagcaggctgaaaagccacgtgccaagggcaagatcaccccaggggaccccgtccaccctgtccccacatccgcacctt

SEQ ID NO: 138020 - DNA, 601 bp, Human
cgctataagccccatgtggtcagcctggcccctgcagcgctcctggcatgagcttggcgtggggtgggtctgtggacactccagtttgtgttactcgtggagaagcagcatgcccgctgccgggggtctttctggtgaggcacagggagcagagtgctctgggtactgcggttccatgtcccaggaattacatggagggaaccagatcctcacagtttcctaaggaagagggtgccctgcctggctcccagaaagcataaagcaggctgaaaagccacgtgccaagggcaagatcaccccrggggaccccgtccaccctgtccccacatccgcaccttctagtgagacctctgtcgccctcctttggaggtaacgcttgcttctcctgtcttgggggcttccaggtggacctgaatgaggaggaaaccattctcatcatccggcgtctccacaaagtgctgcggcccttcttgctccgacgactcaagaaggaagtcgaggcccagttgcccgaaaaggtgatggagttttgaggggagccaccagtgaagcagcctcacgtgggggctttctccagggctgggcgtgctcagggcctctc

SEQ ID NO: 138021 - DNA, 601 bp, Human
gagcacgagcggtgtgtgcggaccgcagcggggcccggtggcctgctcctgcctgtcactgacccctctctccttgccttgcaggagtccttttccgagcacttggggttcactggcggcattgtccaagggtgagaagcttcccaactggatggggtgggcaggtggtccacccagaggttttctgtcgttttgttggctttattgctgctgttatgttgtccaatttcaaaggcagaaaattagaaaatacagaagaatccaaagcaaataatacaaatctttttttttttttttttttgaggtggagttttgctcttgttgcccaggctggagtgcagtgacacaatctcggctcactgcaacctctgcctcctgggttcaaatgattctcctgcctcagcctcccgagtagctgggattaccggcacctgccaccacccagctaattttttgtatttttagtagagatggggtttcaccatgttgaccaggctgatcttgaactcctgacctcaagtgatccacccgccttggcctcccaaagtgctggaattacaggtgtgagccaccgcgcccggccccattatacaaatcttta

SEQ ID NO: 138022 - DNA, 601 bp, Human
ttgttggctttattgctgctgttatgttgtccaatttcaaaggcagaaaattagaaaatacagaagaatccaaagcaaataatacaaatctttttttttttttttttttgaggtggagttttgctcttgttgcccaggctggagtgcagtgacacaatctcggctcactgcaacctctgcctcctgggttcaaatgattctcctgcctcagcctcccgagtagctgggattaccggcacctgccaccacccagctaattttttgtatttttagtagagatggggtttcaccatgttgaccrggctgatcttgaactcctgacctcaagtgatccacccgccttggcctcccaaagtgctggaattacaggtgtgagccaccgcgcccggccccattatacaaatctttagtgcttggagagctgaccactattaaccccaagagacaggattcctgaggcagacctggcttacagatcccactctgccgcctccaagctctgtgactctagacagctttcttaacctctctgagcctaaactctgctcactagtacagaggcactctttacatcatgtgggtgttttctatagcacccttt

SEQ ID NO: 138023 - DNA, 601 bp, Human
tgatgtgtttttttatactgagttgtggaacagggtcctgtacacctggcttcaaggctgggaggcctggcttggacatgtggtcagccatatcacgtcgtccccctgccagcctcagtgtccacatctacaacacttggggtttggctggagagaacatgagaagccgaggtggcccttccttctgggtctagcagagcatgggtgtctccagtgtggcatttgctcctggggcttctttatcgggcaaggggacaaggtctggcttcccggagcatccctgttccagccccgtgttgtsccggccatgtgactcacagctcctctcattttcatgagtgtctgggtttgacgagaaatacatgtgccaccctggtgatacgcctccccagcgagggtggccgggcttatttcagttgggggaaatggctttgctgaagctttgggtgggtgacgtctgcttaggatgcatgtctgtgcccttgaacccggcgcctggcctggaggcgggcgatgcacctcctgccttacctgcctgcagggttccaggtttaacatcctgcgccttctctcctgcctcctccacactccaggctggacc

SEQ ID NO: 138024 - DNA, 601 bp, Human
gggaggcctggcttggacatgtggtcagccatatcacgtcgtccccctgccagcctcagtgtccacatctacaacacttggggtttggctggagagaacatgagaagccgaggtggcccttccttctgggtctagcagagcatgggtgtctccagtgtggcatttgctcctggggcttctttatcgggcaaggggacaaggtctggcttcccggagcatccctgttccagccccgtgttgtgccggccatgtgactcacagctcctctcattttcatgagtgtctgggtttgacgagaaayacatgtgccaccctggtgatacgcctccccagcgagggtggccgggcttatttcagttgggggaaatggctttgctgaagctttgggtgggtgacgtctgcttaggatgcatgtctgtgcccttgaacccggcgcctggcctggaggcgggcgatgcacctcctgccttacctgcctgcagggttccaggtttaacatcctgcgccttctctcctgcctcctccacactccaggctggacctgtaccgagcctcgggtaaatttgagcttcttgatagaattcttcccaaactccgagca

SEQ ID NO: 138025 - DNA, 601 bp, Human
tcaccgcctgtgtttctgcgcctgcctgccccagcacacgggagctcagggaggagaggctgtgagatgccgacagggcacgtgagacatgtctgtcagtcccagtgggtcagggagccctggagtgagttcttcgtgggagttactagaactgggcttacgagaaacacgagcatgagctgctgagacagacacggctcagccagtttgttgttccctacacgacctcccagagcctttgttgaagctcctgtgcaaggtctgtctcacagcaggacaccccagacctccataccccttktcccgttgatcacttggacctgtgtttgctgggccaacctgcccaggtgccacccggagtgtgccctgtgtgtccctccaaactgcaggtcctccccggggttctgtccaggaccactctacagacacgagtctgttgcaggggtctccccggcttgccttcttccttgggggcttcccactttcagctttgaggctgaaaaccaaaatccttcagggtcctcatggccgggccaccccccaccctttcctctcctacggtctctccagcggcttctcccgtcctcgagagggccaaggc

SEQ ID NO: 138026 - DNA, 601 bp, Human
aaacctgctgctggttatggttggtctttcaagtaaaagggtttacctcttcccgaggttaaaaatcatgttgctgatctcagtggactgctggctttcccagtacctgccaggagggaggcacaagggtgaatcatggactattgaggcgccctgcaaagcgttgcactgctggctgcaggcagcctcactttgggcaagtccccccccatgagctggggagactcagtcatggggagggaggagagggcaagcccccaagggcctctgaacctggcaggtgctgcacggggctggcagytgcttgtggagctgacgtgagggcccgttctcagcagatggcagctggccctgcaacagcagctgcagatgtctttgagtcagtcgtgcggtgctcctggggcttcacccgacccaactttcccagcccaaggcacactgtgacagatgcctggcactgatgtcctcactggggttacggtgacagatcagaccccttcccagctcaggggctctgagttatagagacgatgattcagaatccatccctgaagttgtgtcataaaaatgtcctgaagcaataattccgagaaggcaggtg

SEQ ID NO: 138027 - DNA, 601 bp, Human
cgttgcactgctggctgcaggcagcctcactttgggcaagtccccccccatgagctggggagactcagtcatggggagggaggagagggcaagcccccaagggcctctgaacctggcaggtgctgcacggggctggcagttgcttgtggagctgacgtgagggcccgttctcagcagatggcagctggccctgcaacagcagctgcagatgtctttgagtcagtcgtgcggtgctcctggggcttcacccgacccaactttcccagcccaaggcacactgtgacagatgcctggcactgaygtcctcactggggttacggtgacagatcagaccccttcccagctcaggggctctgagttatagagacgatgattcagaatccatccctgaagttgtgtcataaaaatgtcctgaagcaataattccgagaaggcaggtggcagcttttggctatgccatgcaaagtgccacacccaggaaagagccatgtggcctagcccatgtggccaaacagccccggttccctcctgggacctcagcagcccagactcatgagcttgcctgccaagctgtgcaccagagggcgctgttgaaacacac

SEQ ID NO: 138028 - DNA, 601 bp, Human
tcctgggacctcagcagcccagactcatgagcttgcctgccaagctgtgcaccagagggcgctgttgaaacacaccaggagcccaggtgacagacaggccatcctgttccccagccagcctcccaagcacagcgctccaggacccagaagagaaaccctgaaaagacagtgtgagccctgccacagacctgtgtgacagcagagctgtttggctgctgtatgagtgtcaccggccctgcatttttttcttttttaataaagacaaagtcttgctgtgttacccaggctggcctccagttcytgggggctcaagtgatcctcacacctcagcctcctgagtagttcagactacaggtacacaccaacacgcctggctaattttaaattttttgtaaagtgggggtctcactgtgtcactcaggctggtctcaaactcctgggctcaaacaatccacccgcctcggcctgcagagtagctgggattacgagcatgagccacggtgcccagctcagccctgcatatttgaggcagtgagtaccttttaaatttaagatcagttcatacgtggctgctctatgtacatttttttctaggtgtaat

SEQ ID NO: 138029 - DNA, 601 bp, Human
ctaggtgtaatttacataccatacagttcacccttttggggtatatgatacaatcatcttcagtgtatccaagagttgtgcatctctcaccacagtccattttagaacattctcatcgcccccaaaagaagccctgccccgatttgccattcctggtaattcatggattctccccagccccaggcaaccactgatgtactttctgtccatatagttttacctgttctgggcgtttcctgtcagtggagtcctacagcgtgggatgctttggtgtcaggcttttttcacgcaatgtaacatrctgacccatgatgcagcaggtgtgttgcattctttgatggtgaaataatcctgcctcgtacagatttgtcacattcggtttttctgtccattcttgatggacacttgggttgtatccactttcgggctattacaaacaatactaccgtgaacattcacgtacacgtttttgcgtgcacgcgtttctctttaatatgtgatttctctttaatatctgatttctctttaatatgtgcctaggcgtagagttgccggaacaatgttagttctctatttaaccttttgagggaccccagcctgg

SEQ ID NO: 138030 - DNA, 601 bp, Human
gcatctctcaccacagtccattttagaacattctcatcgcccccaaaagaagccctgccccgatttgccattcctggtaattcatggattctccccagccccaggcaaccactgatgtactttctgtccatatagttttacctgttctgggcgtttcctgtcagtggagtcctacagcgtgggatgctttggtgtcaggcttttttcacgcaatgtaacatgctgacccatgatgcagcaggtgtgttgcattctttgatggtgaaataatcctgcctcgtacagatttgtcacattcggkttttctgtccattcttgatggacacttgggttgtatccactttcgggctattacaaacaatactaccgtgaacattcacgtacacgtttttgcgtgcacgcgtttctctttaatatgtgatttctctttaatatctgatttctctttaatatgtgcctaggcgtagagttgccggaacaatgttagttctctatttaaccttttgagggaccccagcctggtttccttggtggctacgccagttcacagttccaccagctgtgtatgagaattcctctttctctacatcctcagcaaccc

SEQ ID NO: 138031 - DNA, 601 bp, Human
gatttctctttaatatctgatttctctttaatatgtgcctaggcgtagagttgccggaacaatgttagttctctatttaaccttttgagggaccccagcctggtttccttggtggctacgccagttcacagttccaccagctgtgtatgagaattcctctttctctacatcctcagcaacccttgctgttccctcgcccgctgattctagccatcccagcacgtatgaagtgccatctgagtgtggttggatttgcatttccctgatggctaatggtgtggagtatctgttcatatgcttsttggccctttgtgtatcctctagaaagagatgtctagtcacatcatcctttacccaaatttaaaatatatttatcttaatattgaattgtaagttatttacaagtgccttatcagatatcatttgtaaatattttgttccattctgcacattctcttttcgcttccgtgatatccgttgaagcacagaagtgtttcattgtacttacagtcgatttttctttttcacctgtgccttggtgttgtatctgagaaaccatcgcctatccaaggtcacgaagacttgcccctgtcttttctcc

SEQ ID NO: 138032 - DNA, 601 bp, Human
tgtgttcctttcgaggccctaggagaggacccttccttggcttttccagcttctgatggttccagaagcctcctggcttggggcagcgtcaccccatctctgcctctgtcttcatggggacttctcctctgtgtccccttctgtgtcttttaagaacaatttttaaaacttaatcccaaaagtaaagacctcatttgcaaagaaggtcccattccgaggttccaggtagacatgagtctggggggcacccgccgctccgccctgggtctgcagggggccttctcctggtgcctcctgcctrctgtgccctccatgctgcttctttgacccggttgccttccatcctcctgggcccctcaggctctcagcttcccatcttctctaagacatgtctgctccatcattctggtgtctctctcttccctccttcctggcacctgacacgtttgttaccccacttgtggggtgttgctgtctgatcaccatcttccttccaagggtaggggaaagggccctggctggttcaagtcacagctctgtcctcagcgccaggcacagtgcccagctcactggcacagcctcagattccctggacacctgg

SEQ ID NO: 138033 - DNA, 601 bp, Human
accccatctctgcctctgtcttcatggggacttctcctctgtgtccccttctgtgtcttttaagaacaatttttaaaacttaatcccaaaagtaaagacctcatttgcaaagaaggtcccattccgaggttccaggtagacatgagtctggggggcacccgccgctccgccctgggtctgcagggggccttctcctggtgcctcctgcctgctgtgccctccatgctgcttctttgacccggttgccttccatcctcctgggcccctcaggctctcagcttcccatcttctctaagacatstctgctccatcattctggtgtctctctcttccctccttcctggcacctgacacgtttgttaccccacttgtggggtgttgctgtctgatcaccatcttccttccaagggtaggggaaagggccctggctggttcaagtcacagctctgtcctcagcgccaggcacagtgcccagctcactggcacagcctcagattccctggacacctggctccccggctgcattttttaccattgggataagttattagtaccattgaaaattaatacctggggattctcttaatattgttcatattca

SEQ ID NO: 138034 - DNA, 601 bp, Human
tacctcagctgggcgtagtggtcacgcctgtaatcccagaactttgtaaggctgtgaggcttgtggatcccttgagaccaagagtacgagaccaacctgagcaaaacagggagaccccgcctatgcaaaaaatacaaaaattagccaggcgtggtggtgcactcctgttgactcagctattcaggaagctgaggcagaaggaccacaagaagtcaaggccgcagtggggtataatcacatcactgcactccaccatgggtgacagaggtgagaccctgttgcaaaaaaaaaaaaaaaaaaagcaaaagaaaagctgcctccatttagcaataatttcaaacatgatgtttgggtacaaaattggtgtacttaatggatatttctgatattcttaactaaatttgaagctgtgagggaagacaaactcagggtccacagggtgggaaaagtccacaagatcaccctcaagtgccgtcattctctaggaccccgagagccctagcggttgttacgcttgcagttatgatttattacagtgcaaggctacagattaaaatcaaccaaggcaagagatgtatggggcctcttgggggccaaggtg

SEQ ID NO: 138035 - DNA, 601 bp, Human
tgttgcaaaaaaaaaaaaaaaaaaagcaaaagaaaagctgcctccatttagcaataatttcaaacatgatgtttgggtacaaaattggtgtacttaatggatatttctgatattcttaactaaatttgaagctgtgagggaagacaaactcagggtccacagggtgggaaaagtccacaagatcaccctcaagtgccgtcattctctaggaccccgagagccctagcggttgttacgcttgcagttatgatttattacagtgcaaggctacagattaaaatcaaccaaggcaagagatgtrtggggcctcttgggggccaaggtgggcggatcacttgaggtgatctggacggttccagacacagggctttcctttgtctcctccctgtggagttgaagacagcgctgatgttcccggtgacgttgactcagagcattgccaaccagagaagcctccgtgtccagaggtttttttttttttttggagatgcagtctcactctgtcactcaggctggagtgcagtggcactatcttggctcactgtaacctctgcctcctgggttgaagtgattcttctgcctcagcctcctgagcaactgg

SEQ ID NO: 138036 - DNA, 601 bp, Human
gggctttcctttgtctcctccctgtggagttgaagacagcgctgatgttcccggtgacgttgactcagagcattgccaaccagagaagcctccgtgtccagaggtttttttttttttttggagatgcagtctcactctgtcactcaggctggagtgcagtggcactatcttggctcactgtaacctctgcctcctgggttgaagtgattcttctgcctcagcctcctgagcaactgggattacaggctcgcgccaccacgcctggctaatttttgtattttttagtagagatggggtttcwccatgttggccaggctggtctcgaactcccgaccttaagtgatccgcccgcctcagcctcccgaagtgttgggattacaggcatgagccaccgtacccaccctgtgtccagcatttttactgggacttggtcacaaagacacagctggctacccacgtggctgacctccatctccagcccctctgcaggtgagcagaaactacatagcccaaagccccaacctaggactggtcccagaccccacgtaaacaaagacagccattaggtgtgacattctaaggactcagagatcacctccca

SEQ ID NO: 138037 - DNA, 601 bp, Human
tttcaaatattgcttttgatcgttggagatacttgcagccccctagttcgtgttttattctggcagaattgtgtttgacgtgacctctgtgttgacctcatcatacgtgtacagttgtcttgcctgggaatcttatactctgttcttctgcactcagattcacagccatgaggccgctcctcccaaggccctggagtgtggcactgccagctgtcacagccacggtcctttacattgtatacacagagtgcagtgacatgcccctcctgctcaggggccacagtaggaacaggctggagtkttctgtggtaccatgccggcagtgctggcttctgctgtccaggggcttgtggtggctccagtgggaagggccacgtaagcagaacaggaagtgtgagcagtgtccactgggaggagagggacaagtgtcccaggcagagaggacacagtgcatgcagaggctggagggaggctaggggcttgagtggggctgcgccagcaccaggggcctcacaggggccctgggccacacacctgcccttagccaagggcgtttctccttggtggtttgaaatctcaaaccacattgaggaacctgcca

SEQ ID NO: 138038 - DNA, 601 bp, Human
gagtgtggcactgccagctgtcacagccacggtcctttacattgtatacacagagtgcagtgacatgcccctcctgctcaggggccacagtaggaacaggctggagtgttctgtggtaccatgccggcagtgctggcttctgctgtccaggggcttgtggtggctccagtgggaagggccacgtaagcagaacaggaagtgtgagcagtgtccactgggaggagagggacaagtgtcccaggcagagaggacacagtgcatgcagaggctggagggaggctaggggcttgagtggggctgygccagcaccaggggcctcacaggggccctgggccacacacctgcccttagccaagggcgtttctccttggtggtttgaaatctcaaaccacattgaggaacctgccagaaatcgaaaccagaattaagaaattaagttacatgtaggagattttactttaaaatcagaacatgcagaaacgttctctgtggcttcgggtcaggttcgggcttgtggggctgtacactgccagttgataccttcttccctgggttctgtgtttttttttttttttttgagacagagtcttgctctgtagcc

SEQ ID NO: 138039 - DNA, 601 bp, Human
tggctgcagactatgctcgggcagctcggaaagacggtgacgggtccaggctgccgcagctaagcctcacaagagctctggccccaccaggcgggccctctgggttccattcccactccccactgcctggaggcagcagccctgtggttactgtaggagggacctgaatgcagtgaagatctgcactccacacctgtctctgtgcctcagtctccacgtctgcagcacaggggcctgactgaaataacgtggccaggcacacagcccagacgccagcactgtgtgcactgtgggaggggaygatggtccctagcccagggcctgagctgctgccttgccaattcgtggtgacagctttggcctgggtctggcaggggctggctgctactgctgaaggcctgtctgcactgtttccctgcctttccacaagcactgtccctcctggctcttcagagttgagtggttataccttgtgcaagaaaaacaatgaaacagattgtctgaatgtttcagacctgcctgaaacattctgcaggagaggtcatcccaaggcttgaaagtgtttgtcacactccttcaagcccccagggcagggcccctg

SEQ ID NO: 138040 - DNA, 601 bp, Human
ggtctggcaggggctggctgctactgctgaaggcctgtctgcactgtttccctgcctttccacaagcactgtccctcctggctcttcagagttgagtggttataccttgtgcaagaaaaacaatgaaacagattgtctgaatgtttcagacctgcctgaaacattctgcaggagaggtcatcccaaggcttgaaagtgtttgtcacactccttcaagcccccagggcagggcccctgagggaagggtgcaggtggagggtgggcaggagtgggagccattccttggggacaggggggctcmtcagggctgtctggcccttggcctgtggttccaggtctatggtctgcttggcacatagcctggaccctggtgctgtgcaggcactggctggatgagggcaccgagcagatgagccccaggcatgcccacttatgggcataggctgggtgcagggcactgggtccaacataaccatggcagagggctcagggggcctaaaagtcatggatggagttgcccacgcagcctgcggtcaggttccctgtggagccgtgctggggttctgcgcctgccccaggatttgctggaagaagctccccc

SEQ ID NO: 138041 - DNA, 601 bp, Human
gccagtccccgcctcgcagtgttggggcagccagcacaggcacgtgagacaggagccacacctgggttctcatctggcatctgcctcttgccatgctcaggttcttgcctccagatatagggcatcaaactaagtggtttccaaacttgggttcttggtggggagtgagatcagggtttcttaaaaactgcacttggaggctgggcacggtggctcacgcctgtaattccagcactttgggaggccgaggcgggcggatcacctgaggtcaggagttacaaaaaacggaacctaggctcaygcctataatcccagcacttcgggaggccaaggctggcgaatcgctggaatttaagagttccagaccagcctggccaacgtggcaaaaccctgtttctactcaaaatacgtaagttagccgggcatggtggtgggtgcctgtaatcccagctactcgggaggcggaggtttcagtaagccaagattgcaccactgcactccagcctgggtgacagagtgagactccgtctcaaaaaaaaaaaaaaaaaagaaagaaattcaaatctcagtgtcgataaatgaagttttgttggaatgcagc

SEQ ID NO: 138042 - DNA, 601 bp, Human
tcagggtttcttaaaaactgcacttggaggctgggcacggtggctcacgcctgtaattccagcactttgggaggccgaggcgggcggatcacctgaggtcaggagttacaaaaaacggaacctaggctcatgcctataatcccagcacttcgggaggccaaggctggcgaatcgctggaatttaagagttccagaccagcctggccaacgtggcaaaaccctgtttctactcaaaatacgtaagttagccgggcatggtggtgggtgcctgtaatcccagctactcgggaggcggaggttkcagtaagccaagattgcaccactgcactccagcctgggtgacagagtgagactccgtctcaaaaaaaaaaaaaaaaaagaaagaaattcaaatctcagtgtcgataaatgaagttttgttggaatgcagccaaagcccaccgatttctgcgttgtctgtggttcccttcatggaacagtggcagaactgagcagttgcaacagaggcaggcccagcaagcctcaaatatttacactgagctgagcgcagtgactcacacctgtaattccagtgctttgggaggctgatgtgggaggatcc

SEQ ID NO: 138043 - DNA, 601 bp, Human
agaggcaggcccagcaagcctcaaatatttacactgagctgagcgcagtgactcacacctgtaattccagtgctttgggaggctgatgtgggaggatcccttgagcccaggagtttgagaccagcctgggcaacctagtgagaccccatctctacaaaatattttttaaattagccaggtgttgtggcgtgtgcctgtagtcctagctacttgggaggctgaagcagtaggatctcatgagcccaggagttggaggcttcagtgagctaggatggcaccactgcactctagcctgggcaamagaacaagatcgtgtctgtaaaaagagagaaaagaaacagacaattcctagactgcagcaggtgtttgcagtagtgcatccagcaaaggactccccagggaaggaaatgggccaaagatgggaacaagcgctgcttggaagagcctgtgaaacagtgcttggcttctctgcacaacaaggaaacgtgtttagggccacattgtagaatggctacaaggacaagcaccactcacgctggctcagtatctcccaagtagagcatttccccaccctgtgacctagagtatcttctcccagata

SEQ ID NO: 138044 - DNA, 601 bp, Human
gaaggaaatgggccaaagatgggaacaagcgctgcttggaagagcctgtgaaacagtgcttggcttctctgcacaacaaggaaacgtgtttagggccacattgtagaatggctacaaggacaagcaccactcacgctggctcagtatctcccaagtagagcatttccccaccctgtgacctagagtatcttctcccagataaattcctaggagaactgcaaactaaacacttgttcctgagtgtccacagacacttgcttcctggtgtccaaccctgagcacagcccagatgcccggcagygggaactgggcatggctggtgtgtgcccacctcgggacctgctgctgcactcggcaacagggacagcaaggaggcaggaggccaggccaggtttgggggctcccctgtgtgtttctgcatcatcaacttgaagaagcagccaacctcggcccaggatcatccctgggggaaggactgacaggagcgcatctttagcctcatgcttaagatctgtgcattgggccaggtgcggtggctcagcctgtgatcccagcacttttgggaggccaaggtgggtggatcaggaggtcaggagttcga

SEQ ID NO: 138045 - DNA, 601 bp, Human
tgtgtgttcttattttctgagcctgtggactgggtttaccaacagttgcctgtggcagagccggccaccagcccgctcataggaaaaaggaagcctgtgcctccagggagggcccacgatgggaatgcagtctgagaagggtatgtgctcccatgctggaccggctggtcccacacccaggaccaaaaacacctcctggcaggagatggggagatgtacttcatgaacacacgttggggaaggacactcctggaaggcagaggctcaaggcgggctgtgtccaggccaggagattcactcycacctcaatttcctcctcagcacggctggcctggcactggtgcctgcttcagagtttagtgtgtgtaaagtgtggctggcccagcaagcaggggatgatggcggttgtcaaggccaggggaggtgcagggacaggattctggctcccgtgtgtaacgtctgcatctcaggaggctctcatgttagaagctgggtcaggggcttcgtgatgcacacaaacaccaaacaagcaggaggccttccgggatcctgctcacgagcagcttcctggaggcaagcctggcccgtctgccccttggtg

SEQ ID NO: 138046 - DNA, 601 bp, Human
atcaggacccaagctcagctcctccttcccatcaggccccgttggccacttttaggcttcgtccgcctggtggctccctgcttggggccgttccctggctaggcccttcctctgggccaaagcagagaggagagcgcgtttgccatgcgttctcattttcccagcctgcgggctgggttctgtcagagcaaggtcagctctcagagcttctgtccccacccaccctgtcctcctgagccaggctcaggtatgggtaagagctgggagcgctgtgcacgaggcctggcagcatctcatcacygccgctgtaccgagtgcacaagggcgcttcctgtggtgttcagggggttagatcagtccccagtgaggacagagcagagatccagatgcatcccaggccggctgcagtggcttctgcctctaatcccagcacttcgggaggccaaggcaggcagatcacgaggtcaagagatcgagaccatcctgaccaacatggtgaaaccctgtctctactaaaaatacaaaaattagccgggtgtggtggctggcatctgtaatcccagctactcgggaggctgaggcaggagaattgcttgagccc

SEQ ID NO: 138047 - DNA, 601 bp, Human
tcatccgcaagcccgtggacttcaagaagataaaggtaaccctgacgttgtacctgcgccccgcatgtgcccggaggggagtctgacccaggggcacccccatctgagagctgtggtgtgtgggcagaatgaccagaaaccacctaggcggtgccttgggctacctggttagggacctggtcgtgggcttttggggttccttgtaagggttgggggtgtcctgagggatgtcagtgggcagtcggtgttgggtgttccttcaaggtcccactcacttagtgctgggcctcagtcatgcagytcccatgcctagtgagccaggttaccgaggctggcgcttcggccacatcctcataggcacgaggaatcctagcccgtggggtctccagcacacagccaggcctgcgggcaggcgaggcggggtcctgaggtaagacctgctcctcccgtccactgcaggagcgcattcgcaaccacaagtaccgcagcctcaacgacctagagaaggacgtcatgctcctgtgccagaacgcacagaccttcaacctggagggctccctggtgagggcaccgctgggggttggggatgggccactcccac

SEQ ID NO: 138048 - DNA, 601 bp, Human
cacttagtgctgggcctcagtcatgcagttcccatgcctagtgagccaggttaccgaggctggcgcttcggccacatcctcataggcacgaggaatcctagcccgtggggtctccagcacacagccaggcctgcgggcaggcgaggcggggtcctgaggtaagacctgctcctcccgtccactgcaggagcgcattcgcaaccacaagtaccgcagcctcaacgacctagagaaggacgtcatgctcctgtgccagaacgcacagaccttcaacctggagggctccctggtgagggcaccrctgggggttggggatgggccactcccacagctgggctttgacccaacccgcccctccttcccttctgaattgatgggttaaaaacaagtcccgctagctgtggtggttcgtgcctgtaatcccagcactttgggaggccaaggcgggaggatcacttgagaccaggagttcacgaccagcctgggcaacataacaagaccctgtctttaaaaaaaaaaaagaaaaaattaaaaatttccaacttgggatattttagcaattacaaaagcagtatgtatttaccgaagaaaataaagatag

SEQ ID NO: 138049 - DNA, 601 bp, Human
atgttattgcagacctcagagattgtgcagaaggagggaggcacctgcagctattcccaaaccagtgtgcctgacctttcaccctggagcatttcagaagtctgatgctcgggcccctatggaggaagattatggagagggccttccaccctgggtgggctgaagccccgacccgctgaggctcgcattggccactgatcagctgtccaggggcaacacagggctggggctggggctggggccagggccgggcaggcagccctccagtcgggcccatccactcaagcccctggtgtctctgcccagatctatgaagactccatcgtcttgcagtcggtcttcaccagcgtgcggcagaaaatcgagaaggaggatgacagtgaaggcgaggagagtgaggaggaggaagagggcgaggaggaaggctccgaatccgaatgtgagtcccgggggggttcaggacgccggggttcacgctggcccgagagcccccaaggccccagcttttcacagccctcccggctcccagacgccccttgctgtgggggtgctgcattcccagagctcaaggctgtctttccctcccggtcccctccagctc

SEQ ID NO: 138050 - DNA, 601 bp, Human
ggaggaaggctccgaatccgaatgtgagtcccgggggggttcaggacgccggggttcacgctggcccgagagcccccaaggccccagcttttcacagccctcccggctcccagacgccccttgctgtgggggtgctgcattcccagagctcaaggctgtctttccctcccggtcccctccagctcggtccgtcaaagtgaagatcaagcttggccggaaggagaaggcacaggaccggctgaagggcggccggcggcggccgagccgagggtcccgagccaagccggtcgtgagtgacgaygacagtgaggaggaacaagaggaggtgaggccgggcccccgagcaggcagagctggcatgtggcaggaggcatcccggggccctgatgggacagccctgtggggcggtgctcccacgcccccacgctgcaggtgggaaagctgaggcttgacctgccatggctgaccccaggtcacacagccagtatgtggcagggctgccactcaaagccaagcctgtgtgaccccggaaccagctctcagtacccgtgggtgtctggggactgggggacacgtgagtcctcaggacaggcagcaggcg

SEQ ID NO: 138051 - DNA, 601 bp, Human
tgaggcttgacctgccatggctgaccccaggtcacacagccagtatgtggcagggctgccactcaaagccaagcctgtgtgaccccggaaccagctctcagtacccgtgggtgtctggggactgggggacacgtgagtcctcaggacaggcagcaggcggtcccagggcaccagggctcctgggctgaggccgggcaggccagggcttgattagggttgggtaggaggtgctaggattggggacccaccagacagtgccccgtctcctcagtggcatagagaatgggcagaaacgccaagmccacagtggatagtttttggggtgcagtggggagccggagaagatccacttgctggctttaaataatctcacctctgtctctggcccttcctggctgtgggacctggcaggtcactttgcttctcaagcttcagtttcctcttatgcaaagcaaggaggctgcatggattagggggctgcccccaccgaagggcctggctcccgctgaagcccagcgaatgccattttgtcatcacagaagcagcaaatttcagtgcctgggaattagtctgacgaaagacgcacgtgacgtttgaggac

SEQ ID NO: 138052 - DNA, 601 bp, Human
tgacatgggacagagcagggaaggcacgtggagcctcgaaggtcccgagagggccgagtgtggtcacagggactcgtcctgtagagaaacatgaagtttgggcatggccatggcgccatctcggctcactgcaagctccaccccccgggatcgcgccattctcctgcctcagcctcccaagtagctgggactacaggcgcccgccaccacgcccggctaattttttgtattttttagtagagacggggtttcaccgtgttagccaggatggtctcgatctcctgacctcgtgatccgcccrccttggccttccaaagtgctgggattacgggcgtgagccaccgtgcccggcccacatcagtgttttcttgagcaagtttatttaaagtttggcaggtccctggcaaggtgccctggcaggggtggccaacgcacactctctcctcctgtcccctctccaggaccgctcaggaagtggcagcgaagaagactgagccccgacattccagtctcgaccccgagcccctcgttccagagctgagatggcataggccttagcagtaacgggtagcagcagatgtagtttcagacttggagtaaa

SEQ ID NO: 138053 - DNA, 601 bp, Human
gggagcctggtgcaggcgacacagcttccatggctcatccctatgcgcccagggaagggagcaggttgggaggggggaccggggagttggcattgcccggcctgtggggggcagtgtgtatgtgtgacacaaggtctagccttgtgtgtgtgtgtgacaaggtgttccttcgtcgcccaggctggagtgcagtggcgcgatcatggctcactgcagcctcaaattctggggcttaagggatcctcccacctcagcttcccaagtagttgagaccacaggcacgcgccacgcctggcttttwttttttttttttttgagacggagtttcgctcttgttgcccaggctggagtgcaatggcgctacctcggctcaccgcaacctccgcctcccgggttcaagcgattctcctgcctcagcctcccgagtagctgggatcacaggcatgcgccaccacgcccggctaattttgtatttttagtagagatagagtttctccatgttggccaggctggtctcaaactcccgacctcaggtgatccgcccgcctcagcctcccaaagtgctgggattacaggcgtgagccaccgcgcccagtctaat

SEQ ID NO: 138054 - DNA, 601 bp, Human
aagtccatcctcgggtggtcacgttccttccagtgggaaggtattaacacacgtaacggtcattagacagtgcctggtatagagctggggcacaaaaaatgtgactgctgtttaatcttcacaccctgtggcgtaactgagtctgtattggggtggagggtggggagacctttcctatctggaaacccagaggcctagcaaagggttcaagtgcaaggccgagggtaaggggctctggcccctgcagaactagattctggagaaggcacaggtgtggacttcgccccagcgtgtgcagccrgtgtggcccaggtgtaagctggggtggggtggggggaggacctgccagctggataagctggatagagcccctgattaaggcttgggtgttgactttggcaggtgtcagccactggggcgcctgccgcccaccaactcatgccaaatacaaccccttctctgagttccaaggggaaggggttttctatgtacagggcccaggtttagagtccagttctaccccctaaatgggtactgctattttctatttgtcaaaggggccaggcctgtctccttctgcccaaggctgactcactccagc

SEQ ID NO: 138055 - DNA, 601 bp, Human
ctctctgccgggccctgttctctgtggaaatgcagctgtgaataggacaagaaaaagtccatcctcgggtggtcacgttccttccagtgggaaggtattaacacacgtaacggtcattagacagtgcctggtatagagctggggcacaaaaaatgtgactgctgtttaatcttcacaccctgtggcgtaactgagtctgtattggggtggagggtggggagacctttcctatctggaaacccagaggcctagcaaagggttcaagtgcaaggccgagggtaaggggctctggcccctgcakaactagattctggagaaggcacaggtgtggacttcgccccagcgtgtgcagccggtgtggcccaggtgtaagctggggtggggtggggggaggacctgccagctggataagctggatagagcccctgattaaggcttgggtgttgactttggcaggtgtcagccactggggcgcctgccgcccaccaactcatgccaaatacaaccccttctctgagttccaaggggaaggggttttctatgtacagggcccaggtttagagtccagttctaccccctaaatgggtactgctattttcta

SEQ ID NO: 138056 - DNA, 601 bp, Human
tgcaccaggcctggattcaaatctcagctcggtcactcggagaccaagtgatgctggatgcatcgcttgccccctctagacctcagtgtcctcttctaaaaaatgggatgtttgtcacagtcccttcctgaaagagtagttggttgtgagcctaaaatgagtttctttctttctttttttttttttttagagacaagatctcgctctgttgcctgaggctggagcgcagtggcgtgatcatagctcactgcagtcttgacctcctgggctcgagtgatcctcctgcctcagcctcccaagyagctgggactacagacatgccaccacatcaggctaatttaaaaaaaatttttttgtagagatggggtctcattatgttgcccatgctggtttcaaactcctctgctcaagcaatcctcctgcctcagccttccaatgtgctaggattacaggcatgagccaccacgcccgacctaaaatgtgtttctttattcattcaacaaatgcttactctctgccgggccctgttctctgtggaaatgcagctgtgaataggacaagaaaaagtccatcctcgggtggtcacgttccttccagtggg

SEQ ID NO: 138057 - DNA, 601 bp, Human
gtgaatgcaccaggcctggattcaaatctcagctcggtcactcggagaccaagtgatgctggatgcatcgcttgccccctctagacctcagtgtcctcttctaaaaaatgggatgtttgtcacagtcccttcctgaaagagtagttggttgtgagcctaaaatgagtttctttctttctttttttttttttttagagacaagatctcgctctgttgcctgaggctggagcgcagtggcgtgatcatagctcactgcagtcttgacctcctgggctcgagtgatcctcctgcctcagcctcycaagtagctgggactacagacatgccaccacatcaggctaatttaaaaaaaatttttttgtagagatggggtctcattatgttgcccatgctggtttcaaactcctctgctcaagcaatcctcctgcctcagccttccaatgtgctaggattacaggcatgagccaccacgcccgacctaaaatgtgtttctttattcattcaacaaatgcttactctctgccgggccctgttctctgtggaaatgcagctgtgaataggacaagaaaaagtccatcctcgggtggtcacgttccttcca

SEQ ID NO: 138058 - DNA, 601 bp, Human
tttaaagttttttttagagatgagatctcgctatgttgtccaggctggtctggaaccgctgggctcaagtgatgctccacctcagcctcccaaagtgttgggattacaggcataagccaccacgctagtgtcacaagtacttcaaacatgtcttaggttagtatcatctccgcaatcagacccccaggaataatactgtttcccgccaggcacagtattacagtggctcatgcctgtaatcccagcgctttgggaggccgaggtgggcggatcacgaggtcaggagttcgagaccagcctrgccaacatggtgaaaccccatctctattaaaagtataaaaaattagccgggtgtggtggcgtgcacctgtaatcccagctactcgggagactgaggcagaagaattgcttgaacccaggagacggaggttgcagtgagccaacattgtgccattgtgctccagcctgggcgacagagcaagactctgtctcgagagaaaaaaaaaaaaaaaaggtcgaggcaggagaatcgcttgaacccaggagatggaggttgcagtgagccgagatcccgccactgccctccagcctgggcaacaga

SEQ ID NO: 138059 - DNA, 601 bp, Human
tctgcagaccaggtcggtccaatgggggtcccagggtcccctctaagatggtacccaaaactcttccctgttggtcaccagcacctgggacctttcttttttctttctttctttttttaatagatggggtcttgccctgtcacccatgctggaatgcagtggtgcaatcatagctcactgcagcctcgaactcctgggctcaagcaatcctcttgcctcagcctcctgaatagctgagactacaggcgggagctaccatgctgggctaatgtttaaagttttttttagagatgagatctckctatgttgtccaggctggtctggaaccgctgggctcaagtgatgctccacctcagcctcccaaagtgttgggattacaggcataagccaccacgctagtgtcacaagtacttcaaacatgtcttaggttagtatcatctccgcaatcagacccccaggaataatactgtttcccgccaggcacagtattacagtggctcatgcctgtaatcccagcgctttgggaggccgaggtgggcggatcacgaggtcaggagttcgagaccagcctggccaacatggtgaaaccccatctctatta

SEQ ID NO: 138060 - DNA, 601 bp, Human
cacagacttatgagcccctttgaccttgtctctaagaaccaactgggccagatggtaccatcctgacaggacaccttggtactcttgctaccacgatgattgttaccagcggctaagttgggagagggagctaggtgtgactctgcagaccaggtcggtccaatgggggtcccagggtcccctctaagatggtacccaaaactcttccctgttggtcaccagcacctgggacctttcttttttctttctttctttttttaatagatggggtcttgccctgtcacccatgctggaatgcagyggtgcaatcatagctcactgcagcctcgaactcctgggctcaagcaatcctcttgcctcagcctcctgaatagctgagactacaggcgggagctaccatgctgggctaatgtttaaagttttttttagagatgagatctcgctatgttgtccaggctggtctggaaccgctgggctcaagtgatgctccacctcagcctcccaaagtgttgggattacaggcataagccaccacgctagtgtcacaagtacttcaaacatgtcttaggttagtatcatctccgcaatcagacccccagga

SEQ ID NO: 138061 - DNA, 601 bp, Human
cagtggcctctcacagacttatgagcccctttgaccttgtctctaagaaccaactgggccagatggtaccatcctgacaggacaccttggtactcttgctaccacgatgattgttaccagcggctaagttgggagagggagctaggtgtgactctgcagaccaggtcggtccaatgggggtcccagggtcccctctaagatggtacccaaaactcttccctgttggtcaccagcacctgggacctttcttttttctttctttctttttttaatagatggggtcttgccctgtcacccatgmtggaatgcagtggtgcaatcatagctcactgcagcctcgaactcctgggctcaagcaatcctcttgcctcagcctcctgaatagctgagactacaggcgggagctaccatgctgggctaatgtttaaagttttttttagagatgagatctcgctatgttgtccaggctggtctggaaccgctgggctcaagtgatgctccacctcagcctcccaaagtgttgggattacaggcataagccaccacgctagtgtcacaagtacttcaaacatgtcttaggttagtatcatctccgcaatca

SEQ ID NO: 138062 - DNA, 601 bp, Human
gattcattaccaagggatctccccagtctgatgagggagagacttgggcttgcccttgaggggttccaagtctcaggggtcagtggcctctcacagacttatgagcccctttgaccttgtctctaagaaccaactgggccagatggtaccatcctgacaggacaccttggtactcttgctaccacgatgattgttaccagcggctaagttgggagagggagctaggtgtgactctgcagaccaggtcggtccaatgggggtcccagggtcccctctaagatggtacccaaaactcttcccygttggtcaccagcacctgggacctttcttttttctttctttctttttttaatagatggggtcttgccctgtcacccatgctggaatgcagtggtgcaatcatagctcactgcagcctcgaactcctgggctcaagcaatcctcttgcctcagcctcctgaatagctgagactacaggcgggagctaccatgctgggctaatgtttaaagttttttttagagatgagatctcgctatgttgtccaggctggtctggaaccgctgggctcaagtgatgctccacctcagcctcccaaagtgt

SEQ ID NO: 138063 - DNA, 601 bp, Human
ccaggagtaggtcttgatttgcgtggccctgcagagttaccagtggtgagccatgagccgggggggttaggggtcagaggagagggcaaagatcaggggtccatgatcagcaagcactcaccagtcctgcacagcggcaaaggattcctgattggcgatgtcatacatgagcaggaagcccatggctccccggtagtaggccgtggtgatggtgcggtagcgctcctggcccgctgtgtcctggacaaatggcagtggcagttggctgggaactacctgtttcccagtccacccctgtctkagaggggcactgccctgtactcatagccccagccttacgggggagacacagacttgcttgtacaacctctggtctgatggagaatacacagatcctgccctcacaaccccagtctgatgggggaggcatggattcattaccaagggatctccccagtctgatgagggagagacttgggcttgcccttgaggggttccaagtctcaggggtcagtggcctctcacagacttatgagcccctttgaccttgtctctaagaaccaactgggccagatggtaccatcctgacaggacaccttgg

SEQ ID NO: 138064 - DNA, 601 bp, Human
gagactccgtctcaaaaaaataaaaaataaaaaaataaagaacatccccatccttttccatggctgcatagtattccaccatgtgaatatactttatgtccacttggttctccaactgtgagacacctgggggggatctgtaggtttcactcctactaatactactactacactccacacaccatatcccacatgggtgaggatatctctaggatcaatttccagaaatggttttgctgggttcccaggggataggcagtggggcagtgggagttcctgcgcgtggatcccctgcaattaracgggacatgtggcatacacatgggtatcttcctgggcagatcctcaaaggatcagtgactgggttggaccctgaatcagaggatggggatgagggtttggttctgggagaccagggcctgtggcccaggctgggcactaaccaaggtcgtcggcgagcctccggccatcctcagcaggcacaacacgttcgtcctccaggtcacacttgttccccaccaggatgacctgggcgttgtcccaggagtaggtcttgatttgcgtggccctgcagagttaccagtggtgagccatgagccgg

SEQ ID NO: 138065 - DNA, 601 bp, Human
aattgcttgaacctgggaggtggaggctgcagtgagccaatacggcaccactgcactccagtctgggtgacagagtgagactccaactcaaaaaaataaaataaacctgggaagcggagcttgcagtgagccgagatcgcgccactgcacttcagcctgggcgacagagcgagactccgtctcaaaaaaataaaaaataaaaaaataaagaacatccccatccttttccatggctgcatagtattccaccatgtgaatatactttatgtccacttggttctccaactgtgagacacctggsggggatctgtaggtttcactcctactaatactactactacactccacacaccatatcccacatgggtgaggatatctctaggatcaatttccagaaatggttttgctgggttcccaggggataggcagtggggcagtgggagttcctgcgcgtggatcccctgcaattagacgggacatgtggcatacacatgggtatcttcctgggcagatcctcaaaggatcagtgactgggttggaccctgaatcagaggatggggatgagggtttggttctgggagaccagggcctgtggcccagg

SEQ ID NO: 138066 - DNA, 601 bp, Human
tacttgggaggctgaagcaggagaattgcttgaacctgggaggtggaggctgcagtgagccaatacggcaccactgcactccagtctgggtgacagagtgagactccaactcaaaaaaataaaataaacctgggaagcggagcttgcagtgagccgagatcgcgccactgcacttcagcctgggcgacagagcgagactccgtctcaaaaaaataaaaaataaaaaaataaagaacatccccatccttttccatggctgcatagtattccaccatgtgaatatactttatgtccacttggktctccaactgtgagacacctgggggggatctgtaggtttcactcctactaatactactactacactccacacaccatatcccacatgggtgaggatatctctaggatcaatttccagaaatggttttgctgggttcccaggggataggcagtggggcagtgggagttcctgcgcgtggatcccctgcaattagacgggacatgtggcatacacatgggtatcttcctgggcagatcctcaaaggatcagtgactgggttggaccctgaatcagaggatggggatgagggtttggttctgg

SEQ ID NO: 138067 - DNA, 601 bp, Human
tgtaatcccagcactttgggaggccaaggcgggcagatcacgaggtcaggagatggagaccatcctggctaacatggtgaaaccccatctttactaaaaatataaaaaattagctgggcatgtggcacgcgccagtagtaccagctacttgggaggctgaagcaggagaattgcttgaacctgggaggtggaggctgcagtgagccaatacggcaccactgcactccagtctgggtgacagagtgagactccaactcaaaaaaataaaataaacctgggaagcggagcttgcagtgagccragatcgcgccactgcacttcagcctgggcgacagagcgagactccgtctcaaaaaaataaaaaataaaaaaataaagaacatccccatccttttccatggctgcatagtattccaccatgtgaatatactttatgtccacttggttctccaactgtgagacacctgggggggatctgtaggtttcactcctactaatactactactacactccacacaccatatcccacatgggtgaggatatctctaggatcaatttccagaaatggttttgctgggttcccaggggataggcagtggg

SEQ ID NO: 138068 - DNA, 601 bp, Human
tgggaggttgaggcgggtggatcacctgaggtcaggaattccagaccagcctggctaacatagtgaaaccccatctctactaaagatacaaaaattagccaggccccgtggtggtgggtgcctgtaatcccagctactcaggaggctgaggcaagagaatcacttgaactggggaggcggaggtggcaatgagccgaaatcacgccattgcactccagcctgggcgacaagagcaagactccgtgtaaaaaaaaaattcttttaaaagggtatagctgtgtctcagaaaaacttcatttayagatacaaatttgaatttcatataaatttcccatgtcatattatttttttttcaaccacttaaaaatgtaaaaaccaaccaggtgccgtggctcatgcctgtaatcccagcactttgggaggctgaggcaggccgactgcttgagcccaggagttcaagaccagcctgggcaatatagtgagacctcatctctacaaaaaataaaaataaaaaattagccagtgtgctggcttatactagtagtcccagctacttgaaaggctgaggcagcagaatcatcttgagcccaggtgtctgagg

SEQ ID NO: 138069 - DNA, 601 bp, Human
gtgagccaccgaacctggcctgtactccaatattttaaacataataacagaaagtgagaatccccctttaccccgagaccccagatataatccgcaagtaggtgtggaaagcacctccaagtattccagcccatcgcgggcgttaactgatttcaccacttccaggctaactggggatccagggccctgccccacagaacagagatccagtttctccaacaaagcaatggcaagaataaaaggggaaagggactggttatggcttagaggtcagcaaacctcctctgtaaaaggccagatygtaaatattttaggctttctgggtcatatggtctctgtctcaattactcaatttcacgcttgaagcactgtttatacccttttctgtattgagacagcctgtaatcacagacgtgtgattaccataaaaatagcaaccatagacaatgcatcaacaaataggcatcaactgagcacgggtgtgagttcactcctgtgatcccagcactttgggaggccaaggtgggaggactgcttaagcccaggagttcaagatcagcccagacaacatggcaagacctatctcttaaaatttttttct

SEQ ID NO: 138070 - DNA, 601 bp, Human
cccagctacttaggaggctgaagcaggaggatcacttgaacctgggaggcggaggttgcagtgagccgagattgtgccattgtactccaggctgggtgacagaacaagatattatctcaaaaaaaaaaaaaaaaaaaagaagaaggttggggggtgccaggcgtggtggctcacgcctgtaattccagcactttgggagacggaggtgggcggatcacgaggtcaggagttcgagaccagggccaatacggtgaaaccccgtctctactaaaaatacaaaatttagctttgtgtggtggcrcgtgcctgcagtcccagctactcaggaggctgaggcagaagaattgcttgaacccgggaggtgtaggttgcagtgagccgagattatgccactgcactccagcctggcaacagagcaagactccatctctaaataaataaataaataaatattagccaggtgtggtggcatgcacccgtagtcccacctacttgggaggctgaggtgggaggatgacctaagccagggaagttgaggctgcagtgagctgaggtcatgccattgcactccagcctgggcaacagagtgagaccctgtctc

SEQ ID NO: 138071 - DNA, 601 bp, Human
ctgtacccagtgcccgacacagagagggtgcttagaaactgtctgctgaatggttgaatgaatgaatgggtaaatgaacaatagcaggggcaggacatgaacttagatctcctactgtcagcccagagatatcaaagccatcccactgtcttcctgggcaaatctggtgtttccttatccacgcgtggctttgcctcataccatctgtgttctttatttttctttttgttgagacagagttttgctcttgtcgcccaggctggagtgtaacggcacgatctcagcccactgcaacctccgyctcccgagttcaagcgattctcctgcttcagcctcccaaggagctgggactgcaggtgtgaaccaccatgccaggctaatttttgtattttcagtagagacagggtttcgctattttggccaggctggtatcgaactcttgacctcagatgatccacctgcctcagcttcccaaagtgctgggattacaggcatgaaccaccgtgcccagcttatttttctgatattaatcaggcgtggtggtatgcgcctgtaatcccaactactcaggaggccaaggcaggagaatcacttgaaccca

SEQ ID NO: 138072 - DNA, 601 bp, Human
attatctgtctccgctactagaaagccagctccaggcaggcaggatttccgcccatggctgtacccagtgcccgacacagagagggtgcttagaaactgtctgctgaatggttgaatgaatgaatgggtaaatgaacaatagcaggggcaggacatgaacttagatctcctactgtcagcccagagatatcaaagccatcccactgtcttcctgggcaaatctggtgtttccttatccacgcgtggctttgcctcataccatctgtgttctttatttttctttttgttgagacagagtttygctcttgtcgcccaggctggagtgtaacggcacgatctcagcccactgcaacctccgtctcccgagttcaagcgattctcctgcttcagcctcccaaggagctgggactgcaggtgtgaaccaccatgccaggctaatttttgtattttcagtagagacagggtttcgctattttggccaggctggtatcgaactcttgacctcagatgatccacctgcctcagcttcccaaagtgctgggattacaggcatgaaccaccgtgcccagcttatttttctgatattaatcaggcgtggtgg

SEQ ID NO: 138073 - DNA, 601 bp, Human
tgtgcgtcatgctgaactatgaaaatggaatcataatgagttagctgtgtaattacccatttattatctgtctccgctactagaaagccagctccaggcaggcaggatttccgcccatggctgtacccagtgcccgacacagagagggtgcttagaaactgtctgctgaatggttgaatgaatgaatgggtaaatgaacaatagcaggggcaggacatgaacttagatctcctactgtcagcccagagatatcaaagccatcccactgtcttcctgggcaaatctggtgtttccttatccrcgcgtggctttgcctcataccatctgtgttctttatttttctttttgttgagacagagttttgctcttgtcgcccaggctggagtgtaacggcacgatctcagcccactgcaacctccgtctcccgagttcaagcgattctcctgcttcagcctcccaaggagctgggactgcaggtgtgaaccaccatgccaggctaatttttgtattttcagtagagacagggtttcgctattttggccaggctggtatcgaactcttgacctcagatgatccacctgcctcagcttcccaaagtgct

SEQ ID NO: 138074 - DNA, 601 bp, Human
gtaagtggacctgtcttctctgtgcgtcatgctgaactatgaaaatggaatcataatgagttagctgtgtaattacccatttattatctgtctccgctactagaaagccagctccaggcaggcaggatttccgcccatggctgtacccagtgcccgacacagagagggtgcttagaaactgtctgctgaatggttgaatgaatgaatgggtaaatgaacaatagcaggggcaggacatgaacttagatctcctactgtcagcccagagatatcaaagccatcccactgtcttcctgggcaratctggtgtttccttatccacgcgtggctttgcctcataccatctgtgttctttatttttctttttgttgagacagagttttgctcttgtcgcccaggctggagtgtaacggcacgatctcagcccactgcaacctccgtctcccgagttcaagcgattctcctgcttcagcctcccaaggagctgggactgcaggtgtgaaccaccatgccaggctaatttttgtattttcagtagagacagggtttcgctattttggccaggctggtatcgaactcttgacctcagatgatccacctg

SEQ ID NO: 138075 - DNA, 601 bp, Human
ggcttcctgcatccttttaaggttcctgagggtctgcctgagaggagctgtccctgaatctccatgcagccccacctgccacatcaccaaggtaagccaggaattcagacaaacgcctgccacgttacacgtggccaagggtaagtggacctgtcttctctgtgcgtcatgctgaactatgaaaatggaatcataatgagttagctgtgtaattacccatttattatctgtctccgctactagaaagccagctccaggcaggcaggatttccgcccatggctgtacccagtgcccgacacrgagagggtgcttagaaactgtctgctgaatggttgaatgaatgaatgggtaaatgaacaatagcaggggcaggacatgaacttagatctcctactgtcagcccagagatatcaaagccatcccactgtcttcctgggcaaatctggtgtttccttatccacgcgtggctttgcctcataccatctgtgttctttatttttctttttgttgagacagagttttgctcttgtcgcccaggctggagtgtaacggcacgatctcagcccactgcaacctccgtctcccgagttcaagcgattc

SEQ ID NO: 138076 - DNA, 601 bp, Human
aggagaggggtgggtggggggttgggggccatctctagcagctgcagctgctgggctggggggctggagcatcccccacggccgggcctttcccgttgctgcctgagctggagctgggttccagggactcgttcatcttctcgcagatgacatccaccaggcgctcgaagacctgcttcacattgatgttctccttggcactggcttcaaagaactcgaaacctggatgaatgttaaggtggggacactcgtaagacccctgaggggcagagtctcagctgtggcatcacagaaacctggmttctaagcctagttctgctctttatcctgctgtgggaccttggttgtgtgcctttgccactccaagcctcagtttgctcacctgtaaaatgggaatgatgatcctaccaatgataaaaatctgtggcaggccaggcgcaggggcttatgcctgtaatcctggcactaaaggaagctacggcgggaggatcgcttgaggccaggagttcaagaccagcctgggcaacatagcaaggccctatctctacaataaatttttttaaaaagtagatgggcggccaggtgaggaggctcatgccta

SEQ ID NO: 138077 - DNA, 601 bp, Human
acattgtgaaggaatgagccatgcaggagtcggggagcagttgacaggagggaagggattgccctgagcttggagataaccactgtggctcacgcctcgatcacagtccctgccgaggcaggagaggggtgggtggggggttgggggccatctctagcagctgcagctgctgggctggggggctggagcatcccccacggccgggcctttcccgttgctgcctgagctggagctgggttccagggactcgttcatcttctcgcagatgacatccaccaggcgctcgaagacctgcttcacrttgatgttctccttggcactggcttcaaagaactcgaaacctggatgaatgttaaggtggggacactcgtaagacccctgaggggcagagtctcagctgtggcatcacagaaacctggcttctaagcctagttctgctctttatcctgctgtgggaccttggttgtgtgcctttgccactccaagcctcagtttgctcacctgtaaaatgggaatgatgatcctaccaatgataaaaatctgtggcaggccaggcgcaggggcttatgcctgtaatcctggcactaaaggaagctacggc

SEQ ID NO: 138078 - DNA, 601 bp, Human; identical to SEQ ID NO: 22641

SEQ ID NO: 138079 - DNA, 601 bp, Human; identical to SEQ ID NO: 22642

SEQ ID NO: 138080 - DNA, 601 bp, Human; identical to SEQ ID NO: 21545

SEQ ID NO: 138081 - DNA, 601 bp, Human; identical to SEQ ID NO: 21546

SEQ ID NO: 138082 - DNA, 601 bp, Human; identical to SEQ ID NO: 21547

SEQ ID NO: 138083 - DNA, 601 bp, Human; identical to SEQ ID NO: 21548

SEQ ID NO: 138084 - DNA, 601 bp, Human; identical to SEQ ID NO: 21549

SEQ ID NO: 138085 - DNA, 601 bp, Human; identical to SEQ ID NO: 21550

SEQ ID NO: 138086 - DNA, 601 bp, Human; identical to SEQ ID NO: 21551

SEQ ID NO: 138087 - DNA, 601 bp, Human; identical to SEQ ID NO: 21552

SEQ ID NO: 138088 - DNA, 601 bp, Human; identical to SEQ ID NO: 21553

SEQ ID NO: 138089 - DNA, 601 bp, Human; identical to SEQ ID NO: 21554

SEQ ID NO: 138090 - DNA, 601 bp, Human; identical to SEQ ID NO: 21555

SEQ ID NO: 138091 - DNA, 601 bp, Human; identical to SEQ ID NO: 21556

SEQ ID NO: 138092 - DNA, 601 bp, Human
tgggcgcggccctgcccactctcaggccccgaggcttggtcctacccccccaacccgggcctagctaggcctggtcctaccccccccgccgcacccgcccaatctccgcggagcctgggcccaactcctccccgtcccgattccctttcggcgacaggggaatacctacagtgaccattcttgtgtgcccggcgggcgcggtccgtgttgaggggggctccgggggtggtgcactcctaggggggcgcccgatgctcacgctggggtcccgcccgggcggcctctggtgcggccgctgcakatgtggcgatgaaggcggcggctccctcgagggccagggacgggcccgaacccggggatgcgcgcgcggatggccgggccccggggtggcctgcgggcggcaggggatggaaagagggagcgggcgcggggttgaggacgccccctgcgcggccccgcggggcccggggaggttgcgcttcccgacagagatcgcggcgctctgcctttcgccgccgcccctcggtcggtcctgtccggtcccgtgtgttcaagtcctctcccctcgcccaccctccctccctccctccggcccgcgctg

SEQ ID NO: 138093 - DNA, 601 bp, Human
ggaacagagttgcataggcggcaaatggtgaaacaagaattcaggctgggcttggtggctcaggcctgcaatcccaatactttgggaggcctaggcgggaggatcacctgaggtcaggagttcgagaccagcctggccaacacagcgaactctcatctctactaaaaatacaaaaattagccaggcatggtggtgggcacctgtaatctcaactactcgagaggctgaggcaggagaatcacttgaacctgggaggcggagcttgcagtgagccgagatttcaccactgcactctagcctgggcgacagagaaagactctgtctcaaaaattagaaaaataaaataaaaaataaaaaaaaaagaattcagttccagggtttggactttagagcccactcccctaacgaaaagaccagtaatataataacaaaataataacagcaaagcgaagctgagtacctgctctctgccgtgccctgggcatcatgacatttaaacccactccatcggttgagtctattaattcaattcaacaaatatttactgagggctacacatgtcagactccaccctcctcatgctgtcctctgatagttaggt

SEQ ID NO: 138094 - DNA, 601 bp, Human
ccagaggtcaggagtttgagaccatcctgaccaaacatggtgaaaccccgtctctactaaaaatacaaaaattagccaggtggggtggtgggcacctgtaatcccagctatttgggaggctgaggcaggagaatcacttgaatccgggaggtggagattgcagtgagccgagatcacaccattgcactccagcctgggtgacagagtgagactctgtctcaaaaagaaaagaaaagaggcagggcgcggtggctcacacctgtaatcccagcactttgggaggccgaggcgtgtggatcaygagatcaggagatcgagaccatcctggctaacacggcgaaactccgtctttactaaaaatacaaaaaattagccgggcatggtggcgggcgcctgtagtcccagctactccggaggctgaggcaggggaatggtgtgaacccaggagacggagcttgcaatgagccgagatcgcaccactgcactccagcctgggcgacagagcgagactccctctcaaaaaaagaaaagagaaaagaaaagaaaaagaaaaagaaatcacatacagttttcagtaggaaagatcactgtgattgattag

SEQ ID NO: 138095 - DNA, 601 bp, Human
tggcccaggccggtctcaaactcttgggctctggtgatcctcccactttggcctcccaaagtgctgggattacaggtgtgagctactatgcctggcccttttagtagctttgaagcctcataagcccttccctaaacatatttatttgcctcctcccaccaaaggtaattcctatcccaaatgtgctaattatgtcttttgcttcatgcataagtttcttactagtcatttacctgccttcatctccccttgccacccccagttttcccactgagctattttgttcttttgcttttattgkataacataaaacaccttcaaataatgacaattttattttttcatcttcagtctatacctgttatctatttttcttgtcatttcaggggctacagtgtgatagtggcttctttattcctgattttttttttttttttttaaagacagagtctccctctgtcacccaggctggggtgcaatggcacgatcttggctcactgccacctctgcctcccaggttcaagcaattctcctgcctcagccttccaagtagctgagactacaggtttccaccaccacgcccgccaaatttttttgtgtg

SEQ ID NO: 138096 - DNA, 601 bp, Human
tacacaccacacacatacacataccacacacacatacacgtaatacacctacacgccacacacatacacacacaccacacacatacacaccgcacaccacacacatacacaccgcacacatacaccacacacatacacacacacacaccacacacacacacaccacacacatacacacatgcacacacaccacacacacatgcgtacacacacacatgcgtacacatatacatacacacatacacacacacatacacgctgcatctcaatgtcactggggtctggggtcctcatgccctgrggcttctgggtctcgttggccatgaagggacccattgggtcacaacttcactcccccaccccaatccccaaccccccacatcaggaaagggaagagattcctgcacctctgttcccatgttgaactgggggccagatgggccacccccccgaccctggcttcctccagggtccgggagcagatttgcagggcggagcccaaacacccccaggcgaacccagagaggggggtttccatgacgattcccccccagggaacctgggcttgtagggtcccagctgcagctgctgagaagggagg

SEQ ID NO: 138097 - DNA, 601 bp, Human
cacacacatacacacatcccacacaccccacacagacacacacacaccacacacacatacacatacaccacacacatacacaccacacacatacacatacacaccacacacatacacataccacacacacatacacgtaatacacctacacgccacacacatacacacacaccacacacatacacaccgcacaccacacacatacacaccgcacacatacaccacacacatacacacacacacaccacacacacacacaccacacacatacacacatgcacacacaccacacacacatgcrtacacacacacatgcgtacacatatacatacacacatacacacacacatacacgctgcatctcaatgtcactggggtctggggtcctcatgccctgaggcttctgggtctcgttggccatgaagggacccattgggtcacaacttcactcccccaccccaatccccaaccccccacatcaggaaagggaagagattcctgcacctctgttcccatgttgaactgggggccagatgggccacccccccgaccctggcttcctccagggtccgggagcagatttgcagggcggagcccaaac

SEQ ID NO: 138098 - DNA, 601 bp, Human
agctgggcgcggtggcgcacgcctgtaatcccagcattttgcgaggctgaggcaggcggatcacaaggtcaggagatcaagaccatcctagctaacatggtgaaaccccatctctactaaaaatacaaaaaattagccaggcgtggtggcgggtgcctgtaatcccagctactcgggaggctgaggcaggagaatggcgtaaacccaggaggcggagcttgcagtgagccgagatcgcgccactgcactccagcctgggcaacagagcgagactccgtctcaaaaaaaaaaaaaaaaaagwaataactagtttaaaaatgaacaaaatagataaagcagtttgagagtgaatggggggcagggtctgattaatataattttgtgcacctggggttctccagaaaaaaaaatcacatcagccattgtcatgtccataataatgatttttaaaatcacagccaggccaggcacggtggctcacgcctgtaatcccagcactttgggaggccgaggtgggcagatcacttgaggtcaggagtaggagaccaccctggccaacatggtgaaaccccgtctctactaaaaatgcaaaaattagccg

SEQ ID NO: 138099 - DNA, 601 bp, Human
tgtgggtttgttttgagatggggtcttgctgtgttgcccaggctggagtacagtgatgcaatcatggttcaccacagccttgacccccccgggctccagcaatcctcccaccctcggcctcccaaagtgctgggactacaggtgtgagcctttgtgcccagcctctattttctgtttcttctaattaacctcttgatagataggggtcattgtcttctggcttttgtttgggacagtgagttgagacagtgagttgtgagagtgtatgcctccattagaaataactaattaaagctgggcrcggtggcgcacgcctgtaatcccagcattttgcgaggctgaggcaggcggatcacaaggtcaggagatcaagaccatcctagctaacatggtgaaaccccatctctactaaaaatacaaaaaattagccaggcgtggtggcgggtgcctgtaatcccagctactcgggaggctgaggcaggagaatggcgtaaacccaggaggcggagcttgcagtgagccgagatcgcgccactgcactccagcctgggcaacagagcgagactccgtctcaaaaaaaaaaaaaaaaaagaaataacta

SEQ ID NO: 138100 - DNA, 601 bp, Human
ggaggatcaagggagcccaggagtttgagaccagcctggacaatacagcaagactcacccccgtcctccaccgccacaacctctacaaaaaaaaaaaaaaaaaaaattagctgggtgtggtggtgcacacctgtggtcccagctactcgggagactgaggctggaggatcacttgaacccaggagttaaaggctgcagtgagctatgatcacaccactgcactccagcctgggctacagagcaagaccctgtctctaaaaaaaaaaagagaaaaagatggacatatatatttatttcccaraaacggtggtgactggtgagtattgtaaaatgggggacagaaaagtctatttacaaagcagggaatattgtgtgaccttgtttcattgtgtgtttatcaatgtcctggaagcatggtagggaagtccacctctcaaatgctcagtgggtgacctgtcaccagggactggggaagaggctggggcgtggtcatcagcaattctcccccttatgtctgctgtatctatttttcctccctccctccctccctccctcccttccttccttccttcattccttccttctttccttccactctccc

SEQ ID NO: 138101 - DNA, 601 bp, Human
ctcagttgaaacatcctccctgtcctctctcatctaaatttgtcctccccccaccacccctattactctttctcaaagcacttctcctaactaggaattagacacattttagcactgttatctgaatcacattattaattatagtccaacccaacaacgaaactctctgcaggtgtttaaaaaaatggtgggtcaggtgcagtggctcatggctgtaatcccagtgctctggaagttcaaggcaggaggatcaagggagcccaggagtttgagaccagcctggacaatacagcaagactcrcccccgtcctccaccgccacaacctctacaaaaaaaaaaaaaaaaaaaattagctgggtgtggtggtgcacacctgtggtcccagctactcgggagactgaggctggaggatcacttgaacccaggagttaaaggctgcagtgagctatgatcacaccactgcactccagcctgggctacagagcaagaccctgtctctaaaaaaaaaaagagaaaaagatggacatatatatttatttcccagaaacggtggtgactggtgagtattgtaaaatgggggacagaaaagtctatttacaa

SEQ ID NO: 138102 - DNA, 601 bp, Human
cttgacctcttgaccttgtgatccgctcatctcggcctcccaaagtgctgggattacaggcgtgagccaccgcgccttacctaatttttataattttagcagagacagggtttcatcatgttggtcaggctggtctcgagctcctgatctcatgatccgcccgcctccgcctcccaaagtgctgggattacaggtgtgagccacctcccccggcctcagctaatctttaaatttttttttttgtagaaacaggatctcactgtgttacctaggctggtattgaacttctggcctcaagcarttctcccatctcggcctcccaaaatactgggattataggtgtgagccaccatgcctggcctatttttattttattgaaagacggagtcttgctgtgttgcccaggctaaatgcagttattattcacaggtgcaatcatactgcactgcagcctccaactcctggactcaagccatcctcccacctcagcctcccaagtagctgggactacaggcatgcaccaccacacccagccactcttcccactcctatagagagtggacctaagacactggccccttctcttcccagctacactggg

SEQ ID NO: 138103 - DNA, 601 bp, Human
ttttttttttttgagatggagtgttgctctgtcgccaggctggagtgcaatggcgacatctcggctcattgcaacctctgcttaccgggttcaagcaattctcctgcctcagcctcctgactagctgggattacaggcgcccaccaccacgcctagctaattttttttttatttttttgtatttttagtagagacgggtttcaccatgttggccaggatggtcttgacctcttgaccttgtgatccgctcatctcggcctcccaaagtgctgggattacaggcgtgagccaccgcgccttrcctaatttttataattttagcagagacagggtttcatcatgttggtcaggctggtctcgagctcctgatctcatgatccgcccgcctccgcctcccaaagtgctgggattacaggtgtgagccacctcccccggcctcagctaatctttaaatttttttttttgtagaaacaggatctcactgtgttacctaggctggtattgaacttctggcctcaagcagttctcccatctcggcctcccaaaatactgggattataggtgtgagccaccatgcctggcctatttttattttattgaa

SEQ ID NO: 138104 - DNA, 601 bp, Human
ccctgccttgcctgtgtactgggcaggaggctggaaaccgacctggatttgcctcaaggcattcattgctagtgggagggacagccagccagggctgctggacaaagggaaattcggggtagagacttcttgcccagttcctctccctctctgccttgggggcaggaggcaaggaaggcttcttggaggaggaggcctctatctcacatgaaatctgttgggtaatttggagttagccaggtagagtgttccaggctgaaggaacagcatgtttgaagaaccggaggcagaagagcgtttrggggtctgaatgttgtcagggcgactggatcctagtaagatagggatggggcaaatggggctggagaatcaggcaggggcctgattacctgggcccttgcgggctacattgaggcgtttgggcttctctccagagggctacagggaaccccagctcgggagagagacccagcttggtgtgtgttttggaacatctccctgctgccctgtggagtagaggcagggaggtagtagtcaatgaggaggaggcagaacagaggagagctggtctcttgccttctgcccacccagaaaaagctca

SEQ ID NO: 138105 - DNA, 601 bp, Human
tgagagggggttagacacaccagtgctcatttcccaaaggtttacagaagaattttacaacttggctttcaagtgtttatagtaaccagaaaactaaagtgtagcaagtgtggataattttatttttcataaaatgtgattacatttaaaactgtctttcacttccatagtttataacgtagataaagccttcctaatatatgtggtgctccagtgtttaaagtattggaaacatcaatttgagaaaactgagaaatgacaacagtaaaaattttagtaaaacattcagatgatcctaaawgtcgggatatgcatagaatgccaacaacaggccagaatttttattggaatgttagcgtcgtataaatcttagatctaattgacagaatatttcaactgaaacggagcataggcccatctagtctaatgcctgaattttctagttgagaaaatcaaagcataaatgttaagcaacttgtgaagatcagagtagcagaaccagaacacgatgccagattgcttgtcttttgtcttactgaattttctcaatattttttcaaatgctttttatcataaaatatgtagtagcaataaatgagcc

SEQ ID NO: 138106 - DNA, 601 bp, Human
tcttactgaattttctcaatattttttcaaatgctttttatcataaaatatgtagtagcaataaatgagccacactccatcacagactgtggttacccagcacatgtggaaatattatagtgtgtatggtatgactaagacataatagaatacgttttccaacttgtggcttatggaatcagtgttgccgtttattatatttatgagattttcatctcaggagccagtagcccctcagcagggaggggatctgatgtatgtgtgttagctgtggtctgtacaatcagaacacccttgcctygaatgccattctgtaggtgatgcttacctgactgccttctcagactaccagaattatgatgaaatacctgagaggttcatattcctggggactatgtaaacaaaacaaattttgaatgactgagctcatactgtggaatgaactgaacacaattcacgaagccgtcaaattaagcaaacattgtttaactgagagtatcttatacggttcaggcatcaactcccagcatttcttaagagtgaggggataaaatctttggccttgcagtccaagggaaatctttattggttccatatggct

SEQ ID NO: 138107 - DNA, 601 bp, Human
acacaattcacgaagccgtcaaattaagcaaacattgtttaactgagagtatcttatacggttcaggcatcaactcccagcatttcttaagagtgaggggataaaatctttggccttgcagtccaagggaaatctttattggttccatatggcttcgctttctgtcattgtcctgcttctagaccatttgttgatcattttccattttctttggctgggtactttgaaataaagattttaggtattaattgctgcatacatagctggagttgttcaaagctcacttctgaatcaaaagtcttttttttttttttttttttaaatggagtctcgctcttttccccagtctggagtgcgatggcacaatctcgggttactgcagcctccgcctcccatgttccagcgattctcctgcctcagcttcctgagtagctgggagtacacgtgtgcaccaccacacccgactaatttttctatttttagtatagacggggtttcaccatgttggccaggctggtcttgaactcctgacctcaagtgatgtacccgccttggtctcccaaagtgctgggattacaggcatagccaatgcgcccggcct

SEQ ID NO: 138108 - DNA, 601 bp, Human
ctcccatgttccagcgattctcctgcctcagcttcctgagtagctgggagtacacgtgtgcaccaccacacccgactaatttttctatttttagtatagacggggtttcaccatgttggccaggctggtcttgaactcctgacctcaagtgatgtacccgccttggtctcccaaagtgctgggattacaggcatagccaatgcgcccggccttaatcaaaagtctttatcagttatattccttaagtgtttccagcttaccattgtacaaatggtaaactgtgatttttttccatgaactkgtgattttgaagctcgggagaagctcttcctcacatggatgctttgccaaatgacagctacacgtactagactttcatttcatgtcgattactaaattttttaaggacatgagtcatccttttattgtgatacttaattggaacagtgaattttatagctacctattcaatgacaactggtttacttctagatacaagaactgatcatcctgaatcctccttgtaatagtatacttgatagctctaaaaatctgaataatttattctttgtctgtagacccaagtttccctgactctaaa

SEQ ID NO: 138109 - DNA, 601 bp, Human
gtttccctgactctaaaatgtgattacgtatccttcatatgaagcctcctggggaaagacagtgaactataagccatattttccaaactgagatatatacatcccaggagactgtgtcaatgttctagaaaatgcaataaaattatgaaataagcatggcacatgtctgtatggagagctaattttagttaaaaagctttggagaaaactatccctattgccctgccctctccccagttctccccagggttccctcttttgtcattagagatgctgtgtgtaaaagtttaaaagaaatttrtatacaaatgcatgcagtgagctgaaatctagatagacttgaatttgaaccatgattccatgtggacaaacggtgacatgtatgagtatgcctaactcacagcaccagcagataaaaagaaaaattaggattcttgatgaataattaatagacatataaaattatgtaattatatattatatacatattttataatatacatagcatattacataatgggacatatatgtataaaatatgactcacaatagcacaaaaatataaaaatctagaaaaaatctctacaagaaaaatttaaaa

SEQ ID NO: 138110 - DNA, 601 bp, Human
catgacagagcttttgtgaatatgaaatacagtaaagtatttaagataactaacagggttttggctcatagtctgtggtcaaaatttgagtttttactcatttaacttgtattttcagctagaactgaaaatagcccctgatggggctcaggtgatagataacttttattggatagcttttttattaatgaatattagaccagtgttttttgtaaaatgaaataattataggccactattcatgttaaagcttgctgttatcattctgcagaaaagatgggctgtaagaaaaagagctggwgagggttgtgtattaaaaaccagaatcaggccgaggcaggcggatcacgaggtcaggagttagagaccagcctgaccaacatggtgaaaccccgtctctactaaaaatacaaaaattagagaggcatggtggtgcgtgcctgtaatcccagctactcaggaggctgaggcaggagaatagcttgaacccgggaggtggaggttgcagtggccgagatcacgccattgcactccagcctgggctacagagcaagattccgtctcaacaaacaaacaaacaaacaaaccccagaatcaacag

SEQ ID NO: 138111 - DNA, 601 bp, Human
taaaaaccagaatcaggccgaggcaggcggatcacgaggtcaggagttagagaccagcctgaccaacatggtgaaaccccgtctctactaaaaatacaaaaattagagaggcatggtggtgcgtgcctgtaatcccagctactcaggaggctgaggcaggagaatagcttgaacccgggaggtggaggttgcagtggccgagatcacgccattgcactccagcctgggctacagagcaagattccgtctcaacaaacaaacaaacaaacaaaccccagaatcaacagtgagaaaattgtakggtaggggctttcatttgtgctacattctggactcttgtttcaccagcagtaaacaagtttcccaatgctaagcttagattgtgaggttgtgtgactgaagaaatagctgctttctaaccatcacagaaggctaaatgaatctttcccagcctgatgatttttggatttccttttaggctgtgtattcaggctaaacacagttgtttgtttctgagagactatttaaaaatggatttaaatagacttgttaatatttacacttcatgaagtactgtttgttttccccttacatatatttc

SEQ ID NO: 138112 - DNA, 601 bp, Human
taagagagacagcgttcacacatcttttgtcataatattacacttctaaaacacagttgctggtgtctgtaatcagtaggcatatgtactggcaacagccttttgaaaagccaagattagagtttcatcttttttgtgagaagctaaaaacttaattggaatgaaactgaaacgtggcacttagaaataaatccagttagctgaactgaggctaccaaagtgtcaatatgtgggtgttgagtagatttgaagctcaggataacctcagtacctgaaataagtaattcctttaaagaattayaaaacaataaaatttggctgcattttttttaatactaccagtttgagagactagtaatccctaatccattccacaaaagggcatttttaacaaggatattattcacagaaacatatattgttgaactatttctaaaaagaaatatccatgtatatataaagtactgttttatatcctggggaagatggaaagaacactactgcagtaaaatgtctgcggaagtagaggtcgatgagacaggaatgtttacaccttagaggctttacatggaagcttctagaaatggctctggggccaccc

SEQ ID NO: 138113 - DNA, 601 bp, Human
gccacccaaagagggggcatgaggagatgatttgggtgacatggacaatgggtcctaagagaagaagagagcagcgaggctggaagaggttgtgtgaaagatgtaggagagatgccaaaagggaaagaaagactcaagagcagactttctctggcttgggccatctggcaggggccttcactgatttggcagcttgcatctttgataagaaaaatttaatttcccacagtattactcatttatatttcagaagaaaaacccagcatccttatgaaactattatcacctgtaaatagaatayattatagtttcctttctcagttagcttgatcaatggccagcactggactacgagagaaaatgaaacgttatcaagctatccagtatgagatagattcagggaaggagtccagtcaggaaccatgtcaggccacttcaggccacttctggctgcagtgtgttcattggggagtgagttttgaggctgagctatcaggaaatgttggggcagccattcattcctgctgctcctctcacctgctctcccatgatcatcaatcatctgggactccaggcatttctctgagtgcctggtatgggt

SEQ ID NO: 138114 - DNA, 601 bp, Human
actgctcctccctcctgcaagccaccttagtttcagaaaagagtgggggagcacaaaaggacatattcttcccagggacttccacttcaattgtaatagtcagaactacaaatgtgtcactgctagcttcagagagcctgagaaatgtggctttagatatcagtaagaaagaaggggagaatggatatcagatatgcaatcattgtctgccatgagtccctacttggaaatctccagatcatcatgactggacctttccttattgtcctctcccattggaacataccacacccagcccccmaaaaatttaagataaatcttaaacattttaaaaaatgtgagtaacatttgtaatttaaaagagagaggcgtggcattccggaggaattcttaaagtaaaatttagatttaccctgaaatctatagtgatgattactaactgctttaagaatgaaaattctttttttaaaataaaaaaattcatgatgtttcacatatgagactaattatattttcagtaatttactggttgacaaaaaggtatgatggatttggtataaaaatgctttgatgctgagtgcagaaggatttgcaagcagac

SEQ ID NO: 138115 - DNA, 601 bp, Human
ttcccagggacttccacttcaattgtaatagtcagaactacaaatgtgtcactgctagcttcagagagcctgagaaatgtggctttagatatcagtaagaaagaaggggagaatggatatcagatatgcaatcattgtctgccatgagtccctacttggaaatctccagatcatcatgactggacctttccttattgtcctctcccattggaacataccacacccagccccccaaaaatttaagataaatcttaaacattttaaaaaatgtgagtaacatttgtaatttaaaagagagagrcgtggcattccggaggaattcttaaagtaaaatttagatttaccctgaaatctatagtgatgattactaactgctttaagaatgaaaattctttttttaaaataaaaaaattcatgatgtttcacatatgagactaattatattttcagtaatttactggttgacaaaaaggtatgatggatttggtataaaaatgctttgatgctgagtgcagaaggatttgcaagcagaccctatgcaattaactcagtgccactgccctccatccctcactctctcatcctctgcccatctggaagt

SEQ ID NO: 138116 - DNA, 601 bp, Human
cccagggacttccacttcaattgtaatagtcagaactacaaatgtgtcactgctagcttcagagagcctgagaaatgtggctttagatatcagtaagaaagaaggggagaatggatatcagatatgcaatcattgtctgccatgagtccctacttggaaatctccagatcatcatgactggacctttccttattgtcctctcccattggaacataccacacccagccccccaaaaatttaagataaatcttaaacattttaaaaaatgtgagtaacatttgtaatttaaaagagagaggcrtggcattccggaggaattcttaaagtaaaatttagatttaccctgaaatctatagtgatgattactaactgctttaagaatgaaaattctttttttaaaataaaaaaattcatgatgtttcacatatgagactaattatattttcagtaatttactggttgacaaaaaggtatgatggatttggtataaaaatgctttgatgctgagtgcagaaggatttgcaagcagaccctatgcaattaactcagtgccactgccctccatccctcactctctcatcctctgcccatctggaagttt

SEQ ID NO: 138117 - DNA, 601 bp, Human
aggcgtggcattccggaggaattcttaaagtaaaatttagatttaccctgaaatctatagtgatgattactaactgctttaagaatgaaaattctttttttaaaataaaaaaattcatgatgtttcacatatgagactaattatattttcagtaatttactggttgacaaaaaggtatgatggatttggtataaaaatgctttgatgctgagtgcagaaggatttgcaagcagaccctatgcaattaactcagtgccactgccctccatccctcactctctcatcctctgcccatctggargtttgcacccagggttaggtaccatgctgggatggctgaggtcttgatcaactctcagatcatcagaaattcctgcaaagagctctgtagaggaaaacaggtatctcttcatcattttatatttagggatagctccaatcagacccaacattctgccatagggtctgatattttcatgcctttgttagctaggtattctccagaaggcctggttaaatgagaacaagtgaaataagacatttgaacaagctcatggaacttaccctctttctctctgttaatgactagcctcaggtatcc

SEQ ID NO: 138118 - DNA, 601 bp, Human
cagtgcaatcagctgagaactctccaggtctttatcggctaagagaaaaaaaaatatatcagagcccatttagaaacaggaaagaggctagccaaaagtcctgagacacactaccagacagaggcaaaatagtcactagttgagctttaagtttgcctttaggtatttctttaccttcattttgccagagtttatctatgcagcctccaaacacagccagccaggggatccctgacactcccggtgtgctcagctgcccaagttcaagtctgtcccatcccttcccacatccaaccatacrtctcctatgtctttgctctctgcttgtcaaggtgatagagtatggagttaaaacttactgagcacctactgtgtgctgggcaataattagacactttacatatgttatctagtaatatttgaacctcataatgttcctatttcacctcatgatacaaataagagacctgagctaataacatacctaaggtgacacagtcagtaaacagcatcacttagatgcagttctttctaactccactaagatcttcagactcttggttattcatgcagcaaacagctgcgggtccctgtgaaggta

SEQ ID NO: 138119 - DNA, 601 bp, Human
gtactccagcctgggtgacggaagaagaccctgtttctcaaacaaacaaacaacaacagcaacatgaccagattacatatctctgaaccttagggaaaggaagtctaaaatacagaaataacaactacagagttcacttgctttatgggacagtacctttctttttggaaactcctgggctagtgggaaaacatgaactgatcctcagtggcaaatagactgatcaaagcaaattagtagaaaaattaagacaaaacagtaatcacaatgatacaaataatctcagattgataaaaatagrgaatattcttaccacaacacagttgtactcacatccatacaaacaaccacacccatcagaagaacctaattatttatcagacacaaattttatctggtctagtagcttgtgtctgtttgtcatttaaatgtaattagaaagggagtgtgaatgtcttctatggtgtggatcttaaaaagttaagcagacacttgggacacgtctattttggaaacttttgtttatgaatttctgtcaacccttttaaactttttcataattgtgacctgttttaagggtgctgagcttataaccttctac

SEQ ID NO: 138120 - DNA, 601 bp, Human
atcctcagtggcaaatagactgatcaaagcaaattagtagaaaaattaagacaaaacagtaatcacaatgatacaaataatctcagattgataaaaatagggaatattcttaccacaacacagttgtactcacatccatacaaacaaccacacccatcagaagaacctaattatttatcagacacaaattttatctggtctagtagcttgtgtctgtttgtcatttaaatgtaattagaaagggagtgtgaatgtcttctatggtgtggatcttaaaaagttaagcagacacttgggacaygtctattttggaaacttttgtttatgaatttctgtcaacccttttaaactttttcataattgtgacctgttttaagggtgctgagcttataaccttctacacagagttgccatttcattttcctgatgccagctttagttcatctgatttactgttctgtgatctggcagactctctgccgaggccctgtccttagtctttatggttttgaagatcacagcctggttctcagctggctctgattccaccaacaaaggagaggctcaccatttgagtccagccacctctatgttactcacc

SEQ ID NO: 138121 - DNA, 601 bp, Human
ggcattaaacaggcttttttaaatgtttgatcaatctgatcaggatctttcctttgcttccatgatcacgattccttctactgagtcttctatcctcttttctgttattttctaaattccccccccatttttgctcatctgtcttgctctcctctctttgcccttgtctctcctcttcttcttcctatcactcttctctcttcctcttttccttctatccttcctttctctcacttcccactttctccttttcattttccccagcttttcctgtttccttcctttcctttcctttctttcytgtctttcccctccttctgcctgtaagttcccttctttcaaccctgtccacggtgctgaatattaaacaaagcatttatggatttagtccatggtgctggtttatggcactgctaaaactctgcaaacaaaatatagttgagtataaaagattgagttcctattatgtagaaataaacaacattgacaagagtacatattagttattaaacattttgagtgttgtgttgtttgttgtgttgtatgatttacgtatccttacccctaatttgaatatgttacattgttgtcagaaataata

SEQ ID NO: 138122 - DNA, 601 bp, Human
gttgagtagtagaagacaataccaaaatggtctgtaaaggttcaaatgtgactatctggacttttgcagaaaaaaagattgccaatcattactctatccaaacaccaaagcttagatcatcctttctttcttcttctttattaaaatctagactccttattttttcccctacaggacttttcttccctctactctcacaataattaacccttcctccacacctcacttccttccccacccacccttcacatctatgcctcctccttcagagaaaattgaattgggaaaacatggggtgagytaaaaatctatttaaatggaacacattttccctggaatgtactactgatggttataagcagcccaaatcagacagatttataaacttactttatttttgaattcctatttatgtataaagtaatttatacactggatcacacctctcagtgcttgaaatgggcctgggtcacttccatttttgaggctctgcatatatgaataaatgccagatagagacttaagatggtatgatttaaaattttttattaagcaataatgcttctaatgcaaaaaaccgcaacataattagttagtcaca

SEQ ID NO: 138123 - DNA, 601 bp, Human
taaagaatcatgttgtataatcgatatcatcactaactcagaaacaaaaacaggtctcctatttagtttacttttcaggtatccaaagatgtttttatgtctcaacatctagaatattttcatgtttcaatgggatcagtttttctaattctgactattggaaaagaaaatatttttaaactctgtgcttatttcatattagattggtttattttatagaattttcctctactgtgcagacttctaatgtctctttcatttccaagtaatggatatgtttagaaatacatgtattttgcartaatttgagtgggctctataaggatgtaaataaactgtagttgatcaatagacacaaagagctcaagttgctttttttatatctgtcattacatctatctatctatctatctatctatctatctatctatctgtctatctatctaatctatctctgtctgcttgtctgtctacctatctataactaaatcaaattactgaacatgttgagcagtcacaacttggaatcacatttacctactgctacaatgttttattttagaacctgctcatctacagatgacttccaattacatgaact

SEQ ID NO: 138124 - DNA, 601 bp, Human
caaaaacaggtctcctatttagtttacttttcaggtatccaaagatgtttttatgtctcaacatctagaatattttcatgtttcaatgggatcagtttttctaattctgactattggaaaagaaaatatttttaaactctgtgcttatttcatattagattggtttattttatagaattttcctctactgtgcagacttctaatgtctctttcatttccaagtaatggatatgtttagaaatacatgtattttgcaataatttgagtgggctctataaggatgtaaataaactgtagttgrtcaatagacacaaagagctcaagttgctttttttatatctgtcattacatctatctatctatctatctatctatctatctatctatctgtctatctatctaatctatctctgtctgcttgtctgtctacctatctataactaaatcaaattactgaacatgttgagcagtcacaacttggaatcacatttacctactgctacaatgttttattttagaacctgctcatctacagatgacttccaattacatgaactgccatgtatgaattacatttggagtttaaaacattctttcccct

SEQ ID NO: 138125 - DNA, 601 bp, Human
gtctcctatttagtttacttttcaggtatccaaagatgtttttatgtctcaacatctagaatattttcatgtttcaatgggatcagtttttctaattctgactattggaaaagaaaatatttttaaactctgtgcttatttcatattagattggtttattttatagaattttcctctactgtgcagacttctaatgtctctttcatttccaagtaatggatatgtttagaaatacatgtattttgcaataatttgagtgggctctataaggatgtaaataaactgtagttgatcaatagamacaaagagctcaagttgctttttttatatctgtcattacatctatctatctatctatctatctatctatctatctatctgtctatctatctaatctatctctgtctgcttgtctgtctacctatctataactaaatcaaattactgaacatgttgagcagtcacaacttggaatcacatttacctactgctacaatgttttattttagaacctgctcatctacagatgacttccaattacatgaactgccatgtatgaattacatttggagtttaaaacattctttcccctcaggctgtt

SEQ ID NO: 138126 - DNA, 601 bp, Human
ctcaacatctagaatattttcatgtttcaatgggatcagtttttctaattctgactattggaaaagaaaatatttttaaactctgtgcttatttcatattagattggtttattttatagaattttcctctactgtgcagacttctaatgtctctttcatttccaagtaatggatatgtttagaaatacatgtattttgcaataatttgagtgggctctataaggatgtaaataaactgtagttgatcaatagacacaaagagctcaagttgctttttttatatctgtcattacatctatctatctatctatctatctatctatctatctatctgtctatctatctaatctatctctgtctgcttgtctgtctacctatctataactaaatcaaattactgaacatgttgagcagtcacaacttggaatcacatttacctactgctacaatgttttattttagaacctgctcatctacagatgacttccaattacatgaactgccatgtatgaattacatttggagtttaaaacattctttcccctcaggctgttattagatacttcgctatgggtgatacctttgatataaggagctatct

SEQ ID NO: 138127 - DNA, 601 bp, Human
catgttcccctcttcccacttcttttgttttatgatctgcccgaaagcctgatgcaaagcgtgtcagcagtcacttggggatgtcttcatttttcaagttcttaaacactttcttgtttttgagacttttaaaagagtggtagcatttgccggacgtgagccaatggagggaataataggagccatctggagaaatattcaggtgcatcacaaggaactagagaaataacagttctggaaagttgaatttctttctgatttcagaacctaccattaaatttttgtattctgtttttggtawattcaaatgattctaactgtgtatttaggtgacttggagattcagtggttaaatggcatgtaaagctcatttaagaacctcatggaagccaaactaaagtacttgcttaacagacagtatgaatatttatgaatgttattcattattctcatttaggaacaataatgaagccaccactagaaatgaatgtgctttttttctggaatcatttttaaagatagaaaagaaaataatatttgataaaattaaagtagtagaaacgcatctgggaaaattaccatataaatattttctacataa

SEQ ID NO: 138128 - DNA, 601 bp, Human
aaatttcttctgttttcttctaaaagtttgtagttttatgtttgacatatagatgtgtgatccattttgagtagactcgttagtaatgctaacttttttttagttcacttgataatagttgaaatatttttatgtctttgagaaaacatctaaggacaaaaagctgctatgacttaagcaatacttaaatttgtgtatctttgtatctactgaccaataaaagttgactcatgttcttatagagccaacttaaatttaaattttattaaccacaacagcatctacatacctttaaaaagcrcagtacatgaacgtcaaggtacttgtggagtggaggattccctgcaatagcgccaccctcccttattcatgtagtggtttaccttccacagatctgagccaatctcctccttttatagacaaataagcagagttttggagggtaacagagctttttccagagtcaaagagaaagttggtggcaaagctagcctagaatctagaatctagatctctagaattctagtccagtgcaagctccattactaggttatggtttactgactggccactagaaagcgaggcatcatcacagtaacca

SEQ ID NO: 138129 - DNA, 601 bp, Human
caaaatgtgcacataattgcccatctccagttcctacctcattaagtcctgccaactcagagactgctgtggtgcttcattggaaagtttaggctgacggtagattgtatatatgctttgtcagcatcaaagtggcctgtgctgacaatatttaagtcagatttagttaagagcttcaaatcaatgctaccttgaggtctctgaaattaaagccttttcttgctgtttccatagcagcctgatagttgacataatccccaaagaagcttatatattaatacccaaggaccatttacagttytcatgcactgctgacctgaaatgccatgactagagctagatatactagcaaaatattgagttatttaaagaacatagtatagtccaaactatagtgaaagaggattgggttttcaagaacctgattaaataaactttaaaaatacacatattttcaatatttgacttctttaaagtttagtgctccatggattctgacctttcaggtacctcacacatgggggttgtaagatgcaaaggatatttttatgtaggcaataaatgcattcagttaatagatgctaaaatttaccatgtttcc

SEQ ID NO: 138130 - DNA, 601 bp, Human
gtttgtacacagactttttatatatttgctcctaatatacaaatataaatacatatatgtatttgacatgtatcacatataatatacatataaaccatattaaaaatgtattttttgttcatgtttgttccaagtcaagtttcccactaagagatacagattctgatgaacgatgttcttgaaactttgtgttaccactcaaatccttgcttatgttacaaatacctttgagtagttctttaatctttttttactgaagggatttgtaatttatttcaaaactatcacaaattttgaaagrtgttctaattgacttgtctctgaatcaggaaaaatagacttgcttctcagctttgaatctctgtcactctataattaatacttggaaacaaattcagagatctgaactcttcccatgtgttacatttaaactgtttaatatatcttgaacaatttttcaagatgtacaccccacatttccattattattgtgagattaaaaaatagtaactcaacggagattgactacattacatctccttgattgcctactgttgcttcttttgtatttttgctcttcgatggtgatttttttgacacc

SEQ ID NO: 138131 - DNA, 601 bp, Human
gccacagaacttttcagaatctttagtgtgcttatgtgtattccaaatcagcaaaagtcggttacatttcccaacttacttggctacaaaatcctttcttcatggaaccttattaaccatctatgagatactgagttcttttcttttcttcttcttcttcttccttttttttttttttttgacaggatcttgctctgtcacccaggctggagtgcagcagagaacttatagctcactgcagcctcaaactcctgggctcaggagatcctcctgccttagcctcctgagtagttgggactaygcgcacaggccaccacacccagctaatttaaaaagaaatttgtatgtggagatggggatctccctttgatgcccaggctaatcttaaacttctggcctcaagggatcctccttccttggcctcccaaagttctgggattacaggtgtgaaccaccacacccagcccacagttcttaattactataagaattttcctaattgttccttttatgatccagggatattggcattgatctgatttggaatacatgagccctctatgtgctcaggtgcttccacctattctagagtctgagaaga

SEQ ID NO: 138132 - DNA, 601 bp, Human
ccacagaacttttcagaatctttagtgtgcttatgtgtattccaaatcagcaaaagtcggttacatttcccaacttacttggctacaaaatcctttcttcatggaaccttattaaccatctatgagatactgagttcttttcttttcttcttcttcttcttccttttttttttttttttgacaggatcttgctctgtcacccaggctggagtgcagcagagaacttatagctcactgcagcctcaaactcctgggctcaggagatcctcctgccttagcctcctgagtagttgggactatrcgcacaggccaccacacccagctaatttaaaaagaaatttgtatgtggagatggggatctccctttgatgcccaggctaatcttaaacttctggcctcaagggatcctccttccttggcctcccaaagttctgggattacaggtgtgaaccaccacacccagcccacagttcttaattactataagaattttcctaattgttccttttatgatccagggatattggcattgatctgatttggaatacatgagccctctatgtgctcaggtgcttccacctattctagagtctgagaagac

SEQ ID NO: 138133 - DNA, 601 bp, Human
tgtgctcaggtgcttccacctattctagagtctgagaagacaaacattttcacccctttagggtgaaaaggaataattaattaattaattgtatctgttgcttaatgctgcttggttctggtagaaaaccttttgaactcacttctgtgtttacttgtcagttaaatggattttgttttctatgtcctttttgtaacatagaacctgggagctggcaatacaagtcttcaggagaaaatgtagttatttcagtgagcactagatggcagagccaacacccaggtggaataacagaggggagtgtgtgtgtgtgtgtgtgtgtgtgtgtgtgtgcgtctgtgtgtgtgtgtgtgtgtgtcagtgggggatgtgtgtgtctctgtgtgccatgagctgacataatagaaccattttgtcattctgttaaactcagtaattcctgaacaccacctagactatttactttatttactgaaaacaaatgagaaattttagctccttcaaaaatagctcgactatcattgacctgtatttatttttcattgtttgaaggagtcaggatcttgataacatcgtcaaagtggccacttcacttcagaga

SEQ ID NO: 138134 - DNA, 601 bp, Human
tgagaagacaaacattttcacccctttagggtgaaaaggaataattaattaattaattgtatctgttgcttaatgctgcttggttctggtagaaaaccttttgaactcacttctgtgtttacttgtcagttaaatggattttgttttctatgtcctttttgtaacatagaacctgggagctggcaatacaagtcttcaggagaaaatgtagttatttcagtgagcactagatggcagagccaacacccaggtggaataacagaggggagtgtgtgtgtgtgtgtgtgtgtgtgtgtgtgtgcgtctgtgtgtgtgtgtgtgtgtgtcagtgggggatgtgtgtgtctctgtgtgccatgagctgacataatagaaccattttgtcattctgttaaactcagtaattcctgaacaccacctagactatttactttatttactgaaaacaaatgagaaattttagctccttcaaaaatagctcgactatcattgacctgtatttatttttcattgtttgaaggagtcaggatcttgataacatcgtcaaagtggccacttcacttcagagaagtgacaaagggtgagatctcagagcttttga

SEQ ID NO: 138135 - DNA, 601 bp, Human
gaaacccccaccccacctcacctaggctgcctgcttaggggagaaagttgaacccatgtggtttaaatagaattcctgaacctaagtatttaaataggttgctcctgaagcagcagccagaaaaggctttgcagttgtcaaatgtggaaacaggctagcaaatttagctgacctggaaatgaagtagcagagctcaagaaggaagccagacttactgatgaacaaatgttttctagaagctacgtgtgcaagtacattgcacaatgctgtaattaatcagtgtacctatgtgtggactcarttaaaagtgggtattaagtatctactgtatgaacactgtattaaaacacagaagtgtgtctgatgtaaaatacagttctaaattttaagtggtgtgcatatgtgtgcctgtgctgaggtaggagcattaacatgagaccagtgtgcaatggctataactcaaagtatagtcacagaactgtcataaagcaggtgcagaaaaaacaaatgctgcaagggctccaaaaatgtagaggactctattcagttagaggactaggaaaggctttctggagaaagtggtgttggatgcgagctttga

SEQ ID NO: 138136 - DNA, 601 bp, Human
ctgttctggcaataatgatcacttaatctgctgctcttcagtttcctcatttacaaggagaggaggttttagatcaggagtcacagactccacggcccgctgagaccaggcaggtgtgagtgggtgaggagactgactgtgataactgcggccaaaaggagagcaaatgccctgtctgagcacacagctgcttctcagctcagctccagctgagggtctccactgagtctagtgttgcaggacagcagggcattctcaggagatcctgaaaatccagttttgttgtttgtttgttcattcrttttagagacagggtctcgctctgtcgcccaggctggagtgcagtgatacaatcatagctcactgcagcctccatttcctggactcaagcaatcttcccacctcaacctcccaagtagctgggactacaggcaccaccaccatgcctggctaagttttaatttttttgtagagatggggtcagaccatgttgcccaggttggtctcgggctcctgggatcaggtgatccttccaccttggcctcccaaagtactgggattacaggcataagccactacacctagcctgaaaattcaggtt

SEQ ID NO: 138137 - DNA, 601 bp, Human
acaccacattcagggacattcttgattatacagatttcagagaaaattgtactgtaacctaactgacaagttttggtgttttttccaaagaagacaaaatctcgaatctgttgctaaagtgaatgccaggatgaataaaacgagcagaaggtgagaactgaacagatgtctctaaatattggttattttctctcatattaattatgtgatattgagggcaccacatctttgtttggcttctctcttctgtgtctaatccctggtgccctgatcttcacttcaaagaatctacagtatattygatctaaatttacatttacatatagcccaataaaatcctaaggattaattaaactatgttattgattggcaatttttatactaaaagccaatttaatgtcagtataataattttctccaaaagcttgaattaatcattgggaatacagaagatgtatgtgtctaatattatgggaatgttttgaaactgatataaacttttttttttaaagaagtgaagaccttgataatgctactgaagtaaatcccaaaggacatgaaaataccactgggtaaaaataattaatgtctttaattatgg

SEQ ID NO: 138138 - DNA, 601 bp, Human
gttagttgaaaagctggtgtgcacactatcatgcctgccctgtttgtgtaggtgtggcatggtcagaggcaccgcgacccaatgaattcaaggcttgcacaagcttgcaacccatagaaggagaagaaaacattgatttccttcagtacctgggtggttcagggaggtaacctgaggtagtcagtgcgagcagggaatccaaaaatcctatattcgaattctggctctatcacttgctgactatctccctgtgcctcaatttactcatttacaaaagagggatcataagattctcatgccrggcacatagtagatacaagtaattgttgcaacaataaagattcaggtgaattatattttcatcataatttagtgttcaaatatttaatttccacttgccaagaaaaatccatgttccttttctaatttttattaaaaataatatttccaggccgagcacagtggctcaagcctgtaatccaagcactttgggaggccgaggcgggtggatcacgaggtcaggggatcgagaccatcctggctaacacagcgaaaccctgtctctattaaaaatacaaaaagttagctgggcgtcccaact

SEQ ID NO: 138139 - DNA, 601 bp, Human
agcagggaatccaaaaatcctatattcgaattctggctctatcacttgctgactatctccctgtgcctcaatttactcatttacaaaagagggatcataagattctcatgccgggcacatagtagatacaagtaattgttgcaacaataaagattcaggtgaattatattttcatcataatttagtgttcaaatatttaatttccacttgccaagaaaaatccatgttccttttctaatttttattaaaaataatatttccaggccgagcacagtggctcaagcctgtaatccaagcactytgggaggccgaggcgggtggatcacgaggtcaggggatcgagaccatcctggctaacacagcgaaaccctgtctctattaaaaatacaaaaagttagctgggcgtcccaactactcgggaggctgaggcaggagaattgcttgaacctgggaggcagaggttgcagtgagccgagatggtgccaccaccactccagcctgggcgacagagtgagactctgtctgaaaaaataataatatttccaatcaggacttatttttcttcatatgttggtgtgtgtatatgtgggcatgcctatgc

SEQ ID NO: 138140 - DNA, 601 bp, Human
ccttatggactctatgaactatgagatttaaataaccttattttattatgtgctttatttaaaatttaaagagatcaagtcctaaaaatatagttaaagcaaaccccacaaccaacacaaagggagggttgtaatgcttaccgttttgttatttttttgaatacacaagtctggaaatagcatcctgggaattttatttttctcagtcactggccttcaaatcccacatacttcatttaggcagaaatcaacaaggagtaatctggagtagagtgattgcttctgtggggctaattgtttyattatttgcataacaaaggttcaaagtaattattgctactttgagtctgtatatcacattctcagacatctggatacaaataaaagacttgaatcagcatctagttgcttccaaatatctgtatctttgatgttgtatagacaaaaccttggggcttttggacatggccttaatagggtcacagagtatggagacgcagtgcaaaagggccttcctgtggatgttcttttccctatgtggcatcctctgtagatcagagcagcatttactgctgctactggtatgcagaaaacacatgta

SEQ ID NO: 138141 - DNA, 601 bp, Human
ggatcataatgtttgtttggccgggtacggtggctcacgcctgtaatcccagcactttgggaggccaaggtgggcggattacttgaggtcaggagttcaagtccagcctgtccaacatagtgaaaccgtgtctctataaaaaatacaaaaattagccaggcatggtggagtgcacctatagtcccagctacttgggaggctgcgacaggagaatcgtttgaacccaggaggtggaagttacaatgagccaagatccagccactgcactccagcctggacgacagagccaaacaccatgccaaaataataataatatttgttttttgtcacttgatagttgttaggaatgaatgaaataatgggtataaaatccattttttaaaaaaggatattacaaatggaaattattaacaaaacagtttagttatagctatagcattagatggaatgcttaggggaaccaggtgagaatttttagcagattattatgtcactcattaactgattttttttaatggcgtcttgctctaattatatggttttattttgggggtaaatgagaaactacgtcagtgtaccagtgattggtaagaaggtcaca

SEQ ID NO: 138142 - DNA, 601 bp, Human
atcataatgtttgtttggccgggtacggtggctcacgcctgtaatcccagcactttgggaggccaaggtgggcggattacttgaggtcaggagttcaagtccagcctgtccaacatagtgaaaccgtgtctctataaaaaatacaaaaattagccaggcatggtggagtgcacctatagtcccagctacttgggaggctgcgacaggagaatcgtttgaacccaggaggtggaagttacaatgagccaagatccagccactgcactccagcctggacgacagagccaaacaccatgccaatataataataatatttgttttttgtcacttgatagttgttaggaatgaatgaaataatgggtataaaatccattttttaaaaaaggatattacaaatggaaattattaacaaaacagtttagttatagctatagcattagatggaatgcttaggggaaccaggtgagaatttttagcagattattatgtcactcattaactgattttttttaatggcgtcttgctctaattatatggttttattttgggggtaaatgagaaactacgtcagtgtaccagtgattggtaagaaggtcacaaa

SEQ ID NO: 138143 - DNA, 601 bp, Human
actagaccggaccccatagttgtgggtctaggcctgtctctgctcctcttacctgtgtgtgctcaaactagtcacttctgtttgggcttcagtttctcatcctcaaagtgaggaaattgcacgaggagctctcccaacactcccaaatctaattcagttactaagttccaatagatatttggtgtcatggtaaggcacaggcattctgcagccagattacctagctttaaatcccacctctgttaccactagccatgtgggaaaattacttaaggtttctgtgtctcagttattccctctrtgaaactggaataataatacttcctatgtcataggattgatgtgagtattaaattagacaaatcatgtaaatcactaagaagagtgcctggcctgggacatcaaacattttctagaagttcttattcattatttctctccagttttagttaggtccctatatgtatattcacagtcaacactgaaaacccccagccctctgagatgatctctaattttattattttaataaatattttataataaaagtatttctctgttttaacaaacacttgaaaccattcgatttaaatctaccact

SEQ ID NO: 138144 - DNA, 601 bp, Human
aattattttctctccaggatatataacatatcatccaataataaagtgtaacaaattaggtttcctattcaggtcttttggtgttagggttggtatcattactgtgataacagcagcatctctgtagagctatgaatgcctatgtgagtgtttacaataaaaacataaattctataaactgaggccttgcttgtgctaattcagctttgcacgaagtgtgattctgaactgatttaatatcttggggtagtgtgaatattacatatttatattgtatatattacctgcataacttagaatmagaaaataactgcttttttcttttctttttttttttttttttttttttttacaaattatctcagtttttgtttgttttggaagaaggggagcaaggaacatatggaaataatgaataattttatattttctctcgctcattgtaacctccagaaaatattataaatggtttaattctgccacacagataaagtatgtaaaataaagagtttaggaataattctgctttgaggttaacgtgaaagaaacaaaaataaaactaaattaaattatcatatatacaaatgtatgcaggaaatga

SEQ ID NO: 138145 - DNA, 601 bp, Human
catatcatccaataataaagtgtaacaaattaggtttcctattcaggtcttttggtgttagggttggtatcattactgtgataacagcagcatctctgtagagctatgaatgcctatgtgagtgtttacaataaaaacataaattctataaactgaggccttgcttgtgctaattcagctttgcacgaagtgtgattctgaactgatttaatatcttggggtagtgtgaatattacatatttatattgtatatattacctgcataacttagaataagaaaataactgcttttttcttttctttttttttttttttttttttttttacaaattatctcagtttttgtttgttttggaagaaggggagcaaggaacatatggaaataatgaataattttatattttctctcgctcattgtaacctccagaaaatattataaatggtttaattctgccacacagataaagtatgtaaaataaagagtttaggaataattctgctttgaggttaacgtgaaagaaacaaaaataaaactaaattaaattatcatatatacaaatgtatgcaggaaatgaattgatagtagccacctgtttttaca

SEQ ID NO: 138146 - DNA, 601 bp, Human
atattgtccatgagttgcattcttaaaaaggagacatattgaagagctaattaataaacacagaggcagtaaaattcatattcatggagtcctaggaggagatgtttggagatggacagagccttggagattatccaattcaatctcctcatttacagatgagaatactgagaccaggggcaaaaatctcacagtcatctgtgagatcttctaactcccagcccaactcctagtctttacatcacagcacacagactttgatcttaaaatatataaaaattaattaagcgccttggaaaayagcaaaggctgtaaagataggagtgttgctcttgctgtgggatggccaggacgtgttttttactgttctcacagggttacttgaaagaatacttcatagattacaatggcacaaatgtgcaaatgattgcaaaacactttacagcttttaaactgcatgaaagtaataataacctaaatatcctaatgtatcctttactacattcttaaagctaaataaataaaaacagtaacttgagagaaaaaatgttacattttcctggataaaatttagacatgcatgttttgcaggatctagggc

SEQ ID NO: 138147 - DNA, 601 bp, Human
gattatgttgtggatagttttaatatatcaatcattcttttaatagtatttatagatatcaatttattatgttcaattgaaaatattatcatagaagaaagctcaaaacagtgaaaattcagttagagcctttccatagactatggagaggtgagaaccatgaagaataaatcaaactaaatgaagccctgaacattctattgaaaggttgaaggctggggaagaaaatgcagaccttttctcagaccttctgatgattcatctctaaatgacgctcttttggtccctaaacttgcatcctttttttttttttttttgaggaataaaatgtattttatttttatataaggaaaaagcattgttgtggtgagaggtacatctagattgtttcccagatggtactggaagcaggttttgtcagttctgcagtctcttgccatggcaactgccatgtatttctctgaataagtatgaaaatcagttcagaagaacactttgaaaaatcactactttcccacccttaaaacaaggggttatgctgaggcagtgaattatagcaaactatataagaggaaacactgttctgtggctgagaagagaa

SEQ ID NO: 138148 - DNA, 601 bp, Human
ataatctcaataaactatagtgaatgggagccactgaaattcttggtcgcatcttatttttaaaatacccaaattgcctaactgctctgtggacctgttaatttctttaatactaaatctttaagactccctcactgaaaagaattataaaaatatgtaaaactctaaagagttgggcccattttgctatgttaataagttgaggaattataccacttctttcactgtattctctattcctttcagaaagacagatattccttttgaactaacgcctaatgcctaagatttagttcctggsgtaaaaggaataccatagtaaattttttatatgaagactcttaattttgtaaatgtgtttgatactctataaaaacaatttaaatgaactgtatggtgagaaacatattgctgcctattaataaatacctcccacacccacatgagaaaggaagaacagttaggagtgagctaataagtttctcatatgcagagcttctcctaggaaaagttatatagtaagagacataattcctgggtccccagaatctctatttttttccttcacctgctttgtaagacagtgttatagtttttgatg

SEQ ID NO: 138149 - DNA, 601 bp, Human
tataataaccttatttgaacccactatttaggaccacgagaggggagatttttaaaaaacagttaattccaaagatgtgacaatttaggacagaaataaaaatgtgaaagtggcctctcaaaatgtggaatcaatagtgtcaactgcaggatcacagcactactatttttttatgcttattcaattcacccacaactgtagtcattgtgtgtattagtctgttctcatgctgccaataaagacatatccaagactgggtaatttataaataaaaagaggtttaatggactcacagttttaygtggctggggagtctcacaatcatggtggaaggtgaaggaggagcaaaagtatgtcttatgtggtggcaggcaagagagcttgtttaggagaattcccatttataaaaccatcagatctcttaggacttgttcactaccacaggaatagtgaggggacaaccactcccatgattcaattatctacacctggctccacccttgacacatagggattattacaattcaaggtgacatttgggtggggacacaaaccatatcattgtgccatgaattttatttacattaacttactcattctc

SEQ ID NO: 138150 - DNA, 601 bp, Human
tggacattagtgtccttctttacaaaatgatatggtttggctctgtgtccccacccaaatactatctcaaattataatctccacatctccacatgtcaagggagggacctagtgggaggtgattggatcatggggacagtttcctccatgctgttctcatgagagccagtgagtttccatgagatctgatagtttaaaagtgtttggtggttccccctggcagccttatgaagtcttatgaagaacgtacttgtttctccttcaccttctgccatgattgtaagtttcctggagcctcccyagccatatggaactgtaagtcaattaagcctcttttcttcataaattacctagtctcaggcagttctctatagcagtgtggaaacagactaataagcaaaataaagtttagaatggttgactaacttggtcacagaagtaaggaaaaaactgggtctcattgttttgacttctaaacagtgctcctaccctattaacaaagacgtttcctaactcatgacaaaagaaaaaaaaaagaactatcaatgttatacctaatatataaataacataccagaggatcttgtatctcatgaaaggg

SEQ ID NO: 138151 - DNA, 601 bp, Human
tatgaagtcttatgaagaacgtacttgtttctccttcaccttctgccatgattgtaagtttcctggagcctccctagccatatggaactgtaagtcaattaagcctcttttcttcataaattacctagtctcaggcagttctctatagcagtgtggaaacagactaataagcaaaataaagtttagaatggttgactaacttggtcacagaagtaaggaaaaaactgggtctcattgttttgacttctaaacagtgctcctaccctattaacaaagacgtttcctaactcatgacaaaagaaaaaaaaaagaactatcaatgttatacctaatatataaataacataccagaggatcttgtatctcatgaaagggtgtcaaatcattaatgcagcccaagatataagaatcaaattactccatttcttcccccacataatgaattatttattcaaattttgtgttgatttcccttgtttctgtgatccccaaagcctaaataaggtctctgggtaaacatctaagaattgatttcaggtgggcagatggcatcatctcaaatcttgactcttccaaaaattaattaattggccttggaaaa

SEQ ID NO: 138152 - DNA, 601 bp, Human
aagaatgcatgaatttatcacagccacaaaacaggacctaattttgaaatttctttacaccatagggtataatagctttaaaactgtgataccttattggccattacaagaaaggttaggacaggagctatacttcatttttgtcacagactgtatacttcaggaaaaattaacttttccatgtttagcaattcttacccctacatatgagggaatactaaacacaataggttaccattttcaccttcataggtgcagttaccttttctattattttttctatgaaaagaaatgatattgygatttcatctgcagagaatggaaaagctaggaaaagagctggctcatttttctttttcatactgtctctaaaaggttcctgaatccgacaggtagatagtttctttccattcctttagttccccaaaacatcttcttccttctgtttgtgaccttgagaaagtctttgagagaatgagggaggataaattttcagtagaatctgcttatcctggaaacacatgtactattttgggaataggactgggcttacatttaactaatctcattcaagtattatttggaagtgattggggtaaaa

SEQ ID NO: 138153 - DNA, 601 bp, Human
catatgtggagaataggtattcaaaatttatttcaaatatattgcttcattttataattttgaaaggatctatgtttaataagagatgctattgttttagagtgtgcttctttcaaatagaagaccgtttataagtacattgagttctatatatatataattctctataatgtttctgatattatgtacttgggctataaataattatagtcattagatgaactcagtaatattttagtataacacatgtatacataatagggttgccatttgaaagttctcacataaatgtatataactrtatggttaaaataagctttataaaatgcacaactattcctatactaatttggagttccacttgaattaaataattctatctacttttgtttactgccaatctaaaataaggggtataaatttgagtagtgctatcttggcccaagttatgggatattgatgtttcaattgaaatctgctgcttggagtgatggatattgaggaaaatgtaaaccaaggtcagggctcaataattcatttggttttcaaggaatataaaacaagaattgtcccaattgtgaagtacaataatggtggggca

SEQ ID NO: 138154 - DNA, 601 bp, Human
gggggtgacttgtgtatcaatatttctacagattaaaaaaatgtgtcagtacatcatcctggcttgtaacatacacaaagataaaatattatgaggcttcatgaggtggtgtgagtgtgttttcttatctacataaggaaaatcacctgattctcacatgtccatatattttgttcctagtaaatcacccaaggatggatatcaggagaatatctctggaaaatacatacaaactgtttattcaacttctgataggtgagtatgtctttatttccatacataaaaagtacacacatacagacacacacacacatatatatatatacacacacacacaggcacacacacatatatataaatatatatacatatatataaatatatatacatatataaacatatatacatatataaacatatacatatataaacatatatacatatataaacatatatacatatataaatatatatacatatataaataaatatatatatatatatttcttgctgttctttgtacttggagatggttctgctgatgtttcttgtcatgtatgtgcatgggcagaccaaagtgcaactcagtaacaacttctgc

SEQ ID NO: 138155 - DNA, 601 bp, Human
tgtatcaatatttctacagattaaaaaaatgtgtcagtacatcatcctggcttgtaacatacacaaagataaaatattatgaggcttcatgaggtggtgtgagtgtgttttcttatctacataaggaaaatcacctgattctcacatgtccatatattttgttcctagtaaatcacccaaggatggatatcaggagaatatctctggaaaatacatacaaactgtttattcaacttctgataggtgagtatgtctttatttccatacataaaaagtacacacatacagacacacacacacttatatatatatacacacacacacaggcacacacacatatatataaatatatatacatatatataaatatatatacatatataaacatatatacatatataaacatatacatatataaacatatatacatatataaacatatatacatatataaatatatatacatatataaataaatatatatatatatatttcttgctgttctttgtacttggagatggttctgctgatgtttcttgtcatgtatgtgcatgggcagaccaaagtgcaactcagtaacaacttctgcatccaggaattt

SEQ ID NO: 138156 - DNA, 601 bp, Human
ctacagattaaaaaaatgtgtcagtacatcatcctggcttgtaacatacacaaagataaaatattatgaggcttcatgaggtggtgtgagtgtgttttcttatctacataaggaaaatcacctgattctcacatgtccatatattttgttcctagtaaatcacccaaggatggatatcaggagaatatctctggaaaatacatacaaactgtttattcaacttctgataggtgagtatgtctttatttccatacataaaaagtacacacatacagacacacacacacatatatatatatayacacacacacaggcacacacacatatatataaatatatatacatatatataaatatatatacatatataaacatatatacatatataaacatatacatatataaacatatatacatatataaacatatatacatatataaatatatatacatatataaataaatatatatatatatatttcttgctgttctttgtacttggagatggttctgctgatgtttcttgtcatgtatgtgcatgggcagaccaaagtgcaactcagtaacaacttctgcatccaggaatttgtttcttggcttc

SEQ ID NO: 138157 - DNA, 601 bp, Human
gtgttttcttatctacataaggaaaatcacctgattctcacatgtccatatattttgttcctagtaaatcacccaaggatggatatcaggagaatatctctggaaaatacatacaaactgtttattcaacttctgataggtgagtatgtctttatttccatacataaaaagtacacacatacagacacacacacacatatatatatatacacacacacacaggcacacacacatatatataaatatatatacatatatataaatatatatacatatataaacatatatacatatataaacttatacatatataaacatatatacatatataaacatatatacatatataaatatatatacatatataaataaatatatatatatatatttcttgctgttctttgtacttggagatggttctgctgatgtttcttgtcatgtatgtgcatgggcagaccaaagtgcaactcagtaacaacttctgcatccaggaatttgtttcttggcttcctggctgttgctgctgtctgattttgatgcatattatcaaaagacctttctgtgccttacagctgcctcccaggccagcccctctgctgct

SEQ ID NO: 138158 - DNA, 601 bp, Human
tggatatcaggagaatatctctggaaaatacatacaaactgtttattcaacttctgataggtgagtatgtctttatttccatacataaaaagtacacacatacagacacacacacacatatatatatatacacacacacacaggcacacacacatatatataaatatatatacatatatataaatatatatacatatataaacatatatacatatataaacatatacatatataaacatatatacatatataaacatatatacatatataaatatatatacatatataaataaatatatayatatatatttcttgctgttctttgtacttggagatggttctgctgatgtttcttgtcatgtatgtgcatgggcagaccaaagtgcaactcagtaacaacttctgcatccaggaatttgtttcttggcttcctggctgttgctgctgtctgattttgatgcatattatcaaaagacctttctgtgccttacagctgcctcccaggccagcccctctgctgctggtgatccccaggaggccccaggactgccacattattagcgtttaggcttcattgcatccatagactgtgccatcaatc

SEQ ID NO: 138159 - DNA, 601 bp, Human
aactatgggccaaatatatggtttctttctagtgcaacattctacggttgatacaaatgatcaaatccagtcaaagaatgcaatactttgtcaattgattgcttctattcctattactttcaaaaagtgacacatagcaatcagaaatatagtaactcattttgagcaaaacattccaattttagggcataatgtacagaattctatataaaaatataatctccaggttgtataattagttatgagaacaaagttttttatttatgaaatatattcaattaaacaaaacttagtctatagwtttttattgaaaattactatgcagaaaaatttaaacaagaatattctcctgatcattgcttttggtaaatagaaatattttcatttattacattttagatcacttatttctattttcaatgtaatttcaataaaatattaccgagaataaaaacaaacatgttcacactcttagaaaaatactgattgttctatagccatagcaatacagagccacatgaactggtttagacacaaccaattaatcaatgacagtttacttcagtaaatttgcttctgaaagccaaccaatcagtgacag

SEQ ID NO: 138160 - DNA, 601 bp, Human
tctgttgtgaccaccaggcttgtggtgggtggaccctcagctcttcctgtgagcaactttgtgctaaagaaagagcactggagccgggcgtggtggcttacgcctgtaatcccagcactttgggaggccaaggcgggcggatcaggagttcaagaccagcctggccaacatggtgaaaccctgtctctactaaaaatacaaaaattagacgggcgtggtggtgggcacctgtaatcccagttactcgggaggttaaggcacgagaattacttgaacccaggaggtggaggttgcagtgagyggagatgacgccgctgcaaaaaaaaaaaaaaaaaaaggagaaaaaaaacagaaagagcactggacttggagtctaaacacaggttctactcccgactcacctgtgactgagggcaagaatgctttcttctcagagactcggtgtccccttttgtaaaatgaggctcattctgtccttccccaagggcttcagggaaactccagttagagcagtgaggtgctaggtaaactctgaggggcaccctaaccgccgtgtgaggtcaggaggtctgaattctctcatcccctctccccaggacaa

SEQ ID NO: 138161 - DNA, 601 bp, Human
cttgtggtgggtggaccctcagctcttcctgtgagcaactttgtgctaaagaaagagcactggagccgggcgtggtggcttacgcctgtaatcccagcactttgggaggccaaggcgggcggatcaggagttcaagaccagcctggccaacatggtgaaaccctgtctctactaaaaatacaaaaattagacgggcgtggtggtgggcacctgtaatcccagttactcgggaggttaaggcacgagaattacttgaacccaggaggtggaggttgcagtgagtggagatgacgccgctgcaaaaaaaaaaaaaaaaaaaggagaaaaaaaacagaaagagcactggacttggagtctaaacacaggttctactcccgactcacctgtgactgagggcaagaatgctttcttctcagagactcggtgtccccttttgtaaaatgaggctcattctgtccttccccaagggcttcagggaaactccagttagagcagtgaggtgctaggtaaactctgaggggcaccctaaccgccgtgtgaggtcaggaggtctgaattctctcatcccctctccccaggacaagggcacacaactggttcc

SEQ ID NO: 138162 - DNA, 601 bp, Human
ctcttcctgtgagcaactttgtgctaaagaaagagcactggagccgggcgtggtggcttacgcctgtaatcccagcactttgggaggccaaggcgggcggatcaggagttcaagaccagcctggccaacatggtgaaaccctgtctctactaaaaatacaaaaattagacgggcgtggtggtgggcacctgtaatcccagttactcgggaggttaaggcacgagaattacttgaacccaggaggtggaggttgcagtgagtggagatgacgccgctgcaaaaaaaaaaaaaaaaaaaggaraaaaaaaacagaaagagcactggacttggagtctaaacacaggttctactcccgactcacctgtgactgagggcaagaatgctttcttctcagagactcggtgtccccttttgtaaaatgaggctcattctgtccttccccaagggcttcagggaaactccagttagagcagtgaggtgctaggtaaactctgaggggcaccctaaccgccgtgtgaggtcaggaggtctgaattctctcatcccctctccccaggacaagggcacacaactggttccgttaagcccctctctcgctcag

SEQ ID NO: 138163 - DNA, 601 bp, Human; identical to SEQ ID NO: 32258

SEQ ID NO: 138164 - DNA, 601 bp, Human; identical to SEQ ID NO: 32259

SEQ ID NO: 138165 - DNA, 601 bp, Human; identical to SEQ ID NO: 32260

SEQ ID NO: 138166 - DNA, 601 bp, Human; identical to SEQ ID NO: 32261

SEQ ID NO: 138167 - DNA, 601 bp, Human
tttttaatgtcataagtttattgacaaacatatctagtatgccatatgagttcaagtttgatccacttccagaggctgtacctcttaaaatgctcttcatatctgttaatggatgaactgaaacatccttatgttttaagtagttgttgtcttactacaagaaagggtgtagcaaatgcagatccaaagtacaaacacatcttagctagtaacgaccacttgttttccactgaaaatggcaaattcttcccagggccctcctcacagtggctcctacggaccacagaggttgtgaacctcyggatgctctggcccaacgtagcgctgctggaagctctgcgaaaggcacagaaaccgaggacggatgaaatggcggcacctcaccaagaccttttttttttcctggattttttttttctttgtttgtagcagttaggattttgcctgttatgatccactttaaattgtgatttccagaaatacagtgaatcaaatgtaagagtgctgaacaactgtatcgttgcatttacatgttctttttgttctcatttatttacattgctcagcctctatacacctagaccaagtcattagatactat

SEQ ID NO: 138168 - DNA, 601 bp, Human; identical to SEQ ID NO: 35541

SEQ ID NO: 138169 - DNA, 601 bp, Human; identical to SEQ ID NO: 35542

SEQ ID NO: 138170 - DNA, 601 bp, Human; identical to SEQ ID NO: 35543

SEQ ID NO: 138171 - DNA, 601 bp, Human; identical to SEQ ID NO: 35544

SEQ ID NO: 138172 - DNA, 601 bp, Human; identical to SEQ ID NO: 35545

SEQ ID NO: 138173 - DNA, 601 bp, Human; identical to SEQ ID NO: 35546

SEQ ID NO: 138174 - DNA, 601 bp, Human; identical to SEQ ID NO: 35547

SEQ ID NO: 138175 - DNA, 601 bp, Human; identical to SEQ ID NO: 35548

SEQ ID NO: 138176 - DNA, 601 bp, Human; identical to SEQ ID NO: 35549

SEQ ID NO: 138177 - DNA, 601 bp, Human; identical to SEQ ID NO: 35550

SEQ ID NO: 138178 - DNA, 601 bp, Human; identical to SEQ ID NO: 35551

SEQ ID NO: 138179 - DNA, 601 bp, Human; identical to SEQ ID NO: 35552

SEQ ID NO: 138180 - DNA, 601 bp, Human; identical to SEQ ID NO: 35553

SEQ ID NO: 138181 - DNA, 601 bp, Human; identical to SEQ ID NO: 35554

SEQ ID NO: 138182 - DNA, 601 bp, Human; identical to SEQ ID NO: 35555

SEQ ID NO: 138183 - DNA, 601 bp, Human; identical to SEQ ID NO: 35556

SEQ ID NO: 138184 - DNA, 601 bp, Human; identical to SEQ ID NO: 35557

SEQ ID NO: 138185 - DNA, 601 bp, Human; identical to SEQ ID NO: 35558

SEQ ID NO: 138186 - DNA, 601 bp, Human; identical to SEQ ID NO: 35559

SEQ ID NO: 138187 - DNA, 601 bp, Human; identical to SEQ ID NO: 35560

SEQ ID NO: 138188 - DNA, 601 bp, Human; identical to SEQ ID NO: 35561

SEQ ID NO: 138189 - DNA, 601 bp, Human; identical to SEQ ID NO: 35562

SEQ ID NO: 138190 - DNA, 601 bp, Human; identical to SEQ ID NO: 35563

SEQ ID NO: 138191 - DNA, 601 bp, Human; identical to SEQ ID NO: 35564

SEQ ID NO: 138192 - DNA, 601 bp, Human; identical to SEQ ID NO: 35565

SEQ ID NO: 138193 - DNA, 601 bp, Human; identical to SEQ ID NO: 35566

SEQ ID NO: 138194 - DNA, 601 bp, Human; identical to SEQ ID NO: 35567

SEQ ID NO: 138195 - DNA, 601 bp, Human; identical to SEQ ID NO: 35568

SEQ ID NO: 138196 - DNA, 601 bp, Human; identical to SEQ ID NO: 35569

SEQ ID NO: 138197 - DNA, 601 bp, Human
cacttgggaaaccctgagccaccatgcctcagggaaagtggtggcacttcctggtggcaccaggaatcgcacaaggccatcactgccgcctggtgcacagggctcccgcggctggcatctccagagcctggaggaagagggtagaggaaggtagcaccggctgcagcaggcctggctgcttcgctctgcacacccccactttcactttctgggtatgactacttcggagtgtagggcaggcactgtttgcaagtcccgtccttcattcaaagctcactcacttccgaagcaggcgcgagcygttgtcaaaggaaagtaattactctactttctaaaaacaaaacaaaaataaaaatggagtgactgcccactcggagaaagcttttgaaatccctcctccccggatgtcccaacggcagggctcaggctggagctgctcccacagtctttccaggcacccggtgccctgctgaggcaccgggcctctgaggctacccggaaggtcagaaagaaatgcccctcgctcgcctgcagcccgtcctgttacagcgtgtgccttatctttcatgatcagtaaccaccagcacccatcaaggcctca

SEQ ID NO: 138198 - DNA, 601 bp, Human
aggctgaagcaggagaattgctagaacccgggaggtagaggttacagtgggctgagatcgtgccactgcactccagcctgggcaacaatgcgagactccatctcaagaggagaagagaaaaaaaaaaaaaaaggaacctgcctaggacaggaaccccgtcaggtcagttatactttgatgaccggtcaaggaagcaagaggaggatcctctgaccaactgcgttaactgctttgaaaaccaagagacccgcagcacgacttcaggcatgcccccacctcccaggcagcaacgctgggaagrgtaggccccggttccccataccccgccccggtaccgtgtgtatccacagcaaaacatggctcttcccatcgacaactgggcatagctgttggttttgtgccaatcaccccacttgggaaaccctgagccaccatgcctcagggaaagtggtggcacttcctggtggcaccaggaatcgcacaaggccatcactgccgcctggtgcacagggctcccgcggctggcatctccagagcctggaggaagagggtagaggaaggtagcaccggctgcagcaggcctggctgcttcgctctgcac

SEQ ID NO: 138199 - DNA, 601 bp, Human
cctgtaatcccagcactttgggaggccaaggcaggtggatcacgaggtgaggagttcgagaccagcctgtccaacacagtgaaaccctgtctctactaaaaatacaaaaaattagctgggcgtggtggcggacgcctgtaatcccagctacttgggaggctgaagcaggagaattgctagaacccgggaggtagaggttacagtgggctgagatcgtgccactgcactccagcctgggcaacaatgcgagactccatctcaagaggagaagagaaaaaaaaaaaaaaaggaacctgcctargacaggaaccccgtcaggtcagttatactttgatgaccggtcaaggaagcaagaggaggatcctctgaccaactgcgttaactgctttgaaaaccaagagacccgcagcacgacttcaggcatgcccccacctcccaggcagcaacgctgggaagagtaggccccggttccccataccccgccccggtaccgtgtgtatccacagcaaaacatggctcttcccatcgacaactgggcatagctgttggttttgtgccaatcaccccacttgggaaaccctgagccaccatgcctcaggga

SEQ ID NO: 138200 - DNA, 601 bp, Human
cctgctggctaggcacggtggctcatgcctgtaatcccagcactttgggaggccaaggcaggtggatcacgaggtgaggagttcgagaccagcctgtccaacacagtgaaaccctgtctctactaaaaatacaaaaaattagctgggcgtggtggcggacgcctgtaatcccagctacttgggaggctgaagcaggagaattgctagaacccgggaggtagaggttacagtgggctgagatcgtgccactgcactccagcctgggcaacaatgcgagactccatctcaagaggagaagagaaaaaaaaaaaaaaaggaacctgcctaggacaggaaccccgtcaggtcagttatactttgatgaccggtcaaggaagcaagaggaggatcctctgaccaactgcgttaactgctttgaaaaccaagagacccgcagcacgacttcaggcatgcccccacctcccaggcagcaacgctgggaagagtaggccccggttccccataccccgccccggtaccgtgtgtatccacagcaaaacatggctcttcccatcgacaactgggcatagctgttggttttgtgccaatcaccccacttggg

SEQ ID NO: 138201 - DNA, 601 bp, Human
attcatccagttaccttctagcttcaaccagatactggcttcgtgatataagggacctgctggctaggcacggtggctcatgcctgtaatcccagcactttgggaggccaaggcaggtggatcacgaggtgaggagttcgagaccagcctgtccaacacagtgaaaccctgtctctactaaaaatacaaaaaattagctgggcgtggtggcggacgcctgtaatcccagctacttgggaggctgaagcaggagaattgctagaacccgggaggtagaggttacagtgggctgagatcgtgscactgcactccagcctgggcaacaatgcgagactccatctcaagaggagaagagaaaaaaaaaaaaaaaggaacctgcctaggacaggaaccccgtcaggtcagttatactttgatgaccggtcaaggaagcaagaggaggatcctctgaccaactgcgttaactgctttgaaaaccaagagacccgcagcacgacttcaggcatgcccccacctcccaggcagcaacgctgggaagagtaggccccggttccccataccccgccccggtaccgtgtgtatccacagcaaaacatggctc

SEQ ID NO: 138202 - DNA, 601 bp, Human
aacaaacaaataagcaagccctcaagcctctcagatggcaggagcccaggaaccagagcagggaggcccgggcacaggggcccatgatgtctgtgcccatgatttcacaggaaggagaataggcaaagaaaaccctatgctccgccaccagctgggcacctctacaaggtggcagtaccaacaaaaacacaggagcaaggccattcttggcaaacgctgacccaaatgcacctggcaccccatcatgctttgctacctgtgcatctcttctgctccaacaagggggcggagccacaggggycgggaaggcccaaggcagacccgcaagttccaaaaccttttacggcaagaagccttgcattctaccatgattcatccagttaccttctagcttcaaccagatactggcttcgtgatataagggacctgctggctaggcacggtggctcatgcctgtaatcccagcactttgggaggccaaggcaggtggatcacgaggtgaggagttcgagaccagcctgtccaacacagtgaaaccctgtctctactaaaaatacaaaaaattagctgggcgtggtggcggacgcctgtaatcccagct

SEQ ID NO: 138203 - DNA, 601 bp, Human
ccagccacacgcacaggtcctggctccactgcgagctcaatcaggagtggccagaagacttacaatttaaaccaccaacaggtgaatggcccaaagtgacactttctctttaaaagagctctcggtcaggcatggtggctcacacctgtaatctcagcactttgggaggctgagatgggtggatcacctgaggtcaggagttcaagaccagcccggccaacatggcgaaaccccatctttactaaaaaataaaaaaaaattaaaaaaaatagccaggcgtggtggcgggcacctgtaatcycagctacttggcaggctgagccagggagaattgcttgaacccaggaggtggaggttgcagtgaagggaaatcatgccattacacaccagcctgggcaacagagtgatactctgtctcaaaataagtaaataaataaatgagctctcaagcatcttggccgagcatggtggctcacgcttgtaatcccagcacttcaggaggcagagacgggtgggtcactcacggccaagagtttgagaccagcctggccaacatggtgaaacgccatctctactaaaaatacaaacaaacaaacaaata

SEQ ID NO: 138204 - DNA, 601 bp, Human
ggtgcgagacgcagacagccaacagcacggacacaacagggtccgagcctccagccacacgcacaggtcctggctccactgcgagctcaatcaggagtggccagaagacttacaatttaaaccaccaacaggtgaatggcccaaagtgacactttctctttaaaagagctctcggtcaggcatggtggctcacacctgtaatctcagcactttgggaggctgagatgggtggatcacctgaggtcaggagttcaagaccagcccggccaacatggcgaaaccccatctttactaaaaaatwaaaaaaaattaaaaaaaatagccaggcgtggtggcgggcacctgtaatctcagctacttggcaggctgagccagggagaattgcttgaacccaggaggtggaggttgcagtgaagggaaatcatgccattacacaccagcctgggcaacagagtgatactctgtctcaaaataagtaaataaataaatgagctctcaagcatcttggccgagcatggtggctcacgcttgtaatcccagcacttcaggaggcagagacgggtgggtcactcacggccaagagtttgagaccagcctggcc

SEQ ID NO: 138205 - DNA, 601 bp, Human
tgcagctggttatcaagccacactcagaaagatccagccggcgactcctgaacatcactgcaccctcagcgggacacttttccaagtggctggaaaagttgtctcccacaataccggattaacttctgacgaactcagtaccttgggggcctgcggcaaggaggggggcgggggcatgttccacgccccatcttcccaacaccaggctccgaaggccctgtgaggaggcagcctgcgaactgactctcagggaacagccacagactggtgcgagacgcagacagccaacagcacggacacracagggtccgagcctccagccacacgcacaggtcctggctccactgcgagctcaatcaggagtggccagaagacttacaatttaaaccaccaacaggtgaatggcccaaagtgacactttctctttaaaagagctctcggtcaggcatggtggctcacacctgtaatctcagcactttgggaggctgagatgggtggatcacctgaggtcaggagttcaagaccagcccggccaacatggcgaaaccccatctttactaaaaaataaaaaaaaattaaaaaaaatagccaggcgtggtgg

SEQ ID NO: 138206 - DNA, 601 bp, Human
gtcagtgctcacacggaggctaaggccgtcccgccccagagtcccacagctcccaggtaccgactcttagtcccaggtcctcacaggtgcactgagggcactccctctgccccagactccaggcctggccagcagccgcctctgcagatcacacccgagtccactgggtgctttgcaaaatgctgcagctggttatcaagccacactcagaaagatccagccggcgactcctgaacatcactgcaccctcagcgggacacttttccaagtggctggaaaagttgtctcccacaataccggrttaacttctgacgaactcagtaccttgggggcctgcggcaaggaggggggcgggggcatgttccacgccccatcttcccaacaccaggctccgaaggccctgtgaggaggcagcctgcgaactgactctcagggaacagccacagactggtgcgagacgcagacagccaacagcacggacacaacagggtccgagcctccagccacacgcacaggtcctggctccactgcgagctcaatcaggagtggccagaagacttacaatttaaaccaccaacaggtgaatggcccaaagtgacac

SEQ ID NO: 138207 - DNA, 601 bp, Human
aacaaagctgcggcaggcccacctagcatccatctgtctgctccatctcctctcagccggcctgacaagaaccaaactcacaaaacaccccggccccaggagacaggcctggcctcactgctgtcccactcagccatgccgagccaggacaaggggccagcagggccgcagctctcagaccatccccttggttatttcgtctatgttctctgctcacccccaaccacaaatgccgaggactgcaggacgcccccaggcctgttgccgggacagaccggaggcagagctaagagcaaagcgygggcatgcagcacatctgtctgtgagtccacagcccacggagccaccgtgcttgacccttgcctcctacccagcccctggtaccagcgagggcctggtcagcatacccagggctctgtcctgtggtgtgggcagatgggggcgggtggcaccctggacccgcaggctcacacagctgcccctttgcacattttgctccttgtgggattgtcaggccaaggctccagtgacgcatggcacagggagggcatcctctcagccgcttacagtagattcttccttctgccacatgacaggttat

SEQ ID NO: 138208 - DNA, 601 bp, Human
aagacctcatatgcctcctgctttctgaacccagggcctgtgcttctccatggccccacggccctgggtgagcggcctctctgaaggtttcccttcctgccatgacgcccccacagccttctggccacaacccgtcacctcttccaagctccgtccctacccgcctctctacccactcctcgaatagagaggactcaaaggacgctctacccccgtgggaccctcatgaggcgcgtgaggaggcccgaccctccacacatgctgggaacgaggaagttggccccacagacactggtcaggycctcccaaccccaggccaccgccacgtagtcagggtctcccacgggtctgggaagggcaggagagccacgactcaggcaggggactctcttcagaggggcagtgagtgaggacagcacctggccctttagagggaaggagacaccgtgctcttagagggacacagcctcagggtcaggccctggtgctccgcacttcctaaaacaaagctgcggcaggcccacctagcatccatctgtctgctccatctcctctcagccggcctgacaagaaccaaactcacaaaacaccccggccccag

SEQ ID NO: 138209 - DNA, 601 bp, Human
ccagtgccttctagacctaagacctcatatgcctcctgctttctgaacccagggcctgtgcttctccatggccccacggccctgggtgagcggcctctctgaaggtttcccttcctgccatgacgcccccacagccttctggccacaacccgtcacctcttccaagctccgtccctacccgcctctctacccactcctcgaatagagaggactcaaaggacgctctacccccgtgggaccctcatgaggcgcgtgaggaggcccgaccctccacacatgctgggaacgaggaagttggccycacagacactggtcaggccctcccaaccccaggccaccgccacgtagtcagggtctcccacgggtctgggaagggcaggagagccacgactcaggcaggggactctcttcagaggggcagtgagtgaggacagcacctggccctttagagggaaggagacaccgtgctcttagagggacacagcctcagggtcaggccctggtgctccgcacttcctaaaacaaagctgcggcaggcccacctagcatccatctgtctgctccatctcctctcagccggcctgacaagaaccaaactcac

SEQ ID NO: 138210 - DNA, 601 bp, Human
gctgcccccacagccccatctaacccggccaacctagcacctgtccccaggcggccagaggtgcctccccggcccacgtggtgaccagcggccaccctccaggactcgggaaactggatctgtcagggcagggctgccttcagtgacagacggagccaactgcttccttctatggagccaggggagaagtcgggggttgggggccccctgtagccctggaggagccctggggagggcagctgggcatcgtgggccccacccaagaaggcacggccagccctggcgcctactccccaggggratctgcccagtgctgtgagccccccatgcacagcgcacctgctctcctgcagctgcctggccgcctggagggcccggctctacaggcccagccctgtcccggggcgcttcagcagactggtggggctatcctggggcatggccccagacacgctgggcaggtgcagctgccagcgctgcctctcccgtgactgtcccctgcaccccacagttctccccactctgcacccaccagtgccttctagacctaagacctcatatgcctcctgctttctgaacccagggcctgtgcttctccatg

SEQ ID NO: 138211 - DNA, 601 bp, Human
ggagggagctgagtctgtgagaagggatcccagcctgctgcccccacagccccatctaacccggccaacctagcacctgtccccaggcggccagaggtgcctccccggcccacgtggtgaccagcggccaccctccaggactcgggaaactggatctgtcagggcagggctgccttcagtgacagacggagccaactgcttccttctatggagccaggggagaagtcgggggttgggggccccctgtagccctggaggagccctggggagggcagctgggcatcgtgggccccacccaagmaggcacggccagccctggcgcctactccccagggggatctgcccagtgctgtgagccccccatgcacagcgcacctgctctcctgcagctgcctggccgcctggagggcccggctctacaggcccagccctgtcccggggcgcttcagcagactggtggggctatcctggggcatggccccagacacgctgggcaggtgcagctgccagcgctgcctctcccgtgactgtcccctgcaccccacagttctccccactctgcacccaccagtgccttctagacctaagacctcatatgcct

SEQ ID NO: 138212 - DNA, 601 bp, Human
gggggtcagatgagccccatcttccataagtggaggggacgctcagaggtgaaggggcacaacgtcgcccaggcagagaaggccagagccagcttgaacaaagctggacatccatgccagactcaccgccaacaccccacagccccagaattctcgggataatgctgggagcagtgctgtgatcggctgtggcaggagggagctgagtctgtgagaagggatcccagcctgctgcccccacagccccatctaacccggccaacctagcacctgtccccaggcggccagaggtgcctccccrgcccacgtggtgaccagcggccaccctccaggactcgggaaactggatctgtcagggcagggctgccttcagtgacagacggagccaactgcttccttctatggagccaggggagaagtcgggggttgggggccccctgtagccctggaggagccctggggagggcagctgggcatcgtgggccccacccaagaaggcacggccagccctggcgcctactccccagggggatctgcccagtgctgtgagccccccatgcacagcgcacctgctctcctgcagctgcctggccgcctggag

SEQ ID NO: 138213 - DNA, 601 bp, Human
tgcgtcagtgggggtcagatgagccccatcttccataagtggaggggacgctcagaggtgaaggggcacaacgtcgcccaggcagagaaggccagagccagcttgaacaaagctggacatccatgccagactcaccgccaacaccccacagccccagaattctcgggataatgctgggagcagtgctgtgatcggctgtggcaggagggagctgagtctgtgagaagggatcccagcctgctgcccccacagccccatctaacccggccaacctagcacctgtccccaggcggccagaggkgcctccccggcccacgtggtgaccagcggccaccctccaggactcgggaaactggatctgtcagggcagggctgccttcagtgacagacggagccaactgcttccttctatggagccaggggagaagtcgggggttgggggccccctgtagccctggaggagccctggggagggcagctgggcatcgtgggccccacccaagaaggcacggccagccctggcgcctactccccagggggatctgcccagtgctgtgagccccccatgcacagcgcacctgctctcctgcagctgcctggc

SEQ ID NO: 138214 - DNA, 601 bp, Human
ccactcatgccccatccaagagaggctctgtgctggacatggaaggaatgttggtgaggtggcccgaatcctacctatcctcacccttgctgtgtggccccaggcaggcccacctctggccctgaagctgtgggtggccccctgaacccttcccaaggtccctggactctgccttcctctccatagggcacaggaggacctgaatgaaaagcagaaattcagccccctttaggctggcccagcccagaattcatcagaaaagatgctgagtccagggctgtttcagggctgtggacaaacrgggagggaatgggaatctgtccagttgccaccaaagaaaacacccagaaatgccagtagcagtctccctgacccctcctgccattccatggccctcttggggagcagagacccagaggggcaggagcaggcatgtcgcctgggcagcacagcagcctagccttcaggcactccacagagggaggacagaggggtgctgcctccaatgccacaccctggggcaaaccagccaaggggcagcggctggaccatgggggcatctccagcctggcctgggcccagagcaaaaagtccttatttg

SEQ ID NO: 138215 - DNA, 601 bp, Human
cgcagtggctcaggcctgtgaccccagcaccttgggaggggcaggagaatcccctgaaaccaggagttcgagaccagcctgggcaacatagtaaggccctgattctacgaaaatttaaaaaaattagccaggcctggtggtgcacctagaatcccagctattcaggaggctgaggtgggaggatcacttgagcctgggagtttgaggatacagtcagctgtgatcgcactgctgcactccagcctggatgtcagagcaagaccctgacacacacacacacacacacacacacacacacacratctggaatgccatggagatttccaaagtagccagcggggagagggcagtggccaggctcccctaacactgactagcccccttcctgggtcccactcatgccccatccaagagaggctctgtgctggacatggaaggaatgttggtgaggtggcccgaatcctacctatcctcacccttgctgtgtggccccaggcaggcccacctctggccctgaagctgtgggtggccccctgaacccttcccaaggtccctggactctgccttcctctccatagggcacaggaggacctgaatgaaa

SEQ ID NO: 138216 - DNA, 601 bp, Human
accacaaaagtcctcgaacgccaagcgaaaacccagcagtgagtgggtctggtgaaatcctcaagaaagacccaggccatgcgcagtggctcaggcctgtgaccccagcaccttgggaggggcaggagaatcccctgaaaccaggagttcgagaccagcctgggcaacatagtaaggccctgattctacgaaaatttaaaaaaattagccaggcctggtggtgcacctagaatcccagctattcaggaggctgaggtgggaggatcacttgagcctgggagtttgaggatacagtcagctktgatcgcactgctgcactccagcctggatgtcagagcaagaccctgacacacacacacacacacacacacacacacacacgatctggaatgccatggagatttccaaagtagccagcggggagagggcagtggccaggctcccctaacactgactagcccccttcctgggtcccactcatgccccatccaagagaggctctgtgctggacatggaaggaatgttggtgaggtggcccgaatcctacctatcctcacccttgctgtgtggccccaggcaggcccacctctggccctgaagc

SEQ ID NO: 138217 - DNA, 601 bp, Human
gctcagagaccctccctggggtccacctccccgggtctcccactcagctgcccacaaagcccatgctagagagcccacaggcactgcctgccgggcccagcagagacagaggcagaggccacccttgccagtcgggtaaaagtcggagtgagcaggcagcctgccttagacacaagaggatccgaaactgcccagagaggaaactcagacaaaccacaaaagtcctcgaacgccaagcgaaaacccagcagtgagtgggtctggtgaaatcctcaagaaagacccaggccatgcgcagtgrctcaggcctgtgaccccagcaccttgggaggggcaggagaatcccctgaaaccaggagttcgagaccagcctgggcaacatagtaaggccctgattctacgaaaatttaaaaaaattagccaggcctggtggtgcacctagaatcccagctattcaggaggctgaggtgggaggatcacttgagcctgggagtttgaggatacagtcagctgtgatcgcactgctgcactccagcctggatgtcagagcaagaccctgacacacacacacacacacacacacacacacacacgatctgga

SEQ ID NO: 138218 - DNA, 601 bp, Human
gagccagatgtgccactgctgctctcccctgggcactgcaggacagggatggagctctgtctcccagaggagggggcggaggctcagagaccctccctggggtccacctccccgggtctcccactcagctgcccacaaagcccatgctagagagcccacaggcactgcctgccgggcccagcagagacagaggcagaggccacccttgccagtcgggtaaaagtcggagtgagcaggcagcctgccttagacacaagaggatccgaaactgcccagagaggaaactcagacaaaccacaaragtcctcgaacgccaagcgaaaacccagcagtgagtgggtctggtgaaatcctcaagaaagacccaggccatgcgcagtggctcaggcctgtgaccccagcaccttgggaggggcaggagaatcccctgaaaccaggagttcgagaccagcctgggcaacatagtaaggccctgattctacgaaaatttaaaaaaattagccaggcctggtggtgcacctagaatcccagctattcaggaggctgaggtgggaggatcacttgagcctgggagtttgaggatacagtcagctgtgatcgc

SEQ ID NO: 138219 - DNA, 601 bp, Human
tccagggttctgccttgcacccactctccaccttcatgcgatggggaataagccgaggggactcctgtgaggaagtggggcaggggtggggcagatggactcaggtggagtgactcgggctggaggaaggcagtggtgccagagaccccagtgccttaaagtctagacacgagacacacaaaaccttcgtgccgcaatccctccttcacccctcgcagctgccctgcgggaatgtgcagcagaagggggtgtggtctcctgggggtaaacccttgctccttttcttggggaacaggggggycccacaccacagggaccctggacactggaggggctggaagcctgtctgctaaaatgtgaaccgagaagggtctgtgagcatgtacagtgcaggaagaactcatttcaccactcagccctccagtggtgaaggggctcccacacagcctgctggcagccacctcgctccagggggctctttgctgtgcgggcaaggccccctcaggaaggcagcctggccatcagcagcctgtcgcagcagcagcagcagccttgtcctcagcaaacgcactccatccctgggaccatggcagggaagcgg

SEQ ID NO: 138220 - DNA, 601 bp, Human
ggatcacgtctggacaccagggaccagcccctgttacatccctgtcccccccaggccagagcctgaccactccgtgtcacctgcctctactcctgtagtgactgtcaactttttggatttcagaaagccaaaccagcaagggaagccttttcccggggggtagaggtgtctctcctacacacacccctaccccagggtctgagatgacatcccaaatcaaacccggtattctgcagagatacacaaaggttcaaactacagacagccttgtatcagctgtaaaggggggccagattttgctgcaaaagaaaaaacccagtatcccctcgctcagcccactgtgtcaccaagagggagggtgggcggctggccgaagagggctccattttatagtccaggaaggggtggcctgggccccacagctggtggggcagtggcactggatctgaagcaaagctgggcactggaggctgtgccttgggccggtgtgctggcagcgcctgctggaggagccaaggggcactgattcaacactgactgtatttccggaaccagagttagtattgggggtatggtggcgttgtggttacaatctttcaaa

SEQ ID NO: 138221 - DNA, 601 bp, Human
aagaccctgggcttcctgtcccaggctcctcaacctgcaggcggccacacagcaagaagaccctgggaagttaaagaacgaggcgctcctgcttcccccaccctcaacggccagcaaggacacaaaggcagcccagggcagggccagccgccagccacaaggcccctccagaacccaaggtccagtggagactctgaaagggctgattgcagggcccccacggggtccacacaccagacacagaggcccatgcagaaaggcggtaaggggcccccctggggtctgcacacccgacacagargccctgcgagagggaggcatggagcgcccgcggtgtcggcacaccaggattcacagcccggctctccacccccagctgacctcgctgtgaagagatggtttgtgctgagagcttagcaaggccgtcgtctaccgagtgcttcccaccacagcccatgcgcaggcatgagagtcatgcctcccgcaggccacagcttcactcatgcaaggacattctgggggccgggacgtcctagccagtggctagaactgggtgtgaccatgggcccccttggctggggagaaaaggaggtgcccctag

SEQ ID NO: 138222 - DNA, 601 bp, Human
gacggtggtggggtcaccctaccccagcctgcgagtgccccagagggtgcacaagcaggacagccaccctgttgcagagtgtggtgctttcacaccatgttcaccccacctcagccctctggcccagacgtcggtggctcctctgccaggtgaggtgaggtgaggtgaggtgggagcagacagtggagaaacaccacaaacagcacaggtggtcggccagggccacgagcccttcagctcaccgatgccgagaccccacaatccccacaacaaacctgcaaggtcagaataattgcgcacrtgtacggacgactaagctgaggccccttcctccttcacctccggaatgccacctgagcgcaaaggctttgggacacaaagcactcagcagtcggcagtggaggcacagcccaggatcaagaccctgggcttcctgtcccaggctcctcaacctgcaggcggccacacagcaagaagaccctgggaagttaaagaacgaggcgctcctgcttcccccaccctcaacggccagcaaggacacaaaggcagcccagggcagggccagccgccagccacaaggcccctccagaacccaaggtcc

SEQ ID NO: 138223 - DNA, 601 bp, Human
ccctgacagaaggcccaggctgtgctgctgctgcctcccagggcccagatgtcagctcccaggtgtcggtcaggtggggacattcccagtatccactgctgctgcacaggcccagagccaggaaatggggctgaaactgacctttggggatgtgggggtggtcagggcacaaaggaaggctcccaggctgcaggccagcttcctccaagcatgaggatggacggtcacagctcaacatgggggcctgcttatgctgccgtcaggatcccacgcctggccagatcaggccctctaagccacycacttccaaccacctgaccactgtttcaaaccggagactgagaaggagcccagctccagccatggacaccggagtgcatgcctcgtcctgggtggggagggcagccccgcccggccatggactgtgagcttgagcaaggcagaaggaggggcgccccaggctctgcttggcaccagcccacgagccacggcagagccgtccaaggcccagcccagaagccctcttgctgctgccagggaaatcccggccaatgtggttaaagctctggggctgcacctggtgccagcatgtgctcactga

SEQ ID NO: 138224 - DNA, 601 bp, Human
ggcacaggctgtccccagcttagcagcaaattcccaaggccagaggcagtctttccaggatgggggcagcaggagggggacagaggacggcagcagcagaacgtggctcttggggaggcagcagctacgcaccggcaggttcaatttgattgcgtccacgggctggtagaagggccaggcgaactggtgtttccagagcgtcttcaccaccacattctgcatgtactgcagctggttggtcttgcggccgggcttgctggggttggagacctccggggggggtgggttcacagggcccggkgtcgccgggatccccgcgggggcgactgtcgtggcggtggacatcctccggcagctcactcactttctgtcacagcagcggcttggagaggccctggctgcttctacgctccctgagaaagcgcgacgtcccatttccgggcccaaccaggcgacagctgcagaggaggaagcacaacagagaggaaggccagtcaccccggggacccccacctctcccagcctcggcgggctcctgagggcacctgtcgggcctcagcagggcctgctccactcactcacccccattgcccagccaccc

SEQ ID NO: 138225 - DNA, 601 bp, Human
gacctttgccctttggagcagggggtaataattcaacttcctcttggggcatctgggccactttttgtagaaaaattttctctaaagcttgggccattagcactatgtcatctgtgggctgaagacacagagagtccaggtcacgtgtcaggaaaggagctgtgtgcttgcaaaggacattattagttgtagctcaaaaaaatatttaaaatttgttaacagatttggcagcgcaggagagaacaaaatgaatatatgtgtgtgtgtgtgtgtgtgtgtgtgtgtgttgtttgtttgtttktttttttttttttgagatggagtcttgctctgtcacccaggctggagtgcagtggcatgatctcggctcactgcaacctccacctcccgggtttaagtgattctcctgccttagccttccgagtagctgggattacaggtgcctgccaccacacctggctaatttttttgtatttttagtagagacggggtttcaccatgttgcacaggctggtcttgaactcctgagctcaagtgatccgccgacctcggcctcccaaagtgctgggattacaggtgtgagccacggcacccagccagg

SEQ ID NO: 138226 - DNA, 601 bp, Human
cggcttccgacctttgccctttggagcagggggtaataattcaacttcctcttggggcatctgggccactttttgtagaaaaattttctctaaagcttgggccattagcactatgtcatctgtgggctgaagacacagagagtccaggtcacgtgtcaggaaaggagctgtgtgcttgcaaaggacattattagttgtagctcaaaaaaatatttaaaatttgttaacagatttggcagcgcaggagagaacaaaatgaatatatgtgtgtgtgtgtgtgtgtgtgtgtgtgtgttgtttktttgtttttttttttttttttgagatggagtcttgctctgtcacccaggctggagtgcagtggcatgatctcggctcactgcaacctccacctcccgggtttaagtgattctcctgccttagccttccgagtagctgggattacaggtgcctgccaccacacctggctaatttttttgtatttttagtagagacggggtttcaccatgttgcacaggctggtcttgaactcctgagctcaagtgatccgccgacctcggcctcccaaagtgctgggattacaggtgtgagccacggcacc

SEQ ID NO: 138227 - DNA, 601 bp, Human
cgcagccggcttccgacctttgccctttggagcagggggtaataattcaacttcctcttggggcatctgggccactttttgtagaaaaattttctctaaagcttgggccattagcactatgtcatctgtgggctgaagacacagagagtccaggtcacgtgtcaggaaaggagctgtgtgcttgcaaaggacattattagttgtagctcaaaaaaatatttaaaatttgttaacagatttggcagcgcaggagagaacaaaatgaatatatgtgtgtgtgtgtgtgtgtgtgtgtgtgtgttgtttgtttgtttttttttttttttttgagatggagtcttgctctgtcacccaggctggagtgcagtggcatgatctcggctcactgcaacctccacctcccgggtttaagtgattctcctgccttagccttccgagtagctgggattacaggtgcctgccaccacacctggctaatttttttgtatttttagtagagacggggtttcaccatgttgcacaggctggtcttgaactcctgagctcaagtgatccgccgacctcggcctcccaaagtgctgggattacaggtgtgagccac

SEQ ID NO: 138228 - DNA, 601 bp, Human
gagactcaccaggcctcgccagccccaaatcttgcagggagcacccactccctgccaagaccaacagggcccactgagaaaagctcccagccaagtggggagcaggacaggcaggtccccatgctcccatgtggagcccacaggcggggccagcttgggtgctggcacctcacaacgcacccaggtaggtacagctggcaccactctcctgagtgtgagcaggggaggaccgggacccctcccaccctggcttctctcccacaacttccccaccttgaccaagcctttggccagggcttcyggccagagaagctggggttcaagttcagccaggccctcccttaccagctgtgtgaccttcagctccccaggcctaggtctcctcatctgtgtcagtaacaacggcctgagctcccagggcgcagagagaaacactcccaagagccagcactcagggaaaggtgggggccccccgcctgctgctcctgccctgacctcaggaaccctggccgggctcaggtgccccacccatccggactcagggtgctcaccttgacgacaggcggcgtaggagggaccacggggacgatgggtgtggcag

SEQ ID NO: 138229 - DNA, 601 bp, Human
ggcgctgcgggggccagcctggagggtgcgcttctccggcaagcgagaccctgctccccgacagcccccactcagccggcacaagacatcagcacccacggcagagccgcaggacatgggcagagcagggcctgccgcgcggccacgtactttcacggtgctgaggtccatcgggtgcttgatgatgtcgtggtagtcgtgcagctccagggcctcggcatccactggcttgtagaagggccaggcgtaggccgcgtgcttcttggatagcatctccctgaggatgctgtcgcagtagcgyaggtgctccgacagcttgcccttcttgcctgcgtgctggggcacctcgccgtcctccaggtccttcttgggaggcttgatggggcggccaccactctcccgccgggccaccactttggcctgcttggggtctgacaacggcgggggcgactcactccggctggcagtgatggccgacgtcgtgggagtggttgtgtctgctttccgcttcacgccctttttctgcgacagtgaaataaccagtgaaccccggaaaccaggggccccgaagacgcatgtcgctgcagccgcgtttctgggg

SEQ ID NO: 138230 - DNA, 601 bp, Human
ggcgcctgtatccggggcttgagggaagcaaagtgcagctttaaaactttgccaactgtgagagtggcccagctctagggaccccctgacctgatgatacagaatgggaggtaggaatgaaatcaatgaaatcactaaacgggttcgatgggaataaacaacaacagagccacagactccgggacccacaggcagagcacgccttcctcgctgagccttgccagccacagccggcgctgcgggggccagcctggagggtgcgcttctccggcaagcgagaccctgctccccgacagccccsactcagccggcacaagacatcagcacccacggcagagccgcaggacatgggcagagcagggcctgccgcgcggccacgtactttcacggtgctgaggtccatcgggtgcttgatgatgtcgtggtagtcgtgcagctccagggcctcggcatccactggcttgtagaagggccaggcgtaggccgcgtgcttcttggatagcatctccctgaggatgctgtcgcagtagcgtaggtgctccgacagcttgcccttcttgcctgcgtgctggggcacctcgccgtcctccaggtccttctt

SEQ ID NO: 138231 - DNA, 601 bp, Human
gctcagtctacacaaggaaatgtaattttttccctcgaggaagccagtagctgttagccagcttgcgtcttacagaagcaccctggtatcccaggggcctagctggacctaagggactccacgctgtgtccagcggcagctcctgaaccccacaggggtggaggcaacgggggcgtgtcggctgacacccacccacgtttactcggccacacagagaccctacagcaaaacccaccgcaggtcccacctggctctggcaagcagagaactgaggccaaggcctgggtagacagtgccaggyggcaggggtaaggaggggcacacagtcagtccccagagctgggaggtgcaggtggctctgccagggagtggccagaggcaggatcgtcgagggacgcttcaaggtggccactgggaacacactagttggggcaaagagaggtcacgctgtgcccgagggagtgagtttcccatcctgggatggcttcaaggagaggcaccttgtcggggacctcgagggacgacacacgcaagggcaaggcaaatctaccccgaccgctctgtggggtccaggctgcatttgtccaggtgccagtgagat

SEQ ID NO: 138232 - DNA, 601 bp, Human
ccccttccttgtccagagcttcccttcacacaaagcgggtaaatcttcacacgccgccacgccatcagcagccccagggggcgtgaggctgcagcaaagtcagactccaccaacaacagggggcctgctcagtctacacaaggaaatgtaattttttccctcgaggaagccagtagctgttagccagcttgcgtcttacagaagcaccctggtatcccaggggcctagctggacctaagggactccacgctgtgtccagcggcagctcctgaaccccacaggggtggaggcaacgggggcrtgtcggctgacacccacccacgtttactcggccacacagagaccctacagcaaaacccaccgcaggtcccacctggctctggcaagcagagaactgaggccaaggcctgggtagacagtgccaggcggcaggggtaaggaggggcacacagtcagtccccagagctgggaggtgcaggtggctctgccagggagtggccagaggcaggatcgtcgagggacgcttcaaggtggccactgggaacacactagttggggcaaagagaggtcacgctgtgcccgagggagtgagtttcccatc

SEQ ID NO: 138233 - DNA, 601 bp, Human
ccttggccccttccttgtccagagcttcccttcacacaaagcgggtaaatcttcacacgccgccacgccatcagcagccccagggggcgtgaggctgcagcaaagtcagactccaccaacaacagggggcctgctcagtctacacaaggaaatgtaattttttccctcgaggaagccagtagctgttagccagcttgcgtcttacagaagcaccctggtatcccaggggcctagctggacctaagggactccacgctgtgtccagcggcagctcctgaaccccacaggggtggaggcaacrggggcgtgtcggctgacacccacccacgtttactcggccacacagagaccctacagcaaaacccaccgcaggtcccacctggctctggcaagcagagaactgaggccaaggcctgggtagacagtgccaggcggcaggggtaaggaggggcacacagtcagtccccagagctgggaggtgcaggtggctctgccagggagtggccagaggcaggatcgtcgagggacgcttcaaggtggccactgggaacacactagttggggcaaagagaggtcacgctgtgcccgagggagtgagttt

SEQ ID NO: 138234 - DNA, 601 bp, Human
accccacgagatgaactctggagcctcaggagccactgccagctccagggcagtgcctactggcctggccggcaggacaccccagctctctgggacctcgtacgaggaaacccaaagtgaggacatgagagggtgacttgatggcttggcagggagggtctgggactccagagacagatctcctgattggaagaaaaatgcactcaacaagaaatcccaggttcccgtaggcgtcccttggccccttccttgtccagagcttcccttcacacaaagcgggtaaatcttcacacgccgccaygccatcagcagccccagggggcgtgaggctgcagcaaagtcagactccaccaacaacagggggcctgctcagtctacacaaggaaatgtaattttttccctcgaggaagccagtagctgttagccagcttgcgtcttacagaagcaccctggtatcccaggggcctagctggacctaagggactccacgctgtgtccagcggcagctcctgaaccccacaggggtggaggcaacgggggcgtgtcggctgacacccacccacgtttactcggccacacagagaccctacagcaaaaccca

SEQ ID NO: 138235 - DNA, 601 bp, Human
ccacgcccggcctactttattttttgtagggacagggtcctgctctgttgcccaggctggtcttgaacccctgagctcaagtgatcctcccaccctggcctcccaaagtgctgagattacaggggtaagccaccacacccagacttcctatcaaaattgactttggaaagcctttggaccaggacctaggccctccgtcacccctctcagcaaacatccccctccctggggcagcccaggctcactgaagacagggaggcacagtgatgtggaaatgaggggagatttctttttgccaagstcagaaacctgaatccacaccgtctgctcacgtgacatgccttcactgttcaggctggacccagctctggagaagcccaccccaggctctcatatcccaggctctcctctcaggagatgtccccagaggcaacccaacccacagagcagcggtccaggcccccgctcggccgacagccttgaaggccatgcaggtcaggtcgttttgctgttgggctctaaccccacagctcaactgataaaattgcacaattgctaaatagtgctcagtcatggaaatccatcagcctcagggtctcct

SEQ ID NO: 138236 - DNA, 601 bp, Human
tttttaaaaaaaatgtattatactttaagttcggggatacatgtgcagaatgtgcaggtttgttacataggtatacatgtgccacggtagtttgctgcacccatcaacccgtcatctacattaggtgggcagctaacatttttattattaccattgttcagataaggaaggactctctagaagtttaaatgcccacacaaaggagattttcatcagtgatttctgggaagccatttgataacacgcaggactccggggttaaaacaatccactgccagcaaccagcattaatccagggcckccctgcagctggcattgtgccaagcgcctcgccctccccactgcagccacctccatgggagaggccccttgagaggcactgcccatgtgagtccacggcctgtccctgcctctgggtggtctgtgcaaggaagacagagggcgggtggaggagctgccacctcacagccgtcttccctgctgtgtgtccttgccacttcaaaatcaaatgtccagcccaactctggggactgcagggccatcgctgtccttgcagccctgattcatgctgttcccctcctgactcgacagccctgctcta

SEQ ID NO: 138237 - DNA, 601 bp, Human
tggagggggcttggggcgatgtcggagctgcctcagctgggtgaggaggtgaaccaggagcacctgggccctgctctgcccctcactcccgtgacccccagtgagtcatgagccctctccgcctcggcttcttcgcctgcagtggggaagagctgcctggccacaggctcagcactgcgcgggtggcacaacagggactcggtgagggcagctaactttttaaaaaaaatgtattatactttaagttcggggatacatgtgcagaatgtgcaggtttgttacataggtatacatgtgccayggtagtttgctgcacccatcaacccgtcatctacattaggtgggcagctaacatttttattattaccattgttcagataaggaaggactctctagaagtttaaatgcccacacaaaggagattttcatcagtgatttctgggaagccatttgataacacgcaggactccggggttaaaacaatccactgccagcaaccagcattaatccagggccgccctgcagctggcattgtgccaagcgcctcgccctccccactgcagccacctccatgggagaggccccttgagaggcactgccc

SEQ ID NO: 138238 - DNA, 601 bp, Human
gccaccttggccttcttctcttcctcggccttcactttgtgcttctccttctccttctccttgtccttcttcttcttctccttctccttcttctccttcttcttctttggtttgtttactggggcctgagacagggcggccagctgctcgtgcacggccttcagctggaaaagagcgggcggctgagcaggtgctgggcacggcccacaccactggggctgcgtggcgccctgggattggagggggcttggggcgatgtcggagctgcctcagctgggtgaggaggtgaaccaggagcacmtgggccctgctctgcccctcactcccgtgacccccagtgagtcatgagccctctccgcctcggcttcttcgcctgcagtggggaagagctgcctggccacaggctcagcactgcgcgggtggcacaacagggactcggtgagggcagctaactttttaaaaaaaatgtattatactttaagttcggggatacatgtgcagaatgtgcaggtttgttacataggtatacatgtgccacggtagtttgctgcacccatcaacccgtcatctacattaggtgggcagctaacatttttattat

SEQ ID NO: 138239 - DNA, 601 bp, Human
ctgttggccttcttggcaggagccttcttctgctgagcctgcttggcaggcggagccaccttggccttcttctcttcctcggccttcactttgtgcttctccttctccttctccttgtccttcttcttcttctccttctccttcttctccttcttcttctttggtttgtttactggggcctgagacagggcggccagctgctcgtgcacggccttcagctggaaaagagcgggcggctgagcaggtgctgggcacggcccacaccactggggctgcgtggcgccctgggattggagggggyttggggcgatgtcggagctgcctcagctgggtgaggaggtgaaccaggagcacctgggccctgctctgcccctcactcccgtgacccccagtgagtcatgagccctctccgcctcggcttcttcgcctgcagtggggaagagctgcctggccacaggctcagcactgcgcgggtggcacaacagggactcggtgagggcagctaactttttaaaaaaaatgtattatactttaagttcggggatacatgtgcagaatgtgcaggtttgttacataggtatacatgtgccacggtagtttg

SEQ ID NO: 138240 - DNA, 601 bp, Human
ggctttgtacccgttgttccctgttcttggaactccctccctggccctctgctgccaagcttgctcccacacagctgttgcctcccccttgggaagcctcccttccacctggccaggagagctcccatcccgggcctgagctccttccctactagctcacactgctttgtggctcctgcatgtccctagcagacgctcctcagggtggtgcccagccacagcaggggctcccgaaggaggctgaatgcagctgtgcacgattccaccatccctgccccctgcctatgggcaagtccaaaayggggcgttcaactccccctagtcaagatccttggcccagaccagagaaacatcccaaaagcttcatgatgtggagaccaggccgtgccagcgcttcaatgcccagaatccaggccagccccgcagacaactgagcagcatcacctgggcccccggacttcccagcacaggtctcatcaggccctctgtctccctgcccccatcaccctggtttccaggtggccaaggcacaaagcccccaatcccagcactgctgctacatgagcccccatggcgtgctgagcgctgggctcttggagcc

SEQ ID NO: 138241 - DNA, 601 bp, Human
gcaaatattccaaaatctgaaaaaatccaaaatcagaagcaccttttattttggaaacatccttattttagataaaggatactcaacctgtataagaaaaatggatttctgcatctgcctccaaaaaggagagagggagggagggagaaaataagggaaggaaagacctatcccgaccattccactcgctgtcttcattaatggctgacccagctgtctaaccccaaacccaggacccccatgctcctcccctcctccctccaagcaccagggcctggccatgccgcctcccaaagtagtstatctccagagccacaccaatttcttttgcctgcacaaccaccataacctccaaaggggtatcctttcttccattcctgatttccactaagctattctccatagtggcgaggatctgatcatgttgagcttaaatcctaactctccttcatttgcttgaaaaggaagcatgaacacctcaaacaaagccggctgatctcagcagcctcaactcaccttttttcccaacttgttctttttcagtggtgccaactttgccctcattcccaaaaggaacacgtcctactggcctctgtggctt

SEQ ID NO: 138242 - DNA, 601 bp, Human
tctcctgtctcagcctcctgagtagctgggattacaggcgcccgtcaccaagcccggccaattttttctgttcttagtagagacagggtttcaccatgttggcccaaatttctgggattacaggtgtgagccactgcacctggcctcaaatcactttttacttgcctctaatcactcaaatattatatcccaaccaacacttttttttgtaaagagattgagaccactatgggcaacacagtaggattctaactcctgagctcaagtgatcctcctgcctggccctcccaaagtgctgggrttacaggtgggagccaccacaccaggctgcaactcatttttgaggccagcattatactgacactaaaaacagacaaagatagtacaagctgggtatcccaaatccaaaaatccaaaatgctccaaaatctgaaactgtctgagtcttaacgtgacgctcaaaggaaatgctcactggagcatttcagattttcagatttgagatgcttcagttttgagatgcttcagatttgagatgctcaatggggagtataatgcaaatattccaaaatctgaaaaaatccaaaatcagaagcacctt

SEQ ID NO: 138243 - DNA, 601 bp, Human
agatcgagactctgcctcaagaaaaagaaaaaaagaaagaaatataaatggtctaaacacaccaactaaaaggaagagatgctcaggttggattaaaaaaacaagaagaccccacttacatagtgtctacacaaatgccactttaaatataatgttctaagtaggttaaaaggaaaaaagtgagaaaaaaatataccatgcaaacactagtcaaaagaaagctggtgtgggtatattaatttcagacaaagtaaacttcagaaaaaggagtatgttcaggaaaaaaggacaacgcagggcygggcgcggtggctcacgcctataatcccagcactttgggaggccaaggcaggtggatcacctgaggtcaggagttcaagactagcctggccaaatggtgaaaccctgtctctactaaaaatacaaaaatgagccaggcacggtggcgggcacctgtaatgccagctactagggatgctgaggcaggagaatcacttgaaccctggaggcggaggttgcagtgagccgagatcgtgccactgcactccagcctaggcaacacagccagactccttctcaaaaaaatttaaaaaataaaaaa

SEQ ID NO: 138244 - DNA, 601 bp, Human
acgggccccctgagggtgctgagccgggcttctctgtggagacatgggcagggagatgcgctcgcacacccgcttcttgacccgcttggcggcatgtcgtccatgccagcgtgacaccatcacactgggtgccacgacccacccacttcctgacccagtcgtttaataagtatttattgaaattaatcaggtcaacaagactatctgaatatacttgagacaggaaaaaaatgaatgcagactactaacaggaaatgatggatgcgagaaaggctgcccatcaaaaacatccaccagtcayatggccaccagcagcgacaggaacaccagctgctggcgtttctggagcgcttactctgcctggggcgtccaaagagtgactacaggagacagaccccttcagcgggcagggtcatgggccctgtctcgacactgggcaaaccatgtcgcaaggccatggcccccagctagaacatgctccagtccagataggaccctactgtcccccccatatgtgtgtcctggaagccaggaaaagagatgtgtgctctaacagggtccagaaaaaggaggcaagggctcaaatgctggctcccctgag

SEQ ID NO: 138245 - DNA, 601 bp, Human
ggaacagaagtagtaatatgaaccacagaggggtacggcagagtctcggcgtgtgcgacatccatctgtcctgttctgtccgaagccagttcattctgagtcactgctgtcagagctggacccgctggagctgctgctcccagactcggaggagctgctgctgctgagcctggacgggccccctgagggtgctgagccgggcttctctgtggagacatgggcagggagatgcgctcgcacacccgcttcttgacccgcttggcggcatgtcgtccatgccagcgtgacaccatcacactgkgtgccacgacccacccacttcctgacccagtcgtttaataagtatttattgaaattaatcaggtcaacaagactatctgaatatacttgagacaggaaaaaaatgaatgcagactactaacaggaaatgatggatgcgagaaaggctgcccatcaaaaacatccaccagtcacatggccaccagcagcgacaggaacaccagctgctggcgtttctggagcgcttactctgcctggggcgtccaaagagtgactacaggagacagaccccttcagcgggcagggtcatgggccctgtctc

SEQ ID NO: 138246 - DNA, 601 bp, Human; identical to SEQ ID NO: 122085

SEQ ID NO: 138247 - DNA, 601 bp, Human; identical to SEQ ID NO: 122084

SEQ ID NO: 138248 - DNA, 601 bp, Human; identical to SEQ ID NO: 122083

SEQ ID NO: 138249 - DNA, 601 bp, Human
aaaaaatgtttactgaagttttgaaccactagcagtggaagagaaaggagatctgcccacctggggtgtggctgcagggtaacaaggaggatgcataaagtccagtgcagttagccgtgaccctctcgtgccttttatatacaagacctccaggtttccccagtgcctgcaccaagccaagcttcagccatgcataagactgcacggagcctatctggtgtttccctcactgaccaaacacaggcccagggtcctggtggctcccagggaaatctgccccctctcccaaagcagctcctargtagccacctggctcccagctagtcgtcatctaggtgtggcatcctaggtgctttagaaacccagagtccaagcttccgaggggtgccccaaactgcctccagggagaggtgggatcttccacggactgcccatgcagatcaaacaggggaggggatattctggggacctcggggaggggaggccaggcagaaaaactagagggacattcccttcctcctctctcctggcaaacaaaaaagatccctttccaagcaccagatggcaggtaagagcctgtctccctcctgtctggacatcc

SEQ ID NO: 138250 - DNA, 601 bp, Human
cctcaactcacccaccgggaacctgctctagcctattacttcatgcccacaggaagctcctagacttgggctccatcaagacctccacagttgtgacatcaaagggtccttgcccttagcagctggggtcctggctgggaatctggctctgtgggcagtgttatagcctgcagcttctctctgcctttgaagatacaatcgcacatctgagggtccttatatgagagaagcaaggttagactggttctacttgacctcagagagtcaaaccaagacagtagtagaatctacaaagaaaaaragttcaaccaacgagttcctgtgaataccaggtgctcaaaaagctagagtaaacatttaaaataaaaaaaaagtcaaccccagctgtgcaaaggtggccggacaaaaggtaacaaatctcaacattggaagttttcagcatggatggaagagagttggatggggtgatccccagctctctgggacaccaaaggtcaaggatagcagctttctaccttggctgcagatcacaatcatctgggagcttcaaaaaatactgatgccctggctgtatctccagaaattaattaatctgggatgg

SEQ ID NO: 138251 - DNA, 601 bp, Human
ctcactgcagccgtaacctcccagacttaagtgatcctgctacctcagcctcccaattaactgagaccacagatgcatgccaccacacttggctaatttttaaatttattttgtagagatgcggtctccctatgttgcccaagctgggctcaagcgatcctcctgcctcggcctcccaaagtgctgggattacaggtgtgagagcccagccaatatcctcactgaaaacaggctcagatgggtgtggtggctcatgcctgtaatcccagcactttgggaggctgaggtgggcagatccccygaggtcaggagtttgaaaccagcctagccaacatggcaaaagcccatctctactaaaagaatgcaaaaattggctgggtgcggtgaggcgcgcctgtaatcccagctacttgggaggctgagacagaagaatcgcttgaacccaggaggcagaggttgcagtgagctatcgcaccactgcactccagcctgggcaacacagcaagactcagtctcaaaaaaacaaacaaacaaaaaacaaagcaaaaaaaaaaaaaaaaaggaaacaggctcagagaggtcaagtgacttgcccacagtc

SEQ ID NO: 138252 - DNA, 601 bp, Human
ctccccttcggtgcagaaaactggagactgcaaggcttcactgagcacctgtcctgtgtgaggaatggccctgcctgcctccaacagggaagttaacagaggggaaaactgcaatctggctctggaactgcaacattcctacccctcttggctaatgccttcagcaggaccacaattataaacacagaactaacaggaactgagaaacagcagcagatcaaaaagcaggttgctcttgcttttggaggatgtgagacagatttcttccaaagaggcaagggaaaatcccccatctttacargtcaggaatagcgccagtaaatccctccactttgtcctttctcctttcatggaatagcccaatgcgccagtgggtgttaagcaaacaagggtgtgagttgcagcttcctgtgcctgactatgcagttcccgcacaggtccttgcccgagctaacgctgtggccccggacacagacagataaagtcccgatcgaacactaagggccaaagctggcaccaatgagcaagcctggtgagcttatataacaaagggcttgtcaccacttcctgtgatcctcatcgccagcattccaacacaatg

SEQ ID NO: 138253 - DNA, 601 bp, Human
gggacgcttagagttaacttccacaggactgtgcacctggtgggactcaagcagagaaggtctgaggacatttgtccttaccgaagtcctcttctccaggctaacaagccacagcttagtttcttctgggcagggatggagggtcaaaagtggccaccaccaagtccttttctctctttctacacaaactgaaacaagcctttccccttcatgcctgatacccagaaagcccttttccctaatcaagagcctgcattttacctttgcccagtaaaggttctaccccagctcccttcccataaccatgcacacgcaccggtgaatccaccagtcaggcgggggctgtgtatggggaagggactcagacctaaagtgaccttaccactatgacatgagatgggccaggtagtcacaagcaaggcccaggcatgacctatgggtatggggcaagagggagactgcgttgggacagagttttgccaactagcaggatctgaggcaaacctgcatttgctaggctggatgggtgatgggaaggagaagggcatgcctgcttcagaaatgggcacaggcaagtgcagaggtataaaacttcggtgag

SEQ ID NO: 138254 - DNA, 601 bp, Human
ccactgcatgccataccaccaacagcaagcgagtgggcgggcaggcagacaggcaggtagtgctggagtggctgggagggcttcctggaggaggtggcggtctttcctgggctcaggcaggggtatcagcaatagggcacactacggtgggggggctgcaagtgaggaaagtggcagtcaagagaccagtttacaacgttgcagagtttgtggggaggtatagagcaaaatgaagaaaaggagtttggggatagattttgagggctctagatgctaaagtctttggggctttgccataaayggaggaagcatgaaagtattggagcagaggtgtgatgtgcactctggaagatgagtggcaagggagggtgcggggtggggttaggtgggaataaagccacactggggacacgtggcagggctggggtggaagatactgccccagggacgcttagagttaacttccacaggactgtgcacctggtgggactcaagcagagaaggtctgaggacatttgtccttaccgaagtcctcttctccaggctaacaagccacagcttagtttcttctgggcagggatggagggtcaaaagtggccac

SEQ ID NO: 138255 - DNA, 601 bp, Human
gaatgccggccgttatccctaaagggggggcttgggaagggaggcctccccagacatgtgtcggcacccatgcagtgcagtggagggacagagagggcacagggtcagccagagctccgctgctctgctcaagtgaagagctacccctgtccccagccactgcatgccataccaccaacagcaagcgagtgggcgggcaggcagacaggcaggtagtgctggagtggctgggagggcttcctggaggaggtggcggtctttcctgggctcaggcaggggtatcagcaatagggcacactayggtgggggggctgcaagtgaggaaagtggcagtcaagagaccagtttacaacgttgcagagtttgtggggaggtatagagcaaaatgaagaaaaggagtttggggatagattttgagggctctagatgctaaagtctttggggctttgccataaatggaggaagcatgaaagtattggagcagaggtgtgatgtgcactctggaagatgagtggcaagggagggtgcggggtggggttaggtgggaataaagccacactggggacacgtggcagggctggggtggaagatactgccccag

SEQ ID NO: 138256 - DNA, 601 bp, Human
aaccagaccacggtgggaagctgccacatgaatgccggccgttatccctaaagggggggcttgggaagggaggcctccccagacatgtgtcggcacccatgcagtgcagtggagggacagagagggcacagggtcagccagagctccgctgctctgctcaagtgaagagctacccctgtccccagccactgcatgccataccaccaacagcaagcgagtgggcgggcaggcagacaggcaggtagtgctggagtggctgggagggcttcctggaggaggtggcggtctttcctgggctcargcaggggtatcagcaatagggcacactacggtgggggggctgcaagtgaggaaagtggcagtcaagagaccagtttacaacgttgcagagtttgtggggaggtatagagcaaaatgaagaaaaggagtttggggatagattttgagggctctagatgctaaagtctttggggctttgccataaatggaggaagcatgaaagtattggagcagaggtgtgatgtgcactctggaagatgagtggcaagggagggtgcggggtggggttaggtgggaataaagccacactggggacacgtgg

SEQ ID NO: 138257 - DNA, 601 bp, Human
cggctggtccagtaggccacaggcctctggggcaacttgcagctggagctcgaggggcgaggggagaggaggagaaatgggcctctcgacaggagtctggcggcccatgccctgccctccatgaatccctaggccccagtcttattttaagccagaacccaggatttgggttctgaaactgcattctagagctgcgccccaggcgtgtttacagccgcctaattcttgtggtgattgtttctggaggataagcctgggggtttttcctcctcagaaattagtacactacctcaggtcagcyggtctttccccatagccgctatctgctgtgtgcaggaaggcgactccttccaaggctcagaactcaccgtccatggcagctgaacattaggttcagagaagcagagggggcacaactcgatggggaaaggctggggtgtggcctcgactgcgccactggctggccatgtgtgtgaccttgggcaagtcttggctgcctcaagggtaagacagagatgatggtccgctgagggctgtcgtgaggaggaaaccagaccacggtgggaagctgccacatgaatgccggccgttatccctaaag

SEQ ID NO: 138258 - DNA, 601 bp, Human
ttcctgaacaacctctttaacttgaccacacaagggcagtaaaacacgtagcaaaggggtcatccggaaacagccctgatataagaagtacctcagggaagctcagctccctcatgagtccaggccaggctggccgggcccaccatcccctcctgcctcagcgagggcagcggctggtccagtaggccacaggcctctggggcaacttgcagctggagctcgaggggcgaggggagaggaggagaaatgggcctctcgacaggagtctggcggcccatgccctgccctccatgaatccctrggccccagtcttattttaagccagaacccaggatttgggttctgaaactgcattctagagctgcgccccaggcgtgtttacagccgcctaattcttgtggtgattgtttctggaggataagcctgggggtttttcctcctcagaaattagtacactacctcaggtcagccggtctttccccatagccgctatctgctgtgtgcaggaaggcgactccttccaaggctcagaactcaccgtccatggcagctgaacattaggttcagagaagcagagggggcacaactcgatggggaaagg

SEQ ID NO: 138259 - DNA, 601 bp, Human
atcgattcagcccccatgtaccattctgagaaccccacctccgctagaagtgagcctctctcctctgagccctgaagttctgtctgctcctccattcagcctccctgggctgaccttggggcagatcctgtgctgggctctggaacatagagcagaaggagtggtccttcctgcaggagacacaggctcattgggggatagccacaggctcacaaataggcatgacacaaggtggctgggctagaagaggagctaaaaagtgacatttcacattctgtcacactctaacaagatttttttwaaaatctggctctcttcctactgactaaaagtggtttaactaactcctaacacattgtctaagagtttttaaaagtcaggccaaactctatttggagaactccaaacagcacccagaatcttcccctaaccctgctttatagcttgggtctggctgtccggctctgccctccccatcctacgccccatgcatgtgtgccccagcccagccattccatgcaggccagagctcagcagcacacaacaggctgggcgcacaggcaccaggcgtggtcaggtcaggcgtgggggacctccagac

SEQ ID NO: 138260 - DNA, 601 bp, Human
ttaattaaggagcggtcaccaggatgataaagagcccagactctcccccacgtctcatgggcataattgaagggaccgaggggtatctactagagaagattcaggggtatctgttgggggcatgcaagacagtggtcaacccctggcacaggatgcaggcgtgttctgtgggatcagagaacagaatgagaaccaaccagtagaagttctcaaaaagatttcaactcaatttcaggaagaatgatcagacagagctattcaaagtataacagagtatttggggaggtagtgagctccctgycacaggggacctccaagcagaagcgggttgagcacttggcaaggaggacctagactgagatcctttgccactagaaactctatagtcctcctgagatttttatggtaccctgaagcataggactggggataggggagccagtgttgaaggggttgctccaaccttataaaactgcatccctccctctcactttcacaggctgctcagtgagagaggttctccacctctttccccagtggcatgtgaaaggttgggtgccatgggagaagcacagaatcacatcctgaagttcagcaatgc

SEQ ID NO: 138261 - DNA, 601 bp, Human
taagaagggggaggtggcttgggttttaaaaagaaaattggattcccattcatgaattacccacaccgagggcacttaacaggtgaaacgggttctgccattgatgaatgagctcgggtaataacggggctcacccttcgccattaaaaatattaacctcattcctggcccagcgatgtcataaacccagggcccctgaagctctctctcatggccacacttcccatctgcctggtgagggagttcaatgtgcacctctcaccctgcgggcaagccctttgggaagtgtactaacgccccwcataaaaccaactgcaggtagacaggaggaagaaataatgtaataacttgccacctgtatgcaagaattcagaggcctccactgcctgggacctttactaaagtgatgcagtgctcatgtggtctaacacagcttcccacagccaacctgaccacaggctgcaaggacagtgataatgatgttatgatccaccatgagagaggagactgtctccctctactctgtacaaccaaaggaccaatggagaatcacgtccagctctttgggaggtcccctgtggcagggagctcactacctccc

SEQ ID NO: 138262 - DNA, 601 bp, Human
ggcggccctcagggtcagcatggttagcctgcaatcaccctcaaagcaggtgctggctccaatggggcatctgggaataatttaaagcctatgctttcctaagataaaagtgagcaccccatcacctctatgggtgccccatgatcatgcccatttatcagggataacaccagtgactggggccagccaattcggggagggggcccttccaacccacagatcccagaaaaatgtactccttggagacatttaaaccaataccccagctggtgcggtggctcatgctggtagaatttgggargatcacttgagcccgcgagttcgagaccagcctggacaatatagggagaccctgcctccacaaaaaataaaaattaaaattaatccaatgccctagttgaccaatcatttcggaagggcttggagagggtccacctgagtggtctcgttacactccccctccccatatttttgttatgcccatcctctgatcagtgggcaacaggataaaacaggtggtcccgagtttcccatctatcctgggtcccacaactagagctgttgcagccccagcctctccataactctcagtcttatggac

SEQ ID NO: 138263 - DNA, 601 bp, Human
aacctcggaccagaccctccaagcgcctgagtgttctagaggactagaacaggcaggaggctaagggacgatgcttacagagggggcaccgcctagagagcaccttctctacaagccaggctcttggctctgtgctttcacgtacatcatcgtatttcatccttcctaatcacctcattttcagatgagaaaaccgaagctcagaaatgtctaggaaccctgccaaggcctcagagcacagaaggctacgcaggtttcaacccaggccagcgtcaccccaaagctctggctctcctgggcyacctacagcctgttgtatgagtttctaagtccaggctccttctgggcaacaggaagagatctctgaagggaagtttgacaggaagaagcagcagctttgccagcttggctcagttgcgccaaccgtgagcaaaggccacctgacaactcccttaagtcagctgagtgctggaagtctcccttccccttcctcagctgccctgtgactccggcacacctgcaacctgccctgcccgggccacacctggggaagcagtgcttccgcctgcagcctttgaagcctggcttccagctctcctct

SEQ ID NO: 138264 - DNA, 601 bp, Human
gctgagtcaatgaaccaagggatacatagtgcctgtcacattatgctggcataggcaagggcacaagggcactagagaacacagaaaagatgctgctcttatcctctagaggccacaggccatgccttttagtctggggaacccagacacagaccttgaagcaggcactaaaatgcaagtggttgatctgggaggagacacttaccggggacagggaaaatgggcctgagaagggtatcaggaaagctgggttacaaagccagctacccatggtgggcaactagatggagcatgatctgayagaggaaactctgggaaaccatgcacaacccacccctcagaattaccttaccaagagtgagggagctgggggtcaggcaccaactcctgggagctcctggtgtaggcagagcggctgttcccattcctatgttctagaaaagccctcgggcacagagatgtggatgagccagttggagaaggccagactggggaggcagaagggacagggtgggtcttgacagcatctgctgcccagggcagggggtgcctcctggagagggatggagctgagccaagaggtctcttctggtgcgttttc

SEQ ID NO: 138265 - DNA, 601 bp, Human
ttccgggccctgagctccaatgcttccaaatttctcaccagctatggagctctactttctctaagcctgagccctcccactttcactgggaaaacatcttccttctgcggtgcaggagaagctgagtcaatgaaccaagggatacatagtgcctgtcacattatgctggcataggcaagggcacaagggcactagagaacacagaaaagatgctgctcttatcctctagaggccacaggccatgccttttagtctggggaacccagacacagaccttgaagcaggcactaaaatgcaagtkgttgatctgggaggagacacttaccggggacagggaaaatgggcctgagaagggtatcaggaaagctgggttacaaagccagctacccatggtgggcaactagatggagcatgatctgacagaggaaactctgggaaaccatgcacaacccacccctcagaattaccttaccaagagtgagggagctgggggtcaggcaccaactcctgggagctcctggtgtaggcagagcggctgttcccattcctatgttctagaaaagccctcgggcacagagatgtggatgagccagttggagaa

SEQ ID NO: 138266 - DNA, 601 bp, Human
agaggctctaagatgggcttctgctttggggggaaggtcagctggctggatgccacactcagtatctttctagtgcacatacagtgcaaagcccagactcaacttggacgtagaggtctgagctgccccaagcagagccctggctttaaggactggctaagtgggttgcagaacccctgccatggcggaggcaggcagcatttccaaagtcccaaggctgaccggtggcagctgggctgcagcagctgcccgaggctatgtaaatatacagaaaggcagctggcagtgcagaaaggatgcmgccaggcagggacagtccaggcaagtggagctctggaactggttctgctacacccttgctgggtaactccgtgcaacctgttttctctgagtttcggcaggtcacctgtgaagtggagcagggtggtttgccttctcagcttcacataaacgttgtaaggagcaaataatcagatgatccaaggatgtgtcagtaatttataaagaaaaggccgtgtccttgttacagagcagatggcacctccaggatgaaggtaagtgcggtgaggggcaaaagcactttcaggcagggtctctgccc

SEQ ID NO: 138267 - DNA, 601 bp, Human
aggctgggcacggtggctcacacctgtagtcccagcactttgggaggccgaggtgggcagataacctgaggtcagataaccctgagttcaagaccaagcctatccaacatatagtgaaactctgtctctattaaaaaatacaaaaattagctgggcgtggtggtgcatgcctgcagtcccagctacttgggaagctgaggcagaagaattgcttgaacccaggaggcggaggttgcagttagctgagatcgtgccactgcactccagcctgggtgacacagcgagactctgtctcaaaagaaaaaaaaaaaagaatgatgagagaggcagactggctgctgtcttccaggatcgagtggcccacactgtccctattgccccatggtcaccttcatgtgccctgctgtctgtgggacagcacaggcctgtgtcacacaccacactgcatttttagacaggtgaataatgagtgttgaattatgatgcagtcagcacgtcgcatctgcacatccgccaccctgctaaggcaaaggagagagtgtcttgctggctgaagggtctctgtgctgctctcctctccccggaaagtgagggggcagca

SEQ ID NO: 138268 - DNA, 601 bp, Human
tcttttgttttcttccctgggggtcaactggagaaaaagaggacccgacgtgccatctccaggatctaagacatggaggaaatggtaacccctctgcaatcatgtgggctggctccagattgagcaattcggcctgtgcagggggagagggctaccaaaatctcacaaatcaccactaaagaacttagtcatgtaaccaaacaccacctgttctccaataacctatgaaaataaaaatttaaataaatttaaaaaaagacttctgccctgtcaccaccctgaaagtgacggggtggggggktggcccaacagggatcctagccccgaggatcttgcaaggcaaggctttctgtttgaaacccacagcagctttcaggccaaggccaatttactctcagcaaactcgttctaggaagatcacccggctacaggaagggctggtggcacttcagaagaggagccactgcagaaatgcaaagggaatctctgctgaaattgctcaaacctgctaaaaagaatgatgaggcatgtccgggcttagtggctcacatctgtaatcccagcattttgggaggccgaggcgggcggattacctgaggtc

SEQ ID NO: 138269 - DNA, 601 bp, Human
tggtacagtagacagaatgtttcccaaacttgcctgaagacaggaatggcttggaacgcttgttaaggaaacagattcctagccccaataatctgtattttaacaagcaagccaggtgatccttatcaggaaagcttgggaaacaataagctagagccagcacccttccccaccagtctagagacaagcctccagatattactctggaattgtacttttcccaggtattgctcagccctgttcgttgaagtgaagcaagaagtttgtgctaacatgcagctcttttgttttcttccctggkggtcaactggagaaaaagaggacccgacgtgccatctccaggatctaagacatggaggaaatggtaacccctctgcaatcatgtgggctggctccagattgagcaattcggcctgtgcagggggagagggctaccaaaatctcacaaatcaccactaaagaacttagtcatgtaaccaaacaccacctgttctccaataacctatgaaaataaaaatttaaataaatttaaaaaaagacttctgccctgtcaccaccctgaaagtgacggggtgggggggtggcccaacagggatcctag

SEQ ID NO: 138270 - DNA, 601 bp, Human
atcctagaagaggtcaaggaagggaggatgctgtcgcccaccggctggttcccaattgtgtggggtggtgaggctgttgctgggggcctcctggctccaggcctctgcttctgttactggggagggcaggagctggcccgggggatctatctcaggcccatgtgcttccctcagcccagggtccatccggcccattgactgcctgccctgctcctgcctgggctttggaacacaactcccaggttcctggaggtgctcccaggcccccagctgttgcggaagcctctgctccaggtttctyactggaaaatggaaacaacccaggcgctccctccctgggccttagggaggcttaggagagatgctgtgaagggcatgagagcacagggcttcagtaaacaccacctgagcagaaaactgaatgccagctggcctggttctgccttgagccacaggcacctggggaaagcagcagatcgggagcctgaagcatgcagaggcttctggggaaggtgaacctgagctgctgggggctgcgtgggactcggaagggaagggccgcggtggagctgagtgaataaagatctgctgaggaggtggg

SEQ ID NO: 138271 - DNA, 601 bp, Human
atgaaacagaaaatataaagttcccagggagggatagcattaggagatatacctaatgtaaacgatgggttaatgggtgcagcacaccaacatggcacatgtatacatatgtgacaaacctgcacgttgtgcacaagtaccttagaacttaaagtataataataataataaaaagaaattacaatgaagaaatcctattctttatgttaacataaacattgagtttgtgttaatgtaagttaaacatatatttgttaatttattctcccttaaaaaaaaaaagaaaatataaagttcccayctaaaaataactgggagtgtaaatgtggacttcaccgttgagaaatacggaatttttgatataagcctgagcttacagtctcacttggcagggaggagttacctgaactttggaattttaaggttctcttctaaataggaagctgacgatacagaactgagatcaactccaagagcattcctgtctattggctcaaagacctacaaaaaacttagactgtgaagacttgcctgaagctgagacccaggacggcaatgggtggaacatggctagagtcagaagcctggccccagctgctgc

SEQ ID NO: 138272 - DNA, 601 bp, Human
atcagctgtgcacatgagagtgtctcagccaggagttagcggcaggcgaggtgagcgacaggtgaagagattttaataaaatgacaagcagcagcctatgttacaagaagattcttgaggtttgctgaaggctcttcctcttccttttttcctggaatgagatgaggcttaacacttgccttttggatgaagtcttgtgaccaagtgaatgagaactggcagggagagtgcgatgggaacggatgcctacttgaatgtgtgtgcgcgtgtgtgtgttaaacaagaaaaaggaagtcacagkaagaaaaacgaactgagctaaaaataaggctgctccaacactattgtgagacagaaaatataacctcagttaggcagggaagccaatgtgatatgaaacagaaaatataaagttcccagggagggatagcattaggagatatacctaatgtaaacgatgggttaatgggtgcagcacaccaacatggcacatgtatacatatgtgacaaacctgcacgttgtgcacaagtaccttagaacttaaagtataataataataataaaaagaaattacaatgaagaaatcctattctttatgtt

SEQ ID NO: 138273 - DNA, 601 bp, Human
ttggcaggatagaattaatgtagaaaactgtgtttgtagatacgcacagatgtgtatttttgtaagcaaatgggaaaagggctataagaatacataaattattaacaatccttgtctcgggagggagatttcactttttacctcctataagcctgtatgctgaatcttcttactcagagcacatattacctaatgtgataattaaaattttaaaaggaagttgcaaatgtggcacatgaagactctcctgtttgatattatcaatatctgtgacagcacttgttgagggtctatgtggaaygaggcacagtgccaggagttctacattaacccctaggacagatggggaaactgaggctgagactgagagggcagatacctgagctggtatggcagggctagaatttcccacctccgcttctctgatcagagtctgtgcacgctctcctcagggctccacgctttcagggacactgcgtcatggaattccatcaacttctacttaatattccagtgaaatgggcttctgcattcaagagtatttctaaacaattttcacttcatgtaatgtttatacattttgaagtttaggaaattaagt

SEQ ID NO: 138274 - DNA, 601 bp, Human
aagccataggggacaggctttcacgccagaccagtcacggctataccccttaccctgtgggggcttccctgctcaccaagtggcttcacctgcagctctcacagaacctcacagagcgaacctcagaggggctgtggtgcagccaggaccctccccgcctgactgctgccaagtccacagctcagacaagctcagtggttgggccaacatcgcaaaaactcaattgtcaatagtgcagtaatcaccattctaggaacactgcgtgctggagtctgctaagtgcatgccatccagcttctcrtttaactctcaagacaaccccatgaggtggtaccccacagacactgccattttatggacagccacagggcaagcgaggaagggatggaggcagtctggctccaaagtccatgtccttaactgtgcagctatctacagtgcctttccagcccaagtcagtgttccctccactccactagggacaaaagaacacggacacattcaggtcagcaaggaaggcaggcactaaagagcccagtcccagctccagctctgtccggatcccacaaggttgagtgacaccaggcaagtcgcttcctcc

SEQ ID NO: 138275 - DNA, 601 bp, Human
tgcttcacatacacaaaatcctttaagaagctggcaggacacatggggatgtggtaactagacactgataatctgaaggttgggccttccaaacaactagggctccaccctttcaagaagtgggcagaagatgcccagggctccagaaagcaaaacacactcctgtgaacagcccccagatgtggaaatgctggcatatccactgggatgatgagcaggggctgggctagcacgggtggcatcagcatcctcaggccaaccatgacagggcgggcatccccggggcccctgtgctgcagaragccagggcccagcagggacttcacagggctgcagcacacacaggcagatgtgcgtcccagcttgttccttctgagtatcgacagaccacagctgcacgaagggccagcgccccacacacgcgatcttccagtctgctgggcacggtgcggtctctgcctccagagaggcctgggaccacactctaatgaggtaaagccataggggacaggctttcacgccagaccagtcacggctataccccttaccctgtgggggcttccctgctcaccaagtggcttcacctgcagctctcacagaa

SEQ ID NO: 138276 - DNA, 601 bp, Human
gactgacaggtacctggtgggagatgatgctggaggcagatggaagtgggtttctggatggccttaaaagtactgcacggcagcatccccaggagtggtaaaggagtgatgcccaggaacctctgggcagggaggagctgggcaggacacaggctggcacagacgtgcaggagccttgctggaaatgatagacgctggcctgcaggcccttcacctctaattttcccagctgggcttgtctgggaatccataccactccctaatcatggggtagcaagctaggtagagttgtatggctctycactcccaggccctgccactacctctcaacccaggaaacctctattctgccagtggtaggcatgccatctgatctctctcacatggctttgcagccaccggggatccgtgcctgagacgccagggttgcaggtagattaggctcagggccccagcggtgtcaggaagggctgcattactggaatgatgcacttgccacttagcggggctgcccctcgccaaccacctggagggaggcaaagccctgggtccaggtgaaccgacaggcatagcagcactgtgtgctgggtgaaaacaccga

SEQ ID NO: 138277 - DNA, 601 bp, Human
acacgcctgtagtcctagctactcgggaggctgaggcagaagaatcacttgaacctggtaggcggaggttgtggtgagccaagatcacactattgcactccagcctgcgcaacaagagcaaaactctgtttcaaagaaaaaaaaaagaataagcatctaatgaaatgatacataacatgtcttatggtaaacatcagaagaaacctgttctttacttctttaccttctcttcaggaatagaaaaaaaaggcttgggtttgctcgctggaaaactgaggccaaggaaatcagcaggcctctytggtgccccccccccctccatcttttccagctgtgctggcatccacctgtcctcccaaccaaccaactatctactgaatgcccagtatgagaggagacagagaggaatgagatgcagtcctggccttcatgaagctcttggtaggagaaggcagagctcccaacagggacagacacagctcagcctccttaatgggagcagacttgataccacaatctgataactaagagacaggtttccattgggggaacctgggagggccttaaaagaatttagacaggaggtcatagcacagtgatg

SEQ ID NO: 138278 - DNA, 601 bp, Human
ttacatccacaacctggctaactattcggtgcaagaagcctacctttcggcagatctcggtttttgacatgacttctgcactaggcttatttccaagattttggtttaaagtgagagatgtgtgactctccctttcctttgaacatgtagaggccattgttgaattattaataggcctgatttcaacattgttgtgttttacagaatagagaggcccaaggagaggggaagagatgaaggaatggtcagtcagtggggcagtcagaacacacataacatttattaagttcgccatcttctrtgggtgcagtttgtggtgccccaaaacaattacaacagtaacatcaaagatcactgatcacaggtcaccgtaacagctataataataaaaaggtttgaaatatgagaattaccaaaatgtgacacagagacacaaaatgagcacacgctgttggaaaaatgatgctgatagacttacttgaaggaaggttgccacaaaccttcattttgtaaaaaaaaaaaaaatgcaatacctgcaaaccacaatgaagcaatgcacaataaaatgaagtatgcctaaacattttattatggagagtct

SEQ ID NO: 138279 - DNA, 601 bp, Human
ttgggaggccaaggtgggcagatcacttgaggtcaagagtccgagaccagtctggccaacatggtgaaaccccatctctactaataatacaaaaattagccaggcatggtggcaggtacctgtaaaattttttggttttccaatgcatacaaaagttatatttatattatactgtagtttattaaatgtgcaataccactgccttaaaaaaatgtagaaccttaattttaaaaatattttattgccaaaaactgcttacaatcatctaagccttcagtgagtcatctttttgctggtggarggtcttgctttgatgttgccggctgccgactgatcagggtggtagttcctgaaggctgaggtggctgtggaaaattttttatgcccctccccccagctgtgggaatttcttaaaatgagacaataaaatttgccacatagattgactcttcctttcacgaaagatttctcttagcgaaaggctgttttataacattttatccacggcagaacttctttcaaaattggagtcaatcttttcaaactctgctgctgcttcatcaactaagtttatgtactattctaaatcctatgttgtcat

SEQ ID NO: 138280 - DNA, 601 bp, Human
tagaaagaaaagaagactaaagcactttctttagaatcagagaatgtttgaactgaaagggaccctaagaatttgcctgggcccattcaccaggagagctaggcaggtgtgctccccacagactgcggccatggcggggtctgcccatgggaatgtggagaaggtaagggctggggaagagagcaggcagtaatcctgagaggatgtgatgggggtttaaaagattgcccagtccacaagcaacaagctatactctgctccagtattcaccaacttagtgcctccctgaaaaaaaaaaaamaaaaaaacaacaacaacaaaaaaaacaggcccccccaccaaagttgggtgcagtggttcatgcctgtaaccccagcactttgggaggccaaggtgggcagatcacttgaggtcaagagtccgagaccagtctggccaacatggtgaaaccccatctctactaataatacaaaaattagccaggcatggtggcaggtacctgtaaaattttttggttttccaatgcatacaaaagttatatttatattatactgtagtttattaaatgtgcaataccactgccttaaaaaaatgtagaacc

SEQ ID NO: 138281 - DNA, 601 bp, Human
gagctgcgtgtatttaggaagcagctgcctttccctgagaaaatgcccatttgggagcatcttctctcctgggagaggctcaccaacagctccaggacatcgaaggcccttgtgccaggccagcttgccagatgttgctgcctcctgcctaactaccaggcccgtcttccttattagctgggccaatccatgagggtccagagaccgatctcacaagggagtctgtgaccatatgttttaagtcacaagttatctgaacatcagcatctacacattcatgcaaaatgacctttaatattargtggcagtctgtaatttcatgcctcttaggcagaaagcagaaacattaacaggatgggggtttctgttgacctctggagcagaaaggtttgtaaacagaactacatacatagaaagaaaagaagactaaagcactttctttagaatcagagaatgtttgaactgaaagggaccctaagaatttgcctgggcccattcaccaggagagctaggcaggtgtgctccccacagactgcggccatggcggggtctgcccatgggaatgtggagaaggtaagggctggggaagagagcaggcagt

SEQ ID NO: 138282 - DNA, 601 bp, Human
cactttcctgcctctgaaattctgcaggcaaaaaggaaggaagcagagatgaaatggatactgcacttcctcacctgcattcccacccagaaacaccacaaactcagagctgccagcggggaggtgagaacgacagagagacagacccctgtctgggttttacccaccccaccaacccccagtgccgcatctctgctcttcctgggccaggcttgctcacaaggctcacatgctcgcaggcctaatgacagccctgcctccatccactcatgaatctcaggcttaagaggtagagcccagmtgtgaacatgatgctccaggtgtgtcctgatgcccacccagaacacgcagagcttctgaccccttgcttcataaacaggctggggtctttccctctagggcagttccttgccctctttggactttcagtcctcatctgtacaaggaaaagactgggccatgcagttcccagttcccaccagctcacacattcatttaaaagaaccaacaagagcctccccaaggagaccagaggccacttttctcccccgcaaagcctgagtgaccccttccctttatttctacctcccccagaccatct

SEQ ID NO: 138283 - DNA, 601 bp, Human
caagctgcttcaacttatcctcaccacttgagaggtggcccaccgacctctccactttccctccagcgacagtaacagtgaggatgcttctcacctgccaatgctgcgcctaatggactctgtccacagacatgggaagagaaggctggtgcccataggacccctccagctcctgagtgagatggcctcctccttctatgccccaggaagcagaactgagccaaaagcagcttgggaaaagcacagccagcacccgccctggagtaggacctacagaggccagtgaccggatgagacacagacgtggatgtgattctctgtctatcttctatcaacagcccaataactcagactgaccgtgacacctgtgatggcaactctgccacacaaaacccaggccaaaacggatgcttgtgggctcagaaactcattctgagacagttccatctgagaccttatgatcctttgtgaacaactaaatgtacaggagttctaaaaccacctttgggcagaagtgggcaagttctggcctgagagttttcttcaaagatgatgtccaataggggaattgcttttcactttcacagatcacctgggatct

SEQ ID NO: 138284 - DNA, 601 bp, Human
aggctccaaagactcagtgcagagagctcccaaaagccaagaaaaaactgcacagggcatttctgacaggtactatgctaaggatggggcccagccaagctgccttactcactgaccacaccaacgactcgctcaagtgtgagtgcatacacttgcatacacacccacacacatgcagatggatgtacactctcatgcacacacaacactgactcaggtgggggtcctcgccatccttcccgggaagctgcacttctggttttacacatggggctgtggcaacacatcagcaatctaaccragctgcttcaacttatcctcaccacttgagaggtggcccaccgacctctccactttccctccagcgacagtaacagtgaggatgcttctcacctgccaatgctgcgcctaatggactctgtccacagacatgggaagagaaggctggtgcccataggacccctccagctcctgagtgagatggcctcctccttctatgccccaggaagcagaactgagccaaaagcagcttgggaaaagcacagccagcacccgccctggagtaggacctacagaggccagtgaccggatgagacacaga

SEQ ID NO: 138285 - DNA, 601 bp, Human
atttcacctatgggcaattaaaaatggaagttggaatctgaaggaggaaagtaagactcagagctgtgcaggttgaggctctgggagcccttctgactttggttccaatgatggggaccagaccctggtggttgatggaagagagaggctggtcaatgtttttccaaaagttctgccatggtggcaggactcattccttgagacccagctcaagtgccttgcttctaggaagctttcctggccctcccatctggattggtcccctttctgattgtatgacagattttacaccaatcagtcytaaaatgtggtcactgccaacaacagaagacagcatccaagacacctagcttagctctatccctcctactggccctgccacgtgggtaatgggtgaggaacggcggtccagaggagtagtaggaggaactcctccagggtctcaaagccaaatagcagggtgagggtcaagcccaggactgcaggcctgcaaggtcaggctcaccccacccttgggtcttcattccccacaagaatacctgagggctgctggtctggcaggagctgggcctcattcatctggcctccctgctgtgcactt

SEQ ID NO: 138286 - DNA, 601 bp, Human; identical to SEQ ID NO: 26381

SEQ ID NO: 138287 - DNA, 601 bp, Human; identical to SEQ ID NO: 26382

SEQ ID NO: 138288 - DNA, 601 bp, Human; identical to SEQ ID NO: 26383

SEQ ID NO: 138289 - DNA, 601 bp, Human; identical to SEQ ID NO: 26384

SEQ ID NO: 138290 - DNA, 601 bp, Human
taagatgaggaagaaaatgcctcgcaggaccttggtgagtgcaacctgcacgtcagtggccccatcactgagaactgcatctcaactcttctgggagcccccgagacccgccaaggctctcctgcacctccatggctctgcctgggctgtcccctctacctgagctgccctgctagccgtccctgtctggggaacacctgccttctcttgaaggttcaggtgcagccttctccctgcagcttctcctgactctctgtggcagggactgcccacccacatgccagctctgggctcccaagacccccctgtgcagacctgtgtacaacaagacacaggctggcctggccaggctgagcccctggaggctgggcctgactgttctcacctctggactctctctgatgcccagcccagtggctggtacggagggctctgaaaaatatctgctgagggaagggtgcacggggtgtcctctgaggctgaactcccccagatcctttcttcatcctagaacaccctcagggcaggacaaactcacatgaaaatggccagaggcggataaccagcatagctggaattccagtgtcaatttgcaccaagc

SEQ ID NO: 138291 - DNA, 601 bp, Human
gtacagagtgcaagagaggtgagaggttcaagacaggttatccaggaagaggggagcctggattggactccagttctgtgagattctctagcattctttccagctgtagccaataaaatctagaacccatcatcgtaaaggacagtggatgtgggcacagatggagacttccaggttgaacccagacaatttgcaatgcactgggacacaccgagctctttccccaacaacccgtggctctctgaggtccataataaagacatttgagctaccactgatagagcactcactatatgctggrgcatatgctaagcacttcacatatattgtgtcttcattaatacacctgtgaaacccattttatagatgagaaaaccaaggctcagagatgttcagtccctttgcccaacactaccctgttagtatgtggcggagctgggtttcaagagcctaagccaagacccagagccattgtcttcaccgctgtgcagagctccctctgttgggggagtcatggggcacatggccaggagctcagggcccctgcaaccactgctgagcagtgtgggggtcctgaggcaagcagtactgtacctgagct

SEQ ID NO: 138292 - DNA, 601 bp, Human
agggctgttcctacactctccacccccactgcaccagaatcaccaaagcaccaggctcagagtccagaagaggtgccagtctaatgttgagggtggcgtccttggcaatgttttaccaccagcagggcacattttctcagtaattctgaataaagggaaatgtcatctaatattcctcacagtgtcccctcaatggtgcactctcttatcctgcaaggcatctgcacattctaaagttcactgttctcatttagtcctctgcaaagagtgtttgaggagtctctgttttgcctacagcagyggcttctaattgtggcatttcttttaaaccttttagaaggagaaaacacgaagcacgctaattgagcagaaagttcatttttcctccatgagccctgaaaggacatgaaatcctccatgcgataagagcaaagagacagaccccctcttcccccaccacccctgctgccctgactcaggctggctcaaatgctgctagcaaacagcttgcctgctgggaaagccagaggcaggcaagcttcttcctctttctgggcctcagtatctccacttgttcaagatattggaccagaaaattgaa

SEQ ID NO: 138293 - DNA, 601 bp, Human
caacaaaacctcattttatagccctagcatttgaactgcgggagcgaagacaagggctataaaatttgacatctgattttataaatctgcctcaaggactgacaatgtctgtggagaaaatgagagaagaatatacagtgcttacggggctccaaagggtgataaccctggggtgggagctgggacttctgggggctctaccagcagccttccagaggacctcaggaaggtcctcttgccttcctgtgcctcagttgaccccaccagggtcttgacctggatgattcaactccctttgggmtctgactccccaaaagtctggggaacagtcaggccctgccttaacactgggattttaccacgtgaagttagctgcttcaagccccaccgaatgcctctaggtaagggccaatcatgtttcctgtggggcctttgtatcgcttacccagctatcagtaaaataagcccctacagcacaaaggctctgcaaaccaccctacctgcatctgtgcagcctctcagagtttacaagagcttccactgccattgcaaatctgggcctcagggctcagaggctgagacgggaagtgactcactggtg

SEQ ID NO: 138294 - DNA, 601 bp, Human
aaatggcaaaaataaaattaaaattaaaaaatggttttaattaaagcatttggaataagctagctttgccaaacccaattgtttctgatattcctcttgggtgaaataatctttaaaaagataagaaaaaaaaaaaaagcaaagcattattaaaagtggcaaacactcgtgctggaaggaggatggaggctgctcacaggggagcttcctagagaagagcaggtgaaagacatagacccgcggatggaacagcctctgctccaacagagggcaagggcgcctgcgtgcgagtgtgccgcayacacaacaaaacctcattttatagccctagcatttgaactgcgggagcgaagacaagggctataaaatttgacatctgattttataaatctgcctcaaggactgacaatgtctgtggagaaaatgagagaagaatatacagtgcttacggggctccaaagggtgataaccctggggtgggagctgggacttctgggggctctaccagcagccttccagaggacctcaggaaggtcctcttgccttcctgtgcctcagttgaccccaccagggtcttgacctggatgattcaactcccttt

SEQ ID NO: 138295 - DNA, 601 bp, Human
actctgtctcaaaaaacaaaacaaaaccaaacaaaacaccattataaaagagattcactgtggaaaatccagaaaacacaaatctaaaataaaaagaagataaaaacctgccatttcatcaccacagacagtggttaatcacaatttggcatagtgccttcctatatttttcccacacacatgcgtacatgcatgtgatatacggctaccgactgggctgacctttgcaatctgattttattacaatcatggctcattttgaatgttgtgattacttttctcccaaatataatctccaaaygtttcctgagtacctatcatgtgccaggccctctggggtgttgagaccaaaagacacattcccaaagaacgctcagccaagaaaggttcctagcagatgacaaatcatttcacactacaaccctgagggtcaaaatcagatgttagatggcaaatttagaaagcaaggtcccagggtttatgtacctagatttttttcctggggggtttctagtaaaaactggaaaatctgctagacaaattctagaagagctgtaacattttatgcacctcaaactggaaacaaaaactgggtgacatt

SEQ ID NO: 138296 - DNA, 601 bp, Human
cactccagcctgggcgacagagcgggactctgtctcaaaaaacaaaacaaaaccaaacaaaacaccattataaaagagattcactgtggaaaatccagaaaacacaaatctaaaataaaaagaagataaaaacctgccatttcatcaccacagacagtggttaatcacaatttggcatagtgccttcctatatttttcccacacacatgcgtacatgcatgtgatatacggctaccgactgggctgacctttgcaatctgattttattacaatcatggctcattttgaatgttgtgattayttttctcccaaatataatctccaaacgtttcctgagtacctatcatgtgccaggccctctggggtgttgagaccaaaagacacattcccaaagaacgctcagccaagaaaggttcctagcagatgacaaatcatttcacactacaaccctgagggtcaaaatcagatgttagatggcaaatttagaaagcaaggtcccagggtttatgtacctagatttttttcctggggggtttctagtaaaaactggaaaatctgctagacaaattctagaagagctgtaacattttatgcacctcaa

SEQ ID NO: 138297 - DNA, 601 bp, Human
taactccatagccaatgagcttcctgctctgcctcattaaagaaaaaaaaaatctctattataggccaggcgactttaggaggccaaggcaggcagatcacctgacgtcaggagttcgagaccagcctgaccaacatggtgaaaccccgtctctactaaaaaaaaaaaaaaaaaatacaacaattagccgggcgtggtgatgcacacctgtaatcccagctactctggaggccgaggcaggagaattgcttgaacttgggaggcagaggttgcagtgagccgagatagcgccattgcactycagcctgggcgacagagcgggactctgtctcaaaaaacaaaacaaaaccaaacaaaacaccattataaaagagattcactgtggaaaatccagaaaacacaaatctaaaataaaaagaagataaaaacctgccatttcatcaccacagacagtggttaatcacaatttggcatagtgccttcctatatttttcccacacacatgcgtacatgcatgtgatatacggctaccgactgggctgacctttgcaatctgattttattacaatcatggctcattttgaatgttgtgattactttt

SEQ ID NO: 138298 - DNA, 601 bp, Human
tgagattagcccagctccgagctctagctcctgcaggccaaggccactgcttctgccctgtgaaggtccctcagagacaggaagacccgggctactcttttccagctgtgcccctggggcagaatttcctgtcctttcccatcctggtcgcttctgctgcccgttccccaggcagtcaccatctctcacacagcgggagtcagcaactaaacagggtcccgtggggtctgtccagcttggccatcagtccttctggctggacacaactccatcattaacacagacactcctgagcttcggytgaactcctttttggggtctgcggacctcctgagtccccccctctcccagcccctcccaagtcccaagagacagggtcttattgacatgcaagtgtcatcaggtatagtaacactcatctcttgagcaccctaaaaggtgcatggggccgagagcttttctgtggtgggaaaggatgggggtcttgctttgttgtccaggctggagtgcagtggcacattcataactcactgtaacctctaactcctgggcttaagtgatcctcctgcctcagcctcctgagtagtttaggattacaggt

SEQ ID NO: 138299 - DNA, 601 bp, Human
cttggagcgcacaatggcttttatagcccaaagggggccagcgccctggggttgacccaggcagggctggagaggggggtgggccttggggtgcctgaggatggtgctgtacgcagcccaggctcagggccacccagacctgtatctgagtccctgccctgaactgtgcctggtctgagcttcaggtcctcatctgggaagtagagctttcactgttcacccacaagggtagtctgaggtctggacagcagggaagcaaggctcgccaggtgcggaggtgccgccgagtatgcaggatgtygttggagcctggtcacctgggtacaaatctgcactctttggcaggcccctcggataagcatgacgtgaaacagggggctggcactagattccagcttaatgcatttttaaatttttaaatgaagaacagtgcctttcagaaaatactgacgccagtgcaggactcagggtcctggcgtgggtcttgttctcatctgctgggcaggagccactgcaccagtggccgcctgtctggtgtgtctggtgcacctggctggctctgtgctgtctgggctgagcactgagctaggtttcccatacg

SEQ ID NO: 138300 - DNA, 601 bp, Human
ccagtgtgggtgggagcaccacagcaggaggaacaaggcagggcagaatggctcccctcatggagggagacaggtgggtacactggccacagtggatcctgggcttggggacagcaaaatgacaaaagcaggcttctcatgcctgtgccaacaggatggacagaatccaggccaagggtgatctcttcctactgaggacaaggctatctgagcccttaggctccttaaagcagtggctcctacctggggcaattttgcactccctcttccctggggaatactcgcaatgtcttggtacatrggtgctactggcatctaagtaagaggaggccagggacgctgctaaataccctacgacgcacagcacagcccccacaacaaagaataatgtagcccagcttcccacagtgcctaggctaaagccacaccactcgctagacggccagtgcctcaaattctgcatccacaacatgggaataaccagagtccacccttgctgctgtggtgaggggcagatgagaacctccacatgaagtgtgaacgtctgacgaatcccggctcgcctggccccttatgtaaaggtgtaagacacagagcggaa

SEQ ID NO: 138301 - DNA, 601 bp, Human
catccctatgaggtgagtacacaggcacacgcttttcaaatcagaaagtctcccccagggaggccacagggaagaatgcaccagagccctcttcccttaggatttggaaaggacttattcctgaggccactcagccgcccagtgtcccctgcccaggcctaaataaaacatgaaagtgagacaagttcccttgcaaaatcatggtcttcttgaaggggtaatgtgagcgctggccctgcccctccctactcaggctctaagtggctgcgtcttttcttcttgttgggctattttattttgstattttttacccctactctttcttatgactttattttccattaccccaaagaatgtggcacaaagctgttgggccattttaaacatttaaatcttacattgtgcgaagattcctgggccaggttgttggaaggagagacagaatgagcttgtgcatttaaagtgcactcaaccatcagttgccagataattctcaggtgagggaggtgtcgcaggtcccttggccttggggagcagggcagcgagtgctcacactctgatccctgggagcactgcctctatgcttggcatggggaagggc

SEQ ID NO: 138302 - DNA, 601 bp, Human
agccaccatcccggctcctctgagcatgccatggagcagggcccagtctatgtccaccatgcttggcttcagacctgcttgggaggagccacctgaagtctgctcaaggaaaagcagtgggtgggtttctcagagatcagagcacacagcccttgcagcctgcctgcatcagctcacgagggccaaagccacagtcctcccaccagcatttgcctagccccagcagacctctcccagctctcaccagggctgcagccacactggatccctcacccctccaccagcctgtcctctgcctgcycactcagttccacgccttttatgattctactgtgattctgccaccagacgtgtggatgctttagattttccaaagcacagtccactttatcgggtgtctgtcccttaggtagaaagctggagcttctgacaaatcacctgcccccatctccacggcctccagcagactcccccaacctgagctccaagcagacttgaaggtttgcagcctttccgctccagctccgcccctagccgctgtcgctcccacaggggctctcagggcttgaacacatctcttccagtcaggactgggcttccc

SEQ ID NO: 138303 - DNA, 601 bp, Human
aggtccagcctgtgttgcctctgctgggtggttttccaggctcccacaggcagagctccttccttcatctggtggcactgaggacacgcatgccttcctgaactgtaggtacttagccaccatcccggctcctctgagcatgccatggagcagggcccagtctatgtccaccatgcttggcttcagacctgcttgggaggagccacctgaagtctgctcaaggaaaagcagtgggtgggtttctcagagatcagagcacacagcccttgcagcctgcctgcatcagctcacgagggccaargccacagtcctcccaccagcatttgcctagccccagcagacctctcccagctctcaccagggctgcagccacactggatccctcacccctccaccagcctgtcctctgcctgcccactcagttccacgccttttatgattctactgtgattctgccaccagacgtgtggatgctttagattttccaaagcacagtccactttatcgggtgtctgtcccttaggtagaaagctggagcttctgacaaatcacctgcccccatctccacggcctccagcagactcccccaacctgagctcca

SEQ ID NO: 138304 - DNA, 601 bp, Human
gggctgttctgacccagaacgtatttctctttggttttggccagtttcatgtgcataaaaccctggttgctcctgtgaacaaaacacagagttatcagaactacccccctgacactcaggctgaggccaagggtctcctcagctgtctgggacagaagggatcccagccatgaagtggctgtgagctgcacctctccaagccaggaccgaggcccaggaccagatgaaatgcagctgcacccaagcgcacccccaattccggcatctgacccggaaccagcagcagccgccactgctacargagagcattccaacactgagcgcttctagggacttcttcagaaaaacaaaacaaaacaaaacaaaacaaaacaaaacaaaacaaaacttagtccctcttttctattaccagtgcatatccctgtttaagccttgcctgacaggtgcaaagtgtgttcatgtccccaatgccatgacaagtgggtagggcaggggtcatcacccccagtttccagaggaggaaactgtgtggcagggatggcaagtgatctgtccttccctttcagtagtaggaaactgtcactgggaaggggccacccag

SEQ ID NO: 138305 - DNA, 601 bp, Human
ggatgacttccgggacactgtcgaacggagggctgttctgacccagaacgtatttctctttggttttggccagtttcatgtgcataaaaccctggttgctcctgtgaacaaaacacagagttatcagaactacccccctgacactcaggctgaggccaagggtctcctcagctgtctgggacagaagggatcccagccatgaagtggctgtgagctgcacctctccaagccaggaccgaggcccaggaccagatgaaatgcagctgcacccaagcgcacccccaattccggcatctgaccyggaaccagcagcagccgccactgctacaagagagcattccaacactgagcgcttctagggacttcttcagaaaaacaaaacaaaacaaaacaaaacaaaacaaaacaaaacaaaacttagtccctcttttctattaccagtgcatatccctgtttaagccttgcctgacaggtgcaaagtgtgttcatgtccccaatgccatgacaagtgggtagggcaggggtcatcacccccagtttccagaggaggaaactgtgtggcagggatggcaagtgatctgtccttccctttcagtagtag

SEQ ID NO: 138306 - DNA, 601 bp, Human; identical to SEQ ID NO: 26385

SEQ ID NO: 138307 - DNA, 601 bp, Human; identical to SEQ ID NO: 26386

SEQ ID NO: 138308 - DNA, 601 bp, Human
ctaatttttaaaattatttgtagagacaggatcttgctatgttggccaggccgttctggaattcttggcctcaagcattcctcagcctgaattaattttctgaagaaagaaactggcacctgttttgggctaataggactggataccccaacttggttggctgcgcatatctgtgaaagataagcagggaacattcaatccaaggagtcctttggccattatgcttttctttaaagtaagctcacaaacctttttcctgggttaggtccacgctctaggtaaagagttctgaaactaaaggctacttttcataacaaaactatttacttgttccatctcttagttgtttaataaacattttcagagaatcataaattattgtgcccctagctttgtttagcaataaaaggtaatatagaaagcagcacagtattttccaattccggaagctttagcaccaagaacccagacatcctacagccagtcaagttttcacccaaaaaaatgcgaacatgaaaatttcaacataatagaatacaagtgataccacctatgtgtgcatgcacacacacttcacaaagttgtattaaaactataagtg

SEQ ID NO: 138309 - DNA, 601 bp, Human
ctttgtgagaaattgcaatctcgagtgctcacaggcagtatgaaaactgtgacatgattacatgagaagcatttcaaaggagttcataaaaagttaacaataggccgggctcacgcctgtaatcccaacattttgggaggctaaggcggacagatcacttgaggtcaagagttcaagacgagcccggccaacatggtgaaaccctgtctctactaaaaatacaaaaattagccaggcatggtggcccatacctgtaatcccaggtactcgggaggctgaggcaggagaactggctgagccygggaggtggaggtttcagtgagccaagatcacgccactgcactctagcgtgggcaacaaagtgagactccatctcaaaaaaaaaaaaaaaaagaaaagaaaagaaaaagtgttctggtgtccccttctctaaaacaaaagcaaatctgaccaattacatagaagacaggcactaaagatggcactgtcctagaaaaatgttggcaatctctttcagctaactggttgccattaaacttctatttttcagaatacattaaaaactgtgttcagccaggcatggcggctcacacctgtcatc

SEQ ID NO: 138310 - DNA, 601 bp, Human
cctttccaaaagagtttaaagagaaaagaaatggcctatttacaagctaaatatagctgccttggctcaaagaacccaatgacattgttttatgttttttggggagagtgaggtggtatagaagagttttgtttttaaatgctaaaatcaatactttcttctttgaggggagcaaatttgaaatttgctaattttgctccatgagaaaaagtagatattctctagactttttagttggtttttatacaaaatagtcagaagttttaagatctcacaaaaaacatggaatctaaaaaaaaawatatatatgtattttgtgaacatatgaatttttttaccttggaaatgaagctctaacaccctctttaactaagtactctcaacgcctctgctaagtcacagggcagagaaatgacagaaagggaaagagtacgtctgtgtgtgcacgtggaaggggtgtggggagcacctcagagacaaaggtgaaggaagaggggatgaaagcagcacattcagtgggagtggtgagcactctgcacctgagccagaggttatctccccatgcctccagcaggaagataaatgacttgtctcactctgg

SEQ ID NO: 138311 - DNA, 601 bp, Human
aatgttttctaaatatttattaggcaggactcattaagcatatgcttggggaaagctattcaatagcaaacttattaacttgcttttaaaagagacctaagagttgggcatggtggtgcatgcctctaattccagctactcaggaggctgaggtgaggtagggggtactattgagcccaggagttctacaccaacccggacaacatagagagagagagagagagagagagagaaagagagagagagagagagagagagagagagagtgtgtgtgtgtgtgtgtgtgtgtgtgtgtgtgtggataaaagagacctagatataggcttttatcaataattcgcatatgtatacactaataatttcagtcctggaaacatcttgataaagtcatatataaataaggagctgttcattgtaacagtaggcttataatgaagtctattcagaagccattccatctagcatgtacttacataaagttttcagcaacaattaaatgccaaacataaatagatacaaaatggaaaactctggggttaaggctggttaatcaaccaagacttttcgattcaacccgaggatatggctagtaaaaagacag

SEQ ID NO: 138312 - DNA, 601 bp, Human
tgttccaatatttctttagccttgtggatatttcagttccatttaaatggcatagcagccagtgtacctgggttccagccccaagatagactttattactgacaaagtcaacaaacaatattaggtgagcttcagtgaccctttgagtattagaagtctatgaggttccacgaaccatatttcttacgagttttacaaaatggtgtctaagctgggaatggcttcaatgttgcccccacttcacaacaataatttgttataaacatcctttgcttgtaaagacaaaatgggtctggagtcytaagcttgaaggtaacagaaaagctaagaacaaaagttagaaaataatttctattaaattcatagtcatacagagagaggcttagcagcttatcgacccagttactgaacaagtgacatttgtattcaatgctctcttctgcacagctaaaatattaaaaggaaaggatttagaatgcacttctttaaaaggatatggaatttaagctggatagccaaagaacacacaagaagaactgatctgctgttttagaacatactcaaaaacaccagtggctttatgtcaataagaaaagggcaa

SEQ ID NO: 138313 - DNA, 601 bp, Human
caacccactgtgttctatttctgtttacaaacaaaaacctctaaagatactaaagtataacagataatgcacaatatcatcttcaaacacaaacttctttctctaaacagttttacttccaagaaatagcagacaaagcattcctcaagaaaatggtagagacctggacagttagagggagaaaaaagaagtgtcgtgattaaacaataaaaatactttcattttgaaaaaataaaaatcattcaatattctgagctaccaatcactctaaataaagcagagaagaatcagaacgccaccmctaaaaaaaaaaaaaaaaaaaaaaaaaaaaaaaaaaaaagagagagagagaaagaagcaaatagcttaatacataatttttctaaatttcctaacatcgatatcctgacttctgctttcaaatggcactaaacataaacatttggtttaaacacttactggttctccaagtttatccaagttatccaggaaatattttacagattcaccctaaaaacaagaagaaaacaaatagttattagggcttagaaatggaagatcttgttacaacagtttacatcatactgtctggttgtacact

SEQ ID NO: 138314 - DNA, 601 bp, Human
agtcaacccactgtgttctatttctgtttacaaacaaaaacctctaaagatactaaagtataacagataatgcacaatatcatcttcaaacacaaacttctttctctaaacagttttacttccaagaaatagcagacaaagcattcctcaagaaaatggtagagacctggacagttagagggagaaaaaagaagtgtcgtgattaaacaataaaaatactttcattttgaaaaaataaaaatcattcaatattctgagctaccaatcactctaaataaagcagagaagaatcagaacgccmccactaaaaaaaaaaaaaaaaaaaaaaaaaaaaaaaaaaaaagagagagagagaaagaagcaaatagcttaatacataatttttctaaatttcctaacatcgatatcctgacttctgctttcaaatggcactaaacataaacatttggtttaaacacttactggttctccaagtttatccaagttatccaggaaatattttacagattcaccctaaaaacaagaagaaaacaaatagttattagggcttagaaatggaagatcttgttacaacagtttacatcatactgtctggttgtac

SEQ ID NO: 138315 - DNA, 601 bp, Human
ctaccgtctatgtattgtgcattactacgatgtaaatgcatacactattgtataattacattatttaatcaccacaagtaaactcccaggagtagtggcatttgccccactttacagatgtgcaaagtggggtacagacacgttaagtacccaataacttaagtgctaaagctaggattttcactcagatctcagtttcccaaacctgtatgtcatatatatatataaatatgtatacatcatactatctggcgtagcccatttttcttcttcagtcgtctgatgagcaattggtctttaytatccactttggattctgtcctcatgatttgagtatcagataggcttcattccgactcttagcacattgttgagtcccttcacgtgggcctgcattagaggaaacaatggatttttgacattggcctagggaggaaggcaggataactgtgtggacatttgggagaatcagtatagttaggcatgaaacacaggtaacatttccacaccgctattaacttgaataacacagtgcactcttttccaccagaagtagcacaagaagcgttcatgtattcaagtaacagtagtggacttagtt

SEQ ID NO: 138316 - DNA, 601 bp, Human
tgtcatatatatatataaatatgtatacatcatactatctggcgtagcccatttttcttcttcagtcgtctgatgagcaattggtctttattatccactttggattctgtcctcatgatttgagtatcagataggcttcattccgactcttagcacattgttgagtcccttcacgtgggcctgcattagaggaaacaatggatttttgacattggcctagggaggaaggcaggataactgtgtggacatttgggagaatcagtatagttaggcatgaaacacaggtaacatttccacaccrctattaacttgaataacacagtgcactcttttccaccagaagtagcacaagaagcgttcatgtattcaagtaacagtagtggacttagttgaagacacagaacattgctcagtccatgtcctggaggagtttacagtctccatggtatgcacaaaatacaaagctgtccaggtgcttattactctaagcccagactgcctcagcttgtctgcctcccctgttggttatgatgatgcctcagtccacccttaaaaaacattctgaaaaaggtcaaatgctttttatttcctctgtaacttg

SEQ ID NO: 138317 - DNA, 601 bp, Human
catatatatatataaatatgtatacatcatactatctggcgtagcccatttttcttcttcagtcgtctgatgagcaattggtctttattatccactttggattctgtcctcatgatttgagtatcagataggcttcattccgactcttagcacattgttgagtcccttcacgtgggcctgcattagaggaaacaatggatttttgacattggcctagggaggaaggcaggataactgtgtggacatttgggagaatcagtatagttaggcatgaaacacaggtaacatttccacaccgctrttaacttgaataacacagtgcactcttttccaccagaagtagcacaagaagcgttcatgtattcaagtaacagtagtggacttagttgaagacacagaacattgctcagtccatgtcctggaggagtttacagtctccatggtatgcacaaaatacaaagctgtccaggtgcttattactctaagcccagactgcctcagcttgtctgcctcccctgttggttatgatgatgcctcagtccacccttaaaaaacattctgaaaaaggtcaaatgctttttatttcctctgtaacttggct

SEQ ID NO: 138318 - DNA, 601 bp, Human
gcctcccctgttggttatgatgatgcctcagtccacccttaaaaaacattctgaaaaaggtcaaatgctttttatttcctctgtaacttggcttcccttttaaagacttgcacctttttatgttctgagtatgttttaatgttctctgcccaacttctgtctccaacataggtttctctagggaaattgattccttatccctagtgcacagtttagtaccactatgtctatatgtatatcccatctgagaatgctatttgcttcctttctgccatttcataactttttttctttgaaaacrtgcccccaatccaactcttctatgaatgcctcttgaatgtctcctcctttcttggtatgcagccttcagcttaatcctgcctgttatcctccaaatctagttgctttcccatgtttttctcatctaggcttttctatggctactgccaaactaatcttcctcagccttccccgtgaaggtttataagatttcccatttgtattcagcacttagaacaacacttagcagcttatgattggggccatctctgagtatcctaccagggatctcatttctcattactgcagaccttcgagcaat

SEQ ID NO: 138319 - DNA, 601 bp, Human
tttctctagggaaattgattccttatccctagtgcacagtttagtaccactatgtctatatgtatatcccatctgagaatgctatttgcttcctttctgccatttcataactttttttctttgaaaacgtgcccccaatccaactcttctatgaatgcctcttgaatgtctcctcctttcttggtatgcagccttcagcttaatcctgcctgttatcctccaaatctagttgctttcccatgtttttctcatctaggcttttctatggctactgccaaactaatcttcctcagccttcccsgtgaaggtttataagatttcccatttgtattcagcacttagaacaacacttagcagcttatgattggggccatctctgagtatcctaccagggatctcatttctcattactgcagaccttcgagcaatttctctttctcactgactcctgactgttcagccttttcactacacatttagttttgcccctttttttgggagtgcgagaagttctcagccctgacttcctgtgctggtttagttcttgaattctttgtcttccagaactctgcaacacttaacagtttgtgttgtccatttc

SEQ ID NO: 138320 - DNA, 601 bp, Human
gaacaacacttagcagcttatgattggggccatctctgagtatcctaccagggatctcatttctcattactgcagaccttcgagcaatttctctttctcactgactcctgactgttcagccttttcactacacatttagttttgcccctttttttgggagtgcgagaagttctcagccctgacttcctgtgctggtttagttcttgaattctttgtcttccagaactctgcaacacttaacagtttgtgttgtccatttctactgcctgtgctgctacttaactctacttgaatgcgttayaggtacccagaggacaagattcatgccatttctttcttttgtggcctcagaacttagcactgtgttttatattctattccacataaatgcttgttgatttctatttgagcattcctttaatatttatactgttttatgtaagtccagtttatgcaatattaacttgtaattccgtataaataatcaggaaaagttgtatggcgtgttgaaagcaattggttatttgtcctaccttcaccagcagttatgcagaaaatggggcaatacctacttttgcctaattcatgagattgtgaagat

SEQ ID NO: 138321 - DNA, 601 bp, Human
ttctactgcctgtgctgctacttaactctacttgaatgcgttataggtacccagaggacaagattcatgccatttctttcttttgtggcctcagaacttagcactgtgttttatattctattccacataaatgcttgttgatttctatttgagcattcctttaatatttatactgttttatgtaagtccagtttatgcaatattaacttgtaattccgtataaataatcaggaaaagttgtatggcgtgttgaaagcaattggttatttgtcctaccttcaccagcagttatgcagaaaaaggggcaatacctacttttgcctaattcatgagattgtgaagatcacatgagaaagtggtatttgagtttgaggttgctattctgtgttgttgctaaagagcaggactgatgttcaataagcagttcccactgggccatgtgtgttttggttaaacatcctttctgattggttggtacccttgtagtgccagttgttaaatatttttaatatcatttctatagggaggcattagtattcaaaaagggaaatgattagtgtaagctggaatgattgggggaggcttcttggacactttagga

SEQ ID NO: 138322 - DNA, 601 bp, Human
aaaagtgaattctaaaggtggaagggagggggaatgattaaagccttaaagttctcaaggaaaaggtcaatttttttttaattgctgataaaaggacctggtatatacttattgattgagaaaagtaggcctatagtagtttggaagatggtcttgagtaagtacagttaattgaattggggtgtagttagaaggctttggtttagaatattagatgatccgctttgttgttgaaattaagagaggaattgacataaaaataatcaagaggaagataaatcttgttcctgtgaggagggcygctcatgtagggaagacccctgtcaaaaggttctaggccttagttgagcagttacagggactcaacaccattcttgtagtgtcattttattgcaccaaatatgttcatgtgtaataaatggaattttgaaaatgccattatcctatggatggcccttctgatgtgagaacgtgtctcttcaaaccacagagccccttgcaaatgtcgacacacctcttgccttttgcagttcttccttggtcatggcttacgtaacacagagttctctgaacagatggactgtggtttgatatcatgtga

SEQ ID NO: 138323 - DNA, 601 bp, Human
aattttgaaaatgccattatcctatggatggcccttctgatgtgagaacgtgtctcttcaaaccacagagccccttgcaaatgtcgacacacctcttgccttttgcagttcttccttggtcatggcttacgtaacacagagttctctgaacagatggactgtggtttgatatcatgtgattgggtcacatctttgcttcctgcttttggaattgagggcagatgctggcatatttctcagggattttttaatgctttgtcccatagaactagcttgaggaaaagttttggagtcttctcaraatttatggtcagttttgacccagcctaactccaatacttaggattacatttaatgccattcttagctgaattttctcaatgtcaaatccaggcagtctccataaacattaaaattgtttaccactctgaattagatccaattttatgtgttttgtttgctttccaggtaagtttcttatggctacccttcttcatcatgaagaaaattggttggtagacttgtaattattcatctcagacatcactttcttaaatactagtggactaagttcagttggttttatggtccaattttatag

SEQ ID NO: 138324 - DNA, 601 bp, Human
cctatacaaatgctcctctacttatgatggggtcacgtacgtccatgctcctttcatatagagtaaatacattgttagagccacttcagcaggaaagtttcctttcccttttttgcaaaccatgagaatttgcttcagattgccttgattacagttttactatttctttgcaactgcaggccattcagatactaacagtctttctttaacattatatttttaggtaatttgaatcttcctgatgagtccagtgatagttgatcacttactatttgtattgatttatacatatattcatagmaaattcttttcttctaaaagttacataagcacaggactgaaaatttgtattagagaaaggaaaaaaaccatcaccagccattattaacatttggcatatcctgcacccatgcttttttttttttttttttttttgagtataaaaaaccattcttgggctgggcacagtagctcacacctgtaatcccagcactttgggaggccgaagtgggcgaatcacgaggtcaggagttcgagaccagcctggccaacatgatgaaaccctgtctctactaaaaataacaaaaaattagctggacgt

SEQ ID NO: 138325 - DNA, 601 bp, Human
gatggggtcacgtacgtccatgctcctttcatatagagtaaatacattgttagagccacttcagcaggaaagtttcctttcccttttttgcaaaccatgagaatttgcttcagattgccttgattacagttttactatttctttgcaactgcaggccattcagatactaacagtctttctttaacattatatttttaggtaatttgaatcttcctgatgagtccagtgatagttgatcacttactatttgtattgatttatacatatattcatagcaaattcttttcttctaaaagttacrtaagcacaggactgaaaatttgtattagagaaaggaaaaaaaccatcaccagccattattaacatttggcatatcctgcacccatgcttttttttttttttttttttttgagtataaaaaaccattcttgggctgggcacagtagctcacacctgtaatcccagcactttgggaggccgaagtgggcgaatcacgaggtcaggagttcgagaccagcctggccaacatgatgaaaccctgtctctactaaaaataacaaaaaattagctggacgtagtggcaggcacctgtaatcccagc

SEQ ID NO: 138326 - DNA, 601 bp, Human
tacattgttagagccacttcagcaggaaagtttcctttcccttttttgcaaaccatgagaatttgcttcagattgccttgattacagttttactatttctttgcaactgcaggccattcagatactaacagtctttctttaacattatatttttaggtaatttgaatcttcctgatgagtccagtgatagttgatcacttactatttgtattgatttatacatatattcatagcaaattcttttcttctaaaagttacataagcacaggactgaaaatttgtattagagaaaggaaaaaarccatcaccagccattattaacatttggcatatcctgcacccatgcttttttttttttttttttttttgagtataaaaaaccattcttgggctgggcacagtagctcacacctgtaatcccagcactttgggaggccgaagtgggcgaatcacgaggtcaggagttcgagaccagcctggccaacatgatgaaaccctgtctctactaaaaataacaaaaaattagctggacgtagtggcaggcacctgtaatcccagctgcttgggaggctgaggcaggagaatcacttgaactcaggag

SEQ ID NO: 138327 - DNA, 601 bp, Human
tcagtttacagaggaaagagcttcagtttacagaggaaatagctcatctattcttagcaaatatttagtagtgatcaacatgatgagaaatataggaaaagtaagaggcagtcttgcttttgaaaaaattgatgctgaggaaatatgactacagactcagtactagcaaccacagggactgctttacagaggaggtaggacttgatctctctgccttgcaggaggatagggctttgagtggatgtgtggtggaaaggaggcacttcttggctggagaggatggcatgtgtggagaaagagyattctaagtttcaggatttctaagaggagaaatggaagttcatggtgtaaagggtgggctcagagaattatgggccttgaaaatcaggagagtggttttaatgtggaaaaagaatgtctaattgtgccgcagagggaatggatcagggtggctacccagttggtttgatggcattgagaacggggtgaaatggtgactgtatgacatttgaaacaaagaaatcagaggaattagtagtagggcctgtgtgtggctgttcccttgcttgtgtgctcttccctcacatacctgcatggcttc

SEQ ID NO: 138328 - DNA, 601 bp, Human
atataggaaaagtaagaggcagtcttgcttttgaaaaaattgatgctgaggaaatatgactacagactcagtactagcaaccacagggactgctttacagaggaggtaggacttgatctctctgccttgcaggaggatagggctttgagtggatgtgtggtggaaaggaggcacttcttggctggagaggatggcatgtgtggagaaagagcattctaagtttcaggatttctaagaggagaaatggaagttcatggtgtaaagggtgggctcagagaattatgggccttgaaaatcaggwgagtggttttaatgtggaaaaagaatgtctaattgtgccgcagagggaatggatcagggtggctacccagttggtttgatggcattgagaacggggtgaaatggtgactgtatgacatttgaaacaaagaaatcagaggaattagtagtagggcctgtgtgtggctgttcccttgcttgtgtgctcttccctcacatacctgcatggcttcctccctcacctcctgcaagtctttgctcagatgacacctttttctcagtgaggcttatcctgccaccttttaaaatattgtcatcatcc

SEQ ID NO: 138329 - DNA, 601 bp, Human
tcttttgggagtgtggttcttggctgagataaaagagaggaagtttcctgcttgcggcctaggcctcaggtcatggttgctgatgttacaggtgtcagctttactatctcctggagctccctgatggctatccttttaaatgcttttcctgttgtttttctcaatgaaccaaacactggtgcagttgtatccctagaccatctctctttttctatttggattgatctaacttaagtttttctttcagttttgaaggcagattaaattcatgtgacttggttgtcagaaatttaatgaaatmtttgtttataggagtagtatataagcaccaacatatctggctgtaattagagtctaatcagtgtatctgtgactcacttttcaaaagaggatagttcctaatttacctgatcgttgtgaagatagtgtacagtagtatttacacttagtacatagcctgacaccagtaggtgttcaataaaggggaattattatatatttaaataagtgaaagaatgtcttctgaaagaagaaatacatgtctgtgtaatgaagaactagaattaattggtagactgaaaggcagaattcagctcaatgt

SEQ ID NO: 138330 - DNA, 601 bp, Human
attttgctttccttctttccatggtgcattgtccttttgttttcttccctcttatttcgatgcatgtataaacttgagcctttctgctctcacattctttctccccatgatcataattgtttcttcactttattcttaaaaaaaaaaaaaaggccacataagtattttatgtagatctcatctatcatttaagttttgtcagatccagcctgctcttgccttaccatgggagaagggaaaggagggaggagttttaagggattttaggcatcaggcagaagtcttaagggaaaactctgcraggaccaacaggctcagaattagctgtgcattgcaaacagatggtgtgtccctgaggaaatagcgtagttgccctaagcaattgggtgcttccatctgatttagcttagtctctgtaactgggaaaaaggaaaatcttatggaagaaatgagtataatcacctgtgaaccattctaaactattatctagagactagtgattattgacttacatatagatttcataattctgcaagatagtcttcggtgttgtatcatcagttatccaaggtataaataacatcaagacccttatgcctct

SEQ ID NO: 138331 - DNA, 601 bp, Human
gaaaactctgcaaggaccaacaggctcagaattagctgtgcattgcaaacagatggtgtgtccctgaggaaatagcgtagttgccctaagcaattgggtgcttccatctgatttagcttagtctctgtaactgggaaaaaggaaaatcttatggaagaaatgagtataatcacctgtgaaccattctaaactattatctagagactagtgattattgacttacatatagatttcataattctgcaagatagtcttcggtgttgtatcatcagttatccaaggtataaataacatcaagacmcttatgcctctgagcctgatagatccttatcttttaataaccaaccccccactttcttcagtagccatgatgctactgtatcaatgctaccagcaattggaaacccatattcctaatgccaagtctcggcatgtagattttgaggtctgaaaactttattagcttggttacagtacatctcaagcctaagttttcatatacacatagtttagtctcaaagggcaaatgtttccctgaaaggagttcagtcaacactagatgcttatatctttaggctccaagggagtccaaaatttaatg

SEQ ID NO: 138332 - DNA, 601 bp, Human
ctttcttcagtagccatgatgctactgtatcaatgctaccagcaattggaaacccatattcctaatgccaagtctcggcatgtagattttgaggtctgaaaactttattagcttggttacagtacatctcaagcctaagttttcatatacacatagtttagtctcaaagggcaaatgtttccctgaaaggagttcagtcaacactagatgcttatatctttaggctccaagggagtccaaaatttaatgattaaaaatattataaaaatgcaaatatagaaataatacaaaagctccttcmttttggtgggcttttctgtccttgcttggttcaattcagctgtgttcttctaggagactgcaaccacaatttaactgctttgctttggtattttgtttgacaagggagatgaatgtttcagatgagacggagtctcactgttgtcacccaggctggaatgcagtggcgcgatcttggctcactgcaacctctgcctcctgggttcaagtgattctcctgtctcagcctcccgtgtagctgggattacaggcatctgccaccacgcctggctatttttttttttttttttgtatttttagt

SEQ ID NO: 138333 - DNA, 601 bp, Human
gattaaaaatattataaaaatgcaaatatagaaataatacaaaagctccttccttttggtgggcttttctgtccttgcttggttcaattcagctgtgttcttctaggagactgcaaccacaatttaactgctttgctttggtattttgtttgacaagggagatgaatgtttcagatgagacggagtctcactgttgtcacccaggctggaatgcagtggcgcgatcttggctcactgcaacctctgcctcctgggttcaagtgattctcctgtctcagcctcccgtgtagctgggattacaggcatctgccaccacgcctggctatttttttttttttttttgtatttttagtagagatggggtttcaccgtgttggccaggctggtgtcgaattcctgacctcaggtgatctgcctgcctcggcctcccaaagtattgggattacagcgtgagccaccgtgcccggccttcaattttttgctttaagttagaatcctgtttgcttactttttctgacccaaatgttttaaaaatgttttcctgtgttttcatttaaaagattggttttacctctcacattgagatgtatctggagttggt

SEQ ID NO: 138334 - DNA, 601 bp, Human
aaagctccttccttttggtgggcttttctgtccttgcttggttcaattcagctgtgttcttctaggagactgcaaccacaatttaactgctttgctttggtattttgtttgacaagggagatgaatgtttcagatgagacggagtctcactgttgtcacccaggctggaatgcagtggcgcgatcttggctcactgcaacctctgcctcctgggttcaagtgattctcctgtctcagcctcccgtgtagctgggattacaggcatctgccaccacgcctggctatttttttttttttttttgtatttttagtagagatggggtttcaccgtgttggccaggctggtgtcgaattcctgacctcaggtgatctgcctgcctcggcctcccaaagtattgggattacagcgtgagccaccgtgcccggccttcaattttttgctttaagttagaatcctgtttgcttactttttctgacccaaatgttttaaaaatgttttcctgtgttttcatttaaaagattggttttacctctcacattgagatgtatctggagttggttatttattatggtatgagatttttattatttttaaaatacg

SEQ ID NO: 138335 - DNA, 601 bp, Human
gccctaaattcaggggtgaaatattatctggactagaggaaaattttatgtacattatatggtgttctctattttgacaagcttactttgatattactgctgcaaggtagccccaggagggttgaattgagaagaactgagtattttgaggaacaaaacctaggatagtaggctggagggaattggaggtcagggttttagccatgtatacagagataagcaacatatttaataaaaagaaaaggagaatctatatagtatgctttactccaaagctggatgagggagaaaagaggacacrtctccttgagaagggggcatgtgttgagaatggagaaaaggggtaaggcagattactcagaagaactggggtagaagaataggttggatgataaaaggggctgacattagtccctgaaagttttttttaaataacttccaacttttgccttcacctttgccagcagtgatgtgatctgctttcagctgtagtgaagcaaactgcataaaggacattgtgcatgttaggtcttttacttgcctgttggtacatgtttgtaatatttggaaatactctcactgcgaagaaaagtatagttgt

SEQ ID NO: 138336 - DNA, 601 bp, Human
tggtgttctctattttgacaagcttactttgatattactgctgcaaggtagccccaggagggttgaattgagaagaactgagtattttgaggaacaaaacctaggatagtaggctggagggaattggaggtcagggttttagccatgtatacagagataagcaacatatttaataaaaagaaaaggagaatctatatagtatgctttactccaaagctggatgagggagaaaagaggacacgtctccttgagaagggggcatgtgttgagaatggagaaaaggggtaaggcagattactcrgaagaactggggtagaagaataggttggatgataaaaggggctgacattagtccctgaaagttttttttaaataacttccaacttttgccttcacctttgccagcagtgatgtgatctgctttcagctgtagtgaagcaaactgcataaaggacattgtgcatgttaggtcttttacttgcctgttggtacatgtttgtaatatttggaaatactctcactgcgaagaaaagtatagttgtgctgtagtgggtagggtgaggaaaataagggtcatcaccagcaaagtcagagtgatgaa

SEQ ID NO: 138337 - DNA, 601 bp, Human
acaagggtgatagaaatatctgttccatatattaatactatacacaactgtttacctctcagcttttctagcaagacatatgggcttgtgaattaaccctgggtagccctggcattagatagaattaatagtgcttccatatgtgacctcgagacgtactgaaatgaggcaaccaaggaaatcctttatattgggaccaagagccaagatctcaacttgggatatgttaccccgagagttgttaccccgatactataataccatgaataataaccccaagggtcctgttgtctctttttcytcatgtcacttcctttggtactaactgtcaccatgctaacatctgcaaactttgaaaattctgatttattctgcaatatttggaaatttcactgctagtaattgtatttcctggcatggttctgatataattttctgtgtacacagtagcttttccttttagtgctgaatcacactgaaatccttgtttaacctaagttatagttgcaagggagctatcaagacaaataattacagtgatggtgaagtgaatacaagtcaaacatcccaatctgaaattcaaaaccttttgagcacacca

SEQ ID NO: 138338 - DNA, 601 bp, Human
ttaaagttcagggttacttagcatggggatagtggtatagcaaatagttgcgtaggtttcactcgtgggctggtgataatatagtgaggattcacatccgcctgtaatctgggtagaatatttgtataaatcattttggttttttggttttctttttaaaatttttaaaattgttttgcttttcttaagttttggtttctacattaataaaatgacagaactgaattgcctagatgatattcaaagtttcatgtggttctgttagtctgggattctacagtggaattttgtcactactttygggaagaagtttacctttggtggcctacgaataaaaaccacattggcacaatgccatttatcatatgggataattctgtgtgtttatataatcatttatgttcgtttccaaatgtgttaataaagtacagtatctcatttgattagctcagatgatgaaataggtcagagaggtattatgtttattttcctgatgaaataaaacatcgtagttagcatcttgaacaatttaaatttgatcatcttacttggtatgccagccactaaggatgaaatcctgccactgagaaagaaaacccag

SEQ ID NO: 138339 - DNA, 601 bp, Human
aaaaaccacattggcacaatgccatttatcatatgggataattctgtgtgtttatataatcatttatgttcgtttccaaatgtgttaataaagtacagtatctcatttgattagctcagatgatgaaataggtcagagaggtattatgtttattttcctgatgaaataaaacatcgtagttagcatcttgaacaatttaaatttgatcatcttacttggtatgccagccactaaggatgaaatcctgccactgagaaagaaaacccagtcaggaaagctttctcacccttatctatctaacaaattgtacatattctccaagttctgacttgaatgctggtgaagcttttcttgataatctcttctaccgcagcagagtagaaacactttgatcattcttctcaggactcaggattttaattatctgtttaatgcctttcccttccaccctagtgaactactcaagtgcaaataccttgtcttactcatctctgcacctcatagcccacactgtacctggcatatagagatgcttagtgaataattgcagaattaaatgaaagagtcaaggtgatgtgttgcagagtgaggagaacttggg

SEQ ID NO: 138340 - DNA, 601 bp, Human; identical to SEQ ID NO: 30799

SEQ ID NO: 138341 - DNA, 601 bp, Human; identical to SEQ ID NO: 30800

SEQ ID NO: 138342 - DNA, 601 bp, Human; identical to SEQ ID NO: 30801

SEQ ID NO: 138343 - DNA, 601 bp, Human; identical to SEQ ID NO: 30802

SEQ ID NO: 138344 - DNA, 601 bp, Human; identical to SEQ ID NO: 30803

SEQ ID NO: 138345 - DNA, 601 bp, Human; identical to SEQ ID NO: 30804

SEQ ID NO: 138346 - DNA, 601 bp, Human; identical to SEQ ID NO: 30805

SEQ ID NO: 138347 - DNA, 601 bp, Human; identical to SEQ ID NO: 30806

SEQ ID NO: 138348 - DNA, 601 bp, Human; identical to SEQ ID NO: 30807

SEQ ID NO: 138349 - DNA, 601 bp, Human; identical to SEQ ID NO: 30808

SEQ ID NO: 138350 - DNA, 601 bp, Human; identical to SEQ ID NO: 30809

SEQ ID NO: 138351 - DNA, 601 bp, Human; identical to SEQ ID NO: 30810

SEQ ID NO: 138352 - DNA, 601 bp, Human; identical to SEQ ID NO: 30811

SEQ ID NO: 138353 - DNA, 601 bp, Human; identical to SEQ ID NO: 30812

SEQ ID NO: 138354 - DNA, 601 bp, Human; identical to SEQ ID NO: 30813

SEQ ID NO: 138355 - DNA, 601 bp, Human; identical to SEQ ID NO: 30814

SEQ ID NO: 138356 - DNA, 601 bp, Human; identical to SEQ ID NO: 30815

SEQ ID NO: 138357 - DNA, 601 bp, Human
cagcagtatttccctgtgattctgtatttctgaggagagaaagcatgtgcatatatgtacgagtgtgcccctgcatgtacaaaggcagcggatatgccaaaacattgagtgcttttctctaggtgatacagcacacttgctttttagattttcttcattttagcttatcggggttttcaagcatgaataaatattacatttgacattaccaaaatcaacccctacagtatgtttacacctggtatgttgaggacagttcttccatctttcttaggctgtcttaccaccagcttacctggtrgcagactccagctactgtctcccagtgagaaatgtgaggagtgtgaggcatggcgaaccgaaaaacaggcacacttaccatgtagtcacattgtgctgtgtctgcttcccctgtagagtctgtctgaccttggcctcgccctctcacttcagttgactggcaccatcagctgaccgtctccctagatcgactggccttcatttcttttttttttttttccttttctctatttttaatggaaaatctcagacatacaaagtggggaggagagtataaaccctcagcctcaacgactgtgaa

SEQ ID NO: 138358 - DNA, 601 bp, Human
taaaagttaccatacaaattttgccaaaatcaaggatgttttagggaacatgaggtttaccatctcgtccccatatatgtgctttagagcttggagattgttttaaaatgagatttattttttttaaatgcatttggttttttggatcttaatatgttaaatgactgtaaaatgatatcacttgtgcagcctgttgggaggagcatggtgcaagagagttggttctgacatcaggagcctgagtttgacttccagtttggtcacttaccagccatgagaccatggcaagatacttagcccrtcagatcctgtcttctctcatgtgaaatgggatggtgatgcccttgtcacaaagttgccaagggtctgcattagaggaattggattagatgcctggcaccccacaggcactcagcacatgtctccaggctgctgagcttctgggtgacctggcactcatgggataatgcctgaacattgctgctgttcttcccagcttctgtcccagtccaacctgctaagctccaggcccatatatgcccctgcccgcaggagatcttatcccagatccaccgtgtctaaaaccagcatctcagttccc

SEQ ID NO: 138359 - DNA, 601 bp, Human
aaatgagatttattttttttaaatgcatttggttttttggatcttaatatgttaaatgactgtaaaatgatatcacttgtgcagcctgttgggaggagcatggtgcaagagagttggttctgacatcaggagcctgagtttgacttccagtttggtcacttaccagccatgagaccatggcaagatacttagcccgtcagatcctgtcttctctcatgtgaaatgggatggtgatgcccttgtcacaaagttgccaagggtctgcattagaggaattggattagatgcctggcaccccacrggcactcagcacatgtctccaggctgctgagcttctgggtgacctggcactcatgggataatgcctgaacattgctgctgttcttcccagcttctgtcccagtccaacctgctaagctccaggcccatatatgcccctgcccgcaggagatcttatcccagatccaccgtgtctaaaaccagcatctcagttcccatcttgttcattggctctgccagtttgcccaaatgagaaacacagaagctattcgagacctatcttttttccttacctaccccagcccatcctgctttcataact

SEQ ID NO: 138360 - DNA, 601 bp, Human
ggttgtctgctttcaaaccctgtctcctgataagatgttatcagtgacaatgcatgcccgaaacttcattagcaattttaattttgcctcagtcttatggtcctgtgatcttgccctgcctccatttaccttgtgatatcttactaccttgtgaagcatgtgatgtctgtgacccacaccctattcatacactccctccccttttgaaaatcactgataaaaacttgctggttttactgctcagggggcatcacagaacctgccgacatgtgatgtctccagctttaaaatttctcttttrtactctttccctttatttctcagaccggccgacacttagggaaaatagaaaagaacctacgtgaaatatcaggggtgaatttcacccaatacataactctgcctggatttgttccctcctgtacctcctcattgccttgtcttattgactgtaataacaccgtaacctgcctcccagacaccagtctggcagcctttccctgagttagtctatacccctaccggaatgatctctgaaaatcaaatctcatcttaaagattgcagctcagaatcctttaatggtgcctccttacctttggt

SEQ ID NO: 138361 - DNA, 601 bp, Human
gatgttatcagtgacaatgcatgcccgaaacttcattagcaattttaattttgcctcagtcttatggtcctgtgatcttgccctgcctccatttaccttgtgatatcttactaccttgtgaagcatgtgatgtctgtgacccacaccctattcatacactccctccccttttgaaaatcactgataaaaacttgctggttttactgctcagggggcatcacagaacctgccgacatgtgatgtctccagctttaaaatttctcttttgtactctttccctttatttctcagaccggccgayacttagggaaaatagaaaagaacctacgtgaaatatcaggggtgaatttcacccaatacataactctgcctggatttgttccctcctgtacctcctcattgccttgtcttattgactgtaataacaccgtaacctgcctcccagacaccagtctggcagcctttccctgagttagtctatacccctaccggaatgatctctgaaaatcaaatctcatcttaaagattgcagctcagaatcctttaatggtgcctccttacctttggtaaaaattcaaactttgcagcaacctggaccttg

SEQ ID NO: 138362 - DNA, 601 bp, Human
gatgtctgtgacccacaccctattcatacactccctccccttttgaaaatcactgataaaaacttgctggttttactgctcagggggcatcacagaacctgccgacatgtgatgtctccagctttaaaatttctcttttgtactctttccctttatttctcagaccggccgacacttagggaaaatagaaaagaacctacgtgaaatatcaggggtgaatttcacccaatacataactctgcctggatttgttccctcctgtacctcctcattgccttgtcttattgactgtaataacacygtaacctgcctcccagacaccagtctggcagcctttccctgagttagtctatacccctaccggaatgatctctgaaaatcaaatctcatcttaaagattgcagctcagaatcctttaatggtgcctccttacctttggtaaaaattcaaactttgcagcaacctggaccttgctccatcccttgtttcttagctctccccaacatgtaccctgtactttatccacgtgcaacactttatgattcccacaatgtcacacttttgtgcctttaatgtattgtttcatctgccagcttattct

SEQ ID NO: 138363 - DNA, 601 bp, Human
catagaaaggcccaggtcccagaagtatcaaggtctaatgctgctttagtatttgtcactccttcaacccagtgaaatagagcagctgtgccattgtgggagtcactgggatggaaccagctgcttcagagctgggctctggagtctgatggacttgggtttgcgttccagttccctctctcagcacgcctgcatctggcttcagatttgtagcttctaacatccttctatcctgctgcggggaaggaatgtgctgatcagaaataggagcatcaggtcctcctgacagttgcctttcttwggtaaaatcagtaaatatatgggtttgcatattgagctctgagaattttattagcatgagtcataatccccgagttcagtcagccctgatgagaccaggttggtgaggtggctgggtatagttggcctcagacacttggcgaattcacagaggtaaagatggccctataagacctctgacagccagacacccaatctcttgtggtgatggcctttctttctaattcctaattcctaaagtttgagttagaaaagttcattgccacaatctgcgaaatgagttcaggagcctgaggaaatc

SEQ ID NO: 138364 - DNA, 601 bp, Human
aaaggcccaggtcccagaagtatcaaggtctaatgctgctttagtatttgtcactccttcaacccagtgaaatagagcagctgtgccattgtgggagtcactgggatggaaccagctgcttcagagctgggctctggagtctgatggacttgggtttgcgttccagttccctctctcagcacgcctgcatctggcttcagatttgtagcttctaacatccttctatcctgctgcggggaaggaatgtgctgatcagaaataggagcatcaggtcctcctgacagttgcctttctttggtaraatcagtaaatatatgggtttgcatattgagctctgagaattttattagcatgagtcataatccccgagttcagtcagccctgatgagaccaggttggtgaggtggctgggtatagttggcctcagacacttggcgaattcacagaggtaaagatggccctataagacctctgacagccagacacccaatctcttgtggtgatggcctttctttctaattcctaattcctaaagtttgagttagaaaagttcattgccacaatctgcgaaatgagttcaggagcctgaggaaatcatgct

SEQ ID NO: 138365 - DNA, 601 bp, Human
tgctgcggggaaggaatgtgctgatcagaaataggagcatcaggtcctcctgacagttgcctttctttggtaaaatcagtaaatatatgggtttgcatattgagctctgagaattttattagcatgagtcataatccccgagttcagtcagccctgatgagaccaggttggtgaggtggctgggtatagttggcctcagacacttggcgaattcacagaggtaaagatggccctataagacctctgacagccagacacccaatctcttgtggtgatggcctttctttctaattcctaattyctaaagtttgagttagaaaagttcattgccacaatctgcgaaatgagttcaggagcctgaggaaatcatgctgctttcttaaagattggatctcaactggacctgctttgtagtacttttttttgaaagtacagctgtcttcacccactacttctcctcctcttaaaacataaatgcaggctgggtgcggtggctcacacctataaccccagcaatttgggaggccgagatgggcggatcacttgaggtcagaagtttgagaccagcctggccaacatggggaaaccccgtctctactaa

SEQ ID NO: 138366 - DNA, 601 bp, Human
tccagtgttttaagaagtaagtagtaaatgaatgcatgcttatcaaaaatagaatttgaataatacaggagtatgaaacatagaaagctaaagtctcccctttatacaatgtgttattctatttgtaatccatgttaactttatgtctttcttttttgtgcatttgcatatgcaatggtgtgtgtgtatgaatgaatatacactaatggtcttgaagtttttttttttttcacttaaatcagatcctagtatatacatatatatattattttgcaactttaaaattctcatatcatttaaygtgagcctttactaacattttgtatcttgaatctgagtaagggattgtatacgcaatattatatcaggaaaattgatttgcccttactgtggcttttggaaaaaagtggcacccagggcagatcatcagaaacctaaatttaagttgtttttccaaagtttagctgtcagttctctggaattctgaaacacatggaagttttagtaagtgattatagaactaacatcacagaagcaccaaaagactgtgatacacctaggtagtacttttttcaactctacctgtgaaagattttaaggg

SEQ ID NO: 138367 - DNA, 601 bp, Human
agaaaatctttcaaagatatcttctgaaaaacttaaacttcatatacatttcgcagtaaagatgttttagggggaagagtgggtggatttttcttttaatctttttttatttgtttttacttcttgggtgggagcagcctgcatttgaatctgacttgaagtctaggtgaaaacacacacacatgaagttctgccatgagagcttgtcaacacaagtatatgtcagtgcaagtatatgtttgagctttttcatccactggaagcttactcctttttttgatcccaagtaactgttgcatawctagcgatctctgcctcttcacgtgggtttccataatgcctatccctttctttccctgtgtttcttcttttgtttgggacatcctctcctctgttcctgccaaatcttacctgtccttcaaggccagcttaaatcttattctgttaggaatcctttactttccagcctacgaagctccctgttcttcagtttgccagatgatttagtgtcctgagtgggcctgtagcccttgaagggaagttgtcacttgagttgacttggtaagtagactctcagctccctgaatgcaagagctgagca

SEQ ID NO: 138368 - DNA, 601 bp, Human
aaatcttattctgttaggaatcctttactttccagcctacgaagctccctgttcttcagtttgccagatgatttagtgtcctgagtgggcctgtagcccttgaagggaagttgtcacttgagttgacttggtaagtagactctcagctccctgaatgcaagagctgagcagataaataggcatttaatatcctaaattgagtgaccttgaaattattcttcgattaagtgagaatcttggtaagcctgaatatagacacctaatggtctataacacctttaggtggggaaaaactaaacarctctgaggataggttttttgttgctgtttttgtttttttaaatccatccccacatccttagcatccaaaggtgtgcatattaaaatgtcttcgttggccccgtgcagtggctcatgcctgtaatcccagcactttggaaggctgaggcaggaggatcgcttgagcccaggagtttgataccagcctgggcaacacaggaagaccatatctctacaaataactttttaaaaattagccatgtgtggtggtgtgtgcctatggtcccagctacttaggaggctgaggcaggaggatcacctg

SEQ ID NO: 138369 - DNA, 601 bp, Human
tgaagggaagttgtcacttgagttgacttggtaagtagactctcagctccctgaatgcaagagctgagcagataaataggcatttaatatcctaaattgagtgaccttgaaattattcttcgattaagtgagaatcttggtaagcctgaatatagacacctaatggtctataacacctttaggtggggaaaaactaaacagctctgaggataggttttttgttgctgtttttgtttttttaaatccatccccacatccttagcatccaaaggtgtgcatattaaaatgtcttcgttggccmcgtgcagtggctcatgcctgtaatcccagcactttggaaggctgaggcaggaggatcgcttgagcccaggagtttgataccagcctgggcaacacaggaagaccatatctctacaaataactttttaaaaattagccatgtgtggtggtgtgtgcctatggtcccagctacttaggaggctgaggcaggaggatcacctgagcccagaaggttaggccatgcataccagttgggtgacagagcgagaccttgtctttaaaaaaaaaaaaatcttaataaaacgtgttacaaagaagagaa

SEQ ID NO: 138370 - DNA, 581 bp, Human
cctaatggtctataacacctttaggtggggaaaaactaaacagctctgaggataggttttttgttgctgtttttgtttttttaaatccatccccacatccttagcatccaaaggtgtgcatattaaaatgtcttcgttggccccgtgcagtggctcatgcctgtaatcccagcactttggaaggctgaggcaggaggatcgcttgagcccaggagtttgataccagcctgggcaacacaggaagaccatatctctacaaataactttttaaaaattagccatgtgtggtggtgtgtgcctrtggtcccagctacttaggaggctgaggcaggaggatcacctgagcccagaaggttaggccatgcataccagttgggtgacagagcgagaccttgtctttaaaaaaaaaaaaatcttaataaaacgtgttacaaagaagagaactgaacatgtgaatatgcagttgtgaactagcaacttaggcctgacctcttaacaaactttgaaagtgaatacttcttaatcaaaatatgtgtaccatttgtaatcctagcccattgaagagagactaagttttgtga

SEQ ID NO: 138371 - DNA, 601 bp, Human
cttgggaggctaaggcaggagaatggcgtgaactggggaggcagagcttgccatgagcagagatagtgccactgcactccagcctgggcgacagagcaagactccgtctcaaaaaaaaaagagtacctgatgaagttaaacttgaaaaaaaaagaatctagtcatctttgccctttggctcaaaatggtaatcaacagatgggaatgaagtcagaagaaactctaccatttgtccttttctccaaaaggcagaatttgtaccagccaaaaccgtgaagatttcaatgtagagatgggtgtaaaaaaaaatcagctattgctgtataacagtcccagaatctcaacagcagtcaacagtaagaatttatttcttacacatcttctagttgtttgggaggtcagccgacctaggtgagcacagtcaggaagctctgctttgcactgcagtagccaggttgggagcttacactgaaccatacatctgcagggcagccgggacaactctgttccatgtgtgtttcttttggggtccaagctaaaggagaaagcagctgtcttgtgaccacagagactcaagggggcaagtgaaaacacacagtat

SEQ ID NO: 138372 - DNA, 601 bp, Human
tacctgatgaagttaaacttgaaaaaaaaagaatctagtcatctttgccctttggctcaaaatggtaatcaacagatgggaatgaagtcagaagaaactctaccatttgtccttttctccaaaaggcagaatttgtaccagccaaaaccgtgaagatttcaatgtagagatgggtgtaaaaaaaaatcagctattgctgtataacagtcccagaatctcaacagcagtcaacagtaagaatttatttcttacacatcttctagttgtttgggaggtcagccgacctaggtgagcacagtcrggaagctctgctttgcactgcagtagccaggttgggagcttacactgaaccatacatctgcagggcagccgggacaactctgttccatgtgtgtttcttttggggtccaagctaaaggagaaagcagctgtcttgtgaccacagagactcaagggggcaagtgaaaacacacagtatctctaaggcctagctaaggaccagcacagcatcacttctgttcacggtgccattgatcaaagcaaatcacatggttgagcccaaagctggaatggggaaatacagtccacccgtcttcggtgg

SEQ ID NO: 138373 - DNA, 601 bp, Human
aataattactctctttactttcactagttacctctcctattctgcattgtaaatagtcatgaatgaaattcatattatcactcagcaagcaaggagatgcaattccattttgtttcttcatcaccaataaatttgaccactaatatgttaagtctcaaattgtatacatttaatttttctctctgacagggcagacagtttacagaagaatcaagacctggaatttgaaagaaatagagagcgatttgaatttttaaaggtatgggcagggtctggttccattgtttggttttctttgtakgcagggtacgagggagagatgccaaggagatgggctgagtagaagtacttcacgcgttcatagtgttctttccatttgtcaatcccagtggggttcccaggcttttcacaacatgcggattattccccctggctcaggaatcatccaccaggtgaatttggaatatttggcaagagtggtatttgatcaggatggatattattacccagacagcctcgtgggcacagactcgcacactaccatgattgatggcttgggcattcttggttggggtgagtgttcttccatatatgctgtttt

SEQ ID NO: 138374 - DNA, 601 bp, Human
ttgctgtcaacctctttacagatctgtagggtagattgattgactagttaattaacattagagaaaactgaggagcagagaagtgttcatacccaaggctaataaacagcagagtcagaatccaaccctgcaactgcctggccccatacaggaacagcactctgcaacacccctctcagggatgtctaaaaaatgaaatgagtccaggcatggtggctcactcctgtaatcccaccactttcagaggccaaggcaggcagatctgacctgaggtcaggagttcgagaccagcctggccaayatggcgaaactcccaggaggtggaggttatggtgggccgatctcgcaccactgcgctccagcctagccaacagagagactgtctcaaaaaaaagaaaaaagaaaagaaatgagagtgtgatgtgataatgagaaagaaaggggaggtggctgaagtaccccagaggtgcttgcacagatctctggatgaagtgaagggacagccatgggaagggtttcatgagaatcttacagactccaaataaatcttagtcttctgctgtagcctgaggaaattcctctagaaatagtaaagattgtc

SEQ ID NO: 138375 - DNA, 601 bp, Human
aaagtctcttctccaactcatattactctgttctgtgaactccataagacttggttcagataccagctactctgcattgggttctcagaatctcatagcagaaagtcccctttcccttattggacacttcatggtgcttgggctgaaatacttcgatagcattccatattctttaacttacattgttggtactttatttgcatgtatgatttctgttgctagactgtacgtgtgagaataggatttgtgtctgaatcaccttgggagcccgcaaggtacctagcacagtatcttacatgcrgtagattttcaatgaacatttcccaaaagaatgattaagatgtatgatggattttatctgtgagacaccagtattatgccaaatattcagctgtactttgtttgcgttgttgatcatgattaattgagtctggtcaaaatagcgcctttttctaaatttccataaggttagaatccatagtcttaatcagtccatatccattaaactgtacaataatgtcattgagttcaatttagactaactttaaatttgtagttttagcatttacatttttgaggtgggaaggaagtaattgttact

SEQ ID NO: 138376 - DNA, 601 bp, Human
attgttagcaaagaaagctgtggatgctggcctgaacgtgatgccttacatcaaaactagcctgtctcctgggagtggcgtggtcacctactacctacaagaaagcggagtcatgccttatctgtctcagcttgggtgagggagagttttcttttgcaccattgcttttgttgaattgtatccctcatgtatcttgctgtgtcaccttgtaacagatgtgagattatctgatgatatctaattgcatagtcgtttatcagttggtagttagacttaaacccttacattccatctaaagagrgccctcttgccctctagggcacctaccatgaatggagtttgcaggactggaagttgctttggttgagtcagtgaatgagtggagagtgaatgtgaaggcctaggacattaccacacactactgttgactttataaacactggacacttaggccacactaacttaataaaaaaaagtttctttcttcaataatgtaaaccgtagcttacttttattttacaaacttttaagtttattgaaactcttgactcttaaaacacttagcttaaaacaaacatattgtatagctgttccaaaatat

SEQ ID NO: 138377 - DNA, 601 bp, Human
taaacccttacattccatctaaagagggccctcttgccctctagggcacctaccatgaatggagtttgcaggactggaagttgctttggttgagtcagtgaatgagtggagagtgaatgtgaaggcctaggacattaccacacactactgttgactttataaacactggacacttaggccacactaacttaataaaaaaaagtttctttcttcaataatgtaaaccgtagcttacttttattttacaaacttttaagtttattgaaactcttgactcttaaaacacttagcttaaaacaamcatattgtatagctgttccaaaatattttctttatatctttatttcataagttttttcctatttttgaagtttttatttttttactttttaaacttttttgttaaaaaccaagacaggctggacccagtagctcacacctgtaatatcagtgctttgggaggccagggcaagaggattgcttcaagccaggagtttgaaactagccagggcaacatagtgggacccctgtttctacaaaaaaaaaaaatgtaaaacaattagccaggcatggtggtgcatgcctgtagtcccagcttctc

SEQ ID NO: 138378 - DNA, 601 bp, Human
gataatatgaaaacaatgcctctgaaatttacttttaggaaatcataactttagacgtacagttgatcctcgttatttgtgagttctatgtttgcagatttgcgtagtcactaaaatgtattttaacccccaaatcagtatttgtagtatgttcacggtcattcacagatcagcacaaaggggtgaaaactttatatcattcaacacacacgttctatgctgagatctgataaggcgtcactctgacttcttgtttcagctctcctgcgatatataaggatccttttcttggtctacgtartgccatgctttttgcatttttgtgctttttgtggtgattttgctgttcaaaatggtccttgagcatagtcctgaagtgcttctggtgttcttgagcacaagccgactgtgatgcgtactgtgtttagataggcttcgctggaagttcaatgtcagtgagtcaacaattgctattaaataaggtgaataataaacctcacatgaagcaaggttatgtattgatgggtgaccagaggcttgcaggaacctaaccctgtatttcctccagtggcagtgattccgtatccagtcattcagtgtt

SEQ ID NO: 138379 - DNA, 601 bp, Human
taccgaggagaacgaggcttgactctgtataatcatgaaaattgcatattagaaagttttctcattaataaacattttttccccaggagtaaatgcaaagggacagcaggtatttctgaaagatatctggccgactagagacgagatccaggcagtggagcgtcagtatgtcatcccggggatgtttaaggaagtctatcagaaaatagaggtgaggtcccacactgccctccccgccccagaggatctaagggaaagctgctccctttgtgtcctgtctgcagacctcaaggctaacggragtataaactatataaagtaacatttatttcttcagatgactggggaggtggttctccgtcatttttctcctgtgactcgcatttttacaaaccccacctcccccagatgttcccagatttggacaagttggtgacagcctagagaagaaaggcctcctcaggttcagctctccaaaaccccacgcctttctcggacacccaggggtgtgtgtcagctgtggcgaggacccctggtggtcactatattgtgtcactaagtggagtccattggtcgaatgcacctctcagaatgcattttt

SEQ ID NO: 138380 - DNA, 601 bp, Human
taacacacccaccccctagtattttaaggaacagctcagtgaactggtcacggtgttaattgtaaggtatgtttcctgacactgcaaagtttcctttcactgaggccccacagacaagatttcctctggtttggggaccagaagtagctgttctgcctctttagcactgcctcgatttttctctcatgaaagttgtaagttatgttgccagctgtgtgtctttcctttgcattgagttcctgataattcagggacaaatttgaaactatttctggttactttgtggaacgtattttgtgtctccccctgtttgtggctccatctgatttgcctaccctaattcttccctttgcttccattttctcacttatttttaatttagctctttatcttatatgaagctttataggctaccctactaacaaataaaacattcttttttagatttccttcttatttttctaaccagatttgaaagacagttaacccaggagaatactgacttatgcctctcaccaccccttctcacctctctctcttctccgttgaagctttggggacagcttttctgccatggagaacaatgcttaggagacttaga

SEQ ID NO: 138381 - DNA, 601 bp, Human
accccctagtattttaaggaacagctcagtgaactggtcacggtgttaattgtaaggtatgtttcctgacactgcaaagtttcctttcactgaggccccacagacaagatttcctctggtttggggaccagaagtagctgttctgcctctttagcactgcctcgatttttctctcatgaaagttgtaagttatgttgccagctgtgtgtctttcctttgcattgagttcctgataattcagggacaaatttgaaactatttctggttactttgtggaacgtattttgtgtttccccctgtctgtggctccatctgatttgcctaccctaattcttccctttgcttccattttctcacttatttttaatttagctctttatcttatatgaagctttataggctaccctactaacaaataaaacattcttttttagatttccttcttatttttctaaccagatttgaaagacagttaacccaggagaatactgacttatgcctctcaccaccccttctcacctctctctcttctccgttgaagctttggggacagcttttctgccatggagaacaatgcttaggagacttagagaaatagcca

SEQ ID NO: 138382 - DNA, 601 bp, Human
agctgttctgcctctttagcactgcctcgatttttctctcatgaaagttgtaagttatgttgccagctgtgtgtctttcctttgcattgagttcctgataattcagggacaaatttgaaactatttctggttactttgtggaacgtattttgtgtttccccctgtttgtggctccatctgatttgcctaccctaattcttccctttgcttccattttctcacttatttttaatttagctctttatcttatatgaagctttataggctaccctactaacaaataaaacattcttttttagayttccttcttatttttctaaccagatttgaaagacagttaacccaggagaatactgacttatgcctctcaccaccccttctcacctctctctcttctccgttgaagctttggggacagcttttctgccatggagaacaatgcttaggagacttagagaaatagccaggtctatgttttgttttgttttgtttttttcttttcttggtgtaagctaaggttaatctttgcttgcttcactaagccagctcctttcttgcttgccttcttagcctaactccacgagaattcaactcctatggc

SEQ ID NO: 138383 - DNA, 601 bp, Human
ttctggggaaatcgtgagtattgtcttctgcttcctgcagacactagcatttgtcagccttggtggaggttggatatttacagttactcgccttttggttttagtttttcttcacagctccatcctaccctaactacagtcctccttgccaggtgtccatatgcatagaatgtatcattgacaaattcaaaccttttcttcttgcttagagattctagaccgtggtttcactgagtctcttttcttaggaattgagctttgagtgacatttcatttaaagtattcgaaggggaaataccasgttaaattaaaggatatttatcaagaagtgctattgtatgactttattggcatgtaatttaattcatctaatccacatgaaaagaaggagtagagaggtgcttggaggcatgttttggttctaatgggagcactgtggtcagtatgttgcagcagggactgtttgttcccagctccacgttatactagctgtggagccttaaagttatttccatctctgagccttgcttttctcacctgtgaagtaaaaatactacttaccttggaagaacgctctgaggcttaaaatgaaatggaatga

SEQ ID NO: 138384 - DNA, 601 bp, Human
ataacagaagaaagcacggtgttatgaggcaaaaataaggaccactaactgaaaatttattaagccattttctgtcatcctagatgtattcaagatgtaattcccttagagtacaaagttaatgtaaaaaaaacgcttcattgtgaccttcagtctagaagatgtatggcaaaattaggctgaagcatctttttctcctgtgacattagacatctgatttcactgaaatatagcacacaattactggaaatgagggcctataaaagtccacaaaaccaagtgacttttcaagatataacasaggtaaaaggttactgtcatcactgtctatgaatcatctcattatcgatattctagactttgaagtaaaataataaaaagtttacttaaagcaacagcatcagataattaaacaattctttggtatttaatactaatatttcagaaatagaactccagagtatttccagatgtgcatatgctgatcgatttttaggtttatcatccttcgctttataacggaagtcatttcttatacattgatagaatgtagtatgagtgtagtgatatttttcactctgacattaactaaaaacatggt

SEQ ID NO: 138385 - DNA, 601 bp, Human
gctcaaatgctgtgctgggaggaccactactctattcagagctgtcaagcagggacatttaagtgtgctgaagctgcacctacagccaccccttcccctaggtgctctgtcccagggagatgggggtgttatctataagtacctgactggggctgctgcctttttttcagagatgccctgcccagagaggaggaatctagagaggcagtaggccttgctgagctgcggtgggctccacccagtttaagactttgtttacactgtgagggtaaaaccacctactcaagcctcagcaatggcygatgcccctctgcccaccaagctcgagcatcccaggtcaacctcagactgctgtgctagcagcaagaatttcaagccagtggatcttagctttctgggctccttgtgggtgggacccaccaagccaggcactggagggaatctcctggtctgctggttgtgaaggccatgggaaaagcgcagtatctgggccagagtgcactgttcctcctggtacagtctctcatggcttcccttggctaggagaggaagtttcctgaccctttgtgcttcccaggtgaggtgacgccccaccccactt

SEQ ID NO: 138386 - DNA, 601 bp, Human
aagataaagtgcccagcaccaggtcccaggggtcattcggtgccccagacagaggcagtgcaaaagtctgtgtctcagataagcagatgggccagctgcctaagggacaaccttaatgaaatctctgctgattgaatacttctgtccacagggagcccccagaggtttagaaaataccaccctgatgtcattaatagctactgccctgagaagctatttctagttcttagatggctctcacccccatcatttacagtctgcagtgattctcaaactgtaatgggcaaagcagcctcccagrgatcttgctgaaatgcatcttctgatttagtgggtctgggctggggccagcagccttgcatgtcctcatgtgctgctggtgttactgaagtgtggaccacacctgaggggcaggctgggcagaatttcctccgagcagagctgtctcgccacctccctcaatgatgcttctgtttctttgtgccacagctggatactggcaagaccttccaggctgtcatgaggtttgacactgatgtggagctcacttatttcctcaacgggggcatcctcaactacatgatccgcaagatggccaagt

SEQ ID NO: 138387 - DNA, 601 bp, Human
gtacttgggatttctggagaaatattttggtacagctggtttagaagtgttttttgggaataattgtttctggatctgtaacggtggtactctgaaagtcatttgtacctttgggcggaaaagcattttaaatattaaatgggagcaggagaatgatttctggttttgtttttttttttttttttttttttttgagacagagtcttgctctgtcgcccaggctggagtgcagtggcgcgatctcagctcactgcaacctccacctgctgggttcaagcaattctcttgcctcagactccaragtagttgggattacaggtgcctgccaccatgcccagctaatttttgtatattttagtagagacggggtttcaccatgttggccaggctggtcttgaacttctgacctcaagtgatccgtccgtctcatcctcccaaagtgctgggattacaggcatgagccactgtgcccggccagtgatttcttggtatttggaaaccttctctgttctccttgtcttatgtaaagactacagagttttctgtattttgcagctttctgggcagtaatctattgaaaaagcatttttagctttcaatt

SEQ ID NO: 138388 - DNA, 601 bp, Human
aaacataagctgctttttcttgtatctggttgctgtcatttttatgagctactgattaagatgtgtctttcagttctggatgtgctgtggattggtacctacgtcttcgccatagtgtatgctgctgcagatgggaccctggaaacgtctccagatgtggtgatggctctactaccggtatgcctgtggaagaaatttcattgtttgagaattagagaagtcttctaataaagctggaggctttgatttcaaggggtttttttgtgtttgtgttttttttttttttttttgagacaagatstcactctgtcgcccaggctagagtgcagtgatgcgatctcgcctcactgaagcctggacctcctggactcaagtgatcctcccaccttagccttctgagtagctggtactacaggtgcacaccactatgcctggctaattttttttttttggtagagatggagtttcaccatgttgcccaggctggtcttgaactcctgagctcaagtgatctgcccacctaggcttctcaaagtgctgggattacaggtgtgcgtcaccgcacctggcctgatttcaggttcttttacttactggcagt

SEQ ID NO: 138389 - DNA, 601 bp, Human
ttgctgtatttgaacgtaatggtctctggttttattctttaagggatttagtgctggcagcatctgcggcttcaacagaagttagtatccttgctcgacaaagtgatcaggtaaatctcttttttgtcacttctgtggtgctttcttttttaaattattattttgagacagtctcgctctgttgtccaggctggagtgcagtggtgcaatttcagcttactgcaacctctgccttccaagttcaagcaattttgtgcctcagcctcccaagtagctgggactgtaggcgcgggccaccacrcctggctgatttttatatttttagtagtgactgggtttcgccatgttggccaggctggtcacaaactcctgatggtacttttctgaaaaagattttggagggaattaactatatgtggttaaggtatacatgatctcacatctgttttatcaagtttctgcgtgacagcaaagcttcagtgacagagtgccttggccaaatggcttggctattgcatggagaaacacgggtgtcagacttagcacttccttcgcttctgttcttttaggatccaacccctgtctgtggaaacataccatg

SEQ ID NO: 138390 - DNA, 601 bp, Human
aagggatttagtgctggcagcatctgcggcttcaacagaagttagtatccttgctcgacaaagtgatcaggtaaatctcttttttgtcacttctgtggtgctttcttttttaaattattattttgagacagtctcgctctgttgtccaggctggagtgcagtggtgcaatttcagcttactgcaacctctgccttccaagttcaagcaattttgtgcctcagcctcccaagtagctgggactgtaggcgcgggccaccacacctggctgatttttatatttttagtagtgactgggtttcrccatgttggccaggctggtcacaaactcctgatggtacttttctgaaaaagattttggagggaattaactatatgtggttaaggtatacatgatctcacatctgttttatcaagtttctgcgtgacagcaaagcttcagtgacagagtgccttggccaaatggcttggctattgcatggagaaacacgggtgtcagacttagcacttccttcgcttctgttcttttaggatccaacccctgtctgtggaaacataccatgcagttaacctccaactggagtatgcctgatgtgtaggcgg

SEQ ID NO: 138391 - DNA, 601 bp, Human
taaatagtagagaagggcttataagtgaaaagaatcacccctgccctacctgtttgctttctagaggggactgtttttaatttgtaaacattttcttataatgctgccaccttatccctaaagaaaaatctgctttataactagtaattggttattagttttagaccttactgactgtacggcaaatgatgatctagctcacacatggcccccagtcccctccttcctctcaagagttacagcgttgttttaatttcttatcttggtgaacctttgtaattttaattggtgttttttaccytcatttctggtggtatctttttttttttttttttttttttgaggccaagtctcactttgtcacccagtgcattggcgccatcttggctcactgcaacctccgcctccctggttcaagcgattctcatgcctcagcctcctagtagctgggactgtaggcatgcgccaacacgcctggctaatttttgtattttttagtagagacaggtttttgccttgttggccaggctggtctcaaactcctgacctcaggtgatccgcccgcctcagcctcccaaagtgctgggattacaggcatgag

SEQ ID NO: 138392 - DNA, 601 bp, Human
agtcatctctgttctcctatttgaacaatgttaggaggaaccaatgcaaagctctaaccaacatggctttttcttttttcttcttcttcttctttttttttttttttttttttttagattaattgggaatcttggctactggaggattctagtcgagctgaattgcctgtgacagacaagagtgatgactccttgcccatgggagttgtcgtagactatacaaaccaagtggaaatcaccatcagtaagtgtagcctggtagttagtgcagaaatagtcttctttctagttagggttaatrttgaaacaccagttacatgttactgacagagtctactctgctgggcacttgtagcttctggcagcacatttctccctgaagagtgataataggctgcgttgtgacaacactaaactgatttgaatggatgttcgttgatgagaccaaggccaaacactgtatgtatgtgtgggtgcatgtttgcacacttgcacatgtctgggtgtactttagaatctggttgaaatatagaacatcaggattttatggcttggtttctttgtccaatccaattccctggtgacctcccaaagaagcaat

SEQ ID NO: 138393 - DNA, 601 bp, Human
tgtcttcaagtgatactatattactaaagaatagtgtaagaatctaacagcagtattctattttctcccttcaccacctttatgctattgtgcattttacttccactgtattgtaaacctcatgatacattgttataaacagttgactatctttcctccccactaccccccagatggattcttcttctgtcgccaaggctggagtgcagtggtgcgatttcagctcactgcaacctctgcctcccaggttcaagtgattttcctgcctcagcctccctagtagctgggattacaggtgccyaccatcacacctggctaatttttatatttttggtagagacggggtttcgccatgttggccaggctggtctcgaactcctgacctcaggtgatccgcctgcctcggcctcccaaagtgctgggattacaggcttgagccaccgcgcccggctgactatcttttaaatacatttaaataagaagaaaaaagtttacatgtttatacatatagttaccatttccagggttcttcattcctgtgtctggtcccagcttgccatctggtataatttttcttctgctcaaaggacttcctttaatg

SEQ ID NO: 138394 - DNA, 601 bp, Human
ctttaatccttttgtttttctaattacaaatgtttgttgtagatataaaaaagatagttaaaaagaacaaacttaaaatcacctttattcccaccacaaatgtatgattgttatttacacattttttcatccttattttatgaaaatgtttcttgttagagaaaaatttggatgcatgctgctttgtaaatttgtaaccttttcagcttaatcatgaaatgtaatcgtttacattttccatgtcattaaaaattcttacactattcgtattttttcttttctttttcttttttctttttcytttttttttttttttttttttgagatggagtctcgctttgtcacccaggcaggagtgcagtggcgcaatctcagctcattccaacctccgcctctcaggttcaagcgattctcctgcctcagcctcctgagtagctgggattacaggtgtgcaccagcacagccggctaatttttgtatttttagtagagacggggtttaaccatgttggcccggctgatttcaaattcctgacctcagatgatccacccaccttggcctcccaaatgctgggactacacgcgtgagacactgcagccgg

SEQ ID NO: 138395 - DNA, 601 bp, Human
atggagtctcgctctgtcactcaggctggagtgcagtggcacaatcttggctcactgcaacctctgtctcccgggttcaagcgattctcgtgcttcagcctcccaagtagctgggactacaggcacctgccaccacacctggctaatttttttgtatttttagtagagacggagtttcaccatgttggccaggctggtctcgaactcctgacctcaagtgatacacccacctcggcctcccaaagtgctgggattacaggcgtgagacaccgcgcctggcctattttttcatatttaatgkggattttttcaaagctctaatgcaattccgtcttaattatttaagttacttagcatctaaacattcatgcaggaaatacaatttgctttaacagacttttggatactattttaaagaatgtgtctttgaagacattaaatttaccaatggagaaaatagttggcagttatatttccatcgacagatgtcaaaaacgcccaagaattgaatatagagtgtttgttttcagtatcttctatcattttcattctttttccctgttgatttctttgtttcttcagttactcttgataagttcca

SEQ ID NO: 138396 - DNA, 601 bp, Human
tcagttttgcttttaaccttattgtacatgctttgagagctagaaccattttattaatttactccttcattaattcatctacctaatagtcaagtgcttttgatgtgctaagcactgtgctaggcactgggaagatagccatgaactaggccagtgtgactgccttcttggagcttgcagagtatttctattttcatcctttaatatgatcttacatatggttaacttaaattgagaccttttttttgtttcctttttctttttggtaatttatctaaaagtatttgtccttgcttatttyaaattatatttttgtgtttacattttacatatttctttgttacaaagaatggttagtggtttaacataaacattttgcttgcattctgttataggggtctctaataaattcccttaagccatctgggcctacaccagcatccggtcagttatcatctggtgacaaagcttcaggtcagtttgcatttttgttttcttgaaaagtgaaagaagcactccacaataggggttattgttctggatcactgagacagttgccataggaaacaggagtcacatttgatgagatcgggagcattca

SEQ ID NO: 138397 - DNA, 601 bp, Human
actattacatgcccagaaaaagcctatggtgtagagatatataatgtagaatgtgaaagctgccctatagattctgtattccagagatcatgatttcatgtatatctcttgaggttacttcattgttttttaaagaaaaatatcctatatactgtatatcctatatatattgattttgtaacttatttccccttctctgccccctcttacaataaatgtcttggtctctgcaggtctgatacagatccaccttactcattttaagagctgtctacaacctcattgtgtagttataccctgktaaatttaactagtactctgctgatgatttagattgtgacttttcatcctgtacattttacattgtatatcagtagttttaaaaatatttgtactgccatctaccctgtgtttgtttattttagaaggttggtgttttttttttcttgttgttgtttggtttagtttcgtttgatttgggcttttaaatagttttcctctttcctttcccccttttgaagtggagcaaggccaggcctggtggctcatgtctgtaatcctagcactttgggaggccaaggcaggcggatcacctgaagtc

SEQ ID NO: 138398 - DNA, 601 bp, Human
taagagtgtacttttaaaactgtacatttaaactatactagaattattttgatatattttctgtaaaggagaagatggcacaccttagactggaattaacattgacagagccacggagcaatttcagagacctcaaacacaagtgaggcaacgtgctcactccccatggccactgacgtgtcacagaaggcaaatgtggtgctaagcagcacctcacaggctgagctacagggaattatacactggaacagtgtttctgtctttttgtaatattcttttttttttttttttttttttttttccataatttcagggacagccaagatagaaacagctgtgacttcaaccccatctgcttctgggcagttcagcaagcctttctcattttctccatcagggtcagtaatgaacttaagttttatggcaaattactagcaattagcttccccaaatcttacaattatagatatatttatttacttattaaatgtgtatgaacccagagttcttaccatggcagtaatacatgtgatgatagtggcagtagtttaatgttctcatgtaaatcgattttccctttgcaattcaagttaatacttgt

SEQ ID NO: 138399 - DNA, 601 bp, Human
cctcagcctccccagtagtttggattgtaggcatgcaccataacactcaactaattttttatttttgtagagacacagtctcgctatgttgtccaggctggtctcaaactgctggcctcaaacgatcctccacgcctgaccacattgcatgatttctatcagtcccctgcctgttaggccaagggttgacaaacttcagtctgtgggctaaatacactgtttggcttttggggggtttgttgttgtttaacttcttaatctaagaatggtgtttgtgtgtgtgtgtctatatgtatacatrtatgtgtgtacacacacacacacacatatatatatttttgtttgtttgtttgtttttgtttttggaggcagagtctaactctgttgcccaggctggaggacaatggcacaatcttggctcactgcaacctccgcctcccaggctcaagtcatcctcccacctcagtttcccaagtagctgggactataggtttgtgccaccacacccagctatttttttttttctttttgtgtttttggttgagacggggttttgccacgttgcccaggctggtctggtctcttaactcctgagctcagg

SEQ ID NO: 138400 - DNA, 601 bp, Human
aggatggtctcgatctcctgatctcgtgatccgcccacctcagcctcccaaagtgctgggattacaggcgtgagccactgtacccagccaattttaagtcttttatacaaattaactcatgtaagcatcacagcacctccataagataggtgcgattattatcgccatttaagagatgaggacaccgaaggcccagagaggttaaattgactgttacatcagacaccggctgcatttagatcatttagatcatagtaacctcctaaggagcccttatgaagaaagataccctaatttatcwgaaaggattgtgactttctgaaggtagaatttgtattagtccggcagttaataaagtggtaggcataatatatgtttcttatacatcttcaggaagaaattttctttatcatctctgttttcctttgaagataggctctgtcctagtcagtgatctttcttaagagagaagtgaaacttctgatttccagtttctggtagtagaggactaagtcattcaagggaaccaagttccctactgaaaactactaaaaaatgctagataaaacataaaaaccttgtctttaaaagcaccaataaa

SEQ ID NO: 138401 - DNA, 601 bp, Human
tggacgtcagctaagcagtcaaataccttccacatgcatgcattcattgttaggttttctaactttccatggcagtttactagttatcagggccaatgctgttaggactgaattggattcctagtttttaaaagctgtgactcaccattaaatggttgtagtgaattggtactgttgttgttgttgttgttgttgttgttgttgttgttgttgttgttaagaaatttaaagggggaaaaaaaaagagactaggaagtacattaagtatgttaccctaagacagaaattagcttgttgtatytgaggcacagaagatatgtgtgactgccctgagtgagggggaggatgataaaagatgatgtcagagcagtggaaaagggacagatcatgttgggccttctagaattggtagacaggagtgaaatgatgtgactgccattgcaagtagtgctccagctgctgtgtggacgtagactgtagtgggagcaaaagaccagctaagttgttgcatagtctgggcaaaaggttggggttaggtggctcagaccagagtagaaaggaggggataccctagggggtggggggcatttcagaagtggcc

SEQ ID NO: 138402 - DNA, 601 bp, Human
ccttggaggaaaacccagtcaggatgcagccaacaaaaacccattcagctcggccagtgggggctttggatccacagctacctcaagtaagttgagaagacttttcccagtcccttggtcccctaatgccattgtcattcttagggtgttatcaaagcttcagtgacaaatataaaaagaaaaaaaaatctagaaggctcatttaaaatatcttccccaaagcagtgtgatctgttttgcttttttatttttggttttttaatgagatgtcctatataatcatgaaaagatatcagagctcagggagaggatctgtgtattgagctgctcccctcttctctcccaaggcccaaatcgctctgtttcttagtattggagtgacttgaagtgaatgcaagcagacaagcataaatgagcagcagcagagcaagccgaggatgctgggaggagagcatgcagactttcatttggatagtactctccaaattttccttaaaattcagctcctgtagggagatgtcacccaaaagttgaagcctttaatatttctcacctcttacatttttgttttattttcatctgaagctgtatctgccagtac

SEQ ID NO: 138403 - DNA, 601 bp, Human
ttttttgagacagagtttcactcttgttgcccaggctggtgtgcaatggcgtgatctcagctcactacaacctccgcctcccaggttcaaatgattctcctgccttagcctcccaggtagctgggattacaggcacgtgctatcacgcctggctgatttttatatttttagtagagacagggtttcaccatgttgaccaggctggtctcaaacttctccgcccgcctcggcctcccaaagtgctgggattacaggtatgagccaccatgcccagccttctttagctaattttaaaaattcytttttttttttttttcttttttctttttgagacagagtcttgctctgtcaccaaggctggagtgcagtggcgtgatcttggctcactgcaagctccacttcccgggttcatgccattgtcctgcctcagcgtcctgaatagctgggattacaggtgcccgccaccaagcccggctaattttttatattttttttagtagagacggggtttcaccatgttagccaggaggtctcgatctcctgacctcatgatccgcctgccttggcctcccaaagtgctgggattacaggcgtgaaccac

SEQ ID NO: 138404 - DNA, 601 bp, Human
ggtttccaaatccactgtgcaccttacctcagattgtgactcaggtagcttagtctttctttggttgctagttgttaatactgttttcctagaaattaaaacagaatattctgaaatgggcttcacagctttctttttgctacacacacagtgcattgtttaaaaatgaaagggccacaaggcttttatcccagttagaaaggtgcatcgtgaacatttcaactggggaattttagttcatcgatcatcaagactttttatgtttttaggaggctgataatgttttctttgactcttaacrgttttcctatatatggttctttatcctgagattatatccccattgatttggaaatctgacctttgaaaattccacctgtaatcccagcagtttgggaggctgaggtgggaggatcacttgagcccaaaagttcaagaccaacctgggcaacatagtgagaccccatctctaaaagaaaaaaggaaaatcacacctaattcagacactgggtacagtggctcacgcctgtaatcccagcactttgggaggccaaggaagacagatcacttgagtccaggagtttgaaaccagcctggataa

SEQ ID NO: 138405 - DNA, 601 bp, Human
agaaagtccaatgagagcagatcccttggccacctttgtatggaaagagccttgacctcaccattaaaagtgaatagaatggtgggaaggcagagttttagatactttttcttgctttggggttgattcttgcccccaggtgctgccccttctcccagaaaccactgatccgtttccctcacctagtcacctccagaccccagaagctctccccaacccagccgagttcctctgcaaacaattcaaggggctctgataggtcacacagtgccaccttgtgtgctggaccatatctggaggkagaactgagtgagggggcacaggggattgtctccaggtggggcgagcaggggaaggaaaatagtggccacttttacattggtttgggtagtaattattgattcaggaagcaaatacaaaatcctgaatgaaatgacttggaaaaagtaaatagaatcaagatcccaagaggagctgaagataaataaatgggagcaggatgtgggggaatggtcggtaagtgagaaatgctaaaatgatagaataaagcttaaggattgttggaggtagagcaggaactgtgtactgcatagttcccaaa

SEQ ID NO: 138406 - DNA, 601 bp, Human
gcttctgtgtgtacctttcctgccttcctgtaggtggtggaggcacggagggcttcccacaagaagcacagaggagggcagacacttagcatggggaccacctttgtctttcgagtggatgcgtgctttaacttcactcttattctgcttttcagggttcagctttgggtcaaataactcgtaagtatccccctttttgagtctcaccttaattaaaagcattaaataaggttggaagtgtgtggatcttgctggatttgtgcattttcttttcgttttttcctgtttttagagtttgtcytggaagtgtgggggttcagcagcagggtttgggttttgtggacttgctcttctctgtagcaatatggcaggaggtgccaggcctcgccttcttaagaggcgtggttcaaagagaaaagagcacgcctgccagtgagctgggcctgagggcagcgctgaggagatgctgctcctgacttccctggaggtttctcagaagctgcatgctaacccctgggctctgggccatcaccaggtctcatgtgttgatccaccctctgtgcttctgtgtaaaatttcatggcgttaaaattcagtctta

SEQ ID NO: 138407 - DNA, 601 bp, Human
gtcactcaaaaccgcaggatctagaatccaggtctccagattcccagacccttgggcctcccctagctggttctagagaaacctcatggactcagctctccggtgtactgacttcatttggtggtgtgtcaactccaacagtaggcagacccaaagggtgcccagagtacaacgcttggacccacggccaactcaagcggcgcacacggagaaggcactcagcacacgaggagcaccccggcatgcacgaagttctgacttatcacacacggagcagtcgtagaccacatggcccaatatatgcctgacacaaagggcacaataactgcgcgggcacacaaacacaaccaggcccacgacgtaaagcacggagaagctcaaacacccaggatcgcacaaatgaccagagacaaaatacaccggccacatggaaaagtgtacagacacaagcccgggacaaaagacagttccacggacacaaccaataacccacgcttccggacgccaggacaagcgcaaggtcacacgcttctggaggacacgtgactaaacccacagaccccgccgggctttcgggacctgcatggagcccacctggcgc

SEQ ID NO: 138408 - DNA, 601 bp, Human
atgatttgtgctaagtaaacagacaaatgcatacgaacagcagagcctttctttctgaagaagagacgccaattcttttccagggatgcggacagcaaggagggagcctgtgtacagtacattacaccaaggtttggttcccccaacagctccgtgaggtcagcaggagccagggttaccaaatctacttcacagaggagaaaccggattcttagaaagaagccgtccatcccaaggtcactcaaaaccgcaggatctagaatccaggtctccagattcccagacccttgggcctcccctrgctggttctagagaaacctcatggactcagctctccggtgtactgacttcatttggtggtgtgtcaactccaacagtaggcagacccaaagggtgcccagagtacaacgcttggacccacggccaactcaagcggcgcacacggagaaggcactcagcacacgaggagcaccccggcatgcacgaagttctgacttatcacacacggagcagtcgtagaccacatggcccaatatatgcctgacacaaagggcacaataactgcgcgggcacacaaacacaaccaggcccacgacgtaaa

SEQ ID NO: 138409 - DNA, 601 bp, Human
ataaataaaaattgtcccagtttgaaaacagagtgactattaggaaaagttcagcagttttaaaactgtcctttggccataaggaaaagccggaaaagaaatgcttacccttggccaggtgcagtggctcacacctgtaatcccagcactttgggaggccgaggcgggtggatcacctgagatcaggagttcgagaccagcctggccaacatggtgaaaccctgtctctactaaaaatacaaaaattagccgggcatggtggtatgcacctgtaatcccagctacttgagaggctgaggcrggagaatcacttgaatccgggaggcggaggttgcagtgagcctagatcgtgccattgcactccagcctgggcgacaagagtgaaacttcgtctcaaaaaaaaaaaaagaaaaagaaagaaagaaaaagaaatgcttacccttaaatatgagtttctgaaaagactgtggaacccctatgacctcttcaacaacctgggccaggtcttggacaactggttcactgctgccctgctgggaggtaacatgaaggtcgtgcttctcattgcctggggagaaagaaaagcatttgacgaatatga

SEQ ID NO: 138410 - DNA, 601 bp, Human
gatagataggtctagcagctttctgcttagttatgctatcccaaattattcacttctctttgtggcaagtcctgagttccagtctcctggcagttccaagtctggattagattttttttgccttcactttgtttatctgccctctctctactcagccacctaactcacaataagggaacttcatatgctcataattctgctgtgtcacaatgcagggctggccacagccctctctcatcaccttaagggttgctgacctcatctgtctttttttcccctcagttctttagtctgaaccttyctttccagtcgaaggttttcccttgtgggagattttagttaaaaggttggttaaagggagagaggctcctgaactggaacagagtgattattcttaatatctacaagtttattttaacaaaagactcttgcaaattctactccaagtgaatgagacctgtcccaggcaccattttaaccagaccaagattccaccaccaaaacaaaaaacatattattaaggcagcacaaccgctcctaattcctagagcaaaagttctaaccaacaggagcaggagggtatgagaacaacaaaactggt

SEQ ID NO: 138411 - DNA, 601 bp, Human
agcctcaaacccctggactcaagtgatcctcctgtctcagactcccaacttgctgggacaataggcatgtgccatggtgccttccttgagttcacacttcgctccatacgctctgtgtcagctccaagtaaaagtcctatagtttcttcaaacttgactctttggttctgcctgttgcccatcaccattctccctgaccctgaagcaagaaatttagaatatttccctcttctctcaggtaaacaattgatagataggtctagcagctttctgcttagttatgctatcccaaattattcayttctctttgtggcaagtcctgagttccagtctcctggcagttccaagtctggattagattttttttgccttcactttgtttatctgccctctctctactcagccacctaactcacaataagggaacttcatatgctcataattctgctgtgtcacaatgcagggctggccacagccctctctcatcaccttaagggttgctgacctcatctgtctttttttcccctcagttctttagtctgaacctttctttccagtcgaaggttttcccttgtgggagattttagttaaaaggttggtt

SEQ ID NO: 138412 - DNA, 601 bp, Human
tgcttcttggaaatcaagtcaaagggttatacatcaagttttccatctacaaagactccagactagagagaaggtgttaggtaaacattctggtgagggccctgacagcttgggtgcagagaatggagacaatccaagtgccagattcagtctcagccctatactgatcaacaaccaagactgaagcctggagggtaatcacatttcagtaaacacttgtgaggagtccagaatggcaagaaaggtggaattctaccattcctttaaatggaattcctaaatggcagcctccaattgagckctcctgtttaatgtgatgctggttaacaacgatgaatacttttattgaacacttcctacatgccacacactatcctaagcaccttacctattttttaagccttaccacaactccatcagggaagtactgctgttttacagatgatgaaactgaggcttaatgtagtaaagtaacatgagatcacacagtccaaaagaggtagattagacttaagttcagacttttttcttttttgagatagggtctcactacggttcccaggttggagtgcagtggctgtttacaggcatgatcataact

SEQ ID NO: 138413 - DNA, 601 bp, Human
gcagtggctcatgcctgtaatcccagcactttgggaggccgaggcgggcagatcacttgaggtcaggagtttgagaccagtctggccaacatggtgaaaccccatctctattaaaaatacaaaaaaatcagacagatgtggtggcaggcggcacctgtaatcccagctactcgggaggctgaggcagaatcacttgaacctggcaggcagaggctacagggagccactgagattgcaccactgcactccagcctgggtgacagagcgagactccatatcaaaaaaaaaaaaaaaaaaaaaagccaaaacacaaacacaccccaattaatgctataaaatgagagggaaaaataaataaaagtggtcttgagctagtcctaatccttactgggttttagtaccccatctctaatataaggaattgaataggatgactcccccaaccccactatcatgttcaacttggaccttctatgaaccaacaaaatgttatttgccttgccaaacacattacaacagcccagagagaagctacttgttctatttcagacaatacatgatcctagcaaggcaggtgctctcctgtgagcataaatggatg

SEQ ID NO: 138414 - DNA, 601 bp, Human
tacacataatggtaaaaataatattaaatgaacaatacagagttggctaggtaaataatacatttatacaagatgaaatgcatgcgagctttgaaaaataccatcacaggaaaatgtttaattttttatccaataaaagaatagtttataaagtgtaaataacattatatcaaatttttttaagatgaaaaatatatttcaggctttggtaatcgtcatctctgagttggtgccccatgggtaatttttattttccatattagtgcctatacatgtacttaaaacttttgtacagtcagccatgtattctgtaattaaaacacaaacatataggccgggcgcagtggctcatgcctgtaatcccagcactttgggaggccgaggcgggcagatcacttgaggtcaggagtttgagaccagtctggccaacatggtgaaaccccatctctattaaaaatacaaaaaaatcagacagatgtggtggcaggcggcacctgtaatcccagctactcgggaggctgaggcagaatcacttgaacctggcaggcagaggctacagggagccactgagattgcaccactgcactccagcctgggtgac

SEQ ID NO: 138415 - DNA, 601 bp, Human
aagcctttccttttcaatctactgtctttgaaattttctggcaggatctatggaagagtaagttgataatacaagttagtaaatagtaaacatgtaacaaataatcctcagtgaaaatgacatgagagcacataagaaacacccacagtacacaaaacaggtcacaggtcaccaatgtaaatgtgatatccattttcaggaaccctttccctgggtctgtatcctgtatggcctttccatggctcttgtccctataaaagctccctgtgttctcaatgtctgggccataggaactgatctktaacacagactttgttcttttattgtttcctatgtatggatactctgccctggccacaccatgggctcattgtgacaggaaaagtgcctgctgctgcttctttacacccaccctggccaacagaagtacacagtgcagttcaccttcaagaatgaagcatcaggctagagatatcattactatcatctgcaaaagagttaatgattttcaatggcctcacatgacctgggtctggctgaatcatctataagtaatgagccctgcagaattatcagtcacatattcatcagagaaagttaa

SEQ ID NO: 138416 - DNA, 601 bp, Human
tcttcagggcagcacagcctttttctgctacacctcactcggccagggcaaagtttgtagactgcagccgctcagtctcctggcagatgttctgctccactgtgtcacactcggctaggaatgcctagaaaatacacacggggcagtaagggcccatccaggggtagccgaccactgcccacacaaggctccttgcttacccattctggggaacccatggctgagactcaaaacagattgtgcatgaatggagatgggccactggcctgggttccaaggtaaggggagggagggagcatasgaccagcattctgaccatgctctaggccagcaatcccctaaaaggtggtaaaggcagggagctttgcctcagggccactgcacagcaactgcacaatcgcaggaagcactgtgtgcatgaatactgcctcctggaattgtgtaatgtgtcagccctacctgctctccagtgagttccctccctaaatagtttaaattcaaatataattacagggacacaggtggctcttctctgacgtttggggttcctgctgataaatgtaaccaaaacaagcccataccacacaccacgctcctacac

SEQ ID NO: 138417 - DNA, 601 bp, Human; identical to SEQ ID NO: 31404

SEQ ID NO: 138418 - DNA, 601 bp, Human; identical to SEQ ID NO: 31405

SEQ ID NO: 138419 - DNA, 601 bp, Human; identical to SEQ ID NO: 31406

SEQ ID NO: 138420 - DNA, 601 bp, Human; identical to SEQ ID NO: 31407

SEQ ID NO: 138421 - DNA, 601 bp, Human; identical to SEQ ID NO: 31408

SEQ ID NO: 138422 - DNA, 601 bp, Human; identical to SEQ ID NO: 31409

SEQ ID NO: 138423 - DNA, 601 bp, Human; identical to SEQ ID NO: 31410

SEQ ID NO: 138424 - DNA, 601 bp, Human; identical to SEQ ID NO: 31411

SEQ ID NO: 138425 - DNA, 601 bp, Human
catttttcaaaagctactttaggccaggcatggtggctcacacctgtaattcctgcacttggggaggctgaggtgagaggatcacttgaacacaggtgttcaagaccagcctgggcaacataaggagaccctgtcactacaaaagaattaaaataaaaaaattagccaggcatgttagcacatgcctgtagtcccagacactcaggaagctgaagtgagaggatcacttgagcccaggagatcgaggctgcagtgagctattgtactccagcctggataacagagcaagaccctgttttgsggggggaaaaaagttactttagtcacatgtccagggaaccttttctcacctttatagatagcgttaatctcttacagccctcacgcttatgtctttctcttaaatttgcatgcttctattacagaacttacactggaaaccataatttatttatgcttcattgtcctccactagtctgtaagctccttaaaaacagacactgtatatttcttttctttttttgtgaccctgctgccccacacagctcttgaaacatagtaggtactcagttctgaccattaaaaagttcatccttatatt

SEQ ID NO: 138426 - DNA, 601 bp, Human
ggaaatactacactcagcaaggtagacaaaactctcccttctcctgagctttcagtctcagggtgttctctatttcttttgacattaaactgaacaatcagaaagtaaatcttaggagagccaatattatggaatattacagtgtgcgcttttgagtcagatagtttgacaagtttgaattttgacttttaaatttctagttgtgtgaccttggataaatgatctaactacatgaagccagtttcttcatctgtaaaatggtacctatgttatagcatttttttttttttttttttttttwttgagacggagtctcactctggagtgcagtggtgcaatctcggctcactgcaacctccgcccccgggttcaagagattctcctgcctcatcctccttggattactactgggattacagccacactccaccacgcccagctaatttttgtattcttagtagagatggggtttcaccatgttggccaggatggtcttgatctcccgacctcatgatctgcccgccttggcctcccaaagtgctggtattacaggtgtaagccaccgtgtccaacctgttacagcctttttgagaggactaaa

SEQ ID NO: 138427 - DNA, 601 bp, Human
aaatactacactcagcaaggtagacaaaactctcccttctcctgagctttcagtctcagggtgttctctatttcttttgacattaaactgaacaatcagaaagtaaatcttaggagagccaatattatggaatattacagtgtgcgcttttgagtcagatagtttgacaagtttgaattttgacttttaaatttctagttgtgtgaccttggataaatgatctaactacatgaagccagtttcttcatctgtaaaatggtacctatgttatagcattttttttttttttttttttttttttgagacggagtctcactctggagtgcagtggtgcaatctcggctcactgcaacctccgcccccgggttcaagagattctcctgcctcatcctccttggattactactgggattacagccacactccaccacgcccagctaatttttgtattcttagtagagatggggtttcaccatgttggccaggatggtcttgatctcccgacctcatgatctgcccgccttggcctcccaaagtgctggtattacaggtgtaagccaccgtgtccaacctgttacagcctttttgagaggactaaata

SEQ ID NO: 138428 - DNA, 601 bp, Human
ttgatcatgtgtttcatatgaccagaattaagttatagatcttaaataaaccagctaaacaacaatattaaaatatattttaagatacgacaaaatcagtcactcttattgaaaatgatggcttttacttattattttttctttgacctactgattttatttcctgtggatacataaacagaagtgtgattgcaggatcatatggtaattctatttttaatttatcttcttccatttttggccaggcatgatggctcacgcctgtaatcccagcgctttgggaggccaaggcaggcggatyacctgaagtcagaagttcaagattagcctggccaacatggcaaaactccatctctactaaagatataaaaattagccaggcgtggtggcgggcacctgtaatcccagctactcgggaggctgaggcacaagaattgcttgaatccaggaggtggagattgcagtgatctgagattgcaccactgccctccagcctgggtgacagagcaagaccctgtctcaaacaaacaaaaaaacatttttttttcatttttaaatttttactatgcatacgtaatagtttacatgtttatggggtaca

SEQ ID NO: 138429 - DNA, 601 bp, Human
ttgagagggagtctcactctgttgcccaggctggagtgcagtggcacgatctcggctcactgcagcctccacctcccaggttcaagtgattcttctgcctcagcctcctgagtagctgggattacaggcgcgcaccaccacgcccagctaatttttgcatttttagtagagatgatgtttcatcatgttagccagggtggtctcaatctcctgaccttgtgatccacccacctctgcttcacaaagcgctgggattataggcatgagccaccacacctggcctttttttttttttttttttaatgaaccccatatttagtggaaaatgctgtattcaagctaagcagtcagtattgtgaatttgttccttaaatgtctgatatgcttaacattgaaattattaccactacttcaatattgtgtcttcctatagatttaaatttttttaattacatgtagcttttggaagaaaatttatttggcctactcccatttttcctgacagatggccagagtggttggaggtgccctgcctgtcagaatgtttctgcacatgttcctaatacctacacttgtttctgtggtaagtttgtttatatac

SEQ ID NO: 138430 - DNA, 601 bp, Human
tccttaaatgtctgatatgcttaacattgaaattattaccactacttcaatattgtgtcttcctatagatttaaatttttttaattacatgtagcttttggaagaaaatttatttggcctactcccatttttcctgacagatggccagagtggttggaggtgccctgcctgtcagaatgtttctgcacatgttcctaatacctacacttgtttctgtggtaagtttgtttatatacactggagtctcttttactacatacattgtacctcagttcaggaaaggtggtctgcggggcatgtwttagaagttactaatgagacttcaaagctctaggagtctataagactgtaattatgtggtccatcacacagctagagccacagcctttgtgctcctggcaagctgttctggagatggccaaccaggctcatgctgcttctgggctgtagtgcttgtctccttggtcttgagaccaggcctgaccatgtagcagagataggtgtggacgtgggcttcatctcacccccagcagttacagctttgatagtccagatttgagcagtatgagtaaataatagtgtttattttaatcctggaaat

SEQ ID NO: 138431 - DNA, 601 bp, Human
agatttgagcagtatgagtaaataatagtgtttattttaatcctggaaataagtcattggtatttataatcagattttttataaaccagcattataaactctatcctggcatcttccctctttatggaatacttctttctgtttttgaatatctcagttcccccaagtattaggggaaaacttcttgtaacccagatgctcattcttgctgctagcccatttctgcatgttttttttcctttcctgccttttaatgactaacttccctctagttgttgatttttcagattttgtttctttrctgtctgtctccctccctgaagcattgcatttttgcttctgtcttgttgcctcactgaaaccgtattcagaaattaccaatgggccgggcttagtggctcacgcctgtaatcccagcactttgggaggccaaggtaggtggatcacctgagatcaggagttcgacaccagcctggccaacatggtgaaaccccgtctctactaaaataagttagctgggcatagtgttgcatgtctgtaatcccagctacttgggaggctgaggcaggagaatcgcttgaacctgggaggcagaggttgc

SEQ ID NO: 138432 - DNA, 601 bp, Human
gagtcaagtcatttaccatcaactctgaatcttctagatgcaataccttggtgaactctttgacttccccttcttttctttcaattcttaaccacagtatcatttaagatctgaccccaaacaccctcttacaaaggaagctttcctttgttattctctgtctcactttggcctctgttttatttggaattttccggtcttacatgttttattgacagaatctcagccttaatagatactaaattggtattagatgagggaataaatattcttgaatatactaccagaaaggcagcatgamactggaagtaagagatcagtggaaatttgggcaaataggacaataccaatacttaataccttattttgaaggattacataaagtaccacaatggaattaaaaatcttgttaaagcctctactggcaaattagatgagagactctaaggcagtataagaatgtggagtgaaggtcaagatgatctgaaagtggtaaaatgatgtgagaatgcacataaaggccttatttgcagatgactttgccccacactgttcttccaggggaccattaatttaacatgtttttattgagaacttatta

SEQ ID NO: 138433 - DNA, 601 bp, Human
agatgagggaataaatattcttgaatatactaccagaaaggcagcatgaaactggaagtaagagatcagtggaaatttgggcaaataggacaataccaatacttaataccttattttgaaggattacataaagtaccacaatggaattaaaaatcttgttaaagcctctactggcaaattagatgagagactctaaggcagtataagaatgtggagtgaaggtcaagatgatctgaaagtggtaaaatgatgtgagaatgcacataaaggccttatttgcagatgactttgccccacactsttcttccaggggaccattaatttaacatgtttttattgagaacttattaatgttcaaggcactgtgaagaaacagaggcgaataaaacggttaacttaccagagcttacagtctaagagttaaaacacaattagcctgatactctgctagaagtacaaagtactatgggagatctttggggtagttacgacttacagctggatgattaagagaagccttcttggaggaggtagaattgaactggcattgtaaactaggtaaaatctttgtaggcagaaagatatgttgaagggaatagca

SEQ ID NO: 138434 - DNA, 601 bp, Human
aagatttgcagtgacattgattataaaagtataaggtcttttatgccgactttatagttctggaataggtgagttcctgctactcgggatttatgtcctttccatttcttactgcctcccccctttccccacggtgctcttctcttattccctctctctgatccttccagcagcaattcgcatatcagttcagaagtccagttatagacgacttgtcttataggtatttatcttaaattaaacgtttccattagtcaagatagtattttcgtaagtaaaagtgactttttatttatctttsccaggtaatccaagatttaagatttatcatactcagtgaaactttttatgaatagcattatatttatctttttattttaagatatgggataatacatttgttgaaataataaaaaccacactaaagttgcatgctgcctagctatactttactgtttcattaaagttgagaatgtggttgaagtttgtaccattgactctctgatctgatatgttctaggcaaggtaaagaatcctgagtggagcagaaatgaaattccacatagctgtggtgaggtttgtagaaagaaacagcctggcc

SEQ ID NO: 138435 - DNA, 601 bp, Human
caacaaagcaagaccatgtctctaaaaataataaataaataaataagtagactgtatgcagtcagcttctaaataccaaaaaatgcacagtaatagaaaaacagttgatcagttacaaataaatttctacaggccttaacctcagacaaaggtttaaatcttaggttcaagttacttaaatagttatgtaaccttggacaagttattaatttatctaagcctgcatctgtaaaataataatgatagtaataataacacttatagggttctatgaaaattaaatgaattagtgcatctatgyggctcgatatagagtctttctggcaagtgatcaaaaaatgacaattcttacttttactacccaaatctaagagtaaaccagacatcagagtgttatcttggtatttctactgcttggaggagggataatattggaccagggccttgtgatcaaggcatggtggtggcgctggggaaatgtcagtgggggtagagctgttttaaactgggctagacagcatggcctgtgatctgctgggcagtcagatacctcattccctttgactgctcgcataggtccttccttaggaaggagttaagc

SEQ ID NO: 138436 - DNA, 601 bp, Human
catttacacttgttaggactcaaaagtgacagagacagggtctcgctctgttgcccaggcttgagtgcagtggtgctatcgtagctcactgcacccttgaactcctgggctcaagcgatcctcccacctcagcctcccaaagtgctgagagtacaggcatgagccaccatgcctggtgtgaacatcaatatttttaaaagctctccaggcacttccaatatatagccagtgttgtggacctctggtctaaaagttaagaaaacctgagattgaggagattgagtccaggcttctgagatayttgacataacctagaatcacccacacctgacaagcaatgaaaattgtttcacccgaaaggattgaggtatatataaaatataactgttgaataatgatactcatctttaaagaaacatgcttaaacttatgtctcctatgggtattgtctatcaaaatgagtcatcttagaagactagacacttgttcctggattgttttcaatgtttaaactttatttaagaattatcagagcttgtttaggagtttcatagaaactaaacattccagccagaccactttataagcacactaatgtttt

SEQ ID NO: 138437 - DNA, 601 bp, Human
taaaataataataataaaatgaacatatgtgaaatctaagaacatataaaactaatttttcataataaaaattagaaaatggttgcctagtggtggaaattgggggaagggacacaaattttctgggttgatagaaatgtttgatatcttgttttgggtggtggtcacacagatgtatacaattaccaaaagatatccgaaaccaatcaaaactgaatatgtaaaatatttgtgtttattatatgctagctgtacatcaatgggaaaaaaagtagaaagtatctacatgaatagaaaaaawttttttaattgtgaatataagtttatgtttttgatgttttcagtttttctcttcctctccattactgcaatctagaaatggaacagaagaatctaattttatagttggggcgtgttggcgggcgccggtaatcccaggtacttggaggctgaggcaggagaatcgcttgaacctgggaggcggaggttgcagtgagctaagatcgtgccattgcactccagcctgggcaacaagagcggaactctgtctcaaaaaaaaaaaaaaaaggaatctagttttattttctcttagtgcaatgca

SEQ ID NO: 138438 - DNA, 601 bp, Human
ccctgaaatatactctctccttcgtctgcctttctctacattttatgttcctcctgggttgttcaaaatcagctgtcatatattctttccccagcgtttcctttcaggcctaacagctgtgattgcttcatttcttccctgtgaaacatgctcagagaccacacatcctcttaaaagtggctagattggcctgggcacggtagctcatgcactctgggaggccagggcaggtggatcacttgagcctaggagtttgagaccagcctgggcaacatggcgaaaaccagtctctaacaacaamaaaaaaaaaaaattagccagacatggtggcatgtatctgtagtcctagctacttgggaggctgaggtggaaggatggcttgagcccaggaggcggaggttgcagtgagctgagatcatgctaccgcactccagcctaggtgacagtacccacctctgtctcaaaaaaaaaaaaagtggccagattgttcacaacaatgccagtctttttgtgggatccacgaaaaccagtattgttcgaaactcggtgttctttgagtacattcttgagatttttcactgagacggaggactgattaaat

SEQ ID NO: 138439 - DNA, 601 bp, Human
aagtggctagattggcctgggcacggtagctcatgcactctgggaggccagggcaggtggatcacttgagcctaggagtttgagaccagcctgggcaacatggcgaaaaccagtctctaacaacaacaaaaaaaaaaaattagccagacatggtggcatgtatctgtagtcctagctacttgggaggctgaggtggaaggatggcttgagcccaggaggcggaggttgcagtgagctgagatcatgctaccgcactccagcctaggtgacagtacccacctctgtctcaaaaaaaaaaaaagtggccagattgttcacaacaatgccagtctttttgtgggatccacgaaaaccagtattgttcgaaactcggtgttctttgagtacattcttgagatttttcactgagacggaggactgattaaatgtgtcctgattattttccagactaaaatttctggtctgttctctgtggaatagaacttcaaggcttccatcacctattgtgaatcctgaccctgcctgtgggtgctccctccagttttatcccaggctgaaaatgggataatatgttccagcccctgtttttaatagtctcttc

SEQ ID NO: 138440 - DNA, 601 bp, Human
ttattgttacctgttctgacccttgattcttttgctcacagctttctattcattacctctgtaaaaagcctttgttctgtttgagcagaaacttagcaaagaaaagcctactagcaaaagcttccagtttccagggtttctttaccagttcattgattctacaaatatttattgtgttttctgaatctttattaatttatcaaatcagtctttattaaatgaacaaatgagttttagaacgggggaaaaaattgcatataggccgggtgtagtggctcacacctgtaatcccagcactttrggaggccaggatgggctgatcacttgagcccaggagtttgagaccagcttgggcaacatggcaaaaccccatctctacaaaaaatacaaaagctagccaggtgtagtggcacgcacctgtactcccagctacttgaggggctgaagtgagaacattgcttgagcccgggagtttgaggctgcagtgagctgtgttcacatgactgcactccagcctgggtgacaaagtgaggccctgtctccaaaaaaaaaaaaaaaaaaaagaaagaaaagaaaagaaattgcacatgcacttactgga

SEQ ID NO: 138441 - DNA, 601 bp, Human
acgcccggctaatttttgtatttttaatagagacggggtttcaccatgttgaccaggctggtctcgaactcctggcaccaagtgatccacccgccttgggttcccaaagtgctgggattacaggtgtaagccactgtacctggccaaagaactaaaattgtaagtacaatagaacctcagccatttagatcattcaaggaatgtcagcctctgtagctaagtttcccatctagctgaggatacgaggatagcacctattgaacatcattttggatgaatatttttcttttcttttcttttyttttttttttttttgagacagagtctcgctctgttgcccaggctagagtgcagtggcgtgattttggctcactgcaacctctacctcctgggttcaagcaattctcctgccttggcctcccgagtagctgggattacaggcacctgcaatcatgcccagctaatttttttttgtatttttgtagagacggggtttcaccatgttggccaagctggtcttgaactcctgaccttgggtgatctgcccgccttggcctcccaaagtgctgggattataggtgtgagccaccatgcccggctg

SEQ ID NO: 138442 - DNA, 601 bp, Human
aaatgcaaaattcattaggctgggtaccgtggcttatgcctgaatctcagtgctttgagagatggaggcaggagaattgcttaagcccaggagttcaagaccagcctgagcacgtagtgagaccctatctctacaaaaaattttaaaaacttaggccaggcacagtggctcatgcctgtaatcccagcactttgggaggctgaggcaggcagatcacttgggatcaggagtttgagatcagcctggccaacatggtgaaatctcgtctctactaaaaatataaaaattagctgggtgtggyggcacacgcctgtaatcctggctatttggaaggctaaggcaggagaatcgcttgaacccagtaggcggaggttgcagtgagccgagatcgcaccactgtactccagcctggacgagggagtaagactccatctcaaaaaaaataataataattaaatttagctgggcatggtggcacacacctgtgatcccagctactcaggaggctgaggtgggaagattgcttgagtccaagaggttgaggttgcagcaagccatgatcatgccactgcgcttcaggtgggcaagaaagcaagaccct

SEQ ID NO: 138443 - DNA, 601 bp, Human
tagtgtggtgtggtggcatatgcctgtgatcccagctactcaggaggctgaggcacaaaaattgtttgaattcaggaggcagaggctgcagtgagccaagatcatgccactgcacttcagcctgggcaacagagcaagcctctgtctttaaaaaaaaaaaaaaaaaaaaaaaagctgggcactgtagctctcacctgtaatcccagctactcaggaggctgaggtggaaggatcacttgaggctaggagttcaaggccagcctgggcaacgtagtgagatttaatccctcaaagaaatttstaaaattacccagacatggtggtatgtgcctgtagtcccacctactcaagaggctaaagtgggggatcacttgaggccaagagttcaagactgcagtcagctatgatcatgccactgcattccagcctgagtgacaagagtgggaccctgtctccaaaaattaataaagctataaatatatatatttgttatctttttcagcttctttaatagatataacattatataaagttctaacaaagtagtattgggtttataacatatagatgtgatatgtataacaataactgcacaaaaggg

SEQ ID NO: 138444 - DNA, 601 bp, Human
tttactacaaggaggttacagttttattacaaggaaaaggatacagattaaatcagccaagggaagaagtatgtaggacagagtccaaaaaaataccaaaggtggaacttcatttgtcctttccctgtggagtcaggaaagtattactctctccgcttcagtgtgtgccagcatacatggaatattgccaaccaggaaagttcacccagacctgtgtgttcagtttttattggtgctctattgtgcaatcatagttgactgcccatgtggctaatctcagtctccagtctctcccgaggtstaccgataccatgtgacccaaaacccctgccctaaaactatccagtgtggccagcctgctcctaaatcacgtaattggactatccagtgactcaagactccaggcaaacaatgacacttatatcaggcatggcattccactaggcttagagattacctctcagaagccaagcacaaaggccagactctctttaagtaaggtttaattcttcactgtacatctgttttgtcagtttctactttctggtgaaagcctggatggtttttatttttcttttttttttttaattttatttattta

SEQ ID NO: 138445 - DNA, 601 bp, Human
atctcagtctccagtctctcccgaggtgtaccgataccatgtgacccaaaacccctgccctaaaactatccagtgtggccagcctgctcctaaatcacgtaattggactatccagtgactcaagactccaggcaaacaatgacacttatatcaggcatggcattccactaggcttagagattacctctcagaagccaagcacaaaggccagactctctttaagtaaggtttaattcttcactgtacatctgttttgtcagtttctactttctggtgaaagcctggatggtttttattttttttttttttttttaattttatttatttattttgagacagagtctcactccatcacccaggatggagtgcagaggcgcagtcttggctcactgcagcctccacctcccagattcaagtgattcttatgccttagcctctggagtagctggaattacaggtgcatgccatcacacccggctaatttttgtatttttagtagagacgggattttgccatgttggccaggctggtctcaaactcctgacctcaagtgatcctcctgcctcagcctcccaaagtgctgggattacaggtgtgcacc

SEQ ID NO: 138446 - DNA, 601 bp, Human
tggatagttttcatcagactttatgttataaaaagtcttcgggtgattcagcttggggaacacactgagtgttgatttatcctgctctttgacctacttagtcattttagtgtatatcaacatttgtcccagtagagtacaagccagggtggagacagaattgtgaaccgttggttctgttaaacacaatgcagggtctggcagcatctgacttgcgaataattctgaggatatagtccataaatgggaagctagtttaataggaaaacttcagaaaaaagggaaaagtagtataatttayatgttacaaaagttgtgtaatcatatatgggttttttcctgaaagaaattacaatatacataggataacagaggcatttttgaatgtcaggtatgggaccacttttgtactttgtaaatactgtattaaagactgagatgctgtgatttggcaatcataaatttagtaatgcccagagatgctctttgtgatctgtgtgactgaaaattgtaagcagggttgggacatgtaagctggaagtggctgctgtcagttttcttcattctcccacaatccctctttctatctctacgttttctt

SEQ ID NO: 138447 - DNA, 601 bp, Human
aaagtcttcgggtgattcagcttggggaacacactgagtgttgatttatcctgctctttgacctacttagtcattttagtgtatatcaacatttgtcccagtagagtacaagccagggtggagacagaattgtgaaccgttggttctgttaaacacaatgcagggtctggcagcatctgacttgcgaataattctgaggatatagtccataaatgggaagctagtttaataggaaaacttcagaaaaaagggaaaagtagtataatttacatgttacaaaagttgtgtaatcatatatggrttttttcctgaaagaaattacaatatacataggataacagaggcatttttgaatgtcaggtatgggaccacttttgtactttgtaaatactgtattaaagactgagatgctgtgatttggcaatcataaatttagtaatgcccagagatgctctttgtgatctgtgtgactgaaaattgtaagcagggttgggacatgtaagctggaagtggctgctgtcagttttcttcattctcccacaatccctctttctatctctacgttttcttgcttctcattgactctttgtcctcactccct

SEQ ID NO: 138448 - DNA, 601 bp, Human
ttatggtaattcatgtgcaggaatttatgggagttctgcctttcctgacaattgtagataaccactcctgcatatcatttcttccatataatccagtgttcactgatgggagcattaactcagtttcatgagtcacttttgctttatatctgtagagagcatatagggaactttttcatatcatcaatcccagacacctcattttttatctgaaatgtatattttccagccaagaaccttttattgcttagacttcttcacatctgttatcaacttcagtagctgctttttttttttttttcaggataatttttacgaagaggggacttttaaagtcatttttctcatttctgagtacatggcaacctgtaaatgacatcaaagccaaaatcagatgtagaagccgggcagctagccagactcattctaccccaagtgactgacttccttcccacacaccatcatcactacacacgatttttaggatcatgccttagcaaaattacgtgatagaccttttagaccactcacatgtagtggaaaccaaactttagaggccaaaccaaagatcctgctttatttcactttgctgtagttttgt

SEQ ID NO: 138449 - DNA, 601 bp, Human
tttattgcttagacttcttcacatctgttatcaacttcagtagctgctttttttttttttttcaggataatttttacgaagaggggacttttaaagtcatttttctcatttctgagtacatggcaacctgtaaatgacatcaaagccaaaatcagatgtagaagccgggcagctagccagactcattctaccccaagtgactgacttccttcccacacaccatcatcactacacacgatttttaggatcatgccttagcaaaattacgtgatagaccttttagaccactcacatgtagtgraaaccaaactttagaggccaaaccaaagatcctgctttatttcactttgctgtagttttgtgatattatcaggtgtgctctgaagtgtgtagagccgtttgtccctgcattaaatggtacagattgtcatctgttttcaattcttatatctgctttttatggctttttctgtctgtacccttgtttggtgatgacttctctttcctttgcatgcctttagcagccctctttctatttagattttgtaattattagtctactgtgaatttggagaccagaccacaaaaattgttagaattg

SEQ ID NO: 138450 - DNA, 601 bp, Human
actgtaaaatactttgaactttttttctttttccttttgagacggagtctcgctctgtttcgcaggccagagtgcagtggcgcgatctcggctcactgcaacctccacctcccaggttcaagtgattcccctgcctcagcctcccaagtagctgggattacaggtgtccaccactacacctggctgatttttgtatttttggtagagacggggtttcactgtgttggccaggctggtctctaactcctgacctcaagtgatccacccgcctcggcctcccaaagtgttgggattacaggcrtgagtcaccacaccggcctcgattcctgtttttataaccgacacatactgttgttgaagccattttaaaacctttttggaaaagtgatggaagataaggatatgcaaaataaaaggtcttactgtagtcagaaagaaagctgtattggttaggaagcttctggatgcaggtaacaaaacccaagaaaaagtgacttttacgataagggtgtttactgccacacctgataggatatctggaggcagaacaagtccgagattggttaattttagctcagtgattttgaagacttcaatttgg

SEQ ID NO: 138451 - DNA, 601 bp, Human
tgttggtcaggctggtctcgaactcctgacctcgtgatccgcctgcctcagcctctcaaagtgctgggattacaggcgtgagccaccgcaccgaccatttttggggctttttaaatcatagccatcctagtgaagtgatatatcactaccacatgatgtgatgtctctgatatctcaatgttaggttttaaaatctatttattgtttaagacagggtctctgtcaccttgactggagtgcagtggcagaccacagctcactgcagccttgatctcctgggctccagtggtcctcccacacragcctcccaaatagctgggaccacaggcatgtgccaccatgccctttgcttaattaacttttaattaagttttaaaaacttaatttttaaaagtttttccagggctgggcgcagtagctcacgcctgtaatcccagcactttgggaggccaaggcaggcggatcacttgaggtcaggagttcaagactagcctggccaacaaggtgaaaccccgtctctactaaaaatacaaaaaattagccggcatggtggcaggcacctgtaatcccagctactcgggaggctgaggcaagagaatcg

SEQ ID NO: 138452 - DNA, 601 bp, Human
gtgcataggttatatgcaaatattataccattttgtataagagacttcaatatctgtggattttgatatccaagggaggtcctggaatcagtcccccatggactccaaaagtttgtacacccatctactaagatgagcatggcttctcctccacaccttaaacactaccgttgctattttttttattttttgagttttaaaggtgaaaattgatattttaatatgcattttcagctgggcagagtggcttacacctgtaatcccaacatttggaaggccaagatgggaggctcatttgagygcaggaattcgaggttacagtgagctatgttaatgctactgcactccagcctgggtgacagaaagagaccctgtctctttaaaacaaaacaaaacaaaacaaaacaaaaactgatggccgggcatggtggttcacacctgtaatcccagcactttgggaggtcaaagcaggtgaatcacctgaggtcaggtgttcaagaccagcctggccaacatggcgaaaccctgtctctactaaaaatacaaaaattagccgggcgtggtggcgcacacctgtaatcccagctactcgggaggctga

SEQ ID NO: 138453 - DNA, 601 bp, Human
tgagcctgtaaattcaaaagcaaattagttacttcctaggtccaatgggagtacaggcattgggtatatacagccattccaaatgggagaaattggccaaaacaaaggggctacaggccccatgcaagtccgaaattcagtggggcagtcaaatcttaaagctacaaaatgctctcctttgactccatgtctcacatctaggtaacactgatgcaggaagtgggttcccatggtcttggacagctccgcccatgtggctttgcagtgtgcagcccccctcccagctgctttcacaggctgkcattgagtgtctgtggcttttccaggcacacagtgcaagctgtcagtggatctcccattctggggtctggaggacagtggccttcttctcacagctccactaggtggtgccctagtagggactccgtgtgggggctgcaaccccacatttcccttctgtactgccctagcagaggttctccatgagagccccacccctgcagcaaacttctgcctggacatccaggcatttccatacatcttttgaaacctaggcagacgtttccaacctcagttattgatttctgtgcacccgcaggct

SEQ ID NO: 138454 - DNA, 601 bp, Human
atatacagccattccaaatgggagaaattggccaaaacaaaggggctacaggccccatgcaagtccgaaattcagtggggcagtcaaatcttaaagctacaaaatgctctcctttgactccatgtctcacatctaggtaacactgatgcaggaagtgggttcccatggtcttggacagctccgcccatgtggctttgcagtgtgcagcccccctcccagctgctttcacaggctgtcattgagtgtctgtggcttttccaggcacacagtgcaagctgtcagtggatctcccattctggggtctggaggacagtggccttcttctcacagctccactaggtggtgccctagtagggactccgtgtgggggctgcaaccccacatttcccttctgtactgccctagcagaggttctccatgagagccccacccctgcagcaaacttctgcctggacatccaggcatttccatacatcttttgaaacctaggcagacgtttccaacctcagttattgatttctgtgcacccgcaggctcagcaccacatggaagctgccaaggtttggtgcctgcactctgaagccttggcccaagctctgtg

SEQ ID NO: 138455 - DNA, 601 bp, Human
ggagcacaagtgtcctttgatttgtgggaggaaactccgttgtggccttcataggtgtgaagaaccttgtcatcgtggaaactgccagacatgctggcaagccagtgagtgtctttactgtatagtttattagaagagttttttagaaattcagacataatatactttgagagattgatttacttagaattgtatggattcttgaactaagccttcgtatttccaatatgttgagactttttttaaagttacttctaatgctgtgttgtagtccctgaatgtgcaaaacttgggatatgarcagtgatcctgagatggggcctagttcgttaatagattccttctctgctacatgcctcatatgtgttattgacctaggttctgtcctcaacaatcttctttctctatattattagcagcagtttgcaaactttttggttgtagggctcatttacattaccaaaaactatcctaaagagtcatttttatgtgaattgtatttatctttatctaccatattagaaattaaaactgagaaatttaaaaaataattgattagtatatttaagaataataatatacctcattgcatgtaatcaca

SEQ ID NO: 138456 - DNA, 601 bp, Human
ctacatgcctcatatgtgttattgacctaggttctgtcctcaacaatcttctttctctatattattagcagcagtttgcaaactttttggttgtagggctcatttacattaccaaaaactatcctaaagagtcatttttatgtgaattgtatttatctttatctaccatattagaaattaaaactgagaaatttaaaaaataattgattagtatatttaagaataataatatacctcattgcatgtaatcacaaaaatttttttaaataacttttcaaaaaagtagaatagcggatacttkgtttaatagaaggtagctggattcttgtatctacttctgcatccagtctgtcgtgatatagttgaggcatatgaaaaaaatccagccttacacagatagccttacacaggagaagggaagagtattttaaagatgttttcaaataattattgatattctttgaaattacaccaaaattcaacctcattttagaaaggacttgactcggtgtttttattctctgtcacaaaaatttattggactttcttgtactttgaatggatctttttacccgtgcatgattttataatagcccacatt

SEQ ID NO: 138457 - DNA, 601 bp, Human
atgttgataaatttcctattataatattaaaaactcagtcattaatataatctccagtctagaaatatgttgggaaaagtattgggaagttgtcagggtcatagtaataaatgaaacttcatatctgttcatgcctttttcaccagcttagctttaataaaataaaagtttaataaaataaaaacctcttttgaaaaaagtagcacccccataaattctcctctaaaaatacaagcaaaaatgtgtgtgtttgtgtgtgttagtatgtacttgcacatcccaaactcagaaaggattcttytgttttacctgctgctccaccaggttttgatgaattaacctgccattgtggtgcatcagtgatttaccctccagttccctgtggtactaggccccctgaatgtacccaaacctgcgctagagtccatgagtgtgaccatccaggtgagtaccaacttgtcttcacacttcagcctgctcacaccatgtcatttaggatcctgctgtgttactgtcttcactgctctagagtcatgctgtgatggctgccccttgctcccggctcaggggctggttctctgaaggtgggtctgtgatctgg

SEQ ID NO: 138458 - DNA, 601 bp, Human
cataaattctcctctaaaaatacaagcaaaaatgtgtgtgtttgtgtgtgttagtatgtacttgcacatcccaaactcagaaaggattcttttgttttacctgctgctccaccaggttttgatgaattaacctgccattgtggtgcatcagtgatttaccctccagttccctgtggtactaggccccctgaatgtacccaaacctgcgctagagtccatgagtgtgaccatccaggtgagtaccaacttgtcttcacacttcagcctgctcacaccatgtcatttaggatcctgctgtgtwactgtcttcactgctctagagtcatgctgtgatggctgccccttgctcccggctcaggggctggttctctgaaggtgggtctgtgatctgggccacagcttggaatcacagtgccctccattggtttactctagggatgtcaaacacacctaaaaacgttggaagactccccagctgatcttatctctcaagaacttttctttctttgtggtctccactttggtgcatgttttgaaatttagcatctttttacaaaattaaaagtgacttttttgttgttatagaagcaatatatattta

SEQ ID NO: 138459 - DNA, 601 bp, Human
aatacaaaacttagcctggcgtggtggtggacgcctgtaatcccagctacttgggaggctgaggcaagagaatcacttgaacccgggaggcagaggttgcagtgagccgagactgtgccattgcactccagcctgggtgacagagtgagactctgtctcaaaaaaaaaagagagataaagtcaaaagtttgaaattaaataatctattatatgtcacctccaaagaattataccttatatgtatttctcagggtcttttgccatgtgcaaatatatatgtttgcattttttccccaatgtraaagtgggatcctactgaacttaatgcttttaactagctttttttcccactcttattattatatttttgatctgtccccttgtaagtatttttttacaatataaacttttaatttcaattgagtgtcctgttacatggatgggccataacttattcagtcagtcttgtgttgctggacattttagtgttttcagttttcctctgataaactgctcagataccaggccaacaaccatttgacatcactcaatttccgtatctgtcaagtctagttgctggcttttctctagcaccataccg

SEQ ID NO: 138460 - DNA, 601 bp, Human
ttgcagtgagccgagactgtgccattgcactccagcctgggtgacagagtgagactctgtctcaaaaaaaaaagagagataaagtcaaaagtttgaaattaaataatctattatatgtcacctccaaagaattataccttatatgtatttctcagggtcttttgccatgtgcaaatatatatgtttgcattttttccccaatgtaaaagtgggatcctactgaacttaatgcttttaactagctttttttcccactcttattattatatttttgatctgtccccttgtaagtatttttttrcaatataaacttttaatttcaattgagtgtcctgttacatggatgggccataacttattcagtcagtcttgtgttgctggacattttagtgttttcagttttcctctgataaactgctcagataccaggccaacaaccatttgacatcactcaatttccgtatctgtcaagtctagttgctggcttttctctagcaccataccgggcccatcatttcattttaccaaataccagaggcaaacctgaagtaattcaggggaccagatttgatacccacagttagtctggcagtatgattca

SEQ ID NO: 138461 - DNA, 601 bp, Human
catccctgtaatcccagctactttacttgggaggctgaggcaggagaattgcttgaactcgggaggcggatgttgcagtgagccaatatcgcaccactgcactccagcctgggcaacagagcaagactccgtctcgaaaaaaaaaataaattttaaaaactacacattgggtacaatgtacactcctcgggtgatgggtgcaccaaaatctcaaaaatcactactaaggaacttatccatgtaaccaaacaccacctgttccccaagaactattgaaataagaaaaaagaaaaaaaaaaaatcactgattgcaggtcaccctaacagatataataatgaaaaagtctgagatgttgcgagaattaccaaaatgtgatgcagacacgaaatgagcatgtgctgttggaaaagtggaacagatagacttgctggagacagggttgccacaaagtttcaatttgtaaaaaatgtgatatctatgaaatgcaataaagtgaagtccaataagaaatgcatatttattgtacagttgagaagatttaattctgctactgagaaagaaatactctaccattctggcatataaaccaccagacgtggt

SEQ ID NO: 138462 - DNA, 601 bp, Human
tgggcaaaaattatcccctttgccctggtagtagaatgggtaagtgtttaatgattgagaactacattctactaaaatatggattccagtgcgatgggaaatatgtatgtcctagatgttggaagtctcttcagggggagaagttgtgtgtcactgcagtagaagtatatccctcatttcgagggttcaagactagcctttggtcctacgagagtaaaatttcagcagctttttcctatggtgaggaagcgtggaaacaggccatttttcaagaaaaaaaaaaagaattgggggttctatsccctgttgtctcttaattttttaaaggacaggactgcgtgaagctgtggagaccatgagttgggagacatgaggagagttaagtatttaattacagaaaacagcctcctagcctgggcaacctagtgggatcctgtctctacaaataatacaaaaattagctgggtttagtggcatgcctgtactcccagctacttggaaggctaaggcaggaggatcacttgaactcaggagttcaaggctgcagtgagacacgattgtgcaactgccctccagcctaggcaacagagcaagattctgc

SEQ ID NO: 138463 - DNA, 601 bp, Human
ggatcacttgaactcaggagttcaaggctgcagtgagacacgattgtgcaactgccctccagcctaggcaacagagcaagattctgcctcaaaaaaaacaaaacaggccaggcgtggtttctcatgcctgtaatcccaacactttgataggctgaggcaagtggatcacctgaggtcagcagttggagaccagcctggccaacatagtgaaaccctgtctctactaaaaatacaaaaattagctgggcatggtggcacacacctgtagtcccagctacttgggaggctgaggtaggagaaycgcttgaacccaggaggtggaggttgcagtgagctgagatggcgccaccgcactccagcctgggcgacagagcgagactccatctcaaaaaaaaaaaaaaaaaaggcaaaataaaacgaaaaaatggccctgccatcagtctcagaaccctgggctaaggttgccctccaccccgcatctataagaattagtctattgactctgctttagcagttcagaaaggagggaaaagatcatctgcccctgccagttagtcatagcattttcaagcactccctagttacctagttacatttgttt

SEQ ID NO: 138464 - DNA, 601 bp, Human
gctggaaaggtttttttgtttgttttgttttgttttattgagaggggtctcgccctgtttcccaggctggtctcccaccttggcctcccaaagtgctgggatcacaggcgtgagccactacacctggctggaaagtttcttacatacatttttaaaaatctggtttctctagttcaaagaaacagtgctgctttatataccttttcttccctaactttagtgtgtaaaataactttgaaatttctccgcttcctccttcctctttctttttttctctcttttggtcgtattacattgtgarataagaagggaagatgtcctgaagttaggtgaattgctttcacatcctaccatttgtcattgacacagccagggctaagctctgtgctcctctggtgtgagggtttctaattgttctgtgaggtatctctgcagcctcctgaagtcttgggacctgtgtagccgtacagggatctgagtgctgagatggaggtgttagagaatgaatggttatatatatatatatctggttagatggggagaggtgccatggatataggactttaagaggatgcacacatcagattggctgtgtttgaat

SEQ ID NO: 138465 - DNA, 601 bp, Human
cccaggttcaagtgattctcctgcttcagcctcctgagtagcggggatcacaggcacctgctaccatgcctggctaattttttgtatttttagtagagacggggtttcaccatattggccaggctggtcatgaactcctgacctcaggtgatccacctgccttggtttcccaaagtgctgggcttacaggcgtgagccaccacacctggcctagatttgcttttaaagaggtcttctgtatcccaagtataaggaggttcttgtgaaactgcaatgcctctttttccctttcttttttatatttcagaatagctgcaatctccatggcctctaagataacagacatgcagcttggaggttcagtggagatcagcaagttaattaccaaaaaggaagttcatcaagccaggtaatttttaaaatgcatatatgtgccttctttcttcaattagacttcaattagagggcagagattattcatttatctcaatccttcatagtagagccttgcatacacaataagtattcaatagacaatttgatgttgagacatctgctccatccccaatgaatcctactcaggagatggctaagactaaag

SEQ ID NO: 138466 - DNA, 601 bp, Human
aggttcaagtgattctcctgcttcagcctcctgagtagcggggatcacaggcacctgctaccatgcctggctaattttttgtatttttagtagagacggggtttcaccatattggccaggctggtcatgaactcctgacctcaggtgatccacctgccttggtttcccaaagtgctgggcttacaggcgtgagccaccacacctggcctagatttgcttttaaagaggtcttctgtatcccaagtataaggaggttcttgtgaaactgcaatgcctctttttccctttcttttttatatttcagaatagctgcaatctccatggcctctaagataacagacatgcagcttggaggttcagtggagatcagcaagttaattaccaaaaaggaagttcatcaagccaggtaatttttaaaatgcatatatgtgccttctttcttcaattagacttcaattagagggcagagattattcatttatctcaatccttcatagtagagccttgcatacacaataagtattcaatagacaatttgatgttgagacatctgctccatccccaatgaatcctactcaggagatggctaagactaaaggag

SEQ ID NO: 138467 - DNA, 601 bp, Human
ccttcaaacgtcattcactcagcactgcgctgcgtcttttaccgttatcaaagagcaagagaaatgccgttaccaagaattgaattgtcttaaggataaaccactcaggtgatttcagcatattgagaaacatgagctgtgtggttttgggcatgatataaacatcacataacacagcatacttattcagggactggccaacttcctgactcagagataagaggtttaaaacaatgtttagttaacttttcgttgaagtttagcatacatattgaagattggaagtgtgcagatcagtgartcgtcactaaatgattacagttgtgtaatcatttgtgtcactaaatgaatacagttgagtatggatacaggtgaaaagataattaccagaaccgtctcttgtactctacataaaggtgaaacctctatcctaatttctctttagattagtttttgaactttatgtaagtgatgaaatcatgtagtttgtattatttttgtctggcttctttcgttatatttttgtgacattcactcctgttgttgcatgtagcaatgctttattcatttttattcctgcatgattttttttgtattacta

SEQ ID NO: 138468 - DNA, 601 bp, Human
gcacccagcccatttccacttatatttcacaattggcttgttattataatatatacccaagaaacctgctgggattttgattgagttggtatttaacttgtaggtcaatttggaatctttacaatgttaaattttctagtccaagagaaggtgtattcttgcatttcatgtcttctttgatttctctcaatgatactttatggttttctatatataaattttgtattctttcagtagatttgtttcttgctttttgatgctgctatagatgggtttatttttcttgtattacttgtaattytttttttgagacagagtctcgttctgtttcccaggctggagtgcaatggtgtgatctcggctcactgcaagctccacctcccgggttcacgccattctcctgcctcagcgtcccaagtagctgggactgcaggtgcccaccactacacccggctaattttttgtatttttagtagagatggtgtttcaccatgttagccaggacagtctcaatctcctgaccttatgatctgcccgcctcagcctcccagagtgctgggattacaggcatgagccactgcgcctggccaacttttaattt

SEQ ID NO: 138469 - DNA, 601 bp, Human
attgtattggttagggccttcagtatattgttgaatggagggtggtaataatagatattccttggccgggcgcggtggctcacgcctgtaatcccagcactttgggagactgaggcgggcggatcacttgaggtcaagagttcgagaccagcctggtcaacatggtgaaaccctgtctctactaaaaatacaaaaattagccgggcatggtggcagacgcctgtagtcccagctactcaggaggctaaggcaagagaattgcttgaacctgggaggcagagggtgcagtgagccgagatggcgccaccacactctagcctagacgatacagcaagactcagtctcaccaaaaaaaaaaaatagatgttcctgactaatcctccatctcatggggaaaactttaagtatttcaccattaaatatgatgtctgcagtaagttatttgaggatactctatcagatcaagaggcatttattcaacaactgacaaactttctgattctagcaaagattgattaaattgaatagccctgcaaattgttaataattggagaatttaggtgaaggttatatagaagtttatggtaatattctcataact

SEQ ID NO: 138470 - DNA, 601 bp, Human
ttgcagcactatttacaatagccaagatatgaaatcaactgaagtggccaacatggctgcatggataaagaaaatggggtatatatacagaatgaaatactattcggccataaaaaaaatgaaaccctgtcatttgcaacaacatggatggacctggaggacatcatgttaagtgaaataagccagacacagaaagacagacaccacacgatctcactcatatgtagaatatttaaaaaataatacagaagcagagagtagaccagtgttgtctgactgagaagagggacagggtggaaargggaggatgaggagaggttggtcagtggatataaagttacaaatagatggtagtaataagttcctgtggttttttttttttttttttttttttttttgagaaggagttttgctcttgttgcccaggctgtagtgcaatggcgctatctcagctcactgcaagctctgcctcccgggttcaagcgattctcctgccccagcctcctgagtagctgggattacaggcatgcacaaccacacctgactaatttttgtgtttttagtagagacgaggtttctccatgttggtcaggctggtctc

SEQ ID NO: 138471 - DNA, 601 bp, Human
gaataatttttataacaaacatattcatgatttaaagagaaaagaaaaccaagttggcaaggggcaagtctgccagatgttttctcagacaggagcagggaaggagctctgagagttgggtgactgttgggctttatttggagaaaccagaattgtgggctgaaaccaactttagagcacttggtcatagccccagttgtcccagttgtttgtcacttgtcagggagaggaagggaaggcaggatggtgctccttctctgctgccctagtgtaaccaaggcagtgtggctaaaagttactwcaaagcccagaaggagaggggtgcctactcctgttctggctttccacagacaagtcctagcagtacctcctctgtgattcctgcacaaaacctctgaagggtggttacggcagttcacaaggtcaccatgaaggtcacagcacttagtgttcctgtgggactggacaagaagacagctaggtgttgcccattgagctcagactcagccaagagcgtcctggtccccaggaccagcccctctccactcctgggagccaggtgtcctaggttctggtcagcacagtctgcaaatccatatgg

SEQ ID NO: 138472 - DNA, 601 bp, Human
tgggcacaggccccgtgtgctgctggtggcagatctgggagaagacctcctttctcccgacatccagccctgctctatcttccacctcactctgcccctcatgcccacatctgctgcaaaacccccaaggcctggcacatgtggctcacacaggctctggctctgccttgtgaggacgtggctgcggccctgattttgttaagggaatggagcccaaatcctcttggtgcttggtgctcactgatcctccctgttgaggaacccccacacccctggccaagtcaaggtcagaggtgcttasagggcaagggatgtattttctacagtggccatcagcaattgccactctggctacaccagacgtgtacaaccttggtttccacttgggaagtgatgacagctgaatggccaacctgcccaagcaagcgggattcctgaggctaacaaggcctgcttgctgcttggtgcaagaggaagggtgtctctagagctttccaattcctgaagcctttggctgacactgtgggactctgtttattcctgcttaggacaccgcgcaagactgtgaagcagtggctgatagaaaaaaacactttgaaga

SEQ ID NO: 138473 - DNA, 601 bp, Human
atgtctgctttaagtctgtttccccaccatctgctatagtacctgctacatagtaggtgctgaataaataagcggtgaatgagtgcaaaagaataaatttgtcacgtaccaggcagccccctccctgcccccagagggatcctacctgccacattccactggctacgtttccaaagctcttttgggtgatttagtacttggggagtaagtggccccaacagaactatgggaggttacaaaataatttatctaaggtcgggtgcagtggctcacacctgtaatcccagcactctgggaagcygaggcaggtggatcacctgtcaggagttcgggaccagcctggccaacatggtgaaaccccgtctctactaaaaatacaaaagtgagccgggtgtggtggtacatgcctgtaatcccagctactctgggattacagaggctgagacaggagaatcacttgaacccgggaggtggaggttgcagtgtgctgagattgtgctattgcactctagcctgggtgacagagtgagactccgtctcgaaaaataaaataaaataaaataaaaataataattggtctgaatggtgaaaaggccccttt

SEQ ID NO: 138474 - DNA, 601 bp, Human
tctggcccctgccagcttctcctgcctcatcttatgacctcttccctcactctggccatatcgaattgccagcagcttccccaaatagactggtggtttcatagccatgctgtcccctctgtctggaatgctctttcccaccttctctggagaaatgcgccctctcatctttcacaccctccgcagtgtttgtctcccctccattccatttggccccatgctccctaagctgtggtgggggtgtacatagccaactggttacagatgggctctggaaccagactaactgggtctgcatccwgcccaggtactagccaggcaaccttaagcaagccatttaacctttctgtgcctcagtttccctctctgtaaaatggggataacagtgccttctccttgaggttgttatgagtattaaatgggctattccattgacagagctggacacggtagtgagcactatgattctaatgcttgattgtgcttctgtgtttagacatccagactgtgagctccttgagagaggaaccatgtctgctttaagtctgtttccccaccatctgctatagtacctgctacatagtaggtgctgaataaataa

SEQ ID NO: 138475 - DNA, 601 bp, Human
ttcttgccatgcacattaacacattaacacatcttcctcatcgttacagctgtttgaatgggggacgtgtaagcaactggaaaccaacctccagccaaagtgcagtcaaacgcgaggaccctggggctgccatggtgtgaatgagttgcacatcctgtgacacacggggccacttgacagccagccaggtgagcagagagagacctacagctctgtcgttcaccccagaagatgggaaacaagggagtttctaagaagagacctgttgtgggcctgttttccagagggacagtccagtcaragctgcctcccatcttttcctggtgggaggtcccttaccattcttttgagccaaagcctggtcaatgaagtcggcagccctttcaaagtaagcgctgaggttgaactcctgtgtgtcgttggccttgatgcccaggtatgtgatgccggagtccttgtagaagttggcattggtgttgacgtgcatgaaggacctgccctcagccgcgttcagcacatgggtgatgcctagtttctgcagcttggggatgtcctgagccacagacctggacaggagacagtggtggggatgattaaccaa

SEQ ID NO: 138476 - DNA, 601 bp, Human
ggaaacgaggtagcttgtcagagaaggagggaagcagggaggcaatatatctaaatgtgctgccaagttcaagttctgagtggatattctaaatgtgcaacgactgagaatggggtgtggacagtaaggaaaatccatgcagatgtctctcctgcacagctggaaaccaatgttagagacacccaccaccccctagccccttaaagcagatcaagggagaatttctggcaaataagaaaaaggaaacagaagcagaagcaggatacagggcagctctgaggcaaggtaggcaggtgcacaraaactctcagggccctgctccagggagaacccccagaattacaagctgtcttgtcagcccaactacccagggaagcaagaacaggtctggaacagttatttttcagccactgaaatgcagccccagagagctctaggccactgtggatgggctgggagaatagccacccaaggccagaagtcaaaagggctctccattttcatttgcatctggtaacctgggccagagattctgcagaatgggccacgtggacccataatcccctctcccctcaatgtcccacaagcatggccagctgtc

SEQ ID NO: 138477 - DNA, 601 bp, Human
tagggcatcccagcccctggttgcttcccatctgaacgcacagacaagatatgactcagccctaaggaaactgtggccatattggatcagggcagggactccagtccagaccatgctatacctagaaagccaggctcgaactcaagtctggcttgcttcaaggctattatcatttctactgtgccaagctgcaacgggcagctatttgctgtaaggggaagaggggtggaaatgaaggtacagtgattcagggctttgtgggaaacgaggtagcttgtcagagaaggagggaagcagggargcaatatatctaaatgtgctgccaagttcaagttctgagtggatattctaaatgtgcaacgactgagaatggggtgtggacagtaaggaaaatccatgcagatgtctctcctgcacagctggaaaccaatgttagagacacccaccaccccctagccccttaaagcagatcaagggagaatttctggcaaataagaaaaaggaaacagaagcagaagcaggatacagggcagctctgaggcaaggtaggcaggtgcacaaaaactctcagggccctgctccagggagaacccccagaatt

SEQ ID NO: 138478 - DNA, 601 bp, Human
ccagcaaagtcagcatgtcttcctgggaccaacggtctggtaaagagtaacagaggccatcatgcctggctcatgctatccccccgatctgttccccagttcttgagtgctcaactcttcctccctagggcatcccagcccctggttgcttcccatctgaacgcacagacaagatatgactcagccctaaggaaactgtggccatattggatcagggcagggactccagtccagaccatgctatacctagaaagccaggctcgaactcaagtctggcttgcttcaaggctattatcatttmtactgtgccaagctgcaacgggcagctatttgctgtaaggggaagaggggtggaaatgaaggtacagtgattcagggctttgtgggaaacgaggtagcttgtcagagaaggagggaagcagggaggcaatatatctaaatgtgctgccaagttcaagttctgagtggatattctaaatgtgcaacgactgagaatggggtgtggacagtaaggaaaatccatgcagatgtctctcctgcacagctggaaaccaatgttagagacacccaccaccccctagccccttaaagcagatcaagg

SEQ ID NO: 138479 - DNA, 601 bp, Human
ccatttgagcttgcacatgtctccagaaaagtctttaaatgctactttttcccagtccatgtgtgattcggtggttttgaacttggagctgtcattggatggaaggttgttcttcatgcattccagcaaagtcagcatgtcttcctgggaccaacggtctggtaaagagtaacagaggccatcatgcctggctcatgctatccccccgatctgttccccagttcttgagtgctcaactcttcctccctagggcatcccagcccctggttgcttcccatctgaacgcacagacaagatatgrctcagccctaaggaaactgtggccatattggatcagggcagggactccagtccagaccatgctatacctagaaagccaggctcgaactcaagtctggcttgcttcaaggctattatcatttctactgtgccaagctgcaacgggcagctatttgctgtaaggggaagaggggtggaaatgaaggtacagtgattcagggctttgtgggaaacgaggtagcttgtcagagaaggagggaagcagggaggcaatatatctaaatgtgctgccaagttcaagttctgagtggatattctaaat

SEQ ID NO: 138480 - DNA, 601 bp, Human
tcattagaaatctccacccatttgagcttgcacatgtctccagaaaagtctttaaatgctactttttcccagtccatgtgtgattcggtggttttgaacttggagctgtcattggatggaaggttgttcttcatgcattccagcaaagtcagcatgtcttcctgggaccaacggtctggtaaagagtaacagaggccatcatgcctggctcatgctatccccccgatctgttccccagttcttgagtgctcaactcttcctccctagggcatcccagcccctggttgcttcccatctgaasgcacagacaagatatgactcagccctaaggaaactgtggccatattggatcagggcagggactccagtccagaccatgctatacctagaaagccaggctcgaactcaagtctggcttgcttcaaggctattatcatttctactgtgccaagctgcaacgggcagctatttgctgtaaggggaagaggggtggaaatgaaggtacagtgattcagggctttgtgggaaacgaggtagcttgtcagagaaggagggaagcagggaggcaatatatctaaatgtgctgccaagttcaagttct

SEQ ID NO: 138481 - DNA, 601 bp, Human
gtactccttccgctgctccagggccttatgaatccatttcagcctctttttgtccgagagctgagaccactgcttccccagggagtccttcacctccttcgtagtggcctgcaaaccaaaagccgtcagacacgcacaggcagccaggggcagggggaggggggaagggggaagggggcacagaggcccccgccccctcaggccatgggaggtcacatcagtgtcccccacaggccaggaggggaaggcggagaggcggggatcccgcctgggtgcaaggggactggctcatacacgcacrcacacacgcacacgcttgcacgccagctggcccgggccctgtccatgcagcccacccctggggaggggcctcctctcctgctcccctgcaccgtgcccggccgacctggcgcggctcccccctggccaccgccgtgcatcctccacccccaacccttggccggacactcacatctggccgcactttgagatacaccttcttctcgtgggtgtaccacagctgctggggggttttgggcttctctgggatgtccgatttcttggcattctggattaggtcggggtgatcctccctagccag

SEQ ID NO: 138482 - DNA, 601 bp, Human
ggtttccttatttttaaaagggtgatagtggctgcggacggtggctcaagcctgtagtcccagtgctttgggaggccgaggtgggcggatcacatgaggtcaggagttcgagaccagcctgcccatctctactaaaaatacaaaaattagccaggtgtggtggtacatgtctgtagccccagctactctggaggctgtggaaggagaatcgcttgaacctgggaggtggaggttgcagtgagccgagactacaccactgtactccagcctgggcaggagagcaagactgtctcaaaaaataaaaaaaaaaaataaaaataaaagggtgatagtgaccgttatcctgaaggattgcgagggcatggaatgaaatcatgaatgagaccagccagcacaagtgggtggatgggccaggctaggatggtgctggcttagtctgatgcctctctgttccttccaagggtcccttgccctctcaccttaacccagaggtccaggtgcaccttgtactgcttttgctgctcctcggccagctttttgtagtgctccttctggctctgggagatgcgctgccagcgactgccgatctccaccatgcgct

SEQ ID NO: 138483 - DNA, 601 bp, Human
atctgggaggggctccttaccgacttggactgcagagtagtccggctggatttggggtttgggcctcgcagcttggtcatgctcttacgtttctgcaggatggggacacaaaggtggcagccatgagttcgacacccctgaattcccccacccctaccccactgctgctctgctcccagactcacattggagatgtactctttatatgctgcacggtcctggggagacaggctctgggggagacagaagcggcaagggttggaacatagccaactactgctgactgagcatgctggcccaktgctaggcagtgggctgagcatttatatatcatcaccccatcttacccctcccaggctccctagattttgggtctctgcagagagcccctgggatctgagaacacagctctaattttttttttttttttttgaaacagggtcttgctctgtcacccaggctggagtgcagtggcacaatctcagctcactgcagccttgaccttcccaggctcaagtgatccttccaactcagcctccagagtagctgggactacaggcatgtgccaccacaccatgctaccttataattttttgtagag

SEQ ID NO: 138484 - DNA, 601 bp, Human
tcaggcccataccccgcacctccccaccccacccccgcccagctctgcactgcctggttctgggcagctggtgtgtgggaggccaagccgggaaggaaaggggggaagggggtatctgtgtactgggagcccacctggccacctgcgcatgcccacactccatgtgcacagtgccaactcacatgccctggtacaggtgacccccatccccaaaagggactgaaggttgctccagcaatcacagaagacagctcaggtggggcacacactggcttctaacacctagttgacccaggcctcrcacacacagaccctgaagggtggtctatggggaaggggctcctggaccgcccccggcttgtgcctcatcttcctattttttcagtccctctcaccccttgctcccgaagcttcctttctctggctgtcacctctcctgtcacccactttgtcaatcagtctcccacctgtcacccttcctccccatctgccaccctctcactccacatgacacggtacctctatggtcactgtagtcttgcctgtctccccactcgctctgccccccaccacatccatgcccttcctgacctttcttctc

SEQ ID NO: 138485 - DNA, 601 bp, Human
gacgggaagacccccgtggtcatcgattacacgccctacctaaagttcacgcagaggtgagcggctccatgactgcggcggggcgggggacggggcctcgggacatcctggggacgtcctggtcccaccgccctcagcggccagcgcagacgcgcggggggaggggcgggaccggccgtgcccactgctccctctcccaagctacgactacctgacggacgaggaggagcggcacagcgccgagagcagcacgagcgaggacaactcgcccgagcacccgtacctcccgctcgtcaccgaygaggacagctggtacagcaagtggcacaagatggagcagaagttccgcatcgtctacgcgcagaaggtgcgcgacgccggcgggcccggggggcgggcgggccgggcgggggatccgggcatcccggggcggggcggggatgggggccgcggccgggacgtcctcccagccgcccgggctgagccggcgccccgcagggctacctggaggagctggtgcgtctgcgcgagtcgcagctgaaggacctggaggcggagaaccggcggcttcagctgcagctggaggaggcggcggcgcaga

SEQ ID NO: 138486 - DNA, 601 bp, Human
cagcataagatccagtgacttccaacagccagagcccacccttcaccttcagttatcttccgctagagtggccatccaaccttactgcagggaccccacgtcactcacaaggacctgcggtgttgctctgcaaccttcaacacgattgcattcatcgcctcactcacctgcaccacaggctcactgaccgtcatcatccgccgtgacccccgacctcacccctgccgatccctgtaacacttcttctctacgcctttccaccaccctgatcttgcggcaagatccccaagacgatcttacmcttcagggattcccacactatcctccactgacgtccccatcaccccagctgaccccaacaacactgcaccattccctccaactcccaatatttgtgcacgaatccctgtcacccctccaccccagtaccacctccacttcctcccgggatctggcccactgaccccaacaccgtatccccatttttgccgctcagatttcattcctgacccctccctcatccccttgctgaatctcccttcctcacttctcctacttccagccaggcctgactcctcctccccctcccaggacaggtctg

SEQ ID NO: 138487 - DNA, 601 bp, Human
agcccacccttcaccttcagttatcttccgctagagtggccatccaaccttactgcagggaccccacgtcactcacaaggacctgcggtgttgctctgcaaccttcaacacgattgcattcatcgcctcactcacctgcaccacaggctcactgaccgtcatcatccgccgtgacccccgacctcacccctgccgatccctgtaacacttcttctctacgcctttccaccaccctgatcttgcggcaagatccccaagacgatcttacacttcagggattcccacactatcctccactgaygtccccatcaccccagctgaccccaacaacactgcaccattccctccaactcccaatatttgtgcacgaatccctgtcacccctccaccccagtaccacctccacttcctcccgggatctggcccactgaccccaacaccgtatccccatttttgccgctcagatttcattcctgacccctccctcatccccttgctgaatctcccttcctcacttctcctacttccagccaggcctgactcctcctccccctcccaggacaggtctgatccccagtgaccacgcccctctggcccaggg

SEQ ID NO: 138488 - DNA, 601 bp, Human
cacccctgtcggtaggtgctggcttcttcccctctcctggtggtggtgggtggttcccgcggcggcctggagccggaggggcgcgcgaccctgggctgggagctccgagggcctgggaacgagacctgagaccttggcttctcgaaggtagtagggacttgggagtggtgactgaacctggtctggctcctccttacttcctcttgttgcgggtgggacgagctagcttccgcctctcccagccactttttcctgctcatttgcagctaggttggctccccttttgggaatttcctctccycttggcactcggagttggggggtgccacctagtggaagataacggagctagggtcttgaagaggctgctgtcccctctggctgttttggcggtgtagggtggcatgagagactgcgactcgcctcctcatccctgtttctgtatgcgagtgcttgtattcagtagaagcatacactatactccctcaatttagggtaaacaggaggggccacatgcacaggtaattcaccagggagccgaacactcctgtgcagacagactccccttcccagcaagccatggcagcggacagcctgctga

SEQ ID NO: 138489 - DNA, 601 bp, Human
tcactgcaacctccacctcctgggctcaagcgattctcctgcctcagcctcttgagtagctgggattgcaggtgtgcgctaccacgcatggctaatttttgtatttttaatagagatggggttttaccacgttggtcaggctggtcttgaactcctgaccttgggatccgcccacctgggcctcccaaagtgctgggattacaggcgttagccaccgcgcccaatatattttgatccctggttggatatggagggctgactgtacttaacatctctaagcttcagtttcctcctttaaaagaaaggtgtggctgggtgtggtggttcaagcctgtaatcccagcacttagggaggctgaggtgggtggatcagctgaggtcaggagttcaagaccagcctgaccaatatggtgaaaccccctctctgctaaaaatacaaaaattagccaggcgtggtggcgagcgcctgtagtcccagctacttgcttgaacttgggaggcagaggttgcagtgagctgagatcgtgccactgaactcgagcatgggcaacagagcaagactgtctcaaaaaaaaaaaaaaaaagggggtgagcagacgtg

SEQ ID NO: 138490 - DNA, 601 bp, Human
agccagctacagctgctgccgtccccttctggtgagtgcccctcagcctaggcaagagctggcagcctgggttttcccaaagggtcatcttggattggccagaggaggacgccaggcacaagtctgtggtttatcattttccctgtctttctaggacaaatggcccacaacactgagcaggcatctgggtggcccctgccaggttgatgcccactgctctgccggccactcctgcatctttaccgtctcagggacttccagttgctgccccttcccagaggtgagcgtgccatcagcccartggaggggcttaggtctgcatttatgcttttcctgcactctaccacctgcagataaaagggccctgccaatgcaggtttctctgtgttccacaggccgtggcatgcggggatggccatcactgctgcccacggggcttccactgcagtgcagacgggcgatcctgcttccaaagatcaggtgcagctggggtgtgggtgcagggcaggcagacgggcagcatgtggagtctggaacccaggagcccagctggcgggggcagccctgattcctgcccttgtgccctcattcatgtggcatc

SEQ ID NO: 138491 - DNA, 601 bp, Human
gagggtgagttaggcctgcctaggagatcactgagccttagtgtcaccctcaaaccccagtagctgggcttgcaggccctggtgccaccagctccttgtgtgatgggggagtcagtcaccttccctgagtgggctggtagtatcctgggtcatcttgtccacaggtaacaactccgtgggtgccatccagtgccctgatagtcagttcgaatgcccggacttctccacgtgctgtgttatggtcgatggctcctgggggtgctgccccatgccccaggtacaaatctgggggagatggggrtatgtggagggaagtgggggcagagttgggggccaggggcagggggtgaagacggagtcaggaccattttttctcaggcttcctgctgtgaagacagggtgcactgctgtccgcacggtgccttctgcgacctggttcacacccgctgcatcacacccacgggcacccaccccctggcaaagaagctccctgcccagaggactaacagggcaggtgaggaggtgggagagcatcaggccaggggctggggcggggcctcattgactccaagtgtaggaaaaagtttcctccatcctggct

SEQ ID NO: 138492 - DNA, 601 bp, Human; identical to SEQ ID NO: 35513

SEQ ID NO: 138493 - DNA, 601 bp, Human; identical to SEQ ID NO: 35514

SEQ ID NO: 138494 - DNA, 601 bp, Human; identical to SEQ ID NO: 35515

SEQ ID NO: 138495 - DNA, 601 bp, Human; identical to SEQ ID NO: 35516

SEQ ID NO: 138496 - DNA, 601 bp, Human; identical to SEQ ID NO: 35517

SEQ ID NO: 138497 - DNA, 601 bp, Human; identical to SEQ ID NO: 35518

SEQ ID NO: 138498 - DNA, 601 bp, Human; identical to SEQ ID NO: 35519

SEQ ID NO: 138499 - DNA, 601 bp, Human; identical to SEQ ID NO: 35520

SEQ ID NO: 138500 - DNA, 601 bp, Human; identical to SEQ ID NO: 35521

SEQ ID NO: 138501 - DNA, 601 bp, Human; identical to SEQ ID NO: 35522

SEQ ID NO: 138502 - DNA, 601 bp, Human; identical to SEQ ID NO: 35523

SEQ ID NO: 138503 - DNA, 601 bp, Human; identical to SEQ ID NO: 35524

SEQ ID NO: 138504 - DNA, 601 bp, Human
tatttctagatataagatcattatttttaaaacattacttaaaatgcatattatctcaataatgacactaaaaattgtgaaaagtcagctcataaatgtatggtagaagtcactacaacaacagattttcagatcacagtattagattgactcctaaataaccctggtttaactgtgtatagtctatgaaaaacacaaagaaaactaaacaccaagttaaaataagcaaaaaatgtcaagaaagtttattatctggagtttcttttgtgcttttttgaagaggaatttgaataatcacttacgtaaattttaataaataacaattccataaaagctgtcatgttgttagctactcatcaaatcaaaatgcttccatgactttctcattcagagatgatactattcacttgctgttctcagaagtagcaagttattttcaagttaacagaatctgttaaatttaactcttcattcgtcataactaagatgcattgaaaaatgaagatagcttgttttacttacgtttgctcctgtccccaggttttccccaggaagattaaaaaacaaagtattcccaaaaggcccatggttggaggtagca

SEQ ID NO: 138505 - DNA, 601 bp, Human
ggccacacagcaggaggtgagcagtggggcaaaggagcattaccacctgagctctgcctcctgtcagatcagtggtggcattagattctcctaggagcatgaactctattgtgaaccgcacatgcgagggatctagattgcaagctccttatgagaatataatgcctgatgatctgaagtggaacagtttcattctgaaaccatccccaccccaatcctggtccatggaaacattgtcttccacaaaacctgtccctagtgccaaaatggttggggactgctggtctatgtgatggtagcygtcaagcaaaaatacatagtgtttagaagcccctaaaagaatattctggaaccaccctttataaagattttggttcttattgacttatcagtagcataatctatccatataaataatttcatagttttctttgtctttcaattgctgcagaggatcaggttactgagcttgcagagaggcaagaatgttattttggcctctatctggaatgctctttcctcaaatatttgcatggtttgcttcctcacttccttcaggctctgtttgagtgcagcctccttaagagaacctttcctggcc

SEQ ID NO: 138506 - DNA, 601 bp, Human
ttcccaaggccacacatataggatttatgaattctataattcacaaattatagaattagaaatcgaacctgagcagcccgtttccagaattaacattttcaactgttgtactaaatggaatttataaagagttttgtaattagaaaaatttagggatataaagctactttaatttcagtatttatagaagctttatgtttttaagtttagtattgctttaattttgaattgtgtatggtaggggtccccaacccctgggccatggacaaataccagtccatggcttgttaggaaccaggcyacacagcaggaggtgagcagtggggcaaaggagcattaccacctgagctctgcctcctgtcagatcagtggtggcattagattctcctaggagcatgaactctattgtgaaccgcacatgcgagggatctagattgcaagctccttatgagaatataatgcctgatgatctgaagtggaacagtttcattctgaaaccatccccaccccaatcctggtccatggaaacattgtcttccacaaaacctgtccctagtgccaaaatggttggggactgctggtctatgtgatggtagccgtc

SEQ ID NO: 138507 - DNA, 601 bp, Human
caaccatagactgttctcttatttttacttttcatgtgatttatacaataatggaagtgagtctatacatgcttttgagtgatttttaaaaattattttatttaaaaacttacaaatataaactggattactaagtgtatatcacaaaagtatctaatttgaatagcgagaactacatacgctattacataggaaaaaaaagtgttttaacccaaaagggcatagtgatcgactaattcaagtggcccaacaagcttggagggcacccaccaccccacctggcagaattattccaggcttytgccaacattgtgacattttaagagtctggtaaaagcaggaagtttttagtaacaatggaattaatttatcagcaattaaatcctttaaagcatctgacagttatcctgcattacaattaatttggatccacttacaggcaaattacaaaagagaggaaagaatttccagatttccaaccatcatctgaattccccttccccacatgcctagtaggagatggcagaaaatgagaggagttcagtttttatgataataagatatatttactgaaattttgccctgtgataaggcactattc

SEQ ID NO: 138508 - DNA, 601 bp, Human
aattctgcactatggaacatgtagtattttcaagaatgtacacaatttttaaattatccaagttatttaaaacctccaaattcaatttaaatttttagaaaaatttcagtcagcgaattaactgagggcagaggaaaaatgaccataaaaagatgttgttctaaaattctagtgcagccatgtatagatgcacttgtcttattcattctgctctattataaatttctttctttcttttcttccctccttccttcctccctcccctccctctttctttccttccttccttccttccttcttctttctatcttagttggagttttgctcctgttgcccaacatggagtgcagtggcatgatcttggctcactttaaccctcacctcccagattcaagcgattctcctgcctcagcctcccgagtagctgggattacaggtgcctgccaccacgcctggctttttttgtatttttgatagagacggggtttcaccatgttggccaggctggtctcaaattcctgacctcaggtgatccaccgacattggcctcccaaagcgttgggattacaggcatgagccaccgcacctggcctattacaaa

SEQ ID NO: 138509 - DNA, 601 bp, Human
aggtttaattctgcactatggaacatgtagtattttcaagaatgtacacaatttttaaattatccaagttatttaaaacctccaaattcaatttaaatttttagaaaaatttcagtcagcgaattaactgagggcagaggaaaaatgaccataaaaagatgttgttctaaaattctagtgcagccatgtatagatgcacttgtcttattcattctgctctattataaatttctttctttcttttcttccctccttccttcctccctcccctccctctttctttccttccttccttccttccttcttctttctatcttagttggagttttgctcctgttgcccaacatggagtgcagtggcatgatcttggctcactttaaccctcacctcccagattcaagcgattctcctgcctcagcctcccgagtagctgggattacaggtgcctgccaccacgcctggctttttttgtatttttgatagagacggggtttcaccatgttggccaggctggtctcaaattcctgacctcaggtgatccaccgacattggcctcccaaagcgttgggattacaggcatgagccaccgcacctggcctat

SEQ ID NO: 138510 - DNA, 601 bp, Human
gggaataaaaatgccagcaagcaagtaaagaaatgattatgacattgagataagtgtcatgaagaaaataaacaagatgctgagatagggagtaaaacaaagcaagagattacattacatcatgcatccaggaatagcctttttgtagcagcttctactctgggtcataacaatgaaaagaagccaggcttatgaagagccaggtgaagcccattccaagtagaggggatgacatgtgcaaaggcacggaggtaggaaagcactggacatgccagaccatggctagcacataatttgccayggggcaagtggcacaagatgaagttggagaaatgatagcagtaataaaataataggtttaattctgcactatggaacatgtagtattttcaagaatgtacacaatttttaaattatccaagttatttaaaacctccaaattcaatttaaatttttagaaaaatttcagtcagcgaattaactgagggcagaggaaaaatgaccataaaaagatgttgttctaaaattctagtgcagccatgtatagatgcacttgtcttattcattctgctctattataaatttctttctttcttttctt

SEQ ID NO: 138511 - DNA, 601 bp, Human
aagccatcctcccacctcagcctcccaagtagctggaactatttaggcatgctccaccacacctggtttacttatgtttaatttagtaaagagaagtgtattctcagcttatagaaagatttaattctatttagttaaatcattcttgaatagattctcccataaatcaagcaaactcaaaacataaatatcattctattaagtcagtcaaggagtaggtgtgataaggtcttctgctatctaacttctgtatttctttgattggtttaggactggataaaggagaaaatgaggcaatcgyttctgggaataagtcccttgaatatgagaaacaaaaatagatacaccttttttcctttaacatctacctctcactgccatatatatatatatatacacacacaattccacacagatatagtttgttattttacttttatataaacatattttaagcttatgttctatataatattgctatatttacatattttagtatatatattatatattactgtatatgcattatatgatactttgttatatattattttctatatatagtatatatatgtaagaacctacaagcatgtccaaacct

SEQ ID NO: 138512 - DNA, 601 bp, Human
ggacttctcctcgcatgggatgattacagagagatgcctaagcatttaggaaatgggggtaggagaagggaagtagtggggaggtagcactaactcttggggacaggagctatgaacgaacatctcagagactatctggcccagtttcattgtgaagtagaggcacagatgggtgcttataaatatgaggtggagaagaaatgatatcatggcagcaatatctaccctcagacagcagaagtgttattagctcatgctctggagtcaggtacacactggttcacataccagtaccaccacktattaactctggataaaattagttaatcaaaagagaggttagaagcctccatttcctgagccacacaatggcaaagataatattctaactcatcttgctaattaaatggtgtttcatgtattcttcataaagctctcagcatgatgcctagcatttagtaagtgctcaatagatgacagtgagcatatgcatgctgcagtcattggcctatgttattatgttactaagttactttgtaactatgttactatgttattgctcatattttatttgagattgggaacttaaataatatttgct

SEQ ID NO: 138513 - DNA, 601 bp, Human
gtccttagagaccagaactgcatacatggatttggtatctagtccataaacagtttccctttatcagtcaatatttatctatggtcctcattactgttttttcaatttcttcctcaaaaatgttgaaaagccaacagcatgtacttggcctggctgtcgaaataattcattccatttatttggtgattgtcaggaagctcttaatattttctgtaagtttttttcttggtttcaccaacaggcttcatcgatccacctctgtttaatataaatgatgcaatagggatgttgctcagctacrgaattggaacaggcaagataggattcaattctcaggagaggattttgcttccccattttttgacaataaaattcacttatccgaactgggtctaggcatataatctttggccatgaaagagaacagaggcaacatgatttaatcaggttctcgctttggaataactaggctctctttggtaaaaagtgttattagaacaggagtcagagtcctcagctcaaatcaaaattttcctcttcccagctgagtaaccatcataagtcttttaacttctctgtccctcagtttcctcatctgtga

SEQ ID NO: 138514 - DNA, 601 bp, Human
ttaactcctttcattctcacaatacatcaataagaggaatattattctcctcatttaagaaactgaggctcagaaactaaaagtcatactgattttaattcaaaatcacacaactagtaaattagagagctaaaatttgaacccaaaaactgttcaaagtcatcacactgtcactaaaaccccttttgtttcaccgattaaaaaaaaatagatgaataagtggagtgcatcttatttggggatttaaagccagggtttagattctaaattgaaggtttaagattaaaaaaaaaaaatcacrtgaagccaaaatgccctcagaggtcccttaaattgtccttagagaccagaactgcatacatggatttggtatctagtccataaacagtttccctttatcagtcaatatttatctatggtcctcattactgttttttcaatttcttcctcaaaaatgttgaaaagccaacagcatgtacttggcctggctgtcgaaataattcattccatttatttggtgattgtcaggaagctcttaatattttctgtaagtttttttcttggtttcaccaacaggcttcatcgatccacctctgtttaa

SEQ ID NO: 138515 - DNA, 601 bp, Human
aaggaaggaaggaaggaaggaaggaaggaaggaaggaaggaaggaaggaagaaagagtgagttaacgtttatgggcctactatgtgccaggaactttaacatgtatttaactcctttcattctcacaatacatcaataagaggaatattattctcctcatttaagaaactgaggctcagaaactaaaagtcatactgattttaattcaaaatcacacaactagtaaattagagagctaaaatttgaacccaaaaactgttcaaagtcatcacactgtcactaaaaccccttttgtttcacygattaaaaaaaaatagatgaataagtggagtgcatcttatttggggatttaaagccagggtttagattctaaattgaaggtttaagattaaaaaaaaaaaatcacgtgaagccaaaatgccctcagaggtcccttaaattgtccttagagaccagaactgcatacatggatttggtatctagtccataaacagtttccctttatcagtcaatatttatctatggtcctcattactgttttttcaatttcttcctcaaaaatgttgaaaagccaacagcatgtacttggcctggctgtcga

SEQ ID NO: 138516 - DNA, 601 bp, Human
tccaggctaatgaaggggaaaccaattccaataaataaaggcccaaaggtgcaaaatagcataatgccactcaagaactccacttggttctgtagagcttaaacataacgtaaggcacagcagggtaagagctagttggagagagccagggcgaagatcatggaaggttttgagtactacactaaagaatttgtactttatcttgaaggccagtgaaacattttatacaggtgagttatgtagtcttggcattctaagatcagggtacagaatatttgggaagaaggataaaaatgagatytggggggcaaatgatcaatgggattttcagtaataaacatgctgagcattttaccattttcttgggagtcatctgcatttgcattagtgaggaaggtaagtccagctaggtggaacacattggcattgttgaggccaccacctgccccacagcccagatcactcttctctaagaattgaaatacctgtccagaaaggcaaaatgttgagcacattgagatgtataaatcattcctctaaagatctaaaaggtactaattgttacatggttatcacaaaccagtgaaatacacagatgata

SEQ ID NO: 138517 - DNA, 601 bp, Human
acatgtggtccatcattgatgaaaatgtcattacgcagcacacataagtataaaacagaagctgtcattttgcttttgcttgttttgttaaagactatacataggctgggcacagtggctcacgcctgtaatctcagcactttgggaggccgaggtggacggatcacctgaggtcaggagttcaagaccagcctggccaatatggtgaaaccctgtccctactaaaaatacaaaaattaaccaggtgtggtggcaggcgcctttaatcccagttactcaggaggctgaggcaggagaatcrcttgaacccagaggcagaggttgcagtaagccaagattgcaccactgcactccagcctgggtgacagagccagattcctactgaaaaaaaaaaaaaaaaagactatatataaagtcctaaaagttctgaaaacatgttaatgagagttctataaattctggaaacatgtattgtggttgaaactgaaataagacatcagcttttatataagtacacttaaccttaggctagatttagaaatattctcctttatttcatcaatgtagatatagacagaatttttaatggttgtaatatcac

SEQ ID NO: 138518 - DNA, 601 bp, Human
atttggaagcaacctaaatgtccatcaacagataaatggataaagaaaatgtggtgcatatacacaatggagtactactcagccatgaaaagaatgagatcctgtcatttgcaacaatatggatggaactggaggtcattatgttaagtgaaataagtcaggcacagaaagacaaaattcacatgttctcacttatttgtgggtgctaaaaatcaaaacaatttaacttatggagatatagagtagaaggctgggaagggtagtaggaggatgagggggatgtggggatggtttatgggtmcaaaaaatagaaagaatgaataagacttagtacttgacagcacaacagggtgactacagtcaataataatttaattgtacatttaaaaataactaaaagagtataattggattgtttataaaacaaaggagaaatacctcaggggatagataccccattttccatgatatgattattacttattgcattcctgtatcaaagtatctcgtgtaccccgtaaatactatttacccacataaatttaaaaattaaaaaaaattaagagaaaaaaaagccaaatcctccctccaaaaagaaaaa

SEQ ID NO: 138519 - DNA, 601 bp, Human
tcttcaattaatggtgctgggaaaactggttatcccattcatgcagaagaatgaaacgtgacccttatctcttgccatatacaaaactcaaataaaaattgattaaagatttaactctaagacctctaactataaaactgctataggaaaacactgggaaaactctctaggacattggtctgggcaaaagtttcttgagtaataccccactacacagacaaccaaagccaaaatggacaaatgggatcacatcaagttaaagagcttctgtacagcaaaggaatcaataaagtaagcagamaacctacagaatgggagaaaatacttgcagctacccatctgacaagagattaataacaagaatatataaggagttcaaacaactctacaggaaaaaatgtaataatcccacttaaaaatgggcaaaagatttgaatagacatttctctaaagaagacatacaaatggcaaaaaagcatgtgaaaaggtgctcaacatcagtaatcaccagagaaatgcaatcaaagctacaatgaaatatcatctcatctcagttaaaatggcttttattcaaaagacaggcaataacaaatgctggagg

SEQ ID NO: 138520 - DNA, 601 bp, Human
tatatcacttaaacctgcttaccagtgtttgaaatgccaatgccttgaatttcccaggtggttagagaatcaggtagggcaaactgcaactgttttctggaagttaaaatgttgatattcaaatacagtggaatattgattaacccaacttaacagagacatccattaacagaatttttgcttcaaactactttagagaaagaaaaaaattcacgagatgaaatcacatcattaaggaaaacctcatcaagaaaaatatattcagtaactctcttatatattgcatgtttttagacattgyacctctatgatgagaattcaagttcagaagaatgcctttgaaacattgcaaaatccaagcacacaaacaaagaaaaagatgtttgttgtgagtatattctaaaatagggaagcaaagtgatgcatgttagcactgctcaaaacaaagttgacataactaaaaactgctgattatgattaagcttgtatatttatttacagctattgtctaccaactttgtatcaggtatagtgctgagtactgagtaaacagcactgataagatacagtcctgctctcaggcagtttacaatctagtgga

SEQ ID NO: 138521 - DNA, 601 bp, Human
atcctacagttgagcagagtttggctgtggcctctgtgccttacccatctgttatggccacctatttatgtgtctatctcaaattacaatttacatggtttaagagtgacacctccttaatcatctaccaaaatcctttggtagccaagatcagtgtgagttataaaattatgctgagtctgttttgatgagatggtctgactgtcttagtatctcagtttccaagcctcaagcccatcttgaatcaggattttgagacatgaaaaccactacaggaacctgatggagaaatggcctttgrtatctctatctgagttatgattatcttaaattcatgaagcattctgtctgcagaaaagctagtgggtttaaaagaaataatgtaaaggcaactttacagcttcttaatcaaggtccttctccaactcttcacgttgtatttagggtggtggggatggagccaaatgagggagggcaattccacagggctgaagatggtggcatgattcataggatttatgcaaaccctgtgagtaaattctaaggaagagaaatgagtaacattttgattttatttctgtaaaaataagataatactggc

SEQ ID NO: 138522 - DNA, 601 bp, Human
ttaatcaaaatgatgcatgtagttatctagtccattcatttcaatttctgtataagtgttcattgtatgaataaaagaaaaaatgtttattcccccaaattataagaatgtgagggatcaaggctacctgcatacacttggtaagaatgtcaattgatggaatccttttggaagataattatggcaatatttattatcagaaggtaaaatgtccatgccctttagcccagttagttcactccaagacaaaacatctatcctacagaaatatacatgtaggaagatatgtatgcataaatgsagactttgcaaaatcagttataatagtgaaaacctgtaaacaacccaaatgtctttaatagaaacatggttcaataaattatagtatacccaccatgtgaattactgtgcagccattaaagtaatgaagtaaatctgtatatactgatatgaaaggatgtctctgataatattattggtggaaacacaaattgctgaggcagtgtgtgtatatatatatatatgtatgtatatatgtatagatatgtacatatatgtagatatgtagatatgtacatatacgtatatatgtatatatacg

SEQ ID NO: 138523 - DNA, 601 bp, Human
tttaaatcagtgtgatactgatgtaaacaaaacagaggagagaatctataaatagatccacatatatggaaattcaatatatatgggggcaagatgacattttaaatcagttggaaaagcatgaattccttaacaaatactgctggatcatctggctatttgggattagatccttatttcagataaaaaaatctaaatgctcacaaaaaactataaaagtactatagaaaatatagaaaaaacagttctttagaaaaacattttattttaggttcggggcacatgtgcaggtctgttgtayaggtaaatggcgtgtcgcagaggtttggtgtgcagattctttcatcattcaggtaataagcatagtacctaataggtcattttttgatctttacccttctctcaccctccaccctcaagcaggccctggtgtctgctgttcccttctttgtgtccatatatactcaatgtttagctcccacttataagtgagaacatgcagtattttgtagaaaaacgtttttaaaacttgcagtgagaaaagatttccaaaaacacaaaactcaaatgacataaaggaaaagatctacagattttataa

SEQ ID NO: 138524 - DNA, 601 bp, Human
ttattgcaaaggacatacaaaagagatggcaggctagatttggcccatggtccataaattgctgacccttgatttagttcataaagcaaaaggataaagagatgtaaaagattcaatatggcaagtcaatttcccttatattaattcataaattcaggacaatatgaaaaccctattataattttaaaaggagaattcaacaaactaattccaaagtttatctggcagagtaaatgtgtaagaataacaacatcaaaaacgtttgaaaaataagaataccagagagtacttgcctaatagwtatacaatataaccacaaatctatggtactttaaatcagtgtgatactgatgtaaacaaaacagaggagagaatctataaatagatccacatatatggaaattcaatatatatgggggcaagatgacattttaaatcagttggaaaagcatgaattccttaacaaatactgctggatcatctggctatttgggattagatccttatttcagataaaaaaatctaaatgctcacaaaaaactataaaagtactatagaaaatatagaaaaaacagttctttagaaaaacattttattttag

SEQ ID NO: 138525 - DNA, 601 bp, Human
agtgtaacccacactcaggaggaaaggtaattaacaggaactaagcccaaaatatcacagatgtacttgtttcttattttgatatgatggaaatgcactgaaaatttaaagattaaataaaatatggcagtatagtgatatgcatgacactttaaaatgctgtcaagttggctgggcatggtggtgtgtgcctgtaatcccagctacttgggaggctgaggcaggagaatcgcttgaacctggcaggcggagcttgcagtgacccgagatcttcccattgcactccagcctgggcgacagrgcgagactctgtctcaaaaaaaaaaaaaatgctgtcaagttatatataattgtgttattgcaaaggacatacaaaagagatggcaggctagatttggcccatggtccataaattgctgacccttgatttagttcataaagcaaaaggataaagagatgtaaaagattcaatatggcaagtcaatttcccttatattaattcataaattcaggacaatatgaaaaccctattataattttaaaaggagaattcaacaaactaattccaaagtttatctggcagagtaaatgtgtaagaata

SEQ ID NO: 138526 - DNA, 601 bp, Human
tctctaaaaaagttgaccttgattatgcttgtctggacacaaactctccactttaacaatgttaaaataatcccttagattctaaggcacagaagaaagttcatttcagatttcctaacatagacacacaagttgccgtagagtttagcaatgcaaacagatgtctagaaaagtcaacactgtctcagaaacatcttacctttcttagactgttacgtactaaattgggtacagagctcatgctgttgtgatagcacttattaccctgtctctttacatgtttgtgtttcagatagtgggcgccttaggctcaggtactttttcattttcatcttattcatttttgtatcttttagctcagcctctggtattcagtaaatgatgggtttcatcaaagactgaaaattccctatatcggcattcaaggccctgcccattatgtccccagcttacttttctaattttatcaacttcccatttgtaccccattttacaaccaaactctggctccagaaagacctggattcaatttttggcattcctcttattaactggtgatggaaactggttgcatgaactctctaatcctccattttctcat

SEQ ID NO: 138527 - DNA, 601 bp, Human
ttccctccacagcagacattttaacacagaactgaaatacaagtgaagaattatatcaaaatacatttttttttttgagacagactcttgctatgtcgcccaggctggagtgcagcggcatgatctcagctcactgcaacctccgcctcctggattcaagcaattctcctgcctcagcctcctgagtagctgggattacaggcatgcgccaccacacccagctaatttttgtatttttagtagaggcacggtttctccatgttggccaggctgatctcgaactcctgatctcaggtgatcygcccacctcagcctcccaaagtactggaattacaggcatgatgctgtaatccgtgcccagactcgaaatactttatctctaaaaaagttgaccttgattatgcttgtctggacacaaactctccactttaacaatgttaaaataatcccttagattctaaggcacagaagaaagttcatttcagatttcctaacatagacacacaagttgccgtagagtttagcaatgcaaacagatgtctagaaaagtcaacactgtctcagaaacatcttacctttcttagactgttacgtactaaat

SEQ ID NO: 138528 - DNA, 601 bp, Human
ccagtgaaaaattgatgttgtgaaggccaatttccagaggaagcacagtgaatgtcaccaagtgactggaggagccctctactttctggcgcacacatttggaggactttgtgccctgatgatcaatgactgggctttccgaagtgcagattccctccacagcagacattttaacacagaactgaaatacaagtgaagaattatatcaaaatacatttttttttttgagacagactcttgctatgtcgcccaggctggagtgcagcggcatgatctcagctcactgcaacctccgcctccyggattcaagcaattctcctgcctcagcctcctgagtagctgggattacaggcatgcgccaccacacccagctaatttttgtatttttagtagaggcacggtttctccatgttggccaggctgatctcgaactcctgatctcaggtgatctgcccacctcagcctcccaaagtactggaattacaggcatgatgctgtaatccgtgcccagactcgaaatactttatctctaaaaaagttgaccttgattatgcttgtctggacacaaactctccactttaacaatgttaaaataatccct

SEQ ID NO: 138529 - DNA, 601 bp, Human
tgaagcatgtttttcttaccaccactcgtaatgtttttactaagatttcttttccaaaccaagtctccagtgaaaaattgatgttgtgaaggccaatttccagaggaagcacagtgaatgtcaccaagtgactggaggagccctctactttctggcgcacacatttggaggactttgtgccctgatgatcaatgactgggctttccgaagtgcagattccctccacagcagacattttaacacagaactgaaatacaagtgaagaattatatcaaaatacatttttttttttgagacagastcttgctatgtcgcccaggctggagtgcagcggcatgatctcagctcactgcaacctccgcctcctggattcaagcaattctcctgcctcagcctcctgagtagctgggattacaggcatgcgccaccacacccagctaatttttgtatttttagtagaggcacggtttctccatgttggccaggctgatctcgaactcctgatctcaggtgatctgcccacctcagcctcccaaagtactggaattacaggcatgatgctgtaatccgtgcccagactcgaaatactttatctctaaaa

SEQ ID NO: 138530 - DNA, 601 bp, Human
ataagttattgaagcatgtttttcttaccaccactcgtaatgtttttactaagatttcttttccaaaccaagtctccagtgaaaaattgatgttgtgaaggccaatttccagaggaagcacagtgaatgtcaccaagtgactggaggagccctctactttctggcgcacacatttggaggactttgtgccctgatgatcaatgactgggctttccgaagtgcagattccctccacagcagacattttaacacagaactgaaatacaagtgaagaattatatcaaaatacatttttttttttgagacagactcttgctatgtcgcccaggctggagtgcagcggcatgatctcagctcactgcaacctccgcctcctggattcaagcaattctcctgcctcagcctcctgagtagctgggattacaggcatgcgccaccacacccagctaatttttgtatttttagtagaggcacggtttctccatgttggccaggctgatctcgaactcctgatctcaggtgatctgcccacctcagcctcccaaagtactggaattacaggcatgatgctgtaatccgtgcccagactcgaaatacttta

SEQ ID NO: 138531 - DNA, 601 bp, Human
ccataaatacccctaggatccaaagtaacaccagaatagctttcccttttgacaccttctggctaaaataaaggcagaaaacattcagttaaaaacataagtttatataacctgaattccctggatcaacttttctggaccacttttcaaactaaaaaattatttttcttggaaaaggcaaactatgtataaatacttacatggatataagcagcaataagattttatggctatttgcatattgaccagagcaaatgcttaaaaagaagttatttataagccagataattgttctaagtgytttatatgtattaactcatttaacctctaaaaacctctatgaggttggtgctgttattactcccattcgacagatgaggagactgacacacatggaaatcaagtaacactgtcacactgctaggaggtgatggagccaagattcaaggcccagcagcctcgctccagagactgcatggaaccacagtgcaaggatgcatgggaatgtgctttgcacaaaataagtcagtacatgtttactgaagtgaatttcatagctgaaaacagagagtgaagagccaggaaatccagtctgtcatta

SEQ ID NO: 138532 - DNA, 601 bp, Human
aatgatccacccacctcggcctcccaaagtgctaggattacaggcatgagccactgtgcctggccagaagtggatactactgattttagacaactcactttctgaaaaatagtgttttaagttacatacacactttaacttctaaagcaaaagataacatataaaataaaaaatcattttgcctaccataaatacccctaggatccaaagtaacaccagaatagctttcccttttgacaccttctggctaaaataaaggcagaaaacattcagttaaaaacataagtttatataacctgarttccctggatcaacttttctggaccacttttcaaactaaaaaattatttttcttggaaaaggcaaactatgtataaatacttacatggatataagcagcaataagattttatggctatttgcatattgaccagagcaaatgcttaaaaagaagttatttataagccagataattgttctaagtgctttatatgtattaactcatttaacctctaaaaacctctatgaggttggtgctgttattactcccattcgacagatgaggagactgacacacatggaaatcaagtaacactgtcac

SEQ ID NO: 138533 - DNA, 601 bp, Human
aaataagctgaacagaatttttatcttttccctctttagctctgcagaaatcaggaaagctgcctaaacccaagttgcctaaaatgttaagggaaaaaagtcatatgagaagattggaaagaggcacagatttttgttttaacccagattttctctacagagatttattcccagataaaagattgttcctatcctgtggccttgatgttcacacctaggatgagtaaggcaagactgctctggaaaattgtttgcaataatgtcagcagaagcagcatctgtggtgaaaaaaaaaaaaaaagaaagagaagccaaggacacagtggcttttgaggcttgatataattgcatgaggctaaaacccttgaaacttgtaatatctctacccatagatcattcacaatgagcaggcaaggaggaggtctgtgtgaagaaaaaattggagaaacaagtaagcatgtggacgcatgtacatagatggattttactttttattactctactgaaataacactcctcagttcatgatactcagatgaattaaagtgtaaagggtattaattctttgctttcccagaggaaatgacactgatgatagtga

SEQ ID NO: 138534 - DNA, 601 bp, Human
agagaaagacctcttaaagattacctcaaaaatatataaccataagatgaaattatgatggatttgactacatcagaataaataattccttttcaaacccatgaaggcttgttgttgctcaaagaggtacatcagagacaaaatcaagaagaaattttaaaaggataacccaaatagaaaatttaaaaacgtgcaaaagatatgaataggcaattgacagatgggaaacccaaatggacaagtatatgaagaaatgcttaaaatcattagtaaccagaagaatccaaattaaaacaataawgagatagtgctttatacccattaaaaatgccacattttagagaggcaagtgttggtgaggttgtggagagacgagaaccctcgtgcactgctaatggaagtataaccattctgaagggcaatatgacaggactaaatggcattaaatatgtatatatcctttgacccagctcctggatatatggtccaggtaaatgctaacatggatttttcaagggaaatatattgtatatacagtgatggataaaatggtgagggaacatgctctgaaattctatgtaagaaaaatgaattaagtata

SEQ ID NO: 138535 - DNA, 601 bp, Human
gtctgctaatggtacctgtaatttagaaaatttggatttatacagagtttccaggggaagactgtttgcagattatttataatgtatctacttccaaagaatatttcaaaataaaagacttataattagactattaaaattttaaaagaaagttaaaaatcatcaaggactttaatcaaaccctaggcttgtataatcttattaaataaagcattaaatttggctgtaagcttcctggtcattataagatgtgaaataaataggttatataaatcttattcaccagcaaaatatagcatgycagcttgcccaaagacagaaaattgttcctggaactgaaagctaagaataactaacatgtaatttcttaatcaactatatattgaacattagctccacagggaagtatgatctgaaattctttccaccttcccttcccagtctagttttgatactttttaatctatgggcaaaacaacagagttttagcatactggtatcagataatttttctactgtgatcactggtttatgtccaaaaaaaggtaacattgatcattctactgatagagtaccaagcatgctactaagttctttaaat

SEQ ID NO: 138536 - DNA, 601 bp, Human
cgttggaagaagatagtgggaaaagtgattaaaggtttgaaagtgggggtgggtaggggtggagcactcctaaaggtagatttgtgtgtgctactgaacacggaagtggagaaacagaataatcatgaggatatttgatttttgtttgaagcaccaagtgaaatgagaaataaaaatggcatttgttaatttaccttttacactcaaaatccttttgatttctgttttggggaccaaatctaagggtatcctgtatgggaactcctttcgtctgctaatggtacctgtaatttagaaaatytggatttatacagagtttccaggggaagactgtttgcagattatttataatgtatctacttccaaagaatatttcaaaataaaagacttataattagactattaaaattttaaaagaaagttaaaaatcatcaaggactttaatcaaaccctaggcttgtataatcttattaaataaagcattaaatttggctgtaagcttcctggtcattataagatgtgaaataaataggttatataaatcttattcaccagcaaaatatagcatgccagcttgcccaaagacagaaaattgttcctg

SEQ ID NO: 138537 - DNA, 601 bp, Human
tgggcagcaagcatatgctctgtggccagcattgaacttctcaaaggaagtatatgaattgctcgaattgggaattatcaagtagaacattctgatctcattcgaaaaggaaggaagtgttctgtagtttggaatgcaggtgccttgcctctcattcaggcattttggtaagttgagccaaaatgctacagaaataatatttatttatatagtagagtccatctcatgatttttttgctaaaattctcttacaaagttttctataattcacaacttaaatattagtttaataaaaatattrgtttagaatcacccaatttttatgtgaaatactttttttttttaccttcttttaattttttcttcagtttctgcttttcaattaatgggtcagaatgaaaaatgttccaatgatttcctgtttccaggtagtgaaaaacatagaatactgggacaacgctcatcagctccgcctctgcactccctttggggaggtgggttaggatattgatgccttcctgacttagaactgcagacaagatctcacctacaagcagtcctgaaacaaaaaagatcaaagtagacacattgctttttatta

SEQ ID NO: 138538 - DNA, 601 bp, Human
cagtgagcagccaaactggagttaagttacagctatatgatttcatgtatatatatactatataaaatattaaaaatgttctggaaagatgcataaactcatgatagtgaatgcccttgggggaaagaaacagaaataagatggaggcttgtagttaaagagaaaagttcaatatccacaatgttctttaaaaaaaaaaaaaagacgaatataaaaaatgttcatcatcatcaattttgggttttgctaatatgaatgatattcgtactttaaaaaatctgctttgtatttctcaagaaawgtttgagggtatttaggtgctggacattttcttctatgtctattatttctttcaaggaactcatggagttgggtgtatgtttcagtcttgccccaaactcttgaaaggctctgagtgtttactgagaggctgttgtaccttcctgtggggctttctgctctccaggcatctatttcccaggtcctgctgtgtcagtttccagtcttcattgacactcactcccactcctgcatcctgggttatcctctggttggtgtgctgcaggggtctatgagccttttatttatttttttatatttt

SEQ ID NO: 138539 - DNA, 601 bp, Human
tgttgcccaggctggagtgcaatggcgcaatcttggctcactacagcttccacctcccaggttcaagcgattctcctgcctcagcctcctgagtaggtgggactacaggcacgtgccaccatgccaagctaatttttgtatttttagtagagacagggtttcaccatgttggccaggctggtctcaaactcctgacctcaggtgatccacccgcctcagcctcccaaagtgctgggattataggtgtgagccactgcacctggtttttataagctcttactcctatctctctttctctttsgtactcttgggtgtctcatccctggtatccttaaggagtgagagtctagacagcacttccctaaaggtaaagcaaatacaattcgctctagctttttgcgttctcctcttcccactgacctgtcccttggagactgccctgaaattcaaattttaagtgtgacatggaggaaaaaaagaagtaggctatttgatttgcttttgttccagaccctaggctacctctacaagtgcttaatatggtctagtttagttcctcatgttttacagtagggtctgggactaaaaatttagagtagaa

SEQ ID NO: 138540 - DNA, 601 bp, Human
ttaatcggaacttgcccctccacaactaggtgccttttcctaattctttctctagaaacatcagaaatttattttctactctattgacttttagggggtaagagttgagagctcctctctttttaatcctcccacactgctctcaaggatgagaaatacttctacggattgctcaggttcaaggacactcacattttcaaagattggcccacattttacattgggtctctcttgggattttggcttttggaagtctctcttcttttagcaggctagaaaggcatatgagtgcagttatacrgccaggctgcctctccacttatctatacatctgtatatataaagatgctttagttacatctttgaaaaaaggcaatggcaataaatagaaacaacggactcatcctttgggatcaattataaagattaaatatatgaacatacttaaaatagttctggattatagtaagtattcaataggtataagctcttactttttttttttttttttttttttcagacggactctctctctgttgcccaggctggagtgcaatggcgcaatcttggctcactacagcttccacctcccaggttcaag

SEQ ID NO: 138541 - DNA, 601 bp, Human
ggcttcaacaggcaaggtaccctaaaaagaagcaatgttttaaaaggggagtgaaatggtgtctttaaggcgaaatgacctgattctactctgttttttgtttgtttgtttgagatggagtctcactctgtcacccaagctggagtgcaatggcttgatcttggctcactgcaacctccgcctcccgggttcaagccatcctccggcctcagccttctgagtagctggtactacaggcgtgcactaccacgcacggctaatttttgtatttttagtagagacggggtttcaccatattgaycaggctggttttgaactcctgacctcatgatccgcccgccttggcctcccaaagtgctgcaattacaggcgtgagccaccgcacctggcctctactctgtgttttaagccttatctcccactctttcccttcctgcttcccatttctcaataagccctgggtctatctcgcttgagtgctttcacttgcccatctacctccaccccgttaaacgagaggtctaagatatcacttctctgatctctagtgaactgtctgaagatcgcttcacttcagatattatgggaaagacctttgtat

SEQ ID NO: 138542 - DNA, 601 bp, Human
gtgtttgggtcatggggcgtaccactttcataaatggattaatgctgcttattatagaagtgaatttgttataaaaagatgagtttatactccactcccaccaaccctccactctgccttctctttgcccttccaccatggaataatgcaacaagaatgccttcaccaggtgcagcccccctgatcttggacttcctaggacccagaaccatgaggtaataaatttctgtccattgtaaattatccagtgtgtcgttttttctgttacagcaacacacaatggactaaggcaatgtccatygcatttagcaggtacataaatatttgttgaaggaataaatgaataaactttatctttctggacctcatctttctcatctataaaactgagaaacatgactagatcagagatgttaaacaatgtggccattccctctgcctatatctgtggcggcaaatgctaatcaatagggcagtcttttctgctaaccctataattgtacccaaaataaaacacattacatggtcagtaaattaatactgaaggccctctctacatctaaattacatatatataaatatacacactccatcattatct

SEQ ID NO: 138543 - DNA, 601 bp, Human
gtgtggcctcagatctgggtcctctatatattctgcaaatgtaacctcaggcaagtcactgtttgcagaattcatctgagtctttgaacaattatctcttcctcatcctttagtctgaccttaagtatctccacaacaaggccataaactcccctttcccgttattctctgttttaaggttccctttttgccctttctagcattcatctcaatttgtaatgcttttatttatagtttattgttggcctaccccactgcaatataagatttgtgaggcaagtaggtaatatatttttcttgrtgcctgctgtggtttgaatgtgtcccccaaagttcatgtgttggaaagcttggtccccaatgtggcagtgttaggaggtgaggcctaatgggaggtgtttgggtcatggggcgtaccactttcataaatggattaatgctgcttattatagaagtgaatttgttataaaaagatgagtttatactccactcccaccaaccctccactctgccttctctttgcccttccaccatggaataatgcaacaagaatgccttcaccaggtgcagcccccctgatcttggacttcctaggacccag

SEQ ID NO: 138544 - DNA, 601 bp, Human
atctggacacatctgacaaactccctccatctttcagccaggatcaggagggcccctctgtacttccatgtacctatcaagactcttatttttcactatctgcttaaatgacaatctccctgcactacgctgattgtttgtgttttatttttgaatcctcagtgcccaggatatagcaggcatccctgtttaggacatagctgacactcaatatatgtttaagtagtgaagagatagatttataaaataaagagtggaacagatgatttcaatggtctcagccaattgtaaaatactacasaaagttcttcatttacctctactggcctcccaaggaaattcttgtctgtcattttataattatgtaaggcacctttatgcttgtaagaaacatcgatgtccatactcaagcggagttgtttaaccaggagtgaatattccgtcaggccctcaatggcattgattgtgtcctgtcagcaatcagcaaggcacaaaaatatgtttagtttatttatgtactccctatttacaaatgccctttttatgagagggtagggcagcattgtctggagatgaaactccagctgactcagtaagactg

SEQ ID NO: 138545 - DNA, 601 bp, Human
ttttttcagatttaacccacacatctggacacatctgacaaactccctccatctttcagccaggatcaggagggcccctctgtacttccatgtacctatcaagactcttatttttcactatctgcttaaatgacaatctccctgcactacgctgattgtttgtgttttatttttgaatcctcagtgcccaggatatagcaggcatccctgtttaggacatagctgacactcaatatatgtttaagtagtgaagagatagatttataaaataaagagtggaacagatgatttcaatggtctyagccaattgtaaaatactacagaaagttcttcatttacctctactggcctcccaaggaaattcttgtctgtcattttataattatgtaaggcacctttatgcttgtaagaaacatcgatgtccatactcaagcggagttgtttaaccaggagtgaatattccgtcaggccctcaatggcattgattgtgtcctgtcagcaatcagcaaggcacaaaaatatgtttagtttatttatgtactccctatttacaaatgccctttttatgagagggtagggcagcattgtctggagatgaaac

SEQ ID NO: 138546 - DNA, 601 bp, Human
gaacctttccactttaattttacacacaacagcacaaggctaagaagtgtgggtttcttccagccacacgccatcatggcaaacaacaaattataggtgtgtatgaatgggcagaggtgctgccagaagtagatatattgacaccaaccagaagtggcagaaaagtggacaatctctcctcccccatataaacttacaacagtccttgaaggaatgaatgcactaaagataagagcgtgattaaaattattaataggatgttaatttatgctcagaacatgcaatttaagaatgcatgaamatacttaaacagcctagaaaaatttgcacctgccagctgggcgtggtggctcgcgcccataatcccagcacattgggaggtcaaggtggacggatcacttgaggtcaggagtttgagaccagcctggtcaacatggtgaaactccgtctctactaaaaatacaaaaattagccaggcgtagtggcatgtgcctgtaatcccacctacttgggaggctgaggcaggagaattgcttgaacctgggaggcggaggttgcagtgagccaagattgcaccactgcactctagcctgggtgacag

SEQ ID NO: 138547 - DNA, 601 bp, Human
aggctgaggcacgagaatggcttgaggctgggaggcagaggttgcagtgagctgagatcgcaccactgcactctagtctgggcaactgagcaagactctgcctcaaaaataaataaataaataaataaataaataaataaataaataaaagcagtccccattagaagtcatagatgtaatatttgccacaataaagaaaagtattctaaaatctctgactcataaaaatttaaccctattcttcaccaaattaacaatttagaacagaatataaaacacttggaactctaatgtgacatcygaacatctccctaattggatgggtagaagcagagcactcttgctcacagatgcaaacactttgtcagcaggatggaaaagggcctcccgagtggagagtgtctatgaaaaggttgctggagccttgatgactggttgccatggagactgtttcaatggtggaacagaaatcctcctttcaagaagccctttgcctgctgccaaaaccagcaatcttccccaaaggcattttgttgtgagggaaatgaaatccttttttcttttcttaggaatacaacagagaggttgtaaaaaggtaaat

SEQ ID NO: 138548 - DNA, 601 bp, Human
cacctgtcatcccagcactttgagaggctgagtcagatcagctgaagccaggagttcgagaccagcctggccaacatggtgaaaccacttctctactaaaaatacaaaaattagctggctgtggtagctcacacctgtaatcccagctacttaagaggctgaggcacgagaatggcttgaggctgggaggcagaggttgcagtgagctgagatcgcaccactgcactctagtctgggcaactgagcaagactctgcctcaaaaataaataaataaataaataaataaataaataaataaataaaagcagtccccattagaagtcatagatgtaatatttgccacaataaagaaaagtattctaaaatctctgactcataaaaatttaaccctattcttcaccaaattaacaatttagaacagaatataaaacacttggaactctaatgtgacatccgaacatctccctaattggatgggtagaagcagagcactcttgctcacagatgcaaacactttgtcagcaggatggaaaagggcctcccgagtggagagtgtctatgaaaaggttgctggagccttgatgactggttgccatggag

SEQ ID NO: 138549 - DNA, 601 bp, Human
tccacattcaggtctttagaaatgtatgtggttcccttgatgaaagggggaaattttccattttgagtataatcagaagtcctttgaaggacccaaaatgataatgtgactgatttatagctataaaatggcacaataagtacctagaaaatgtgtagatattgaggattttgaaaaaaccaaaactaactgagaccctcatggagccagctgttgattattggtgagttctggatcttttccttggccaagaaggctttcttcaatttaggaaagactaaatggaactggacaataaacmgaattccattaactgggaagtataagagaaaaggaacagaagctagtggttcagtgctgagcctctggtcttatatgataaaaagactaggtgaaagtaaaatctcacatcatgttgcccctataatattcaacaaccctctcgatggtgtttccctgcctctgtacagcatgaactatcaggttgttcaggaactgtgaaaatgtagttttacaatgctcaaggaatcattagctttcaattagctgagatagcatttctacttctgagaaagaacagtttaccaaacagtgtccccca

SEQ ID NO: 138550 - DNA, 601 bp, Human
acccctggcataagacttattgttagactgggtggctactccacattcaggtctttagaaatgtatgtggttcccttgatgaaagggggaaattttccattttgagtataatcagaagtcctttgaaggacccaaaatgataatgtgactgatttatagctataaaatggcacaataagtacctagaaaatgtgtagatattgaggattttgaaaaaaccaaaactaactgagaccctcatggagccagctgttgattattggtgagttctggatcttttccttggccaagaaggctttcytcaatttaggaaagactaaatggaactggacaataaaccgaattccattaactgggaagtataagagaaaaggaacagaagctagtggttcagtgctgagcctctggtcttatatgataaaaagactaggtgaaagtaaaatctcacatcatgttgcccctataatattcaacaaccctctcgatggtgtttccctgcctctgtacagcatgaactatcaggttgttcaggaactgtgaaaatgtagttttacaatgctcaaggaatcattagctttcaattagctgagatagcatttct

SEQ ID NO: 138551 - DNA, 601 bp, Human
caatttcaaaatgaaaaaatgatttgagatagtgtacaatatgctctctctctctcaaaaaatgccagcaataaacatcaaaaactgaatagataacaaaggagctaattttatcaggaactgagacaaggctacaactgtacttgaacactaatttagctctaagcgctggacaactagaagcactgagatttgctttttcaaatggagagtgtctcaaacatggattgcaatcttgaatatattaaaaattatttggtatttatatttttaccctgaagatatttttttaaaaaccaarccccctaaatcacctttgcctctgcctctggtctatcaattggaagagtacagaactgaaatcttatacctctgtggcttctcaaaagttccctttgactatgttttagtgcctgtaattgaaaaagctctattgtgggaaagtatcctggctgggtatacatgtcacttctattatttataatgaaaatcacatttctttgctgaggaataaaaactttgcatgttaatgctaaaaatcgatggcattttccttcaggggatcacatggaatgttgtattcatataatcactatataaa

SEQ ID NO: 138552 - DNA, 601 bp, Human
gtttctattctgttattctggcttgtagtccagaaaaagccagcgaagtcttttcttgaaacaacacaataaacccaaattgcatttattctctgtgttaaaatagatttctgatattttagatttaaaatagttctaaaatggagggaagaaataatttagtggaacttttgtttgttaaaacaatatagtattctcaagtcttcatgtatttaacaaactgcagtgggcctaggctgagtcaggcagctttttagcttttttttttttccaaaatcaatataaattcaaagaaagaaawgttattaaccatataaaacttattctgttgcctgaattactattaagagaattcagtagacttcgatggaaaaaatactggagatcaggatgcatcttaattctattacttgctttctgcatgaccttgagcaaattatttaatctccctgagcctcagtttcttcactggtaaatagtgataatactctgttacattttttttttgacagggtctcactctgtcactcaggctggagtgcaatggcttactgcaatctccacctcccaggctcaagcgatcctcctacctcagcttccc

SEQ ID NO: 138553 - DNA, 601 bp, Human
ggaaaaacattccacgctcatggataggaagaattaatattgttaaaatggccatactgtccaaagcaatttacagatttaatgctattcctatcatttttcataaaattagaaaaaaacattttaatattcatatggaacaaagaaagaacttgaatagccaaaggaattctaagcaaaaagaacaaagctagatgcctcctactacctgatttcaaactatattacaaggctacagtaaccaaagcaacatgttactgatacaaaaaaagacacgtagaccaatggaacaggttacagmacccagaaataaagccactatcctaagtgaattaacacagtaacagaaaaccaaatatcacatattttcacttataagtgggaactaaacagtgagtacacatggacacaaagaagggaacactagacagcagagcctacttgagggtagagggtgaggattgaaaaattacctattgggtactatgcttattacctgggtgacaaaatgatctatataccaaacccccaaaacatgcaatttacccatgtagcaaatttgcacacgtatcccctgaacctaaaataaaagttgtaaaga

SEQ ID NO: 138554 - DNA, 601 bp, Human
ctctctacagttgaacaacattaatctccacattatatagtaaaatataaaattatttggtatttggcaactgttaactttgtggaaaagtacaaaatgtgaaagacttggaaaacttcaaagatagtaattttgggattctcaaagaactcacaagtagccagttcccctacctggaatgcattcctccccatgttggcctcttgaatttcatttatcttgaaagtctccttcaattctcacagtatccagtaaaatattcctggatgctctttgttttaaatatctttctgtctcctcyttacctcttttacacttgaatttctgtcacaattttttgtcccacatctgtccttctagctagactagaaacttcttaaggcatggactgtgtctgatttatcgctatatatacagggctgatatttaactattaagttctggcagagtcatcttaattgttaagtcctgaaaaacttctgaaccaattggcaaatagtgtataatagaaactgtgtaaatggtaaactttcattagtgatataaatttcagtgtacacccattagttcaagctgatttcttaggctgccctgatggtgt

SEQ ID NO: 138555 - DNA, 601 bp, Human
aggccttagaccctcatcttaagactgggcatgataataaaacctaccttgtagaaccatcgtgagattaaatgagttaatacatgaaaagtgcctggaacatagtaggaactatgtaagtacttattattactcttatataaccagaattaaaagaacctctctacagttgaacaacattaatctccacattatatagtaaaatataaaattatttggtatttggcaactgttaactttgtggaaaagtacaaaatgtgaaagacttggaaaacttcaaagatagtaattttgggattcycaaagaactcacaagtagccagttcccctacctggaatgcattcctccccatgttggcctcttgaatttcatttatcttgaaagtctccttcaattctcacagtatccagtaaaatattcctggatgctctttgttttaaatatctttctgtctcctctttacctcttttacacttgaatttctgtcacaattttttgtcccacatctgtccttctagctagactagaaacttcttaaggcatggactgtgtctgatttatcgctatatatacagggctgatatttaactattaagttct

SEQ ID NO: 138556 - DNA, 601 bp, Human
aatttgatttctttatttttttttgagacggagtcttgctcagtcgcccatgctggagtgcagtggcgtgatctcagctcactgcaagctctgcctctcgggttcacgccattctcctgcctcagcctcccgagtagctgggactacaggtgcctgccaccacgcccggctattttttttgtatttttagtagagacggggtttcaccgtgttagccacgatggtctcgatctcctgaccttgtgatctgcccgtcttggcctcccatagtgctgggattacaggtgtgagccaccgtgcycagcctgatttattttataagagcccagctgtggtcaggtccccaggggtcaggctgtccgccaaactcttctgtaccggcctctcctggggagggttcacaaacccttaaggaattgtaaagctgcctggggctcccatattaaaggcagaaagtacatctatttcaatgactagtttctaaaagcagataatacaatacatatttacacattttcctctttacaaacagtctgagaactatcaagggagctggtgtggtggttaggggaggtccggtgagtactttcagattcatcat

SEQ ID NO: 138557 - DNA, 601 bp, Human
caaactgtatgcagctgaacttcaggaattttagcatccatttaaaaagatatcttcggcaaattcatctaaattagctaaaaatgcttgacacgatgaacatgttgtgtctctaggccagtattcaatccaggtcaaggaatctaaagggtagatgtacctaccaagaaacaaagtgtttgtgaggtggccacaaaacagaaaagctgaatttgatttctttatttttttttgagacggagtcttgctcagtcgcccatgctggagtgcagtggcgtgatctcagctcactgcaagctcygcctctcgggttcacgccattctcctgcctcagcctcccgagtagctgggactacaggtgcctgccaccacgcccggctattttttttgtatttttagtagagacggggtttcaccgtgttagccacgatggtctcgatctcctgaccttgtgatctgcccgtcttggcctcccatagtgctgggattacaggtgtgagccaccgtgctcagcctgatttattttataagagcccagctgtggtcaggtccccaggggtcaggctgtccgccaaactcttctgtaccggcctctcctggg

SEQ ID NO: 138558 - DNA, 601 bp, Human; identical to SEQ ID NO: 33044

SEQ ID NO: 138559 - DNA, 601 bp, Human; identical to SEQ ID NO: 33045

SEQ ID NO: 138560 - DNA, 601 bp, Human; identical to SEQ ID NO: 33046

SEQ ID NO: 138561 - DNA, 601 bp, Human; identical to SEQ ID NO: 33047

SEQ ID NO: 138562 - DNA, 601 bp, Human; identical to SEQ ID NO: 33048

SEQ ID NO: 138563 - DNA, 601 bp, Human; identical to SEQ ID NO: 33049

SEQ ID NO: 138564 - DNA, 601 bp, Human; identical to SEQ ID NO: 33050

SEQ ID NO: 138565 - DNA, 601 bp, Human; identical to SEQ ID NO: 33051

SEQ ID NO: 138566 - DNA, 601 bp, Human; identical to SEQ ID NO: 33052

SEQ ID NO: 138567 - DNA, 601 bp, Human; identical to SEQ ID NO: 33053

SEQ ID NO: 138568 - DNA, 601 bp, Human; identical to SEQ ID NO: 33054

SEQ ID NO: 138569 - DNA, 601 bp, Human; identical to SEQ ID NO: 33055

SEQ ID NO: 138570 - DNA, 601 bp, Human; identical to SEQ ID NO: 33056

SEQ ID NO: 138571 - DNA, 601 bp, Human; identical to SEQ ID NO: 33057

SEQ ID NO: 138572 - DNA, 601 bp, Human; identical to SEQ ID NO: 33058

SEQ ID NO: 138573 - DNA, 601 bp, Human; identical to SEQ ID NO: 33059

SEQ ID NO: 138574 - DNA, 601 bp, Human; identical to SEQ ID NO: 33060

SEQ ID NO: 138575 - DNA, 601 bp, Human; identical to SEQ ID NO: 33061

SEQ ID NO: 138576 - DNA, 601 bp, Human; identical to SEQ ID NO: 33062

SEQ ID NO: 138577 - DNA, 601 bp, Human; identical to SEQ ID NO: 33063

SEQ ID NO: 138578 - DNA, 601 bp, Human; identical to SEQ ID NO: 33064

SEQ ID NO: 138579 - DNA, 601 bp, Human; identical to SEQ ID NO: 33065

SEQ ID NO: 138580 - DNA, 601 bp, Human; identical to SEQ ID NO: 33066

SEQ ID NO: 138581 - DNA, 601 bp, Human; identical to SEQ ID NO: 33067

SEQ ID NO: 138582 - DNA, 601 bp, Human; identical to SEQ ID NO: 33068

SEQ ID NO: 138583 - DNA, 601 bp, Human; identical to SEQ ID NO: 33069

SEQ ID NO: 138584 - DNA, 601 bp, Human; identical to SEQ ID NO: 33070

SEQ ID NO: 138585 - DNA, 601 bp, Human; identical to SEQ ID NO: 33071

SEQ ID NO: 138586 - DNA, 601 bp, Human; identical to SEQ ID NO: 33072

SEQ ID NO: 138587 - DNA, 601 bp, Human; identical to SEQ ID NO: 33073

SEQ ID NO: 138588 - DNA, 601 bp, Human
ctcaaactccaaagctcaagcgatccacccgcctcagcctcccaaagtgttaggattacacgtgtgagccactgctcccggtctacaaagtgtttttattattattattatattattattattatcttgagatggagtctcactgtgttgccaggctggagtgcagtggtgcaatcttggctcactgcaacctccacctctcaggttcaagtgattgtcctgcctcagcctcccaactagctgggactacaggtgtgcgctaccaagcccagctaatttttgcttttttttttttttttttgagacggaatctcactctgttgcccaggctgaagtgcagtggagcgatctcgtctcaccgcaacctctgcctcccaggttcaagagattctcctgcctcagcctccagagtagctgggactacaggcacgtgccaccatgcccggctaatttttgtatttttagtagagacagggtttcactatgttggccgggttggtctcgaactcttgaccttgtgatccacccgcctcggcctcccaaagtgctgggattacaggcgtgagccaccgtgcctggcctaacttttgtatttttagta

SEQ ID NO: 138589 - DNA, 601 bp, Human
gatggctctttagtgggcctaaaaggatggacagaatatggacagacagcaaagtatttcagttagaaaggctggtatgagtaaagttaggaaagtgcaagtcaggcttaaggaaaaataagggtgccacatggtagctggagcagatgaaaagaagtggagtggaggaaaaaagtgaggttggaaaagtaggatggaaatatactgtaaagggcccaaatggcattctaaaaactcactacaggcaatgggaaaccacggaaaagattagcaccagctgactcgagatgtatgctcactrgggttacaaggtgggaaggaatttgctagaaaaggaatttgctagaaaaggaatttcagaggtaaggagaagtcagactaacactacagacctagcaatagggaaaaaatgagggcttgaattaaagaggagacaaataagagacatttcataggcagacccaaataatgttaactgatagacatcatgaatggagaacacttacagaaaaggaaggaatcttagaaggtcagagccaagaaagcgctctgaaatcatccactgttgattcagtggttcataatcttttcaagtagtaag

SEQ ID NO: 138590 - DNA, 601 bp, Human
agacatgaacaaaatgcggtcactgccttcaaagaatttacaaactggaaatagacacacagagaactataacataggtaatagtgtcaattatcattaacagaaataacaataatgtcctttagcagatctaaggagcagtcatttgcaactggaataattgagaaaaatattttggaggagatggctctttagtgggcctaaaaggatggacagaatatggacagacagcaaagtatttcagttagaaaggctggtatgagtaaagttaggaaagtgcaagtcaggcttaaggaaaaayaagggtgccacatggtagctggagcagatgaaaagaagtggagtggaggaaaaaagtgaggttggaaaagtaggatggaaatatactgtaaagggcccaaatggcattctaaaaactcactacaggcaatgggaaaccacggaaaagattagcaccagctgactcgagatgtatgctcactggggttacaaggtgggaaggaatttgctagaaaaggaatttgctagaaaaggaatttcagaggtaaggagaagtcagactaacactacagacctagcaatagggaaaaaatgagggctt

SEQ ID NO: 138591 - DNA, 601 bp, Human
gtgcacaaatttcagatcctatgtgacccttctttgccaacgagccaaagagttaatgcttaaaattagtcttgtttgattttcatgttctaaagcagtaatcttaggacttaaactctctcaaaaaaaactgtcaagattctaacttacatctgcaagatcagattgtgaaccaacacacaacaacttatgtggtttagccaggataacagcaaagtatctgaagactgccagatactatccagagaattattcccacaaggtgcagttggtatctactatgtatccagttctgaattaytctgtctttaaattccattaaaattgttccctaaagcactgctccttcattcagcaaactatcttccccatggacctgaatcctcaaattctgcctcacttcagttcctactgcatctctgctgtcaacttgcggtatgacctctggaagtctcttcatctctaataggagaggttggacaaggtggccactctaaactctgtgagtctcaaatttaattgggcgtatactgcattatgtgctgggccctaagagggatgcagacatgaacaaaatgcggtcactgccttcaaagaattt

SEQ ID NO: 138592 - DNA, 601 bp, Human
ctatcttaattgtggcgatggtttcatgggtatatacatatgtcaaaacttgccaacttgtacgttttattaagtgcagttcattgtatataaattatacctttgaaagctgtttaaaaaaaagtagtggtacgttaaactgcacagtgcacaaatttcagatcctatgtgacccttctttgccaacgagccaaagagttaatgcttaaaattagtcttgtttgattttcatgttctaaagcagtaatcttaggacttaaactctctcaaaaaaaactgtcaagattctaacttacatctrcaagatcagattgtgaaccaacacacaacaacttatgtggtttagccaggataacagcaaagtatctgaagactgccagatactatccagagaattattcccacaaggtgcagttggtatctactatgtatccagttctgaattattctgtctttaaattccattaaaattgttccctaaagcactgctccttcattcagcaaactatcttccccatggacctgaatcctcaaattctgcctcacttcagttcctactgcatctctgctgtcaacttgcggtatgacctctggaagtctc

SEQ ID NO: 138593 - DNA, 601 bp, Human
gtccatctccagaacattttcctcttcccaaccagaaactctgcatccattgaacactccctattctcccctccccaagcacctggcaaccaccattccactttctgtctctctagatttgactactctaggtatgtaagtaaaagcatacaacatttatccttttgtgtctggtttatttcatttagcacaacgtcttcaaagttcatctgtcagaatttcctttctttttgaggcaagatgtacaatatcccatcatatgtatataccccattttgtttatccattcatcccttcatacacactttggttgcacatgtgggttgcattgcttctgtgccttttaaaattttagccaatctaatagtgtgcagtagaatctcactgtaattttaatttgtatttccctatttaatgttgaatatctttctacgtgcatatttatcatctgtactttttttttttttttttgagatggagtctcgctctgttgcccaggctggagtgcgatggcgtgatcttggctcactgcaacctccacctcctgggttcaagtgattctcctgcctcagcctcccgagtagctgggatcacaggtgtc

SEQ ID NO: 138594 - DNA, 601 bp, Human
atgggctaagactagaaactataggagcttaaaaaagaacagagggtacagggaaggcttcccagaagggtaacatctaaactaaattttaagaaaaagtaggagttatccagaagaaaagtgttctaggtagagggagtagcagcacatgaaaaggcagagaggaataagacatagtattatactttcaaggaacaagtagtttggtatgattggggtcagaatgggagagaggtggtgagaaggtaaaagggtgaggtgaaggacaagaactgaaactgaaaagatgcacagaagccarattctaacaggtattttatgtcatgcttggaatttagacttcttccagaaaatcaatggcaggccataagtggtcttaaagaagtaaaatgacgagatctgacttatagaattcactctgcaccagtgttaggggaagaattttcaattacaaggcagtaaatggtgagaggtgatgaaggagtaaaccaggggagcagcagtgaggatagagagaagagggaagaactatgtaagagaaactgatgactaccagtggtagatacagaagatgttttcagaacaattttcttgtctctta

SEQ ID NO: 138595 - DNA, 601 bp, Human
gaggtggagttttgctctgtcgcccaggctggagtgcaatggcctgatcttggctcactgcaacctccacctcccaggttcaagcaattctcctgcctcagcctcccgagtagctgggattacaggggcctgccaccatgctgggataatttttgtatttttagagacgaggtttcaccatgttggccaggctggtctcgaactcctgacctcaggtgatccacctgcctcggcctcccaaaatgctgggattacaggcttgggccaccgcacctggccttttttttttttttttttttttgagacagagtctcgctctgttgcccaggctggagtacagtggcacgatctctgctcactgcaacctccgcctcctgggttcaaacaattcccctgcctcagcctcccgagtagctgggactacaggtgcatgccaccacacccggctaactttttgtatttttagcagagacgggggtttcactgtgttagccatgatgatctcgatctcctgaccttgtgattctcccacctcagcctcccaaagtgctgggattacaggtgtgagacaccgtgcctggcccgatatattctctagtct

SEQ ID NO: 138596 - DNA, 601 bp, Human
ccttgcacaaattttagccccatttcttatccgtaaaatgggaacacaatatttaattccaggatagttacgaagattaaatgagaccgaacaggcaaagcacctgctacagtgtctggcatataaatggccagtgaataaactgatatcttccccctttcccccaacctttttttttttttttttttttgagatggagtctcactctttcgcccaggctggagtgcagtggcgcgatctcagctcactacaacctctgcctcctgggttcaaacgattctcccacctcaggctcctgagyagctgggattacaggcacctgccatcatgcccggctaatttctgtatttgtgtagagacagggtttcaccatgttggccaggctggtcttgaactcctgacctcaggtgatccgcctgccttggcttcccaaagtgctgggattacaggcgtgagccactgtgcccagcgcccttttttgctgaataaacacagaaaaggaaaaacagtagttcagtatctactgagtaactgtttagctcctaacatttcaacaagataatccttagcagcagctcttcactcaaatagcaaggatgct

SEQ ID NO: 138597 - DNA, 601 bp, Human
attttaataatattaatccttccaatccatgaacataggatacctttccatttatttgtgtcttcttcaatttccttcatcagtttttatagttttcagtgtacagatctttcacctccttaaatttattcataaatatttaattttttttgaatgctattgtaaatgggaatgtatctttgattactttttcagagttcactgttagtgtatagaaatgctacggatttttatgcactgattttgtatcctgcagctttattgaatttatttattcattctaacagttttttggtggaawctttattctatatattaataaaacattacatcacttgcaaacagggaaattttcacttctttctttccgatttggatgccttttatttatttatcttgcctaattgctctggctataacttcttgtactttgctgaatagaagtggtaattgtgggcatccttgtcctgatctttttttttttttttttttgagatggagtctcactctgttgtccaggctggagtgcagtggcgcgatcctggctcactgcaatctccacctcccaggttcaaaggattctcctgcctcagcctcctga

SEQ ID NO: 138598 - DNA, 601 bp, Human
taacatgccaaaagtatctcttaacatgaaatcttataacaaacttttattttcctttctcaaaatttcataaatattcacaacaaccctgagaagcagttgttatgccatttttataaatgaagaaaatgaggcctagaaaagtgaagtgagtaaatgaagttcaaaaagcaaagtcagggctggatacaatggtgtggacctgtagacccagccaatcaagaggatgaggcaggaggattgcttgagcccgggagttcggggccagcctgggtaacagagagacactctcaatctcttaaaaaaaaaaaaaaaaaaaaaaagaatagaaaacccaaggacatgaatccagacctttctgactctagcccgtggtctttgtaccatgaaatctagtcaaagaagacatcatagaggggaaacaggaaacaatgtttggttgaaatcgattggtagaaacctaaaccaatgaaaacctaaaccagtgaaaagtcaaaaaaaaaaaaaaaaaggttttccgtaataattattagattttcagacatgagtacaaggtcatggttaacaagactgccacccataaaatagtttctacaatgta

SEQ ID NO: 138599 - DNA, 601 bp, Human
gatcccatagcatcctgttcaaacctcaaacagcacctaatatcttttactgaaacaatctgtttacacatctgtctccttacttagtctctaaggtagcagaaggtagaaactatactatgcacttgtgcatccccagagatggcacaggctctggctcactgttaagtactcaagtgttgagctggcagggtcccagaaggacctatggaagtgaatacctaccgtaaacacttttaaggcagcacagtgtagttcagggaagggctgactactaatgccacggaagagctccagtggrtcccgagataaagaagaaaaccaggattctgtcatcctcagaaggtcatcagtctgctgctcaggctacaggaaagaaaaggaaaatctcatcaaaagttaactgatctggagaaaagcacttatttagaagtcagacacctgagtgctgatggcactctgtcattaatttgttgtgtgaaactggctaagtctggaggactctttctcaaatccagcccagacctttcccagttttctttgaatgtggttgattaagcagtctctagagtctcttcagttctaacactctatgattcca

SEQ ID NO: 138600 - DNA, 601 bp, Human
ataatataacaaatagaacacaaaggtataatccttaccacagctgtaattatataagtaactgtacaattatatttactgcctggctccttcaatagacaggaaactacatgaaaggaaggtctttatatattttcttcactgttgtatgcccttcactgagcaaaaacggaaactcaacaaatatttgctgaataaataaatgcaacatatgagaaccaacattgtttaactcaaccttgtcaatctgggcaaagtgtgctgaagacaaggagttagtccttgacgagtgagtaagagkttaagaagcaaagttaaggaagagtgttagatacggagaccccagcaaaggtccagagacacaaaacaaacagtttggtaccactggagcattaggtgccagaagccttattttctgcacgggaaataaggattaggaagaccagggctaggttaatagaggatggcagataaaaagtctggaattaactgtgtgatcccatagcatcctgttcaaacctcaaacagcacctaatatcttttactgaaacaatctgtttacacatctgtctccttacttagtctctaaggtagcagaagg

SEQ ID NO: 138601 - DNA, 601 bp, Human
agtccttgggtaaatgcttgggagaataatttaaatatttttattctaccatggtggccctaatttttcagggggcagtaagatggctttttaggattggtctaatcagatcctcatttttgttcccttcctaggttttaaaacatgaatcctacactcatccttgctgccttttgcctgggaattgcctcagctactctaacatttgatcacagtttagaggcacagtggaccaagtggaaggcgatgcacaacagattatacggcatggttagtgaaacttccccagaaagaatagtcytggctgttgagaagttttagtcagagagtagcttctagaggccagcttttaccaatagcctaatgtaataacctaatggcgtggattatgagcacaatgtggacattcatccttgttgtgtctcagtttggagaacagcatccccagaggtgtcaagccttcccttgccatggtttctcttccatctctgtctgcagattcacttggtgaggatgagttgggttttaggtagaagtaaagagcatcagttacatgtttgcctctagaatgaagaaggatggaggagagcagtgtgggaga

SEQ ID NO: 138602 - DNA, 601 bp, Human
ttttttaattcccttttcagggtcagtgtggttcttgttgggcttttagtgctactggtgctcttgaaggacagatgttccggaaaactgggaggcttatctcactgagtgagcagaatctggtagactgctctgggcctcaaggcaatgaaggctgcaatggtggcctaatggattatgctttccagtatgttcaggataatggaggcctggactctgaggaatcctatccatatgaggcaacagtaagtggagctccttgtcatcattccagctcagcttttggaaggtggacactttmagagataacagatacctttttcggaattcatatattagggctgggtggggtggctcacgcctgtaatcccagccctttaggaggctgagccaggcagatggcttaagctcaggagtttgagaccagcctgggcaacaaggtgaaaccttgactctatcaaaaatacaacgaaaattagccggctgtggtggtgtgcgtctgtggtcccagctatgctgaggtagggcgattgcttgagtgtgggaggtggttgtgcaaatgcactctccagtctgagtgacagaatgagaccctgtctcc

SEQ ID NO: 138603 - DNA, 601 bp, Human
agccagactgtagcagtgaagacatggatcatggtgtgctggtggttggctacggatttgaaagcacagaatcagataacaataaatattggctggtgaagaacaggtataaattgccagaaatacttacatttgaaattcaaaagagaatacttatttgcaaacagtgtttggatacagttccacatgcccttaggcatacttctgaaatccccagaagtctaagttgaacatataatattaatgtttgattataaaagtaagaaactgtcacaaatatcttgggagtatgaatatagtmtttgttccattgtataaaggtgtatctaaatctgaacagtttttaaattctgaggcatatctggctgcaaagacatcctattgttttcctgtctctgatctgtagttctgtgaaaggtcacagtttggaggctgggatggaaattatgtccaggttatgtcaagaattttttaaggataaacaggaacattgcctgtcctgattctttctgttaagtctatggcctctggcacagtgtttaagttgggtgttcctgttaataaccctttgggctttattctttctctgaaatggaaaacc

SEQ ID NO: 138604 - DNA, 601 bp, Human
acattccttccctgccagaccataacctggatgcccctgaaatccgaaatgactactacctgaatcttgtggactggagctctgggaatgtattggccgtggcgctggacaacagtgtgtacctgtggagcgcaagctctggtgacatcctgcagcttttgcaaatggagcagactgggaaatatgtatcctctgcggcctggatcaaagagggcaactacttggctgtgggcatcagcagtgctgaggtgcagctttgggatgtgcagcagcagaaacggcttcgaaatatgaccattcmctctgcccgagtgggctccctaagctggaacagctatatcctatccagtggttcacattctggccacatccaccaccatgatgttcgggtagcagaacaccacgtggccacactgagtggccacagccaggaagtgtgtgggctgcgctgggtcccagatggacgacatttggccagtggtggcaataacttggtcaaagtgtggcctagtgctcttggagagggtggctgggttcctctgcagacattcacccttcaaggggctgtcaaggccgtagcatggtgtccctggaagtccaa

SEQ ID NO: 138605 - DNA, 601 bp, Human
ttgcacagaaccagctggttatttggaagtacccaaccatggccaaggtggctgaactcaaaggtcacacatcccgggtcctgactctgaccatgagcccagatggggccacagtggcatctgcagcagcagatgagaccccgaggctatggcactgttttgagttggaccctgtgtggcggcgggagcgggagaaggccagtgcagccaaaagcagcttcatccaccaaggcatccgctgaagaccaacccctcgcctcagttgttttttatttttctaataaagtcatgtctcccttcaaaaaaaaaaaaaacaaaactgctgtgtaattacagaattgtattcaatcctgttttaataaataagagacaatttacaataactcacttgcagcaacgtgctttgaatcatttcagagaagaaggacagaagagattggttgacaccacagtgtgattaaaaaaataggagtcagtggtatttatgaaattaataaataaagcacatgcccacccccattaacccactgcatggtcaagttcttagggaggtgatgaggcaacctctccaatattcccattatagagctccactaacatt

SEQ ID NO: 138606 - DNA, 601 bp, Human; identical to SEQ ID NO: 23962

SEQ ID NO: 138607 - DNA, 601 bp, Human
ccccgcccaccgcgtgctcaggccccgctgagcggtcccggctccgctcgcgccctgtggggtccacggcgcgctcttccagagcctttgggacccgtgcccgctcgcgtcctcaagtgcacgcgccgtcccgcgcgcggtattttggcggccgacgcgttccgtagcgaggccggcgagtggggtcggaggtcgcggggcggggccagcgtcggttgccgccttagcgggcgcctccttttcatccctcatccttcatccctggctttcgcgctctagcggagtgggatctgcgaacacgtgaggcgggggcgcggtccccaggctgccgagatggccctgagcgacgaaccggccgcgggcggccccgaggaggaggcggaggacgagacactggcctttggcgcggcgctggaagcgttcggcgagagcgcggagacccgggcgctgctgggccgcctgcgggaggtgcacggcggcggcgcggagcgcgaggtggccctggagcggttccgcggtgcgtgggcggcgccgcgtgcccgcttcctcccccggcccgggttcggcgcgctgagtgcactttaccgggcggggaccgcag

SEQ ID NO: 138608 - DNA, 601 bp, Human
tcatccctcatccttcatccctggctttcgcgctctagcggagtgggatctgcgaacacgtgaggcgggggcgcggtccccaggctgccgagatggccctgagcgacgaaccggccgcgggcggccccgaggaggaggcggaggacgagacactggcctttggcgcggcgctggaagcgttcggcgagagcgcggagacccgggcgctgctgggccgcctgcgggaggtgcacggcggcggcgcggagcgcgaggtggccctggagcggttccgcggtgcgtgggcggcgccgcgtgcccscttcctcccccggcccgggttcggcgcgctgagtgcactttaccgggcggggaccgcagcccggcggcgccggccgctctgcgagggctgccggtgcgcggtcccgcgggccgtggtggggcgcggccttcctaggcgggagagggccaccccggcgcggcgttaggtgcacggggcagacgcgcgcctcccttggggggaccgtggcccgcggagcgcctgctctcgcacggggtgaagcctctgcggcctccccgggaggcggggtgcagaagccctccgtcccccgtctccgtcact

SEQ ID NO: 138609 - DNA, 601 bp, Human
atcatctttgtagaccctttgagtaagaagaacttttgcattatttggccttcctcattttagaatgacagcgctttgattttaggagtcaggcagggtggggggccttgtgggaggagtgcgggttcggcgtcagatcctcctgcctgtgaattctggccctgtcgcttggacctgatacttgattgcctgtttcttcgggtgtaagctggggcggataacgatgcctctcgtgcagaactgttctgagggtgagggaccctcatccagggaccagtgaagccagattttttgttcctgrtgtaacagcccaatggcttcttccttttttttttttttttttttttttgatacgaagtcttgctctgttgcccaggctggagtgcagtgcagtggtgcgatcttggctcactgcaacctcaacctctcaggttcaagctattctcctgtcttagcctcccgagtagctggggctacaggcgcgcgccaccacgcccggctaattttgtatttttagtagagggggtttcaccatgttggtcaggctggtctcaaactcctgacctcaagtggtcgcccgactcagcctcccaaagtgttg

SEQ ID NO: 138610 - DNA, 601 bp, Human
gagtaagaagaacttttgcattatttggccttcctcattttagaatgacagcgctttgattttaggagtcaggcagggtggggggccttgtgggaggagtgcgggttcggcgtcagatcctcctgcctgtgaattctggccctgtcgcttggacctgatacttgattgcctgtttcttcgggtgtaagctggggcggataacgatgcctctcgtgcagaactgttctgagggtgagggaccctcatccagggaccagtgaagccagattttttgttcctggtgtaacagcccaatggcttyttccttttttttttttttttttttttttgatacgaagtcttgctctgttgcccaggctggagtgcagtgcagtggtgcgatcttggctcactgcaacctcaacctctcaggttcaagctattctcctgtcttagcctcccgagtagctggggctacaggcgcgcgccaccacgcccggctaattttgtatttttagtagagggggtttcaccatgttggtcaggctggtctcaaactcctgacctcaagtggtcgcccgactcagcctcccaaagtgttgagattacaggtgtgagccac

SEQ ID NO: 138611 - DNA, 601 bp, Human
taagaagaacttttgcattatttggccttcctcattttagaatgacagcgctttgattttaggagtcaggcagggtggggggccttgtgggaggagtgcgggttcggcgtcagatcctcctgcctgtgaattctggccctgtcgcttggacctgatacttgattgcctgtttcttcgggtgtaagctggggcggataacgatgcctctcgtgcagaactgttctgagggtgagggaccctcatccagggaccagtgaagccagattttttgttcctggtgtaacagcccaatggcttcttscttttttttttttttttttttttttgatacgaagtcttgctctgttgcccaggctggagtgcagtgcagtggtgcgatcttggctcactgcaacctcaacctctcaggttcaagctattctcctgtcttagcctcccgagtagctggggctacaggcgcgcgccaccacgcccggctaattttgtatttttagtagagggggtttcaccatgttggtcaggctggtctcaaactcctgacctcaagtggtcgcccgactcagcctcccaaagtgttgagattacaggtgtgagccactgc

SEQ ID NO: 138612 - DNA, 601 bp, Human
agaagaacttttgcattatttggccttcctcattttagaatgacagcgctttgattttaggagtcaggcagggtggggggccttgtgggaggagtgcgggttcggcgtcagatcctcctgcctgtgaattctggccctgtcgcttggacctgatacttgattgcctgtttcttcgggtgtaagctggggcggataacgatgcctctcgtgcagaactgttctgagggtgagggaccctcatccagggaccagtgaagccagattttttgttcctggtgtaacagcccaatggcttcttccttttttttttttttttttttttttgatacgaagtcttgctctgttgcccaggctggagtgcagtgcagtggtgcgatcttggctcactgcaacctcaacctctcaggttcaagctattctcctgtcttagcctcccgagtagctggggctacaggcgcgcgccaccacgcccggctaattttgtatttttagtagagggggtttcaccatgttggtcaggctggtctcaaactcctgacctcaagtggtcgcccgactcagcctcccaaagtgttgagattacaggtgtgagccactgcgc

SEQ ID NO: 138613 - DNA, 601 bp, Human
acgatgcctctcgtgcagaactgttctgagggtgagggaccctcatccagggaccagtgaagccagattttttgttcctggtgtaacagcccaatggcttcttccttttttttttttttttttttttttgatacgaagtcttgctctgttgcccaggctggagtgcagtgcagtggtgcgatcttggctcactgcaacctcaacctctcaggttcaagctattctcctgtcttagcctcccgagtagctggggctacaggcgcgcgccaccacgcccggctaattttgtatttttagtagrgggggtttcaccatgttggtcaggctggtctcaaactcctgacctcaagtggtcgcccgactcagcctcccaaagtgttgagattacaggtgtgagccactgcgctcggccccagtgggttctttctgcgggctgcccagatagagttgatttgtcagggcaggggagttgccatggagaagatttagttcacgcagagccggttgaaagggagactagactagaggtttttttttttttttttgaggcggagtctcactttgtcccccagggtggagtgcagtgatgagatctcagctc

SEQ ID NO: 138614 - DNA, 601 bp, Human
tgtgatagtggcttgagttccagatgtcactctaggctggggggagatgtgtctgagctacttaattcctttctgctaaggaaacaacatctgctcctcatgtgttttttttgtttttttttcttttttttgagacggagtctcgctctgtctccaggctagagtgctgtggcgcgatctcagctcactgcatcctccagctccctggttcaagggattctcctgcctctgcctcccgagtagctgggattacaggcatgcgccaccatgcccagctaatttttgtatttttagtagagayggggtttcactatgttggccaggatggtcttgatctcctgacctcgtgatccgcctgcctcggcctcccaaagtgctgggattacaggcgtgagccaccgcgcctggcctcctcaagtgtttttagtttacattagtttattattttagtttacatttgggcacatgatgtttttctggtaatagtcatacagggtcaggtgttttacatgggtcatcatttaatcctcacagcagctaaggagggcatctgttgtcatctccagtttacagatggggacactgaggctcggttttctta

SEQ ID NO: 138615 - DNA, 601 bp, Human
gcaggagaatggcgtgaacccgggaggcggagcttgcagtgagctgagatcacgtcactgcactccagcctgggtgacagagtgagacttcatctcaaaaaaaaaaaaaaaccaaaaaaaaccctctaaattcgggattcaagaattcattgggatcagacttgtccttctgtcctagaaaaatttataggccttgtgaaggagaccaaagatagaggtccttgggagagggtcagctgcagggaacatgactctgacatctggtggaggggctagccatgctggatggcgtggcaggcastgggctccccaggccatatcttataggaggtcttgggttcctggagttcctgtgtgtgagcgctggttcccaggaaacagatgtggtcactgctcacaaggtagcgggtggtgtttttatatctcttcaagtaacaacgttggacctgtagttaaatgcctttattcttgccagacctctttccagagtggatcatggaatattaacacttgttgtgagctgcttagagtactgcgaatgatttttagagttattttctttctttgcaaaaactgtttttcgccgggtgtggtggcttat

SEQ ID NO: 138616 - DNA, 601 bp, Human
tagagttattttctttctttgcaaaaactgtttttcgccgggtgtggtggcttatgcctgtaatcccagcactttgggaggccggggcgggtggatcacctgaggtcaggagtttgagaccagcctgaccaacatagtgaaaccccgtatctactaaaaatgcaaaaattagccgcgtgtggtgcacgcctgtaatcccagctacttggggctgaagcaggagaattgcccgaacccaggaggcagaggttgcagtgagccaagatcgtgccattgtactccagcctgggcaacaagaacraaaacgtctcgggaaaaaaaaaaaaaaaaaaaaaaaaataaataaataaatttttttttttgtagagaaggggtcttgccgtgttgcccaggctggtctcatacctctgggttcaagcggttcacccaccttggcctcctaaagtgctgggatttcaggtgtgagccagcgtgcccagctgagttcattattttctggaattcctttttagaaaaaggaaaatgtagtcgtgggatgctggtcctttgtcatttgttgcacatttttccacccttttgcttttttttttttctttttttt

SEQ ID NO: 138617 - DNA, 601 bp, Human
tttctttgcaaaaactgtttttcgccgggtgtggtggcttatgcctgtaatcccagcactttgggaggccggggcgggtggatcacctgaggtcaggagtttgagaccagcctgaccaacatagtgaaaccccgtatctactaaaaatgcaaaaattagccgcgtgtggtgcacgcctgtaatcccagctacttggggctgaagcaggagaattgcccgaacccaggaggcagaggttgcagtgagccaagatcgtgccattgtactccagcctgggcaacaagaacgaaaacgtctcggraaaaaaaaaaaaaaaaaaaaaaaaataaataaataaatttttttttttgtagagaaggggtcttgccgtgttgcccaggctggtctcatacctctgggttcaagcggttcacccaccttggcctcctaaagtgctgggatttcaggtgtgagccagcgtgcccagctgagttcattattttctggaattcctttttagaaaaaggaaaatgtagtcgtgggatgctggtcctttgtcatttgttgcacatttttccacccttttgcttttttttttttcttttttttttttttttttgag

SEQ ID NO: 138618 - DNA, 601 bp, Human
gaacgaaaacgtctcgggaaaaaaaaaaaaaaaaaaaaaaaaataaataaataaatttttttttttgtagagaaggggtcttgccgtgttgcccaggctggtctcatacctctgggttcaagcggttcacccaccttggcctcctaaagtgctgggatttcaggtgtgagccagcgtgcccagctgagttcattattttctggaattcctttttagaaaaaggaaaatgtagtcgtgggatgctggtcctttgtcatttgttgcacatttttccacccttttgcttttttttttttctttwttttttttttttttgagatgtagtctctctgttgcccaggctggagtatagtggcccaatcttggctcactgcaacttctgcctccagggttcaagcgattctcctgcctcagcctccagcgtagctgggattacaggcgtgtgctaccacgcctggctaattttttgcatttttagtagagacagggtttcaccatgttggccaggctggtctcaaactcctgacccccacgtgatctgcccaccttggtctcccaaaagtgctgggattacaggtgtgagccattgtgcccggcctgc

SEQ ID NO: 138619 - DNA, 601 bp, Human
ctgggatgacaggtgtgagccactgcacccagtctctactgaagttttagaaatatttagcttgtcaaactatcagtttctttgtgtttggcctttggtagtacggttagaaagtttatttttcctaatcagttatgtaagcctcatttattggatgatttagtggcctctcccctacttgaaatgccattttaaatctatattaaatattcaaatatattagcctttgcttttagattttttatcctgttccattgacctatctgtatgctcttttttctgggtcatttcgtttgtttgttttttttttttttttgagatggagtctcgctctgtcacccaggctggagtgcagtggcgtgttcttggcttactgcaacctccgcctcccaggttcaagagattctcctgcctcagcctcccgagtagcatgtgccaccacgcctggctaatttttgtatttttagtagagaacggttttcatcatgttggccaggatagtctcgaactcctgacctcaagcagtctgcccgccttggcctcccaaagtgctggaattagaggcgtgagccaccacgcctggcctgggtcattttgtttg

SEQ ID NO: 138620 - DNA, 601 bp, Human
ggcatcctttcctcttattttcttgatggttttgtagcccgttcattaatgcggatgaactccggaattattttatcactctccaccctttggaattctattaaattcacaaattcatgtaggggagaagtctttctaagatttaattttcatgtctaagatcatggtattatgtctctaattattcacatcttttgtgttcctcagtgaaggttggtgattttctttagatgattcctggagacttttttttaggtttatttctaggtatgttttgtcttttattgctcttgtgaaactmtttgttatgtgttctaactagttattgctgatgtctagtgaagatatgttttgtatactgtttttgtaaatggcaacactgtaatggaatatgtatgtgtaaacatacatttcttaacatctttatagggatataattacatactatagagttcactcttctaaatatacattttagtgttagtgtattagtgtattacagagttgtgtaactatcactaccacaatctaggcattttcatcatctgaagcaacccaactcccatcaacaattccttcccattctctgcttccgcagtaa

SEQ ID NO: 138621 - DNA, 601 bp, Human
ttgtgattggttggaatatctttttccttttgcttacgtttaacctagctatgtctttttgtttgtttttgttttttaagagacagggttttgggccaggtgcggtgggctcacacctgtaatcccatcactttgggaggccgaggtgggtggatcacctgaggtcaggagttcgagaccagcctggccaacatggtgaaaccccgtctctactaaaaatacaaaaattagccaggcgtggtgacgcgtgcctgtaattccagctacttgggaatctgagggaggagaatagcctgaaccygggaggtggaggttgcagtgagctgagatcacgccactgcactccagcctgggggacagagcaagactctgtctcaaaaaaaaagaaaaaaaagagacgggttttgctctgttgcccaggctggagtgcaatagtaggatcatagctcattgccgccttgaaattctggcttcaaatgatcctcccaccttggtctcccaaagtgctgggaaaacaggcatgagccaccacacctggccggcctcaatgtcatgttgatgttcacttttacagtaaatgtttcctatgtttttccctaga

SEQ ID NO: 138622 - DNA, 601 bp, Human
ggctcacacctgtaatcccatcactttgggaggccgaggtgggtggatcacctgaggtcaggagttcgagaccagcctggccaacatggtgaaaccccgtctctactaaaaatacaaaaattagccaggcgtggtgacgcgtgcctgtaattccagctacttgggaatctgagggaggagaatagcctgaacccgggaggtggaggttgcagtgagctgagatcacgccactgcactccagcctgggggacagagcaagactctgtctcaaaaaaaaagaaaaaaaagagacgggttttgstctgttgcccaggctggagtgcaatagtaggatcatagctcattgccgccttgaaattctggcttcaaatgatcctcccaccttggtctcccaaagtgctgggaaaacaggcatgagccaccacacctggccggcctcaatgtcatgttgatgttcacttttacagtaaatgtttcctatgtttttccctagaatggatgatgaacttgttgttggacatagtgcaagatcagacatctccagcttcccttgtacatctggcttttaaatttctttacatcatctccaaggtaacatttc

SEQ ID NO: 138623 - DNA, 601 bp, Human
ttgcgggtgtctgctcatagtctgcttttcttacaagcttgcgggtgtctgtgtgctcatagtctgcttttcttacaagcttgcgggtgtctgtgtgctcatagtctgcttttcttacaagcttgcgggtgtctgtgctcatagtctgcttttcttacaagcttgcgggtgtctgtgtgctcatagtctgcttttcttacaagcttgcgggtgtctgtgtgctcatagtctgcttttcttacaagcttgcgggtgtctgtgctcatagtctgcttttcttacaagcttgcgggtgtctgtgctcatagtctgcttttcttacaagcttgcgggtgtctgtgtgctcatagtctgcttttcttacaagcttgcgggtgtctgtgtgctcatagtctgcttttcttacaagcttgcgggtgtctgtgtgctggcccagaggctcactgttggcagttttgactatggaagtactcacagccgtctcagggtggggcttggggttcgtagtggcgaggcgcatttctgttgtctggcgggaaagtccttggccggcgagaggacactgcgggtgggctgccaaggacacgcaggcctctgtagc

SEQ ID NO: 138624 - DNA, 601 bp, Human
cttgcgggtgtctgtgtgctcatagtctgcttttcttacaagcttgcgggtgtctgtgtgctcatagtctgcttttcttacaagcttgcgggtgtctgtgctcatagtctgcttttcttacaagcttgcgggtgtctgtgctcatagtctgcttttcttacaagcttgcgggtgtctgtgtgctcatagtctgcttttcttacaagcttgcgggtgtctgtgtgctcatagtctgcttttcttacaagcttgcgggtgtctgtgtgctggcccagaggctcactgttggcagttttgactrtggaagtactcacagccgtctcagggtggggcttggggttcgtagtggcgaggcgcatttctgttgtctggcgggaaagtccttggccggcgagaggacactgcgggtgggctgccaaggacacgcaggcctctgtagctccgctgtgtgaggttaggatttctccggaaggcgtggtatcactgagcttcagggaagtgttaatgaatttgggcccttgcggtttgtaggcacttattcctcataaatgtcagaggacagtcatataaatgaacatatttaatgactgattccgtaaat

SEQ ID NO: 138625 - DNA, 601 bp, Human
gggtgtctgtgctcatagtctgcttttcttacaagcttgcgggtgtctgtgctcatagtctgcttttcttacaagcttgcgggtgtctgtgtgctcatagtctgcttttcttacaagcttgcgggtgtctgtgtgctcatagtctgcttttcttacaagcttgcgggtgtctgtgtgctggcccagaggctcactgttggcagttttgactatggaagtactcacagccgtctcagggtggggcttggggttcgtagtggcgaggcgcatttctgttgtctggcgggaaagtccttggccrgcgagaggacactgcgggtgggctgccaaggacacgcaggcctctgtagctccgctgtgtgaggttaggatttctccggaaggcgtggtatcactgagcttcagggaagtgttaatgaatttgggcccttgcggtttgtaggcacttattcctcataaatgtcagaggacagtcatataaatgaacatatttaatgactgattccgtaaatatggtaatgaataacactaccaatttaggaaggaaatctttttttttgagagatggggtcttgctctgtcactcaggctagagtgcagt

SEQ ID NO: 138626 - DNA, 601 bp, Human
gcttttcttacaagcttgcgggtgtctgtgctcatagtctgcttttcttacaagcttgcgggtgtctgtgtgctcatagtctgcttttcttacaagcttgcgggtgtctgtgtgctcatagtctgcttttcttacaagcttgcgggtgtctgtgtgctggcccagaggctcactgttggcagttttgactatggaagtactcacagccgtctcagggtggggcttggggttcgtagtggcgaggcgcatttctgttgtctggcgggaaagtccttggccggcgagaggacactgcgggtgrgctgccaaggacacgcaggcctctgtagctccgctgtgtgaggttaggatttctccggaaggcgtggtatcactgagcttcagggaagtgttaatgaatttgggcccttgcggtttgtaggcacttattcctcataaatgtcagaggacagtcatataaatgaacatatttaatgactgattccgtaaatatggtaatgaataacactaccaatttaggaaggaaatctttttttttgagagatggggtcttgctctgtcactcaggctagagtgcagtgatgcagtcagctcactgcag

SEQ ID NO: 138627 - DNA, 601 bp, Human
atagtctgcttttcttacaagcttgcgggtgtctgtgtgctcatagtctgcttttcttacaagcttgcgggtgtctgtgtgctcatagtctgcttttcttacaagcttgcgggtgtctgtgtgctggcccagaggctcactgttggcagttttgactatggaagtactcacagccgtctcagggtggggcttggggttcgtagtggcgaggcgcatttctgttgtctggcgggaaagtccttggccggcgagaggacactgcgggtgggctgccaaggacacgcaggcctctgtagctcckctgtgtgaggttaggatttctccggaaggcgtggtatcactgagcttcagggaagtgttaatgaatttgggcccttgcggtttgtaggcacttattcctcataaatgtcagaggacagtcatataaatgaacatatttaatgactgattccgtaaatatggtaatgaataacactaccaatttaggaaggaaatctttttttttgagagatggggtcttgctctgtcactcaggctagagtgcagtgatgcagtcagctcactgcagcctcgaactcttggtctcaaatgattctccctc

SEQ ID NO: 138628 - DNA, 601 bp, Human
ctgcttttcttacaagcttgcgggtgtctgtgtgctcatagtctgcttttcttacaagcttgcgggtgtctgtgtgctcatagtctgcttttcttacaagcttgcgggtgtctgtgtgctggcccagaggctcactgttggcagttttgactatggaagtactcacagccgtctcagggtggggcttggggttcgtagtggcgaggcgcatttctgttgtctggcgggaaagtccttggccggcgagaggacactgcgggtgggctgccaaggacacgcaggcctctgtagctccgctgtktgaggttaggatttctccggaaggcgtggtatcactgagcttcagggaagtgttaatgaatttgggcccttgcggtttgtaggcacttattcctcataaatgtcagaggacagtcatataaatgaacatatttaatgactgattccgtaaatatggtaatgaataacactaccaatttaggaaggaaatctttttttttgagagatggggtcttgctctgtcactcaggctagagtgcagtgatgcagtcagctcactgcagcctcgaactcttggtctcaaatgattctccctcctgcc

SEQ ID NO: 138629 - DNA, 601 bp, Human
ggggtctggccacatggacacctctgcctggcacgaaacgaaattccagacccccagcaggaaagcaggtgccagcgtaaagcacacggtttgtgcagattgagccagcgagggacctcatcaggcagggcttggtgggaaccctgctggtgtccaggtccctggataccagcccagggccggcctcgtcaggggccttgcctcagacggcagcggggcctgctatgctcgctgtcttctgcgtggtatgtatttggaggagcacacggtttataaccgtgcagtgcggtggcttgtctckgcgtggatgtgactgatgagcgctgtggggcatttccctgctgccctgcactccgtgcccttctttccctagtacttctagcgccccccagtggaatgattgcagggacaaattgggatgttttttactaattactgaaaataagggtactccttttttattagaagttgataattgttttctttattcttttttttttaaaaagacagagtttcactcttcttgcccaggttggagagcaatggcacaatcttggctcactgcaacctctgtctcccaggttcaagcgattctcctgtg

SEQ ID NO: 138630 - DNA, 601 bp, Human
tgtttttcactttttcaaaaggccagtttgtatgtggagaggtgccagcgaagagaagctgctatactgatgtattatgatttttctttgttcattttgatgtctctcttgtctgctgagctaagttacggcggtaggtgtgtgtggtggggattccgggggggatgtggcgaggagttggtgaacggcttgcatttctggccctgagggtgatggcatttgaatggctttcataggcattgggtgggcatggagggcagtgactttgagtagattgtggccagtggcctgtgattttcargcaagactcattcttcccgtggtttaattttttaggcttgggaaacccgctacatgcttttgctctggctctccgtgacctgcctgatcccttttgatttttctcgccttgacgggaacctcctcacccagcctgggcaagcacgaatgtccataatggaccgtattctccaaatagcagaggtaaatatcatgcagataattagctgctaattagtactcactttcatgttcatgctgtcttgatgttagtggtttactcggtaagcttctgatatgtattcaactgctgtttttttca

SEQ ID NO: 138631 - DNA, 601 bp, Human
aataaagataagcaagaaaaatactaaatttaaatttatgaaattctagtgccaagagataagttgtttattttctccgaacttttcctgatgtaaatattatgcatataaacacagcttattgtattagttatctattggatcataactaattaccccaaacttgagtgtttgacacacatttatcctcttgtagtttctgtgggtcgggagtctggcatggctgagctgggtcctttgtgtcaagcttgcccacagctgcagttaaaactcgacatgggcaggctttgccccaaggccrttggattgaggccaccctcagttctttgccacctgggcccctccaacttagtgacttattccatcaaagcctgcaagggagaaactctgctaatgagatggaagtcatgataatatgttacctgatcatggaagtgacgtcccattcctctgccagatcctgtggttagcagcaagtcaccgagtccagcctacgcaagcgagcactaggaggctgtcaggctctgagccatctcagttgtctcggtcttcctgccacgctgactgcgacagccctggtcagcattcactgagtgcctgc

SEQ ID NO: 138632 - DNA, 601 bp, Human
aatttaacctatacattgggctgggcatggtgggtcactcctgtaatcccagcactttgggaggccggggcgggcagatcacgtgaggttaggacttcgagaccagcctggccaacatggtgaaaccctgtgtctactaaaaatacaaaaattagctgggcctggtgacacatacctgtaatcccagctactcaagaggctgaggcagaagaatcccttgaacctgggaggtggagattgtagtgaactgagattacgccactgcactccagcctgggtgacagagcgagagtccatctcaaaaaaaaaaaaaaaaaatttaacctatacgttgatgattgatagatcatcagtgattaattaactgtgattaataatcattgaattctccttcatgaggctgttgacaattcttaccctcgtttaaccgagaaggcaacaggcataaaaattaataacttagtttactttgctcataaatggtggatccatgtttgaatccaggcggtttatctggagtctgtgctcttcatcagggctcagcattgccccatgacctgctgttctgagtcctttttaccctcagcaacacgttcttagt

SEQ ID NO: 138633 - DNA, 601 bp, Human
tttaacctatacgttgatgattgatagatcatcagtgattaattaactgtgattaataatcattgaattctccttcatgaggctgttgacaattcttaccctcgtttaaccgagaaggcaacaggcataaaaattaataacttagtttactttgctcataaatggtggatccatgtttgaatccaggcggtttatctggagtctgtgctcttcatcagggctcagcattgccccatgacctgctgttctgagtcctttttaccctcagcaacacgttcttagtgtcttacgatgtcagaargtgtccccctcataatcgttaagggaaaaggtactccattgtaatctaatttaaaattctctctgatagatggatgttttgtttgttcttgttttgttacgttagaggtagtgtggtgatgggctgggtgcggtggctcacgcctgtaatcccagcactctgggaggccaaggtgggcatatcacctgaggtcaggaattcgagaccagcctgaccaacatggagaaaccttgtctctactaaaaatacaacattagctgggcgtggtggcacgtgcctgtagtcccagctactcaggag

SEQ ID NO: 138634 - DNA, 601 bp, Human
gctcacacctgtaatcccagcactttgggaggccgaggcaggtggatcacgaggtcaggagtttaagaccagcctggacaagatggtgaaaccccatctctactaaaaatacaaaaattagccgggaatggtggctagtgcctgtgatcctttcatatttattcaactgttctcttacaaatgaacagctacttgggaggctgaggcagagaattgcttgaacccgggaagcagaggttgcagtgagccaagattgcaccactgcactctagcctgggcagcagagcaagactccgtctcaaaaaaaaaaaaaaaaaaaaagcctgccccagaaaaaaagatcttctaagtgtatcgttatgggaaaaaacaaacaaacaaacaaaaaaaaccgagacaagcattggaaacattttaaggcagccctccgaaaaataaatctagctgggcgtggaggtttcatgcctgtaattccagcactttgggaggccagggtgggaggatagcttgagcccaggagtttgagagcagcctagacaatataatgtgactcagtctctaccaaaaaataaaagaaaattagccaggtgtggtggtacac

SEQ ID NO: 138635 - DNA, 435 bp, Human
tagtggtctaatctcaactcactgcagcctctgcctttgaggctcaagcaatcctcccacctcagcctcctgagtagctgggattacaggcatgtgccatcatgcctggccaatttttgtgtcattagtagagayggggttttaccatattgaccaggctggtctcaaactcctgacctcaggtgatccgcctgccccagcctctcaaagtgctgggattacaggcgtgagccgcagtgcccagcctacagtgagctttgctcacaccactgtactccagcctgggtgacagagcgagacccggtctcaaaacaacagcaaaaaaaccctaagaccagctactggggaggctgaggcaggagaatggcgtgaacctgggaggcggagcttgcagtgagccgagatcgcgccacggccctccagcctgggcgacag

SEQ ID NO: 138636 - DNA, 533 bp, Human
tagtggtctaatctcaactcactgcagcctctgcctttgaggctcaagcaatcctcccacctcagcctcctgagtagctgggattacaggcatgtgccatcatgcctggccaatttttgtgtcattagtagagatggggttttaccatattgaccaggctggtctcaaactcctgacctcaggtgatccgcctgccccagcctctcaaagtgctgggattacaggcgtgagcygcagtgcccagcctacagtgagctttgctcacaccactgtactccagcctgggtgacagagcgagacccggtctcaaaacaacagcaaaaaaaccctaagaccagctactggggaggctgaggcaggagaatggcgtgaacctgggaggcggagcttgcagtgagccgagatcgcgccacggccctccagcctgggcgacagagcaagactccgtctcaaaaaaaaaaacaaaaacaaaaacaaaaaatatatacacctactatgtaccccaaaaattaaacactaaaaattaaaaataa

SEQ ID NO: 138637 - DNA, 601 bp, Human
tgaagagaggtttttttttgcagctttggacttaggcctgtgctggtaaggtttgtgaacctgggccctcggggagctggtgagggtgggactggtgactgtgtggtgtccccaaggctggcgtgtgcaggagtgaccgtgtctgtgcttcaccctttcttgcagtcctacttgattgtcagtgacaaggcccgagatgcagctgctgtccttgtgtccaggtaagtttccatggcacatttcttggtgtgtggctggtgggttctgagaggggtttgtttgggtacgtgtttcatgtgcrtcttcagtcctcagacgaaggaccccgggaagtctttggactctgtggctttctctgagggagcgtgcagcagtgtttgggcacagaagacctctgaccctgaaatgaccaccctcagtggtggtttggggtgctggtgggggtcacctgacaggcccatcgacaggagtgcaggtctggaagaggcgtggctgtcatccctggggtgcagcccctgcacagggatggggtggcagttatgagaaacatctcgggccgtctcccatggagatgatgggtggtgttgggcctctgtgactg

SEQ ID NO: 138638 - DNA, 601 bp, Human
gccctcggggagctggtgagggtgggactggtgactgtgtggtgtccccaaggctggcgtgtgcaggagtgaccgtgtctgtgcttcaccctttcttgcagtcctacttgattgtcagtgacaaggcccgagatgcagctgctgtccttgtgtccaggtaagtttccatggcacatttcttggtgtgtggctggtgggttctgagaggggtttgtttgggtacgtgtttcatgtgcgtcttcagtcctcagacgaaggaccccgggaagtctttggactctgtggctttctctgagggagygtgcagcagtgtttgggcacagaagacctctgaccctgaaatgaccaccctcagtggtggtttggggtgctggtgggggtcacctgacaggcccatcgacaggagtgcaggtctggaagaggcgtggctgtcatccctggggtgcagcccctgcacagggatggggtggcagttatgagaaacatctcgggccgtctcccatggagatgatgggtggtgttgggcctctgtgactggggatgaaaatcccccaacgtcctgtattaactgcaccccccgtgtgccccagacaggggaagg

SEQ ID NO: 138639 - DNA, 601 bp, Human
caccccccgtgtgccccagacaggggaaggtggttttctctgctgagcgcagcaggcctgcggtgttggaaagataccaaggatgtgtgtatagactgagcgaacctgtttcatgagatgcaagaaggaagaaagcaatatttctaatcagtattttacatgacatgtgattttaagtatgtatgtagtttactaagtcagaacagttgacattttccccctctgcaatagtgaaagtcgaaagctggtcctaaaacctttcggtggttgtggttgggaatacggtcagtgcctcatgcarcgtcaccttcactcgggtgtgtagctgcaacttgcacagcttctttcccagagaagtgggaggagagaagcttcctttgtggggcagttggaggcattggatgaggggtttgtgacagcctggagctgaggaaggaacgcctgagtcccctggagcaggtgaggcccctcccgagagggcagaggctgcttcctgtcttgtcaaggacataaaaagatgatcgtctaattattaaagtaatctgtatatatttagataatagagcatgaagtacaaaataaaacctttgaatgctttcat

SEQ ID NO: 138640 - DNA, 601 bp, Human
ctcactttgtctcccaggctggagtgcagtggcacgatctcggctcactgcaagctctgcctcccggtttcacaccattctcctgcctcagcctcccgagtagctgggactacaggtgcccgccaccatgctcagctaatttttttttgtattttcagtagagatggggtttcactgtgttagccaggatggtctccatctcctgacctcatgatccgcccacctcggcctcccaaagtgctgagattacaggtgtgagccaccgcgcctggcccgagtgtgtctttttttttttttttttaatttttttagtatttattgatcattcttgggtgtttctcagagagggggatttggcagggtcataggacaatagtggagggaaggtcgcagataaacatgtgaacaaaggtctctggttttcctaggcagaggaccctgcggccttccgcagtgtttttgtccctgggtacttgagatcagggagtggtgatgactcttaaggagcatgctgccttcaagcatctgtttaacaaagcacatcttgcaccgcccttaatccatttacccctgagtggacacagcacatgtttcagagagc

SEQ ID NO: 138641 - DNA, 601 bp, Human
tcccttgattaactgagcttgccaacatccacagcgctgtaggtggtgcttggtgttacagtgttgctaaaacatgcagattgagtgctgccttagaaacccacaggaaggggaacatcacactctggggactgttgtggggtggggggaggggggagggatagcattgggagatatacctaatgctagatgacgagttagtgggtgcagcacaccagcatggcacatgtatacgtatgtaactaacttgcacaatgtgcacatgtaccctaaaacttaaagtataataataaaaaaattwaaaaaaaacccctttaatagatatgcctttcgccaggcacggtggctcatgcctgtaatcccagcactttgggaggctgaggcgggtggatcacctgaggtcaggagttcaagaccagcctggccaacatggtgaaaccctgtctccactaaaaatacaaaaaaattagctgggcatggtggtgcgtgcctctaattccagatacttgggaagctgaggcaggacaatcgcttgagcccaggaggcagaggttgcagtgagcagagatcgcaccattgcactccagcctgggcaacagag

SEQ ID NO: 138642 - DNA, 601 bp, Human
cttagagatggacttctgggttccaggacacgagagtggtgttggggtctgcacacctggtggctctcagctgctctctgagcagtgctttggtggccgaggcagccccaggaacaccccacccccaaattggattaaacatggtgtcgctgattgcaggtatttaattggcatcacgctgattgccctcaccttaggtgttacatactccgcttcgtgacctgactctgcgtgtctgtgggctccttggggccttttcttccccacgagtgtgagtttcctccggtgaagggcgatgggkattgccccaggtggttgttggccttttcctttttttttggaccaaagttttaattttaatgtcaaaccgtttttttctcctttatttagttatttttacttttaagcctgcagtcttattaagagatttaacaagtagtcatttatatttttctctaccgtttattaagacagaattattgattcatttggggtttcttttggtctacagtagaaccccgcccttcccagtaggtaaccagttgctttagtgccattttgtgtctgtagggaccagcaccacaaggtcggtgggtttctc

SEQ ID NO: 138643 - DNA, 601 bp, Human
cctgcagtcttattaagagatttaacaagtagtcatttatatttttctctaccgtttattaagacagaattattgattcatttggggtttcttttggtctacagtagaaccccgcccttcccagtaggtaaccagttgctttagtgccattttgtgtctgtagggaccagcaccacaaggtcggtgggtttctccctgtgtgtggagatgagagagtgtagaaataaagacacaagacaaagagataaaagacagctgggcccgggggacaactaccaccaagttgcagagaccggtagcrgccccgaatgccaggctgcactgatattattggatacaagacaaaggggcagtgtaaggaatgtgagccatctccaacggtaggtaaggtcacgtgggtcacgtgtccactggacggggggcccttccctgcctggcagccgaggcagagagagagagaggagaaggagataaacagcttacattattatttctgcttatcagagacttttcactaatttgctactgctaactaaacggcagagccaggtgtacaggatggaacgtgaaggcagactaggagcgtgaccactgaagcaca

SEQ ID NO: 138644 - DNA, 601 bp, Human
tatatttttctctaccgtttattaagacagaattattgattcatttggggtttcttttggtctacagtagaaccccgcccttcccagtaggtaaccagttgctttagtgccattttgtgtctgtagggaccagcaccacaaggtcggtgggtttctccctgtgtgtggagatgagagagtgtagaaataaagacacaagacaaagagataaaagacagctgggcccgggggacaactaccaccaagttgcagagaccggtagcggccccgaatgccaggctgcactgatattattggatasaagacaaaggggcagtgtaaggaatgtgagccatctccaacggtaggtaaggtcacgtgggtcacgtgtccactggacggggggcccttccctgcctggcagccgaggcagagagagagagaggagaaggagataaacagcttacattattatttctgcttatcagagacttttcactaatttgctactgctaactaaacggcagagccaggtgtacaggatggaacgtgaaggcagactaggagcgtgaccactgaagcacagcatcacagggagacggttaggcctccggataactgc

SEQ ID NO: 138645 - DNA, 601 bp, Human
tttggtctacagtagaaccccgcccttcccagtaggtaaccagttgctttagtgccattttgtgtctgtagggaccagcaccacaaggtcggtgggtttctccctgtgtgtggagatgagagagtgtagaaataaagacacaagacaaagagataaaagacagctgggcccgggggacaactaccaccaagttgcagagaccggtagcggccccgaatgccaggctgcactgatattattggatacaagacaaaggggcagtgtaaggaatgtgagccatctccaacggtaggtaaggtcwcgtgggtcacgtgtccactggacggggggcccttccctgcctggcagccgaggcagagagagagagaggagaaggagataaacagcttacattattatttctgcttatcagagacttttcactaatttgctactgctaactaaacggcagagccaggtgtacaggatggaacgtgaaggcagactaggagcgtgaccactgaagcacagcatcacagggagacggttaggcctccggataactgcgggcgagcctgactgatgtcaggccctccacaggaggtggaggagtagagtcttc

SEQ ID NO: 138646 - DNA, 601 bp, Human
gcccttccctgcctggcagccgaggcagagagagagagaggagaaggagataaacagcttacattattatttctgcttatcagagacttttcactaatttgctactgctaactaaacggcagagccaggtgtacaggatggaacgtgaaggcagactaggagcgtgaccactgaagcacagcatcacagggagacggttaggcctccggataactgcgggcgagcctgactgatgtcaggccctccacaggaggtggaggagtagagtcttctctaaactcccccggggaaagggagactttttcccggtccgctaagtagcgggtgtttttccttgacactaacgctaccgctagaccacggtccgcttgtcaacaggcgtcttcccagacgctggcgttaccgctagaccaaggagccctctggtggccctgtctgggcataacagaaggctcgcactcttgtcttctggtcacacctcactatgtcccctcagctcctatctctgtatggcctggcttttcctaggttatgattatagagcgaggattattataatattggaataaagaataattgctaccaactaatgattaatgat

SEQ ID NO: 138647 - DNA, 601 bp, Human
ggagccccacctgttgccagcagagggcagtggtgccacgcagcccgggctccccagggtaggtttctctgcatctgggctgcttagttcctgtttaagtgcagagactgaacgagctctaataaaacaaggtgggtgagttgaaatttgattctgttcctttgcactgggctcgggttggatgttcctgactgcttcgttgggacacagaccctggcctctgcctgcaggtgcctggttagtgccctggctgcagccctttgccagccctttccctgccctttcgctctgattgtctcttgtgttaccttttcttgtgctaacgaggaggaaaggtcaagtctcagaagagggcaaagcctcttttgggtcagcgtcctggaggctgcagctccctggtcagccttctggagggggagccggcagccggctgtggcctttggcgtggtgggttcagcgccttcttctctctttaattacagcgggtgaggctttgagagcacttctcatccttgtctcacgctgtggagcctgtggtccctctgaggagcggggcactttgttcttgtttaaaaaatatattttatagagacagggtctt

SEQ ID NO: 138648 - DNA, 601 bp, Human
ccatgctgtgtgactgagaccactggatcccacccatcgcagcgggaggggggtccatgctgtgtgactgggaccactggaccccacccatcgcagcgggaggggggtccatgctgtgtgactgggaccactggatcccacccatcgcagcgacagggggtccatgctgtgtgactgagaccactggatcccacccatcgcagcgggaggggggtccatgctgtgtgactgggaccactggacccgacccatcgcagcgggaggggggtccatgctgtgtgactgggaccactggatcccrcccatcgcagcgggaggggggtccatgctgtgtgactgggaccactggacccgacccatcgcagcgggaggggggtccatgctgtgtgactgggaccactggacccgacccatcgcagtgggagggggtccatgctgtgactgggaccacctggcctgaggttggactggtgaaatgacaatgttggcacctacatgtgtgtcaggatccatgtggatatgtcccgcacacctgcttcttggaatattgtgtaagcagctcttcagcttcacggccttcatgatcgtgttctgggtgggg

SEQ ID NO: 138649 - DNA, 601 bp, Human
cctctaaggcagatgtccctcaggctttggtcctggctgttgatatctcagctctgattcacccttgacctttattacctgatttctgtccttggttctcgagccctccttctgtggacccgttgggtacacgtgtgacacttcagaacccgcaagtcccaggtcacacctgttgtaccatcactttcccctcctggcctgtttacccgggagcccagcaacaaatgggagcttctgtgctgctgtccgtgcatacggcccaggagccgggctcatccccgagacgccgtgttccctcccrctgtccgctcacacctgcctgtgtggacgtggctctgacatgtctccttcctggttcattgctcatctgttctcatgtggctgcgccgccaccctgtcctgggggtccttgtcccagcacgtggctctgtgcttcacgtcatcctgagtctgtcccgctctgccgcctggtccaggtgggagccatttccttctgtgaagtgttccctctggaggccctgggctccccgactaccctcccgcctctcctgtggctgtcggctgcagtaaaggtgctggtggagggtgtgagccatccatt

SEQ ID NO: 138650 - DNA, 601 bp, Human
agtgccagactctgtcccatgctgcctctgtgcccttgatcctggcagcacacctgctgtcctgtggcctgcgtaaagggtggcctcggaagcctgtggcctgggtaaagcgtggcctcggaagcttgtggcctgggtagtgggtggcctcatcttggcctcggaagcaggagggctcaggctgtggcccacgcctggggttccccatccccccgtgtgtcctggtgtctttgcttggctcgccggcctccatgggctccccaggtggcaggtggctctcagccatgctctccgtcctcaygcttgtttctgccctggcagagctgctcagtggccagcccgtgggacccctgtgcaccctgccgcccccagcatatgtcagcagcgccgtccgggggagatgtggcatcagcacagccttgtccttgtctctgcccgttcttccttccttgcctctatgtgtctgcttttttctcttccacatggtgtccacagtggataaccacatccactggcctcctggttggtggatcctcctcctgctgggctcagagctgtgccacccccacctgcactgcagagaagctcagacccctctctg

SEQ ID NO: 138651 - DNA, 601 bp, Human
tgagaacttgttttgggcaaacaaggatcatctccattcacttggtagggaacgtgttactatccatttcgctaaagagaaaggggctaagtctctgatcaccttggtgaatgtgttattctgagtggctcagggaggtgggtgctgccactgccccattttacagacagaggaacaggagcgcagagaccctgctctgctccacaggcgtgactggtggtctgtctggctgtctccttcccgttttgatcgtaggtgtgggatctgcaccacaggtgtgactggtggtctgtgtgccttygctgcttctccactcagcgcttaggagagccccccagcgggctccatggagagagtctaagttccctctccttttaagaagatgtttctattctacacttaagtaagagatcaggcagtttacagggttcataatgcaaataaaagacaccagtatttagtgaaagcctcttcaccttgtctgagcatctcctgatgggcggcacctgcttcttcatttttccgtgtggtgggcgacagcaggacaggggtggcgtggtgtgcggtgcagatagtctgagacagatgcagttctcacctt

SEQ ID NO: 138652 - DNA, 601 bp, Human
attctgttttctgaaggaaaggaaattcattcgcgttttcttagaagggctcagttctaggattcttcgattatgaggcttggatatttatgtgaatcatcgcatttgtcctccagactttaaagcagaaggtaaaacctcaggttgagaattcaggagggctagaaccagtgtttgagagaaaatctgatattcctgtttggtctgatggactccaggtgatgacgtccgtgtgtgcgcatcgtggggaccgggctgccaggtgtgtgtgtgagacacgggctgagctggtcacccttckcatttgttggtgaagcatgaatgcagatggaggcctttgtgtgaggtggtttggcctgtaacttttatcctttgtaactttatttatacgcagataatttttaaaaacctactgagatatcttctttttccaggctagtagtgccctgaacttaaacctgggcacgttttgtgatgccattgatgagggaggggtggagaggctgcagtctccatgaggggactggacttatcattgcatccctattttcagatgaatttttgggagatgatttcactagtctcttataattactttatc

SEQ ID NO: 138653 - DNA, 601 bp, Human
ggcagtgtttttctccacgcagaggtttaccatctggaaaaagagaaacttcttagagcctttgtgtgttttagaagctatccggactgggcgttgtggctcacgcctgtaatcccagcgctttgggaggctgaggcgggtggatcacgaggtcaggagatcgagaccagcctggccaacatagtgaaaccccatctctactaaaaatacaaaaattagctgggcatggtggcacatgcctgtaatcccagctactcgggaggcggaggcaggagaatcccttgagccagggagttggagrttgcagtgagctgagatcgcgccacagcactctagcctggcgacagagcaagactctgtctcaaaaaaaaaaaaaaaaaaaaaagaaactatccgaatatcaaatttgaataactttctttttttgaaagtttttcattatggaaaatttgaaacatgtataaagaagagagaatggcgtgcacgccccgtgtctctctcaggagtgtgcgagttttcgtgtgcagcctgtttcatccctgcaccgcacaggagggacacacagtgccatctcacctgtgtgcacttccatacatgtctc

SEQ ID NO: 138654 - DNA, 601 bp, Human
gagccagggagttggaggttgcagtgagctgagatcgcgccacagcactctagcctggcgacagagcaagactctgtctcaaaaaaaaaaaaaaaaaaaaaagaaactatccgaatatcaaatttgaataactttctttttttgaaagtttttcattatggaaaatttgaaacatgtataaagaagagagaatggcgtgcacgccccgtgtctctctcaggagtgtgcgagttttcgtgtgcagcctgtttcatccctgcaccgcacaggagggacacacagtgccatctcacctgtgtgyacttccatacatgtctctggaaggtggggctctttatgtcctcaccacacccgagaacgcgagcagccgttgccaggccctgtcggcgggaggagcgtccttggtgacgtgaacacagacctccctcttgggctgtcgtgcttgtcacccacgctcattgtgcccactgtcagagccttctgagaagttactcagatgctctttcagctgacctggttttataggcaagcattatgagttaaacggcacctctgcccgaggtcacggcacccacataaaactggtgaacgttcactttct

SEQ ID NO: 138655 - DNA, 601 bp, Human
tgacctggttttataggcaagcattatgagttaaacggcacctctgcccgaggtcacggcacccacataaaactggtgaacgttcactttctgtcatttcccagcctcaaggcagagcttcctgcagggcactgcagctccagcccccatccccctgctctgtccccgccccactgccccttcctccatctccttgtcttccatcacctcacctaactctcagctctgtcttcagcttctcttcttttctcctgtcccctgtcagttggttgcagtcttgtccatttcacttccagcccayctctgaagccgccatgcacttccaccccagcccttgtctgtcccgggaatgctgtcctcctggcctcagcttgccctcgtcgcagcacccgggcgtctcctgctcgcaggctctccctgtcgtgctgtgcccagtgctaccttgagcctccccttggctcagcctcctgtcctgctattgtcatcactgcatgacaccgagtgattccccctgaaaaacagagcaagccacaggaaccccgtggcctgtgtgttctccccagccgcagtgtgctccatggcttctggggttgctgcagtg

SEQ ID NO: 138656 - DNA, 601 bp, Human
ctgtcatttcccagcctcaaggcagagcttcctgcagggcactgcagctccagcccccatccccctgctctgtccccgccccactgccccttcctccatctccttgtcttccatcacctcacctaactctcagctctgtcttcagcttctcttcttttctcctgtcccctgtcagttggttgcagtcttgtccatttcacttccagcccatctctgaagccgccatgcacttccaccccagcccttgtctgtcccgggaatgctgtcctcctggcctcagcttgccctcgtcgcagcaccygggcgtctcctgctcgcaggctctccctgtcgtgctgtgcccagtgctaccttgagcctccccttggctcagcctcctgtcctgctattgtcatcactgcatgacaccgagtgattccccctgaaaaacagagcaagccacaggaaccccgtggcctgtgtgttctccccagccgcagtgtgctccatggcttctggggttgctgcagtgtgccctgtggcctgtgtgttctccccggccacagcatgcccgtggcctgcgtggtctctgtggccgcaggatgcccgtggcctgtggggt

SEQ ID NO: 138657 - DNA, 601 bp, Human
cccctgctctgtccccgccccactgccccttcctccatctccttgtcttccatcacctcacctaactctcagctctgtcttcagcttctcttcttttctcctgtcccctgtcagttggttgcagtcttgtccatttcacttccagcccatctctgaagccgccatgcacttccaccccagcccttgtctgtcccgggaatgctgtcctcctggcctcagcttgccctcgtcgcagcacccgggcgtctcctgctcgcaggctctccctgtcgtgctgtgcccagtgctaccttgagcctcyccttggctcagcctcctgtcctgctattgtcatcactgcatgacaccgagtgattccccctgaaaaacagagcaagccacaggaaccccgtggcctgtgtgttctccccagccgcagtgtgctccatggcttctggggttgctgcagtgtgccctgtggcctgtgtgttctccccggccacagcatgcccgtggcctgcgtggtctctgtggccgcaggatgcccgtggcctgtggggtctccgtggctgcagtgtgcctgtggtcggttgggcctttgtgtgtgctgccccccttcaga

SEQ ID NO: 138658 - DNA, 601 bp, Human
ggggctgaccccccacctccctcccggactgggcggctggccgggcgggggctgagacaggctccctttcaaagactgttggagaaagtgaaaccgcctttcttgctggcagaaatgatgtcttagcagtctgtagcggccggtgtgaacgggttggttctcaaggagacagacttttctagtgttcttagggtgctgtgtgttagcgaccttcagtttgtttcaagtgctataatacgtgtggtttgggaaggaattacttggttaaggtcagctcacactccgtcctggatgatggcamattccagagacgcgtgttgtgttgcagtgttgggtgtgcagctcactctgtaggaagttgctcattaggcacagtgttcgtggctagtttctcaaagctgctgtggggaatgttcagtgctgtaccaggcagggttctccagagaagcagagcccataggatgtgtgtgtgtcggcgaggctgtgagctggagaccaggagagctcatggtggttcttggccaaaggcctcagggtggagacccaggaagagctgattggttttagtctgaagacagaacaagtccagttgagagattgc

SEQ ID NO: 138659 - DNA, 601 bp, Human
ctgttccttgggagggaatcattgggcccaggccacaccccgtgtgagaggaacgctaggcggtgggggtcgtgggctgtcttggaaactgcccccctccttgtttcctagacttggaaactgagtcccagagggctagagctaggatgagtcattcgaagcaggttgatggcatcagcaccagtgtgtgagttctggttctgccgccaaagcccaagctgtttgtcctctgggaggctgtctcaggctacagccgcagcagctgccctgaactctcactggacaccttttctgcatgagrccggggaagcagggcccacagccaggcggcccgccctgcactcacccttggcaggagcagctgtgtacgcgggggccttgctcagcgcagggctgggctgcacgccgagcgcagactctgacggctcctcacacagctctctgcgtaggactgcgttcccattttatagagggggaagtgggggcatggagcggctcaggagctgttcagaatcacacagcaagtaggcgtagagcaggcctgaccaggagccaggtcccagggtctgtgccatgggccccttcatggcgtgtccagggg

SEQ ID NO: 138660 - DNA, 601 bp, Human
tgactggttccagtcatcaggatgctgtgagctacaaagctgatctgaggatgctttgctttgcacaggtaccagcgtggctgccgatctttggctgcaaatctgcagctcctcactcagggtcagagtgagcagaagccactcatcctgaccgaagatgacgacgaagatgacgacgtcccagagggggtggagcgtgtgataggtgcgtggggtctaagcggcggcctctgctcttgggcaccgtcgggccaattcccctctactccaggaccacacttccttcttccttgctggtgcyggcactgtctggccacccgtccccttcgctgagtgcacggtcactgcccgtcctctggctcctgaacccaggcctgtccctgaccatggacagtctcttcctgtgtgccgtagaagccctttttcccaccgcctcgcctccttcctgacctgggctgcctgttctgggcagctgggtgtgtcctcaggaaacagttctcccaggaaattgagttggggtccctggggctcaggtctctggctccttggcccctaaaccctgctcagttccttacctcaggagccatttcaaactccctta

SEQ ID NO: 138661 - DNA, 601 bp, Human
gagctacaaagctgatctgaggatgctttgctttgcacaggtaccagcgtggctgccgatctttggctgcaaatctgcagctcctcactcagggtcagagtgagcagaagccactcatcctgaccgaagatgacgacgaagatgacgacgtcccagagggggtggagcgtgtgataggtgcgtggggtctaagcggcggcctctgctcttgggcaccgtcgggccaattcccctctactccaggaccacacttccttcttccttgctggtgctggcactgtctggccacccgtccccttcrctgagtgcacggtcactgcccgtcctctggctcctgaacccaggcctgtccctgaccatggacagtctcttcctgtgtgccgtagaagccctttttcccaccgcctcgcctccttcctgacctgggctgcctgttctgggcagctgggtgtgtcctcaggaaacagttctcccaggaaattgagttggggtccctggggctcaggtctctggctccttggcccctaaaccctgctcagttccttacctcaggagccatttcaaactcccttaaaccacattacaccttgcaggggtctcc

SEQ ID NO: 138662 - DNA, 601 bp, Human
gctgctggtcgggctgaaggacaaggacacggtcgtgcggtggtctgcagccaaggggtaggtgtctgtggccgcagaagcaccccggggggtgggccggcctctcctgtgcgattcagcagctacaaatacccaacagctttggagtggcagcgcggccccctcctcggccccctccaacttatgtgtgttgctttacgtgttggcgtgaagatggttcccgaggcggagcttcggtctcctccgtcctcctgcctctggctggccctgccgggtcacgagcaggccgggtttacctgtytatcttcaaaatgttcccttgcttttccacatcctcatcactgtgccccccacctatcgttccccacagatgggggtcacggctcctacaatgacggtgctcagggaagagccctcttttgtggggtgagcaggtgccagtccctcattcacccctcactagcacctgtcatacctgtgggagtcgacatgcaccctgcaccccaggcctcagtggaggtcgtggggcagatccagtggggcctggccttgaacacaacaggtggagccctggcctggaggagccggtggccctgtgggc

SEQ ID NO: 138663 - DNA, 601 bp, Human
tgcttttatcaattccattctatttaaaaaccttaaggaaaaagagagtcagtttagacatatacccatgtagatgtttattctgaaaggaaaagctctactgagtgagttggggctgctccgagagctttctgtgggaggttcgggtctacccctcgcctacccattagccacgtgtatcactcagaccttgaagtgaggctggtgtgaccaaggcctgagtttgaattggatttcattttaacgaaatgtgaggctttgggaggccaaagtgggaggacggcttgagcctgtgaattcragaccagcctgggcaacgaagcgaaaccccatctctacagagagttaaaaaattagccagacgtggtcccagctactcgggaggctgaggtgggaggatcacttgaggccaggagtttgaggcttcatgagccatgatggtgccactgctgcactccagactgggcaacagagtgagacccggtctcagaacaaaactgagtgtagacagccacgtgtgctgtgccgcatttctcttgtcagccttcagggagttctgggtcttgggaccgtgtggcttgtgggtggtagagttgtgggc

SEQ ID NO: 138664 - DNA, 601 bp, Human
aaaagctctactgagtgagttggggctgctccgagagctttctgtgggaggttcgggtctacccctcgcctacccattagccacgtgtatcactcagaccttgaagtgaggctggtgtgaccaaggcctgagtttgaattggatttcattttaacgaaatgtgaggctttgggaggccaaagtgggaggacggcttgagcctgtgaattcgagaccagcctgggcaacgaagcgaaaccccatctctacagagagttaaaaaattagccagacgtggtcccagctactcgggaggctgagrtgggaggatcacttgaggccaggagtttgaggcttcatgagccatgatggtgccactgctgcactccagactgggcaacagagtgagacccggtctcagaacaaaactgagtgtagacagccacgtgtgctgtgccgcatttctcttgtcagccttcagggagttctgggtcttgggaccgtgtggcttgtgggtggtagagttgtgggctgggatgtgcgggtggcagggcctgggatttcagcctggggcctgcagacctgccctggtgtgctcacacgtgtgaggcatcgatctgtg

SEQ ID NO: 138665 - DNA, 601 bp, Human
aaaattagccagacgtggtcccagctactcgggaggctgaggtgggaggatcacttgaggccaggagtttgaggcttcatgagccatgatggtgccactgctgcactccagactgggcaacagagtgagacccggtctcagaacaaaactgagtgtagacagccacgtgtgctgtgccgcatttctcttgtcagccttcagggagttctgggtcttgggaccgtgtggcttgtgggtggtagagttgtgggctgggatgtgcgggtggcagggcctgggatttcagcctggggcctgcagwcctgccctggtgtgctcacacgtgtgaggcatcgatctgtgacctccccagggaattctcccttttgcttgtgtaaatgtctctcccagtttcagaagcggagggtcgagagcaggcgtccagcttgctcaggaccccgggcgtgctgttgctcttcattagcctggacaccgtggcgaaagctgtgctgtcagcactttggaggctccagttcgcgttgcctgtcagtcaccagggacagctccggagccgttcacaaagccttgttttccttctggagcagatttcttgtgcacttag

SEQ ID NO: 138666 - DNA, 601 bp, Human
ttcagcctggggcctgcagacctgccctggtgtgctcacacgtgtgaggcatcgatctgtgacctccccagggaattctcccttttgcttgtgtaaatgtctctcccagtttcagaagcggagggtcgagagcaggcgtccagcttgctcaggaccccgggcgtgctgttgctcttcattagcctggacaccgtggcgaaagctgtgctgtcagcactttggaggctccagttcgcgttgcctgtcagtcaccagggacagctccggagccgttcacaaagccttgttttccttctggagsagatttcttgtgcacttagcctccagcctgctcagtgacaatttcaggagcacaggaaacaatgtgtcagatacgggtcatgtttttcagagcagtgtgcatgcatgtgtgagaaatattcttccagtggaaacattgctagcagaaaacatgctctttaccacaactgcttgatgggaggcaggggttggagggtgctacgtgcttggcttctctgtaggcgacctccagccttgtttcaggcgtgtccctggagctcctttctggtggtcatggtgggcatatgtcctcctgtcgcct

SEQ ID NO: 138667 - DNA, 601 bp, Human
tggcataaaaaggcggctctggacagcgcctgctttccctttcgctgggtgctcagcatgtgattgtcaaccatggcataaaaaggtgcagcctcagagcaggatgtctgaagacaccaggaagccaggagttgctggggtgtggggcggcccacagccctgcatggtggctgctccaatcttgtccttccctgggacgtgtggtaagctgccagcctcttctgaaacgggtccgagaaagggcattaattatattaactgtaagaacacccagcacccaggagggttaacttactcccckctcctttcctgggctgggttatgcagtgagtggaactgcacccatccccagggggttcaggatctgtgtggctgatgtggctgtcccccaagcgtgcacgactccctcaggacctggggccccctcctgactcccatcaccagccctgcagcattaccctggacctaggaagtagcgccagaccccaggctgtggcagaagcagggtgccttggagaggagtgtgtctgtgtctgtgccaaccccattggtttctcctgtgagcaaaccaactgaacctgtgcccgggcccagctgtggg

SEQ ID NO: 138668 - DNA, 601 bp, Human
agacctgagccctgtacctggctaaaattgtctctttcattttacacagataatggcttacttgtcacactttaacaccaaacgcatctttgaggtcattttacattagtgctgttccccttgctcttgatgatctgagacccgtgtacctgcgacactctttacccgcctcctctctctctctctctcttcctctcccgctcatccgcccactcatagcttccactattttctgttgtcttccctcctctgagaccccccctgtgcttccaggagtgccttaagcttggatctgagggcrggaactcgccccggctgcttggcttctccctgtgcccctggtgtccatggacagggtcccctgtccggttccactgtgccgtggtggtgctgggcctctgaggcgagccggatggacggacggcatcccctggaccctgccacccttgccaccgtgccacagtgaacacgtgtctgatttagaagtagacattggtctgacaggcatttgttttggtatttttaagtcacggtaaccttggtgttttgtcaagttcattcagatgttaactaaatctttgtgaaaggtgtgaagcatctt

SEQ ID NO: 138669 - DNA, 601 bp, Human
ttatgacttgatcgatggccattgcaattgttcattaaaagttcatatttcaaatactgtgaaaaatcttgaaatgccaattcattattgtagcatttaattctgagtttgactaaacagtggggtgtcatttaaagaaggtcttcctgctcccttttccactgacgtcttcctgtgctgggattcctgttttaagttcctacttttctgaagtgtcttatttctttctatgggagcgtgggtgttgcccgtacttggagcgacaccactgtggtgggaaaaccccacctgggacggcacrgacgggacggtctctttgtttggggactgaccaagacttgtcctcactctcgggagatctgaagaggccctggggtaggcacggctgttgtcttcatactcagttgcagtgtgttatttcttcagccaactgattatttgtttttttattttgagacggagtcttgctctgtcacccaggctagagtgcagtggcgcgatctcagctcactgcaacctccgcctccctggttcaagcgattctcctgcctcagcctcttgagtagctgggattataggcgtgagccgctgtgcccagcct

SEQ ID NO: 138670 - DNA, 601 bp, Human
actcagttgcagtgtgttatttcttcagccaactgattatttgtttttttattttgagacggagtcttgctctgtcacccaggctagagtgcagtggcgcgatctcagctcactgcaacctccgcctccctggttcaagcgattctcctgcctcagcctcttgagtagctgggattataggcgtgagccgctgtgcccagccttgatactttaaaaacttaggaatgggttttagtgagccttacgtgagccttacaggcagaggatatggacctgccaggctgtgctccttgccatgctrtgggctttgaaccaaaagctgacacgtgggctgtggtctcaggatctttgttgctctcagtttccaggagactgacaaggcgtggcatgggggatgtctggcgctggcagagctgggcaggagaggcctgttgctgccgtctcgactcgtggatggtgagtagctgaggcacggtcaggggggatgtctggcgctggcggagctgggcaggagaggcctgttgctgccatctcgactcgtggatggtgagtagctgaagcacggtcagctgcgtcaccaggctgtccgtggcaggctgca

SEQ ID NO: 138671 - DNA, 601 bp, Human
ctgcttctttaaaaaaaaaaaaaaaaaaaaaagccgtcctagtgagtgtgaagcgccaccttgttttgcttttcatctgcttttccccagtgactgatgacactgagcattttctgtgtttgcccgtttgtatgtcttctttggagaaatgtcttttcaagttctttactcatttaaaaaaatatttttttaattgttgttgtaagtaagagtttttttatgtattctggatataagtctcttattggatatatgatttgcaaatgttttattgcgttccatggttgccttttcactttcyattgattgattgacagagtcttgctccgttgcccaggctagagtgcagtggccccatcacagcttgttgccaccttgatctcctgggctcaagccatattcccaccttagcttcccaagtagttgggactacaggggtgcaccaccatgcctggcaacttttttttctttttttgagacaggatctcattcccatcgcccaggccggagtgcagtggcgtgatctcagctcactgcagcctccacctctcaggctcaggcggtctgcctacctcagtcccctaagtagctggggctacag

SEQ ID NO: 138672 - DNA, 601 bp, Human
ttgcttttcatctgcttttccccagtgactgatgacactgagcattttctgtgtttgcccgtttgtatgtcttctttggagaaatgtcttttcaagttctttactcatttaaaaaaatatttttttaattgttgttgtaagtaagagtttttttatgtattctggatataagtctcttattggatatatgatttgcaaatgttttattgcgttccatggttgccttttcactttccattgattgattgacagagtcttgctccgttgcccaggctagagtgcagtggccccatcacagctygttgccaccttgatctcctgggctcaagccatattcccaccttagcttcccaagtagttgggactacaggggtgcaccaccatgcctggcaacttttttttctttttttgagacaggatctcattcccatcgcccaggccggagtgcagtggcgtgatctcagctcactgcagcctccacctctcaggctcaggcggtctgcctacctcagtcccctaagtagctggggctacaggtatgtgccaccatgcccagctaatttttgtattttttatagagatggggttttcccatgttgtc

SEQ ID NO: 138673 - DNA, 601 bp, Human
tgaagttgtggtttcatttaacgttttgttccatccgaagtaagtgactcgtaatgtttatttgtgacactagatgtgtgtgagggtgtgtgtgtgaatgtgtagctgggatggaatgaagtccctgcctgtggggagccagctccaggttcactcaaaggagacaagagactctactggcttgtgtgtgtgctctgtcatgtcttatggcaacatgcactgaccccaggcagctggggcgagaggatatgggtgttggcatcataaacgaaaagggtaaagctatggttcagaaactgayacgtgatgtggaatacactggcccatgaccttcgcatggttggttggccccttctgcctggcggtgccctccatgtgagctgaaccctctttgcagcccccattctgttcctggtgggacatggagaagctgtgctgtctctgcacagggcaagggttctttcaggcaggggtgaaagagatcccatcttggggctgactcaggaggtgacagggctgacatttgatgagcatttgcagcatgctttttatgtttttgttttagacctcacaccattcctctgagagccgtcttgtttat

SEQ ID NO: 138674 - DNA, 601 bp, Human
gagccaggaagtctttctggtgtcacagctcatgctcagcccttcggcctcctccatgtcacacggctgagctgtccctgcacctccttgtctccttggagagttactgtggttctctgtcagtttggtttgaaaagtgaaaacaggctgggcacggcggctcatgcctataatcccagcactttgggaggccaaggcggggggagcacctgaggccaggagttcgagaccagcctggccaacatggtgaaaccccgtctctgctaaaaatacaaggatgtggtggtgcatgtctgtaatyccagctactcgggaggctgaggcagaagaatcgcgtgaacccaggaggcagaggttgcagtgaaccgagatcgcaccactgcactccagcctgggtgacagagcaagatcctgtctcaaaaaaaagaaaaaaaagcgcgaaaacaaatgcttggcaaataaatgtcgtagaaagacacaatatagatgagcatgtttgatgactaaagcttttgtttgtcttagaggaaatgtggagcttcattggtgcatgctaaaggaggaagaagtaaaactagggaagtcaggtgggcaggcagtg

SEQ ID NO: 138675 - DNA, 601 bp, Human
gggctacttggtctttattttaggtgattcaaattccaggacttttcttgagtggtcctggcgtaggtcctttcaccttttttgtggctcctctttgaacacctctgttgttgtggcaggaggaggtgggcactcctcaccatgagtaagctcctacaatgtttgtgaacccttacggtttcctttgttggatacaagaagcacaggtggggggatgtattggtttaagtttaccttttttttttttttctttttttgagacagagtcttgctctgttgcccaggctggagtgcagtggcrccctcttggctcactgccagctccatctcccaggttcaagtgattctcatgactcagcctcccgagtagctgggagtcaggcgcccgccaccatgcccagccaatttttttatttttagtagagaccagatttctccatgttggccaggctggtctcgaactcctgacctcaagtgatctgcctgccttggcttcccaaagtgctgggattacaggcgtgaggcactgcgcccagccaactgtactattttgataaaatgtatacatgtgctccttattatgcattttgtggttttcatc

SEQ ID NO: 138676 - DNA, 601 bp, Human
tgaaccctatttcccttgctatccttattgattgagaattgtgcatattgatttgggtaataataactagcacttggtgtttttctgagcttggatgtgtagattcatgtctttcatcaaactcgggtagttttcagtcattgtttcttcaggtatttttgctgcccctctcctctccttgtgggactcttgttatgttaatacacatgttggtactcttggtggtaccctatgagtctcttaggttttgcactcatttcagctcttgagtcttcttgttatgttaatacacatgttggtrcgcttgatggtgccctatgagtttcttaggttctgccctcatttcagctcttgagtcctcttgttatgttaatacacatgttggtaagcttgatggtgccctatgagtctcttaggttctgtgctcatttcagctgttgagtcctcttgttgtgttaatatacatgttggtaagcttgatggtgccctatgagtctcttaggttctgcgctcatttcagctgttgagtcctcagttccagaatttctctttagtttctcttttaataatttctttttgagacagggtcttgctctgtcgc

SEQ ID NO: 138677 - DNA, 601 bp, Human
cccctggccatattttcttgatccattcatttgtcagtggacgcttgggttattcccaccttttgggtattgtgaataatgctgctgtggacatggatacaagaacctgtttgacacccctttttttagttcctttgggtatataccctgaagtggaattagtgggtcatgtggtaattctatgttcagctttttgagagcttatcactttttgtatgtaaaaattacgagtgtttagttcttaagtcggatcatgcataaatgcagaaacgtagttaaaaaataagtctcttttttttttctttttgctataaagctctaggaatcgattttgcttttagagatagacacaaagggcttatcctggttgcaatgggtgagctattgcagatgacctttggaggaattgtgtcggagtgtagaattttcacagtgtagctcgccatgcatcaggcacatgtagcctgtgccacaaccattgtgcttgggcggggttctccatgctgccctgttgcaggaggatgctctgcccctgcttctccctatttgtcatttaagatgattcctggtgctttttggtgagcgatcaaatggtgttctc

SEQ ID NO: 138678 - DNA, 601 bp, Human
ttcagctttttgagagcttatcactttttgtatgtaaaaattacgagtgtttagttcttaagtcggatcatgcataaatgcagaaacgtagttaaaaaataagtctcttttttttttctttttgctataaagctctaggaatcgattttgcttttagagatagacacaaagggcttatcctggttgcaatgggtgagctattgcagatgacctttggaggaattgtgtcggagtgtagaattttcacagtgtagctcgccatgcatcaggcacatgtagcctgtgccacaaccattgtgcytgggcggggttctccatgctgccctgttgcaggaggatgctctgcccctgcttctccctatttgtcatttaagatgattcctggtgctttttggtgagcgatcaaatggtgttctcagaatctttgggcccttgacaacggagggctgtattcttgggggtgtgatgtgagagctccttgtctgcagggtgtgaggctttgggtcctgagtgtggaccgtggcatgtgatgtcttgtcacggctccctgcacggctgtttagtttctgaaagctggaagtataatatttttgttctttgc

SEQ ID NO: 138679 - DNA, 601 bp, Human
ttttaaaaaattatgagtacagagttgaccaaaacaacataaaatagcatattattgaaatttagctcttaataagatagctgtttagtttgagttatcttttgatgagtcaggctttttttgtttttattttttgaaatgattcttgctctgtcacccaggctggagtgaagtggtatgatcttggctcactgcagccttgacctcctgggctcaagcaatcctcctgcctcagcctctcaagttggtgggactacaggcaaacatcccattgctcagctaatttttgtattttttgtarggatggggtctccctgtgttgcccagactggtcttgaactccttggctcaagcagtcctctcacctcagcctcccaaagtgctgggattatgggtgtgtgccaccatgcctggccgtgagccatgcttttaaccagaataaggcaaggttctgcaacagtacaatttttgctttttatttatgtattttttttgagaaaaggtctcactctgtcacccaggctggagtgcagtagtgtgatcatggctcactacaacctctgcctcccaggctcaggccatcctcccgcctcagcctccc

SEQ ID NO: 138680 - DNA, 601 bp, Human
ccacagatacacacacgtgcacatccacacaatcgaatgcaccccccccgcagatatgcacacgtgcacaccggcacaatggaatgtgcccccccgattgcacacgtgcacacccacacaattgaatgcacacacacccgcaggtacgcacacatgcacacccacacaatcgaatgcgcacacacctgcagatatgtacacatgcacacccacagaatcgagtgtgcacacacccatacataatgcgcatgcactcacatgattgaatgtgcacacacccagagatgcacacacacacatytaatcagatgtgcacccccacacagatatgcacatgtgcacacccacaggatcgaatgtgcacgcctaatcagatgtgtacacccctcccacatatgtacacatgcacactaacacaaatgtgtacacacccgcaggtatgtacacatgcacacctacacagtcgagtgtgcatgccccccacggatatgcacacgtgcatacccacacaatcccatatacccacccccacaatcacgtgtacacacccccgcagatatgcacacacgcacacccacaggatcgaatgcgcacacaccca

SEQ ID NO: 138681 - DNA, 601 bp, Human
ccgcagatatgcacacacgcacacccacaggatcgaatgcgcacacacccacagatagcacacacgcacacccacacaattgaatgcgcaccccccacagatatgcacacgtgcacacccacacaatagaatgtgcacacacccgcagagatgcacaagcgcatacccacacccgcagacgtgcacatgcacacatccacacgatcaaatgtgcacgtgcatctgcagacatgcacaagcagacacctacacgcactcgcagacatgcacacccacatgggcgaatgtgcacaccccccccacacagatagcacacgtgtacacccacacaattgaatgtgcatacacgcacccgttcacaggttaatcgctgccacagctatcagctctttttcattgactgttacggcaaaatattctaaaggataacatagatttatgtttatttgcattttatgtttccttatggttcatatgagtttattggaaaattagcaacatacacatcattttggggaatggaaagtgaggcagagtaagccagaacattcactgtaacattataagcaagtagaataaattgataataccttcaccagta

SEQ ID NO: 138682 - DNA, 601 bp, Human
gctctccatggagctcagtgtgggtgtgtcttgccggcaggcaggttccggggccgcagcatccccatcgcccacccggatgttcctggggctgtaggccgccagctggcacagggccacggctgccgtctgcttctgctcctcgctgctgtccaccgcgcatgcgtctggagcctcctcgccggggcctgtgggtggggccccgtcaccgtcgaggctgcctggcttggtctcagggtggctgggcccatcctcagaaccttctgtcccagtcttctgtggaacagcagcagcaggttcygcagctcgtggtcgaccggggaaggcgggcctcggagcctgggtgttacaggggtccttcaccgagagattgagtggaaggtcctgcagctctgagaagctggcggtttccgcctgggggctgccttggtacgtgggttcgtgggtggctgccaggtttatctctgatttcttggagaggttgagggggcccatcccggagctgtcgtccggactggaaggcgcggcctccgagacgagagaggcgcttccggtcggagcaggagggtctccgttcacaacattgaggctagaagaagcc

SEQ ID NO: 138683 - DNA, 601 bp, Human
gtcttgccggcaggcaggttccggggccgcagcatccccatcgcccacccggatgttcctggggctgtaggccgccagctggcacagggccacggctgccgtctgcttctgctcctcgctgctgtccaccgcgcatgcgtctggagcctcctcgccggggcctgtgggtggggccccgtcaccgtcgaggctgcctggcttggtctcagggtggctgggcccatcctcagaaccttctgtcccagtcttctgtggaacagcagcagcaggttccgcagctcgtggtcgaccggggaaggcrggcctcggagcctgggtgttacaggggtccttcaccgagagattgagtggaaggtcctgcagctctgagaagctggcggtttccgcctgggggctgccttggtacgtgggttcgtgggtggctgccaggtttatctctgatttcttggagaggttgagggggcccatcccggagctgtcgtccggactggaaggcgcggcctccgagacgagagaggcgcttccggtcggagcaggagggtctccgttcacaacattgaggctagaagaagccaagaaaaagcttagtaggagcttgctt

SEQ ID NO: 138684 - DNA, 601 bp, Human
ggcatcgggctggttggtttgcttggggtctagtgagttagatttagggcacttgggaactcgatcctgctctgatactaaagtaatcgagtttttacaaagaccatacttcatgtgattaaaaagatgtgacttctcattgcaagtaaagggacattggaaacatttatacttgaagggctttcctggaggcctggggatgtaatgtggcttttttggcttccgctctttgaggagactcattttcctccttatgccttggactctggctgtccaggtggcgtgatcactgtcgacgccrcgtgcacttcgtggtttctaaagaggcacctcccgctttgctttctttcccgagcacttctatcagaagccagctctgcgtgctgagggtctggcgagagcctccgtcatctggcggctgggagctgtaataaagagcagtcttggtgtcaggacagcgagtgaggggtcggcgagaagccggcctcggctcgccacagtgccacaggatccctgaagcagaacccctgaagggctgaaactgcctgctcctgaggggagcagctgccggtcacagaagcagccctgccctacccttggt

SEQ ID NO: 138685 - DNA, 601 bp, Human
cgctctttgaggagactcattttcctccttatgccttggactctggctgtccaggtggcgtgatcactgtcgacgccgcgtgcacttcgtggtttctaaagaggcacctcccgctttgctttctttcccgagcacttctatcagaagccagctctgcgtgctgagggtctggcgagagcctccgtcatctggcggctgggagctgtaataaagagcagtcttggtgtcaggacagcgagtgaggggtcggcgagaagccggcctcggctcgccacagtgccacaggatccctgaagcagarcccctgaagggctgaaactgcctgctcctgaggggagcagctgccggtcacagaagcagccctgccctacccttggtaacctggctgctgactccccaccgtgttttctgttttctgagtctgatctgaaagagtcacctcggggcctagaggtggagtgtggtgtgtggtgcgttgagtgtctgttctgagaatgcctgtaagcctttgagttttgggaactttcatcctgtgacctggacctttcctcgaaagcgccctgccgggggctgaggacaccgagccccctcccagggtctg

SEQ ID NO: 138686 - DNA, 601 bp, Human
tgagggtctggcgagagcctccgtcatctggcggctgggagctgtaataaagagcagtcttggtgtcaggacagcgagtgaggggtcggcgagaagccggcctcggctcgccacagtgccacaggatccctgaagcagaacccctgaagggctgaaactgcctgctcctgaggggagcagctgccggtcacagaagcagccctgccctacccttggtaacctggctgctgactccccaccgtgttttctgttttctgagtctgatctgaaagagtcacctcggggcctagaggtggagtgyggtgtgtggtgcgttgagtgtctgttctgagaatgcctgtaagcctttgagttttgggaactttcatcctgtgacctggacctttcctcgaaagcgccctgccgggggctgaggacaccgagccccctcccagggtctggacagagtcctgtcccagggctgcccgactctgcttgggggttacacgcttgaagcagtgggtgtgtgatcggccacactctcacgtgaaatacgaaggggtttgtggctgtttccccttaacatgtacccacagtcacagagtgcccctcacttttacac

SEQ ID NO: 138687 - DNA, 601 bp, Human
gtgagtagtatccgctttagagatggttgggtcatgggaggaagctgtcctggcccttaacctttagggagtgggttcagccctctggccacacccactcaggtcctgggacccaccagaggctgtgtgtgtgatgtcagagctggcctgctcttttggattcttccagagggtctctgtgtcccccttaccagcctcaggtttccttcagaggctgtgccgcacgcccaaggctgagaacaaaggctgtttttttttttttgagacagagtttctcccttgttgcccagtctggagtgcmgtggcgcaatctcagctcactgcaacctccgcctcctgggttcaagcgattctcctgcctcagcctcccgagtagctggaattacaggcgcccaccaccatgcccagctaattttttttgtatttttagtagagacggggttttgccatgttggccaggctggtctcgagctcctgacctcaggtgatccacctgccttagcctcccaaagtgctgggattagaggcgtgagccaccgcacccgtcccagaacaaaggctttgagagtctgggactgtccacctggcagctgggcctgga

SEQ ID NO: 138688 - DNA, 601 bp, Human
tgagtagtatccgctttagagatggttgggtcatgggaggaagctgtcctggcccttaacctttagggagtgggttcagccctctggccacacccactcaggtcctgggacccaccagaggctgtgtgtgtgatgtcagagctggcctgctcttttggattcttccagagggtctctgtgtcccccttaccagcctcaggtttccttcagaggctgtgccgcacgcccaaggctgagaacaaaggctgtttttttttttttgagacagagtttctcccttgttgcccagtctggagtgcartggcgcaatctcagctcactgcaacctccgcctcctgggttcaagcgattctcctgcctcagcctcccgagtagctggaattacaggcgcccaccaccatgcccagctaattttttttgtatttttagtagagacggggttttgccatgttggccaggctggtctcgagctcctgacctcaggtgatccacctgccttagcctcccaaagtgctgggattagaggcgtgagccaccgcacccgtcccagaacaaaggctttgagagtctgggactgtccacctggcagctgggcctggag

SEQ ID NO: 138689 - DNA, 601 bp, Human
tcatgtccttcgcagggagaaatggatggagctggaagccagcatcctcagcaaactaacgcaggaagagaaaaccaaacgtgcatggtctcacccataagtgggagctgaacagtgaaaacacatggacacagggaggggaacatcacacaccagggcctgtttaggggtgggggtcggggggagggagagcattaagacaaatagctaatgcatgcagggcttaaaacctagatgatcggttgatgggtacagtaaaccaccatggcacacatttacctgtgtaacctacacgttctgyacttgtgtcctggaacttaaagtataataaaaaaaaaatacattaaagtaaagttaaatggagggctgggggccgtggctcatgcctgtaatcccagcactttgggaggccgaggtgggaggatcccttgagcccaggagattgaggctgcagggagctgtcatcccaccaccgcactgcagcctggtgggcaacagaatgagaccctgcctcaaaaaaaagctaaatggaaatgacttaagaaaactgtttcaactgcagtattttttttaaggaatgggcagatgtgcccattcttga

SEQ ID NO: 138690 - DNA, 601 bp, Human
ccaaacgtgcatggtctcacccataagtgggagctgaacagtgaaaacacatggacacagggaggggaacatcacacaccagggcctgtttaggggtgggggtcggggggagggagagcattaagacaaatagctaatgcatgcagggcttaaaacctagatgatcggttgatgggtacagtaaaccaccatggcacacatttacctgtgtaacctacacgttctgcacttgtgtcctggaacttaaagtataataaaaaaaaaatacattaaagtaaagttaaatggagggctgggggcygtggctcatgcctgtaatcccagcactttgggaggccgaggtgggaggatcccttgagcccaggagattgaggctgcagggagctgtcatcccaccaccgcactgcagcctggtgggcaacagaatgagaccctgcctcaaaaaaaagctaaatggaaatgacttaagaaaactgtttcaactgcagtattttttttaaggaatgggcagatgtgcccattcttgagtctgcgaggttttatgtgtagacatcagggtggctaaaagtcaagtgaaaagccgccccttgaaaatagagca

SEQ ID NO: 138691 - DNA, 601 bp, Human
tcatttatttataattcttaaaaacacaaccacccttccccctacaaactgcctctattaacatactttaagttctttaagacatttatttactaagaagtggtttgggtagaaaaggggctctgctgacctgccaccttcgctgtgatgagtttctgtgtagcagggacagcgaggcacggtttggatgaggacaagatgtttgttaccctacaaccagggagggtgtcgggtgacaccctgggctcagaccccgcgctcagcacccgtctcccaccgtgggctgccacagaagctacamggcaccgggtcaaggccaagcaaatgaaacacgtaatgatagctctgtctttctaatttccccctattagaagaaagaacgtgaaataattctttatgggctcagtccctaccgtgtggggcagacctgctctgggtgatgaaagcagtttccctgcctcccttcaggaagtagagaagccgggtgcctggttccagccaaacgctgggccagccagctcagtcagtggggcctgtgccggcatgcctcgccgcgctccctggttctgaaggcgtgagaacctctgcaagtcaggttccc

SEQ ID NO: 138692 - DNA, 601 bp, Human
ctgcttcagttgtaagccgggcgtaggtcacctgatctgtaaaactacaatagtgtcagagaagtaagtgggataacattgttgctttggtaagctttcaaatgatgatgatgtcagcctgtgagttctgtgtcctgcttaagtgaggtttataaggatgaagaaaccaaacccgacggccagtacctcaggctgtcacagctgtctgtgggcacagcgtttgaaatagtctctgtgtggtcagtttctaccagcccgactttgtactctggcagctgctggtgttaaatattcccaaaacagtatgttgttgcccaaacagtgtaacccagaaatctagctgtttacagtaatttggatttgtatttagaggtgcagtttttctctagaggggataaagaagtgcggagcgtctttctctcctgggggaggtgtgtttccattttagttaataacatgcccggagagctgtctgtctgtctgttaataaagcagagtctcattcattatctgctttcatttgagaactgcagtgctagcgtgttttacagtgaagacctcggtgtgatcctgaaggagggtttcatcctcctctcatttc

SEQ ID NO: 138693 - DNA, 601 bp, Human
tggcttctggaaagtgcgctgagctgagagctcgcttctcttcctgctcaacgtgcactgggccgggtgttggggcgtagctgcccacacagacagtgctttgaagagtgagtggtttcggttggccatggggttgtgtctaaattgccaatatactgtctttccaaaggttcctaagtgtggacagttaatgcagcagacagttgttagggtaatagtgagaagttgggatgcttaacaagcttctaaggagtttgaactttgaaaaatagacaagagaaagagttcttaaaaaaaaaaactttgataggacagagcggaagtaattacagtttaactttatgggacgtttctgtgacaggctgggtaactatgcttgtcatgcgtcctaacctgtgccctgagattgtgctgtaatgttccttttggtggtgtccagctgtctggcaaggagcctgctcggctggagcattgtgaagggcatgctgtaattacaatattgtgatgtggcgttgttgcataactcaaggacacaccattgtcgcctacccactgtgatgtcgcaagaacgagatttgtgagttttactccaattgagctt

SEQ ID NO: 138694 - DNA, 601 bp, Human
tgcgctgagctgagagctcgcttctcttcctgctcaacgtgcactgggccgggtgttggggcgtagctgcccacacagacagtgctttgaagagtgagtggtttcggttggccatggggttgtgtctaaattgccaatatactgtctttccaaaggttcctaagtgtggacagttaatgcagcagacagttgttagggtaatagtgagaagttgggatgcttaacaagcttctaaggagtttgaactttgaaaaatagacaagagaaagagttcttaaaaaaaaaaactttgataggacasagcggaagtaattacagtttaactttatgggacgtttctgtgacaggctgggtaactatgcttgtcatgcgtcctaacctgtgccctgagattgtgctgtaatgttccttttggtggtgtccagctgtctggcaaggagcctgctcggctggagcattgtgaagggcatgctgtaattacaatattgtgatgtggcgttgttgcataactcaaggacacaccattgtcgcctacccactgtgatgtcgcaagaacgagatttgtgagttttactccaattgagcttttccagtgattgac

SEQ ID NO: 138695 - DNA, 601 bp, Human
ctgttgctgcccaggctggagtgcaatggcatgatcttggctcactgcgtttctcctgcctcagcctcccgagtagctgggactacaggcgcctgccaccacgcccggctaattttttgtatttttagtagagatggggtttcaccgtgttagccaggatggtcttgatctcctgaccttgtgatccacccacgtcggcctcccaaagtgcttggattacaggtgtgagccactgcacccggtctgtttttttgtttttgttatttttttccttaagacttaagattttacatggctttgygtttacttttatatttaattccttttttttttcttttgagacagggtcttgccctgtcacccaagctggagtgcagtggtgcgatcacggttcactgtagcctcaacctcctggactcgagtgatcctcccgcctcagtctccccagtagctgggactacaggcacggtcactatgcctggagaattttttgtagagacagggttttgccatgtttcctaggatggtttaataccttaaaattttttttggtggcttttgtccattgagacatccatatactttatgaagtcaaaaagag

SEQ ID NO: 138696 - DNA, 601 bp, Human
agctgggactacaggcgcctgccaccacgcccggctaattttttgtatttttagtagagatggggtttcaccgtgttagccaggatggtcttgatctcctgaccttgtgatccacccacgtcggcctcccaaagtgcttggattacaggtgtgagccactgcacccggtctgtttttttgtttttgttatttttttccttaagacttaagattttacatggctttgtgtttacttttatatttaattccttttttttttcttttgagacagggtcttgccctgtcacccaagctggagtgyagtggtgcgatcacggttcactgtagcctcaacctcctggactcgagtgatcctcccgcctcagtctccccagtagctgggactacaggcacggtcactatgcctggagaattttttgtagagacagggttttgccatgtttcctaggatggtttaataccttaaaattttttttggtggcttttgtccattgagacatccatatactttatgaagtcaaaaagagttatgtaagtcttatgacaaaaaacagcagttccctgtccctcttacctattcctggatagcaaactatcccaa

SEQ ID NO: 138697 - DNA, 601 bp, Human
atgctacaaaataacagtgaaaaacctaacgatgaaaatagatgcgaacagacaaaaggtcaatgggcttgatcccttctcatcctctctcctgtgtctcctggaggcttctgcacctctgtgtcttcccccgctctgctgcgtcttctccacctcgatgtccccctctgcctgctgcgtcttctccacctcgatgttcccctctgcctgctgcgtcttctccacctcgatgtccccctctgcctgctgcgtcttctccacctcgatgtccccctctgcctgctgtgtcttctccacctcratgtccccctctgcctgctgcgtcttctccacctcgatgtccccctctgcctgctgcgtcttctccacctcgatgtcccccgctctgctgcgtcttctccacctcgatgtccccctctgcctgctgcgtcttctccacctcgatgtccccctctgtctgctgcgtcggggctgcctaccgggcttggtcttcagggccactgtttctcctcagctaagtcctgagagtcacatttccatccattgcagtgaaatcttttccttcaggtatttccagaccttggttttggccccttttcat

SEQ ID NO: 138698 - DNA, 601 bp, Human
aaacctaacgatgaaaatagatgcgaacagacaaaaggtcaatgggcttgatcccttctcatcctctctcctgtgtctcctggaggcttctgcacctctgtgtcttcccccgctctgctgcgtcttctccacctcgatgtccccctctgcctgctgcgtcttctccacctcgatgttcccctctgcctgctgcgtcttctccacctcgatgtccccctctgcctgctgcgtcttctccacctcgatgtccccctctgcctgctgtgtcttctccacctcgatgtccccctctgcctgctgygtcttctccacctcgatgtccccctctgcctgctgcgtcttctccacctcgatgtcccccgctctgctgcgtcttctccacctcgatgtccccctctgcctgctgcgtcttctccacctcgatgtccccctctgtctgctgcgtcggggctgcctaccgggcttggtcttcagggccactgtttctcctcagctaagtcctgagagtcacatttccatccattgcagtgaaatcttttccttcaggtatttccagaccttggttttggccccttttcatatcttccttgtttcctcgctg

SEQ ID NO: 138699 - DNA, 601 bp, Human
aataaaaataaacagtcacaaaattattctatctaaaattttgggatgcagctaaggaaacttaaacctttaaacaggtgtgacgaaattgtggcctgcaggcccagtggggcctcagcctgtttctgtacagctttggagccaagaagggttttcacattttaaaaatgttatcaatgagaataaacacaaccaagcagagtctgcgatgtggactgcatgtggcccacagggcccgaggttctctctggccctggcaggaatcacttggtgactcggcctcagacacgtgtacagaaamggagaaaggttcactctgcacagggcgggtgggaagagggcagtgagcagaaccctagaaatgaaggaggtggaagacaaagatgagagaggacacacagagccaaacgcagctcttcgagagggctgatgggaccaataaacgcgtggccgacgggcagaaagcaggagccttacacacggaagggagccctcgtgcagccaccgtggagatggaaaatggcatgttaagaatatcttttgccaggaaatttggtagcttaggcaaaatagacgttccgagagaaatgtaatttatcaa

SEQ ID NO: 138700 - DNA, 601 bp, Human
ggcccagtggggcctcagcctgtttctgtacagctttggagccaagaagggttttcacattttaaaaatgttatcaatgagaataaacacaaccaagcagagtctgcgatgtggactgcatgtggcccacagggcccgaggttctctctggccctggcaggaatcacttggtgactcggcctcagacacgtgtacagaaaaggagaaaggttcactctgcacagggcgggtgggaagagggcagtgagcagaaccctagaaatgaaggaggtggaagacaaagatgagagaggacacacasagccaaacgcagctcttcgagagggctgatgggaccaataaacgcgtggccgacgggcagaaagcaggagccttacacacggaagggagccctcgtgcagccaccgtggagatggaaaatggcatgttaagaatatcttttgccaggaaatttggtagcttaggcaaaatagacgttccgagagaaatgtaatttatcaaagttgacccaggtgggaatagaaaagtgactcctcactgcttcagcgcatctgcttgtaagcgggaacgattactgttgaccccataggatttttaatga

SEQ ID NO: 138701 - DNA, 601 bp, Human
aagaagggttttcacattttaaaaatgttatcaatgagaataaacacaaccaagcagagtctgcgatgtggactgcatgtggcccacagggcccgaggttctctctggccctggcaggaatcacttggtgactcggcctcagacacgtgtacagaaaaggagaaaggttcactctgcacagggcgggtgggaagagggcagtgagcagaaccctagaaatgaaggaggtggaagacaaagatgagagaggacacacagagccaaacgcagctcttcgagagggctgatgggaccaataaasgcgtggccgacgggcagaaagcaggagccttacacacggaagggagccctcgtgcagccaccgtggagatggaaaatggcatgttaagaatatcttttgccaggaaatttggtagcttaggcaaaatagacgttccgagagaaatgtaatttatcaaagttgacccaggtgggaatagaaaagtgactcctcactgcttcagcgcatctgcttgtaagcgggaacgattactgttgaccccataggatttttaatgattttgttgagacgcaattcacatgccattcagttctgtcatta

SEQ ID NO: 138702 - DNA, 601 bp, Human
cacttggtgactcggcctcagacacgtgtacagaaaaggagaaaggttcactctgcacagggcgggtgggaagagggcagtgagcagaaccctagaaatgaaggaggtggaagacaaagatgagagaggacacacagagccaaacgcagctcttcgagagggctgatgggaccaataaacgcgtggccgacgggcagaaagcaggagccttacacacggaagggagccctcgtgcagccaccgtggagatggaaaatggcatgttaagaatatcttttgccaggaaatttggtagcttagkcaaaatagacgttccgagagaaatgtaatttatcaaagttgacccaggtgggaatagaaaagtgactcctcactgcttcagcgcatctgcttgtaagcgggaacgattactgttgaccccataggatttttaatgattttgttgagacgcaattcacatgccattcagttctgtcattaagtgtacagttcagtggcttgtaacgcatttgcagagttttgcagccatcgccacagtcagttgtagaacattttaccccacgctccttcgctgtcatccccaacccccccgacagatgga

SEQ ID NO: 138703 - DNA, 601 bp, Human
gagccttacacacggaagggagccctcgtgcagccaccgtggagatggaaaatggcatgttaagaatatcttttgccaggaaatttggtagcttaggcaaaatagacgttccgagagaaatgtaatttatcaaagttgacccaggtgggaatagaaaagtgactcctcactgcttcagcgcatctgcttgtaagcgggaacgattactgttgaccccataggatttttaatgattttgttgagacgcaattcacatgccattcagttctgtcattaagtgtacagttcagtggcttgtaaygcatttgcagagttttgcagccatcgccacagtcagttgtagaacattttaccccacgctccttcgctgtcatccccaacccccccgacagatggataaaccccccctcctagacaccacagatgggttctctgtgtctacccattctggacatttcctgtgaatggaaccgtgccccctgtggtcctctgtggtggctccttgccccgagcgtggcgttggcgtggtccgtgggcgatgcagcccccagcagtgctccttttcttttccttgttgaagcctgttccatcgtgtggcatc

SEQ ID NO: 138704 - DNA, 601 bp, Human
catgtagctggtctcaaagtcctgggcttaagcagtccacctgtctcagcttcctaaggtgctgggattacaggcttgagccactgcatccagcaacaccccccctccttttttttttctgtttttgagtcagggtcttgctctgttgcccaggctggagtgcagtggctcactcacggctcactgtagctttgaactcatgggctagatccatcccccgacctcagcctcacaagtagctgagactacaggtgtttgccagcacacccagctcattttttctttttttttttgtagagayggtctcaccatctagcccaggttggtcttgaactcctcgcctcaaatgatcctctcatcttggcctcccaaagtattgcgattacaggcatgagccactgttaatggccccagctttctttgggttcgtgttttctcagtgtattcttttctgtcttttaatttttttatattcttgcattttagatgtatgttgagtaaaaatctaccgtatgtgattttaagctggtgagtttagtccatttactttactgacatgtttgggtgtctttgtcttattatatgaattttgctttttcag

SEQ ID NO: 138705 - DNA, 601 bp, Human
gggagctgggcagcagtgtaagagcacggtgctggagtgagtgccagagatgacctaagaaacaggaggaatggttgacgttctgtgctggaaacgatgaccagaaaaaccctgcacaaagctacacgtgaaatttctatcacgtattgaaagagtggatctgtcagcatcgcagtggacacaagccacttaacagtgccaatcacaagacaagcaaagctctgtgtaaaggccctgatcgcattcatgaagctctgtccttgggactcatcatctacgaaaggccacacctcctaacacygtgctcttgggagtgaggatttcagcaggaattctggggaacagaagcattggggcgtcgcatctccctgtggccttcctccctgtggccttcctccgcctgccagctgccccctcaccctgctgtccacctcacggacccctcttcgccccatatgggccactttggcccccaccaccccttcctggatgtgcagaccctatgcggtgccacctgatgcttcaagactgaattttccagaggggcagggaaaggtgtttgcctttttttttttttttttttttttttttttttttttaa

SEQ ID NO: 138706 - DNA, 601 bp, Human
atgacctaagaaacaggaggaatggttgacgttctgtgctggaaacgatgaccagaaaaaccctgcacaaagctacacgtgaaatttctatcacgtattgaaagagtggatctgtcagcatcgcagtggacacaagccacttaacagtgccaatcacaagacaagcaaagctctgtgtaaaggccctgatcgcattcatgaagctctgtccttgggactcatcatctacgaaaggccacacctcctaacaccgtgctcttgggagtgaggatttcagcaggaattctggggaacagaagcrttggggcgtcgcatctccctgtggccttcctccctgtggccttcctccgcctgccagctgccccctcaccctgctgtccacctcacggacccctcttcgccccatatgggccactttggcccccaccaccccttcctggatgtgcagaccctatgcggtgccacctgatgcttcaagactgaattttccagaggggcagggaaaggtgtttgcctttttttttttttttttttttttttttttttttttaattttttagagccagggtcactctgttgctcacgctggagtgagtgccat

SEQ ID NO: 138707 - DNA, 601 bp, Human
cactctgttgctcacgctggagtgagtgccatggtgtagtcgcggctcactgcagtcttggcctcctggactaaagcgatccttccacctcagcctcccaagtcactgtggcactatgggtgcatgctaccgtgcccggctaattttttttatcttttgaagagatgggatctcactatgttgcccaggctggtcacgaactcctgggctcacgtgatctactcacctcggcctcctgaagggctgggattacaggtgtgagccactgtgcctggccaggtgtttgctcttaaaaagtcayttctctctttctgtgtgtatttgtgttttgaggtaaaatttcacataacataaaaataaccattaactttaaagtgaaaaactcagagcatttagtacatacccaatgttgcacagctattacttctgtctacttttaacacatttttgtcaccgaaaaaatactctggtgtccattcacatagtcatgacacatcacgacacatgactgtattcccaacccctggcacctgccaggctgttttctgcctctacgtttacttattctgagaattttatacacatggagtctgcaatgcgt

SEQ ID NO: 138708 - DNA, 601 bp, Human
tgtctacttttaacacatttttgtcaccgaaaaaatactctggtgtccattcacatagtcatgacacatcacgacacatgactgtattcccaacccctggcacctgccaggctgttttctgcctctacgtttacttattctgagaattttatacacatggagtctgcaatgcgtgaccctttgtgcctggttcatctgtattgtagcatgtgtcaggccttcatttgtttttatggctgaataatattgctttgtatgggtagactccccccccacttttttttttttttttttttttttkgtagagacagggtctcaccatctagcccaggttggtcttgaactcctggcctcaaatgatcctctcatcttggcctcccaaagtattgtgattacaggcatgagcctgaatctgaaaaagcaaaattcatatagtaagacaaagacacccaaacatgtcagtgaagtaaatggactaaactcaccagcttaaaatcatatggtagaattttactcaacatacatctaaaatgcaagaatataaaaagattaaaaggaaagacagaaaagaatatgctgagaaaacactaaccaaaagaaa

SEQ ID NO: 138709 - DNA, 601 bp, Human
gtggcgaggagggtgcggctcgtgggtggctgcctggggctaccccgtgtagacttgctgggactttgtctagacaagagaactgctgtcagtggcgcttcctgcggggggatgagtgcggctctcagcgcctctgtggggctgggggtcttgggccgtgaggccggggccaggctgcgtggcaaccctgagtcccaccctcattgtctttgctcggggccccgagaggccatggggagcctgccggctctgtgtcctccccgcactggcttttagggaaagagagtctcgtgggtcatcyggcctgccggctctgtgtcctccctacactgacacactggctttcagggaaagggagtcttgtgggtcgtctggcctgccggctctgtgtcctccccgcactggctttcagggaaagagagtctcgtgggtcgtctggcctgccagctctgtgtcctccctacactcacacactggctttcagggagattgggccttgtgtgtcctgttgggtgagcagacacacaagctgtgacttcagggctacggaagttgctctgtggtttccggcactgcagactccaagtgtgagccctgtagt

SEQ ID NO: 138710 - DNA, 601 bp, Human
acttgctgggactttgtctagacaagagaactgctgtcagtggcgcttcctgcggggggatgagtgcggctctcagcgcctctgtggggctgggggtcttgggccgtgaggccggggccaggctgcgtggcaaccctgagtcccaccctcattgtctttgctcggggccccgagaggccatggggagcctgccggctctgtgtcctccccgcactggcttttagggaaagagagtctcgtgggtcatccggcctgccggctctgtgtcctccctacactgacacactggctttcagggaargggagtcttgtgggtcgtctggcctgccggctctgtgtcctccccgcactggctttcagggaaagagagtctcgtgggtcgtctggcctgccagctctgtgtcctccctacactcacacactggctttcagggagattgggccttgtgtgtcctgttgggtgagcagacacacaagctgtgacttcagggctacggaagttgctctgtggtttccggcactgcagactccaagtgtgagccctgtagtgaggacaaagagtggaggttggagttcagaattgtggacaggctcctgagga

SEQ ID NO: 138711 - DNA, 601 bp, Human
gtcctctgggccctgctgcttctgaagtgcctgtgccagggacactgtcttggggccagtggaggtctgagtatgggggctgggagtcctaggcagtgagtcatggcagaactggcccctgacttcctggttaagcctttaattctcccgaatgcctgtttttgcttctttcaagttgttgtgcttgagccactctgtcattagctgtgggcgttccgagtgccagcgcacagtgttgagcagagcgggtaggagcgccctggcttcagggagggcccccgccccctgcatggcggtcacrctgcgctgagcgtcccctcccctctggtggcctttcgcagtggtggaggggcaggaactgactggctcttttccctgtggtggctgctcgggtggcagtgagcggacagcgagggggacagacacaggtggaaggaaccacggtgggtttcattaacaatgacagtggctcaggagatcctgaggctgattaatttgcaaacagcaattacttgggattgcttgaaaagaaagttctagcttagaacaggaacctgaggagggctggccacactggaatccagtgcccactgtgacagtg

SEQ ID NO: 138712 - DNA, 601 bp, Human
gcttattttagaaagtaaggtgctttcatagagaatgtttaaaattattaagaggtagacaattcttttaaaaacctgaaggtcttttttttttttcttttttttgagacagagtctcgctgtcgcccaggctggagtgctggagtgcagtggcgcgatctcggctcactgcaacctccgcctcccaggttcacgccattctcctgcctcagcctcctgagtagctgggactacaggcgcccgccaccttgcccggctaattttttgtatttttagtagagacggggtttcaccgtgttarccaggatggtcttgatctcctgacctcatgatctgcccgcctcagcctcccaaagtgctgggattacaggcgtgagccactgcgcccggccaaaacctgaaggtcttatattgtggtgtgagtttatatttatttccatcattttatatttgtcagatttttatgcaggggggctgcataatgtctccctggagagcctcagcctctgtggaagagttgggtcaggagaagcctctcggcggaggaagccggagggagaagcctctcggtggaggaaccttcacccagagaccagcctgg

SEQ ID NO: 138713 - DNA, 601 bp, Human
tagagaatgtttaaaattattaagaggtagacaattcttttaaaaacctgaaggtcttttttttttttcttttttttgagacagagtctcgctgtcgcccaggctggagtgctggagtgcagtggcgcgatctcggctcactgcaacctccgcctcccaggttcacgccattctcctgcctcagcctcctgagtagctgggactacaggcgcccgccaccttgcccggctaattttttgtatttttagtagagacggggtttcaccgtgttagccaggatggtcttgatctcctgacctcrtgatctgcccgcctcagcctcccaaagtgctgggattacaggcgtgagccactgcgcccggccaaaacctgaaggtcttatattgtggtgtgagtttatatttatttccatcattttatatttgtcagatttttatgcaggggggctgcataatgtctccctggagagcctcagcctctgtggaagagttgggtcaggagaagcctctcggcggaggaagccggagggagaagcctctcggtggaggaaccttcacccagagaccagcctgggggtccttggcccagacgggggaggtgg

SEQ ID NO: 138714 - DNA, 601 bp, Human
cggctaattttttgtatttttagtagagacggggtttcaccgtgttagccaggatggtcttgatctcctgacctcatgatctgcccgcctcagcctcccaaagtgctgggattacaggcgtgagccactgcgcccggccaaaacctgaaggtcttatattgtggtgtgagtttatatttatttccatcattttatatttgtcagatttttatgcaggggggctgcataatgtctccctggagagcctcagcctctgtggaagagttgggtcaggagaagcctctcggcggaggaagccggrgggagaagcctctcggtggaggaaccttcacccagagaccagcctgggggtccttggcccagacgggggaggtgggaacatggccttgggttctttcctccttgcagtttgggtgaataatgtgtgatgaggcctaagaggagatttataaagagtataatctctcagtcttagagaaaagtgtttcaaagtatgggttctcagtgtctgtattgaaaaaataaaaaattcagtgaatgggtaggttatttttcgatctgagggttatttctaagcacatgatttatctttagcacggga

SEQ ID NO: 138715 - DNA, 601 bp, Human
tagagaaaagtgtttcaaagtatgggttctcagtgtctgtattgaaaaaataaaaaattcagtgaatgggtaggttatttttcgatctgagggttatttctaagcacatgatttatctttagcacgggagggtgatgccccgccatgtctttttagcttagggactgtcttctgccgtgagttggcctctctgcctgtgcacgtgtgttgccggccccggctcagctgtggcagaagtcagtcacctgtggagttatggaagtccaggcggccaccccaggccggggcctcattccgttargtagggccaggtgtctgtcctctcacgcgtccgaggtggctgccggcgtgcgggtgtgactgtcgatgagagctctgagctgggatatctggtgacggctgcccctgcttggtcttgcggtgtggctggggagaggattactgggtggaatgtagccgtccgccttttgtgttgacctcttgacctcccttttgggaggcttattaatgtcaaaaagtgaagatatgaggatgggatcgtaatttctttgtgttgctttccagtagcccagggaccaagctgtgggaaccaggcctccat

SEQ ID NO: 138716 - DNA, 601 bp, Human
agttgtgcttctcaagcctttcaaatgcctcacagcggcagtccgacgtgcagtcagtgacagctgagtagattaccaccctcaggactaaatgcaaaatcatcttcactgggtgcagcatttacagttttggtgctggaacctcctaaccagtgttcttaggggctgtcttaccagtgaagggagctgcctgctgttgacgctccacaggaggtttgcggcatggctgccatctgtgttgtggcctgggactttcttagagagtgggtaaaagatgagtcatctcttgtgtgatttatcrgcttcacttgtgcttccagggctctttgaagcgtctcactttttaatttcatgaagaaacaaatgtagtgcagagaacagaaagctgctgtgtgacctgcgggtgcccagcctgtggggcttcctcatcgcccccatccaggcagatcgagtgccggctctctgtgctctccaggaggtggcctttcacagcagggacgttctgtgctcttattttaacaactgtaagaatctgagcttggtgacagttgggtgacccgggctctgtgtcttcgtgttggccagggtgtgtcatacacct

SEQ ID NO: 138717 - DNA, 601 bp, Human
gcagtccgacgtgcagtcagtgacagctgagtagattaccaccctcaggactaaatgcaaaatcatcttcactgggtgcagcatttacagttttggtgctggaacctcctaaccagtgttcttaggggctgtcttaccagtgaagggagctgcctgctgttgacgctccacaggaggtttgcggcatggctgccatctgtgttgtggcctgggactttcttagagagtgggtaaaagatgagtcatctcttgtgtgatttatcagcttcacttgtgcttccagggctctttgaagcgtctmactttttaatttcatgaagaaacaaatgtagtgcagagaacagaaagctgctgtgtgacctgcgggtgcccagcctgtggggcttcctcatcgcccccatccaggcagatcgagtgccggctctctgtgctctccaggaggtggcctttcacagcagggacgttctgtgctcttattttaacaactgtaagaatctgagcttggtgacagttgggtgacccgggctctgtgtcttcgtgttggccagggtgtgtcatacacctggcctggcctgcgtgcctcacgtgtggtggggatttg

SEQ ID NO: 138718 - DNA, 601 bp, Human
ctgcaggcagctgagggcctctgggaaggcttctctacaacgtcctgtgggaactggaaacccagatgtcagtggaaccaggtgttctgtccatcactgcctcttacctcctagcaaattcaacactggcgtttttttttctgagcaagttgagctgcatttttgggacaggagccatggctgtgtgtgctggtgctgaagggagggtctgcagggacggccacacggatggctgtgtgtgctggtgctgaagggagggtctgcagggacggccacgcggctctcgggagccgtttcctgygctcgggctctgcaccggcaggctccacgctgagggtccctccacatccaccccatcgtgggagggaggctcagtgctctgcaggggcctgagcagtcggggagacaccccctgcccacagccaccctctctgggctatgtgggaggtgcccacgtttccacgccttcctcgtggagggtgtggcgggctgtctgtgccgcgggggtactcggctgcactgtgcacagccctcaccgcccagtgccgaaatgggaaggcctgacagggcgatgcggtctgcaccagctacatctgcagaa

SEQ ID NO: 138719 - DNA, 601 bp, Human
aatcagagccaagaggcttggtttttctgttcttgttaaggaaattgatcatctcacaccctctcaagctgttttactttgtgcaaatcagattcctttctagggacctgcgaggagaaacatcctcagcttctaggactcccggggatgccgtcagcagccaggccttggcagctgccgcttcacctgtgctggcgtgtggggccctgacgtctcttgcgggtgtcatggagcaggattggaggtttctgagcagcaggagggcaggagaaaggccccaggactttgcgctgtggcctgkcctggaaggaggctggctgggcccttctggatgcctgtagcagcactgccacctgggcagaggccccagaggccccagaggccgaggcaggctttgttctctgctgctgggactcagccctgcgggagcacagggaggacagctggaagcccagcccctctgtggctctgtccacagctggggacagcagtccagtgtgcacgggccacccacagccctctcaggaactggcctcttctctttaagacagaggagtgcgccaggtgggcctctggctggacctcctaggccatcagtttt

SEQ ID NO: 138720 - DNA, 601 bp, Human
gggtggctgattcatcccagcagctgactacgatggtgctaaagagaaccatcttacacggacttggggacagaaacctgggctcccctaccgaggtcaggtcctgggggtgtggtgggatcagctcccccagcacctccgtggcctggggtggggggtctgtgtcctcccttgggggcttctcacagggctgccaagcagtgtccaggtgcatgcgttgggcgtgcaggaggcctgaggccagtgtccatgctggccactgccactcgcggttgtctgttgggagtcggtctgtccagtrgatgaataaattgggactcagcggtttgcacccagatgcccgaggctgtggagttgccgggtggtcgtgcctggggctgcctggagtggtgttgcagtgactgtccctggggatctggcctggcagggatgccacatttgggcagcgctttcctcttgaaggtgccacagcctgttagttttgatgtgttggccacgaacaggctgccctgttagcacagaaagtgaacgtgagcagtacgagaaggctcagagtggactttccggggcaaacaactgagggccttttgggcgtcacaga

SEQ ID NO: 138721 - DNA, 601 bp, Human
ccatcttacacggacttggggacagaaacctgggctcccctaccgaggtcaggtcctgggggtgtggtgggatcagctcccccagcacctccgtggcctggggtggggggtctgtgtcctcccttgggggcttctcacagggctgccaagcagtgtccaggtgcatgcgttgggcgtgcaggaggcctgaggccagtgtccatgctggccactgccactcgcggttgtctgttgggagtcggtctgtccagtggatgaataaattgggactcagcggtttgcacccagatgcccgaggctrtggagttgccgggtggtcgtgcctggggctgcctggagtggtgttgcagtgactgtccctggggatctggcctggcagggatgccacatttgggcagcgctttcctcttgaaggtgccacagcctgttagttttgatgtgttggccacgaacaggctgccctgttagcacagaaagtgaacgtgagcagtacgagaaggctcagagtggactttccggggcaaacaactgagggccttttgggcgtcacagatttggtttagttcggatcgaggtaatcatcttgaacccgcttattaga

SEQ ID NO: 138722 - DNA, 601 bp, Human
gtccagtggatgaataaattgggactcagcggtttgcacccagatgcccgaggctgtggagttgccgggtggtcgtgcctggggctgcctggagtggtgttgcagtgactgtccctggggatctggcctggcagggatgccacatttgggcagcgctttcctcttgaaggtgccacagcctgttagttttgatgtgttggccacgaacaggctgccctgttagcacagaaagtgaacgtgagcagtacgagaaggctcagagtggactttccggggcaaacaactgagggccttttgggcrtcacagatttggtttagttcggatcgaggtaatcatcttgaacccgcttattagagtcagtggctttttctgtctcacagccgccttcttgtttggtttcgcgtctcacatgcattctgtgatcctcactgactttttagaaggaaaatgtttgacatttacaagaagtgagagatactcttgcaaatcatccagcagtttctggtttgcagattgatggcagccctggcctttaccctcagtgcctcctgccggtgatggtgctgccggctctgacctgtgtgaggagggccttggaga

SEQ ID NO: 138723 - DNA, 601 bp, Human
acctgctctgggcagagccaggcatcccctgggacgctctgcctttgcgtgtccacgacagtacaattccaggcactgcctggcatctgcgtctctccctcccctgaaccaggggcgcctctccctcccctgaaccaggggctcctcttcctccctgcctggcaggagctgcgtttccttgagtctcctcagactcggcagacccctgggtggtatcatgtgctattctgaaggagcttttgcttcatggcacttgaaaaaaatcctttcactggatctgagttggtgagcatgcatcttyctttcgtaggtttgttttctgaccaggccgtgggtctaacaggagccccgagcctctgggtgggctccgtgtcgcttgcgtgcctcactcatctggcaccgtgaccgcgctccggccctgagccccacttctctgaagcctcacgtgttgcccgtgtggtctgctcctcaccgtcttttctcttgtccttgcccagttgtcgccgtgatcctgaaggcgctgacctacgacgagaagcggggtgcctgcagcgtgggcaccaacgtcagggacgccgcctgctacgtgtgctgggccttc

SEQ ID NO: 138724 - DNA, 601 bp, Human
ctgcctggcaggagctgcgtttccttgagtctcctcagactcggcagacccctgggtggtatcatgtgctattctgaaggagcttttgcttcatggcacttgaaaaaaatcctttcactggatctgagttggtgagcatgcatcttcctttcgtaggtttgttttctgaccaggccgtgggtctaacaggagccccgagcctctgggtgggctccgtgtcgcttgcgtgcctcactcatctggcaccgtgaccgcgctccggccctgagccccacttctctgaagcctcacgtgttgcccrtgtggtctgctcctcaccgtcttttctcttgtccttgcccagttgtcgccgtgatcctgaaggcgctgacctacgacgagaagcggggtgcctgcagcgtgggcaccaacgtcagggacgccgcctgctacgtgtgctgggccttcgcgcgtgcctatgagcctcaggagctgaagccctttgtgactgcaatctcgaggtaggcccattcgtcgaggtacatcggatgcgccgtgccccctgacggcgccgtgtgtcgtttcctccatgagaggtgtgcacagcagatgctcgtgaaaa

SEQ ID NO: 138725 - DNA, 601 bp, Human
ttagaagctcctcctgcagctgttcaggagccgagcgtcccctgctcactacaagacgcctgaaggggtcatgggatgcagcgtctgaagcttccacctggaagtgcactgctccttttggtctgggcggggcggggcgccggtggcagatgcccctggtggcaggctcaggctactgtgctgggtcccctctgccccgcacgccccgcgagcaccagcagggcctccccggcatgtggcggggccagcgttggcctggggcccgcttggctttgatctcgtggggcttcgtcttttggaygtcctgggtgcgcctccactgtggctcctgggttccctcacgcacccgggtgtaagcgccactgcctgtgtccgacaagcagctcgttgtgaggcacacgctggtaagcagctcgttgtgaggcacacgctggtgtaggctccgaagggtctcggtgacaggcgcttttctcttgttcctgcccactgctgttccatcttaccaaatactcagtagcgtccggagagggacctcaacccggttacttccctgggtgtgcagcacgtggccagcgtctcatagtctagattcttgcatcag

SEQ ID NO: 138726 - DNA, 601 bp, Human
tgatctcgtggggcttcgtcttttggacgtcctgggtgcgcctccactgtggctcctgggttccctcacgcacccgggtgtaagcgccactgcctgtgtccgacaagcagctcgttgtgaggcacacgctggtaagcagctcgttgtgaggcacacgctggtgtaggctccgaagggtctcggtgacaggcgcttttctcttgttcctgcccactgctgttccatcttaccaaatactcagtagcgtccggagagggacctcaacccggttacttccctgggtgtgcagcacgtggccagygtctcatagtctagattcttgcatcagagcgaagcctgagaggagccgagggtcctcctcctatccagggagaccgtgtgtttcccgaggcagctgtgaacacgcacgtccctcttgtcctgctcctcttcggaggagaacagcgcggctggagggtgctggtgctggccaacgtgttatggagagtgtggcttacctgaggccagggaggtctggggtggctgagagcggctgtggcctctgtctgctgctctccccagtggccactctggcagcgctgctgggcaggggcttggctgc

SEQ ID NO: 138727 - DNA, 601 bp, Human
gcagcacgtggccagcgtctcatagtctagattcttgcatcagagcgaagcctgagaggagccgagggtcctcctcctatccagggagaccgtgtgtttcccgaggcagctgtgaacacgcacgtccctcttgtcctgctcctcttcggaggagaacagcgcggctggagggtgctggtgctggccaacgtgttatggagagtgtggcttacctgaggccagggaggtctggggtggctgagagcggctgtggcctctgtctgctgctctccccagtggccactctggcagcgctgctggrcaggggcttggctgctggtggtcttcagggagcagtgccttgcagagtggagcagagaagacggagaggtccggctttaggcccctgccgagctcctgaggccctgccgcgtgcctgtgccagcctgcagcgctgctgtctgtgtgcgggagctcttgtgtgtgatcagcctcaggaaaggctcttcctgttacttccttgtgctgctcctgcacttctaggaagttgatcctgtaactaggaagtgaaagcaaaaaaatgtatctttcttattgttgataggaatagtcacagaacgag

SEQ ID NO: 138728 - DNA, 601 bp, Human
cattcagtttccttagcaaccctgagaggtgggcaggggccaccgtcattctggtttcactgaggaagtcaggacagcactgaagacacctgtccagcaccttgtgctgacggcttcccagccaggcccatcacctggtggccgaaggcttctgagccaggcccatcacctggtggccgacggcttctgagccaggcccggcacctcgtggccgacggcttctgagccaggcccggcacctcgtggccgacggcttctgagccaggcccggcacctcgtggccgacggcttctgagcagcwccccaggccctggcccggggctcagcgctgcctcgtggctgagaagctcctcaccacctgctgtgaggccgtggaaagaccctgaatgcagacgtgtgacggctgcagctgcatctggcccctcagatggtggttcccctttcatggtgaaaatcctcacggatttccttttcagcctcatattttgtctaagagctgtcaacatcactgaaacctgggcctgcccttcatcctggggaggactccctggtccagtgtcacaggaggagtcgggccagggttgagggctggcacaggaca

SEQ ID NO: 138729 - DNA, 601 bp, Human
gcccctcagatggtggttcccctttcatggtgaaaatcctcacggatttccttttcagcctcatattttgtctaagagctgtcaacatcactgaaacctgggcctgcccttcatcctggggaggactccctggtccagtgtcacaggaggagtcgggccagggttgagggctggcacaggacatgggggtgagacgaaacctccactcacctgggagggtgtctaggtgggcacggaacccagggtcgtgtatgggccatcactcatgggttctctgttttgggggaaagctgatcccacyggaggttgactgtaatgagagtctccagatcaggtgccgactttggagaaatgcaggtgcaactgtccgaacaaatcaagtccccgctactggacggggctggcagctcagctggggccggagagaaaagtcacgagcaagaaagttcttacctaaggtcctggacaggcagatacataacttctgcctttggcaacgttagatgtcatcgttccagagtaaaatacctataaaaacctgccgatgcgcggggagcctggccttggtctgggtgtggagggctgggggccggccggtcgg

SEQ ID NO: 138730 - DNA, 601 bp, Human
cagatggtggttcccctttcatggtgaaaatcctcacggatttccttttcagcctcatattttgtctaagagctgtcaacatcactgaaacctgggcctgcccttcatcctggggaggactccctggtccagtgtcacaggaggagtcgggccagggttgagggctggcacaggacatgggggtgagacgaaacctccactcacctgggagggtgtctaggtgggcacggaacccagggtcgtgtatgggccatcactcatgggttctctgttttgggggaaagctgatcccactggaggktgactgtaatgagagtctccagatcaggtgccgactttggagaaatgcaggtgcaactgtccgaacaaatcaagtccccgctactggacggggctggcagctcagctggggccggagagaaaagtcacgagcaagaaagttcttacctaaggtcctggacaggcagatacataacttctgcctttggcaacgttagatgtcatcgttccagagtaaaatacctataaaaacctgccgatgcgcggggagcctggccttggtctgggtgtggagggctgggggccggccggtcggtaggtc

SEQ ID NO: 138731 - DNA, 601 bp, Human
tgagtttctggagtagcctggactgcacagccagggcctccccggcatgtggcggggccagcgttggcctgggtcccacttggctttgatctcgtggggctttggtttttggaggtcctgggtgcgtctccaccatggctcccgggttcccttgcgcacaccgagccagcagctgctggggcctcagggctcgcagctcacaggcttctgacgcctcagcctggagctggcgttgtgcccctcgcccctttacctgtgccatcccggccgcagacccaagggtgcccttggagccgtgccygccggcctgggtgtcaggcttgtccaacgggttcttagagaacctgggccccatccctccttggcccacgcagactccaggcatccggccgggcgggctgtgagtcaggctgcaccaggtgagcgtgtgggatgctgctggtgcgagcctccctgcccaggagccctgcgcacccgggtatcggttggggtgtgcccttccagatctccctcccttggtttgtcataggtgaccacattttaattaccagcttttatgcccgtcaatttgggaacgtgatacaatcttgatttctctaac

SEQ ID NO: 138732 - DNA, 601 bp, Human
cagtgtatttggctttttattgctataaaatattatataaataagaaaacttgagctggggtgaggtctgcactttgctgtacctgccgaaaatgaggtgcctggagcttgggacaagtcgaggcgtgcacttccccttgactcggacaggaaagagaatccctttctgtttgacacagaccatttctctgtgttgggaaatcctggtgaagtatcacataaacttctccagcgaaagcaaacgggcgaggacacctagggcacgtttcagcgcagacaggccggcccttctcgcggcctygcagtgtctctctccaggttcccggggatggtagatgaacgtggtgactcactcagggtgttcctgcgaagggaaactgagaggcccacgtgggacgttgggtgtcctgttggagtagtcctttaggaaggagcttttatatttatatttaactagcatcattaaacctgtttgtatttatttctcgatgagccagttttgttctgagaatgagaaaatagagccgttttaataaatgtccaaatcaggacagtgttaaatttgttgtaagtccatatatagttgattggtcgaattaac

SEQ ID NO: 138733 - DNA, 601 bp, Human
tcctggtgaagtatcacataaacttctccagcgaaagcaaacgggcgaggacacctagggcacgtttcagcgcagacaggccggcccttctcgcggcctcgcagtgtctctctccaggttcccggggatggtagatgaacgtggtgactcactcagggtgttcctgcgaagggaaactgagaggcccacgtgggacgttgggtgtcctgttggagtagtcctttaggaaggagcttttatatttatatttaactagcatcattaaacctgtttgtatttatttctcgatgagccagttttrttctgagaatgagaaaatagagccgttttaataaatgtccaaatcaggacagtgttaaatttgttgtaagtccatatatagttgattggtcgaattaacttgggagtctgtgtttagttaaaaacagcgtttctcaggcgttgctgtattttctgtgaggttcagtaaaatatacacgcaacagcaaccattttgacttctcatggcaggagccagcttcgttgaagtgggccaggctgaagtgaggccagctttgcctgctgcagccctgtggtctgtgtccaaattgctgagtactgc

SEQ ID NO: 138734 - DNA, 601 bp, Human
gctgttgaagtggactgaacaacagtaaccttagagggttagacttggtgaggatggtagatgattttaagtttcttctcttttttccattctttcttcattaatcaatgttccacactttaaatatagtaatttaaacaaataacacatttcaagaattcagtgtaacatgtgacctttcagtagtattggctggagccggcggcaataaagatagaagcctgtgttcctcttgtggcaaatgttaaaggaaaccagaaattcttgattcatatttttccctagaacacgtggctttacrggtttcaaaaaatgaaactcttgttcatatggtaaatatgacacacatttctatgcattctgaaaagatttagaataaactgccatttgttgttaaaaatagcagttatataactttttttttttcttgagacggagtcttcctctgtcgcccaggctggagtgcagtggtgcgatcttggctcactgcaatctccgcctcctgggttcaagcaattcttctgcctgcctagtagctgggattacaggtgcgcatcaccacccccgattaagttttttgtatttttagtagagacagggt

SEQ ID NO: 138735 - DNA, 601 bp, Human
gccggcggcaataaagatagaagcctgtgttcctcttgtggcaaatgttaaaggaaaccagaaattcttgattcatatttttccctagaacacgtggctttacaggtttcaaaaaatgaaactcttgttcatatggtaaatatgacacacatttctatgcattctgaaaagatttagaataaactgccatttgttgttaaaaatagcagttatataactttttttttttcttgagacggagtcttcctctgtcgcccaggctggagtgcagtggtgcgatcttggctcactgcaatctccrcctcctgggttcaagcaattcttctgcctgcctagtagctgggattacaggtgcgcatcaccacccccgattaagttttttgtatttttagtagagacagggtttcactgtgttggccaggctgttctcgaactcctgatctcgtgatccacccaccttggcctcccaaagtgctgggattacaggcgtgagccactgcgcccggctgtagttatataacttttagttattagaagatcacattcatatgtcttgatcagtttaatgatttctaagatatcattaacaaaagccattatg

SEQ ID NO: 138736 - DNA, 601 bp, Human
ggggcacttaaaaaataggttttattgagatgaattcacttgccataaaattcacccctttagggtccacagttcagtggtttttagtgtattctcagacttgaggagacctcaccccagacagaagccatgtgcaccaggtcccgtcacccgctccaagcctggcactgccagcctgctttccgcccctgtggatttgaccctgagacctccagagacgactggccagatgttctgtaggacgcccctctctctgatgctttctcgtgtgttactggaaagagtgatgtgaggtgacctgccctcctccgtgtgctgttgggcccatatagtgccccacaacgggtcctgcgtggtctggaccttgatccctggtcaagatggggcctgccaggtgcctccacttgaggagactgtgttttcctctgtaactagcagtgttcttgtggggtactcgaaggttatgcaacatcctgctgtttctcctttggttttcaccccatccgagctctgtccaaagaccttgttgtgtggtctggtggtggttcctgtgtccccaccccgacgttcagtgattgcagcttgttcttaaggaaggctc

SEQ ID NO: 138737 - DNA, 601 bp, Human
aaaaaataggttttattgagatgaattcacttgccataaaattcacccctttagggtccacagttcagtggtttttagtgtattctcagacttgaggagacctcaccccagacagaagccatgtgcaccaggtcccgtcacccgctccaagcctggcactgccagcctgctttccgcccctgtggatttgaccctgagacctccagagacgactggccagatgttctgtaggacgcccctctctctgatgctttctcgtgtgttactggaaagagtgatgtgaggtgacctgccctcctcygtgtgctgttgggcccatatagtgccccacaacgggtcctgcgtggtctggaccttgatccctggtcaagatggggcctgccaggtgcctccacttgaggagactgtgttttcctctgtaactagcagtgttcttgtggggtactcgaaggttatgcaacatcctgctgtttctcctttggttttcaccccatccgagctctgtccaaagaccttgttgtgtggtctggtggtggttcctgtgtccccaccccgacgttcagtgattgcagcttgttcttaaggaaggctcgttcctctc

SEQ ID NO: 138738 - DNA, 601 bp, Human
caccaggtcccgtcacccgctccaagcctggcactgccagcctgctttccgcccctgtggatttgaccctgagacctccagagacgactggccagatgttctgtaggacgcccctctctctgatgctttctcgtgtgttactggaaagagtgatgtgaggtgacctgccctcctccgtgtgctgttgggcccatatagtgccccacaacgggtcctgcgtggtctggaccttgatccctggtcaagatggggcctgccaggtgcctccacttgaggagactgtgttttcctctgtaactakcagtgttcttgtggggtactcgaaggttatgcaacatcctgctgtttctcctttggttttcaccccatccgagctctgtccaaagaccttgttgtgtggtctggtggtggttcctgtgtccccaccccgacgttcagtgattgcagcttgttcttaaggaaggctcgttcctctcccagctttatttcatcattcgctcctgccagtgtggactcatgggtgctcatcctgtttgggggttatcatctaacactattgttactagttttgtttgagttataatctaacactaactattgt

SEQ ID NO: 138739 - DNA, 601 bp, Human
ttttggtgatggggtgggccccacagttcctcatgggctcgagctgctggaactctgtgtgcaggctcagcatagctggcttagtgggaacctgttgagggagccgttcacactccctgatactgtcagacttgggggccagtggaccaggtggaaggggtgctgggactggtgagggtttcctgtcagccctgcagtgtgtggcccctggtgagtgggaccaggcggaaggggtgctgggaccggtgatggtttcctgtcagccctgcagtgtgtggcccctggtgagtggggccgtgcrggtgcagtgttggttctctctctctctcaaatgcaggagctcagatgataccctgaagtctttctagctcaaaatgtctgtcatcttctatagcttctggtggtctgcctgctctctgtatcctgaagtagttagaagtctttctctgcctcaggtcctttaaaactagagagaattcaccaggagagctcagaagctcttctctgtccctgaagctgctcttattttgtcttcagcatcagtaaaaacctcataattttttggggaaatcatcacatttttgccctgctatttacccaa

SEQ ID NO: 138740 - DNA, 601 bp, Human
ttttgccctgctatttacccaaaggcagtaaatgtaagactttgaaatataatacaattttatgttaaatctgtacttaaattaagcttttagattttctttactgcaacctaagacatttcatgggaagcagtaataaaattaaagtacttaggcttctatgaaccctgaatatgaggtgaaataatataaatcatttttcacattaaaatccctttaaattggcaataaatcttttctgataaataccaccgagtgcacctagcttaccctgtagcttgcaaaattaaaacagccaaargtaaaagacacctttttgaagcttagttggaaatgtgaggattgagggcctcataattgggaatcattttttggagctgctgctttcagataacgatgtctcggtctttctggctcagcttggcttcctgtttgacgctgtgtcactgggtgaggtcacccctgtgaggccctgaggcctcttcagcaccggccaggaggcagcagcaaaaggcgttgaagtcctgtccctccttggggctggacacggtcccttgcccctgaactctagacgccctgcattgccctggtgctcccatgt

SEQ ID NO: 138741 - DNA, 601 bp, Human
ggtgccgcctctcccatgtcagagcctcggcggctgctggtcctcgatgcttctggggtcagctgtcaccacccccaagaaccggctgggccagctgcccccagtcaacgtcttgcctgcccgggactgctgagtgaggcctgggctctggtccaggctttgtagaccgtgcaggcggctgcatccccgacctgacccaggcctgctcgctctggtgtgcaccgacctgccagctttgtggcactttgtggcatggggctcaggccgatggaggtcagtggctgtaacactgttgagaccygaagaccgtttacggtgtatgttttcgggaaaggtctcttaccacgtaccgaagtggaaatgtttgagttgtttgaaaaagatgaaatacttgtgagtggtttcaatgatttagcgtggtgttgcctgggtagaccgtcaggaagtcagtgtgacgtggaagtcctcggcgagccatgtctgtggtgtgtggcttgctcaccacctgcctcagggctcggggttcatgagtgtaaatgtctgtggatgtgattattgaacttggtgaaatgcctttgttcattcaaattcttctttttcc

SEQ ID NO: 138742 - DNA, 601 bp, Human
tagttgtgtaattaggtactggggaggttacttcagttatcttagttgatccattgcagcagaaatgtgaaaaagggtgtgactttatttatttatttttggagacagaatctagctctgttgcccaggctggagtgcagtggggtgtgactttatgaagtgatttatttgccttaaattaggaccagaagcatgcccgatgcatttttaacattaaccattaaataccctaaagatcgattccccaacagccctgctgtgtagaccgtgcagaaaggacgtttctccgtcaccagcctgsgcagaattttgaaaatgtagcatttggcctctttcccaggaaggatctttgaacacacttatctgtatttttataccctttcaggtttcctcaacatttaatgtccttttttgccttatcagttctttcctattaatacttggccatatattttatgtggaaaatctactggcccgatgcagtggctcatgcctgtaatcccagcactctgggaggccaagacgggcagatcacctgaggtcaggagttggagaccagcctggtgaaaccccgtgaatactaaaaatacaaaaattagcc

SEQ ID NO: 138743 - DNA, 601 bp, Human
ccctttcaggtttcctcaacatttaatgtccttttttgccttatcagttctttcctattaatacttggccatatattttatgtggaaaatctactggcccgatgcagtggctcatgcctgtaatcccagcactctgggaggccaagacgggcagatcacctgaggtcaggagttggagaccagcctggtgaaaccccgtgaatactaaaaatacaaaaattagccaggcgtggtggcgggtgcctgtaatcccagctactcaggaggctgaggcaggagaatcacttgagcccgggaagcrgaggctgcagtgagccgagatcgtgccactgcactccagcctgggtgacagagtgagactccatctaaagaaaaagacaatctaccaccttttcccgagtttcctgagtaacacacctgacagctatgggaagcttcagcatatttcccttgttgctgaggtttctaagccagcctaaaactcgcatgtaattagctgtgtgcgttttataaaaacatttgccaacccaagacctgggtccaggcatgtcttcccccagtgtgtttggcttcctcacgatgccaggccctgcgtgcagac

SEQ ID NO: 138744 - DNA, 601 bp, Human
gaaaaagacaatctaccaccttttcccgagtttcctgagtaacacacctgacagctatgggaagcttcagcatatttcccttgttgctgaggtttctaagccagcctaaaactcgcatgtaattagctgtgtgcgttttataaaaacatttgccaacccaagacctgggtccaggcatgtcttcccccagtgtgtttggcttcctcacgatgccaggccctgcgtgcagaccagatgccacttgtgaggacgcaccggcaggcaggcccctccaatcctgagggcggcatcacggggacckgcagtcatggctgcaccctagcaccgcggggcccccctgcacccgaggcagggtcctgctgtcagcctggaccttggggtgagggaggcagtggtcctgttcagcagagggcatgggactgagcacagcccatcagggaggagagttagcagggccctgggccctggcggggagctgctgggggcctttgagccatagtgaagagtgtggattgtcctgaggtcatggcactttgatggtcaggtctttgttttgaacatatccctgtggctgtatttggtgactggaaataaggagagg

SEQ ID NO: 138745 - DNA, 601 bp, Human
gttcagcagagggcatgggactgagcacagcccatcagggaggagagttagcagggccctgggccctggcggggagctgctgggggcctttgagccatagtgaagagtgtggattgtcctgaggtcatggcactttgatggtcaggtctttgttttgaacatatccctgtggctgtatttggtgactggaaataaggagagggcttgagggctcttgggagacgggagagggctgggggcctggaggtgtgcccgctggaggaaggtgggagttgccagggcattacagagggtctcagarctgtgttggcatcactccgcaggtggagggcacagctgagggcgacagtgtcgttgagtgtgaggaggttggggcctcagcttgcacgtgctggcctgcgaggaagcatcagccgtgctgacacggagatgtttcctctgcaaattggagtttcggacacacagactggaattgaactaacgggcaccccaggaagactgtggggcgagacgaggaggatggggggaccagccgtcgccccactctcctgttcatcatcacagcctcgttggggtgtaaacgacccccagtaagctggtg

SEQ ID NO: 138746 - DNA, 601 bp, Human
ggccctggcggggagctgctgggggcctttgagccatagtgaagagtgtggattgtcctgaggtcatggcactttgatggtcaggtctttgttttgaacatatccctgtggctgtatttggtgactggaaataaggagagggcttgagggctcttgggagacgggagagggctgggggcctggaggtgtgcccgctggaggaaggtgggagttgccagggcattacagagggtctcagaactgtgttggcatcactccgcaggtggagggcacagctgagggcgacagtgtcgttgagtgygaggaggttggggcctcagcttgcacgtgctggcctgcgaggaagcatcagccgtgctgacacggagatgtttcctctgcaaattggagtttcggacacacagactggaattgaactaacgggcaccccaggaagactgtggggcgagacgaggaggatggggggaccagccgtcgccccactctcctgttcatcatcacagcctcgttggggtgtaaacgacccccagtaagctggtgcatgttcaataggtacatttttgtaaatgttaacatctgtaaattcgtacctatcaccaca

SEQ ID NO: 138747 - DNA, 601 bp, Human
ggaggtgtgcccgctggaggaaggtgggagttgccagggcattacagagggtctcagaactgtgttggcatcactccgcaggtggagggcacagctgagggcgacagtgtcgttgagtgtgaggaggttggggcctcagcttgcacgtgctggcctgcgaggaagcatcagccgtgctgacacggagatgtttcctctgcaaattggagtttcggacacacagactggaattgaactaacgggcaccccaggaagactgtggggcgagacgaggaggatggggggaccagccgtcgccccrctctcctgttcatcatcacagcctcgttggggtgtaaacgacccccagtaagctggtgcatgttcaataggtacatttttgtaaatgttaacatctgtaaattcgtacctatcaccacaatcaagacgagaaaaggcccaggtttcccctttcccattcggggtccctcccctcccacacccccttcttcaggcacccctggtctgttgctctcactgcagctgtgtctgcatttcccaaagctctgtgtgaatgggttcaggcagtgggcactctcctcactcacactggcttcctctg

SEQ ID NO: 138748 - DNA, 601 bp, Human
ggaagcatcagccgtgctgacacggagatgtttcctctgcaaattggagtttcggacacacagactggaattgaactaacgggcaccccaggaagactgtggggcgagacgaggaggatggggggaccagccgtcgccccactctcctgttcatcatcacagcctcgttggggtgtaaacgacccccagtaagctggtgcatgttcaataggtacatttttgtaaatgttaacatctgtaaattcgtacctatcaccacaatcaagacgagaaaaggcccaggtttcccctttcccattcrgggtccctcccctcccacacccccttcttcaggcacccctggtctgttgctctcactgcagctgtgtctgcatttcccaaagctctgtgtgaatgggttcaggcagtgggcactctcctcactcacactggcttcctctgctccatgcttcctgcagactgtccgcctgtggggaccgtcccccgagcctccagggccaggggtgtggtacgtggcgtctgtctccactcacctggtgaggggcttctgggcagtgtcttgtctgggttgtcacaggtgcagctgcggtgaacatgtgtg

SEQ ID NO: 138749 - DNA, 601 bp, Human
atatagtaaaattgccagttttcaatatgggtttaagtgtggcagcgggtttggcagatgtgagctgttgaatgaccaccactgtggtcagtgtggtgcacatgaccctccctccaggaggcgccatcctgactgacctcctgtcgctggggctcccctgttttagaatccgtgcaggtagcttccttcatctgctgcctgcctcatcagctgcctgtgtttcagggttcctcagtggttctcactgtgtggacgccccacatttgaggggctttgagcccccgtgggttttgatgtgagcacacggcacagctctgttctccccggctggttttctgttggagtgagcattgagcccccgtgggttttggtgtgagcacacgtcacggctctgttctccccgatggttttctgtttttcatgagcattgagcccctgtgggttttggtgtgagcacacggcatggctctgggttttggtgtgagcacatggcatggctctgggttttggtgtgagcacacggcatggctctgttctccccggctggttttctggttttcgtgagcattgagcccccgtgggttttggtgggagcacacgg

SEQ ID NO: 138750 - DNA, 601 bp, Human
agtggacggttgtggaggggctgacagtgtgtccacctgcgtcacctgcatcttccttgggagtggagctcccaccacttccacggccaacactccttccccccagcctgtgtgctgctgccctgccctcgacgcggagcagggctgcccctcggggaaggtcgtatccatggaaccagagggaacacactcctgtgtgtcaggttctttgctcagcgtagtgcgcctggggaccgtccgcagcgcgtgtgtcctcagtgcatgtgtcctccgctagtgtcctcagcgtgtccgcagtgcrcgcgtcctcggctcgtgtcctcagcgcgtgtccgcagtgcgtcctcagcatgtgtcctcagcgcatgtcctcagcgcacgtgtcctcagcgtgcgtgtcctcagcgcgtgtgtcctcagtgcgtgtgtcctccgctcacgtgtcctcagcgcgcacgtcctcagctcgtgtcctcagtgcgtgtccgcagtgcgtcctcagtgcacgtgtcctcagcacgcgtgtcctcagctgcttttcgttggtgagtctttgctcagcatcgtgcgcctggggcccgtcctcagcgtgtgtgtccgc

SEQ ID NO: 138751 - DNA, 601 bp, Human
ggaaggtcgtatccatggaaccagagggaacacactcctgtgtgtcaggttctttgctcagcgtagtgcgcctggggaccgtccgcagcgcgtgtgtcctcagtgcatgtgtcctccgctagtgtcctcagcgtgtccgcagtgcacgcgtcctcggctcgtgtcctcagcgcgtgtccgcagtgcgtcctcagcatgtgtcctcagcgcatgtcctcagcgcacgtgtcctcagcgtgcgtgtcctcagcgcgtgtgtcctcagtgcgtgtgtcctccgctcacgtgtcctcagcgcgcrcgtcctcagctcgtgtcctcagtgcgtgtccgcagtgcgtcctcagtgcacgtgtcctcagcacgcgtgtcctcagctgcttttcgttggtgagtctttgctcagcatcgtgcgcctggggcccgtcctcagcgtgtgtgtccgcagcgcgtgtgtctgcacctccttttggttggtgagttgtgtgcactgttctgtggctatacagtttttctgtgagtttgcctgacatttaggttattttgaatttttggctctgatgaataaagcagttgtatatatttatttagaaatcatctt

SEQ ID NO: 138752 - DNA, 601 bp, Human
gcatgtcctcagcgcacgtgtcctcagcgtgcgtgtcctcagcgcgtgtgtcctcagtgcgtgtgtcctccgctcacgtgtcctcagcgcgcacgtcctcagctcgtgtcctcagtgcgtgtccgcagtgcgtcctcagtgcacgtgtcctcagcacgcgtgtcctcagctgcttttcgttggtgagtctttgctcagcatcgtgcgcctggggcccgtcctcagcgtgtgtgtccgcagcgcgtgtgtctgcacctccttttggttggtgagttgtgtgcactgttctgtggctatacartttttctgtgagtttgcctgacatttaggttattttgaatttttggctctgatgaataaagcagttgtatatatttatttagaaatcatcttcatgtggatgtgtattttcatttctttcagataaagagttagaatttttatatatttaactttatgagaaactgccaaactgttttgcaaagtggctgtataatcttgtactttcaccagaacgtatgcagcctctggttttcccacatctgtgccaacgcttggtatttaccagtcttttaaaatttacccattcgagtgggggtaa

SEQ ID NO: 138753 - DNA, 601 bp, Human
cttttgggtaactgctcaggagggaatggctggatcacgtggtagatttgaagaaatgggcaaactggttttgaaagtaactgtgctgaattcccacccacaggcagtgagttctcgttcttccgcgtctcaccacctctccatgctgtcttttccagtgtgtttattgccggctttcctgagtacacgcagccaatgatagaccacctggttaccatgaagatcagccactgggatgggtaggttttctgtttttgtttttctaagagctttttttccccccaaaggagagattcagttragcttataagccttgagtgtattttctcactgtggatgtcgtattttaaaataacttctgagaagtaatatgaattccagtcttcatgccggatgtgttgagtcatggtctgtctccagttccacttctggagcgcctggtccagtgtgtccgacgtggcggtgtacccgtgcgaatgtccacgctggcgtgttgtggagtgccgctgccgtccgagggggcgcgggcgtagcttggaggcggactctgcgttgtctccctcagcagtgcttcccgctgactctgctccatgtggctcca

SEQ ID NO: 138754 - DNA, 601 bp, Human
gtttattgccggctttcctgagtacacgcagccaatgatagaccacctggttaccatgaagatcagccactgggatgggtaggttttctgtttttgtttttctaagagctttttttccccccaaaggagagattcagttgagcttataagccttgagtgtattttctcactgtggatgtcgtattttaaaataacttctgagaagtaatatgaattccagtcttcatgccggatgtgttgagtcatggtctgtctccagttccacttctggagcgcctggtccagtgtgtccgacgtggcrgtgtacccgtgcgaatgtccacgctggcgtgttgtggagtgccgctgccgtccgagggggcgcgggcgtagcttggaggcggactctgcgttgtctccctcagcagtgcttcccgctgactctgctccatgtggctccacaggtggtttctgcgctgtctcctgggagcccagcagttcttagtggccgttttcatcattacagtagcagcttcagggtttccttgcatttcataggcagttaaatgtgtctcagaaaggaaaagtgaagtgcggtctggagcataaacagcgcgttagt

SEQ ID NO: 138755 - DNA, 601 bp, Human
cctggggagcggcccggctgcctactgtggtccaggcagggccctcaggactgggagcctctgggaaaggaactcctgggtagcactcgggctgccgggggaagaccctcccttcattcgcttacagagaggggtgtgaattcctgagactcggggtgtccctgcaaatgttacaccaaaactctctccattaggtacaaggtcccctaaaccgaacctggggaaaattaattaatttgtcagttgtatcagccgattagtcaataacgtctttaaaaccaaagttacagatatatgcccrtagcgtcggagctgtgggactctccagttggtacatatgcccgtggtgtcggagctgtgggactctccagctgttgctgtctgtctctgcctcagttctgtcggcctttccttcacgtgttttgggcggggtcacttattggaggcagatacactttcgctttttgtctcttcctaatgtattgaccctttatctttgcggaacggccctcattgtctcgtgtgagatttcttgccttaaagtaactgatgactggtgtagtacctgagttggcaagccttttctttgaggggctggata

SEQ ID NO: 138756 - DNA, 601 bp, Human
ggtccaggcagggccctcaggactgggagcctctgggaaaggaactcctgggtagcactcgggctgccgggggaagaccctcccttcattcgcttacagagaggggtgtgaattcctgagactcggggtgtccctgcaaatgttacaccaaaactctctccattaggtacaaggtcccctaaaccgaacctggggaaaattaattaatttgtcagttgtatcagccgattagtcaataacgtctttaaaaccaaagttacagatatatgcccatagcgtcggagctgtgggactctccagytggtacatatgcccgtggtgtcggagctgtgggactctccagctgttgctgtctgtctctgcctcagttctgtcggcctttccttcacgtgttttgggcggggtcacttattggaggcagatacactttcgctttttgtctcttcctaatgtattgaccctttatctttgcggaacggccctcattgtctcgtgtgagatttcttgccttaaagtaactgatgactggtgtagtacctgagttggcaagccttttctttgaggggctggataaacgtggtagatctctgttccatacgct

SEQ ID NO: 138757 - DNA, 601 bp, Human
agaggggtgtgaattcctgagactcggggtgtccctgcaaatgttacaccaaaactctctccattaggtacaaggtcccctaaaccgaacctggggaaaattaattaatttgtcagttgtatcagccgattagtcaataacgtctttaaaaccaaagttacagatatatgcccatagcgtcggagctgtgggactctccagttggtacatatgcccgtggtgtcggagctgtgggactctccagctgttgctgtctgtctctgcctcagttctgtcggcctttccttcacgtgttttgggyggggtcacttattggaggcagatacactttcgctttttgtctcttcctaatgtattgaccctttatctttgcggaacggccctcattgtctcgtgtgagatttcttgccttaaagtaactgatgactggtgtagtacctgagttggcaagccttttctttgaggggctggataaacgtggtagatctctgttccatacgctttgctttagtttattttatttagtttatgtaacccttgaaaaatgtgaaaaccattcttagctgagggccgtccttactcgaagaggcctcgggctggg

SEQ ID NO: 138758 - DNA, 601 bp, Human
tttccttcacgtgttttgggcggggtcacttattggaggcagatacactttcgctttttgtctcttcctaatgtattgaccctttatctttgcggaacggccctcattgtctcgtgtgagatttcttgccttaaagtaactgatgactggtgtagtacctgagttggcaagccttttctttgaggggctggataaacgtggtagatctctgttccatacgctttgctttagtttattttatttagtttatgtaacccttgaaaaatgtgaaaaccattcttagctgagggccgtccttackcgaagaggcctcgggctgggcttgcggctgcagactgcattgcctccgcttctcaggtgctttgtcttttctgttccctcagagttgcaggcgatggtcttctagacagcatgcagttgggtgtcgctcagggtgtggagtcctggcacatgagacgccacctgcctcgaagagctctttgtttaccgttagaagtggaccctgagcagggccctcggccgacaccagaggggctgtggcaggtggtcctgccagcgcgggcgtctgccattgtgcctggtttcactgtggtgctgtggg

SEQ ID NO: 138759 - DNA, 601 bp, Human
gtctctaggtggctcgcacctgccacacgacactccctggtctctaggtggctcgcacctgccacacgacactccctggtctctaggtggctcgcacctgccacacgacactccctggtctctaggtggctcgcacctgccacacgacactccctggtctctggttggcatgcacctgccacacaacactccttggtctctaggtggcttccatctgccacacgacactccctggtctctggttggcatgcacctgccacacgacactccttggtctctaggtggcttgcacctgccacaygacactccttggtctctaggtggcttccatctgccacacgacactccctggtctctaggtggcttgcacctgccacacgacactccttggtctctaggtggcttccatctgccacacgacgctccctggtctctaggtggcttgcacctgccacacgtgaatgcactttggaattgggcagcgtgtatagaaagaaaaggcctgaatgggagactcaaagtctgcccaggactaacatcaccttggaatggctcagctaagtctgcacttcttacacttcatcagtgaagagagaaatcc

SEQ ID NO: 138760 - DNA, 601 bp, Human
ccctggtctctggttggcatgcacctgccacacaacactccttggtctctaggtggcttccatctgccacacgacactccctggtctctggttggcatgcacctgccacacgacactccttggtctctaggtggcttgcacctgccacacgacactccttggtctctaggtggcttccatctgccacacgacactccctggtctctaggtggcttgcacctgccacacgacactccttggtctctaggtggcttccatctgccacacgacgctccctggtctctaggtggcttgcacctgccacacgtgaatgcactttggaattgggcagcgtgtatagaaagaaaaggcctgaatgggagactcaaagtctgcccaggactaacatcaccttggaatggctcagctaagtctgcacttcttacacttcatcagtgaagagagaaatcctgtttgttctgtcttgtttttttctacttggaataaataatcatctgacttaaatgtggggaagaatacacacatttctcaatgtgtgtaccgtcactcccccgacatttattacaggggctacactggaggctggattgtggctcttcag

SEQ ID NO: 138761 - DNA, 601 bp, Human
atgaggcatccacgtcacgggtttagtgtggcgctcccctacttttcagtgataattaacccttgctgacactgagggggctcagctttgtcctccacccggttgaagagcacggacacccagaacaggactgtgaccttttgtagatttctctgattctcgaaaatccgatcacccccagccgccacatcttagcctctctgattctcaaaccatcgcaagcctggcagcacttggggaggcttaggctcggggagcttggtttccccacgcaggtgtggcagagccgcctccctctgcrtccgtgagggttctgaggagtctgtgctttctgagcaaactcagagtagaggcaccacccctgggggcagccctgcctctgtcctgctccgccccctccaccgcccaggcagccaggcagagctcctgccaggaccagaggccaccctacaccgacagggaaggcctggggagtgtgtcgtcctcctccatgctccctctcctgtctgagttacccaccccgtctggggcacttgggagcgggccatgtccagcacaccgcagcctccgtcctgttgcccttggtgtctcaggggccatc

SEQ ID NO: 138762 - DNA, 601 bp, Human
gctcctccgagtgtactcggggttagggtcttggggagtgtgacttcagctctgtgtttgaacttctgcaggcccgtcacggaccatctggacgagcaggcagtgcagggcctgaagcagattcaccagcaggtttgtgtgcagcctctgggtgtaccctcaggaggcatcacaggacctgcccccttagggcctcccaccctccccaggcagggtctgcagtcctggtggccactgtgctccatcagtcctgggctcagtgggggacctgcggtgtgatcactctgggaacaggctctcygctggcgtcatgcttgtgaacagccaccttggagggttgccctgggaggggaagagactcctaggaaatgagtgcagactttctgtgcacgtagccagcatgtccttggtctctgaggaaggcttatgaagctagtgcagtcggtggaggtttcggctgcagctggagtgtggtttccctccggggcgcgcggctgcggtcccacgatggagcgtgcagccaactctgggtgggggcattgggccccgtgctctcctggtggagttgggggcacacagaacgagcacagaagcctctggt

SEQ ID NO: 138763 - DNA, 601 bp, Human
ggagttgggggcacacagaacgagcacagaagcctctggtttccagccgtgcatctgcagctggggtctgatgtctcctgaaagtaaagcagaattttgtgtgtgcgtctgtcggatttctctggggagacagtgtgttcatctttctgggctttgagagattctcaaaggcttctgtgacccagaggtaaagtatgaactatggatcttggtgttacaggagaatataaaaattgttcacgagggattacgtggtttacttgtctgttgtccagatagctttatattctttaagattcakctcggattcttatcctatttttgccattaactttcattatgattttggcaaagccattttgtttgcttacatttttcacttttaatgtggtgtctggcctccccctctgaccgagacaagcatggctgcagagtgcagacggggaggtggccccgggcagcagccatgaacgtggcctccccactgacgctgagccatggctcccttttttcagtaaaatataagcagtaatagagccgatctccttgagtttttgtgagaattaaagaatacattttaaagaattgaggagaatttttg

SEQ ID NO: 138764 - DNA, 601 bp, Human
tcggattcttatcctatttttgccattaactttcattatgattttggcaaagccattttgtttgcttacatttttcacttttaatgtggtgtctggcctccccctctgaccgagacaagcatggctgcagagtgcagacggggaggtggccccgggcagcagccatgaacgtggcctccccactgacgctgagccatggctcccttttttcagtaaaatataagcagtaatagagccgatctccttgagtttttgtgagaattaaagaatacattttaaagaattgaggagaatttttggsacagtgtgagcattcagtaaattttagttgtagtggccatcacaacgtggcttttaagctctcttacaaaaaaagaaacatcagcatcctgtttggcacagttacttttctgcacaagaggctgcctgggtgggttctacgtcggtctctggggccagaatgcaggtggctccagctccctactctggccctctcctccctctctctgtgcctcagtttccccttcaagggagctctgggcctgtctggaggttaaacaaggccatctgcgtcagtaggtgggcctccgtcctcagcccc

SEQ ID NO: 138765 - DNA, 601 bp, Human
tgaggttctgacctggttaggttttcagctctgcaggtgtcatcgcgtttcctcgttcccaggacttgctggtcataggcaggggtgtggcctccccaaccccgagatctggccgggtgcctccctgagggtttccctctgtgcctttgcagcccaggcagcctgtctgctctgacagattgctttgctttttctagaatttgctaccgagggtgtcacacagtaggaagcctttgggtgtggtttcttccccgacgtgtctttgagatacctgtgttgctgtgtgttccgtggtgtgcaygtacggcgccgtgttatccactcaccagcccaggctcatctgggtttccagcctttggctattgtagggaagctgctgtgcacatctagacgtacaagtcttggtacgtttcacgtttcctggctgactaccaggagcagcatcgcagggtgtggggcacatgtgtgacttctcagcagccgagccaacttcccagaccctgctgctgcacgtccccatccacaagtgaccccttggtgtggtcggctctgaacgtgggccctctgggtgagtagaggcctctcgctgctgctggagtct

SEQ ID NO: 138766 - DNA, 601 bp, Human
tcgtctgtcttattgagctgttagaactcttcatatattccagatgccagctctttgtcacacacaggatctgccagtgctttctccagctctgtggttcacttttcttttctcttagtgactttttttttttggagaagcagtctcactctgtcgcccaggctggagtgcagtggcagcatgtcggctcactgcaagctcacctcccacgttcaagcgactctcctgtctcagcctcccgggtagctgggactacaggtgccccccatcatgcccacctaatttttgtatttttaggagrgacggggtttcaccatgttggccaggctggtcttgcactcctgacctgaagcgatccgcccgcctcggccttccacagtgctgggattacaggctgagccaccgcgcccagcctcctagtggctttttactgggacttgtgtggggtagtgaacctcgtgctgttctcctttaccttcgaggggtgaagcctccctttctgcctcctagtccttccaggctgctcccaagaggtcccttggctgctcccaccagtttctggccacctcctcagtcagcagggcgggtggccctgtttggg

SEQ ID NO: 138767 - DNA, 601 bp, Human
ggatctgccagtgctttctccagctctgtggttcacttttcttttctcttagtgactttttttttttggagaagcagtctcactctgtcgcccaggctggagtgcagtggcagcatgtcggctcactgcaagctcacctcccacgttcaagcgactctcctgtctcagcctcccgggtagctgggactacaggtgccccccatcatgcccacctaatttttgtatttttaggagggacggggtttcaccatgttggccaggctggtcttgcactcctgacctgaagcgatccgcccgcctyggccttccacagtgctgggattacaggctgagccaccgcgcccagcctcctagtggctttttactgggacttgtgtggggtagtgaacctcgtgctgttctcctttaccttcgaggggtgaagcctccctttctgcctcctagtccttccaggctgctcccaagaggtcccttggctgctcccaccagtttctggccacctcctcagtcagcagggcgggtggccctgtttgggctccaccccacacactgggcctggagggctccttcaggtgctccttggggtactggaggacccctg

SEQ ID NO: 138768 - DNA, 601 bp, Human
accttcacacgaccttcacgtgctccccgtgtgctgcggggtctgcttttagggtcgctcttggtgtttgagcagtaagtctgcacaggagccactgcccaccatgaaaggggggagttaaaggcgttccgaatccctttggccaacgacggagttgaaggtgttccgagtccccgtggccggcggcgacagagttgaaggcgtttggagtccccgtggctggcggtgatggagttgaaggcgttccgaatccccgtggccggtggtgacggagttgaaggcgttccgagtccctgtggckggcggcgatggagttgaatgcgttccgagtccccaggacgccattttggctgaatttcctttaccctcctgctccgtgaagcggggcccattggggaggtgctgctctgtaatctgctcttcttcttgaatgtgtggttagggcagccacattgatgtcccccaggctccagagtgaccgccccttaggggtcctgctgggcgttggccgctgttggccgcagggcaccgttggcctgtgcattgctgccacctacccatgatgggcagaattgtcacgagctcaggaggaaaccatgga

SEQ ID NO: 138769 - DNA, 601 bp, Human
gttctgtcctgcatttctcaccttctaagaggaccattttctctttgcctggagaacactctagtgttttccatagtgtgtgtctgctggtggcaccctctcgtttgtttatcccaaaatggctttttccactttttttttttgagacggagtctcattcactcttgttgctcaggctggagtcacagtggcgcgatctcggctcactgcagcctccatctcccaggttcaagtgtttctcccgcctcagcctcccgagtagctgggattacaggcatgcgccaccgtggcaggctaattkttgtatttttagtggagatggggttccaccatgtgggccaggctggtcttgaactcctgacctcaggtgatccacccacctcggcctcccaaaggtgctgtttttttttttttccccactttgattcttaaaggttatttttgctaagaatgaaactttagtttgcatttattcattcgtttgtgttttggcactttaaagataatagtctcttgtcttctggagaggttagctgccagtctacttattactgtattggagacaatcttttaagtttcgctggcttcttttgagattttt

SEQ ID NO: 138770 - DNA, 601 bp, Human
tgtgatctgctcaccttggcctcccaaagtgctgggattacaggaacattttctttgatttaaatttcattgtcacaaattctttcaggtgtgccttatctgccgttaaacgcatccttgaatttttttatttttcagaacttattttttatagttttcatttttttcacatcctggaacatattaagcatggtttaaaatctttgtttaatgtcatcatctggagcctctgtggctgtttctgaaggacggtatatcatacatgaaaagcatctccaccaagctgcaggaacaagacatkacagaaatgctttgaggtctgcaatgttctcctctcccagagagacttgatgttggctcttgacgggaggcgggtgcttgctgtcggggtcacctccattgggttttgggacgtaggaggggtccgtgctgggctggcccacgttttacacctatttctaggtgtggtcctctgggttcagagcctgtggtgagggctctaccgcttctccctttggtcatcctggactcccgttctcctgctagctggagatgctcctggatgcactgttgggggtttctggttcttgtggcgccccct

SEQ ID NO: 138771 - DNA, 601 bp, Human
tctgccgttaaacgcatccttgaatttttttatttttcagaacttattttttatagttttcatttttttcacatcctggaacatattaagcatggtttaaaatctttgtttaatgtcatcatctggagcctctgtggctgtttctgaaggacggtatatcatacatgaaaagcatctccaccaagctgcaggaacaagacatgacagaaatgctttgaggtctgcaatgttctcctctcccagagagacttgatgttggctcttgacgggaggcgggtgcttgctgtcggggtcacctccrttgggttttgggacgtaggaggggtccgtgctgggctggcccacgttttacacctatttctaggtgtggtcctctgggttcagagcctgtggtgagggctctaccgcttctccctttggtcatcctggactcccgttctcctgctagctggagatgctcctggatgcactgttgggggtttctggttcttgtggcgccccctggagtcagccgtgagccggggagagttggcccccgccgctctgtccctctcaggtcttcgtgagctctctggtaactgcaggcacttcctgtgtgttt

SEQ ID NO: 138772 - DNA, 601 bp, Human
aaatctttgtttaatgtcatcatctggagcctctgtggctgtttctgaaggacggtatatcatacatgaaaagcatctccaccaagctgcaggaacaagacatgacagaaatgctttgaggtctgcaatgttctcctctcccagagagacttgatgttggctcttgacgggaggcgggtgcttgctgtcggggtcacctccattgggttttgggacgtaggaggggtccgtgctgggctggcccacgttttacacctatttctaggtgtggtcctctgggttcagagcctgtggtgagggstctaccgcttctccctttggtcatcctggactcccgttctcctgctagctggagatgctcctggatgcactgttgggggtttctggttcttgtggcgccccctggagtcagccgtgagccggggagagttggcccccgccgctctgtccctctcaggtcttcgtgagctctctggtaactgcaggcacttcctgtgtgttttcattttgtctggcttttaaaaatgtcttagtggagggttggtctgcgttatctagtctgttagtttttaaaaaatattcttcatttcgaaataattat

SEQ ID NO: 138773 - DNA, 601 bp, Human
ctggatgcactgttgggggtttctggttcttgtggcgccccctggagtcagccgtgagccggggagagttggcccccgccgctctgtccctctcaggtcttcgtgagctctctggtaactgcaggcacttcctgtgtgttttcattttgtctggcttttaaaaatgtcttagtggagggttggtctgcgttatctagtctgttagtttttaaaaaatattcttcatttcgaaataattatagacttacaggaagttatgagattagtaatagagcctggctgtgcttcccatgcttcctcygcggtgactccgggtatgacagtgttggagccgggactgcggtgtcgaggccctgcctctaactggactgcaggcctgtgcggtttcgtggcttcatgtgtgtgtggagtggccatgtgtgtctagtttcgtgcagattgatgccctgtgtagatttctgtaactaactccacactcaaatcagaaacctgcgtccttcccacagagacagcccctgccctttgcattctcaccctgcccccctgccaccagtctgtcccttctagaatatgccatgatcgactcgtatggttgtggcat

SEQ ID NO: 138774 - DNA, 601 bp, Human
gagccccgcgtgccgtttcgtgagaggctgaggcaccgctgagccgcgcgtgccgtttttaacttgattataaaatacatttaaagttcacatgcaggtgcatctccaagaaaattattttaaaaactagttaagactttcatttcccagtcctcaacacacatcagagcagtactctgttcagagctgaaaggattcgcgctgggacaaaggcgtgtcacttgagtgagtgatggtgtcacaggtgcccacgtggaagaaggtaaagtcgtatctaaaactaaatgtgagagtaactaawaacttacgcataaaaactaccatcataaaaatcctcgaagaaattttaggagacgttgtaggacagtgtcagtctctgaagaaaacttcttagtttagaaattttcaaatctgcgcagaagtaaagagaagtagtttacgggggggcccagagtctcgcccggcgcttcctttctcctcccctcctctgagtttaaagaagaccctgaatgtcaggtcccagcagcccctcgctgggtttttctgacttgtgttaagaactggttttctggggttttttgtttctttttgtttcccccct

SEQ ID NO: 138775 - DNA, 601 bp, Human
catttcccagtcctcaacacacatcagagcagtactctgttcagagctgaaaggattcgcgctgggacaaaggcgtgtcacttgagtgagtgatggtgtcacaggtgcccacgtggaagaaggtaaagtcgtatctaaaactaaatgtgagagtaactaaaaacttacgcataaaaactaccatcataaaaatcctcgaagaaattttaggagacgttgtaggacagtgtcagtctctgaagaaaacttcttagtttagaaattttcaaatctgcgcagaagtaaagagaagtagtttacgggggggcccagagtctcgcccggcgcttcctttctcctcccctcctctgagtttaaagaagaccctgaatgtcaggtcccagcagcccctcgctgggtttttctgacttgtgttaagaactggttttctggggttttttgtttctttttgtttcccccctcttggcatgtaatccccagctaacagattttataataataattccacaaggtagaaacaaaaggagataattatgttgggccttatattgaagaatagaccatgtgtaggttggtagggaaaacggagattgagaataaa

SEQ ID NO: 138776 - DNA, 601 bp, Human
gtgcccacgtggaagaaggtaaagtcgtatctaaaactaaatgtgagagtaactaaaaacttacgcataaaaactaccatcataaaaatcctcgaagaaattttaggagacgttgtaggacagtgtcagtctctgaagaaaacttcttagtttagaaattttcaaatctgcgcagaagtaaagagaagtagtttacgggggggcccagagtctcgcccggcgcttcctttctcctcccctcctctgagtttaaagaagaccctgaatgtcaggtcccagcagcccctcgctgggtttttcygacttgtgttaagaactggttttctggggttttttgtttctttttgtttcccccctcttggcatgtaatccccagctaacagattttataataataattccacaaggtagaaacaaaaggagataattatgttgggccttatattgaagaatagaccatgtgtaggttggtagggaaaacggagattgagaataaacgtctgttctacagtcgaaaaggtaaaaagttaattagtgtacaaagactaaattgtaaaactgcctgtgacgaggtaaaggatccagtatgaaatggggcaga

SEQ ID NO: 138777 - DNA, 601 bp, Human
tgtaattctctgacttcctccatgcttagcatttctttttccttagcatcttcaattttcttattttttttttcttaaggaacttgaacattctgtaggatccaagtaccgttctactaattgaatttgaatgcatcatgatcagtgcctcaaaattttatttcaaaagtccatgattaattcacactggccatgatgctggtgcactttgcccctgggattggcacaggtggtgactcgtggaatgcagcaccctgtagacgacgcacctcctctgctcatggcccccacctgccccgcycccagtgcctctccaaggctgctctgttggcctcggctcctgggcttcgggggagcggtggaaagaacacgtgggtttggtgtttgccacttgctggctgtgtggtcacgagaggctcctccgtaggtggcagaggtgggggttcgaggagacagtggcactgagccccgcacgcggcgggactggtgactctctgcccgctcctgctctgtgcagcaattgccgtccctcccaccacggttcctggtggccttgggatgggttcccgggggtctcctgctgtccggccccaactcctgt

SEQ ID NO: 138778 - DNA, 601 bp, Human
caggtgatccacctgcctcagcctcccaaagttctgggattacaggtgtgagccactgcactcggtcagtgtttttagaatttttgtatgcaccgtgacatttttctgctgtgtgtttcactcgttaatacattttgctgttttttccttctttatgaaagtagcattaggctggctttacgccgtgtcccgtgcgtagctgctgtgccgcctcactgtacatcctgcacccccgtgctgaagttcaggcttgcttctcgcacatcatgttcgagggatctgcttcatgaatcgtactttwatttttaaagtgtcacatgcacatatgttggcccacagtgttcctttatgtcatatgatagaacatgcattattaatcacgtcaaaagtgtgtgaatcaccacttaaaattattataagtatataaaaatcatgcattagcttggcatggtggcacacacctgtaatcccagctacttgggaggctgagtgtggggttgaggctgcagcgagctaagcttgcaccacggcactccagcctgggtgacagaatgagactctctcaaaaaaaaaattctctttctgattcctattttgaggt

SEQ ID NO: 138779 - DNA, 601 bp, Human
ttggttgcggccgtgcatcctgcatccaggtcggggcagaggtggttccacgtcctcccagaggtcagccccacgctggcctcagtgacctgctctctcacgctttcctgtggtgctggtcccactgaccaacctgccgggaactcctgcttgtctcccctccggccacctggcgtctgaagctggaataggccctggccactgggttccccacgcccttccctccccatgggatccagccttggcacttcaggatctgcagctccagacggactcctgcctgtgtggcgggtgggcctcrcagccgccatgccatctaaaactcgcatgtgggggtttatccagttgaaacacagataaatgtgaaacaggatcacttggagatatgacagatgaggttgtcgggacccagcagcttcctttgtcaataccccaggtctcagcgtaggacaaaagggggggacctcaggtagggtgtggccagacccccagtgacaccctggggtgggggctggccgtggagaggctggaggtgacctctccccgggtgtccttcctgggttgtaccgggggccgtggagaggctggaggtgactcctcc

SEQ ID NO: 138780 - DNA, 601 bp, Human
gaagttcagcgtcagcctccagccttgtttcttctttccacagttgttttgtcttttcctgaagctttgcgtttccacgtaaattataaagggggcttgtcgctttccactgggatcctgctgactctcagccattcagggagttgggcgtccttgttgctggtgtccagggtctcacagctccttctcccctcagggtgtccgtgccgctgctgaagacgctggaccacgtgctcacccacggctgcttcgacatcttcaccacggaggaggagtgaggctctgcttttcatgacttccyttccgattaagcctaagtagctcatgtattaaagaaaaagtcatcagacacagagatcagaattccaggaaatgatcttccagtgcgttctgggtcagttatggtgactgtaaataccgtcatcacagctggccctcaaaataacgcaataataacatatttacataatgacatattatgactgtaagtgcagtcagccccatctggggctgaggcgggggccctgctgtgcactctccccccagctatcccaccgggccaggggtgggcctcagggttgtgctgggagccgcagggcct

SEQ ID NO: 138781 - DNA, 601 bp, Human
ggagcaggttagttaatagagagcaggcgagattgcttctctggtgagggagcaggttggttaataaagcatttaaacaagaatgatgtcatcttcactgctgggatcctgcagctagctgtgtgtctgtggagggaggaggtggttaatgggcctggaaggcacctcctcttggttgcagccctgctgtggctgggatgggatgcagggtcagcgtcctcctcctgacgccttccactgacggggctccctggcctgggtcctgtcgtctctccggggtggggcggtggcgcttccctcyggcaaatgcactgcatccctgtcccagatccggaagaccacggccagccaggtgtacgagacattgctcacctacagtgacgtcgtgggcgcggatgtgctggacgaggtggtgactgtgctcagtgacactgcgtggtgagtgaaggcccttcctgcacggccacctgggcctggcaccgcccctcttcctgtccccaccgtgtctactcgtctctcccaaaaccctctgataggaggaggaaagagggttcccaggtctccacatcctctgcttaggttttacaaggcagccgtgctg

SEQ ID NO: 138782 - DNA, 601 bp, Human
ccacccccttcctcagggccatgaggccctcaggaggccatagtgccactctccacgtttactttggcaggcacagtttctgcaacatgggctggcttctttaccatgggtggagtagaatggcggttttgaaagatgtgtgtattgagttgggggtgggagggtctgaatgagagcagagtggggaaagtgcaggctcaggtgtcctgggccaaccggtatgttcctgggaacagcagtgatggtgtcttacacatatgggcatgggcacccatgctggctcacacacatgctcactcgcgcgcacacacacacacacactcacacacacacacacacttctaaaaggggagcagtctcgtcaccccgtgttggagatcaggactgaagcaaccagaggctgtgtgggtgtccacatggcatacccggggtggtggagtcccaggtgtcctgcctgtggatgctgctctgttttgagtgccgactgtgagggcctccgtgctgatcccggtgcgttgctacaggtctgtggggtccacgccccttgttgaatccagcaaggacgtaggtgacgttccctaggtgtctcctcggaacagtg

SEQ ID NO: 138783 - DNA, 601 bp, Human
ccccttcctcagggccatgaggccctcaggaggccatagtgccactctccacgtttactttggcaggcacagtttctgcaacatgggctggcttctttaccatgggtggagtagaatggcggttttgaaagatgtgtgtattgagttgggggtgggagggtctgaatgagagcagagtggggaaagtgcaggctcaggtgtcctgggccaaccggtatgttcctgggaacagcagtgatggtgtcttacacatatgggcatgggcacccatgctggctcacacacatgctcactcgcgcgaacacacacacacacactcacacacacacacacacttctaaaaggggagcagtctcgtcaccccgtgttggagatcaggactgaagcaaccagaggctgtgtgggtgtccacatggcatacccggggtggtggagtcccaggtgtcctgcctgtggatgctgctctgttttgagtgccgactgtgagggcctccgtgctgatcccggtgcgttgctacaggtctgtggggtccacgccccttgttgaatccagcaaggacgtaggtgacgttccctaggtgtctcctcggaacagtgacct

SEQ ID NO: 138784 - DNA, 601 bp, Human
tgaggccctcaggaggccatagtgccactctccacgtttactttggcaggcacagtttctgcaacatgggctggcttctttaccatgggtggagtagaatggcggttttgaaagatgtgtgtattgagttgggggtgggagggtctgaatgagagcagagtggggaaagtgcaggctcaggtgtcctgggccaaccggtatgttcctgggaacagcagtgatggtgtcttacacatatgggcatgggcacccatgctggctcacacacatgctcactcgcgcgcacacacacacacacacwcacacacacacacacacttctaaaaggggagcagtctcgtcaccccgtgttggagatcaggactgaagcaaccagaggctgtgtgggtgtccacatggcatacccggggtggtggagtcccaggtgtcctgcctgtggatgctgctctgttttgagtgccgactgtgagggcctccgtgctgatcccggtgcgttgctacaggtctgtggggtccacgccccttgttgaatccagcaaggacgtaggtgacgttccctaggtgtctcctcggaacagtgaccttccaacagggctgggtt

SEQ ID NO: 138785 - DNA, 601 bp, Human
tccagcaaggacgtaggtgacgttccctaggtgtctcctcggaacagtgaccttccaacagggctgggttcccatagagctcacgcaccaggcagccgctgtggcctcggaggacagaggtggcctctccagggcttccgcgaggttttctggtttggggaggagtgtgtgtctgctcctaaacaaacacgtggtcccaggagaggaaccgggagcagctgggctgtcttctcaacatgcgttgagagaatggccatcttaactactgctctggagacccgtttttacaatgatttttttwaaaaaaaacaccaaggtgcattctggaccagattctaaaataattggctttaggactgaagaagccaggtgtcccgagcggggcgaggcctcctccagcgaggctgggtcggggtggcctcctttcctcacatcagggagggaggaactagcagggtgggcctgggggcttctcctatcgtttaatcccctttctgttaaaaaaaaaaatccttagaatttaaagagaatattttaaattagaaacgaaaaacatgccccagatatctccacagcattgctagaatttttatttcgcatc

SEQ ID NO: 138786 - DNA, 601 bp, Human
gtaggtgacgttccctaggtgtctcctcggaacagtgaccttccaacagggctgggttcccatagagctcacgcaccaggcagccgctgtggcctcggaggacagaggtggcctctccagggcttccgcgaggttttctggtttggggaggagtgtgtgtctgctcctaaacaaacacgtggtcccaggagaggaaccgggagcagctgggctgtcttctcaacatgcgttgagagaatggccatcttaactactgctctggagacccgtttttacaatgatttttttaaaaaaaaacacyaaggtgcattctggaccagattctaaaataattggctttaggactgaagaagccaggtgtcccgagcggggcgaggcctcctccagcgaggctgggtcggggtggcctcctttcctcacatcagggagggaggaactagcagggtgggcctgggggcttctcctatcgtttaatcccctttctgttaaaaaaaaaaatccttagaatttaaagagaatattttaaattagaaacgaaaaacatgccccagatatctccacagcattgctagaatttttatttcgcatcaacagctaaatt

SEQ ID NO: 138787 - DNA, 601 bp, Human
agtggcgttttcttctcccagtgcaattagtttgttctctaaaaccaggtcattcagtcgacgcttctcacgagatcttttggcagcttcattatttttccgccttttttcccaatacatagcatctttcttttcatcaggaatgaattcccgtttcctccgacatgcagaagatttgttcttccccacacttccttcactgagaagcagctcctcacctgttgtggagtcttctgacacttccgttaaagcagaattaaggaccatcatcttgtccacattgctactggcatcaagagaygcctgctcctttttgacggtctgcatttttctcagctgcatcagaaacaaccttaccctatctatgtgtgtaggagaacaaattaatttccccgtattctcaagctctttaaaaactctggtttaaaatccatcaatattcttccttttgttctaccgtctgggataaatccgtcaggctccttattgaatgaagttgggcctccttcgttatctgcaatacatgaataaaaaaaaaaccagttattcactggataaatgtttattacaaattatgtacaaggaaatatgctaagcattt

SEQ ID NO: 138788 - DNA, 601 bp, Human
ttcgttccgggcctccagctatcagctcccgatctcgtgtttgagggtagcgaccccgatttctgtttgcatgcacagccagcagccctagcgccagatcctaaagctggatatcttttaactgggctaccagcccgggcctcaaagttttggtgagtgctgtgatgccgctcggggtgtcagggagggcaaagggcgtgaatcatctttcaccttttctgtgtgacttggatgccttaccttaaatatataaaccaaggcctaagtacagagagcccacgcggctcagccctgtgcaccycaggtactattaaggctggacgggcgtctgtattgtgctctttgcccttatgggacgctaatgacaacaaaattttggttttcagttgagtattttggggaggggggtgagaggacctcttcaagcccaaggaggggtccttgtggtggtgtaggctgatgagaggcatttgggaagcatagagtggtacttcagtgagtctgaagggccacttgtaatcaaaggaaaactgttcttccacggatagttttatatgcatcatggccatactagttgagtatggggaaatccgacaagtgg

SEQ ID NO: 138789 - DNA, 601 bp, Human
gatttctgtttgcatgcacagccagcagccctagcgccagatcctaaagctggatatcttttaactgggctaccagcccgggcctcaaagttttggtgagtgctgtgatgccgctcggggtgtcagggagggcaaagggcgtgaatcatctttcaccttttctgtgtgacttggatgccttaccttaaatatataaaccaaggcctaagtacagagagcccacgcggctcagccctgtgcacctcaggtactattaaggctggacgggcgtctgtattgtgctctttgcccttatgggackctaatgacaacaaaattttggttttcagttgagtattttggggaggggggtgagaggacctcttcaagcccaaggaggggtccttgtggtggtgtaggctgatgagaggcatttgggaagcatagagtggtacttcagtgagtctgaagggccacttgtaatcaaaggaaaactgttcttccacggatagttttatatgcatcatggccatactagttgagtatggggaaatccgacaagtggcctggggctgcctatttggacacaatattttgtgtgtgtgtgataagtgagttaccc

SEQ ID NO: 138790 - DNA, 601 bp, Human
aatttggagtttgcagccggacccaggagaccctcatctcttcattcccctatcaccccaccctgcctgccctgccacagggagaaatccgcccggcctcactgcttcacagcaggccttgggcaccttctatccgacaggtgggctcccaggacccagcctggctgcaaccatctcttgaggtcgggtgcccccctgaaagggatttcactttttcacttccctccgggatgtcccctcacttctggccataggtctgcgtatatctagagtgattagagtctagagtgactatgctgcsgaaagcaggggatccagctcaccagctgaggttccagctccttgccctaggattaaggggtgctgatattaattcgtttgtaattatttttcacacggaatgggaaaattcaatacatttagaagggggagagtttctagaagatttacggacatcccgtccttcccccttctcgcccccattttctttcagggcattattgatgatgtttcttgtgtttacaggacaagaaggggctttccgggaaacagaataatttcgagcgcaaagctgtgtaccagaggcaagtcagagccccca

SEQ ID NO: 138791 - DNA, 601 bp, Human
gaaaatgaatctcacatacctcctgaggtttctgtcaccaccagttgaagaatccctattatttggttgtctgcttagtggttaatcggttaatgtggagtgcatgtgaaatttaccccgtatgagggatgtacaaagatatactgccaagtgatcctggagcagatgtcttggaaggaaataaataacttaaacaaagcaaaacaaaacaacacaaccacgtccacttttcttagttgtgggagctgaatagatgaagtcaagtgaggagtttaacagctgctcgcaaccagtaaagccstttagtctggaagttcaacctcagattccgctctttttcattgtacttttttttttttttttggattacttggataattcctattattccaaacttcatttttaccattttttgacagtcaaggttatagaatctgaaaaaggtttcgaatccagcaagcgaagtggaggttgaatgcgaacagtgcgaaatctctagctttctgtctccatgttctcactttcgtgaaagcctgggggtacattaatttttcttaaaatattactcatttttaaaagcatctctatttgggtatggaat

SEQ ID NO: 138792 - DNA, 601 bp, Human
ctatttttaaccgtttctctttaaatttttaaaaatttaaataagggacaattaatgtttgctttaatcactgccacttcatgaaattcaggttgaaagtaaacaaaaatttttaagtagacatttggattctgtttttttcttgtgtagcttctgaattttgttggttctggacaggtttgtgtgtgtcctataaaaatttttaagtagacatttggattctgtttttttcttgtgtagcttctgaattttgttggttctggacaggttttgaagtttgtgtgtgtcctatcatgtgttrtatacttctgaccatagagtggtttcttatgaattaaaaatgaatttggttacaaactggataaacagatttataataatagggccacattgataaactgagattatgcaaagcaacttgtgaagtctgaggactaaatggaatagtaaattcaactaaataacttcctggcaaaaacttatcatagaaatgtaaacattaattttcaaattttattttatttgcaaatgagtataatgggtttgtcactatgtaaacacaaatataacaatggatgcttcaaacaaatatgacagaggt

SEQ ID NO: 138793 - DNA, 601 bp, Human
tttgtcactatgtaaacacaaatataacaatggatgcttcaaacaaatatgacagaggtgagtgcttgggggtgatgaaatactccaagtattttatgcctccaggaattctatttatgttacactaatctttgtatttgagtttgctcctattcgtgcgatgacttagcctgtgttttaatgattgcttgttcaaccattttggtatccggccaaaatgattagagcttgggaagaatgtttcagaacagttattttcgatagagcagggaatactccccgccttttttgagttttgttktattttattttatttttttttgtagtggtatcaggggaaggggcctggttaaattgttcactgtagagtgtgtttgactagttaacagctcttttcaattttctatgcttctctattttcttaagccttttttttctttttctactcgctaatctcctttaactttctttctttctcttttttcctagttctccttggattattctacagctattatgtgtacataatgaaccatctttagaaaataaaagtgacatcagctctaggtatagatatattttttaataatgaaaaaagatg

SEQ ID NO: 138794 - DNA, 601 bp, Human
cctagtctataaaaccgtgagcctccagacattgtcctaccctgcctgccttcaggcagtttcgaggcagacacctggcccacgatcaggttgttagtgccaggcactgtgcactgggccaaccaccctctcagcctgttcccagcaggtcctggcaccaatggatggagactgccatggggctctgggtggagcccatggggcaccaacctctgacccagcttccttctgggaagacagccccctatccactttccattgtcccaggcctggagagctcaggatggaggtcgattcatgrcattccccgctaggctcttcctgtggctcagactgggaaaaggaacgggttggtagttggaagggctggtcttcccaggagaccctgggtggggctggggacaggcctcagtcctctctgaaaggtggagacaggctcttccttcattcgactcttgggagctgagaaaagactttgacacctgggctgtgggagggacagagggtggtggctagcactctatcagccctgggtttcagggagtgactttcattccttgagcctcagtttccccccgcttgtctcactggatatctctga

SEQ ID NO: 138795 - DNA, 601 bp, Human
cagctcactctggaatccacaggctcgggatggagtccaggcctcatcacctagttccttggtgctgtgggcaaatgacctgtgtccccctctgcaaaacctgtgacctcttggttgatgtcacatgcttccccagggcctggtccatggtaagggctcggcataggctggccaaggcggtggttggggcactgatcaaatttcattagcaggtgcctcctagggcctggtggaagggaggagactctgctgagggggagcccccgtccggtgtcctggcacctgtgctggtgctgggatrtcacctgtcatggtccttgcccacttgttgctcacctctgtggggagagatggacagtcgttaagtctcccctcagacgaatgtgaatattcagaaggctcgattctcctagcagcgtttattgtcgcccactctgcctgacccagtgttgggcataaggaaaacagagggaaagagttaaccaccctggagagagttccagcctcaaggaggagccaggcaggctacagaagtctcacagtgagggcgtggtcctgcaggttgacagaagttagaggacagatcagggaaggctgcctg

SEQ ID NO: 138796 - DNA, 601 bp, Human; identical to SEQ ID NO: 29271

SEQ ID NO: 138797 - DNA, 601 bp, Human; identical to SEQ ID NO: 29272

SEQ ID NO: 138798 - DNA, 601 bp, Human; identical to SEQ ID NO: 29273

SEQ ID NO: 138799 - DNA, 601 bp, Human; identical to SEQ ID NO: 29274

SEQ ID NO: 138800 - DNA, 601 bp, Human; identical to SEQ ID NO: 29275

SEQ ID NO: 138801 - DNA, 601 bp, Human; identical to SEQ ID NO: 29276

SEQ ID NO: 138802 - DNA, 601 bp, Human; identical to SEQ ID NO: 29277

SEQ ID NO: 138803 - DNA, 601 bp, Human; identical to SEQ ID NO: 29278

SEQ ID NO: 138804 - DNA, 601 bp, Human
gaacctctgcgaactgctgccccagaaagcggcaggagggcagggacccgctgtatccccagcgcctgggacccagcctggcacacagaaagcactcaagaaactgtcgaatgagttcccacaaaacagaagagaaaactgaggctcagggtacagcactgcccacagtcgccctggaagtcagaaaagggctccagaagccacgaaagggctccggattcagcatccggaggcgagcagggtcccgcctccgtaatccagcgggggccagggagccgcagggagttccggagaggacacrggcgctgttcccatcctgctgaggctcacgcggcaccttcgggggcttccggcctgggatcagcgggaagcaggcagcaggaggcgcggcccggccccggcgaaggcccccacgccactggttctcacgcctccaccatgctgccctgcacggggtcccgccgcccgcacttaccgggccgcacggccgcttcctgccgcgctccgccatgttccgcacacaccgtcggtcccgcctctgccaatgagactcgcctcttccggccacacctccattaagctgtccaatcggagagccaat

SEQ ID NO: 138805 - DNA, 601 bp, Human
gcggcaaggaagccaaggaacctctgcgaactgctgccccagaaagcggcaggagggcagggacccgctgtatccccagcgcctgggacccagcctggcacacagaaagcactcaagaaactgtcgaatgagttcccacaaaacagaagagaaaactgaggctcagggtacagcactgcccacagtcgccctggaagtcagaaaagggctccagaagccacgaaagggctccggattcagcatccggaggcgagcagggtcccgcctccgtaatccagcgggggccagggagccgcagggrgttccggagaggacacgggcgctgttcccatcctgctgaggctcacgcggcaccttcgggggcttccggcctgggatcagcgggaagcaggcagcaggaggcgcggcccggccccggcgaaggcccccacgccactggttctcacgcctccaccatgctgccctgcacggggtcccgccgcccgcacttaccgggccgcacggccgcttcctgccgcgctccgccatgttccgcacacaccgtcggtcccgcctctgccaatgagactcgcctcttccggccacacctccattaagctgt

SEQ ID NO: 138806 - DNA, 601 bp, Human
caggatgttcccaggggaagccgcctcctacctggtctccactttgacacacccctccctcatgcttaggggagtgacccccttactgtggacactccaggtactgcaggatccgggccagctgtacgcacgcctgccccttcttcccaactcctgtgaattccccctccacagtcctggagagagagagatgggggctcaggatccagctgtggccccttcaagagctcctgtctacaagtgcacgcgtataatcccagctactcaggaggctaaggtgggaggatcatctgagtgcagyaagtagaggctgcagtgagccatgaccatgccactgcatgcactccagccggggtgacagctgagatacaggtttaggccttctggctcccaatcccacctctgtagtcatcacccccacctggcaactctacccactaaggattacacagggaatatttcaggcagggcacgagggaagagccaggcatgtggacgggggcatggtgaagcctcggcccatcccggcagcccctccctctccctgaaccctggcaccctgtgggatggccccttacttggcatcctggccctcctcatc

SEQ ID NO: 138807 - DNA, 601 bp, Human
agggtaggactgggtggtctcagtgtctgtggcatgatccaggggaaatgggggggcgggcccacacagcgttacctgcaaactgtagatcctggtgcttggggaagaacgccttcctcaggtacctaggaaagaatgctgacctcaggatgttcccaggggaagccgcctcctacctggtctccactttgacacacccctccctcatgcttaggggagtgacccccttactgtggacactccaggtactgcaggatccgggccagctgtacgcacgcctgccccttcttcccaactcctstgaattccccctccacagtcctggagagagagagatgggggctcaggatccagctgtggccccttcaagagctcctgtctacaagtgcacgcgtataatcccagctactcaggaggctaaggtgggaggatcatctgagtgcagcaagtagaggctgcagtgagccatgaccatgccactgcatgcactccagccggggtgacagctgagatacaggtttaggccttctggctcccaatcccacctctgtagtcatcacccccacctggcaactctacccactaaggattacacagggaa

SEQ ID NO: 138808 - DNA, 601 bp, Human
tctgccacagacctgcgtcttggcatcagacacaggtcttgctctcccaggcctgctttcccacctggacagcgcagggtaggactgggtggtctcagtgtctgtggcatgatccaggggaaatgggggggcgggcccacacagcgttacctgcaaactgtagatcctggtgcttggggaagaacgccttcctcaggtacctaggaaagaatgctgacctcaggatgttcccaggggaagccgcctcctacctggtctccactttgacacacccctccctcatgcttaggggagtgacccscttactgtggacactccaggtactgcaggatccgggccagctgtacgcacgcctgccccttcttcccaactcctgtgaattccccctccacagtcctggagagagagagatgggggctcaggatccagctgtggccccttcaagagctcctgtctacaagtgcacgcgtataatcccagctactcaggaggctaaggtgggaggatcatctgagtgcagcaagtagaggctgcagtgagccatgaccatgccactgcatgcactccagccggggtgacagctgagatacaggtttaggcc

SEQ ID NO: 138809 - DNA, 601 bp, Human
cagcaagttgacaggacaaaaaccctggtctgatatttgggtcaggcaaggctcccggccacctcccagagggatggatggatattcagagaagtaaggtctgtccttactgaggcaggaagccagtcggacggtgtagccccagtagagaccagctttggtgcgagggtcctgcgatgataccactttgccatggtaggtcttgcagtctggaggggtaacagagtctgtaaagatggggtgagggaatggaagcaggtggctgaaccctggagctcatcaggccaacccaggggttggrgaaccttccagatacctgggtgctgctgctggttcagtcgcacagtcacccgaagcccgggctccaggttcttgtcaatcttcacctcctggggagaagccagaagaaatgggtgccattcctctcaagatcagcaggggccacggctcttccagatgccaccaggggagccccggggctggcaagggaccaaggggtccaggtcaacctgccaccctccacccctggcaccggctgaacctgctcacaagagatcatttgtgcaaaacacaggtcactggccaaacatgcacctttggg

SEQ ID NO: 138810 - DNA, 601 bp, Human
caggtcaaagaggacactgggttcagccacctccaggttggggtcagcatccgctccagcttccagaccctggaggcccccgaacaccacaagagcatgcctggcccatgtaagagggggtcacctgagcggccaccgaggccccacccagcacagcgcccagacctcagtccctccccaccccagacagcaggggcccatctgtgcagcttcacccaccaggcaggttcctggccacattcctcctgccctggccgcagccccaggaggtacacacctgaagttgggaagctgggcagargccacatctgagccgcgctctgacgtcccgatggtcaggtcatacccatcttggaagggggcctcagcaaacacagcacctgggggtggggccagctcagtgcaggtcctgctccccacaagccatagctccgggtattatgtgtgtgtgtactgaggcgggggtgggtgggaagagctgtgtggtgtgtgtgtgtgtgtgtgtgcgtgtgtgtactaaggtaggggtgggtgggtagagctctgcctgtgtgtgcactgaggcaggggtgtgtgtgtaccgagcaggggtgggtagagc

SEQ ID NO: 138811 - DNA, 601 bp, Human
cccctcgtgcaggggttggaagggtggcagccagggttcctgctggggggtatggctgtcaggctcagagtgctcggcttgggcaaggccttagggatgggtagacagggctgtcggcccggcgagactgatgggagtaccagccttcccagcagagttcccgtagcacagcgtcctatgcctgaccccaaaagtgggtacacaggttccatgaggccaggacgaaggctccagctgcacgtggcttcccccgtgggacagatgcaagtgagaccccaaggggagagctgctgtgcccacmgtggtcacacacaaggaagtggcagaaccagggccctgggagatcactgagcgcacggctaaggaaccagaggcccggagcaggggtgggcagggccccctgggtcacccagtctgggagcacaggacgggcactagcacccatggttgactcccagctacactcatgtctcgtcgctgtggcaagaggccaagggggatgagaggaccacctccagacaaggcagccacgggcaagggtgggtgacagggcaagagtagcacccgcccctcggacagatcccaaggccccagcggctgg

SEQ ID NO: 138812 - DNA, 601 bp, Human
gtgtgcaggccggggagtattaaaggtggtgatttttggagacaagtctggtggcgtccgtcccaagtgacctgcagagcccctggtttcactgctgcttcactgatgtcctcggccccttagaactttcaggtgtgccgggcacccgcctgggtgaggccaggctgcagggcggccagggagatgaggatggcttcctggaagagaagcgtggcagtgggctggggcctggggggctagcgggtgcccccgctcccagcctgtcttcagtgcctggctgcccgagacccggcccactggkgtcccctgtccttagtagggcctggtgaggttaatgacaggcccaggttcacactgcacacttgccacctggaggaccacacagcctgctcctcaggctcctcttctgtaaaatgggggcgaaggtaacaacgcccacctcccagggccaggggagggcaagaagaggggcaagaagttttcacccctcgtgcaggggttggaagggtggcagccagggttcctgctggggggtatggctgtcaggctcagagtgctcggcttgggcaaggccttagggatgggtagacagggctgtcgg

SEQ ID NO: 138813 - DNA, 601 bp, Human
tggcccaataagtgagtttttgaccatccccagcagagaactgtccaaggaggcaggagactggggtatcagagcagcctgaggaacctgtggcctcggggagtagatacccactttgatctcaaggtcagggcaatcttgaggggatgctccctgcaaggatgaatccttatgctagtgacaagatgtgggtgacacatccttactctctgccctgacggtctgtcctctctctggggggtggggggtctctgggcaccagccagggatgtggtattaaaggctccatgtctggcgctgygcacactcccaggtgactgtcaccctgtgtcctctatgctgactgcaacacccacccttcctgcacacagccagtacagctttctctggccttccacccccagagacctgggcccacctgcgccccctcaacccgtggtgaacagcagcaggatgcgcctcttcatcacacgcactcccctgcagcactgggccactagcctttggcaaggggtgagggggaggcaacttggcaaggggtgagggggaggcaacttgtccccaagttgtacaacaggtgactggtagcccctaagaactg

SEQ ID NO: 138814 - DNA, 601 bp, Human
acaaagtccaatgagtgactttttttttgagacagggtctcactgtcacccaggctaaagtgccacggtgctatctcagctcactgcaacctccacctcctgcattcaagcgattctcttgcctcagcctcttgagtagctgggactataggtgcgcaccaccatgcctggctcatttttgtattttttgctgcagacaggttttcaccatgttggccaggctggtcttgaactcctgacctcaaatgatccacctgcctcagcttcccaaagtgctgggattccaggcgtgagccaccgsgtctggcccaataagtgagtttttgaccatccccagcagagaactgtccaaggaggcaggagactggggtatcagagcagcctgaggaacctgtggcctcggggagtagatacccactttgatctcaaggtcagggcaatcttgaggggatgctccctgcaaggatgaatccttatgctagtgacaagatgtgggtgacacatccttactctctgccctgacggtctgtcctctctctggggggtggggggtctctgggcaccagccagggatgtggtattaaaggctccatgtctggcg

SEQ ID NO: 138815 - DNA, 601 bp, Human
agtagagacggggtttcaccgtgttagccaggatggtctcgatttcctgacctcatgatccgcccgccttggcctcccaaagtgctgggattacaggcatgagccactgtgcccggtctttttttttttttttgagacggagtctcgctctgtcccccacgctggagtgcagtggcatgatctcggctcactgcaagctccacctcctgggttcacgccattctcctgcctcagcctcctgagtagctgggactacaggcgcccgccactgtgcccggctaatttttttttttgtagtttyagtagagacggggtttcaccgtgttagccaggatggtctcgatctcctgacctcgtgatcctcccgcctcggcctcccaaagtgctgggattacaggcgtgagccaccgcgcccggcaaggtgaacaaattctcatcttacacattctctgtcaatgactgtcatatgttaaattaaaatgtatgcctgaatagatagaaaggaaaaaagggaagggtctacaaaaacaaagtccaatgagtgactttttttttgagacagggtctcactgtcacccaggctaaagtgccacggtgctat

SEQ ID NO: 138816 - DNA, 601 bp, Human
tttttgagacagggtctcgctgtgtcatgcaggctggagtgcagtggcgcaatctcggctcactgcaagctccgcctcctgggttcacgccattctcctgcctcagcctcctgagtaagtgggactacaggcgcccgccaccacacctggctatttttttgtatttttagtagagacggggtttcaccgtgttagccaggatggtctcgatttcctgacctcatgatccgcccgccttggcctcccaaagtgctgggattacaggcatgagccactgtgcccggtctttttttttttttttgagacggagtctcgctctgtcccccacgctggagtgcagtggcatgatctcggctcactgcaagctccacctcctgggttcacgccattctcctgcctcagcctcctgagtagctgggactacaggcgcccgccactgtgcccggctaatttttttttttgtagttttagtagagacggggtttcaccgtgttagccaggatggtctcgatctcctgacctcgtgatcctcccgcctcggcctcccaaagtgctgggattacaggcgtgagccaccgcgcccggcaaggtgaacaaattc

SEQ ID NO: 138817 - DNA, 601 bp, Human
gaaagaaagatcaggaggaaacccggggtgtggggaggggcagcaaggtgaacgaattctttttttttttttgagacagggtctcgctgtgtcatgcaggctggagtgcagtggcgcaatctcggctcactgcaagctccgcctcctgggttcacgccattctcctgcctcagcctcctgagtaagtgggactacaggcgcccgccaccacacctggctatttttttgtatttttagtagagacggggtttcaccgtgttagccaggatggtctcgatttcctgacctcatgatccgcccrccttggcctcccaaagtgctgggattacaggcatgagccactgtgcccggtctttttttttttttttgagacggagtctcgctctgtcccccacgctggagtgcagtggcatgatctcggctcactgcaagctccacctcctgggttcacgccattctcctgcctcagcctcctgagtagctgggactacaggcgcccgccactgtgcccggctaatttttttttttgtagttttagtagagacggggtttcaccgtgttagccaggatggtctcgatctcctgacctcgtgatcctccc

SEQ ID NO: 138818 - DNA, 601 bp, Human
gatggagcgcacggaatcccggttcaccttgtctgcaggtggcatggggcggggagacgcaaaatggggtctcatggtgtgggagagatggaccagcccctccgcagcctcctgccctgggctcttctgacccatttgtacctctctgggatgaggagaccccccacctcgccggccctccagggcattcaccaagtgcagggtgtgggttcagagcttcgaactcaacaggaccctgcaggcccacagcactcctcgaggcagggcccaacacctggcccactttagacacaggaaaccraagcccaggggtcacatgggagctggtgtggcagccggggaacccacacaggtggtctgactttggggtcaatgcccctgagcaagacatgctttggaggactgctggtacttgggggcacagggggtgtggaggcgggtgggcttctcagccagaggacttggactctaatcctaacttgctatttagctgagagaaactaccctaaccatgaggtgtcctcaactaggacatggggcccacattgcctgctccacgttgagaggatgcagcgggaaacatgtctgcccatggctgtgc

SEQ ID NO: 138819 - DNA, 601 bp, Human
ccatcaccccattttacaggtgtggagagggactgttgtgccaggattgcactggtgaccccggatcccaggttctctgtgaggtgctgagggggtgtgctgggggtgacagcggtttccaggccagaggcaggactggtgatgacaggctggctgcctggtaattacggcagcgtccagcctgctggcttcctgcctgctttacaagctaggaggctggggacgcagccggggacgggcaggaagtcccgaggctgcagaggtcctgttcaggtgtgtgtgagtgggcgaagccctgccrggcctcacctgcagcgtcttgtcgaaccagcggttgccgctgttgagcctgctgccgcccccatgcagcatctggcctgccacgtggctgcggtacacgtcttctgagaccctgggcatggttgcatctaggcacacggtgaagatgctcttctggatggagcgcacggaatcccggttcaccttgtctgcaggtggcatggggcggggagacgcaaaatggggtctcatggtgtgggagagatggaccagcccctccgcagcctcctgccctgggctcttctgacccatttgtacctct

SEQ ID NO: 138820 - DNA, 601 bp, Human
cgctcagcgtgcctgactgagtccttcaaactactctaccggtgaggttgaccatcaccccattttacaggtgtggagagggactgttgtgccaggattgcactggtgaccccggatcccaggttctctgtgaggtgctgagggggtgtgctgggggtgacagcggtttccaggccagaggcaggactggtgatgacaggctggctgcctggtaattacggcagcgtccagcctgctggcttcctgcctgctttacaagctaggaggctggggacgcagccggggacgggcaggaagtccygaggctgcagaggtcctgttcaggtgtgtgtgagtgggcgaagccctgccgggcctcacctgcagcgtcttgtcgaaccagcggttgccgctgttgagcctgctgccgcccccatgcagcatctggcctgccacgtggctgcggtacacgtcttctgagaccctgggcatggttgcatctaggcacacggtgaagatgctcttctggatggagcgcacggaatcccggttcaccttgtctgcaggtggcatggggcggggagacgcaaaatggggtctcatggtgtgggagagatggacc

SEQ ID NO: 138821 - DNA, 601 bp, Human; identical to SEQ ID NO: 138813

SEQ ID NO: 138822 - DNA, 601 bp, Human; identical to SEQ ID NO: 138814

SEQ ID NO: 138823 - DNA, 601 bp, Human; identical to SEQ ID NO: 138815

SEQ ID NO: 138824 - DNA, 601 bp, Human; identical to SEQ ID NO: 138816

SEQ ID NO: 138825 - DNA, 601 bp, Human; identical to SEQ ID NO: 138817

SEQ ID NO: 138826 - DNA, 601 bp, Human; identical to SEQ ID NO: 138818

SEQ ID NO: 138827 - DNA, 601 bp, Human; identical to SEQ ID NO: 138819

SEQ ID NO: 138828 - DNA, 601 bp, Human; identical to SEQ ID NO: 138820

SEQ ID NO: 138829 - DNA, 601 bp, Human
cctgcctatttcctgtttctctccaggactcctgggacccatctgagccatccctctacgaacactcattttttcctgagctgtggctcattcagctagggtccaagagcggaggacttttggtatgaaaaataaaccaaaggacactgggattgggctggatttgaatgagcaggtccaggggactctgggcaagtccctccttgcctcagtttccctgcaggaaggtaaccagtccagtcggatggtcctggaggatgatctagaggctgtttgtgggatggatgcagcttgggagacrgtgacaagggtgcggtggaggctcagggtgttgcaacacctaaaagagcctctaggcctgagcctggatgcaccctccgccctctggccccgtagtgtgtgtctgagacagagtgagacaccagcaacatatgcttggatcagggacggaagggactgaaattaggctagcatccgggctgctcaccggggaggactgaggggtagatatagccagggtggggaagggggctagaggggaggatatagccagggtggggaagggggctggagggaaggatacagccagggtggggaaggg

SEQ ID NO: 138830 - DNA, 601 bp, Human; identical to SEQ ID NO: 138813

SEQ ID NO: 138831 - DNA, 601 bp, Human; identical to SEQ ID NO: 138814

SEQ ID NO: 138832 - DNA, 601 bp, Human; identical to SEQ ID NO: 138815

SEQ ID NO: 138833 - DNA, 601 bp, Human; identical to SEQ ID NO: 138816

SEQ ID NO: 138834 - DNA, 601 bp, Human; identical to SEQ ID NO: 138817

SEQ ID NO: 138835 - DNA, 601 bp, Human; identical to SEQ ID NO: 138818

SEQ ID NO: 138836 - DNA, 601 bp, Human; identical to SEQ ID NO: 138819

SEQ ID NO: 138837 - DNA, 601 bp, Human; identical to SEQ ID NO: 138820

SEQ ID NO: 138838 - DNA, 601 bp, Human; identical to SEQ ID NO: 138829

SEQ ID NO: 138839 - DNA, 601 bp, Human; identical to SEQ ID NO: 138813

SEQ ID NO: 138840 - DNA, 601 bp, Human; identical to SEQ ID NO: 138814

SEQ ID NO: 138841 - DNA, 601 bp, Human; identical to SEQ ID NO: 138815

SEQ ID NO: 138842 - DNA, 601 bp, Human; identical to SEQ ID NO: 138816

SEQ ID NO: 138843 - DNA, 601 bp, Human; identical to SEQ ID NO: 138817

SEQ ID NO: 138844 - DNA, 601 bp, Human; identical to SEQ ID NO: 138818

SEQ ID NO: 138845 - DNA, 601 bp, Human; identical to SEQ ID NO: 138819

SEQ ID NO: 138846 - DNA, 601 bp, Human; identical to SEQ ID NO: 138820

SEQ ID NO: 138847 - DNA, 601 bp, Human; identical to SEQ ID NO: 17997

SEQ ID NO: 138848 - DNA, 601 bp, Human; identical to SEQ ID NO: 17998

SEQ ID NO: 138849 - DNA, 601 bp, Human; identical to SEQ ID NO: 17999

SEQ ID NO: 138850 - DNA, 601 bp, Human; identical to SEQ ID NO: 18000

SEQ ID NO: 138851 - DNA, 601 bp, Human; identical to SEQ ID NO: 18001

SEQ ID NO: 138852 - DNA, 601 bp, Human; identical to SEQ ID NO: 18002

SEQ ID NO: 138853 - DNA, 601 bp, Human; identical to SEQ ID NO: 18003

SEQ ID NO: 138854 - DNA, 601 bp, Human; identical to SEQ ID NO: 18004

SEQ ID NO: 138855 - DNA, 601 bp, Human; identical to SEQ ID NO: 18005

SEQ ID NO: 138856 - DNA, 601 bp, Human; identical to SEQ ID NO: 18006

SEQ ID NO: 138857 - DNA, 601 bp, Human; identical to SEQ ID NO: 18007

SEQ ID NO: 138858 - DNA, 601 bp, Human; identical to SEQ ID NO: 18008

SEQ ID NO: 138859 - DNA, 601 bp, Human; identical to SEQ ID NO: 18009

SEQ ID NO: 138860 - DNA, 601 bp, Human; identical to SEQ ID NO: 18010

SEQ ID NO: 138861 - DNA, 601 bp, Human
cgggggcggtggctcacacctgtaaccccagtgctttgggaggctgaggtggttggatcactagaggtcaggagtttgagacaagtctggctaacatggtgaaaccccatctctactaaaaatacaaaattagccgggtgtggtggtgcatgcctgtaatctcagctactggagaagctgagacaggagaatcccttgaacccgggaggcggaggttgcagtgagccaagattgcaccactgcacactccagcctgggcaacagaatgagactccatctcaaaaaaaaaaaaaaaaaaaagaaagaaagaaaagaaaagaaagagatggcaccaaagagggagtgcccccattagaaaaataagggttagccaggtgcagtggctcacacctgtaatcccagcactttgggaggctgaggcagttggatcacaaggtcaggagttcaagaccagcctggccaagatagtgaaactgcatctctactaaaactacacaaattagtcaggtgtggtgacagacgcctataatcccagctactcgggaggctgaggcaggagaaaaaaaaaagaaagaaagaaagaaaaataagggttaatggg

SEQ ID NO: 138862 - DNA, 601 bp, Human
gcggtggctcacacctgtaaccccagtgctttgggaggctgaggtggttggatcactagaggtcaggagtttgagacaagtctggctaacatggtgaaaccccatctctactaaaaatacaaaattagccgggtgtggtggtgcatgcctgtaatctcagctactggagaagctgagacaggagaatcccttgaacccgggaggcggaggttgcagtgagccaagattgcaccactgcacactccagcctgggcaacagaatgagactccatctcaaaaaaaaaaaaaaaaaaaagaaagaaagaaaagaaaagaaagagatggcaccaaagagggagtgcccccattagaaaaataagggttagccaggtgcagtggctcacacctgtaatcccagcactttgggaggctgaggcagttggatcacaaggtcaggagttcaagaccagcctggccaagatagtgaaactgcatctctactaaaactacacaaattagtcaggtgtggtgacagacgcctataatcccagctactcgggaggctgaggcaggagaaaaaaaaaagaaagaaagaaagaaaaataagggttaatgggggaca

SEQ ID NO: 138863 - DNA, 601 bp, Human
aaaaaagaaagaaagaaagaaaaataagggttaatgggggacaccaatgagttaggaattaatacgtcttcaatctgctgggatagcaggctcaaactttttttttttaatttaaaaatttttgtttgcacaaagccaccagtagataaagcccgctactgccaatgactttctaagaccaggctccctccagaaatggccgggaagaccgtggcttcgccagtgactcagaacaaaccagggtcgcgggttccttcctcgccagtcaaacgctgagggctgcaccaggcacgttaggaaracaaaccctggtttgctgcctttgcaatgacttacaacaaaagaaaccacattaataactgagattttctctaaagcattccctcctgtgggcagagtggaaacggggacgtggacacactgggaaaataaacaaagcccctagagccaggcaggggtgaggcctctggccagggaaggctgggcggccagtgctcagggctggtacctgctttggaaaaccccaggattcactgcaggagaaaccttgggatcccacgtggattcattttccagagatttcggaagatgaagtgcttgc

SEQ ID NO: 138864 - DNA, 601 bp, Human
aaagcccgctactgccaatgactttctaagaccaggctccctccagaaatggccgggaagaccgtggcttcgccagtgactcagaacaaaccagggtcgcgggttccttcctcgccagtcaaacgctgagggctgcaccaggcacgttaggaaaacaaaccctggtttgctgcctttgcaatgacttacaacaaaagaaaccacattaataactgagattttctctaaagcattccctcctgtgggcagagtggaaacggggacgtggacacactgggaaaataaacaaagcccctagagscaggcaggggtgaggcctctggccagggaaggctgggcggccagtgctcagggctggtacctgctttggaaaaccccaggattcactgcaggagaaaccttgggatcccacgtggattcattttccagagatttcggaagatgaagtgcttgcatctaaggcacggggcaaggcagggtgaggtgggagccctcgaggggctgtcggtgcatctgttcataggggtgggtctggtttgtggtgggggtccccagggctcagctcagggcctgagttaagagactgagttaagagactggc

SEQ ID NO: 138865 - DNA, 601 bp, Human
acactgggaaaataaacaaagcccctagagccaggcaggggtgaggcctctggccagggaaggctgggcggccagtgctcagggctggtacctgctttggaaaaccccaggattcactgcaggagaaaccttgggatcccacgtggattcattttccagagatttcggaagatgaagtgcttgcatctaaggcacggggcaaggcagggtgaggtgggagccctcgaggggctgtcggtgcatctgttcataggggtgggtctggtttgtggtgggggtccccagggctcagctcagggcytgagttaagagactgagttaagagactggcagacctaccttcaattattttttattgcgataaaagatgcctaacatcagattgaccattttcaccatttacaagaatgctgtccggtggcattaagtccgttcacattgtcgtgcagtcgccaccaccatccatctccagaactttctcatcttcccaaactgaaaccgcacccccttgaacatgcattccccctcccccagcccctggcacccagcagtctgcttcctgtctctgtggatttgactaccctagggatctcgtatgtaa

SEQ ID NO: 138866 - DNA, 601 bp, Human
actgtgaacagcaccgctgtggacgtggatgtatacaagtccctgcttttaatgatttgggatatctagtcagtgttggaatggctgcattctatggtagttctacctttaatttttttattttttagtttttcacggagtcttgctccattgaccgggttggagtacagtggtgtgatctccgctcactgcaacctccgcctcctgggttcaggtgattctcctgcctcagcctcccgagtagctaggattacaggtgcgtgccaccatacctggctaatttttgtatttttagtagagmcagggtcttgccttgttggccaggctggtcttgaactcctgacctcaggtgatccacccgtctcagcctcccaaagtgctgggattacaggtctgagccaccgtgcccggccctacctttaaatgtgttaagggtccataatactgttttccacggctaacttcggtttttaaccggcctccctgtaactgatgctgaaacagggcatcatcacaagaccagagccaggctttggaggaagagacaaaggggtcccttcagagcccagcctttgaaaggcagcttgcgttccttcccctc

SEQ ID NO: 138867 - DNA, 601 bp, Human
gggcacagcagctgtgtgctctgcatgtcggctggggcatcacaggcctcactggagttgtcctcctgccagccgtgtgaagcccattttatgaagagggaaactgaggtgtgaggtgaaggtcacaccgttcccattcctgtaagattccagcctggccctcctgttccaaaacccctgatctctaccactgcctgaagctgcccctggctcccgggaatgctggggtggcctgaccagggatgtccacacccaggcaggcgcaggctgcattcaggggccgtgaggtggcccggggttggggggtttctccttaatatctccagcaacctggcctgggtcatgtcccaagtgtgagggagatgggtcaggcctggagagtggggactgcccggggctggggtgtttgacatgggagtgtgggggtgatgcccttcccctcctgcccagaaataaccggaacggcctccctcacctgtctccagctgcccggatgcacgagagctgtggagggtccctgtctctgtgtaacagcaataggacaggttccctttccccctccatccccagctcccgcacttgttcattcattcattcattc

SEQ ID NO: 138868 - DNA, 601 bp, Human
agcagctgtgtgctctgcatgtcggctggggcatcacaggcctcactggagttgtcctcctgccagccgtgtgaagcccattttatgaagagggaaactgaggtgtgaggtgaaggtcacaccgttcccattcctgtaagattccagcctggccctcctgttccaaaacccctgatctctaccactgcctgaagctgcccctggctcccgggaatgctggggtggcctgaccagggatgtccacacccaggcaggcgcaggctgcattcaggggccgtgaggtggcccggggttggggggkttctccttaatatctccagcaacctggcctgggtcatgtcccaagtgtgagggagatgggtcaggcctggagagtggggactgcccggggctggggtgtttgacatgggagtgtgggggtgatgcccttcccctcctgcccagaaataaccggaacggcctccctcacctgtctccagctgcccggatgcacgagagctgtggagggtccctgtctctgtgtaacagcaataggacaggttccctttccccctccatccccagctcccgcacttgttcattcattcattcattcattcat

SEQ ID NO: 138869 - DNA, 601 bp, Human
aaaatgaagcagtctctggaagatattattctggtttatctctgtgattgattctgcttttctgtgcgtgggatgggcagcctggaccttccagtttgggggcggtaggaggggctaggagtgagtgggggcaacgggtgatggagcagccaaggagctgaggcctgtaggattggggaccgggcaacaggctgtgggctgcaaaactcgcagtctttggagaagacttgggagtgagacaatgacagagaaggaggcccaggctgtgaggactggaaacttccacagagggacccccccrcccccagagctgagcgaacacctcagttgcttgagatttgacaaggtgagggcaggtgacctcctgtaacactgctgcccaagacgcagtgagaagggccccagactaggagtcaggacatggggttcctgcctcgccttgcccagctctacagcttgagacacaccctgtggctggtctgagcctccgtgtccccatctgcaagacaagaaggttggacatttgtttatggacatatttagtgtggtcccaggagtcactgcgtcagaatcacccagggagctggtgcgtgttcccagg

SEQ ID NO: 138870 - DNA, 601 bp, Human
tgcccagctctacagcttgagacacaccctgtggctggtctgagcctccgtgtccccatctgcaagacaagaaggttggacatttgtttatggacatatttagtgtggtcccaggagtcactgcgtcagaatcacccagggagctggtgcgtgttcccaggtcccaccctgacccaccggatcggactcggagcctaggcctatgcgtctgcattcaatagccccctgcctagcgattcttgtaccctgctgcgggctccttccagagctgactctgcctccattaccctcctcagtttayccgagtggaaagcggtcctctcgaggggacagagaggccgggcagagctgccgcaggatgcataaggctggctctggacctggaagggcccggaagtgtccagtatacaggagagggagggggctgcgctgaggctaagccccagcatccccagggactggattttgtgccaaagctgcactgccgggtctaggaggaagtatttgctctcgaccatccaccagcatccattgagcacctactgagtaccagcccaaggcagcccaggggcgtggaatgcaggggtgatgtgatagggac

SEQ ID NO: 138871 - DNA, 601 bp, Human
catttgtttatggacatatttagtgtggtcccaggagtcactgcgtcagaatcacccagggagctggtgcgtgttcccaggtcccaccctgacccaccggatcggactcggagcctaggcctatgcgtctgcattcaatagccccctgcctagcgattcttgtaccctgctgcgggctccttccagagctgactctgcctccattaccctcctcagtttacccgagtggaaagcggtcctctcgaggggacagagaggccgggcagagctgccgcaggatgcataaggctggctctggacytggaagggcccggaagtgtccagtatacaggagagggagggggctgcgctgaggctaagccccagcatccccagggactggattttgtgccaaagctgcactgccgggtctaggaggaagtatttgctctcgaccatccaccagcatccattgagcacctactgagtaccagcccaaggcagcccaggggcgtggaatgcaggggtgatgtgatagggacgattcctgtctctccctcaccagcatcctgaccccctctagctttggtggccagggttggggtgtaggaggcagtcaaaa

SEQ ID NO: 138872 - DNA, 601 bp, Human
ttatggacatatttagtgtggtcccaggagtcactgcgtcagaatcacccagggagctggtgcgtgttcccaggtcccaccctgacccaccggatcggactcggagcctaggcctatgcgtctgcattcaatagccccctgcctagcgattcttgtaccctgctgcgggctccttccagagctgactctgcctccattaccctcctcagtttacccgagtggaaagcggtcctctcgaggggacagagaggccgggcagagctgccgcaggatgcataaggctggctctggacctggaagrgcccggaagtgtccagtatacaggagagggagggggctgcgctgaggctaagccccagcatccccagggactggattttgtgccaaagctgcactgccgggtctaggaggaagtatttgctctcgaccatccaccagcatccattgagcacctactgagtaccagcccaaggcagcccaggggcgtggaatgcaggggtgatgtgatagggacgattcctgtctctccctcaccagcatcctgaccccctctagctttggtggccagggttggggtgtaggaggcagtcaaaagcacccc

SEQ ID NO: 138873 - DNA, 601 bp, Human
ctctgcctccattaccctcctcagtttacccgagtggaaagcggtcctctcgaggggacagagaggccgggcagagctgccgcaggatgcataaggctggctctggacctggaagggcccggaagtgtccagtatacaggagagggagggggctgcgctgaggctaagccccagcatccccagggactggattttgtgccaaagctgcactgccgggtctaggaggaagtatttgctctcgaccatccaccagcatccattgagcacctactgagtaccagcccaaggcagcccaggggcktggaatgcaggggtgatgtgatagggacgattcctgtctctccctcaccagcatcctgaccccctctagctttggtggccagggttggggtgtaggaggcagtcaaaagcacccctgctgagctggagccactggacaagccccctcctggcatcctgccggcacctcctgcccccctgctaccctccctcccccatggggtcccctcaaagggctctcttggggatggggatccactgcccccagggggcggctgccttgccccagactttgtcctcctgcccccacccccgcctccct

SEQ ID NO: 138874 - DNA, 601 bp, Human
acctcctgcccccctgctaccctccctcccccatggggtcccctcaaagggctctcttggggatggggatccactgcccccagggggcggctgccttgccccagactttgtcctcctgcccccacccccgcctccctgtctgtcctcccccactgccggtctccccctcgctggcctcccttcttgccgtgggcgcagacgtttacacgccagagatggcgttattaaaaatgacatttaaccagagctggaattaccacgcggatggctgcaaacctcggaatcaaagcgggagccgccrggcgggcgcgcctggcaggggcctcgcagcctctctcgccgccagagctctgcgcgggcctcccgtataaaaccccgcagaacgccgaggtcttgaaagccagtgcacctcctttcattagactaacaaataacgcgtaacagaaaacagctgttaacagcagccctctaatgctctcaagatggtgcctcaggcagctggtccagccagtgggcagccggtgggcaactcagcctcaggtggaggctgctcccaccccaggtgggtgtagaatgtctggcaccctcccgtttttccagg

SEQ ID NO: 138875 - DNA, 601 bp, Human
ggggcggctgccttgccccagactttgtcctcctgcccccacccccgcctccctgtctgtcctcccccactgccggtctccccctcgctggcctcccttcttgccgtgggcgcagacgtttacacgccagagatggcgttattaaaaatgacatttaaccagagctggaattaccacgcggatggctgcaaacctcggaatcaaagcgggagccgccaggcgggcgcgcctggcaggggcctcgcagcctctctcgccgccagagctctgcgcgggcctcccgtataaaaccccgcagaasgccgaggtcttgaaagccagtgcacctcctttcattagactaacaaataacgcgtaacagaaaacagctgttaacagcagccctctaatgctctcaagatggtgcctcaggcagctggtccagccagtgggcagccggtgggcaactcagcctcaggtggaggctgctcccaccccaggtgggtgtagaatgtctggcaccctcccgtttttccagggctgggtctgcaccctctgggacctgggagcctccttctccttctgtccttcctcctgctcagtcattcacccgctccttgct

SEQ ID NO: 138876 - DNA, 601 bp, Human
cttgccgtgggcgcagacgtttacacgccagagatggcgttattaaaaatgacatttaaccagagctggaattaccacgcggatggctgcaaacctcggaatcaaagcgggagccgccaggcgggcgcgcctggcaggggcctcgcagcctctctcgccgccagagctctgcgcgggcctcccgtataaaaccccgcagaacgccgaggtcttgaaagccagtgcacctcctttcattagactaacaaataacgcgtaacagaaaacagctgttaacagcagccctctaatgctctcaagrtggtgcctcaggcagctggtccagccagtgggcagccggtgggcaactcagcctcaggtggaggctgctcccaccccaggtgggtgtagaatgtctggcaccctcccgtttttccagggctgggtctgcaccctctgggacctgggagcctccttctccttctgtccttcctcctgctcagtcattcacccgctccttgctgagagcccatgtctgagggtctgttggcgaggggttgggccctgggacggtgggaatcaggggtggcatggccaagaacatgggaagcaacagccagat

SEQ ID NO: 138877 - DNA, 601 bp, Human
ttcacccgctccttgctgagagcccatgtctgagggtctgttggcgaggggttgggccctgggacggtgggaatcaggggtggcatggccaagaacatgggaagcaacagccagatcttgagctccagccccacctctggcccgctgagggaccatggctagtttctctctaagctccttatttgtcatctggggaggacaagagtcacaccttcttgcagggaggttttatggatttgggagatgatggaagtggagttctcagcaggcagccagacagtgctcagaagaaagagtatctgcaatcgtggttacagctgaggaaccctgtgctcagagaggctaagtgacttgcccaaggtcacacagggggtggagaagccagagcccatgtgctttcaggacactgtgaagcagggactgaggcattcagaagtgggtctgaaccggcccctgccctcagacggcttccagtccacagttgatgtagaggatgagctccctagccctcactgaggccaggcaaccccttgaggcccccaccactaaccctgcgggcttggaagccagaggggcctccagatgcagacatcattccaag

SEQ ID NO: 138878 - DNA, 601 bp, Human
ccagagaaaacctccctaagttgggaagaaagacaaatgggcattttgtttcatttcccctcatggtgaagccacagaagagacccctttgccttccccctaagagactgtatgttaaactccgtgcctccccacttgccaccaagatcctgctctgcattttgcttgcaagaaaactgcataggattctccttatttgctcatttgttcagcgcatgtgcgtgttgttttgaggcgtggtgctgggaaaatcccagtgaacaggccagccctggtcccaaagggcataatctcagcacaragcgcccccagcgatcccgttcttaccatctgccagtctccgagctctaggatttatgcagagcctctcactgaatcactcagcagcctcacgagagaggtgaagctttatcctcatcttacaggcgaggaaaccgaggcttagaaggataaagtgacttgacccaggaaatacgcagtgatccccagagcccaggtatcacactggccacctcacgccggtgcctcagatggccaaggagccgcgcggggttctcctgctagaagcagcctaggctctgcctctgggggaggcccagga

SEQ ID NO: 138879 - DNA, 601 bp, Human
gcgatcccgttcttaccatctgccagtctccgagctctaggatttatgcagagcctctcactgaatcactcagcagcctcacgagagaggtgaagctttatcctcatcttacaggcgaggaaaccgaggcttagaaggataaagtgacttgacccaggaaatacgcagtgatccccagagcccaggtatcacactggccacctcacgccggtgcctcagatggccaaggagccgcgcggggttctcctgctagaagcagcctaggctctgcctctgggggaggcccaggagggatgggggkgttcctccccacctcccggttcctgcctggagagctctgcagtgtcctgaggaaggcccccctccaaaccccccatttgcagggacacacccatgcagacactgggccgtggcatggtcaggcggggaggctccaggccttgctgtgatggggaggggggtgaccagggaggggcccttgccttagggaagctcatgtttcctagagacatcatgttttaattggaaggccagcctctcccgcagagcgggccgccccaccaccacatccctgcgggaggagagtgtcagggctcaaagc

SEQ ID NO: 138880 - DNA, 601 bp, Human
ggcccttgccttagggaagctcatgtttcctagagacatcatgttttaattggaaggccagcctctcccgcagagcgggccgccccaccaccacatccctgcgggaggagagtgtcagggctcaaagcgggaaattgctagagacaagaagtaaaaacggactactctgatttcactgggaaggaagaaagaaaaggcaaagatctaataccagctgaaagcagggttgctgtttaaagaaaactgttgctgttgcagcaaatttaaggctgcggctgctttttctttctttctttctttytttttttttttttttttttgagatggagtctcactctgtcgcccaggctggagtgcagtggcgcaatctcggctcgctacaacctccgcctccagggttcaggtgattgtcctgcctcagcctctcgagtagctagaattacaggcacgtaccaccatgcctggcacatttttgtatttttagtagagatggggttttgtcacgttggccaggctggtctcgaactcctggcctcaggtgatccgcctgcctcgacctcccaaagtgctggggttacaagcgtgagccactgtgcccagc

SEQ ID NO: 138881 - DNA, 601 bp, Human
ccgcctgcctcgacctcccaaagtgctggggttacaagcgtgagccactgtgcccagcctagggggcggctttttcaaggggctggtttctctgtcaagggaggaaaagtcagggaggccttctgtgaatgcttctctccttccacaaatattgttgagcacctactgcacgccaggccctggccaggcacaggggcccctgcaggaatcaagggagctgtggtccttggtgtgaaggagacatgctggatgctatgacaacacacgacggggcccctacattgtctggaggttcagggamggtttcctgggggaaacagaatttcagaagggacctcaagaatgagtggagttgtccagtagaggaggtcagggagggcacgccgggtggaggaaacagcagacggaaaggctccgagttggaaagagcatggctgttctggagcagaaagggtgggagagagcatgatgggggcctgtgatctggcagaccttgtttgaggtgtgtgacttttgtgttaagagcagtggggatgcgttctgtgtgtctgtgagtgtccagagtggccactcactccggccctctctgggggcgctctca

SEQ ID NO: 138882 - DNA, 601 bp, Human
aggggcccctgcaggaatcaagggagctgtggtccttggtgtgaaggagacatgctggatgctatgacaacacacgacggggcccctacattgtctggaggttcagggacggtttcctgggggaaacagaatttcagaagggacctcaagaatgagtggagttgtccagtagaggaggtcagggagggcacgccgggtggaggaaacagcagacggaaaggctccgagttggaaagagcatggctgttctggagcagaaagggtgggagagagcatgatgggggcctgtgatctggcagascttgtttgaggtgtgtgacttttgtgttaagagcagtggggatgcgttctgtgtgtctgtgagtgtccagagtggccactcactccggccctctctgggggcgctctcagtgagcatctcttacggtcacatgggaagccagtgtgtgatatggggatgacagttgtgtctcagttgcccagagctcgctgggctgccccagtctccaaaggagctgaccacaagcccctaactggctgcccctggcccagctgccgtgagacctgcactgcctgagaagcccagatcctcagccaggga

SEQ ID NO: 138883 - DNA, 601 bp, Human
cagggacggtttcctgggggaaacagaatttcagaagggacctcaagaatgagtggagttgtccagtagaggaggtcagggagggcacgccgggtggaggaaacagcagacggaaaggctccgagttggaaagagcatggctgttctggagcagaaagggtgggagagagcatgatgggggcctgtgatctggcagaccttgtttgaggtgtgtgacttttgtgttaagagcagtggggatgcgttctgtgtgtctgtgagtgtccagagtggccactcactccggccctctctgggggckctctcagtgagcatctcttacggtcacatgggaagccagtgtgtgatatggggatgacagttgtgtctcagttgcccagagctcgctgggctgccccagtctccaaaggagctgaccacaagcccctaactggctgcccctggcccagctgccgtgagacctgcactgcctgagaagcccagatcctcagccagggagggaaagctccaggagccatttagagccagaggtggggcaggtggccgtgccccacgtcgcagtccaccacgtgcaggacggcagcaccaatcagggaggtgg

SEQ ID NO: 138884 - DNA, 601 bp, Human
acggtggcaggggggaggtggctgtgagggcccacctccatcatcgtcggccccatgatccaagaggaccatttattgtgcacctgccaagtgctacaccctctgcatggatcatctcattaaatcctcccaaacattctagaaggcaggcggttttatgaccccattttctaggtgaggaaactgaggcccaggaagccaagttacacagtaagtacgtgggggcaccaggccttgggctcttgactgtgatctattccctacccctgccgacctggagtccctggattgggctgactgygaccttacccagcctctccaggcctggttaggaagggaaaggtaagaaggttccataacgctggagcaggggctgctgaacgaaaccagaggtgatccctggcccaggcaggcgggctaggggcaggggcagcccctcttgtcccccatgcagctcagtggtgatgcagacagagaaatgtagagccagctccagagagctcccaagggcacccctccagggcctccgtttcccagggataggacacgctggggagtggcccggctctgctgtggagattctggcccaacctcagctcca

SEQ ID NO: 138885 - DNA, 601 bp, Human
cctcacctgcaaaatgatcatcataatagtacctggggtttgggctgctcagaggagtcgataagaccaggcaggtaggggattagctttacgcctgcctcgcccctgaagagtgctcagtaaacaccaatttaggcaggcacggtggctcatgcctgtaatctcagcactttgggaggctgagaagggtggatcacctgaggtcaagagttcgagacctgcctggccaacatggtgaagccccatctctactaaaaatacgaagttagctgggcgtggtggcgtgcacctgtaatcccarctactccggaggctgacacaggagaatcgcttgaacctgggaggcggaggttgcagtgcgctgagatcatgccactgcactccagcctgggtgacagagcgagactccgtctcaaaaaaaaaaaaaaaagaaaagaaaagaaaaggaaaaataacaatttgctttctctctctctctcccaccccccccacccgccctagacacctgggaggaggggcagatgtcccatttaggaccatcacgttcccttcacagatggaaaaactgagggagaggtttccccaagccccacaggaaggg

SEQ ID NO: 138886 - DNA, 601 bp, Human
gctcagaggagtcgataagaccaggcaggtaggggattagctttacgcctgcctcgcccctgaagagtgctcagtaaacaccaatttaggcaggcacggtggctcatgcctgtaatctcagcactttgggaggctgagaagggtggatcacctgaggtcaagagttcgagacctgcctggccaacatggtgaagccccatctctactaaaaatacgaagttagctgggcgtggtggcgtgcacctgtaatcccaactactccggaggctgacacaggagaatcgcttgaacctgggaggcrgaggttgcagtgcgctgagatcatgccactgcactccagcctgggtgacagagcgagactccgtctcaaaaaaaaaaaaaaaagaaaagaaaagaaaaggaaaaataacaatttgctttctctctctctctcccaccccccccacccgccctagacacctgggaggaggggcagatgtcccatttaggaccatcacgttcccttcacagatggaaaaactgagggagaggtttccccaagccccacaggaaggggagctgagattaggaacagagttctgggtgtcaggagcttgcctca

SEQ ID NO: 138887 - DNA, 601 bp, Human
gctcagtaaacaccaatttaggcaggcacggtggctcatgcctgtaatctcagcactttgggaggctgagaagggtggatcacctgaggtcaagagttcgagacctgcctggccaacatggtgaagccccatctctactaaaaatacgaagttagctgggcgtggtggcgtgcacctgtaatcccaactactccggaggctgacacaggagaatcgcttgaacctgggaggcggaggttgcagtgcgctgagatcatgccactgcactccagcctgggtgacagagcgagactccgtctcaaaaaaaaaaaaaaaagaaaagaaaagaaaaggaaaaataacaatttgctttctctctctctctcccaccccccccacccgccctagacacctgggaggaggggcagatgtcccatttaggaccatcacgttcccttcacagatggaaaaactgagggagaggtttccccaagccccacaggaaggggagctgagattaggaacagagttctgggtgtcaggagcttgcctcacggctttgctggtatctaaccatgctttccaaaagggagataagttacccagcccaacaccccgcccc

SEQ ID NO: 138888 - DNA, 601 bp, Human
tttaggcaggcacggtggctcatgcctgtaatctcagcactttgggaggctgagaagggtggatcacctgaggtcaagagttcgagacctgcctggccaacatggtgaagccccatctctactaaaaatacgaagttagctgggcgtggtggcgtgcacctgtaatcccaactactccggaggctgacacaggagaatcgcttgaacctgggaggcggaggttgcagtgcgctgagatcatgccactgcactccagcctgggtgacagagcgagactccgtctcaaaaaaaaaaaaaaaaraaaagaaaagaaaaggaaaaataacaatttgctttctctctctctctcccaccccccccacccgccctagacacctgggaggaggggcagatgtcccatttaggaccatcacgttcccttcacagatggaaaaactgagggagaggtttccccaagccccacaggaaggggagctgagattaggaacagagttctgggtgtcaggagcttgcctcacggctttgctggtatctaaccatgctttccaaaagggagataagttacccagcccaacaccccgcccccagcccgcacacagga

SEQ ID NO: 138889 - DNA, 601 bp, Human
agaagggtggatcacctgaggtcaagagttcgagacctgcctggccaacatggtgaagccccatctctactaaaaatacgaagttagctgggcgtggtggcgtgcacctgtaatcccaactactccggaggctgacacaggagaatcgcttgaacctgggaggcggaggttgcagtgcgctgagatcatgccactgcactccagcctgggtgacagagcgagactccgtctcaaaaaaaaaaaaaaaagaaaagaaaagaaaaggaaaaataacaatttgctttctctctctctctcccaycccccccacccgccctagacacctgggaggaggggcagatgtcccatttaggaccatcacgttcccttcacagatggaaaaactgagggagaggtttccccaagccccacaggaaggggagctgagattaggaacagagttctgggtgtcaggagcttgcctcacggctttgctggtatctaaccatgctttccaaaagggagataagttacccagcccaacaccccgcccccagcccgcacacaggacccagatccctctcccctgcccagccctgcctggcgacctgggatcccctct

SEQ ID NO: 138890 - DNA, 601 bp, Human
cgacctgggatcccctctctggaaggacagtgctgatccactgcactgaacctagcttctggctggatgtgaccgccactcctgtgcagaaggaggcatcttgctttattttccacagcacaaatggtaaccatatataatggcagataccatctataaaacacaactgtttttgtaatgtggtgtttgaagttaaaaattcaaattagagattaattacaacatctagaaggtctgtggctaagacgaccttggggaggaaggctgacacgttcagatttgcagcctggagcattgcagrtgggtactccctgcgtgcctagagcgtgcacatgcactcgcacccacactctgagccagtccccgggctccggcaaagctgggttccatgtggcattggcatccctgggagagctggtttcagtgctggctccttttctgcctaggacactgaggtccaagcaggcatcagagagcaggttccctggttgggtgtgatggctcacacctgtaatcccagcactttgggaggctgaggcgggcggatcacctgaggtcaggtgttcgagaccagcctggccaacatggcaaaaccccgtct

SEQ ID NO: 138891 - DNA, 601 bp, Human
aaaaaaaaacagaaagcaggttccttgatgataaagcagccctgggggttgtggatgcggcagcaggtggggagatgcccgtgtctggggcacccagaaaagttgtgaatgtcttggatttgcctccatccggtgccccctctctgctcctccctaaacccgccctccctccaccccccaaaaccagaaccagatggaaacccaaagtgaatagtggatctgaggctggggcagatggtgtgggatgggagccccggtgtggggagtgaaccccattccagaaacactaaaggccaatgcrtctccttcggcacagggacagcttggagcccgctgcggaagaacctccaggttctggaggcttctgggctccctggggatcacgggcacatgtttgctgctttattcaaaatggggaaccacagcagtgactggaagcgtatgggctgcctgtggcgccgagaattttcctccctccaccttcccacggtacaggctggtccctgaggaggaggcgtgggtcttaggaggaaagcagctctggggagctgttggccaaatgcccgtggcctcctcctgtgcccgaggtaccccagggaga

SEQ ID NO: 138892 - DNA, 601 bp, Human
gcgccactacactccagcctgggtgagagtgagactctgtctaaaaaaaaaaaaattccctctggctatgccagttcctgccaggccaccattaagtcttatttgggtgaagtcactgcccatcaggaacccctcctgggactcccttcataacagtaattaatcatctcccttttaggaagcccccactacagactaagcacatgacacacacggtctcccctcatctttatagacagatattgacatttccattttagagatgagaaacagaggctccttcctgcagcacatatttctkgagagcccctgctctgtgcaggtcctgggcacacacccacctgccagcccttatcgagcttacaggtaactgataaagacacaggcaggaggccgggcgcggtggctcacgcctgtaatcccagcactttgggaggccgaggtgggcggatcacgaggtcaggagatcgagaccgtcctggctaaaacggtgaaaccctgtctctactaaaaatacaaaaaattagctgggcgtggtgacgggcacctgtagtcccaactactcgggaggctgaggcaggagaatggcgggaacccggga

SEQ ID NO: 138893 - DNA, 601 bp, Human
tcccttttaggaagcccccactacagactaagcacatgacacacacggtctcccctcatctttatagacagatattgacatttccattttagagatgagaaacagaggctccttcctgcagcacatatttcttgagagcccctgctctgtgcaggtcctgggcacacacccacctgccagcccttatcgagcttacaggtaactgataaagacacaggcaggaggccgggcgcggtggctcacgcctgtaatcccagcactttgggaggccgaggtgggcggatcacgaggtcaggagatygagaccgtcctggctaaaacggtgaaaccctgtctctactaaaaatacaaaaaattagctgggcgtggtgacgggcacctgtagtcccaactactcgggaggctgaggcaggagaatggcgggaacccgggaggcggagcttgcagtgagcagagatcgcgccactgcactccagcatgggcgacagagcgagactccatctcaaaaaaaaataaaaaataaaaaagacacaggcaggtaatttactgcagtgctgttaaattccaccgaagagaagcacaggggcctctggggctcaga

SEQ ID NO: 138894 - DNA, 601 bp, Human
tgcaggtcctgggcacacacccacctgccagcccttatcgagcttacaggtaactgataaagacacaggcaggaggccgggcgcggtggctcacgcctgtaatcccagcactttgggaggccgaggtgggcggatcacgaggtcaggagatcgagaccgtcctggctaaaacggtgaaaccctgtctctactaaaaatacaaaaaattagctgggcgtggtgacgggcacctgtagtcccaactactcgggaggctgaggcaggagaatggcgggaacccgggaggcggagcttgcagtgagcagagatcgcgccactgcactccagcatgggcgacagagcgagactccatctcaaaaaaaaataaaaaataaaaaagacacaggcaggtaatttactgcagtgctgttaaattccaccgaagagaagcacaggggcctctggggctcagaggcgggagcgccacccccaggctgcacagccagcacctgcagaggtaaggctaaagcccaggatcagacttcagagccctcctgtccctaccctcttcctgtacaaggctatggctaacgggagcccctcccaacaggctgcagagact

SEQ ID NO: 138895 - DNA, 601 bp, Human
ccagggtgaggacaagggtacggttatagttggactttggcattatatcagtcaaggctgtcacctatgatgggtagaagactggtcccagctagcttaagcaaactaggatatatttattagcctaatttagaaatccagggtgggacttcaggcactgctggatccaggcttaagcaatgacactggggcctgggttctctctctctggcttcaccctttcctatagaggagacacacacacagagagagacacacacagatacaacacacacacacacacacacacacacacacacaccccaacagaaaagataccagaaatcacacacacacacacacacacacacacacacacacacacacccacacacaccccaacagaaaagagaccagaaatctccgaaaaagtctcgctgtgccatgattgggtccttacccacttctgaaccaatcatatggccaagagaagtggagtgctgattggccgaggcctgggctgtgtggggtggggcctcagtggcacctctgggacggggaatgtagggaggttgctctccacgtggtgctcctgggtgtaacagaactcacgtttataaag

SEQ ID NO: 138896 - DNA, 601 bp, Human
agggtgaggacaagggtacggttatagttggactttggcattatatcagtcaaggctgtcacctatgatgggtagaagactggtcccagctagcttaagcaaactaggatatatttattagcctaatttagaaatccagggtgggacttcaggcactgctggatccaggcttaagcaatgacactggggcctgggttctctctctctggcttcaccctttcctatagaggagacacacacacagagagagacacacacagatacaacacacacacacacacacacacacacacacacaccmcaacagaaaagataccagaaatcacacacacacacacacacacacacacacacacacacacacccacacacaccccaacagaaaagagaccagaaatctccgaaaaagtctcgctgtgccatgattgggtccttacccacttctgaaccaatcatatggccaagagaagtggagtgctgattggccgaggcctgggctgtgtggggtggggcctcagtggcacctctgggacggggaatgtagggaggttgctctccacgtggtgctcctgggtgtaacagaactcacgtttataaagga

SEQ ID NO: 138897 - DNA, 601 bp, Human
ggaggggtcatcaccaccctacctggttccaagcacaggcctgggaggccagggagcagggcaagttggggtctggctgggcccagggccccctaccagtagcagcatccccctcacgttacattaagcaccatggcaagtatgcggagccaaaagcagggtggactgtggtccgcttgccgtgccatcacaggcagtccacatttcactcactgtttgttcatttcctttttttatttttatttttttgaggcagggtctcactctgttgcccaggctggagtgcagtggcacaatcacrgctcactatagcctcaacctcctgggctgttgatcctcccacctcagcctcctgagtagctgggtgacatgtgccaccacccccacctggctaattctttaaattttttgtagagacgagcgtctcgaactgctggacttaagcagtcctcccacctcagcctcccaaagtgttgggactacaggcatgagccactgcgcccggccagtttcccttcttcactgtactttggaactaagttaaaaacaatttccagtctcccattttcctgggcctttaaaaagctccagggccttaggt

SEQ ID NO: 138898 - DNA, 601 bp, Human
cactatagcctcaacctcctgggctgttgatcctcccacctcagcctcctgagtagctgggtgacatgtgccaccacccccacctggctaattctttaaattttttgtagagacgagcgtctcgaactgctggacttaagcagtcctcccacctcagcctcccaaagtgttgggactacaggcatgagccactgcgcccggccagtttcccttcttcactgtactttggaactaagttaaaaacaatttccagtctcccattttcctgggcctttaaaaagctccagggccttaggtattrtgcacccaaagacttaagggcgtggtttgtgagtcattcattcattcatccatgcagtgtttactgagcaccgacaatgtgccaggcgccactgctgacacagccctgagggcgcagagggaacccggttcttggtgcagtgtaagcaagttgagttagtgatggtggagtggctgggagacgtggccagacccccacgcctttctggaccagtgagggaagggttcctacaggaagtgttgtctaagaagagaggtgagggctgggttgggctttgtgaagaggtgggaaaagtcttcc

SEQ ID NO: 138899 - DNA, 601 bp, Human
accacccccacctggctaattctttaaattttttgtagagacgagcgtctcgaactgctggacttaagcagtcctcccacctcagcctcccaaagtgttgggactacaggcatgagccactgcgcccggccagtttcccttcttcactgtactttggaactaagttaaaaacaatttccagtctcccattttcctgggcctttaaaaagctccagggccttaggtattatgcacccaaagacttaagggcgtggtttgtgagtcattcattcattcatccatgcagtgtttactgagcacygacaatgtgccaggcgccactgctgacacagccctgagggcgcagagggaacccggttcttggtgcagtgtaagcaagttgagttagtgatggtggagtggctgggagacgtggccagacccccacgcctttctggaccagtgagggaagggttcctacaggaagtgttgtctaagaagagaggtgagggctgggttgggctttgtgaagaggtgggaaaagtcttccagccagggggaactgcatgtgcaaagactggaagtagcagagtaccagcgtccaaggagcataaggaaggcc

SEQ ID NO: 138900 - DNA, 601 bp, Human
gggactacaggcatgagccactgcgcccggccagtttcccttcttcactgtactttggaactaagttaaaaacaatttccagtctcccattttcctgggcctttaaaaagctccagggccttaggtattatgcacccaaagacttaagggcgtggtttgtgagtcattcattcattcatccatgcagtgtttactgagcaccgacaatgtgccaggcgccactgctgacacagccctgagggcgcagagggaacccggttcttggtgcagtgtaagcaagttgagttagtgatggtggagyggctgggagacgtggccagacccccacgcctttctggaccagtgagggaagggttcctacaggaagtgttgtctaagaagagaggtgagggctgggttgggctttgtgaagaggtgggaaaagtcttccagccagggggaactgcatgtgcaaagactggaagtagcagagtaccagcgtccaaggagcataaggaaggccaggatggcttgtagtgggtggggctcgtagggggcaggggcacccagtgaagctggagggggcaggtcctgggaactagaccctgggctggcatgtagg

SEQ ID NO: 138901 - DNA, 601 bp, Human
cacagctgaccctcttacttttgcagcctgggtgcctccctcaccttgccccacaccaggacctgctcagaagggggatccctggtcatctgcagcctccggattcgccctcaccaccggccgcccctcctccacccaggcccctcccctcccttccagaaaatactccaatgtccttattttttcgggggagggccttgatgggtccagcgggggagtggggtctgggcagaatgctaatgaaatcagaggagcccgggttgggggcaggccctgggcaggggagaattaagcaattgcwggcaggctcttttccatatttgattggcgctggctgagggacagccacctgcagggaagccccctgcagagggggtgggggagtagtaaaggggacagatctgcttcttcaggtgccctcctcctacttggctgaggcaggctgcaggccgggcatggtgtaatcccagcacattgggaggcctaggtgggaggatcacttggggccaggagttcaagaccagcttaggccacagaatgagatcaccaactctataaaacattaaaaaagaaaaaaagtcggctgcattcaacatgcaca

SEQ ID NO: 138902 - DNA, 601 bp, Human
taactcaacttgcttgcgctgtaccagccggcttccctctgcacactcaaggctgtgtcaacagtggcgcctggcacaagggtggtgctcagtaaatgctgcctggatgaatgaatgagtgactcacaaactatacccttttgatcgctgcgccaactccgtggaattctagcagcctggttggtgtgggaactcatcacacccgagatttggggagcagaaaggtagcatggcccaggagacaagggcaggcagacagactggctcagaccctggccgggcaggcctaggcaggcagcawcagctctctgagcctcagtttctccttttctaaagcaacctgatgacagtagccccctcgcacagtgattgagggtggatgagaaagggctttctggaggtagcggggacagtctgtcactcaggctggagtgcagtggtgcaatcactgctcaccgcagccttgacctcctgggctcaagcggtcctcctgcctaagcctcctgagtagctaggattacaagtgtgcaccaccacgcctggctaacttttatattttttgtagagatgggggtctcactctgtcacccaggctggagtg

SEQ ID NO: 138903 - DNA, 601 bp, Human
ctctgagcctcagtttctccttttctaaagcaacctgatgacagtagccccctcgcacagtgattgagggtggatgagaaagggctttctggaggtagcggggacagtctgtcactcaggctggagtgcagtggtgcaatcactgctcaccgcagccttgacctcctgggctcaagcggtcctcctgcctaagcctcctgagtagctaggattacaagtgtgcaccaccacgcctggctaacttttatattttttgtagagatgggggtctcactctgtcacccaggctggagtgcagtgktgctatcttggctcactgcaacctccgcctctgggctcaagccatcctcccacctcagcctgccaggtaactgggactacaggcatgccactaccatgcctggctaatttttgtcttttttgtagagatgggggtctcactctgttgcccaagctggtcttgaactcttggactcaagcgatcctcccacctcagcctcctaaaagtgctgggattataggtgtgagtcaccgtgcccggtcaagaaatggctttgaggactgggaagagccccatgatataatgggggtcatttgaaga

SEQ ID NO: 138904 - DNA, 601 bp, Human
gtttggaaaaggggagtaagtgataatgcttgtctctcaggactgccagatttcggtgtgaccaggcatttggcttagtgctccgcttgaaggaattgctccacgcgagttagtggcatccatcatcatttcccattctcccatctcccactgtgcgtgtttgcttgagttatcaccaataccaaccctgtaagtagatgtcgcttttgcagatgaagataccaaggcttatttgggacaagtggtccctggccatagggctgggcctcaactctaggctggtctgatgcgcaaagacctkgcacttggtgtcgccagtgagtggtcctcaaccctggctgcacggtagcatgagctggcgagctttcaatgaatgctgatggccaggcctcactccgaacctgtggagtccgactctccggggtgggggcgggggcttggcatcttattttgcttatttatttatttattgagacggagtcttactctttcgcccaggctggagtgcagtggcacaatcttggctcactgcaacctctgtctcccaggttcaagcgattctcctgcttcagcctcccaagtagctcgtattacaggcgcg

SEQ ID NO: 138905 - DNA, 601 bp, Human
ttatttatttattttatttttgaggcagggtctcactctgtcacccaggctggagtgcaatggtgtgatctcggctcactgcaatctccacctcctgggttcaagcgattctcccacctcagcctcccaagtagctgggactatacaggtacacaccaccacgcctggctagtttttgtatttttttttagaagtgataaggttttgctgtgttgaccaggctggtctcgaactcctgacctaaagtgatctactctcctctgcctcccaaagtgctgggattacaggcatgagccaccaygcctggcctagactttatttttttagagcagttttagattcacagcaaagttgagtggaaagtgcagagattccccatctatctcctgtccccacctccacccccaccatcccccaccagagtgttacattcgttacagtcagtgagcctacagtgacataccatcatcactcaaagtccatagtgtacattggggttccctcttggtgttgttcattctgtggggttagagaaatgcataatgacacggatccaccactgcagtatcacccagagtggcttcactgccctaacagtccc

SEQ ID NO: 138906 - DNA, 601 bp, Human
tggagtgcaatggtgtgatctcggctcactgcaatctccacctcctgggttcaagcgattctcccacctcagcctcccaagtagctgggactatacaggtacacaccaccacgcctggctagtttttgtatttttttttagaagtgataaggttttgctgtgttgaccaggctggtctcgaactcctgacctaaagtgatctactctcctctgcctcccaaagtgctgggattacaggcatgagccaccacgcctggcctagactttatttttttagagcagttttagattcacagcaaarttgagtggaaagtgcagagattccccatctatctcctgtccccacctccacccccaccatcccccaccagagtgttacattcgttacagtcagtgagcctacagtgacataccatcatcactcaaagtccatagtgtacattggggttccctcttggtgttgttcattctgtggggttagagaaatgcataatgacacggatccaccactgcagtatcacccagagtggcttcactgccctaacagtcccccgggttctgcctcttcatccgtccctcctgcagccctgcaaccactgac

SEQ ID NO: 138907 - DNA, 601 bp, Human
tttagaagtgataaggttttgctgtgttgaccaggctggtctcgaactcctgacctaaagtgatctactctcctctgcctcccaaagtgctgggattacaggcatgagccaccacgcctggcctagactttatttttttagagcagttttagattcacagcaaagttgagtggaaagtgcagagattccccatctatctcctgtccccacctccacccccaccatcccccaccagagtgttacattcgttacagtcagtgagcctacagtgacataccatcatcactcaaagtccatagtktacattggggttccctcttggtgttgttcattctgtggggttagagaaatgcataatgacacggatccaccactgcagtatcacccagagtggcttcactgccctaacagtcccccgggttctgcctcttcatccgtccctcctgcagccctgcaaccactgacccttttactatctccaaagatttgcctttttcagaacgtcatgtggttggaatcatacagtatgtagcctcttgaggttggcttctttcacttagtaaatatccatgtaagtttcttccacattttttcatggttc

SEQ ID NO: 138908 - DNA, 601 bp, Human
ctcctctgcctcccaaagtgctgggattacaggcatgagccaccacgcctggcctagactttatttttttagagcagttttagattcacagcaaagttgagtggaaagtgcagagattccccatctatctcctgtccccacctccacccccaccatcccccaccagagtgttacattcgttacagtcagtgagcctacagtgacataccatcatcactcaaagtccatagtgtacattggggttccctcttggtgttgttcattctgtggggttagagaaatgcataatgacacggatccrccactgcagtatcacccagagtggcttcactgccctaacagtcccccgggttctgcctcttcatccgtccctcctgcagccctgcaaccactgacccttttactatctccaaagatttgcctttttcagaacgtcatgtggttggaatcatacagtatgtagcctcttgaggttggcttctttcacttagtaaatatccatgtaagtttcttccacattttttcatggttcgatagctccttttttcagtgctgagtaatattcctttgtctggatgtagcacagtttatccattcacct

SEQ ID NO: 138909 - DNA, 601 bp, Human
tttagagcagttttagattcacagcaaagttgagtggaaagtgcagagattccccatctatctcctgtccccacctccacccccaccatcccccaccagagtgttacattcgttacagtcagtgagcctacagtgacataccatcatcactcaaagtccatagtgtacattggggttccctcttggtgttgttcattctgtggggttagagaaatgcataatgacacggatccaccactgcagtatcacccagagtggcttcactgccctaacagtcccccgggttctgcctcttcatccrtccctcctgcagccctgcaaccactgacccttttactatctccaaagatttgcctttttcagaacgtcatgtggttggaatcatacagtatgtagcctcttgaggttggcttctttcacttagtaaatatccatgtaagtttcttccacattttttcatggttcgatagctccttttttcagtgctgagtaatattcctttgtctggatgtagcacagtttatccattcacctactggaggacgtgttagttgcttctaagttttggcaattatgaacagagctgctataaacatccctg

SEQ ID NO: 138910 - DNA, 601 bp, Human
atgcataatgacacggatccaccactgcagtatcacccagagtggcttcactgccctaacagtcccccgggttctgcctcttcatccgtccctcctgcagccctgcaaccactgacccttttactatctccaaagatttgcctttttcagaacgtcatgtggttggaatcatacagtatgtagcctcttgaggttggcttctttcacttagtaaatatccatgtaagtttcttccacattttttcatggttcgatagctccttttttcagtgctgagtaatattcctttgtctggatgtascacagtttatccattcacctactggaggacgtgttagttgcttctaagttttggcaattatgaacagagctgctataaacatccctgggcaggcctttttgtggacagaagtttccacctcatttgggtaggaaccaaggagtgtgatggccaaatcgtacggtaaaagtatgtttagttttgtaagaaacggccaagctgtcttccaaagtggctgtaccatttcgcattctcgccagcagtggatgagagttcctgttgccccacatcttcgccagcatttggttgtcagtgttctgg

SEQ ID NO: 138911 - DNA, 601 bp, Human
tgtggttggaatcatacagtatgtagcctcttgaggttggcttctttcacttagtaaatatccatgtaagtttcttccacattttttcatggttcgatagctccttttttcagtgctgagtaatattcctttgtctggatgtagcacagtttatccattcacctactggaggacgtgttagttgcttctaagttttggcaattatgaacagagctgctataaacatccctgggcaggcctttttgtggacagaagtttccacctcatttgggtaggaaccaaggagtgtgatggccaaatygtacggtaaaagtatgtttagttttgtaagaaacggccaagctgtcttccaaagtggctgtaccatttcgcattctcgccagcagtggatgagagttcctgttgccccacatcttcgccagcatttggttgtcagtgttctggattctgggcattctaatagccgtgtggtggtatctcactgtagttttaatttgcatttccccagtgatacaagatacggtgtatctttcatatgcttacttgccatctgtctgtctttttggtgaggtgtctgctcagggcttccgtccattttaaa

SEQ ID NO: 138912 - DNA, 601 bp, Human
caagagcgaaactctgtctcaaaaaaaaaaaaaaaaaagatcgttcttttggggcaaaactcgccttgccatcattactggttaatacagtatttatgtgcaggaggaagaatattgtccctattggaaatatgtccagagaggttggataatttttcctgccaccaccaaggccttggaagagggacgagggtttgcctcctggcaatgccacattgctgcttgtttattttaaaaggcagaattgaacatcattctcttcaaatgtctttctgtggtctatgtggaacttcccaaaatragcgtgtcaagggacaagggatggtaagacgatgccacacgtgacatagtttgctgtgtccttggaggtagaaagggcccccagcagggagtgaaggcagagtccttgcttggggtttttctgaagctcttcctgagcccatggcagacgaagctcatccaccagagaccctccgaatcctccacaacacagggttctaagcagctactagcaggcgatcaggagtggcagggaaatgacaccatgagccagccccggcctgagtgtgctcaaaaacaccccacgtctcccctttaattt

SEQ ID NO: 138913 - DNA, 601 bp, Human
ctaggaggattattcccttctccaccccacagtccgtgagtgtggataggtggcccgtaatcaacactccctccagaggtttctggctaagggggacagaggagaggccatggaggagaaggaaaggcaagaggacagagttctgtgacctgaaattgccaccagctgtctttagccccagaggaaactgtcttttcaaagagagaggctgcggaaatggcagatgcttgaagaatcagcttccctccaaattcccggtctcttgctctgggctttacttgaccaatgtgcttctttggtytggtttttatacaccccacagccttgttgtgtttacccccttttcaggcctgctggggaagggctcagtcttagcctggcacagagctgggagccgggccgggagcccccagctggcaggcacctccctttcctggcccacgctgctcttcctccaggcccccgccaccccaaacctttaacaggagacttggctgggaagtcaaaaggactttcccgctgctttcagatgcttaggcacattcaccaggccattatgggcctcactacctttaggcggggaactttttaaaagtgagtt

SEQ ID NO: 138914 - DNA, 601 bp, Human
ggaagggctcagtcttagcctggcacagagctgggagccgggccgggagcccccagctggcaggcacctccctttcctggcccacgctgctcttcctccaggcccccgccaccccaaacctttaacaggagacttggctgggaagtcaaaaggactttcccgctgctttcagatgcttaggcacattcaccaggccattatgggcctcactacctttaggcggggaactttttaaaagtgagttttttttctaaaatccagaatttctgacagcccaagttaacaagcccccacaagtgarttcagagagcattaacgggaaagttctaaacagaacctctgctgtcatgtaagcagctcagaaaaaaacactcttctcccattttaagggtgaacatggcactttgatgtggccccatttccttataaagccccctctgagaaggcggaaagctgaagtttaatctggagccaacaaattacttggaatttgcaagcacacatgcttagcccataggagctaaagtccacagtaaaagaaagaaaacgaaaaaaaaaagaaaggtggggtagggagtcacagaaggagagaaagggagga

SEQ ID NO: 138915 - DNA, 601 bp, Human
aatcccagcactttgggaggctgaggcggatggatcgcttgagcccaggggttaggcaccagcctgggcaacatggtgaaaccccgtctctacaaaaaatacaaaaattggccaggcgtggtagtgggcgcctgtaatttcagctactctagaggctcaggtgggaggatcgcttaagcctgagagttcaaggctgcagcggagcccagatcgcgccgctgcactccagcctgcgccacagagttagaccctgtctcgaaaaaaataatagtaataataatttttaaaaaatacattttawaaagcaaagctaccctcggttcccggtttgataaggggtggattccaaataagcagctgtcttgccgccttgccaagggaaaggagctgggcaaattcctgcagagtccccacaaagcttcactttccccagatgcttgggtgggaggaccctcgctaagggatcaaggttgcaggtgcagagggggtccctgacagagggagggcaagggaggggcgccccgggtgaaggtgactttgagttccaggtgtgtgggctagcagttgaagagggggtgcagcgcggacccccctggggcca

SEQ ID NO: 138916 - DNA, 601 bp, Human
ggctgaggcggatggatcgcttgagcccaggggttaggcaccagcctgggcaacatggtgaaaccccgtctctacaaaaaatacaaaaattggccaggcgtggtagtgggcgcctgtaatttcagctactctagaggctcaggtgggaggatcgcttaagcctgagagttcaaggctgcagcggagcccagatcgcgccgctgcactccagcctgcgccacagagttagaccctgtctcgaaaaaaataatagtaataataatttttaaaaaatacattttataaagcaaagctaccctcrgttcccggtttgataaggggtggattccaaataagcagctgtcttgccgccttgccaagggaaaggagctgggcaaattcctgcagagtccccacaaagcttcactttccccagatgcttgggtgggaggaccctcgctaagggatcaaggttgcaggtgcagagggggtccctgacagagggagggcaagggaggggcgccccgggtgaaggtgactttgagttccaggtgtgtgggctagcagttgaagagggggtgcagcgcggacccccctggggccagagtccgatagaccagct

SEQ ID NO: 138917 - DNA, 601 bp, Human
gggggaggggagcgtggaggttggagggttttaagcgccgggattcggaagggggcttttcacccactgggtgagtacaagggcttcattgaggccggtcccagctccgcaccaaatctgtcttaaccacaaggtggtccctggtcctggctgctgtcagcaccgagccttcccgtccccaggcagcttcggggtgctctgcctttctggaccagccccttcagctctctgggccccctcgcagggcctataaagtgagcagtggagctgggagctcccagcaggggagcttaggagaaaygggtggttggatggggcgggggggggggggggcgggggcacttaggctctgtctccatggttctccaccaaaaggaagcgtaagaccaggcggtggtgctgccaggccgggctgggccaggccaacccagtctggctgcagagaagagggcttgcccagggcttgggactcagcagttccccgagttccccctggtgtgcagcccttccccatgatcgggaggagggtgtttggtgaaacacacgtggcaagagcgggtttttcccgccacgcctgccttccttgttccggaaaagggga

SEQ ID NO: 138918 - DNA, 601 bp, Human
tggactccagagatgaaaccttgggcttgggatcaaatcttcctggtgtctggaggctcaggaaacaaggtggttcgttcctaaactctaggaagtagagggaggatgctggcccagctggagggccatcaggatagcctgactgtcccttccctcccagggcatgctggaggcccttccccacaggaaggccgctgtgcctgttcctctgactatgagcaccagcaaagccaggctgaagcatttccctgtgggaggtgatttccctagcccatgctctggcctgtcaattaaaaaaatycatcaataggctgggcgcagtggctcacgcccataatcccagaactttgggaggccaaggtgggcagatcacttgaggtcaggagttcgagaccagcctggccaacatggtgaaacctcgtctaaaatatatacacacaaaattagctgggcgtggtggtgcgcacctgtaatcccagttgcttgggaggctgaggtgggagaaacacttaaacccaggaggtggaagttgcagtgagccgagatcacgccattgcactgcagcctgggcaacagggcaagactctgtctcaaaaaaaat

SEQ ID NO: 138919 - DNA, 601 bp, Human
atccatcaataggctgggcgcagtggctcacgcccataatcccagaactttgggaggccaaggtgggcagatcacttgaggtcaggagttcgagaccagcctggccaacatggtgaaacctcgtctaaaatatatacacacaaaattagctgggcgtggtggtgcgcacctgtaatcccagttgcttgggaggctgaggtgggagaaacacttaaacccaggaggtggaagttgcagtgagccgagatcacgccattgcactgcagcctgggcaacagggcaagactctgtctcaaaaaawatatatatatgtgtgtgtgtgtgtgtgtgtgtgtgtgtgtgtatacatatatccatcaatatattagtttctgcagataggagggtccagaagtgagaaggcttgtaatggtgtatagtgcatacaaattttcaggtgtttgggcaagcagagaattgagattatgttcccatcaggagccaaaatccattcattcattcacttacatattcattcagtatttattgaggacctgctatgcatccgcccggaataaagaatatccagtgtgtgactgtgccatggctttctacatggtcc

SEQ ID NO: 138920 - DNA, 601 bp, Human
tatgcatccgcccggaataaagaatatccagtgtgtgactgtgccatggctttctacatggtccagcccagctttctgggaagcatccacgaaggatgaattctttccttgggcaccttcagggcagcctctgctctgtgtgtgtcagtgcaagctttggggaggaagtgtcccagggagcagagaacttggtctctgaggcaccgacagcagctgttcaggagagagacctcagcgtgccaggcacatggttgcttctgcctctcagcatcccaagtctccaccagacagttacaaaccraggtctagagaggttcagtaaattgcctcaaagctgcacagccaatatacagcaagtgtgggaggggaatgcacacgcacctaactccagataaatatactaatggctaacgtgatttagcacttactacgtgccaggcactgctttaagaaccttatatatatattctttcatttaattttcacaacaactctgggaggaagatcttgttatccccattttctggatgggataactgaagcacagagaggttgtaacttcctcagggtcacacagcagtgaagttgggatttgaactta

SEQ ID NO: 138921 - DNA, 601 bp, Human
gctttctgggaagcatccacgaaggatgaattctttccttgggcaccttcagggcagcctctgctctgtgtgtgtcagtgcaagctttggggaggaagtgtcccagggagcagagaacttggtctctgaggcaccgacagcagctgttcaggagagagacctcagcgtgccaggcacatggttgcttctgcctctcagcatcccaagtctccaccagacagttacaaaccgaggtctagagaggttcagtaaattgcctcaaagctgcacagccaatatacagcaagtgtgggaggggaaygcacacgcacctaactccagataaatatactaatggctaacgtgatttagcacttactacgtgccaggcactgctttaagaaccttatatatatattctttcatttaattttcacaacaactctgggaggaagatcttgttatccccattttctggatgggataactgaagcacagagaggttgtaacttcctcagggtcacacagcagtgaagttgggatttgaacttaggcagcctgccgccagggtccagctcttcctcagtggggtgctgtatttttttttggtttgttgttgttg

SEQ ID NO: 138922 - DNA, 601 bp, Human
cgcacctaactccagataaatatactaatggctaacgtgatttagcacttactacgtgccaggcactgctttaagaaccttatatatatattctttcatttaattttcacaacaactctgggaggaagatcttgttatccccattttctggatgggataactgaagcacagagaggttgtaacttcctcagggtcacacagcagtgaagttgggatttgaacttaggcagcctgccgccagggtccagctcttcctcagtggggtgctgtatttttttttggtttgttgttgttgttggctttttttttttttttagatgaagcctcgctctgtcgcccaggctggagtgcagtggcgcaatctcggctctccgcctcccaggttcaagcgattctcttgcctcaggctcctgagtagctgggagtacaggcacatgccaccaagcccggctaatttttgtatttttagtagtgacggggtttcaccatggtggccaggctggtcttgaactcctgccttcaagtgatctgcccgcctccgcctcccaaagtgctgggattgcagagccacacctggccgttattgttgttttgagacagg

SEQ ID NO: 138923 - DNA, 601 bp, Human
actgaagcacagagaggttgtaacttcctcagggtcacacagcagtgaagttgggatttgaacttaggcagcctgccgccagggtccagctcttcctcagtggggtgctgtatttttttttggtttgttgttgttgttggctttttttttttttttagatgaagcctcgctctgtcgcccaggctggagtgcagtggcgcaatctcggctctccgcctcccaggttcaagcgattctcttgcctcaggctcctgagtagctgggagtacaggcacatgccaccaagcccggctaatttttstatttttagtagtgacggggtttcaccatggtggccaggctggtcttgaactcctgccttcaagtgatctgcccgcctccgcctcccaaagtgctgggattgcagagccacacctggccgttattgttgttttgagacagggtctgaacctgtcacccaggctggagtgcagtggcacaattgtggctcactgtgaccttcatctcccgggctcaagtgatcctcccacttcagcctcctgagttgctgggactacaggtgcgtgccaccatgcccggctaatgttttaattttttgtaa

SEQ ID NO: 138924 - DNA, 601 bp, Human
ctcggctctccgcctcccaggttcaagcgattctcttgcctcaggctcctgagtagctgggagtacaggcacatgccaccaagcccggctaatttttgtatttttagtagtgacggggtttcaccatggtggccaggctggtcttgaactcctgccttcaagtgatctgcccgcctccgcctcccaaagtgctgggattgcagagccacacctggccgttattgttgttttgagacagggtctgaacctgtcacccaggctggagtgcagtggcacaattgtggctcactgtgaccttcayctcccgggctcaagtgatcctcccacttcagcctcctgagttgctgggactacaggtgcgtgccaccatgcccggctaatgttttaattttttgtaaaggtgggggttttgccatgttgtccaggctggtcccaaactcctggcctgaagcgatccacccgcctcagcctcccaaagtgctgggattacaggcgtgagccacggtgcttagccagtacgccaccttttgtgggctggcctgttctgaccaacttggtagcaaaaaggttccttctggagaggagagcgctgttggaagaa

SEQ ID NO: 138925 - DNA, 601 bp, Human
cagaaggacaaagaaatgagacatttttcacagtgtttacaatagaggaaaatcgcaagagacctaaatatcccacaagaggggaagggctgtgaggccgttttggcatccccactaggggaagtgatgcagccgctcacactaacgtgaggaagaagataggaaacagagcagagggtttaggatggagcttgagggaccatcgttcactgtgtgtcgctcacagcgggaagcagtctacctgcaccatcacattgacttcgcttcataaaatggtgaggtcatggcagtcaccaacgcratagctgatgttacttgaccactaactgggtgccaggtattgtcgaggcactttaggtgttgctgttcccacttacagtggggacactgagtctcacagagctcacagagctggcatggaaagccagaaccagaatgcagctatttccaggaaagcgggatatggttgggcaggttgtccactgcataactgcaggggacaccagtcacactggagtctgtgggaatggcacccctgaagttgtacagtgcacagcctgtgcaaccatacgcagcatccctgggtgtgtctgatcacaat

SEQ ID NO: 138926 - DNA, 601 bp, Human
gaaaatcgcaagagacctaaatatcccacaagaggggaagggctgtgaggccgttttggcatccccactaggggaagtgatgcagccgctcacactaacgtgaggaagaagataggaaacagagcagagggtttaggatggagcttgagggaccatcgttcactgtgtgtcgctcacagcgggaagcagtctacctgcaccatcacattgacttcgcttcataaaatggtgaggtcatggcagtcaccaacgcgatagctgatgttacttgaccactaactgggtgccaggtattgtcgasgcactttaggtgttgctgttcccacttacagtggggacactgagtctcacagagctcacagagctggcatggaaagccagaaccagaatgcagctatttccaggaaagcgggatatggttgggcaggttgtccactgcataactgcaggggacaccagtcacactggagtctgtgggaatggcacccctgaagttgtacagtgcacagcctgtgcaaccatacgcagcatccctgggtgtgtctgatcacaatcctaggctcttaatccatgccccatccaaaacagaaaatgatattca

SEQ ID NO: 138927 - DNA, 601 bp, Human
tgaggccgttttggcatccccactaggggaagtgatgcagccgctcacactaacgtgaggaagaagataggaaacagagcagagggtttaggatggagcttgagggaccatcgttcactgtgtgtcgctcacagcgggaagcagtctacctgcaccatcacattgacttcgcttcataaaatggtgaggtcatggcagtcaccaacgcgatagctgatgttacttgaccactaactgggtgccaggtattgtcgaggcactttaggtgttgctgttcccacttacagtggggacactgagyctcacagagctcacagagctggcatggaaagccagaaccagaatgcagctatttccaggaaagcgggatatggttgggcaggttgtccactgcataactgcaggggacaccagtcacactggagtctgtgggaatggcacccctgaagttgtacagtgcacagcctgtgcaaccatacgcagcatccctgggtgtgtctgatcacaatcctaggctcttaatccatgccccatccaaaacagaaaatgatattcatgcacactgtaaatggagtcatgtgatagctagatacatgtggac

SEQ ID NO: 138928 - DNA, 601 bp, Human
agaccagcctggccaacatggtgaaaccccatccatactaaaaatacaaaaaaattagtcaggcctgatgccgggtgcctgtaatgccagctactcaggaggctgaggcaggagaatcgcttgaacccgggaggcagaggctgccctgagccaggatcgcaccactgcactccagcctgggcgacagagtgaaactccgtctcaaaactttctacaactgccaggcgcggtggctcacacctgtaatcccagcactttgggaggctgaggcgggtggatcacgaggtcaggagatcgagamcatcctggctaacacggtgaaaccctgtctctactaaaaatacaaaagcattagctgggcatggtggtgggcgcctgtagtcccagctactcgggaggctgaggcaggagaatggcgtgaacccgggaggcggagcttgcaatgagcagagatcgcgctactgcactccagcctgggcgacagagcgagactccgtctcaaaaaaaaaaaaaaaactttctagaactctctgtgatgatgaaaatgtttcctatctgtgctgtccaatgtggcggccactggccatgtgtggatattgag

SEQ ID NO: 138929 - DNA, 601 bp, Human
agattcccagctggacccttgagatgggagtgtctggctttaacaagcttcccggggaattcccaggcaaattgtcagtggactcccttttaagaaatgcggaagatgtggtgccagcctcttcacgtggcaaagtgtggcaaggggggcggggcagctcccagagctgtggctgaaatcaccagaacagctgccctcagaggctagcaagggggtcgttgaggaatagagtcctgtgtgctgcccttcaaagtgtaaacacagcatgtcgtggggaccacagggaggtggactaggaccyactgtaatggagaattttctagagccagggttggctgttgtgtgaggatgtgattggaaacatgctggagatgtcgaagatggccccgtgcccagactctgagcatgcaccccactggtgaggctgtcctgggtggggcacagcagctggtgggtacctggtggaggctgagacatagcaggggagccaggtgggtgggtgtgggccgagcattccgacttgttcgggtagagaggggtggccaattaagccgcaggagtctgaacggtctctgcgcctggccaccagcacttgccctgg

SEQ ID NO: 138930 - DNA, 601 bp, Human
gtgtaaacacagcatgtcgtggggaccacagggaggtggactaggacctactgtaatggagaattttctagagccagggttggctgttgtgtgaggatgtgattggaaacatgctggagatgtcgaagatggccccgtgcccagactctgagcatgcaccccactggtgaggctgtcctgggtggggcacagcagctggtgggtacctggtggaggctgagacatagcaggggagccaggtgggtgggtgtgggccgagcattccgacttgttcgggtagagaggggtggccaattaagcygcaggagtctgaacggtctctgcgcctggccaccagcacttgccctggcttccctgcaggtcctggctgcagactatgagcagcccaggagctcttaaatggggaagagctcatttcccacatgggacccttagcagcaacttcgcctggtctggaaatggttaacttttccaagggcagctttcatccagataccagccactttggggacagagtctggacataaatcacccctgatcactggcagtggtacctgggtttggtactttacctctctgaatctcattgcccctgactgtg

SEQ ID NO: 138931 - DNA, 601 bp, Human
gagccagggttggctgttgtgtgaggatgtgattggaaacatgctggagatgtcgaagatggccccgtgcccagactctgagcatgcaccccactggtgaggctgtcctgggtggggcacagcagctggtgggtacctggtggaggctgagacatagcaggggagccaggtgggtgggtgtgggccgagcattccgacttgttcgggtagagaggggtggccaattaagccgcaggagtctgaacggtctctgcgcctggccaccagcacttgccctggcttccctgcaggtcctggctgyagactatgagcagcccaggagctcttaaatggggaagagctcatttcccacatgggacccttagcagcaacttcgcctggtctggaaatggttaacttttccaagggcagctttcatccagataccagccactttggggacagagtctggacataaatcacccctgatcactggcagtggtacctgggtttggtactttacctctctgaatctcattgcccctgactgtgaacagggcttaataacagtaccctctgcattgtacgacgcagggctccataacccagtgccaggcgcata

SEQ ID NO: 138932 - DNA, 601 bp, Human
gggccgagcattccgacttgttcgggtagagaggggtggccaattaagccgcaggagtctgaacggtctctgcgcctggccaccagcacttgccctggcttccctgcaggtcctggctgcagactatgagcagcccaggagctcttaaatggggaagagctcatttcccacatgggacccttagcagcaacttcgcctggtctggaaatggttaacttttccaagggcagctttcatccagataccagccactttggggacagagtctggacataaatcacccctgatcactggcagtggkacctgggtttggtactttacctctctgaatctcattgcccctgactgtgaacagggcttaataacagtaccctctgcattgtacgacgcagggctccataacccagtgccaggcgcataataaagtgggttaaatggaaaccaaaaaagaaaaaaaattaagggtgtggaagaagtccttctcgcctcaccacagtcccatgctgcggtgaggggcgcggcagaaacactcaggacgccattggagctttgccgagcaaggctcagactcacattttccagcactgcccggaactcacaa

SEQ ID NO: 138933 - DNA, 601 bp, Human
ggttaacttttccaagggcagctttcatccagataccagccactttggggacagagtctggacataaatcacccctgatcactggcagtggtacctgggtttggtactttacctctctgaatctcattgcccctgactgtgaacagggcttaataacagtaccctctgcattgtacgacgcagggctccataacccagtgccaggcgcataataaagtgggttaaatggaaaccaaaaaagaaaaaaaattaagggtgtggaagaagtccttctcgcctcaccacagtcccatgctgcggygaggggcgcggcagaaacactcaggacgccattggagctttgccgagcaaggctcagactcacattttccagcactgcccggaactcacaaatgggtcatagaaacctccagcgatgtttaaagttgagcctctctgggaatgcagcactgcccagagccaggggcacggcaggtcccgtcagcctcgcaggcactgcccttgtctgggctgctcgccatgaagggctggccaggggaccccaagagggggcagaggggcaggttcttccaggacagagagaactgactttccatggagc

SEQ ID NO: 138934 - DNA, 601 bp, Human
agccctgggccacgccatcctcactgagccacctgagagggagggagagatactgttttgtcccaatacagatggtgaaaccaagaatccaagaggagagacctcttgtctgaggacacacgggggcaatttttctcattctcagatgctcagggcaggcaggcgtttgctatctgggtgggctgctggtagcccccctaacccaattgctgggttgggaatattctctcctgcatcctcccaggaaacccgggaacagagatgggagcaggaaggaagcgcatgtgtgtctgcaggcagyacatctcagcagacagaacttggggttccactgccttgctgtgagtgcgtggccgagtcactgcccctccaggcctcagttttcctatcagcaaaatgaggggtcttgacagatgacctctaaagtcccttcagaccctgagtcctcgagacgacaagaatgacaggtttgagaccgcagagctgtttgcaggtttgttgcaaaaccaagccacacgaagtcaacatctttgtgcctgggccccagccctcaccccaagttcccaactggctctgggctttaggaggcccaggagctctt

SEQ ID NO: 138935 - DNA, 601 bp, Human
gcaaaaccaagccacacgaagtcaacatctttgtgcctgggccccagccctcaccccaagttcccaactggctctgggctttaggaggcccaggagctcttaaatgggagagaaaaacccaccttgggccctgagcagaaaacttcatcgtggtctggaaacagttaacgagggcagctttcctcccgataccagcgccttattaaaatgtaggctttacaataaacctggcatttggccatcaaccttagattaaaaccagacgggacagacatgaacccctctcttagaccaaatttckagcagagggctgctccccttcctcctgggtgactccctgcctcccacccaccccgcaccccattccaacaggtgcccccctctctagagcttagttttggggtctcaggaatagagagactgagctggacttgggacccccagctcctagtgcagagggaggtagtcaggcaccaaaacgcaggggctgagggatatgaggggaggctcctgctagggccacgctggggagccagggcctcagagccactcggctgcatctggccttggcccccctggccctttgattgcctgtgaacag

SEQ ID NO: 138936 - DNA, 601 bp, Human
aaacccaccttgggccctgagcagaaaacttcatcgtggtctggaaacagttaacgagggcagctttcctcccgataccagcgccttattaaaatgtaggctttacaataaacctggcatttggccatcaaccttagattaaaaccagacgggacagacatgaacccctctcttagaccaaatttcgagcagagggctgctccccttcctcctgggtgactccctgcctcccacccaccccgcaccccattccaacaggtgcccccctctctagagcttagttttggggtctcaggaatagagagactgagctggacttgggacccccagctcctagtgcagagggaggtagtcaggcaccaaaacgcaggggctgagggatatgaggggaggctcctgctagggccacgctggggagccagggcctcagagccactcggctgcatctggccttggcccccctggccctttgattgcctgtgaacaggaggcaaatggagttcagtggcttgatcctggcccacggcaacctccgcctcccgggttcaagcaattctcctgcctcagcctcccgggtagctgggattacaggcaggtgcca

SEQ ID NO: 138937 - DNA, 601 bp, Human
ctccccgctaccgttagcctgctgctgtgaccgcgccgcatggggacattctgtgcgagagccactccctggctgggcacggtggctcatgcctgtaatcccagcactttgggaggccgaggcaggtggatcgcctgaggtcaggagttcaagagccactcctgctggctctctcactgagggttccccaaagaccctaacccagaggcccctgacctcttggggcctccccggcaccccagcccacctcactcctcaccccctgtcacctcactacctgtggcacccccagagactcagkagatatcctttgcttgccattctctccaatctcaatgcttctcttgacaccacctcctttttctgtgtgtttttaggaataattttatttcgtatatttcacatactgtacaatcacccatttaaagtgcacagtccagggccggatgtggtggctcacacctataatcccagtgctttgggaggccaaggtaggaggatcacttgaggccatgagtttgagaccaggctggacaacatagtgagactcccatctctacacaaaaatttttttttcccaggcgcggtggctcacacctgt

SEQ ID NO: 138938 - DNA, 601 bp, Human
ctgtggcacccccagagactcaggagatatcctttgcttgccattctctccaatctcaatgcttctcttgacaccacctcctttttctgtgtgtttttaggaataattttatttcgtatatttcacatactgtacaatcacccatttaaagtgcacagtccagggccggatgtggtggctcacacctataatcccagtgctttgggaggccaaggtaggaggatcacttgaggccatgagtttgagaccaggctggacaacatagtgagactcccatctctacacaaaaatttttttttcgcaggcgcggtggctcacacctgtaatcccagcactttgggagaccgaggggggcagatcatttgaggtcaggagcaacccggtaaaaccctgtctctaccaaaaatacaaaagttaacagacgtggtggcatgcgcctgtaatcccagctactcgggaggctgaggcaagagaatcgcttgaacctgggaggcggaggttgcagtgggccaagttcacgccactgcactccagcctgggcgacagagtgaaactccatctcaaaaaaaaaaaaataattatttgagcatggtggcgcatg

SEQ ID NO: 138939 - DNA, 601 bp, Human
ataatgctgctatggccgggcgcggtggctcacacgtgtaatcccagtactttgggaggccaaggctggtctggtgggtcacctgaggtcaggagttcgagaccagcctggccaacatggtgaaaccccgtctctactaaaaatacaaaaattaacccggtacggtgatgtgcgcctgtagtcccagctaccagggaggctgaggcaggagaattgcttgaacccaggaggaggaggttgcagtgagccgagatcgtgccactgcactccagcctgggtgacagagggagactgtgtctcaaaaaaaaaaaaaaatgctgctatggacatatgtcattgtgtacaggtttttgtgtggacacatgtttcatttctcctgcgtctgtacctaagagtggaattgctgggtcagatggtaagtctatgtttcaccttgtgagcaactcccagactgttttccacagcagctgtaccttgcattcccaccagcagtgtatgagggttctagtttctccacttcctggccagcacttggtgttatcaggccacctgccctggctcagcctactggagtctcgctctgttgcccaggctagagtgc

SEQ ID NO: 138940 - DNA, 601 bp, Human
acacgtgtaatcccagtactttgggaggccaaggctggtctggtgggtcacctgaggtcaggagttcgagaccagcctggccaacatggtgaaaccccgtctctactaaaaatacaaaaattaacccggtacggtgatgtgcgcctgtagtcccagctaccagggaggctgaggcaggagaattgcttgaacccaggaggaggaggttgcagtgagccgagatcgtgccactgcactccagcctgggtgacagagggagactgtgtctcaaaaaaaaaaaaaaatgctgctatggacataygtcattgtgtacaggtttttgtgtggacacatgtttcatttctcctgcgtctgtacctaagagtggaattgctgggtcagatggtaagtctatgtttcaccttgtgagcaactcccagactgttttccacagcagctgtaccttgcattcccaccagcagtgtatgagggttctagtttctccacttcctggccagcacttggtgttatcaggccacctgccctggctcagcctactggagtctcgctctgttgcccaggctagagtgcagtgcgtgatctcggctcactgcaacctcca

SEQ ID NO: 138941 - DNA, 601 bp, Human
tgcagccccaagaatgtttctgttgccttcagcctccctcctttttgttgatccatacactgttaagccaccagggagacccccagaatcccagcaccacgaggatcttggggctggcttcccatgccgaggtgactcaggcagcagtgtggggaagtggctaagaccccggactgtgtgctgctctctgagttccaatcccagctctggtctttcctggtcatgtggcatcagtatgtcatttaactctctgttcctcagtttcctcctacgtaaaatggaactaggagccagccgtgtkgggttgttatgagggttaaatgaggtagatcctgttattcccatttttcaggtgagattctcttttttttttttttttttttttttgagacagagtcttgcttcgttgcccaggctggagtgcagtgacatgatctcggctcactgcaacctccacctcccgggtttaagcaattctcatgccccagcctcccaagtagctgggattataggtgcacaccaccacacccagttaatttttttgtacttttagtagagaccggggtttcaccatgttggccgggctggtctcaaactcctg

SEQ ID NO: 138942 - DNA, 601 bp, Human
gccccagcctcccaagtagctgggattataggtgcacaccaccacacccagttaatttttttgtacttttagtagagaccggggtttcaccatgttggccgggctggtctcaaactcctgacctcaggcattccactcgcctcggcctcccaaagtgctgggattacaggcatgagccacggcgcccggcctcaggtgagattcttgaggctgggagcggttaaaggttcacccacggcactctgctagtgaggcggaccggcctgagagccagacccggaccggccacctccttaaccastaggcggtactgccttccattccttactgggggaggtgagaatcctccctcaagcctccctcagggccacttgtgtccttgctgatgatgccaggcagtggctaaggatgtggtttcagagttcctgtctgagcccttctcccaggggcccttcaaaggaacccaaatctctaccaagaaatctcagggggaaaccgaagcctccacggcctctccaccctaccccacctccacttcttgcctaagacgttccaggctgtaaatatttctccagctccgaggctcctctgagaaggccca

SEQ ID NO: 138943 - DNA, 601 bp, Human
accatgttggccgggctggtctcaaactcctgacctcaggcattccactcgcctcggcctcccaaagtgctgggattacaggcatgagccacggcgcccggcctcaggtgagattcttgaggctgggagcggttaaaggttcacccacggcactctgctagtgaggcggaccggcctgagagccagacccggaccggccacctccttaaccagtaggcggtactgccttccattccttactgggggaggtgagaatcctccctcaagcctccctcagggccacttgtgtccttgctgatgmtgccaggcagtggctaaggatgtggtttcagagttcctgtctgagcccttctcccaggggcccttcaaaggaacccaaatctctaccaagaaatctcagggggaaaccgaagcctccacggcctctccaccctaccccacctccacttcttgcctaagacgttccaggctgtaaatatttctccagctccgaggctcctctgagaaggcccagtgttaatttgttaaatccacatcgaggtcccaaggacccgttgtttgtttttgcgatcctgttggcagagatcacgttgggggtggt

SEQ ID NO: 138944 - DNA, 601 bp, Human
aatcctccctcaagcctccctcagggccacttgtgtccttgctgatgatgccaggcagtggctaaggatgtggtttcagagttcctgtctgagcccttctcccaggggcccttcaaaggaacccaaatctctaccaagaaatctcagggggaaaccgaagcctccacggcctctccaccctaccccacctccacttcttgcctaagacgttccaggctgtaaatatttctccagctccgaggctcctctgagaaggcccagtgttaatttgttaaatccacatcgaggtcccaaggacccrttgtttgtttttgcgatcctgttggcagagatcacgttgggggtggtgaggagggctgcttatttgctcagaataaatgctaattaataaaagttatttatttgggttggagctcacctcagcccgggggtcaggcgcaaactgactatttgaagcaaaaacaaatagagtgtgtctctcaacagcttgagaaaggcaggaacgaagaggctgagtttatttgtcttaggaagaatctgcagttaattccctccagactatttagacccttaaattacacggaataagaaaaaccatagg

SEQ ID NO: 138945 - DNA, 601 bp, Human
tttaaatgcctttggcccccagtcagccaactaaatggtacgtgtgaaataatttaatggcagaaaaccgtgcaccagtcattttttcactgtaatgtaatcggggacgatgtcgttttggttttaaggaggagacagcgcgagacaggcctcccccatctgagctcgtttctctcctctgggatccaggccccctacaaaagcagctaaacagcctggtcaaagggaggcggtttcatgctttgtttcagtctcagggaaaagcagaacttttcctgaacaaaaagagactctgggcacrgccctccttggagagtgcagacgcagggtttgctgaccggaggagagggcccccgtgaaaaggcagggacctgacgccagtggcctgaggcttagagagtatttattttattgatttcctaaatgctttaagcccaagcacggagtccccagaggaacacacacgcccaccacaatgcatttctcaggaggtgattcaggaacttagggcaacaaatatccggcacatccgctcggaggcggaggcgagcgccagagcccccggctaagtccagagctgtgggttcgagttctggtccgc

SEQ ID NO: 138946 - DNA, 601 bp, Human
gtgctatcccacaccctcccaggggtgagggcttcctttaggacgaagaggtgacgtgaggctggaggcctcccaccatggcatctcctgaccccgcccacccatgggatcagagagctgggactgagcgtgtgacaggccccctacgctgctgagcctgggagcgaggtagaagagggaggaggccccgtgaagaggggttcgcagccttggcttggccaggcctcccagcagacatcgatttcttccttttttttctttcttttttttttttagacggaatttcactcttgttgcccaractggagtgcaatggcgtgatctcagctcactgcaacctccgcctgccgggttcaagtgattctcctgcctcggcctcctgagtagctggaattacaggtgcccgccaccatgcctggctaatttatttatttatttatttatttttagtagagatggggtttcaccatgttggccaggctagtcttgatctcctgacctcaggtgttccgcctgcctcgacctcccaaagtgctgggattataggcatgagccactgcacctggccaacagacatcgatttcaatcccagatgtacgac

SEQ ID NO: 138947 - DNA, 601 bp, Human
aagcatggtggctcgtgcctgtaatcccagtactttgggaggctgaggcaggagaattgaggtcaggagtttaagaccagtcttggcaacatagtaagacctcatctctacattaaaataaaaatcagctgggcatggtggcaggcacctgtagtcccagctacttgggaggctgaggtgggggaattgcttgagcccaggaggtcgaggctgcagtgtgttacgattgcgccactgcactccagcttgggcaacagagtgagaccctgtctcaaaaaataaaaaagatatttagcagcaytcctggcctctttaccattagatcctagtagcaccccttccccagtcctaacgatcaaaaatgtctcacaggggcaaaattgccctcggttgagaagcagtggtccaaacccagcttcagggacatctttctcacacacacacacacacacacacacacacacacacacacactcatttacagtctcatggagcaatttaaccttacatcaaatcagttggttgctcaagagtcagtaaaccctcctaacctgggaactgattaaaagcagatattcagcagtacccatcactgggcctg

SEQ ID NO: 138948 - DNA, 601 bp, Human
agcccaggaggtcgaggctgcagtgtgttacgattgcgccactgcactccagcttgggcaacagagtgagaccctgtctcaaaaaataaaaaagatatttagcagcactcctggcctctttaccattagatcctagtagcaccccttccccagtcctaacgatcaaaaatgtctcacaggggcaaaattgccctcggttgagaagcagtggtccaaacccagcttcagggacatctttctcacacacacacacacacacacacacacacacacacacacactcatttacagtctcatggarcaatttaaccttacatcaaatcagttggttgctcaagagtcagtaaaccctcctaacctgggaactgattaaaagcagatattcagcagtacccatcactgggcctggcatgttctagaagctcagtaacagttcactgaacaaatgcccagtactgtgcaaagaacatcgggtgtaaaatgggaacatgtaactggggaaacaaaaatacaaggtatggactaaaatccaaagctcttctgttggccaaactgtaggcaaaacacgtcgccccaaacccggccggtgggaatgcaaaat

SEQ ID NO: 138949 - DNA, 601 bp, Human
gctttctttctttttttttttttttttgagacaagagtctcactctgtcgcccaggctggagtgcagtggtacggtaccggctcatagcaacctccaccccacaggttcaagtgattctcctgcctcagcctccagagtagctgggattacaggcatgcaccaccacacttggctaatttttgtatttttagtagagactgggttttgccatgttgcccaggctggtcttgaactcctgacctcaggtgatccacctgcctcggcctcccaaagtgctgggattacaggcatgagccaccrtgcctggccgctatgctttcttttgatagaagaaagggagaaaatattacacatattttgttatatttgcaaaaagcaatgctggagggataaaggaagaactaactcttaaaatggttcctgaaggtaggggagagggaacaagagggaaaatacattttggaaaaacaatcgcaataaagatggttaggtttgtttcactaagatggaaaggtatccagaatattattaaataaaaagaggtaagttgaagccccagtgtgtgcttgtcaatttttaattttatttttaaattttatt

SEQ ID NO: 138950 - DNA, 312 bp, Human
atttttaaattttatttatttatttatttatttttgagacagagtattgctctgtcacccaggctggagtgcagtggcataatcttggctcactgcaacctcagcctcctgggtttaagcgattcttgtgcctcagcctctggagtaactgggattccagacacttgtgaccatgcctggctaatttcttttgtctttgtctttgttttgttttgtttttagtagagatggggtttcaccatattgcccaggctggtgtcaaaatcctggcctcaagtaatccacctgcctcagcgtcccraagtgatggga

SEQ ID NO: 138951 - DNA, 601 bp, Human
agcatcctcccgtgccctggcccacacctgccctgacccaccccacggccccaccaaagcttattcggggcctgcctcccctgccgatggatccctctggttcgtctctccccggcccccagtacagcctctggcctagtaggccctctggaaaggaaggctgctctcaacagctgcctgattggctaaaaaggagaagatgaggactctcgtacccgattggtgggttcagatccttccaccaacaatgactccactgggaccttgaacttgggcccgagaccatagcctctctgactcytcctccttaggaatgatgaggatcacgacatctgtctttagggctcctgggagcttcctagaatctgtgggtcctgagccttgactcccactgctctttatgacatattaattattattattattacatgtcagcaacaggtgtccatgcagaatgtgccatgccccacagcctgggccgggtgctggggacactcaggtgtctcctgagccctccttgagcaggtcacttgtccctggtggaagggacacctgtccccagggctcttgccgtggtcccatctcagttggctcagactgg

SEQ ID NO: 138952 - DNA, 601 bp, Human; identical to SEQ ID NO: 38249

SEQ ID NO: 138953 - DNA, 601 bp, Human; identical to SEQ ID NO: 38250

SEQ ID NO: 138954 - DNA, 601 bp, Human; identical to SEQ ID NO: 38251

SEQ ID NO: 138955 - DNA, 601 bp, Human; identical to SEQ ID NO: 38252

SEQ ID NO: 138956 - DNA, 601 bp, Human; identical to SEQ ID NO: 38253

SEQ ID NO: 138957 - DNA, 601 bp, Human; identical to SEQ ID NO: 38254

SEQ ID NO: 138958 - DNA, 601 bp, Human; identical to SEQ ID NO: 38255

SEQ ID NO: 138959 - DNA, 601 bp, Human; identical to SEQ ID NO: 38256

SEQ ID NO: 138960 - DNA, 601 bp, Human; identical to SEQ ID NO: 40105

SEQ ID NO: 138961 - DNA, 601 bp, Human; identical to SEQ ID NO: 40106

SEQ ID NO: 138962 - DNA, 601 bp, Human; identical to SEQ ID NO: 40107

SEQ ID NO: 138963 - DNA, 601 bp, Human; identical to SEQ ID NO: 40108

SEQ ID NO: 138964 - DNA, 601 bp, Human; identical to SEQ ID NO: 40109

SEQ ID NO: 138965 - DNA, 601 bp, Human; identical to SEQ ID NO: 40110

SEQ ID NO: 138966 - DNA, 601 bp, Human; identical to SEQ ID NO: 40111

SEQ ID NO: 138967 - DNA, 601 bp, Human; identical to SEQ ID NO: 40112

SEQ ID NO: 138968 - DNA, 601 bp, Human; identical to SEQ ID NO: 40113

SEQ ID NO: 138969 - DNA, 601 bp, Human; identical to SEQ ID NO: 40114

SEQ ID NO: 138970 - DNA, 601 bp, Human; identical to SEQ ID NO: 40115

SEQ ID NO: 138971 - DNA, 601 bp, Human; identical to SEQ ID NO: 40116

SEQ ID NO: 138972 - DNA, 601 bp, Human; identical to SEQ ID NO: 40117

SEQ ID NO: 138973 - DNA, 601 bp, Human; identical to SEQ ID NO: 40118

SEQ ID NO: 138974 - DNA, 601 bp, Human; identical to SEQ ID NO: 40119

SEQ ID NO: 138975 - DNA, 601 bp, Human; identical to SEQ ID NO: 40120

SEQ ID NO: 138976 - DNA, 601 bp, Human; identical to SEQ ID NO: 40121

SEQ ID NO: 138977 - DNA, 601 bp, Human; identical to SEQ ID NO: 40122

SEQ ID NO: 138978 - DNA, 601 bp, Human; identical to SEQ ID NO: 40123

SEQ ID NO: 138979 - DNA, 448 bp, Human
gggaagaagctgaccttcgagtacagagtctccgaggtaggcccaaggaggagctgctgcagcagcctttccaaaaatagctccagagtcactgggtgcggtggctcacctctgtaatctcagcaccttgggaggccgaggcaggcggctcacgaggtcaggagatcgagaccatcctggccaacatgtgaaaccccatctctagtaaaaatacaaaaaattagccgggtgtggtgacgggcgcctgtagtcccagctactcaggaggctgaggcaggagaatggtgtgaacccaggaggyagagcttgcagtgagctgagatcgcgccactgcactccagcctgggcgacagagcgagactctgtctcaaaaaaaaaaaatagctccagagtccttgtgggctcagtgcccaccacggggccagagcagaaaataagatcgcccaaa

SEQ ID NO: 138980 - DNA, 601 bp, Human
cacatgcattttttttttgcgtttgggttcacactgcctggtgggtgctttttggacgttgtttcagagatagttttgtttgtgtagagagggcaagagctgaggggaggcagatactgattggcaggtgtggccttactggctgtttgcttttgctggatgctgtctcccagggctaggacctaggcctccaggagcctcttgggttcatgtcccaccttgagtctcttatctcagacaccagggcctgaagggcctccctttactttggcctacccagctctctagccacagccttggrcctgttgggtaagatgtagccctgccctggcccagtttttccacctgccccaagattaacactgtgtgcctcaccctcatacccggcccctggcagagctgcctattgctgggcctgtctggctattaggtgacctaggtcctgttctgtccacttcaggagaaccaggcctgtgcttctggtagacagccttcccttgggagccaggcccattagtggctttttgggttccttttgggctcactcagtcctttgggactgaggctctgggtgcaggatggctggggaaagagggggttc

SEQ ID NO: 138981 - DNA, 601 bp, Human
gaatctggggctgactagtgcttcctggggccaagatgactgtgccatccattgtaagcccccgtttctgcatgggttaggtctggcctgtgcttatcagccattcctggtttttcacaaagccaggctctggcagcgctctcacatttcagcaaggcagctttatgccatcctagccctctgccttagccaggtgtaaagggaaatttatcctcttacaggctactttttctgtcctcccatgccccaagcctagataaaggggagataagagagagcagcactcagggccggtttcacrtatgcagctgggggcatggccagcctgtttcattagcttaagcctgcctctccccaggtacatacatagctcttggctgagtctttgcacatggcaggcctggtctgccttgccctcccaggcgcaacttctcatgtgggcatcaccctgctagttcctacccagtgccaggatttcctgtaagtttcttatgccgtttgtttccatagacacaggcaagatccacttcctggcagggactcttttctcaggactgaatggctgcagatagcctccgcgttgtattttccaccggccctg

SEQ ID NO: 138982 - DNA, 601 bp, Human
aggccaggcacggtggctcacgcttgtaatcccagaactttgggaggccgatgcaggtgcatcacttgaggtcgggagtttgagaccagcctgactaacatggagaaaccccatctctactagaagtacaaaaattagctgggcgtggtggtgtgcgcctttagtcccagctacttgggaggctgaggcaggagaatcgcttgaacctgggaggcaaaggttgcagtgagccgagattgcaccactgcactccagcctgggcaacaagagcgaaactctgtctcaaaaaaaaaaaaaaaaagtttagtgtatttctgggtggcaggattactggtcattttcattttcttctgtttatatttctattttttatgatgagtaggtattgcatactgaacaaaaggcttccataaagtctttttaaaaagatgtcagggctggagttagcttctctatagcagcagcccatgggtaggctgcctacagaaaccaggtgctaaagccaccccgtccctgtcccatcagcctagtgtgcttccctctctggaaagcctatcatgctctcctgaccctccttcatattcagaacagtggggaagaa

SEQ ID NO: 138983 - DNA, 601 bp, Human
ggcaggattactggtcattttcattttcttctgtttatatttctattttttatgatgagtaggtattgcatactgaacaaaaggcttccataaagtctttttaaaaagatgtcagggctggagttagcttctctatagcagcagcccatgggtaggctgcctacagaaaccaggtgctaaagccaccccgtccctgtcccatcagcctagtgtgcttccctctctggaaagcctatcatgctctcctgaccctccttcatattcagaacagtggggaagaaagagggatgggggagagttsccagtaggggccatgccaaggggtcattgtctggcagcagtggacttccctctgtggctaagcgggagccacttgctctgtagcttggacccctctattttgcctccacaggccattgagaaactagtcgctcttctcaacacgctggacaggtggattgatgagactcctccagtggaccagccctctcggtttgggaataaggcatacaggacctggtatgccaaacttgatgaggtgaggctgccacaggacaggccagggactgggctggcagtgagggtggttctggcaccagtt

SEQ ID NO: 138984 - DNA, 601 bp, Human; identical to SEQ ID NO: 40124

SEQ ID NO: 138985 - DNA, 601 bp, Human; identical to SEQ ID NO: 40125

SEQ ID NO: 138986 - DNA, 601 bp, Human; identical to SEQ ID NO: 40126

SEQ ID NO: 138987 - DNA, 601 bp, Human; identical to SEQ ID NO: 40127

SEQ ID NO: 138988 - DNA, 601 bp, Human; identical to SEQ ID NO: 40128

SEQ ID NO: 138989 - DNA, 601 bp, Human; identical to SEQ ID NO: 40129

SEQ ID NO: 138990 - DNA, 601 bp, Human; identical to SEQ ID NO: 40130

SEQ ID NO: 138991 - DNA, 601 bp, Human; identical to SEQ ID NO: 40131

SEQ ID NO: 138992 - DNA, 601 bp, Human; identical to SEQ ID NO: 40132

SEQ ID NO: 138993 - DNA, 601 bp, Human; identical to SEQ ID NO: 40133

SEQ ID NO: 138994 - DNA, 601 bp, Human; identical to SEQ ID NO: 40134

SEQ ID NO: 138995 - DNA, 601 bp, Human; identical to SEQ ID NO: 40135

SEQ ID NO: 138996 - DNA, 601 bp, Human; identical to SEQ ID NO: 40136

SEQ ID NO: 138997 - DNA, 601 bp, Human; identical to SEQ ID NO: 40137

SEQ ID NO: 138998 - DNA, 601 bp, Human; identical to SEQ ID NO: 40138

SEQ ID NO: 138999 - DNA, 601 bp, Human; identical to SEQ ID NO: 40139

SEQ ID NO: 139000 - DNA, 601 bp, Human; identical to SEQ ID NO: 40140

SEQ ID NO: 139001 - DNA, 601 bp, Human; identical to SEQ ID NO: 40141

SEQ ID NO: 139002 - DNA, 601 bp, Human; identical to SEQ ID NO: 40142

SEQ ID NO: 139003 - DNA, 601 bp, Human; identical to SEQ ID NO: 40143

SEQ ID NO: 139004 - DNA, 601 bp, Human; identical to SEQ ID NO: 40144

SEQ ID NO: 139005 - DNA, 601 bp, Human; identical to SEQ ID NO: 40145

SEQ ID NO: 139006 - DNA, 601 bp, Human; identical to SEQ ID NO: 40146

SEQ ID NO: 139007 - DNA, 601 bp, Human; identical to SEQ ID NO: 40147

SEQ ID NO: 139008 - DNA, 601 bp, Human; identical to SEQ ID NO: 40148

SEQ ID NO: 139009 - DNA, 601 bp, Human; identical to SEQ ID NO: 40149

SEQ ID NO: 139010 - DNA, 601 bp, Human; identical to SEQ ID NO: 40150

SEQ ID NO: 139011 - DNA, 601 bp, Human; identical to SEQ ID NO: 40151

SEQ ID NO: 139012 - DNA, 601 bp, Human; identical to SEQ ID NO: 40152

SEQ ID NO: 139013 - DNA, 601 bp, Human; identical to SEQ ID NO: 40153

SEQ ID NO: 139014 - DNA, 601 bp, Human; identical to SEQ ID NO: 40154

SEQ ID NO: 139015 - DNA, 601 bp, Human; identical to SEQ ID NO: 40155

SEQ ID NO: 139016 - DNA, 601 bp, Human; identical to SEQ ID NO: 40156

SEQ ID NO: 139017 - DNA, 601 bp, Human; identical to SEQ ID NO: 40157

SEQ ID NO: 139018 - DNA, 601 bp, Human; identical to SEQ ID NO: 40158

SEQ ID NO: 139019 - DNA, 601 bp, Human; identical to SEQ ID NO: 40159

SEQ ID NO: 139020 - DNA, 601 bp, Human; identical to SEQ ID NO: 40160

SEQ ID NO: 139021 - DNA, 601 bp, Human; identical to SEQ ID NO: 40161

SEQ ID NO: 139022 - DNA, 601 bp, Human
catgatacaggctgggtgcggtggctcacgcctgtaatcccagcactttgggaggctgaggcgggcggatcacgaggtcaggagatcgagaccatcctagctaacacgatgaaaccctgtctctactaaatatacaaaaaattagtcgggcgtggtggtgggcgcctgtagtcccaggtactcaggagactgaggcaagagaatggcgtgaacccgggaggcggagcttgcagtgagcaaagatcatgccactgcactccagcctgggagacagagcgagactccgtctcaaaaaaaaaatatatatatatatatatttatatatttatatttatatatttatatagatatttatatatttatatatatttatatatatatttatatatatatttatatattatatatattgtatttaaacattctttaaaatatttatcatttatctcaactaatagaaagtgatcttatcactttttattattcatagacagactgaaatttgttttaacttaaattcaaccaatgttttacttaattttattaatgtttttaagttactccactgtcaagcaaagcattttaaagtacactgtgatgt

SEQ ID NO: 139023 - DNA, 601 bp, Human
ttttattagtttagctttttccaaacgtgtttactcagagatacctattttagttaggaagaaaaagagaaataacaccaattaaagctaattgaggctgaattcttgtcagtcttaaaagaatcctaattgtttctctttgaactgactaatccataaaagttttctgaagggatggggtgtggttgtatttgatagcttccatttggatgatttctactaccttttttcttgtttgagaactattagaacgaacatgatcattttttcaagctggagtgcggtggcacgatctcagctyactgcaacctctgcctcccaggttcaagcgattctcctgtctcagcctcccgagtagctggaactacaggcacctgccaccacacccagctgatttttgtatgaacatgatcaattttatacacatagaacatagtaaaatgctgataattataagttgtttgtttactcattgtagctatttactgtgtgatcaactgtgaaattttgtgcaaccctctctcagaatggaaaaaaaagaggatttagtctgagtttctgagaataattttccaagtatatctggaaaggtaaattgatt

SEQ ID NO: 139024 - DNA, 601 bp, Human
ttgggttcagtaactacagttttcaccatttgtcctcagtctcctttatgcatctgcaactttaaggcatagtccatcgatctacagggtgatctcatttgaaagctatgatggcattgtcgctgagttgacagaagcaactattgtacaaattaaaaataaccataagggagaaaccagaagaattcctctgaccacttacaattaaaatattttgtcttctttaaaaaaataagtaaaggagaaatattttcctacaagagtactgaatttcaggaaatgggatagagcttctaaccartgtattccgtcaagtaagataataacagctgacctgccaacagcattacagggagattctttgctcagctaacacatttctgtttttcaaaattgatgcttaattgtagctgttattctaatttgtgacatggaactaactcatgcttcaatccttgatagagcaaaactcagaacaggttatgtaaaaatatagtctggctttagaatttgttaattcacctgctttgccacagaaaatggaggctttcacaagggtttgatcagaattaaaaccccaaacccgccctctgttaggggt

SEQ ID NO: 139025 - DNA, 601 bp, Human
acataaaccctgatgtcaaagacatcctagtcctgtcttcttgccattcctttttctcttaaggcagatacagtttagtttactagcaagaaataatttgtaccttccctactttcacatgtcagcatcccagtaaacccaggctgagccgaaattccagacacagccccagagactgctgctggctctgttcacttttcaagatcggtgcatcagcctgagctagtccctcccgggatcttgaggtgtctgtgggacacagtagacggggatggcaatacagcagggcttcaaggctctrctgttacaggctgggtctacttctcaggaagaattcagagtaaaaataggattagtgaggggcagtggggatacagaggcaggttggggacagcagggcaaagggttctatgtatcagatactacactgaagaataaatgctgggtccatgcctatagttaaataccaggtgtttttaggtttcagtgagtttttttagtttaaaatgttggtttgttcacagcacagctctgtagtgtgttctgaagaggtcttataccatgagagggtttgctgaaaacgatgatagagtcaagcaag

SEQ ID NO: 139026 - DNA, 601 bp, Human
gctctgttcacttttcaagatcggtgcatcagcctgagctagtccctcccgggatcttgaggtgtctgtgggacacagtagacggggatggcaatacagcagggcttcaaggctctactgttacaggctgggtctacttctcaggaagaattcagagtaaaaataggattagtgaggggcagtggggatacagaggcaggttggggacagcagggcaaagggttctatgtatcagatactacactgaagaataaatgctgggtccatgcctatagttaaataccaggtgtttttaggtttyagtgagtttttttagtttaaaatgttggtttgttcacagcacagctctgtagtgtgttctgaagaggtcttataccatgagagggtttgctgaaaacgatgatagagtcaagcaagtttgggaaaccccacataacacatctcacatcttggaaaaaactcaaattccactcatgtctcaaaaataactagaccccaggacactttctttcaattatacatagtagcactctctggagcacaatttggaaaatgctgctattagatatttggcctccaaatgctgatgtgggaactctgt

SEQ ID NO: 139027 - DNA, 601 bp, Human
gccagtccttcgtgtctaagagagaaatgtgttctggagccagacactggcataaggaactggtggtgggatgggtgaggtctgagatggagagggtgtaggcataagaggctgagctacaccactgggcatccgtgcaacctccaacaagttactaagccatatttccttctctttaacgttgacctattgggacctgccccgcaggggagttgtgaaggtaacatttaataatgtaggtaacatgcttagcacagggcttggcacatagtaggtacccaatacttggtagctgttgtcatttgcatcctagaagggaggtgttgataggggctgagtcgactctgcagtttctccaaggtatcctctggtatgtcccttttccctgctcctcaggccagcaggtggccatcaagaagatccctaatgctttcgatgtggtgaccaatgccaagcggaccctcagggagctgaagatcctcaagcactttaaacacgacaacatcatcgccatcaaggacatcctgaggcccaccgtgccctatggcgaattcaaatctgtgtaagaagcgggatgggagagggagccagacttgggact

SEQ ID NO: 139028 - DNA, 601 bp, Human
gcataatcttcaaaacctcatccttgagagaggcccccaggaagaaatcaatgatctctgattccttaattgggcagggagaagagatagatctcctccagggacttgatcttcatgtccttgaccaagcggcccaacttggtgacgggcatccactccttatcctcggccttgcctccgcgagctccgcggccttggccccggccccgtccacggccgcgaccctggccccggatgccactgccgaaacctccgcggaagccaccgcggttccccatctcagggccaccagggcctccgkgcccccccgctgcaccggcgtcatccgccatttggtgttttgtcggaaaagaagccactgtgtttctttaagacaattattttgaattattaatccgatagtttatagatctccatctcttcggaggcagtttctagagatttattttgttcctttgatttggttatatttccctgctttattgtgtggcttgtgatattttttttgttgagttgtacgcatttgaaaaaaaatagccttctctctcagtctttatggattgggtttgtacgggggaattctgttcaccaatcagccaca

SEQ ID NO: 139029 - DNA, 601 bp, Human
cacgggtctgcttctgcactggcataatcttcaaaacctcatccttgagagaggcccccaggaagaaatcaatgatctctgattccttaattgggcagggagaagagatagatctcctccagggacttgatcttcatgtccttgaccaagcggcccaacttggtgacgggcatccactccttatcctcggccttgcctccgcgagctccgcggccttggccccggccccgtccacggccgcgaccctggccccggatgccactgccgaaacctccgcggaagccaccgcggttccccatcycagggccaccagggcctccgggcccccccgctgcaccggcgtcatccgccatttggtgttttgtcggaaaagaagccactgtgtttctttaagacaattattttgaattattaatccgatagtttatagatctccatctcttcggaggcagtttctagagatttattttgttcctttgatttggttatatttccctgctttattgtgtggcttgtgatattttttttgttgagttgtacgcatttgaaaaaaaatagccttctctctcagtctttatggattgggtttgtacgggggaat

SEQ ID NO: 139030 - DNA, 601 bp, Human
ggccgttgtagtccccgatagcaacaaatgccttgaacctggtgcgctggccggcacgggtctgcttctgcactggcataatcttcaaaacctcatccttgagagaggcccccaggaagaaatcaatgatctctgattccttaattgggcagggagaagagatagatctcctccagggacttgatcttcatgtccttgaccaagcggcccaacttggtgacgggcatccactccttatcctcggccttgcctccgcgagctccgcggccttggccccggccccgtccacggccgcgacccyggccccggatgccactgccgaaacctccgcggaagccaccgcggttccccatctcagggccaccagggcctccgggcccccccgctgcaccggcgtcatccgccatttggtgttttgtcggaaaagaagccactgtgtttctttaagacaattattttgaattattaatccgatagtttatagatctccatctcttcggaggcagtttctagagatttattttgttcctttgatttggttatatttccctgctttattgtgtggcttgtgatattttttttgttgagttgtacgcatttg

SEQ ID NO: 139031 - DNA, 601 bp, Human
ccttggagcacttaacacccagaccgacgtggccgttgtagtccccgatagcaacaaatgccttgaacctggtgcgctggccggcacgggtctgcttctgcactggcataatcttcaaaacctcatccttgagagaggcccccaggaagaaatcaatgatctctgattccttaattgggcagggagaagagatagatctcctccagggacttgatcttcatgtccttgaccaagcggcccaacttggtgacgggcatccactccttatcctcggccttgcctccgcgagctccgcggcctyggccccggccccgtccacggccgcgaccctggccccggatgccactgccgaaacctccgcggaagccaccgcggttccccatctcagggccaccagggcctccgggcccccccgctgcaccggcgtcatccgccatttggtgttttgtcggaaaagaagccactgtgtttctttaagacaattattttgaattattaatccgatagtttatagatctccatctcttcggaggcagtttctagagatttattttgttcctttgatttggttatatttccctgctttattgtgtggcttgtg

SEQ ID NO: 139032 - DNA, 601 bp, Human
gcccagggtggcagtgcagccccgggctgaggtgtagcagtcatcgataccagccatcatgagcagcttcttaggcacaggtgcggagacgatgccagtgcccctgggtgcagggatgaggcgtaccagcacagagccgcagcggcctgtcaccttgcaagggacagtgtggggcttgccgatcttgttcccccagtagcctctgcgcacggggacgatggagagcttggccaggatgatggccccacggatggcggtggccacctccttggagcacttaacacccagaccgacgtggccrttgtagtccccgatagcaacaaatgccttgaacctggtgcgctggccggcacgggtctgcttctgcactggcataatcttcaaaacctcatccttgagagaggcccccaggaagaaatcaatgatctctgattccttaattgggcagggagaagagatagatctcctccagggacttgatcttcatgtccttgaccaagcggcccaacttggtgacgggcatccactccttatcctcggccttgcctccgcgagctccgcggccttggccccggccccgtccacggccgcgaccctggcc

SEQ ID NO: 139033 - DNA, 601 bp, Human
accccccggagggaggcggagggaagggaggcgaggcctgcacctgcatgcttcccgcctcccactccccagcgcccccggaccgtgcagttctctgcaggaccaggccatggagctcgaagtccggcgggtccgacaggcgttcctgtccggccggtcgcgacctctgcggtttcggctgcagcagctggaggccctgcggaggatggtgcaggagcgcgagaaggatatcctgacggccatcgccgccgacctgtgcaaggtacgcacgcgtgcggcggggtgtggggaaactggcccycgccgcgcacttgtggactggagcttcggctgggttttgtttttgcttttacatttcggattactccagcactgggagtatgatctccagcgatacagataaagccaaagttcccgcagactttcccggtcctctagcactcagaagggcatatgttacctagcttctgtggttccttttctgccttttctattcttgtccatttttctgttacatttgtggttcttttccttatgatgtgtaggaactctttgtatattctggatttaagtaatttgtcagtttactgtattgtggata

SEQ ID NO: 139034 - DNA, 601 bp, Human
cgccgccgacctgtgcaaggtacgcacgcgtgcggcggggtgtggggaaactggcccccgccgcgcacttgtggactggagcttcggctgggttttgtttttgcttttacatttcggattactccagcactgggagtatgatctccagcgatacagataaagccaaagttcccgcagactttcccggtcctctagcactcagaagggcatatgttacctagcttctgtggttccttttctgccttttctattcttgtccatttttctgttacatttgtggttcttttccttatgatgtgtrggaactctttgtatattctggatttaagtaatttgtcagtttactgtattgtggatactttctttgggtttctttcttttctttttttttaagccaaatttagcagtgggagagttgcataccaacttgaataacagtaatattaataagttctgaataacccattaccatcagaccagcctctgggtctatttcttgtcttttagctttgtttatggtttctttgttagacagagttttgtttttaagttatagttgcagtcaaatttttcttcataactttgtgtattattaggtcag

SEQ ID NO: 139035 - DNA, 601 bp, Human
ttcagtatgtcgggggtgggatctgagattccaagtttctaacaaggtccccagtgatatcatatgcctcttttggaagcacgctttgtgtagcaaagtttttattgttttgatttgtgtgtgtggtttttttgtttgtttgcttgttttgttttgcttttaagacggagtctcactgtgtctcccaggctggagtgcagtggtgcgatctcggctcactgcaacctccatctcttgggttcaagcgattctcttgcctcagcctcctcagtagctgggattacaggcgtgcgccaccacrcccggctcatttttgtatttttagtagagatggagtttcaccatgttgaccaagctggtcctgaactcctggcctcaagtgatccgcctgcctgggcctcccaaagtgctgggattacaggtgtgagccacccccccggcctgtggtagcaaagttttaagtagtgttttagggtgtaagtatattcctgtatgtttgctgataatattgttactttttttttttttaaacggacagggtctccctttgttacccaggctgaagtgcagtgactcaatcataactcactgcagcctccaa

SEQ ID NO: 139036 - DNA, 601 bp, Human
tctgaccagtttcttcattcaaataaagactatgagagtaatgctagcttgggtatatagcaaatgccaggagattaatttctcactttgcaggatccagatagagagatgtatgttgaaatggctcacttgcccaataattccagggcagagaggacaatctaagggcagaagtgggagaaaagcgatagaaagctggaggagtgggaaaggctgctggaacccattgtcagtgacctgaagatgaggacagctaaggagttagccttagaagagaaagtgagatgagctcttatgctawttatgaggatatgcagcattgagagctgcagaaataattgggagtacctagcctgttcttcccactgaacatcattttggtagctattaaagttaaatattagatgatactgttctactttttactttatttaggaaatgctgtgattataaagccttctgaactgagtgaaaatacagccaagatcttggcaaagcttctccctcagtatttagaccaggtaagaatttcttgactcatctccaacatatgtgtttactgtggaaaacacacattttattttcttgctattgcatgtta

SEQ ID NO: 139037 - DNA, 601 bp, Human
agctaaggagttagccttagaagagaaagtgagatgagctcttatgctaattatgaggatatgcagcattgagagctgcagaaataattgggagtacctagcctgttcttcccactgaacatcattttggtagctattaaagttaaatattagatgatactgttctactttttactttatttaggaaatgctgtgattataaagccttctgaactgagtgaaaatacagccaagatcttggcaaagcttctccctcagtatttagaccaggtaagaatttcttgactcatctccaacataygtgtttactgtggaaaacacacattttattttcttgctattgcatgttattgctggccggggacccaattgcagtctctttaagccttcaacagttggcttagcaaaagaagttcggttccaaaatacacggagtgtattttgtgtggagtcacccagctcttggggttacacaatatatgtaggcccatggcttcatgccaaacagattctgtgtttgtctgggatttggggttaatttttgagctaacatgattttaggtgttttcatttaatggattatttaatgagggactggtac

SEQ ID NO: 139038 - DNA, 601 bp, Human
aaatggtgagctgtaagtcctgacatcatgtggttgtccttaggaattttaaaaaagttatatctgttctcaagattacagctagatctagcaagaaattttaacgttcttctggccagtgatctgtgaagtacataatccaaagtattgtgtgtgcctaataaaatctttaaatgcccatttgagagggtattatgctgatatcttaactgagatcctttgtgggcaaaacaagtgttcctcattttttaactgtgaataacatcttgcatctgaaaattagaaaataagaggtttcagkttctctctgctaaatccggtttagctactaagaagtgccaaatcatagaactgactctgtgctctgggtggtgtggctttctctgcccttcagagattccaggtcagggttccaggttggcttcctaagtagaaatccatttgtcaaaaccagacaccctcagttagtgaatgtttagggcatgggtttctgcccatgcataggaaaggtcttcccaagtggggcagggctccacaaagaggaggatggccttggaggctggctgacatcctgctttatacctgaacatcttgcaggcag

SEQ ID NO: 139039 - DNA, 601 bp, Human
gggtttctgcccatgcataggaaaggtcttcccaagtggggcagggctccacaaagaggaggatggccttggaggctggctgacatcctgctttatacctgaacatcttgcaggcagagccaaaagccacaaccaggagagtctgtaccgaactctggtcatccaggactttcctttggctggactggaagaggggaaaggacattgggaggctgtttctcctcttttcctgcagcaggcaatggcttcactgtttaccaagtactgtttgccgtgagctggcctgagaacttccctgctrtgtaaaatattccacctcatttggaaaatactttctaagttccaaacaactgatttagaaatgagtttttaacttttttataaaaattgccagataaatatatgaatctattttagttgcaagacattcaaacaacacaatgtaacaaatgaatatttgactgaattatatagctgttctggatgttttcccctcagacgcataacctggggaaaatacatgaattgtggccaaacctgcattgcacccgactatattctctgtgaagcatccctccaaaatcaaattgtatggaagatt

SEQ ID NO: 139040 - DNA, 601 bp, Human
catccctccaaaatcaaattgtatggaagattaaggaaacagtgaaggtttgtattaaaaacatctgattccactgattttaataagataaggagtcaaattaactattcgcaggcagcatccccatttgtttctcccttcaggaaaatttcaaaatcatatgtgactcagtgaacttattgactaatatgaaaatgctatgtgtaccatagaatatatgctgggagcaaggttgcattggtgttaaatctacttaaactgtctagttgatttgttgatgattagttgtggcatatacttkttttaaaaaagttaaataatcgtgtgtccgtggttttgagggaatgttgccaaccctttaggtataatcagagagactctttggcatattggccattgctgctgaaggttatcagtttttgtgtatgtagagggcctagggtggccagtagtttggaggagtgacttaattaaataactacttacagtataccctttatataattaacaatctttcagcgtgtttaaagtaaatatttgcagtgagggaaccaaggaagactgcatgtagagtcctaagccaagacttgaagaaatatag

SEQ ID NO: 139041 - DNA, 601 bp, Human
gaggatataaaaccagattgattttggggcatggctggattttgtacttactgaaattgaattgtgggtctttgtgacatttatatactcctgttgttttaaataggaattttatggagaaaatataaaagagtctcctgattatgaaaggatcatcaatcttcgtcattttaagaggatactaagtttgcttgaaggacaaaagatagcttttggtggggagactgatgaggccacacgctacataggtaatggaaattctccttttcctatgggaagatggcaatttggcagtttttgstgacactacttattaacactagataaactattaaatatatagcatttaattgttaaagtactaaatcctgctttctggtatactgtacctgtagcttttgttataaactatttaaaatgtctgtgtttctgtgtattgaatgatgccaccagcgttgctccagttgttcatatttacacataactccttttttcctcctaacaatcctgagaagcagaatagaacttgatgtaattatctgtagtttgtggatgggaaaacagcacaaagaaggaaatagcttggccactattccacaat

SEQ ID NO: 139042 - DNA, 601 bp, Human
ataagcaactgtcaagagtcatgttccttctttgctgtaaaacaatgcaaaaaacaatgtgaaacaatgatggtttcttttgtgtcatgtcagagtccatccactaagtgaggttgtgttccgaggttgctgtcttggttaatgagactctggggttatcacagcatccattcccctcctccctcgggttagatctgagtctgcagggttgagtgtcacaaggtttttgattcacaaacatctcctgtataattggaagacttatatgtgccagcattaaatgcttttctgatgttaatcacagggcattgctgaataacagcctgcacaaaatggcattcacacccactgtgtgggacaaagaccccgacactgtcacataaatggttgtgatatgatggattttagtttctaacatgacgctagcttcttgttagagtggtggaactgcatcacctggttgagcagttctgccactttctgcatggctcactcattcatgtcactaggtgaccagccgctactaagagaccatggcccaaatgttttctggagagcttctgatggtaatgtatagatagtcatgtgacagcttttggag

SEQ ID NO: 139043 - DNA, 601 bp, Human
tgtgtgtttaatgaagtagcaaatgaaaggttcggaataccagggacagaaggtagaggggttttctaatgtgcctttgttttctgctcagttcttacctgcattgttccccagccctttgttgggaggagcagcctctccttgaattgttttgtgatttgagtaaaacgggactccccctgttctagagaggatgggcagaaagaaattcattccaagtgaagctttgtggacatagcctgatccttgcttttccctttagaacatgacctgcctgcctctcccacatgtgagatgactractcagctttttatttctcctttgggacctaggctaggtgggcttttctactctctactagagctattacaaaatagccgatatgtaaacattctcataacaaaaacccaaccagaaaagccactgtcttaaagccctgttctatcctctccctttgtaataccgtcctaagtcagttgctccatgggatgcgatggcccagtttggcaggaccatctgttcctggttaaggaaaccttgtcctatgaccaaggagccttgacctatatagccacaggtccttgtctaggaggtaaacat

SEQ ID NO: 139044 - DNA, 601 bp, Human
aaactttttaatattttggcatatagtttagatttttcttttttttttctttttatcgagactgagactccctgtcacctaagctggagtgcagtggtgtgatctcagctcattgcaacctccaactcctgggttctagcaattctcctggctcagcctcccaagtagctggaactacaggtgtgtgccaccaggcccagctaatttttgtatttttagtagagacacggttttgccatgttagccagcctggtctcaaactcctgggctcaagagatccacttgccttggcctcccaaastgctgggattacaggtgtgagccatcgcacccagcctaggtttttctttagaaatgcttctctttaagacttttgatagatatttcaagtgtctttgcagatttctgccactttatattcccatgatcagtatatgagtgtttacttccttatatccccaattctggattattccattattaaatttctagacagaaaagggtctcatttcaatttgtactcctttgattattagtgagtttgaattttttttaccactctcatgaattttctatttatgtcctttgatatttttgctgt

SEQ ID NO: 139045 - DNA, 601 bp, Human
tctagcaattctcctggctcagcctcccaagtagctggaactacaggtgtgtgccaccaggcccagctaatttttgtatttttagtagagacacggttttgccatgttagccagcctggtctcaaactcctgggctcaagagatccacttgccttggcctcccaaagtgctgggattacaggtgtgagccatcgcacccagcctaggtttttctttagaaatgcttctctttaagacttttgatagatatttcaagtgtctttgcagatttctgccactttatattcccatgatcagtatrtgagtgtttacttccttatatccccaattctggattattccattattaaatttctagacagaaaagggtctcatttcaatttgtactcctttgattattagtgagtttgaattttttttaccactctcatgaattttctatttatgtcctttgatatttttgctgtgttcacatcttccttattattggtatataaatagccttttttataagtaagaaaatcctcagtcctatctgtaatacatatccctttccagattttaatttttcttttaattttatctatgatttgaagcgttt

SEQ ID NO: 139046 - DNA, 601 bp, Human
tgaagttattggaacacagccacacccacttgtttaatcatccacagctgctttcatgggacagtgacagagctgagtagttgcaacagaggctgaatggccctcagagcctaaattattacagaaaagtttgctgatctctggtctaagagattaaaacagcgtagaacttgattgcagaattctgagctgtctgatcaaagggttagccctttgatccttttggtattggactttccttgtcacttacagctttgttcttgaatgtgcatgaaatcagcttaccacagaggtgaaggcragaactctggtacaacagctttggtgagggatattttattaggcttgagtttttttcctccaaagttcactacctgataaagtttatctttggtgattagtcattatagggatgggcttgcaaagaggccctcatgatagctgccttctcaaagcagtttgcgtattttgagatgaaagaggaaatccgtaattaaagttaagatggaatgaggaaggcaattgtgtctgtggtgccctcagccgttcaactgaggatataacattgaaaatattgaccatatcagtgaagaatgggctt

SEQ ID NO: 139047 - DNA, 601 bp, Human
cctccaaagttcactacctgataaagtttatctttggtgattagtcattatagggatgggcttgcaaagaggccctcatgatagctgccttctcaaagcagtttgcgtattttgagatgaaagaggaaatccgtaattaaagttaagatggaatgaggaaggcaattgtgtctgtggtgccctcagccgttcaactgaggatataacattgaaaatattgaccatatcagtgaagaatgggcttggaaaaggcaatggtaatagttgtgtttatgttttgtttaaaatttgaaagggggcyggcgcagtggctcacacctgtaatcctagcacttcgggaggctgaggcaggggaatcacgaggtcaggagttcaagaccagcctgaccaatatggtgaaaccctgtctctactaaaaatacaaaaattagccaggcatggtggcacgcacctgtagtcccagctactcgggaggctgagggaggagaatcacttgaacccgggaggtggaggttgcagtgagccaagatcatgccactgcactccagcctgggcaatagagcgagactccatctcaacaacaacaacaacaaaaatttga

SEQ ID NO: 139048 - DNA, 601 bp, Human
tggaggcttaagggttattgaaaaaagaatgggccgggcgcagtggctcacgcctgtaatcctagcactttgggaggccaaggcaggtggattgcctgagttccggagttcgagaacagcctggccaacatggtgaaaccccatctctactaaaaatacaaacgttagctgggtgtggtggtacgtgactgtagtcccagctactagggaggctgaggcaggagaattgctttaacccgggaggcagaggttgcagtgagccaagattgtgccactgcactccaccctgggtgacagagcragactccgtctccaaaaaaaaagaaagaaaaaagaatgtttaacttacttatctctagacattttggacctgggcccagagtatcagggtgttaaaactccacttatccacaattttaaaagggtgaagtgacttgctaggaatctaagagaagtgtgcagaggcaatggcttagctgcgtccaggtgaagcatacatcatttcttggaaaagggcagctgagtgtgagcctcatttctcttccccttctactcagctctcctgggggaggtgccagctgactaattcagacttgtcacc

SEQ ID NO: 139049 - DNA, 601 bp, Human
cctgtaatcctagcactttgggaggccaaggcaggtggattgcctgagttccggagttcgagaacagcctggccaacatggtgaaaccccatctctactaaaaatacaaacgttagctgggtgtggtggtacgtgactgtagtcccagctactagggaggctgaggcaggagaattgctttaacccgggaggcagaggttgcagtgagccaagattgtgccactgcactccaccctgggtgacagagcgagactccgtctccaaaaaaaaagaaagaaaaaagaatgtttaacttacttayctctagacattttggacctgggcccagagtatcagggtgttaaaactccacttatccacaattttaaaagggtgaagtgacttgctaggaatctaagagaagtgtgcagaggcaatggcttagctgcgtccaggtgaagcatacatcatttcttggaaaagggcagctgagtgtgagcctcatttctcttccccttctactcagctctcctgggggaggtgccagctgactaattcagacttgtcaccatctaggcactgaactctttatgtcataatttaagaatatgttttttaaatc

SEQ ID NO: 139050 - DNA, 601 bp, Human
tgttaaaactccacttatccacaattttaaaagggtgaagtgacttgctaggaatctaagagaagtgtgcagaggcaatggcttagctgcgtccaggtgaagcatacatcatttcttggaaaagggcagctgagtgtgagcctcatttctcttccccttctactcagctctcctgggggaggtgccagctgactaattcagacttgtcaccatctaggcactgaactctttatgtcataatttaagaatatgttttttaaatcactaagtagttttgatttgttttcatttttaaaaaaakgtttgactttggaattcatggcagcaaatgtcgtgaaatcaaggtgtagtatacaatttaggggctactttctttgccttcctgaggctggaggtgtggtcggaagcttacttgggtctctggtcaatatctgtctcttttgttcttttcccaagacctcggttcctcagtttgataatgcatcttggtaggatagaatattttagcctcatggaaaatacggaggcccaggctgagtctgcattctccaatcttaccaaacccccaagaagcctccctcaggtgcagtgcagtgtgcca

SEQ ID NO: 139051 - DNA, 601 bp, Human
gctcaatgaacttgggcaaggccttttctgagctctttcttgggcctcagcttgctcatctacagggtgagggagtaggtgtcagtgattccccaggccactttcaacccttccgctcaattctcattactaatagttgttaatatttctttggattcaatctggaactaggtagagatttggttttcttttccactttgctgcttttctgctcctttctgagcttttaatcctctttttatcaaattaccttttatttaaaataaatgactttgaatctgtactgtatatttacctgaayagtctatttattgtaattacatttttctgaaatggcttttatgtacttaatagtttccttattttgttacactcttggattttattttattaattaccttactagaattagaagggatttagagcagaagtattgtacacaaagtaaagttccaataaagcttataagctacagaaggcattgtgggagatgtgggttttaaaaggtcgagaaacataagaggttaatgttgataaatttcattaggcctttgacaactaaatatgacatttgaaccttgagattgcagcagcccttcct

SEQ ID NO: 139052 - DNA, 601 bp, Human; identical to SEQ ID NO: 25807

SEQ ID NO: 139053 - DNA, 601 bp, Human; identical to SEQ ID NO: 25808

SEQ ID NO: 139054 - DNA, 601 bp, Human; identical to SEQ ID NO: 25809

SEQ ID NO: 139055 - DNA, 601 bp, Human
aggtaatggattgatgtaacaatttaatgttgactttaaattttataagaagaataactttattttattttactcttatcgatttacgagtctccttaaatagtaaagatactgggtttcttctattactttttcagctttttccccctttctcttctctaggcggctaggggtggagatgggcaaagtgcaggtttaccaggaacctaacagaggtgagctatcttgggcatgtggaacattgacctttttgtgaaatgtggcatattggctccgtccttcatcctttactattgaaacratttgattcagttgtacatttccattagcaagaagtcaggcaggcaaggtagaacagagtggttttttagctctcactaataccagctagatatctaaccctggtgcaagtcatttctggggcttgaactgcagttctgagacttcattcagtaaaagctgcagacatatttgaaccagctggtcaactgaatgaacatgagctcaactgttgcttaaatttatgtcaccttaggaaggatgagtaaatcctgtcaccttagacaggatgactaaatcctgtgtgaccgcagttttagtt

SEQ ID NO: 139056 - DNA, 601 bp, Human
ttctgagacttcattcagtaaaagctgcagacatatttgaaccagctggtcaactgaatgaacatgagctcaactgttgcttaaatttatgtcaccttaggaaggatgagtaaatcctgtcaccttagacaggatgactaaatcctgtgtgaccgcagttttagttagtctttatttgcacctaagctgccttgggttagacttcataaaatattgttaagaaatactttttgctaattgatacatgtcattacataattctcccaagttgtaaaaagaagtgttatttaacctttgtagrtccaggtgtgctggctcatgcatctaatgccagcactttgggaggctgaggcaggcagattccttgagctcaggagttgagaccagcctgggcaacacggcaaaaccctgtctctactaaaaatacaaaaattagccaggagtggtggtttgcacttgtagtcccagctactagggaggctgaggtggaaggatcgcttgagcccaggaggtggaggctgcagtgaagtgtgatcataccacagagtgagaccctgtctcaaaaataaataaataaataaatagaaagtgatctttgtaa

SEQ ID NO: 139057 - DNA, 601 bp, Human
ctgggggggaacaagagcgagactttgtctcaggggaaaaaaaaaaaaaaagaaattattttagcaggagcgatggacagcttgcatgggcttgagagttacacaccttatccttgacaagttatttaacctttctaaactataaataaactgtaaattagggctgttttgaggattaagtgggataacttgtgtgcctaccagtttttggcacacagtaggtgctcaatatatacttattcctgttccttttccactagaagatttaaaaaaacattttttttttttttttggtagaacragggtctcattatgttgcccaggcttatctcaaactctgggcaaaagcagttctcctatttcagccccccaaagtgctaggattacaggtgtgagccaccaggcctggcccctctacaggattttatcaaatatttacatattataaagcctacaggaggctttgataaaaaggcacaagttttgctgttcccatgtttatctccgttcctgcctcttttctgtctcccaagatccctatgtggcgtcagtagggaaaaagtataattaaactctgcaaggagagtttggagaagattct

SEQ ID NO: 139058 - DNA, 601 bp, Human
ggtagaacaagggtctcattatgttgcccaggcttatctcaaactctgggcaaaagcagttctcctatttcagccccccaaagtgctaggattacaggtgtgagccaccaggcctggcccctctacaggattttatcaaatatttacatattataaagcctacaggaggctttgataaaaaggcacaagttttgctgttcccatgtttatctccgttcctgcctcttttctgtctcccaagatccctatgtggcgtcagtagggaaaaagtataattaaactctgcaaggagagtttggasaagattcttcctctagaggggattgaatgatgttctttgtctggagtctaggagggaaggtgaaagggagaagcagtggcataagactccaggagactggtccactctccaagtttctgaataaagggagagaaaatacttggtgtttattgggaaggaaggaagtaatatttgtgaatttcttactgttaccagatactgaaaaactgagttcaggagttcagggattgatgttaggtacgaggtccagtttgaatccagatctccctgactctaaagctcattttcttttcttttctt

SEQ ID NO: 139059 - DNA, 461 bp, Human
ttgagacagggtctttctgtgtcactcaggctggggtgtagtggcatgatcagggctcactgcagcctctgcctcctgggctcatgtgcttctcccaccttagcctccccagtagctggtactacaggtgggcaccatgctgccaggctattttttttttttttttaaatatggagtcttgctctgtcacccaggctggagtgcagtggggcaacctcggctcactgccacctccgcctcccaggttcgagtgattctcgtgcctcagcctcccaaagtgctgggattacaggtgtgagcyacacacacacacccagccataatttttttttttttttgatacggggctttgccatcttgctcaggctggtaaagctcattttcttaacatcataccacatttcttttgtaaacttggattctgttttttccaacatttttttttctcttatcctcacaat

SEQ ID NO: 139060 - DNA, 601 bp, Human; identical to SEQ ID NO: 25810

SEQ ID NO: 139061 - DNA, 601 bp, Human; identical to SEQ ID NO: 25811

SEQ ID NO: 139062 - DNA, 601 bp, Human; identical to SEQ ID NO: 25812

SEQ ID NO: 139063 - DNA, 601 bp, Human; identical to SEQ ID NO: 25813

SEQ ID NO: 139064 - DNA, 601 bp, Human; identical to SEQ ID NO: 25814

SEQ ID NO: 139065 - DNA, 601 bp, Human; identical to SEQ ID NO: 25815

SEQ ID NO: 139066 - DNA, 601 bp, Human; identical to SEQ ID NO: 25816

SEQ ID NO: 139067 - DNA, 601 bp, Human
atgaaccaccataccctgctggagttttatttttaccttagaaatatcaaagtaatggctgggcacagcagctcacgcctgcaatcccaatgctttgggaagctatgtgggatgatctttgaactcctgggctcaagtgatccccctgagtagttggaactatggacatataccaccgtgcctgcctagataggcatatattggaaaagatacatattattctgtgtcaggcattttcaggtaacaacctaagtatttttcctgtgtttctaaataaccttcatagttgttattgggtatktgtgtcaatatatttgtgtttgtgtgtgtgcgcgcttgtataagtgtatatgattttatttatttatttatttattttgagatggagtttcgctcctgttgcccaggctggagtgcaatggcatgatcttcgctcaccacaacctccacctccccggttcaagcgattctcctgcctcagcctcccaagtagctgggattacaggcatgcgccaccacgcccggctaattttgtatttttagtagagacagggtttctccatgttggtcaggctggtctcaaactcccgaccccgcctca

SEQ ID NO: 139068 - DNA, 601 bp, Human
atccccctgagtagttggaactatggacatataccaccgtgcctgcctagataggcatatattggaaaagatacatattattctgtgtcaggcattttcaggtaacaacctaagtatttttcctgtgtttctaaataaccttcatagttgttattgggtatttgtgtcaatatatttgtgtttgtgtgtgtgcgcgcttgtataagtgtatatgattttatttatttatttatttattttgagatggagtttcgctcctgttgcccaggctggagtgcaatggcatgatcttcgctcaccrcaacctccacctccccggttcaagcgattctcctgcctcagcctcccaagtagctgggattacaggcatgcgccaccacgcccggctaattttgtatttttagtagagacagggtttctccatgttggtcaggctggtctcaaactcccgaccccgcctcagactcccaaagtgctgggattacaggcgtaagccactgcacccggcctatgatttttttattttaatttttattctgtttatttattttttgagacggagtcttgctccgttgcccaggctggagtgcagtggtggcac

SEQ ID NO: 139069 - DNA, 601 bp, Human
aagcgatttttgtaccttagcttctctagtagctgggactacaggtgcctgccaccacactcagctaatttttgtatttttagtagagatggggttttgccatgttggccaggctggtctcgaactcctgacctcaagtgatccacctgctttgggctcctaaaattctgggattacagacacaagccaccatagccagcctgaatgtatatgattttagaaggtatgtatcacggagcatttgcacagagtgaatagaataaaagtccccatatcactgcattttaagacaggtacttaytgtagaataaacctttttttttgtttgttttttgagacggagtcttgctctgttgcccagtctggagtgcaatgacgtgatcttggctcactgcaacctccaccacccgggttcaagcaattctcctgcctcagcccccagagtagctgggattgcaggcacacaccaacatgcccaactaattattattatttttattttttatttttgagtctcacctgtcatccaggctggagtgcagtagcgtgatctcggctcaccgcaacctccacttcctgggtttaagcgattcacctgcct

SEQ ID NO: 139070 - DNA, 601 bp, Human; identical to SEQ ID NO: 25817

SEQ ID NO: 139071 - DNA, 601 bp, Human; identical to SEQ ID NO: 25818

SEQ ID NO: 139072 - DNA, 601 bp, Human; identical to SEQ ID NO: 25819

SEQ ID NO: 139073 - DNA, 601 bp, Human; identical to SEQ ID NO: 25820

SEQ ID NO: 139074 - DNA, 601 bp, Human; identical to SEQ ID NO: 25821

SEQ ID NO: 139075 - DNA, 601 bp, Human; identical to SEQ ID NO: 25822

SEQ ID NO: 139076 - DNA, 601 bp, Human; identical to SEQ ID NO: 25823

SEQ ID NO: 139077 - DNA, 601 bp, Human; identical to SEQ ID NO: 25824

SEQ ID NO: 139078 - DNA, 601 bp, Human; identical to SEQ ID NO: 25825

SEQ ID NO: 139079 - DNA, 601 bp, Human; identical to SEQ ID NO: 25826

SEQ ID NO: 139080 - DNA, 601 bp, Human; identical to SEQ ID NO: 25827

SEQ ID NO: 139081 - DNA, 601 bp, Human
ccctacttttttcctaaaagaagtctgtgtggctcacaagttagtaatattttttcataggcaggttcctttcttcattttccaaaggagaattttactttgaactttttctttttttggaaaactttcaactagctaagcatttttgggtctgttggaattttcctttttgttgacatgcagtaatacctgacttcttgtctgtcacagatcccagattacaggaatgcagtaatcgtggccaagtctccagcctcggcgaagaggtaggtgggaatctcacaacctctttctggatctrcttctaaggattgtatccgtgatgagttccaggcattctaatttgaacttcagtggttcccagcgatatctcttatttttcttccatggactggtattttaagattgttctgtcaactccatttattaagtaaacattttaatttcctctcttttttttccaatcccactctatgattgccagacatacttccttttttaagttatcttccacttacactttcttttatttttattattattattatttattttattttatttctttattttttgagatggagtttcgctcttgttgccc

SEQ ID NO: 139082 - DNA, 601 bp, Human
atattaaataaaataaattggcatttgagataaaaccattacatggctgtgttcttgtggctgactttcccaacccagccgggcctgtgttcacccatgtgtccttcaagaagttgtatcacctgatctcctcttgtccatttgattaaattgtaagaaacagactgaattttagaatgtaaacatttcaaatagcttttccaaacatttcttcaaaggctgaattaattttacttaataatttttctctgatatacatgctttaaaaaaatgtaggtgaaaaatcacataatatacaatmattttaaagtatagaattcactggcatttagtgcattcacaatgttgtgtaaccaccacctgtctctgttttcagaacattttcgtcttcccagaagaacatctagtacccattcagcaatcattccttatcccttcaccttctgtccctcggcagccacacagtatgtggccctctgtgtctggtttctttcacttagcagttttcaaggttcatctatggtgtagcatgtagtatctcagtgttttgttgtcgctgttattgttcgagacaaaatcttactctgttgccgaggctgga

SEQ ID NO: 139083 - DNA, 601 bp, Human
gaacatctagtacccattcagcaatcattccttatcccttcaccttctgtccctcggcagccacacagtatgtggccctctgtgtctggtttctttcacttagcagttttcaaggttcatctatggtgtagcatgtagtatctcagtgttttgttgtcgctgttattgttcgagacaaaatcttactctgttgccgaggctggagtgcagtggcacgatctcagctcactgcaacctccgcctcctgggttcaagcaattctcctgcctcatcctcccaggtagctggaattacaggtgcrtgctaccacacctgggtaatttttgtatttctggtagagatgaggtttcaccatgttggtcaggctggtcttaaactcctgaccttgtgatctgcctgcctcggcctcccaaagtgctgggattacaggcgtgagccaccgcacttggccagtacctcagtccttttgatggctgagtaatattgcattgtatgtgtatactagtttgtttatccattcatctgttgatggacactttttttttttaccgtttggctattatgaataggactcctatggtcagtcatggattagtttttg

SEQ ID NO: 139084 - DNA, 601 bp, Human
ttttgaggaactatcagtctcttttccactgcagctgcccattttacattcccaccagcagagtatgagggttccaacttctccacatcttcaccaacacttaattctctgagttttttcattataatcatcctagtgggtgtgaaattctaccttatcgtggttttcatttgcatttccctaatgattgatgatgttgagtatcttttttttttttttaatgagacagggtctcagtatgttgctcaggctgggctcaaactcttgggctcaatcaatccttctgcctcagcctgttgagtgtgtgtgtgtgtgtgtgtgtgtgtgtgtgtgtgtgtgtgtgtgtgtatttatttatttatttatttttttgagacagagtctcgctctgtcacccaggctggagtgcagtggcgcgatctcggctcactgcaacctccgcctcccaggtttaagcgattctcctgcctcagcctcctgagtagctgggattacaggcatgcgccaccatgcctagctgttgagtatatttttatgtgctttttggccatttgtatatatttggagaaatgcctgttcacaccctttgcccatttaataa

SEQ ID NO: 139085 - DNA, 601 bp, Human
cattcccaccagcagagtatgagggttccaacttctccacatcttcaccaacacttaattctctgagttttttcattataatcatcctagtgggtgtgaaattctaccttatcgtggttttcatttgcatttccctaatgattgatgatgttgagtatcttttttttttttttaatgagacagggtctcagtatgttgctcaggctgggctcaaactcttgggctcaatcaatccttctgcctcagcctgttgagtgtgtgtgtgtgtgtgtgtgtgtgtgtgtgtgtgtgtgtgtgtgtktatttatttatttatttatttttttgagacagagtctcgctctgtcacccaggctggagtgcagtggcgcgatctcggctcactgcaacctccgcctcccaggtttaagcgattctcctgcctcagcctcctgagtagctgggattacaggcatgcgccaccatgcctagctgttgagtatatttttatgtgctttttggccatttgtatatatttggagaaatgcctgttcacaccctttgcccatttaataattgggttgtctttttgttgagttataagcactctttatatattcta

SEQ ID NO: 139086 - DNA, 601 bp, Human
gggaggctgaggcagaaggatcacttgagcccaggaatttgagaccagccagggcaatatagtgagacctcgtttttaagaaaaaaaaaaacattaactggatgtggtggcatttgtctgtggttctagctacttgggtggctgaggtgggaggattgcttgagcccaagaggtcaaggctacagtgagccgtgattgcaccactgcctggctaatttttgtgtttttagtagagacggggtttcgccatgttggccagactggtctccaactcctgacctcaagtgatcttgacctcaartgatcatcccaaagtattgggattacaggcatgagccaccgcacccagccaccatagctttttaatttttttgagatggagtttcactcttgttgcccgggctgcacaatcttggctcactgcaacctctgcctcccaggctcaagcaattctattgcctcagcctcccaagtagctgggattacaggtgtgcaccacttcacctggctaattagtagagatggggtttcactatgttggtcaggctggtgaccaacctgatctcctgacctcaggtgatccacccacctctgactccca

SEQ ID NO: 139087 - DNA, 601 bp, Human
gagaactggcatcttgacaatattgagtcttcctatccatgaacatgggatatcattttttaaaaattcatctttgatttctgtcatcagagttttgtagttttccccatatagatgtgtactttttttttttttttttttaaagagaaagtcttgctctgtttacccagactggagtgcactggtgccatcacagctcactacagccttgaatttttgggctcatggcaatcctttcatttcagcctcctaagtagctaggactataggtgtgcaccaccatgcctggctaattaaaaawatatatatatattttttgttagagacaggggtctgactgtgttgcctaggctggtctctaactcctaggctcagcctcccagtgttgggattgcaggcatgagccatcacttccagcccatattttgttatatttatgcctaaataaatatttcatttctttgggtatcccttaattttttagacattgttttctttagttctgtgaacatatttatgatagctaatttattgtgtctagttattctgacattgggctttttcagagatcgtttctgttgactgcttttttactgtgtat

SEQ ID NO: 139088 - DNA, 601 bp, Human
tattgagtcttcctatccatgaacatgggatatcattttttaaaaattcatctttgatttctgtcatcagagttttgtagttttccccatatagatgtgtactttttttttttttttttttaaagagaaagtcttgctctgtttacccagactggagtgcactggtgccatcacagctcactacagccttgaatttttgggctcatggcaatcctttcatttcagcctcctaagtagctaggactataggtgtgcaccaccatgcctggctaattaaaaatatatatatatattttttgtyagagacaggggtctgactgtgttgcctaggctggtctctaactcctaggctcagcctcccagtgttgggattgcaggcatgagccatcacttccagcccatattttgttatatttatgcctaaataaatatttcatttctttgggtatcccttaattttttagacattgttttctttagttctgtgaacatatttatgatagctaatttattgtgtctagttattctgacattgggctttttcagagatcgtttctgttgactgcttttttactgtgtatgggccatgtttttctttttt

SEQ ID NO: 139089 - DNA, 601 bp, Human
tcttcctatccatgaacatgggatatcattttttaaaaattcatctttgatttctgtcatcagagttttgtagttttccccatatagatgtgtactttttttttttttttttttaaagagaaagtcttgctctgtttacccagactggagtgcactggtgccatcacagctcactacagccttgaatttttgggctcatggcaatcctttcatttcagcctcctaagtagctaggactataggtgtgcaccaccatgcctggctaattaaaaatatatatatatattttttgttagagacrggggtctgactgtgttgcctaggctggtctctaactcctaggctcagcctcccagtgttgggattgcaggcatgagccatcacttccagcccatattttgttatatttatgcctaaataaatatttcatttctttgggtatcccttaattttttagacattgttttctttagttctgtgaacatatttatgatagctaatttattgtgtctagttattctgacattgggctttttcagagatcgtttctgttgactgcttttttactgtgtatgggccatgtttttcttttttttaatgt

SEQ ID NO: 139090 - DNA, 601 bp, Human
gcaccaccatgcctggctaattaaaaatatatatatatattttttgttagagacaggggtctgactgtgttgcctaggctggtctctaactcctaggctcagcctcccagtgttgggattgcaggcatgagccatcacttccagcccatattttgttatatttatgcctaaataaatatttcatttctttgggtatcccttaattttttagacattgttttctttagttctgtgaacatatttatgatagctaatttattgtgtctagttattctgacattgggctttttcagagatcgtktctgttgactgcttttttactgtgtatgggccatgtttttcttttttttaatgtttaaaaaaacttattactttattattttaatttaatttaatttttatttttattttatgacagagtcttgctctgttgcccaggctggagtgcagtggcatgatctcagctcactgtgacctctgcctcctgggttccagcgattctcctgccttagcctcctgagcagctgggattacaggtgtgtgccaccaaacccagctaatttttgtatttttagtagagacgggatttcaccatgttggc

SEQ ID NO: 139091 - DNA, 601 bp, Human
ttaggggcttttcaggtccttcctgggtaagcgcatgttctttacatgcaggaataagcttttcaaggcccatgtggccatctcattccccagattttccttttttttttttttttttttcaggctagccccttgttttactcaactggtattgtcacttcaggcggctgcagtgttaaacagttgctgttgattgctcatctactctggggatgggactattcacacagagtgactctaagtttgatcatattctccagccctgagtctcagcaagctgccagataggcataatagtgayggttacctgagaatgggcttcttgagaagctccaaacctgttcttttcccaccagtggttgctagtcttctgtttctcatggccaccatgattatgaggtttccaatttttgtcttttgcagaactggagagagaggcatgggaataatggaataatgggaatggggcaagttaaaacacacacagtttcttttttttgagacagggtctcactctgatgcccaggctggagtgcagtggcatcattatggtttactgcagcctggacttcctgggctcaggtgatccacctcagcctcc

SEQ ID NO: 139092 - DNA, 601 bp, Human
gtttagacttcttgttttttatttcacacatgctcataattgctgcttgtagcacttttctgatggctgctctaaaatctttgttatacagtttcagcatgtctgtcatcttggtgttggcatctgttaattgtcttttttcattcatattgagatttcactggcctttagtgtggcgagtggcttctgattggaatctggacttttagatattgtgtgtgagactctgggtctcatttaggccttctgattttgctggcttctcaggactctggcagggaaagtggtggtgttggggctygtttctgctaggtaagggtagaagtcgagattcaccaccaggccttgtgtggaccacctaaggtggtccttgttactcatgggtggaaatgctccctccatgtcctccgctgacgccaaggaaaagtagcatcattctcattgggtggtggtggaattcctgactccaccaggctgcctctgataccactgcaatggagaggggaggggcacctcttaactgctgagttgggggtagaagtccagatttcactctccactgactctggcagttgctccttactgctgagtgagggtgaaa

SEQ ID NO: 139093 - DNA, 601 bp, Human
ttcttgctctgtcatccaggctggagtgcagtggtacaaccacggctcactgtagcctccatctcctgggctcaagagatcctcctgccttagtctcctgagtagctgggactgcaggcatgtgccaccatgcccagctggttttttccttatttttgtagcaacgggatctccctatgttgccaggtctggtctctaactctagggtacaagtaatcctcctgccttggcctcctaaagttccgggattacaggcatgagccactgcatctggccttgatacatttttttttctttcccrctaaataccagaagaacatgatgaattttctgttgactttcccatctgggtggacttttagtaacctctagagtcctcagtttacttctgtcacccacctgttcacagagggatggatgtagtagccttttgctcagtttctttggcttttgtcagtgatgtttgtcattcatctgttcaaatgtttattgagaacctattttgctggggctgatgaggcctaggaagatgccctgtaggaatgcatgtgtagcgtcagatgttttttatctatgttatgttatttgatctttgcaactt

SEQ ID NO: 139094 - DNA, 601 bp, Human
gagtagctgggactgcaggcatgtgccaccatgcccagctggttttttccttatttttgtagcaacgggatctccctatgttgccaggtctggtctctaactctagggtacaagtaatcctcctgccttggcctcctaaagttccgggattacaggcatgagccactgcatctggccttgatacatttttttttctttcccactaaataccagaagaacatgatgaattttctgttgactttcccatctgggtggacttttagtaacctctagagtcctcagtttacttctgtcacccacstgttcacagagggatggatgtagtagccttttgctcagtttctttggcttttgtcagtgatgtttgtcattcatctgttcaaatgtttattgagaacctattttgctggggctgatgaggcctaggaagatgccctgtaggaatgcatgtgtagcgtcagatgttttttatctatgttatgttatttgatctttgcaactttggaagtcagcagttataatctctcatagatgaggaaacagacccacagagatgaaggaaccaaggtagttccaccaaatgttgtttccttgaaggtag

SEQ ID NO: 139095 - DNA, 601 bp, Human
tcattcatctgttcaaatgtttattgagaacctattttgctggggctgatgaggcctaggaagatgccctgtaggaatgcatgtgtagcgtcagatgttttttatctatgttatgttatttgatctttgcaactttggaagtcagcagttataatctctcatagatgaggaaacagacccacagagatgaaggaaccaaggtagttccaccaaatgttgtttccttgaaggtagtggggcaactatttacttccaagaatgttttctataccagtgattaggggacttgagtgttggccaratatgattgaaattgggccaggtgcggtgtcacacctgtaatcccagcactttgggaggccgaggggggtggatcacttgaggtcaggagtttgagaccagcctgaccaacttagtgaagccctgtctctactaaaattacaaaattagcggggcatggtggcgcacgcctgtaatcccagctacttgggaggctgaggcaggagaattgcttgaacctgggaggcagaggttgcagttagtcaggattgcgccattgtactccagcctgggtgacaagagcaaaactccatctcaaaaa

SEQ ID NO: 139096 - DNA, 601 bp, Human
aagtcagcagttataatctctcatagatgaggaaacagacccacagagatgaaggaaccaaggtagttccaccaaatgttgtttccttgaaggtagtggggcaactatttacttccaagaatgttttctataccagtgattaggggacttgagtgttggccaaatatgattgaaattgggccaggtgcggtgtcacacctgtaatcccagcactttgggaggccgaggggggtggatcacttgaggtcaggagtttgagaccagcctgaccaacttagtgaagccctgtctctactaaaawtacaaaattagcggggcatggtggcgcacgcctgtaatcccagctacttgggaggctgaggcaggagaattgcttgaacctgggaggcagaggttgcagttagtcaggattgcgccattgtactccagcctgggtgacaagagcaaaactccatctcaaaaaaaaaaaaaaaaaaaaaagaaattgacttgcccccctccactcagtctttaccgagtacatatttgagtgctgctgtgccagccatcgtggatgtggtggtgaccagtgcaggcagggctgtgttcccatggcacttgc

SEQ ID NO: 139097 - DNA, 601 bp, Human
ttgagacagggtctccctctgtcgcccagtctggagtgcagtggtgtgatctcggctcactacaacctccacctcctggattcaagcgattctcttgcctcagcctcctaagtagctgggattacagacgtgcgccaccatgcccagctaatttttgtatttttggtagacatggggtttcaccatgctggtaaggctcttctcgaactcctgacctcaagtgatctgcctgcctcggcctcccaaagtgttgggataacagacgtgagccactgttgggataacaggcgtgagccactgygtttagtggttagtgcctttagaatcctgaagttattgatgaataggtcgaagtgcagagctattgttttggagttgtttgacaatgagcagttgttttgactaaaagggatcatcagagaaagtgttgcttttgtaaggaacagaacttgcttgaatgagttgtttgaaattgttttctctgaataactgagtgaataggaaacaaaaggatagctgaggccctgtgtcttgttctttctcacccatgatgtaaattaactcattatcgtacaatcaggatcaagttgctttagaattc

SEQ ID NO: 139098 - DNA, 601 bp, Human
ctcactacaacctccacctcctggattcaagcgattctcttgcctcagcctcctaagtagctgggattacagacgtgcgccaccatgcccagctaatttttgtatttttggtagacatggggtttcaccatgctggtaaggctcttctcgaactcctgacctcaagtgatctgcctgcctcggcctcccaaagtgttgggataacagacgtgagccactgttgggataacaggcgtgagccactgcgtttagtggttagtgcctttagaatcctgaagttattgatgaataggtcgaagtscagagctattgttttggagttgtttgacaatgagcagttgttttgactaaaagggatcatcagagaaagtgttgcttttgtaaggaacagaacttgcttgaatgagttgtttgaaattgttttctctgaataactgagtgaataggaaacaaaaggatagctgaggccctgtgtcttgttctttctcacccatgatgtaaattaactcattatcgtacaatcaggatcaagttgctttagaattcctctctgtcagtgcatgaaacaaaatgacacagagaaaccatcctgattgatttt

SEQ ID NO: 139099 - DNA, 601 bp, Human
ccgcaatctccgcctcccgggttcaagtgattctcccacctcagcctcccaagtagctggggattacaggcatgtgccaccacacccggctaatttgtttgtgtttttagtaaagacagggtttctccatgttggtcaggctggccccaaactcccagcctcaggtgatctgcccgcctcggcctcccaaagtgctgggattacaggcgtgagccactgctcctggccactctcttgataattttttaaaaactattttgattttttttgtaaggatgaattcaaagttatatgaatactraatcttacatcttgggatatttatcaaatgttattaaaatattctgtgtttatgatgctccctcttttcccttaggacaaatattctgtcttacacacacatagataaatatattttactgacttcactgtttttgacctgaacagtcttgctcctgtgaaggtttatcatcttttccttggaaatataaattacattcctcatagataggaccagaccaataaatgtttacttacgtgtgtctgagattgtttgtttgtttgtttgtttgtttatttgagacagggtctttctctgttg

SEQ ID NO: 139100 - DNA, 601 bp, Human
atgaattcaaagttatatgaatactaaatcttacatcttgggatatttatcaaatgttattaaaatattctgtgtttatgatgctccctcttttcccttaggacaaatattctgtcttacacacacatagataaatatattttactgacttcactgtttttgacctgaacagtcttgctcctgtgaaggtttatcatcttttccttggaaatataaattacattcctcatagataggaccagaccaataaatgtttacttacgtgtgtctgagattgtttgtttgtttgtttgtttgtttrtttgagacagggtctttctctgttgcccaggcaggagtgcagtggtgcaattatagctcagtgcagccttgaccttctgggctcaagtgattctcccacctcagcctcccaagtagctgggactacaggcgcgtgctaccacgcccagctaatttttgtatttttagtagagacagggtttcaccatgttggccaggatagtttcgatctcttgaccttgtgatccacccgcctcagcctcccaaagtgctgggattacaggcgtgagtcactgtgcctgggccagctaattttttttta

SEQ ID NO: 139101 - DNA, 601 bp, Human
attcctcatagataggaccagaccaataaatgtttacttacgtgtgtctgagattgtttgtttgtttgtttgtttgtttatttgagacagggtctttctctgttgcccaggcaggagtgcagtggtgcaattatagctcagtgcagccttgaccttctgggctcaagtgattctcccacctcagcctcccaagtagctgggactacaggcgcgtgctaccacgcccagctaatttttgtatttttagtagagacagggtttcaccatgttggccaggatagtttcgatctcttgaccttgygatccacccgcctcagcctcccaaagtgctgggattacaggcgtgagtcactgtgcctgggccagctaatttttttttatttttgtagagacgaggtctccctgtgttgcccaggctggtctcaaacccctgggctcaagccattctcctgccttcgtctcaaagtgctgggattacaggtgtgagccatcacccagctttaaaaagtatattgaaaataggatgatttaagcatgagttttttgtgtgtttgtttgtttgtttgttcgtttttcagtagagatggagtttcaccatgtt

SEQ ID NO: 139102 - DNA, 601 bp, Human
tatttttagtagagacagggtttcaccatgttggccaggatagtttcgatctcttgaccttgtgatccacccgcctcagcctcccaaagtgctgggattacaggcgtgagtcactgtgcctgggccagctaatttttttttatttttgtagagacgaggtctccctgtgttgcccaggctggtctcaaacccctgggctcaagccattctcctgccttcgtctcaaagtgctgggattacaggtgtgagccatcacccagctttaaaaagtatattgaaaataggatgatttaagcatgarttttttgtgtgtttgtttgtttgtttgttcgtttttcagtagagatggagtttcaccatgttggccaggctggtcttgaactccttgtcccaagtgatctgcccgccttagcctcccaaagtgctgggattacaggcgtgagctgccgtgcccagccaaatttaaatttcttgaaataattgctaacactgtagcaaagctttcctttgttgtgtagtgcatataggaaaccaggttgatgtgaaatttctaacagctcataagagtctacatactaatagtatttagtactttctagtg

SEQ ID NO: 139103 - DNA, 601 bp, Human
gtggctcatgcctgtattcccaacactttgggatgccaaggccggcagattacctaaggtcaggagttcaagaccagcctggccaatatgatgatgaaaccccatctctacaaaaaatacaaaattagccgagcgtggtggcacaccctgtaatcccagctactcgggaggctgagacaggagaatcacttgatccagaggtggaggctgcagtgagccgagatcatgtgaccgcactagccaagatcacgccactgcactccagcctgggcgacagagcaagactccatctcaacaacaraaaaaagccagatgcggtgggaagaagctcctgcaagaggccacggagccagcgacgggaggccttgaagccagtgacgacccactcagccgagctgccgctttcgcagcacgccaaggacactcatgaggaccatgatacttccactgagaatgcagatgagtccaaccatgaccctcagtttgagccaatagtttctcttcctgagcaagaaattaaaacgctggaggaagatgaagaacttttaaaaatgcagacgaaactgttctgatttgcctcagagaaggatctcccagaatg

SEQ ID NO: 139104 - DNA, 601 bp, Human
tcatgtgaccgcactagccaagatcacgccactgcactccagcctgggcgacagagcaagactccatctcaacaacagaaaaaagccagatgcggtgggaagaagctcctgcaagaggccacggagccagcgacgggaggccttgaagccagtgacgacccactcagccgagctgccgctttcgcagcacgccaaggacactcatgaggaccatgatacttccactgagaatgcagatgagtccaaccatgaccctcagtttgagccaatagtttctcttcctgagcaagaaattaaaacrctggaggaagatgaagaacttttaaaaatgcagacgaaactgttctgatttgcctcagagaaggatctcccagaatggaaggagtgaggcaccggcaacgtcaagctcctgaaacacaaggagaaagggaccatctgcctcctcatgcggagggacaagaccctgaagatctgtgctaaccactcttcacgctgataatggagctgaagcccaacatgggtagtgaccatgcctgggtctggaacacccacgccgacttcgccaacgagtgccccaagccagagctgctggccatccact

SEQ ID NO: 139105 - DNA, 601 bp, Human
ctcctgaaacacaaggagaaagggaccatctgcctcctcatgcggagggacaagaccctgaagatctgtgctaaccactcttcacgctgataatggagctgaagcccaacatgggtagtgaccatgcctgggtctggaacacccacgccgacttcgccaacgagtgccccaagccagagctgctggccatccacttcctgaatattgagaatgcacagaaattcaaaacaaagtttgaagaatgcaagaaagagatcggagagaaaagaaaggatcgggcaaaaacgatcatgccaaaaaagtggcggaaaagctagaagctcttttggtggaggaggaaaccaaggaggatgctgaggagaagcaataaatcatcttattttatttccttttcctccctttcctttccttttcaaattttaccctgcccctccttttcggtttgtttttattctgttttgtttttacaagggatgttatataaagaactgaattcaacattcaaaaaaaaagattaaagcataaatcaatgaaatagaaaacaaaaaccagaaaaaagctaaaaagctgattctttgagaaaatcaatgcaattgataaa

SEQ ID NO: 139106 - DNA, 601 bp, Human
acatggtaaaaccccatctgtactaaaaatacaaaaaagttagccagatgtggtggtgcatgactgtagttctggctatttgagaggctgaggcaggagaatcgcttgaacccgggaggcagaggttgcagtgaactgagaaatcctgccaccacacttcagtctgggcgacagagcaagactccatctcaaaaaaaaatcagacaaaaaaaggcaactttatgatttcacttacgtgaaattctagataggtgaaactatagtgacagaaagcagatcagctgttgcctggggcaacacktagtgaaaaatcactaaggggcataaggagatgcttgtggtgatgacgttccttatcttgattgtgctaatgcttatatgggcacatacagccttcagagctcatgaaattatatactttagatatgcacagtttctcatatctcagttttacctccctaaaactattaagaaatttgtgcttaatactttggtgagcattttatgccctttgccccatgtagttggttctcactggtaggtaggcaggcaggtagaattagcagctttaggtgagacagagctgagcggaggttccttc

SEQ ID NO: 139107 - DNA, 601 bp, Human
catggtaaaaccccatctgtactaaaaatacaaaaaagttagccagatgtggtggtgcatgactgtagttctggctatttgagaggctgaggcaggagaatcgcttgaacccgggaggcagaggttgcagtgaactgagaaatcctgccaccacacttcagtctgggcgacagagcaagactccatctcaaaaaaaaatcagacaaaaaaaggcaactttatgatttcacttacgtgaaattctagataggtgaaactatagtgacagaaagcagatcagctgttgcctggggcaacactwagtgaaaaatcactaaggggcataaggagatgcttgtggtgatgacgttccttatcttgattgtgctaatgcttatatgggcacatacagccttcagagctcatgaaattatatactttagatatgcacagtttctcatatctcagttttacctccctaaaactattaagaaatttgtgcttaatactttggtgagcattttatgccctttgccccatgtagttggttctcactggtaggtaggcaggcaggtagaattagcagctttaggtgagacagagctgagcggaggttccttca

SEQ ID NO: 139108 - DNA, 601 bp, Human
gctgactacactgttgtctgtgtggtttttttcctcattcttcgttttttttttaagttggcaaaaactcattaacacctttcttggccagatagtagcgaatgcatttctgattaccttgtaaattgtaaggccgtttagaagcagtctgtccttctttgcaagacctgtgaaaatgtttggactattgagacagttgcaatgcttcagggaagtccattcattcattcagcagtatatactagagtgtagtttaacataagcaaaaagctttttatatacaaagttattgactgtgatttttttaatgcaaaatattagaaaggtttaaatggtttaccagagtgtagggcttggtaaattatactgtgtcagtacagctaattatgcagccctttgaaataatcaagactatctggaaacgagaaaaatatatggaatatatatgaacaaggcagaatataagattgtatacctatttgtcttagttcaggctgctgtgatgaaataccttagactgggtaatataaacaacaaatttattgctcacagttctagaggctgtgaaggtcaagataaaggcgccagcactgaccccgtg

SEQ ID NO: 139109 - DNA, 601 bp, Human
actcattaacacctttcttggccagatagtagcgaatgcatttctgattaccttgtaaattgtaaggccgtttagaagcagtctgtccttctttgcaagacctgtgaaaatgtttggactattgagacagttgcaatgcttcagggaagtccattcattcattcagcagtatatactagagtgtagtttaacataagcaaaaagctttttatatacaaagttattgactgtgatgtttttaatgcaaaatattagaaaggtttaaatggtttaccagagtgtagggcttggtaaattataytgtgtcagtacagctaattatgcagccctttgaaataatcaagactatctggaaacgagaaaaatatatggaatatatatgaacaaggcagaatataagattgtatacctatttgtcttagttcaggctgctgtgatgaaataccttagactgggtaatataaacaacaaatttattgctcacagttctagaggctgtgaaggtcaagataaaggcgccagcactgaccccgtgatgggccgggcacggtggctcacgcctgtaatcccaacactttgggaggccgaggcgggtgaatca

SEQ ID NO: 139110 - DNA, 601 bp, Human
gggcacggtggctcacgcctgtaatcccaacactttgggaggccgaggcgggtgaatcacctgaggtcaggagttcgagaccagcctgatccacatggagaaaccccctctctactaaaaatacaaaattagccaagtgtggtggcgtatgcctgtaatcccagctccttgggaggctgaggcaggagaatcgcttgaacccgggagacagaggttgtggtgagccgagatcgcgccattgcactccagcctgggcaacaagagtgaaactccttctcagaaaaaaaaaaagataaaggcrccagcagatttggtgtctgtcgagggcctgttcctcgtagatggtaccttcttgctgcatcctcatgtggtggagaaaggtggaagactccctcaagcctctctgacaagggcactgacccccttcgtagagcagagtcctaacaaactagtcacctaaaagccctacctcttaataccaccacagtgggttccagcatgaatttggaaggacacaaaaattcagaccatagcattttgccccggcccctcaaaattcatgttcatcttacgtgcaaaatacattcattctatcctaata

SEQ ID NO: 139111 - DNA, 601 bp, Human
gagcctgtgaaatcaaacaggttgtatgcttccaaaatgcaatggtgggacagacattggatagacattcccattccaaaaaggagaagtgaggcccagtgtggtggttcacgcttgtagtcccagcgttttgggtagccaaggtgggagggttgcttgaggccaggagttcgagaccaaaagggagaagtaggaagaaagaaaggagtgacaggtcctgaccaagtctaaaacccaaccagacaaacaacattaaatcttaaggcttaagttgactcaaagccccgccttccacaaaaaytggggcaggggttggtcttgcaaagctctggatggccccactcccacagctttgctgggagcagcccatgcagcagctctcagtcactggattctcatgcctgcatctctcaggctggagttgcactctagtggttctaccagtcttgggtcttggggtggtcttgccccacaactccactgggcattgccctagtggggtctctctggtggccctgcccttgtgacagttctctgcttgggccctggcactctttggggcatcctttgaagtctgggtagaggtagatgtgcccccaca

SEQ ID NO: 139112 - DNA, 601 bp, Human
cttatcaaatgtttgcttggtggctgggcgcggcggctcacacctataatcccagcactttgggaggccgaggcaggtggatcacgaggtcaggagatcaagaccagcctggccaacatgatgaaaccccgtctctacaaaaaatacaaaaattagctgggcatggtggtgcgtgccttaaatcccaactactcgggaggctaaggcaggagaatcacttgaaccagggagttggaggttgcagtgagctgagatccaagactgtgccaccgtactccagcatggcaacagagtgagacaycatctcaaaaaaaaaaagaaaaaagaaaagtttgcttggctacacacttggagttctgtcctgaacatgtttttgctttttttttttttttttttttttttgagacagagtcttgatctgtcttccaggctggagtacagtggtgcgatcagatctcactgcagcctccacctcccgggcccaagccattctcctacctcagcctcccaagtagctgggactatagatgtgtgcaccaggcctggctaatttttttttttttttttggtagagacggggtcttgctttgttgcctaggtt

SEQ ID NO: 139113 - DNA, 601 bp, Human
ccttaaatcccaactactcgggaggctaaggcaggagaatcacttgaaccagggagttggaggttgcagtgagctgagatccaagactgtgccaccgtactccagcatggcaacagagtgagacatcatctcaaaaaaaaaaagaaaaaagaaaagtttgcttggctacacacttggagttctgtcctgaacatgtttttgctttttttttttttttttttttttttgagacagagtcttgatctgtcttccaggctggagtacagtggtgcgatcagatctcactgcagcctccacctcscgggcccaagccattctcctacctcagcctcccaagtagctgggactatagatgtgtgcaccaggcctggctaatttttttttttttttttggtagagacggggtcttgctttgttgcctaggttggtcacaaactcttgggctcaagcaatcctccctccttggcctcccaaactcttgggcttataggcctgagccattgcatccagccttgcttttacattctttacaagatggccaggctgataattttccaaatatttaagttctacctcccctttgatgataaatctcatcttt

SEQ ID NO: 139114 - DNA, 601 bp, Human
tctacctcccctttgatgataaatctcatctttaattcatcttcttggattttagtataagcagtcaagagcagccatgcaccctcttttgccaaagattctatttcactgcccttttttttttttttgagatggagtctcactctgtcacccaggctggaatgcagtggtgcaatctcggctcactgcaacctccagctcccgggttcaagcaattctcatgcctcggcctcctgagtagctagcactacaggtgcacaccaccacacctggctcatttttgtatttttaatagagatgrcattccaccatgttggccaggttggtctcaaaactcctgaactcaagtggtccgcctgcctcagcctcccaaagtgctggggttacagacatgaaccactgcacccgaccttttttttttttttttttgagacagtgttttactctcttgctcaggctggagtgcagtggtgtgatcacagctcacagcagccttgacctcctgggctcaatcgatcctcccacctcagcctcccaagtagctgggactgcaggcatgtgccaccatgtctggctaatttttgtattttatgtagagatg

SEQ ID NO: 139115 - DNA, 601 bp, Human
gagatggagtctcactctgtcacccaggctggaatgcagtggtgcaatctcggctcactgcaacctccagctcccgggttcaagcaattctcatgcctcggcctcctgagtagctagcactacaggtgcacaccaccacacctggctcatttttgtatttttaatagagatgacattccaccatgttggccaggttggtctcaaaactcctgaactcaagtggtccgcctgcctcagcctcccaaagtgctggggttacagacatgaaccactgcacccgaccttttttttttttttttttgagacagtgttttactctcttgctcaggctggagtgcagtggtgtgatcacagctcacagcagccttgacctcctgggctcaatcgatcctcccacctcagcctcccaagtagctgggactgcaggcatgtgccaccatgtctggctaatttttgtattttatgtagagatggagttttgccatgttgcccaggttggttttgaactcttgggctcaaagcgatccttccacctcagcctcccaaagtgctgaaattacaggtgtgagccaccatgaccagcctactgtctgtttttcta

SEQ ID NO: 139116 - DNA, 601 bp, Human
tggctaatttttgtattttatgtagagatggagttttgccatgttgcccaggttggttttgaactcttgggctcaaagcgatccttccacctcagcctcccaaagtgctgaaattacaggtgtgagccaccatgaccagcctactgtctgtttttctactagcattgtgatcatgaccacttagatcatttctaagaagattgaggctttctttacagctgttttcttctgagcctgtcttagtctgttttgtgttgctataacagactatataagactgggtattctataaagaagacaatttatttagctcacagttcttcgggctggtaagttaaagagcatagcatcacatctggcagtttctggtgagggccacacactaggttgaaacatggtggagaagaaaagtgagcaggcgggtgcagagaaatcacatggcaagagaggaaacgagagagcctgggaagccaaactcatttttataacaacctgttctcatgggaactaagtgccctgagagcaagaactcactcacccccataggaaggcattaatccattcatgaaggatctgcctctgtgacccaaacatctcccac

SEQ ID NO: 139117 - DNA, 601 bp, Human
gcattgtgatcatgaccacttagatcatttctaagaagattgaggctttctttacagctgttttcttctgagcctgtcttagtctgttttgtgttgctataacagactatataagactgggtattctataaagaagacactttatttagctcacagttcttcgggctggtaagttaaagagcatagcatcacatctggcagtttctggtgagggccacacactaggttgaaacatggtggagaagaaaagtgagcaggcgggtgcagagaaatcacatggcaagagaggaaacgagagagyctgggaagccaaactcatttttataacaacctgttctcatgggaactaagtgccctgagagcaagaactcactcacccccataggaaggcattaatccattcatgaaggatctgcctctgtgacccaaacatctcccactaggccccacctctcaatagcgcacactggggatcaatttttttttttttttgagacggagtcttgctctgtcgcccaggctggagtgcagtggtacgattttggctcactgcaagctccacctcctgggttcaagcagttctcctgcctcagcctcccga

SEQ ID NO: 139118 - DNA, 601 bp, Human
acccaaacatctcccactaggccccacctctcaatagcgcacactggggatcaatttttttttttttttgagacggagtcttgctctgtcgcccaggctggagtgcagtggtacgattttggctcactgcaagctccacctcctgggttcaagcagttctcctgcctcagcctcccgagtagctgggactacaggtgcatgccaccacacccggctaattttttgtattttagtagagatggggtttcaccttgttgcccaggctggttgaactcctgagctcaggcaatctgcctacctyggcctcccaaagtgctgggattacaggcgtgagccactgcgcctggcccaaatttttaacataagttttagtggagacaaactacatccaaaccaaagcagaactctcaccagagctcccctttacggtctgtacatagcaatacagtctttttctagccttttcctcttccagcctctgcccattacccagttccaaagccactcctgcattggtgggtatttaatacagcagcaactcacttctcagtaccaatttctgtcttagtttgttaaggctactataacaaaataccttaga

SEQ ID NO: 139119 - DNA, 601 bp, Human
gagtcacaaaaatgtgactcgaagtggttacaatttggggcttatatagcatcttaataggggaacaggaggggcagaaaaggcccctgtgggaaaacagatgacttctttttttttttttttgaaacgctcttttgcccagcctggagtgcagtggtgcaatcatggcacactgcaacctcggcctcccaggttcaggcgattctcctgggtagctgggactaccggtacatgccaccatgcccaggtaattttggtattattattattattattattattattattattattatttttwttttttttttttttttttttttttagtagagacagggtttcgccatgttggccaggctggcctcgaactgactgcaagtgattcgcccgcctcggcctcccaatgtgctgggattacaggcgcccggccaagatgactccttaataggggaagaggaggagggaggggactgatgggaagtgggcgctgaggagaaaagatgggagagaggctagtttttgacagcgtctgtttaggtgtggtctggacttcttctggtcttaagcgataagagtcagtcttccctggtgttcccaggga

SEQ ID NO: 139120 - DNA, 601 bp, Human
aaaaggcccctgtgggaaaacagatgacttctttttttttttttttgaaacgctcttttgcccagcctggagtgcagtggtgcaatcatggcacactgcaacctcggcctcccaggttcaggcgattctcctgggtagctgggactaccggtacatgccaccatgcccaggtaattttggtattattattattattattattattattattattattattttttttttttttttttttttttttttttagtagagacagggtttcgccatgttggccaggctggcctcgaactgactgcawgtgattcgcccgcctcggcctcccaatgtgctgggattacaggcgcccggccaagatgactccttaataggggaagaggaggagggaggggactgatgggaagtgggcgctgaggagaaaagatgggagagaggctagtttttgacagcgtctgtttaggtgtggtctggacttcttctggtcttaagcgataagagtcagtcttccctggtgttcccagggaggagatttatcacagttgagttctttggagttattttgtgaggctctgcttttcagcatataagggacttcaggaac

SEQ ID NO: 139121 - DNA, 601 bp, Human
ttattattattattattattattattttttttttttttttttttttttttttttagtagagacagggtttcgccatgttggccaggctggcctcgaactgactgcaagtgattcgcccgcctcggcctcccaatgtgctgggattacaggcgcccggccaagatgactccttaataggggaagaggaggagggaggggactgatgggaagtgggcgctgaggagaaaagatgggagagaggctagtttttgacagcgtctgtttaggtgtggtctggacttcttctggtcttaagcgatamgagtcagtcttccctggtgttcccagggaggagatttatcacagttgagttctttggagttattttgtgaggctctgcttttcagcatataagggacttcaggaactcaaatgctttcagctcaaaataatttttaggtcacagaggtatattctggactgttaggtttttgccttgcccaggagtttgctcatttataaatagagggaaaaaaaaaccagagaaggaactagtgtggttgggatagccatgcacacagctgggattccagctatactttgtagatcccaactgaggtgg

SEQ ID NO: 139122 - DNA, 601 bp, Human
gggactgagcttgagtttgcatctggctccatcacttatcagctgtgtgttcttgggcctgttgtttttctgaaaaagagcgacagcaagaggccatcctcagagtggacccatgataggccaagatggtggaaagcccaggacgagccctcaggacccagcactgcctgccttatgtgagtgagataggactgcagtggtgagacgttcagtgatgggccatggtgtggccaggaagacactagcctgactaccaggaggcccctggagggaagagatggactaagatagcagtatctgyggggagccaaccaaggaggactttgaataccagtaaatacactcgtgtcctagaaggcagcccacaaaggctctcgatccgggccatttagtgttcagcaggccaggcctgcatctgtgtttgggatagggctgcaagtgcagaggccagatccgggaggctgatgaagttgagcaggcacatgggaggagagcttgatctcttgggctatgctgtccagtcgggtggccactggctacatgtggctcctgcacactgggaacggggtggggagcagtgggagtgtgaaggacacacccc

SEQ ID NO: 139123 - DNA, 601 bp, Human
ggaagacactagcctgactaccaggaggcccctggagggaagagatggactaagatagcagtatctgtggggagccaaccaaggaggactttgaataccagtaaatacactcgtgtcctagaaggcagcccacaaaggctctcgatccgggccatttagtgttcagcaggccaggcctgcatctgtgtttgggatagggctgcaagtgcagaggccagatccgggaggctgatgaagttgagcaggcacatgggaggagagcttgatctcttgggctatgctgtccagtcgggtggccacyggctacatgtggctcctgcacactgggaacggggtggggagcagtgggagtgtgaaggacacacccctaatctgaaaactttaatgtaagtatctcattagtgaagttttattgactctgtgttaaaatggtaatattttgatatgttgaatcaaatcaaacatgttattaaaattaattttacctttttttgtgcttttgtaatgtggctactagaaaatctgaaattgcatatgtggctttcatttctgttgtgcgttattgctctaggggttggtaacaatgggaatgaaagtgaca

SEQ ID NO: 139124 - DNA, 601 bp, Human
tcccagctacttgagagtgaggtgaaaggatcacttgaacccaggaagtcgaggctgcagtgagccatgatggtgccactgcactccagcctgtgtgacagagtgagaccctgtctctaaaaaagatagcaggagggaatgaacatttttagtgtattagtctccagtacagcccttttaattgagtgatgattttccactttatagataaacaggatcagaaagagaaagcgacttccctgcagtcacatagtgacaagctggacatgtctgactaaaacctgtgctttttccactgtgytcttgggtctcttggacttagtaatggggatttaaggaggaggaaggcagtgagatagagccagggttcaggatttggggctgggagggtgttaataaagcgtttggctcaggacctcaaagccttttgcttgtgtgtgcatttctcacagcctcacgtgcccaggctgttggtgctggggggtaggcctggggctgccgctccctttcagaatccttgcctggcctcagaggggcttgtgtctaggaacctcagcagaaccctgcaagggctggctgggaccattggtgagatgagcca

SEQ ID NO: 139125 - DNA, 601 bp, Human
cagctgcccgacgtgtcatctcaggtcaccagaaactttgacaggaaacagcaatttcttttttttttctttgagactgggtctcactttgtcacccaggctggagtgcagtgacaatcacggctcactgcaaccttgacctcccaggctcaagcgatttgtccacctcagcctcttgtaaacagcatttttatggctaataacccatcgtatgaatgtggcttagactgcccaaccacagcctaatttggggtttttatgttttcttctgttctttgcccttataatgtggcaggaaatrtatgtggataaaacacttttcccatactttggcttatttcatttcaagcttctaaaagtgagattaatgagtcagaaggtatgaatataaggctttttgtcaaattgatttcctagagggtgattcattatactttttcaccggcattgaggtcaagtgtcctgggagtaggactgttgaaaatgtaaaaagtcacttcagttctggaatttatcttgctttgctttgttttgttacacttttttgccctctcctgatgctcacctggggtcacacattgcctctggttgtcatatgtct

SEQ ID NO: 139126 - DNA, 601 bp, Human
tggcatatggcgcatatatatatatataatttttttttttttttttttttttgcgacagggcctcactctctcacccaggctggagtgcagtggtgcagtcgtggctcactggagccttgacctcccgggcccaagtgatcctctcacctcagccccctaagtagctgtgactactgtcatgcaccaccacgccctgctaatttttgtatttttttatagagacagggtttcgccatgttgctcaggctggtctcaaactcctgaactcaggcaggcaatctgtccacctcggcctcccaragtactgggattacaggcatgagccaccatgcccagcctactttatatattttggatactagactcttaccagatacatgatatgcaaatattttctgccattctgtaggggttttttttacttttttatttttatctatttatttatttttatttatttattttttgagacagagtctcgctctgtcacccaggctagagtgcagtggcatgatctcggctcactgcaagctccacatctcaggttcacgccattctcctgcctcagcctcccaagtagctgggactacaggcgcccac

SEQ ID NO: 139127 - DNA, 601 bp, Human
agccttgacctcccgggcccaagtgatcctctcacctcagccccctaagtagctgtgactactgtcatgcaccaccacgccctgctaatttttgtatttttttatagagacagggtttcgccatgttgctcaggctggtctcaaactcctgaactcaggcaggcaatctgtccacctcggcctcccaaagtactgggattacaggcatgagccaccatgcccagcctactttatatattttggatactagactcttaccagatacatgatatgcaaatattttctgccattctgtaggggktttttttacttttttatttttatctatttatttatttttatttatttattttttgagacagagtctcgctctgtcacccaggctagagtgcagtggcatgatctcggctcactgcaagctccacatctcaggttcacgccattctcctgcctcagcctcccaagtagctgggactacaggcgcccaccagcacacttggctaatttttttttttttttttttttttgtatttttagtagagacagggtttcaccatgttagccaggaaggtcccgatctcctgacctcgtgatccgcccg

SEQ ID NO: 139128 - DNA, 601 bp, Human
tactttatatattttggatactagactcttaccagatacatgatatgcaaatattttctgccattctgtaggggttttttttacttttttatttttatctatttatttatttttatttatttattttttgagacagagtctcgctctgtcacccaggctagagtgcagtggcatgatctcggctcactgcaagctccacatctcaggttcacgccattctcctgcctcagcctcccaagtagctgggactacaggcgcccaccagcacacttggctaatttttttttttttttttttttttgtatttttagtagagacagggtttcaccatgttagccaggaaggtcccgatctcctgacctcgtgatccgcccgcctcagcctcccaaagggctgggattacaggcgtgagccaccacgcctggcgtggaattgctttctcaattccctcttttgattgttcagtgctgctgtgtagcagctgattttgtgtgttgattttgtacttggcaacttggctgaattcatatattattagctttggtaggtggatttgtggattcttgggtattttcaatatgtaggaacatgtcatctgcta

SEQ ID NO: 139129 - DNA, 601 bp, Human; identical to SEQ ID NO: 25828

SEQ ID NO: 139130 - DNA, 601 bp, Human; identical to SEQ ID NO: 25829

SEQ ID NO: 139131 - DNA, 601 bp, Human; identical to SEQ ID NO: 25830

SEQ ID NO: 139132 - DNA, 601 bp, Human; identical to SEQ ID NO: 25831

SEQ ID NO: 139133 - DNA, 601 bp, Human; identical to SEQ ID NO: 25832

SEQ ID NO: 139134 - DNA, 601 bp, Human; identical to SEQ ID NO: 25833

SEQ ID NO: 139135 - DNA, 601 bp, Human; identical to SEQ ID NO: 25834

SEQ ID NO: 139136 - DNA, 601 bp, Human; identical to SEQ ID NO: 25835

SEQ ID NO: 139137 - DNA, 601 bp, Human; identical to SEQ ID NO: 25836

SEQ ID NO: 139138 - DNA, 601 bp, Human; identical to SEQ ID NO: 25837

SEQ ID NO: 139139 - DNA, 601 bp, Human; identical to SEQ ID NO: 25838

SEQ ID NO: 139140 - DNA, 601 bp, Human; identical to SEQ ID NO: 25839

SEQ ID NO: 139141 - DNA, 601 bp, Human; identical to SEQ ID NO: 25840

SEQ ID NO: 139142 - DNA, 601 bp, Human; identical to SEQ ID NO: 25841

SEQ ID NO: 139143 - DNA, 601 bp, Human; identical to SEQ ID NO: 25842

SEQ ID NO: 139144 - DNA, 601 bp, Human; identical to SEQ ID NO: 25843

SEQ ID NO: 139145 - DNA, 601 bp, Human
aacagttggtaagtagcagggccttccaggctgggatgggtgcagtgaggccaggcaggtcagttgaaatggccggtcctggaacacagagcccggcagcccagccgggagggctgtccgcctgaggctggatccgccaggctgtggagggagggacaggaagaagcaggtgggtgctgcagggaggcagatgccagctcagagcagagagcggaaggaatcttctaagatccagagccatctgcccaactgcagcacaggctgatggcttctcctcactgtccctgtagcatggggttgyggagggtatcatccctgggggcctggctgaagtcagcacctcatggagggagccccgctgtagaacgccgggagaggctcttcccaagcatttgcaccaggcactgtgcagacagctgcacacgcctcctctcggatggccaccccaacggccccatgaggggtattgctatcctctccattgggacagttaggaaattgaggcccagagaggggaaggaacttgcttgcatttgcatggctgggatgtggtggagtccattccactcagattttctccctctcagactctctcaccatt

SEQ ID NO: 139146 - DNA, 601 bp, Human
gccaagaggaggagaggcatccctgcagggctgcaggtggggcgccaatggcctcgccaggggcatatggatgtggagccaccccttcttgctggggaaagaagggaagaaggtgaggggggaagtggcagaaggaggtcagggatgggaaggggaatcaagaagggcgtctctggggtgaggatagaagatggggatgggacggggcagggttgggaagaatgtgggagaacaaggcaggcctggccccttgggtctttccctaccccctgcataggtggcggtgttcctggtggacacrggggatgccatgagccctgagctgagcagggaaacaaggatcaagctctgtgctctcaccacgatgctgagctcctaccaggtgatggggggcgctgatgttggcatccccaccccacacacccttctccagctcagcttcctcaaggccagagcatctcacaggctttggtgtctggggtcctgataggttctggggctgccttagaagggggaaggtgctcctagttggtgaaggtgggaacgtgggttattcctaaaagtgggctgatggtcccaggggcagctgaagacctgatgg

SEQ ID NO: 139147 - DNA, 601 bp, Human
tctcatacatgttgttctctctgattccagatcctcagcacctcccaggagctgaaggatacagacctggactatctggaggtaaagagacctctgatgttggggcatcccccacccccaccctccccactagggctggacccaaaggaactaggtgccctcctggtctggcctagggttttatgacacttgaacagggttgaagggggagggtggagagtaaagcaagagatgtgtggtctggggagaggcaggagaaccccaggctgcaaaagggggagcctagctcctacagcaggcktagggaggtggggagacaggcttggggtgcaccatagtcctcaaagtggcccagccctgacgctttctgtgtcccacccccagatgtttgtccacgtggccgaggtgatgggcaagcattatgggatggtgccaatccaggtgagacacctatctctggattcattggccccaggccccgccacccccatttgctggtgtcaggaccccttctctttcagcatctggacctcttagttcgtgactcatcccaccccaacaaggcagggcaggggcatgtaggcaacatcttccaggtgag

SEQ ID NO: 139148 - DNA, 601 bp, Human
agccctgacgctttctgtgtcccacccccagatgtttgtccacgtggccgaggtgatgggcaagcattatgggatggtgccaatccaggtgagacacctatctctggattcattggccccaggccccgccacccccatttgctggtgtcaggaccccttctctttcagcatctggacctcttagttcgtgactcatcccaccccaacaaggcagggcaggggcatgtaggcaacatcttccaggtgagtggtgcaaggggatggggtggaggggccatggacagggcagaggtggggaagrcatgggaggctggacctcctagctcagagcactcctctcgctgcctcacagagattgtctggcagataccccaaggtgcaggagctgctgcaagggaagcgagcccgttgctgcctcttgcctgccccagggaggcggcggatgaaccaaggccatgcaagccctggtggtgagtgtctctgagagctgaacctctcttgcgctgctcccagctcccctccggcaaccgagccccttgaagcacccacctctcctggcctctgacaccccttctcctcccaaagcccgcagtctctcagc

SEQ ID NO: 139149 - DNA, 601 bp, Human
tgtgccgaggcctccggggtgggggtctgtgtgccctgggagtggagatgaggaaacaagcagcgcccctggctgagaaggaaggaaggaggcagcctgggttttcccgtggacagatggctgctcagctgcacgacctgaggaaggtggaagctgccaagagggagttcgaggagtatgtgaggcagcaggtgagccccggggctgcacgggaggcaggtgtgggccgggcagggtccagatcagggagaggatacctgggactcctggtcagggcaccttcttttcccctccctgtcayaggacgtagccaccaagcgcatattctctgcgctgcgggtcctgccagacaccatgcggaacctcctctccacccagaaagatgccattctggcccgccatggtgtggccttactctgcaaggggagagatcagaccttggaggcactggaagctgagctgcaggccacggccaaggccttcatggactcctacacgatgcgcttctgtggccacctagctgctgtggggggtgctgtgggggccgggctcatgggcctggcagggggcgtggtgggtgctggcatggcagcagctgcac

SEQ ID NO: 139150 - DNA, 601 bp, Human
cctggattgtaggaaagttaagcaggcaccatcctggaagtctacccctaggtggtcgagagacctgttctttcacagatgtgagaagccccaggatgattgaccatggtgttcaggagcggggagcactgatgaggtgctggggatgacaggaaggaaggaacactgggcagaaccagagagatgggacatggtagactgtggcccagaccccagagcagagaaacttgttcccatgacccttcccaaatctgctccagcaggactaaggtggctttcccactcctggcccacagccccrgagagcctgtctgtgcatcctgaaccactctttgctgggcctccgcaagggcctctcttgggtctgtgtcctttttcaagcctgtttagatgggggagtgcccatgccctctgtgaagtgcccaaatgcgaaagaataacaccttttcttgcattctgagctaagccagacagcctttatactagattctatcaaaatcttgcaaaggaaaacaaaatgaacaacttctacccttaaacacatcctttctcccctgggcttgtaagaagatgcagcttgatgcagctcctcaaacaccag

SEQ ID NO: 139151 - DNA, 601 bp, Human
agaggcaaggctttgggaaggatggcttttaagctgttctcccatccagaaacacagggacagacagacagaaagggagtccacatgggtccccatagtccccctctcccaccttcaagctccctgctgcctgctgcttctctgaaaggcctgggacatccttgcccagagctgggcagtgcctcgtgccccacctttcccgccgctccttgtaggccttgtccaccagctgcttggcctcctccatggagctcagcaccaacgaggtgtccacctcccccaggacagctgcccagagcarggatcacaaagtcaggaatgggccccaaccccctatcaggccccagagctaggaaggcctgctctgagaaaaggggtctctggaacacaaccaccccaacacaccatcttctcccaccttgggaactgttacctggagcagcaccttcagagggctggggcgtggccagaatggccaggagccctgctagggccagaagcagcttcatctctgcagtgagacccccagcccagcaaggtcctaagtccaccatgcatctgagagaagagaagaagggaacccccatctctcttctcctgg

SEQ ID NO: 139152 - DNA, 601 bp, Human
cctcaccagtccgctctgctgccttccacatactcagtattctcatcagcacaaacacacactcacataaatggcacatacacataacccatgaaacactccccatgttcagacaacacacacgcatgaaaagccaatttatatacttcgcacatacatgagcacacaaatgaacgtctagtcactcattttctcagctgcacccagaacagggctgggctcatctagggcaaggagatctccgtggttccaactggccagcccagatatacccctcactgctgcacccccttacctggcctctaggaggcttccctccaggaagccaggttcaatgcaggaagtgtactgcagttgacaaagtcccggggatatgagttggacatgaagatgttgttcttagacacggtggtgatgcctgtgttgtcgcagatgatccggggcaatgagatctgggccagggcctgtcgctgctgcatgctgaacacaccctcgttctcccaccaaaacctgcatggggaacacccatggacactgtgcccaaggatattctgggctggcagggcatcgatgggcttgtgctgctcccaggatataacaa

SEQ ID NO: 139153 - DNA, 601 bp, Human; identical to SEQ ID NO: 30864

SEQ ID NO: 139154 - DNA, 601 bp, Human; identical to SEQ ID NO: 30865

SEQ ID NO: 139155 - DNA, 601 bp, Human; identical to SEQ ID NO: 30866

SEQ ID NO: 139156 - DNA, 601 bp, Human; identical to SEQ ID NO: 30867

SEQ ID NO: 139157 - DNA, 601 bp, Human; identical to SEQ ID NO: 30868

SEQ ID NO: 139158 - DNA, 601 bp, Human; identical to SEQ ID NO: 30869

SEQ ID NO: 139159 - DNA, 601 bp, Human; identical to SEQ ID NO: 30870

SEQ ID NO: 139160 - DNA, 601 bp, Human; identical to SEQ ID NO: 30871

SEQ ID NO: 139161 - DNA, 601 bp, Human; identical to SEQ ID NO: 30872

SEQ ID NO: 139162 - DNA, 601 bp, Human
aacactttgggaggccagggcgggtggatcacttgaggtcaggagttcgagtggtctcaaaccaacatggtgaccaacatggtgaccaccatggcctgaccaacatggtgaaaccccatctctactaaatacaaaaaattagccaggcatggtggtgcatgcctgtagtctcagctacttgggaggctgaggcaggagaatcgcttgaacctgggagacagaggttgcagtaaaccgagattgcgccattgcactccagtctgggcaaaaagagtgaaactgtctcaaaaaaaaaaaaaaagtagcctagataccacccaaggagccattacattatgggagtaatgaaaaaactaaaaaatttatgctaggattgaccacccaccacccctggtttacaggtgtacagcttacagagaatgggactaagctgtcaaagtaatgaggttacagggccactctggaggcctccagcactgctgaaggagagtcagagtgaatggtcatttggctggaattggaaggcctgggttccagttctataacaagttctctgtgatcctgagcaggttacaacctctctgaaccttagttttctcat

SEQ ID NO: 139163 - DNA, 601 bp, Human
ttattcatcatcagaacccagagtctaggccaggcaaggtggctcatgcctgtaatcccaacactttgggaggccgaggtgggcagatcacctgaggtcaggagttcgagaccagcggtgaccaacatgaagaaaccccatctctattaaaaatacaaaattagccaggcatggtggcgcatgactgtaatcccacctgctagggaggctgaggcaggagaatcacttgaaccccacaggtggaggttgtggtgagccaagatcacgccattgcactccagcctgggcaacaggaacaaamctctgtctccaaaaaaaaaaaaaaaagaaaaaacccagagtctagatagcctctggctctatagctgtttgttgaatgagtgaatgaatgaatagcagcttagaatggagattaatacctatccaagatactttattcaataagttgagccatgcaaaattgccaatacttgaccattttaactaataaaacagcaatttaatatggttcaatttgatacatacgaatttacagagaaggacaatgggctgtgtgttgggtctgaactgggagacagagagtatctacgttggaattcca

SEQ ID NO: 139164 - DNA, 601 bp, Human
aaaaaattagccaggcatggtggcacgtgactgtagtcccagctactcgggaggctgaggcaggagaatcgcttgaacctgggaggcagagtttgcagtgagcagagatcgtgccactgtactccggcctgggcaacagagtgagaccctatctcaaaataaataaaataaaataaaaaataaaaaagaggataactcttaagcggagaattctaaaacagtaacaaaacccagtaaaagttggcctgctttttatcaccatgggccagctattctaaataatatcagtaataacatccgycttccaatgaggcagacctctcccaccccacccgcatcttgacatctctgggcctcaggaagtttatatcactgggcttgagcttcacactctgtaaattgacagggctaatccatgtctaagggatcttccaactctaaaattctaaaattcaagaggcagccagctctctgagtgtgaacttgttcaaattcattaattcattcatcccctcattccttcactgactatttactgagttccttctatgtactggtcaccatgctaggtgctgggacacaggaggagtcagatgttggc

SEQ ID NO: 139165 - DNA, 601 bp, Human
cagcctgtagtcccacctactcaggggtctgaggcgggaggatcgcttgagtccagaagattgaggctgcagtgagccatgacagtgccacttcactccagcaaaaataaatgccaatgcttttccaaatgttctaagtgaggactgaagcctcactaagattcagtattgtacaatgaaagaacaacagaccaggagtcaggagacctgcccctaaccaacttggcccttggttgtagcacagcaagttgagaggtggcagggagagctatcttccctgtataggcaataaaagggtgayatggccaggcacggtggctcatgcctgtaatcctagcactttgggaggctgaggcaggtggatcacctatggtcaggagttcaagaccagctgggccaacatggtgaaaacctgtctctactaaaaatacaaaaaattagccaggcatggtggcacgtgactgtagtcccagctactcgggaggctgaggcaggagaatcgcttgaacctgggaggcagagtttgcagtgagcagagatcgtgccactgtactccggcctgggcaacagagtgagaccctatctcaaaataaataaaata

SEQ ID NO: 139166 - DNA, 601 bp, Human
gctcaagcgattaacctgccttggcctcccaaagtgctggaataaaccactgcacctggctgtgtcttctctttatataaaaacaaatgacagctgggcatggtggctcttgcctgtaatcccacacttttggaggccaaggcgggtggattgcttgagctcaagagtttgagagcagcctgggcaacatagtgaaaccccatctctatggaaaaaaaaaaaaagataaagaaataaataccagccgggcgtgctgagaccccatctctacaattcacaaaattagccaggtgtgctgatrcagcctgtagtcccacctactcaggggtctgaggcgggaggatcgcttgagtccagaagattgaggctgcagtgagccatgacagtgccacttcactccagcaaaaataaatgccaatgcttttccaaatgttctaagtgaggactgaagcctcactaagattcagtattgtacaatgaaagaacaacagaccaggagtcaggagacctgcccctaaccaacttggcccttggttgtagcacagcaagttgagaggtggcagggagagctatcttccctgtataggcaataaaagggtga

SEQ ID NO: 139167 - DNA, 601 bp, Human
tatttccccacccagtgaatctgggctggcctcgtgaatttcttcgatcaacagaaagcagcgaaagtgatacaatcctagggtcaggactaacttttaagaggtctggtggttttagctttcacttgcaaagtcagctgctatgctgtagagaagcttgggtgagactatttattgaatgacaagtcaagtgcaaagagaggccacctggaggagctcaaggtaccagacatgtaagtagaggcttcttggaccttcttgcccagtccaacctccagctgactgcaaacaagtgagtgaygctagccaatggccatgtggaacagaagatccactcaggtgaacctgtcaaattcctgacccacagaattgtgagaaataataaactattgttattttaagccattaggttttgggctttgttgttgttgctacgcagcaatagataacaaaatataatatataaaagttatttcaggccgggcgcggtcgctcacacctgtaatcccaacactttgggaggccaaggtgggcggatcacaaggtcaggagtttgagaccagcctggccaatatggtaaaaccccctctctactaaaaat

SEQ ID NO: 139168 - DNA, 601 bp, Human
aatacttaggaaacagcaaaagtaaaacaaatgaaagtctgtgctctttattcaagagactattagctctacttatcccaattttaacataattttaacaaacttagttaattatatttcctagcctacagcaaattaaggcaacaaatatggagtttgagatgggagcaagatgtgtaaaagtgagaaggaggcacaaaaaattactacatgctccctgaagtataagatccagaggcctttgtatgggcaaacactccttagcagaagcttaagacagccctatatcatgatgcttcascataacaggtgttcagaaaaataccactgtcaccaagaaaaggttagaatatgtttagaatataatcaaaatagatatttagaatatcatgaagtttgtaacgttttcattcaatataattaaaattttaagaactaagaaattaaagaaataaacttcaattgtctgaaaaatgcatttagatggagatggctttttccctgatgctagaaaaagagggtgatgtttttaaggaaaaaataaatatggtatcattgttttatatcctatgtactagtagattgtttccagcagtggccg

SEQ ID NO: 139169 - DNA, 601 bp, Human
ctgacactaagagaatcttgtacttatccataaagtaagaccttgtacttatccataaaataagaatgataatacctaccactggggatgctatgaaaataaaacagaatacaataaaggttacaatacttaggaaacagcaaaagtaaaacaaatgaaagtctgtgctctttattcaagagactattagctctacttatcccaattttaacataattttaacaaacttagttaattatatttcctagcctacagcaaattaaggcaacaaatatggagtttgagatgggagcaagatgtrtaaaagtgagaaggaggcacaaaaaattactacatgctccctgaagtataagatccagaggcctttgtatgggcaaacactccttagcagaagcttaagacagccctatatcatgatgcttcaccataacaggtgttcagaaaaataccactgtcaccaagaaaaggttagaatatgtttagaatataatcaaaatagatatttagaatatcatgaagtttgtaacgttttcattcaatataattaaaattttaagaactaagaaattaaagaaataaacttcaattgtctgaaaaatgc

SEQ ID NO: 139170 - DNA, 601 bp, Human
aaagtcaattcatttcattcgtctggctggaaatcacacaccccagggtcatagtgatgttgttcaactctctctggagtcagtgacacttactttaaacaaccctggtttccaattagtttagtttctggagcactggtaaatggaatacctggtgtttgtttttataagaaaaactatctgggcagttgcggaaaggcaagatgctttgcttctaacaactgatgagttctgtctgattaacctgccagccacttgggctttgatgtctcctcaagttcccatgacactgctcttcctwctcactcagtgggagaacctgccaatctgcattactcttcttcatcactcacagtccttttgtcactagacataagaagatcactgagtggcctcagagacacacagaagtctaaaggcatagtgacattaagaacaacaaaatgttgacccacctactggtattttggatcctgcttgtttccaaactgtccttggctccttgagtgcactgaaattgttcatctgtgttctgttttccagggtcacaaagagtcggcagcttaaaaagcaataaacatgtttcagggctttgatgaga

SEQ ID NO: 139171 - DNA, 601 bp, Human
tactcaggaggctgagacaggaggatcgcttgaacccaggaggtggagtttgcagtgagtcgagatcacgccactgcactctatctagcctgggcaacaagagtgaaactccatctcaaaaaaaaaaaagaaagaaaaaaaaattattgcccttttagtaattcccttacttataatacctaactaaatttaaaccaaaaaaaattttaatcaattttttaaaaattgaaaaaaaattcccacacaccaaataaatttgttttacttaagttcgttctttatttatttaatttttttttttgagtcagaatctcactctgttgccaaggctggagtgcagtggtgccatctcagctcactgcaacttctgcctcctgggttcgagtgattctttttttttttttttgagacggagtcttgctctatcgcccaggctggactgcagtggcgcgatctcctctcactgcaagctctgcttcctgggttcacgccattttcctgcctcagcctcccgagtagctgggactataggcgcccgccaccacgcccggctaattttttgtatttttagtagagacggggtgtcaccatgttagccagg

SEQ ID NO: 139172 - DNA, 601 bp, Human
aaaattcaacaataggtgaaatccaactatttttgttgttgttgttgttgttgttgttgttgtttgagacagggtcttattctgtcgcccaaactggaatgcagtggcataatcatggcactgcagccttgacctccccaggatcaggtgatcctcccacctcagcctcccaagtaggagagggtgtgggtctacagccgcacaccaccatgcctggctaattttttgtagagatggtgttttgccatgtttcccagggtagtctccaattcctgggctcaagtgatctgcctgtcttggyttccgaaagtgctgggattacaggtgggagccaccttgcccagcccaacaatttcaaaataagtttacagggttttttttttttaataacatagagtaatgtttacattctaatgtaaagtgaaaatcatgacataaaattgcttacacatatcgtaattgtcactttttttttaagcacacaaaaagactagaggaacaggtggaaaaatgtcaaacttttttttggtctgttctttgtacttctgagggaagagggtgccgagcaggggaggccacaacaactatgggtttttctttg

SEQ ID NO: 139173 - DNA, 601 bp, Human
gagaaaactgatacaaagaataatgcccacaggatatgagagtgacactgcatactctccacttttataatgttatatagtaaatatctatgtagcagttcctcaaataatgtcattttattcaacattgtttcattgtaactctgatgagaaaaaaaaaaaacaatcaattcccagctggggccactgtctgtgtggcacttgcatgttctccccgcatctgcatgggttttttccaggtagtccggtttcctcccacatcctaaatatgtgcacgttaggtgaactagtgtgttgaagktgccccagtctgtgtgagtgggagtgtgtgagtacactctgcaatggaatggtgtctgtctagggctggttccctccttgtaccctgagttgccaggataggttccagccacctgtgaccctgaactagaataaacaggtaattacttatcttacttgtttttattaatctctcttaaatgtgtacatagctcacatttatttcaatgtttaatattagaagtgtcttggtctttatttagaagtatggtgatgtatttgtgaccagaaatatgctataggaacttaactcttgcttaca

SEQ ID NO: 139174 - DNA, 601 bp, Human
tgtataaatgcagtaaccacaattttgggagaaactgcacatgacttcccatcctcaaaaataaaaaaattttcagatgtttttcaaaacacgtatgaatgcatgggttcatatcacactcctgacaccaaaaaaggtataaaaaatcctggtagacattacatactttgatatgtaagctatttttctcaataaaagaaataaggcaatggagaaaggtgaaaaggtactttaccctgaactgcgttttttacctctagagctaagttttcttgagcagtcgaggagtaaaaatattcaycgtctggagttaaaaattcatctgttatatcctcagaagactctggtgaacaagttgattgcatggactgatgctattaataatgtaggaaatcacttttaagttgctgttcattgtaacgaaatccctttatagttggatgcagtgttaacaacggggttatctaacactacccagcagtcagtgtgacactgagctgactctccctacctctttgtgcatgtgcctctgccttcccttcctggtggggaaaagcagctgttaactgactggaatagcatgaaggaatgctaatcctga

SEQ ID NO: 139175 - DNA, 601 bp, Human
atactctgtacaggaggttcttgtaaaagctaggcagattcccaagaaaacttggtatattggacagtctcatatttgttgctgaacccttgcctcaatcctggctctcccatcactaaaacttggcaggctggagttaattaattccgtatatctgcagaacaccagtcttcctcagagagaggaatgatagccttgtcctttcccattaggaagtatgaattaagtagcatgaataaaaacattttgagccggcatggtggctcacgcctgtaatcccagcattttgggaggccgaggygggcggatcacgagttcaggagtttgagaccagcccgaccaacatggtgaaaccccatctctactaaaaatacaaaaattagctgggtgtgatggcacacgcctgtaattccagctactcaggaggctgaggcaggagaatcgcttgaacccgggaggcagaggatgcggtgagccgagatcacaccactgcactccagcctgggtgacagagcgagactctatctcaaaaattaaaaaaaaaaaaaagttttgaaaaaaaagtacaaagtgctgtataaatgcagtaaccacaattttg

SEQ ID NO: 139176 - DNA, 601 bp, Human
tcagcctcccgagtagctgggaatacaggcacctgccactgcgcccggttaatttttgtatttttagtagagacgaggtttcaccatcttggccaggctggtcttgaacttctgacctcacgatccacccacctcggcctccccaagtgctgggattacaggcgtgagctaccgcgcctggcctgaaattacatctttgatgcatcctagaattcttatcagtcaaatactgtgattgacacaatcctccctttcatataggtaaaagatcccaaaaaggtgccaggttagcagggaggtrgggtggaaaataagtaaataagagaattcatcaaaattcattttacaaatgaaaatactctgtacaggaggttcttgtaaaagctaggcagattcccaagaaaacttggtatattggacagtctcatatttgttgctgaacccttgcctcaatcctggctctcccatcactaaaacttggcaggctggagttaattaattccgtatatctgcagaacaccagtcttcctcagagagaggaatgatagccttgtcctttcccattaggaagtatgaattaagtagcatgaataaaaacatt

SEQ ID NO: 139177 - DNA, 601 bp, Human
taattgggtttggattgagtgctgtagaagaggtttttgctctgaaagtttattttccttgctcagagcacagaactatattctgacactcagaatacaatcaagctatttactggcctttcagttataaccacagttatttctgaagacaaatgttgttttgtctttttaagaaggcaaactgacccggttcctgtcaacagacgccagggggcgttgaaaacaagaactgtttgttaactaaacagccccgaactctaactatgccacttggccatcaaacactaggtgtgggcgtgggcgtgggcgtggggtcttgagtactgaggagctaattcaactgtcttctgttcttcttggcatcaagttatctgaagttactcctccccagttctcagtaagatgctttgctccaggcaggcagggccagtatccattttccttcccaccactgtactgtcctagttaataaagaagggggcagatggagcatccagccctgtttccaaatgcctatgactcccccacccccatcccattccttaggtccaggtggtctggtagacactaagaaggcccatcagaacaatgccacctttca

SEQ ID NO: 139178 - DNA, 601 bp, Human
aggtgatgactcaatccctcaaattctactgcacaagtcctaacacagctaagctgcccaaagctaacttttataagatagtagctaatacatctgaagacaagcaatatataaacacggagcattatcaccatttaacattgcatctatgagtttgaaactgcataagataataatagcccataccttcgtacaggttgaaattgagacctgggcaaaatctcagcattctttccaagaatttttctcatttggaacttttcctcacctgaaagaataaagttaaaaatatatatatatwtttttttttactgaatctttgtcaacccaaattattgtcaccattccctagaatgtcccttggtctggtccagaattagaaataatctggataaacaaagtgctgccctaattgggtttggattgagtgctgtagaagaggtttttgctctgaaagtttattttccttgctcagagcacagaactatattctgacactcagaatacaatcaagctatttactggcctttcagttataaccacagttatttctgaagacaaatgttgttttgtctttttaagaaggcaaactgacccggtt

SEQ ID NO: 139179 - DNA, 601 bp, Human
gtggtaacatcttgcaaatctataggacagtatcacaaccaggatattgacattgatacagtcaagatacagaacatttctactaccacaaagatatttctggtttacagctatgcctgcttccctcctttccccaccccttccttaacccctggcaaccactcatctgttctttatttttataattttgtcatttcaagaatgttatattaatggaatcacacagtaaataactttttgggattgcttttcctactcagcataattctctggaaatttagccaagttgttgcatgtatcmatagtttatttctttttactgctgagtagcaagcactcaatggtatggatgtaccaaagtctgtttaatcatttacttggtgaaggacatccgggtttccagtttggaggtattatggataaatttgttataaacgttcctgtatgtatttctgtgtaaatgtaaattttcatctctctgggataaatgcccaggagttatattattactttaagttcctattgtcaacattctcagtaaggattcttatccctgcttcacagatgggaaaatagaatagaggggttgagaaccttgaca

SEQ ID NO: 139180 - DNA, 601 bp, Human
tggacatgaagcaggagcaaagaagaaacttgttgttttaaaccactaaaatttgggagttgtttactatatatagcataatctagtctatcctgactgactagctgagtgaccttagaaaaaaatatttaaactctctgaactttgctttctttactggcaaatggaggcaatggtatgtgcctcacagggttgttatgtggattaaatcagacaatgaaacagagtgcctggcatatgctagatatttaggaaatactagctacaataattataattaaggaaactgaggcccagagasaataaaataaattgaatgttattgtgccagatacgttataacaattatgaattttttaaacttttcttttgagataattgtagattcacatgcaattgtaagaaatacactttactggctgaatgcggtggctcacgcctgtaatcccagcactttgggaggccgaggcaggtggatcacctgaggtcaagagttcgagatcaacctggccaacatggtgaaaccccatctctactaaaaatacaaaattagccaggtgtggtggcacatgcctataattccgctacttgggaggctggg

SEQ ID NO: 139181 - DNA, 601 bp, Human
ataaaaaataatagtctctaaacttggcctctaaactttaccaaaataaaataaacggtgattttttaaaccacaaatatattggaagtaaggccactaaagagaggatatttgatgctggttgcatatggttgcaggacttaagaactatataaagtttaagcacaaggtactgttttaagttgcaaactctacaaagctcaatgtttttgtactaaattcagtagtgcttagaggagatgtagcatttgcatggctttaccactgcagttctaaccaaaacctcctaacggctgcccartaatcaccaccaccatcaccccgccccctggcctacaatgggattacccagttttggccctaaagaaaaacctttgcactatgacaacacagccaccagctctgataccacggcttggcttcccagagacaatgggctggggctgtaagtccttctccccaaacacttctcttccctgtgattacctgggctgagtggagtgctgacactggtaggtgcatggtttattttgggtgttttgcatgaagcttccttaaaagagctgtctggttcataggagatactagacaggtcttgaat

SEQ ID NO: 139182 - DNA, 601 bp, Human
tcctttttttttttttttttttttttttgagatggagtcttactctgttgcccaggctggagtgcagtggcacaatctcagctcactgcaaccttcacctcccgggttcatgcaattctcctgcctcagcctcccaagtagctgggattacaggtgtgtaccaccacgcccagccaaatttttttctgtatttttagtagagacggggtttcatcatgttggccaggctggtctcaaactcctgatctcaaatgatccacccacttcagcttcccaaagtggtgggattacaggcataagycactgcatctggcctgggaagccttatccctgactgcctcctcagcactcagtacttaccgctgtgttacatcaggcctgtctttctcactagacagtgagctcctttgaggcagggatcatgtctttcttattcacacttggatgccttgaagagggcctgacatggtgcttggcacttagaatctgcccaattaacggttaaatgaacacataaaattccttgtcatctccctacttcaaagtgagaccttttttgagccaaataccaaaaaagttgacaatcaatttttcataaagg

SEQ ID NO: 139183 - DNA, 601 bp, Human
gaaactgtcttctaagaatctatcctaaggaaaggatcagaggtacagataaaaatttatgtataaagagcaaaaattggaaaatgatataaatcttaaacataagaaaatggttaagcaacatgtagaatggactataactactacatatatttatgaacaatttttaataacaagggaaaagcctcaaaatataacaagggaataaagcagtccagaactgatacacaatatgatctcactatgctaaaacatattattatatatttataaaaatatttaaaagatatgcaaaaaaaaagtacatgaggttaaaaaagtgtatagtcaccttctttgttaagcttttatttattctccaagtttcctacaatgagtgtgttttacttttataatcatggggaaaacagcatttctgtctgaacctaatgtggcatcaaagattgataagcatcaatttaagcctccttgattataaacttctattttgatattaaacacagggtacctttaggcaggctccttctctgggtggcatggggtggtgatgagtcacatgccttaacaaggctgggggatccagccccaataaatgaagaca

SEQ ID NO: 139184 - DNA, 601 bp, Human
gcctgaccaacatggtgaaccccatctctactaaaaatacaaaaaattagccaggcatggtggctcatgcctgtaatcccagctactcgggaggctgaggcaggagaattgcttgaaccctggaggtgaaggttgcagtgagctgagatcactccattgcactctagcctgggcaacaagagtgaaaccctgtcaaaggaaaggaaaaaggaaaggaaaggaaaaaggcaaggcaaggaatactcactagactaagacaagcatctgctaactcagtatgctgctttatcctcaaagtgcyctgcaaagcaaagcaagttgggaggcagcatagacaagccaccctgagctcgttggcatggtcctcttctgtgctggtgcaggtcttctcccttcctgcagtgcaggaagcagtcctacctggcagccatgggtgtcaagggtccccataagatcatttaatataatttgaaatttaaaaaatccattttcgtccttgttaaaagtagtcctgcgcagatcttaaatgatcatctgtatcctagttctaaagaaccttccactttaggcacctgtcaggagcctagagctttggatgtga

SEQ ID NO: 139185 - DNA, 601 bp, Human
cctataaagggaagaggactaacatttgctaagtatttgaaaatgttagtacttgtacatggctctgtacatggagctaatatgtacttcatgagacagaaattattgtccccattttacagattaagacgactgaggctcagaaacagtaaaacagcttgccatacaaataactataaagtcagacttgaggtggagttgtgcctgacctcaaggtcacacttccctatatgtaccactgtgttgccaaggacagcgttaaaagaacctgatgaaaacaatctaggtagttcacttaccrtttgcagtgcctcctccatcacttgctgtgttctcatgcaacaccgtggatgagccctgctgctgtttcaagagctctgtcacaacacaaaagccaaaggaaacttatttcctcccttgcgtgtcctgccgttctctagagcagtggttctccaagggtgatccttagacttgcagcattaacataacccgggaactcgttaggaatgcaaattctcaggcctcatctcagacctgctgaatcagaaactctgggggtctagcaatgtgtgttttacttagcccttcaggtgattctgat

SEQ ID NO: 139186 - DNA, 601 bp, Human
ccttataggcggcagagccatcttatccctctttgtggtacctctagcccctagcacagtgctttggacattgtccgtgctcggtggatgctggttgaaccaaaataacattgtttagggattcttctgttttcatttggtggatagtcaaaacaaaatacgtaaaatgagagagaaaataaagccagctagagtgaagagagattttttcccctcttaatattttcccactaatagaatcacaggttcaagagttggaggaggcctttgggttatattccgcccccgttcaaatgcccargacagggaatcatccagccactgcctgagcagcagtaaccattactaaaataagtgtaaaggcaggcagctatttccctttatcagatagctgtggctattaggtttgtgctttattgaataaaaatctgttactctgcaatttctagtcactaattagtcttctagggcagacaagtaagctgactctcttcactttgcaatatttcaggtatttgagggcagctatcaaattctccattccatctgcctttctcaggctgagcctctcagctccttcagctgttctcatatgacatgg

SEQ ID NO: 139187 - DNA, 601 bp, Human
tgctttcaaccactatgctatactgctccaaaggaaaaaaaaggcattttacttaagttttgattggtgtccctttcaaaaccatcatttattttatcatcttatcttcatttcccgaaactctctcctaagtgaaatatgtaaataatttaagtacctcaaaatttaagaccatgtttgtcaatctattaagcagaaaccatccccccgacccaagtggaaactccttataggcggcagagccatcttatccctctttgtggtacctctagcccctagcacagtgctttggacattgtcmgtgctcggtggatgctggttgaaccaaaataacattgtttagggattcttctgttttcatttggtggatagtcaaaacaaaatacgtaaaatgagagagaaaataaagccagctagagtgaagagagattttttcccctcttaatattttcccactaatagaatcacaggttcaagagttggaggaggcctttgggttatattccgcccccgttcaaatgcccaggacagggaatcatccagccactgcctgagcagcagtaaccattactaaaataagtgtaaaggcaggcagctattt

SEQ ID NO: 139188 - DNA, 601 bp, Human
aaccgaggcacagagaagttaaattacacacctaataattcctagagctagactctgaccttagactcagtctgccttagactctgctttcaaccactatgctatactgctccaaaggaaaaaaaaggcattttacttaagttttgattggtgtccctttcaaaaccatcatttattttatcatcttatcttcatttcccgaaactctctcctaagtgaaatatgtaaataatttaagtacctcaaaatttaagaccatgtttgtcaatctattaagcagaaaccatccccccgacccaastggaaactccttataggcggcagagccatcttatccctctttgtggtacctctagcccctagcacagtgctttggacattgtccgtgctcggtggatgctggttgaaccaaaataacattgtttagggattcttctgttttcatttggtggatagtcaaaacaaaatacgtaaaatgagagagaaaataaagccagctagagtgaagagagattttttcccctcttaatattttcccactaatagaatcacaggttcaagagttggaggaggcctttgggttatattccgcccccgttca

SEQ ID NO: 139189 - DNA, 601 bp, Human
agctagcactaacaagagtgttctctatgcaccaggcattggtttaagtgctataatttaactcatttaattcccataactatataaggtagttaccactgccatccccattaagcaatgaggaaaccgaggcacagagaagttaaattacacacctaataattcctagagctagactctgaccttagactcagtctgccttagactctgctttcaaccactatgctatactgctccaaaggaaaaaaaaggcattttacttaagttttgattggtgtccctttcaaaaccatcatttatyttatcatcttatcttcatttcccgaaactctctcctaagtgaaatatgtaaataatttaagtacctcaaaatttaagaccatgtttgtcaatctattaagcagaaaccatccccccgacccaagtggaaactccttataggcggcagagccatcttatccctctttgtggtacctctagcccctagcacagtgctttggacattgtccgtgctcggtggatgctggttgaaccaaaataacattgtttagggattcttctgttttcatttggtggatagtcaaaacaaaatacgtaaaat

SEQ ID NO: 139190 - DNA, 601 bp, Human
tatagcatctgggaaacatttctaaataactttgaagcacatcaaagcccaaggactacagactacattataaacatacattaattcataccttcttcagaagtccctagaacaccctctgatttccttctctctggtgtaatgctatcttccctttttcttttctcttcaccaactttttgatccttgatatttgtctccctgtaacaacaattatttggggaatcaaaacgtatacacaacagccaagaaaacaggactgtactcaaaacaaaaaacaaacaacaacaacaacaacaacaaaaccatataatagctagcactaacaagagtgttctctatgcaccaggcattggtttaagtgctataatttaactcatttaattcccataactatataaggtagttaccactgccatccccattaagcaatgaggaaaccgaggcacagagaagttaaattacacacctaataattcctagagctagactctgaccttagactcagtctgccttagactctgctttcaaccactatgctatactgctccaaaggaaaaaaaaggcattttacttaagttttgattggtgtccctttcaa

SEQ ID NO: 139191 - DNA, 601 bp, Human
taaattggagtctttgtcattaatgtgtatttagacactggtaaatgtttttaagtctgcttctgttgtctataaacatgacttttgatctacaaacatctgatatttcattacctggatgattcggaccaacctagtcgcttccaaaaacaggattttagttcatcttgatgaaatataagaggaaggaaaaaacaacatgattaatttctaggtcaaagggtgccagtattcatattagtgctccctctaatttagagtagactgttttacctacaatggttgttatattctgccagayagactctttctaaaaacacaattaatgggcttcccctcctaacattctatagttttctgccacagcaatgggcgctaatgacactaattcacaaagtccctgtattatcttctcagtgaaatcaatactattaatagctaaatgcctacacgttctgggccctgtgcagtcagggttctggaggaaacagaatgtacccacggctggttcaaataaagatccttagtgaagtgactacatacagaggtttatttagagttaagggaacaaacaaggaatgtcaaggcatccagtgattag

SEQ ID NO: 139192 - DNA, 601 bp, Human
ggaatggcagcagaaaatgtcctgaccccctcacctccactcagagcccacctgctcccgcccatctcttagaaactgcaggagcagccacggccgggccgccggggatcctcgcggactaagggctgggtcagagccgcgcaaacatgggctcgctcgtagtcctggcgagcagcactcccaggcaagtcgcccgagggccttgcagggcacccagaaaatgtcactgccggcgaagtgaccccgagccgggccacgggacccctcacacctcaccctttctcctgccgaccctcgagaygacagcggactggaaggcattacctgagcagcagcccgctgggccgtccgaggccggtggttccgaagggtggccacggccactagcctgccgtagaacatggaggccgccatttctgagtcggaccccgtcccctcggcgccgcgcgcaggcgcacaggcgacaggcggcccaaggcgcagcctctctgcagcgctcacctacgccccgcctcgcgccacccgttgggggcggggcctcgggttaacactgcagccgctagaccagctccctggcgggcgcggagcaagctttcacctt

SEQ ID NO: 139193 - DNA, 601 bp, Human
aactctagagctgcatttcttaataccagggtagaagacagcaactgttataaagaaaataatattggaaatttccataaggagaaatgaaggcttttaaatgaacttccaaaaagataaagattttgactagaatgaaaacgtatttgtcactaaattccccattttctaaaaactaaatagcactcttctaagattcataagaaggaagttcaaggtcaaaaagtcacttctatcgggaagcaaactcacagaactcactacccctaggctgaaagtatgaacaacttcaataaaaataaaaaaaaaaaaaaaaggtaggggcgggagggccctaaatcaattcatactatgacatgtatgaagagttacttcagaaaaaaacccaaaactctggaattgacttaggacaccaataatgcccttccacagttttttgttgtcaaagttggaaggaagatgtttgttttcgaagttgtggagccaactcaagtacacggctttagaaccagacacctctgggattaaatctcagctttgatcttacctcctatatgacctagtccaaattacttgttctcttaaccataatatgttcaac

SEQ ID NO: 139194 - DNA, 601 bp, Human
atgatcactgcggttatttggaagaatgtccttattcttaaagacatatgctgaaatatctattttcaacgaaggtacactaggctaaagataccaagaaattggaggagggtcagagaacttaaacaaatgtttaaaacaggccgggtgcggtggctcaagcttgtaatcccagcactttaggaggccgcggcgggaggatcacgaggtcaggagatcgagaccgtcctggctaacacggtgaaaccccgtctttactaaaaatacaaaaaattagccggacgtggtggcaggcgcctgyagtcccagctactagggaggctgaggcaggagaatggcatgaacccgggaggcggagcttgcagtgagccaagatcgcgccactgcactccagcctgggcgacagagcaagactccgtctcaaggaaaaaaaaaaaaaaatgtggaaaacaaattgctaaattaaatgtgtgaccttgaacgagtttcttaagactccgtacttctatgtcctcatctacaaaagcaaagggttggactaaggtccttccaaactctagagctgcatttcttaataccagggtagaagacagcaactgtt

SEQ ID NO: 139195 - DNA, 601 bp, Human
gtagtgagagattcctttgctgttgctgctgtacttggagtccatggttattaaacaatccagaacttcccagaacctagaaagattggggacatatttatatatgacagtgatttggcagtcactcttgttaactacttggttcttcataactataacaaaactgttacattacattagcaaagtacaatattcagagtacctgaattacagcataaaactaaaagctagcctatcagctaaatatcactgttaccactgtcattttaattatttcctcatcatctctattccttatttyagatttcagctttactatcatatctccaatgatctacagggcagttctacctcaatgccaaattcagcggatctaaaaccaatctcatcttttccaccaaaccaaaaatccttcccaattttcttctctctaccattcctccacacctaacaagtcacctggcactagatatgtaataataaaatgatttgataccattactctttcatacactcgatattcaaaaccatggcttcatctgtagtggatgttgcagtatgctgcccagatctccctggcactccccattcaggaccaagg

SEQ ID NO: 139196 - DNA, 601 bp, Human
aacaaacttcaaatcttctcagagctctcatgtcaaggtggcaaaagcttttcttaatttagtacctaattttttggcaattgcataagcttcatctggtgactttgccacatatcctttgggaacggagacaccagcttcttgcaataattccatactcatgtattcatgtagtgagagattcctttgctgttgctgctgtacttggagtccatggttattaaacaatccagaacttcccagaacctagaaagattggggacatatttatatatgacagtgatttggcagtcactcttgytaactacttggttcttcataactataacaaaactgttacattacattagcaaagtacaatattcagagtacctgaattacagcataaaactaaaagctagcctatcagctaaatatcactgttaccactgtcattttaattatttcctcatcatctctattccttattttagatttcagctttactatcatatctccaatgatctacagggcagttctacctcaatgccaaattcagcggatctaaaaccaatctcatcttttccaccaaaccaaaaatccttcccaattttcttctctc

SEQ ID NO: 139197 - DNA, 601 bp, Human
gagaaaccctgtctctactaaaaatacaaaattagccggggtggtggcacatgcctgtaatcccagctactcaggaggctgaggcaggagaactgcttgaacccaggaggcagaggttgcttgaacccaggaggcggaggttgcggtgagctgagatggcgccattgcactccagcctgggcaacaagaacgaaactccgtctcaaaaaaaaaaaaaaagagtttttatgaaatgaaaattagcattttatgaattttgcagaaagtcaaaaagcaaaaatcaccctgaagtaatgaaaamtcagcattgggaattgctagctacatgaacaaaaccaagtgtatttctaaggtccctcattctacaccttgtgcaactagatcccataatcgttatcttttgttatcaatgactcactaaaaacacaaaattgggctgggtgcggtggctcacgcctgtaatcccagcactttgggaggcctaggcgggtggatcacaaggtcaggggttcgagaccagcctgaccaacatggtgaaaccccgtctctactaaaaatacaaaaattagctgggcatggtggcgggcacctgtaatcccag

SEQ ID NO: 139198 - DNA, 601 bp, Human
agatttctttctaaccattcctccattcctaacctcaattattcacagcaggtaaaacttgcctacaggacaatgcctctcaacttttttcacatcatcacacaaacagaaaatgatggacatggtaggaaatactgggtaaagaggctcagtggccccaaaccccatgctaactcaacttctcctgccaccacaggactgggaagaaacaatagtttggcacacctgtaaagcatttatgttctattatatcatttgttgagcaaagcgctgagttaagagtttttatgaaggccaggcrtggtggctcacgcctattgtaatcccagcactttgggagggtgaggcaggtggatcacctgaggtcgggagttcaagaccagcctgatcaacatggagaaaccctgtctctactaaaaatacaaaattagccggggtggtggcacatgcctgtaatcccagctactcaggaggctgaggcaggagaactgcttgaacccaggaggcagaggttgcttgaacccaggaggcggaggttgcggtgagctgagatggcgccattgcactccagcctgggcaacaagaacgaaactccgtctca

SEQ ID NO: 139199 - DNA, 601 bp, Human
aaccttcattttggggactcatatagtcttttaaaatattagaattagatttctttctaaccattcctccattcctaacctcaattattcacagcaggtaaaacttgcctacaggacaatgcctctcaacttttttcacatcatcacacaaacagaaaatgatggacatggtaggaaatactgggtaaagaggctcagtggccccaaaccccatgctaactcaacttctcctgccaccacaggactgggaagaaacaatagtttggcacacctgtaaagcatttatgttctattatatcayttgttgagcaaagcgctgagttaagagtttttatgaaggccaggcatggtggctcacgcctattgtaatcccagcactttgggagggtgaggcaggtggatcacctgaggtcgggagttcaagaccagcctgatcaacatggagaaaccctgtctctactaaaaatacaaaattagccggggtggtggcacatgcctgtaatcccagctactcaggaggctgaggcaggagaactgcttgaacccaggaggcagaggttgcttgaacccaggaggcggaggttgcggtgagctgagatgg

SEQ ID NO: 139200 - DNA, 601 bp, Human
agtcctattatatgccattagaaatctccctccaggctgacattcattaatcagcaccctttacatgtatctattcaaccagatagggattccaccttaaatatactagaagccaaactatctttctatagtcaatagggaaattataaaaattctgccaaatctgtgcccaggcgcagtggctcacgcctgtagtcccagcactttgggaagccaagggtgggtggaaggcttgagccccggagtttgagaccagcctgggcaacatggtgaaaccccatctcaagaaaaaatacaaaamttagccaggcatggtggagcacacctatagtcccagctactcagcaggctgagacgggagaagtggcttgagcccaggaggtcgaagctgcaatgagccatgatcacaccactgcactccagcctgggtgacagaacaagacactgtctcagaaacaaaacaacaaacattctgccaaacccttactaaaatcatatttccttgaactatgaactgttagagataatttgctctcagaactgaccccaaataatatctactacatttatctgtgctaataaccatccctttgataatcta

SEQ ID NO: 139201 - DNA, 601 bp, Human
ttgaaaaaaaggaacatttaaaaatatgaacagaattcttataaatctagatttcttcactgctcttacgaaaactcccaatgggaaaaactgggtgcacagtactacaactagagctgattagaaaaagtatcttgtttagataagacaaacccttttcaattaccctgtctctactattcacaaatgtatcacaactaatattaggtaacaaatagaaacaactcagaaatttccttaaaaccaacaataacgttcttattgagaatactacaggttgtctctgaaccatggcaaattggagtttgtgcccaaacggaagggagcagccactatttattccacttgtttctgtttacctgtccagtcctgattttccagcactttaaatatttgtttatatccgaagaagagaactacaaggcaaacagtgcaaatgtaatgtaaaaaatggtcatagttacactgtgctttactgagctaaattcaatcattcctattcattaaactgggaacttaacacattgacctattaagagtaacgaagctctattttttcaaaaacacttggcaagacagaaggttcttctcttccccgcaa

SEQ ID NO: 139202 - DNA, 601 bp, Human
aaacatggatttgaacagactgaagtagagtcctctacaactaggatgtcactccacgatgcatttatcaagcagaatgagaggaagctcccacctaatcagatgaaccaaccaaatcaatgaggtaggaaatggagtttgaaaccaaacaaaaacaacctaaagtttacacattaacaattattttaaaagaacatttagaaaattactgatgtaagccttcaccagaaatacatgctatttaaaccagatgatgaccctatgcgtagtcagccaagagagtgtttaaaaaacttgtctytctcaaaccccacttccattcagccaggaaatcatactggttctatcttcaaatttatccagaatcttcaccattcctcatcacctgcagtttagactctgatcccaaccaccactatctcttaactatatgacctttgtcccccacagaatattctcaaggcagcagccaaagcaggcacaccattcctctacttaaaaccttgcactgaatgccagtctcactcagttaaatgccaaagtgcttacaatggcctagaagaccttataataccctctacactttttatctcctaggccc

SEQ ID NO: 139203 - DNA, 601 bp, Human
agtattctctcctgggatattttcgctcacagaccaatacttgattgcatattctgcccttttctcccgtttgcttggtaaacaattttttcccaatcatttgtgaagaaacagcttttgcttcttctggactaaaataagaaaaagaactcaaatttttctttcctccagttgagaaaaagcaaatccacataatagccaaaattttatctcatctaatatttaaatttcagtattttcatcaattcaataagtaatctttaatcagtctttaacaaggatgatttttccttaaaaaatrtgacttacgagaaaactatcttcactcctcctttgaggccactttcaaatgttccttttcctctaccaccagctaaaacctgtgcctttatcacgacatcttttgaacctagaagaaaaacacttctattaaatatgaagcatggagcagcatgccagacatagtattttgttatttaacatacatattgacaggtgttattaaatcaagtctaatttattcacaatgtccaaaaatgaggcattctctttatgtagattttctagattagaacactaaaataatcactgtctaaaaggc

SEQ ID NO: 139204 - DNA, 601 bp, Human
agtgaaaataagtgaatgtgtaaaaatataatttatgtaaattttgggtaatatatgaggttactgtcatgggatttttaaaataacttacaaactaaattctatcacatagaatatcacttaagaataaaacaatgcttcttaattttatattctgagtggatttttactaccatctagtgttatatctttagaaatacttccttataaaaattaaaagttgcaaaagacatatcattcaaacattaatagatttaattgtaaataagaaaaatcacaatacagaaagttgctatttttwaaaaagttgttctacataagaaaattattttcatgactcttaaaatttttgttactctaaattctacacaattaatgttctacatgaaatccgtactggggctttcaaatatatacccagttgcttcaaaaaacaagctagttaacacacagattcagcttgtaaaacctaataccctcgaaaaacagataattctagtataaaatgattatcaatgctctcttccaaacaccaggtctataaagggattttctcttcaccagaagctttatgttcaacattttaggttccataaagaga

SEQ ID NO: 139205 - DNA, 601 bp, Human
aagtaaaaacataactaacaaaatgacagatgccgatatataatgtcaatgaaaagaaaaataaaatgtagtgaaaataagtgaatgtgtaaaaatataatttatgtaaattttgggtaatatatgaggttactgtcatgggatttttaaaataacttacaaactaaattctatcacatagaatatcacttaagaataaaacaatgcttcttaattttatattctgagtggatttttactaccatctagtgttatatctttagaaatacttccttataaaaattaaaagttgcaaaagacrtatcattcaaacattaatagatttaattgtaaataagaaaaatcacaatacagaaagttgctattttttaaaaagttgttctacataagaaaattattttcatgactcttaaaatttttgttactctaaattctacacaattaatgttctacatgaaatccgtactggggctttcaaatatatacccagttgcttcaaaaaacaagctagttaacacacagattcagcttgtaaaacctaataccctcgaaaaacagataattctagtataaaatgattatcaatgctctcttccaaaca
